United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 218

SEQ ID NO: 9035666 - DNA, 22 bp, Homo sapiens
tatccttgtactatagtattta

SEQ ID NO: 9035667 - DNA, 22 bp, Homo sapiens
tatctaagagagtcaatattta

SEQ ID NO: 9035668 - DNA, 22 bp, Homo sapiens
tatctacaggtgtcaggtaaga

SEQ ID NO: 9035669 - DNA, 22 bp, Homo sapiens
tatctaaatggaatattccaga

SEQ ID NO: 9035670 - DNA, 22 bp, Homo sapiens
tatctaaatggaatattccaga

SEQ ID NO: 9035671 - DNA, 22 bp, Homo sapiens
tatctaaaggatttaatttagt

SEQ ID NO: 9035672 - DNA, 20 bp, Homo sapiens
tatctaaatgcttacattac

SEQ ID NO: 9035673 - DNA, 22 bp, Homo sapiens
tatctaaaggatttaatttagt

SEQ ID NO: 9035674 - DNA, 22 bp, Homo sapiens
tatctaaaggatttaatttagt

SEQ ID NO: 9035675 - DNA, 22 bp, Homo sapiens
tatctaaaggatttaatttagt

SEQ ID NO: 9035676 - DNA, 22 bp, Homo sapiens
tatctaaaggatttaatttagt

SEQ ID NO: 9035677 - DNA, 22 bp, Homo sapiens
tatctaaaggatttaatttagt

SEQ ID NO: 9035678 - DNA, 22 bp, Homo sapiens
tatctaaaggatttaatttagt

SEQ ID NO: 9035679 - DNA, 22 bp, Homo sapiens
tatccaaagtttctcagaaact

SEQ ID NO: 9035680 - DNA, 22 bp, Homo sapiens
tatccaattcaccattgatggg

SEQ ID NO: 9035681 - DNA, 22 bp, Homo sapiens
tatccaaagtggcatattatag

SEQ ID NO: 9035682 - DNA, 22 bp, Homo sapiens
tatccaaagtggcatattatag

SEQ ID NO: 9035683 - DNA, 22 bp, Homo sapiens
tatccaaagtggcatattatag

SEQ ID NO: 9035684 - DNA, 22 bp, Homo sapiens
tatccacactcaaggggagggg

SEQ ID NO: 9035685 - DNA, 22 bp, Homo sapiens
tatccacactgggatgttttga

SEQ ID NO: 9035686 - DNA, 22 bp, Homo sapiens
tatccattaggtctatggtcaa

SEQ ID NO: 9035687 - DNA, 22 bp, Homo sapiens
tatccatggccaatcaaataca

SEQ ID NO: 9035688 - DNA, 22 bp, Homo sapiens
tatccatgcctttgtgccttag

SEQ ID NO: 9035689 - DNA, 22 bp, Homo sapiens
tatccattatgttggctagtct

SEQ ID NO: 9035690 - DNA, 22 bp, Homo sapiens
tatccatttattttctaggcaa

SEQ ID NO: 9035691 - DNA, 22 bp, Homo sapiens
tatcccaggaggccacctgtca

SEQ ID NO: 9035692 - DNA, 22 bp, Homo sapiens
tatccataccactacttccctt

SEQ ID NO: 9035693 - DNA, 22 bp, Homo sapiens
tatccacactgggatgttttga

SEQ ID NO: 9035694 - DNA, 22 bp, Homo sapiens
tatccatagtttatagatcaag

SEQ ID NO: 9035695 - DNA, 22 bp, Homo sapiens
tatccatagtttatagatcaag

SEQ ID NO: 9035696 - DNA, 22 bp, Homo sapiens
tatccatattaagatgcctctg

SEQ ID NO: 9035697 - DNA, 22 bp, Homo sapiens
tatccatattcagactgtgaat

SEQ ID NO: 9035698 - DNA, 22 bp, Homo sapiens
tatccatattcagactgtgaat

SEQ ID NO: 9035699 - DNA, 22 bp, Homo sapiens
tatatcatggagattaacattc

SEQ ID NO: 9035700 - DNA, 22 bp, Homo sapiens
tatatcatggagattaacattc

SEQ ID NO: 9035701 - DNA, 22 bp, Homo sapiens
tatatccagaaaatcagttcat

SEQ ID NO: 9035702 - DNA, 22 bp, Homo sapiens
tatatccataggctgtgcctag

SEQ ID NO: 9035703 - DNA, 22 bp, Homo sapiens
tatatcatggagattaacattc

SEQ ID NO: 9035704 - DNA, 22 bp, Homo sapiens
tatatccagaaaatcagttcat

SEQ ID NO: 9035705 - DNA, 22 bp, Homo sapiens
tatatctaagtgtatgtaagag

SEQ ID NO: 9035706 - DNA, 22 bp, Homo sapiens
tatatctggatggactgcagaa

SEQ ID NO: 9035707 - DNA, 22 bp, Homo sapiens
tatatcttatatgtgcaggtac

SEQ ID NO: 9035708 - DNA, 22 bp, Homo sapiens
tatatgacagtatcattttaaa

SEQ ID NO: 9035709 - DNA, 22 bp, Homo sapiens
tatatcagcaaagcatttaaaa

SEQ ID NO: 9035710 - DNA, 22 bp, Homo sapiens
tatatcagagttaaaagaatgt

SEQ ID NO: 9035711 - DNA, 22 bp, Homo sapiens
tatatcaccaaaaacagttctg

SEQ ID NO: 9035712 - DNA, 19 bp, Homo sapiens
tatatattttggggttgtg

SEQ ID NO: 9035713 - DNA, 22 bp, Homo sapiens
tatatattcttaagtagtgtag

SEQ ID NO: 9035714 - DNA, 21 bp, Homo sapiens
tataggcttccatatgaaggg

SEQ ID NO: 9035715 - DNA, 21 bp, Homo sapiens
tataggcttccatatgaaggg

SEQ ID NO: 9035716 - DNA, 22 bp, Homo sapiens
tataggcttttgcctgaagcta

SEQ ID NO: 9035717 - DNA, 22 bp, Homo sapiens
tataggcttttgttgcagaaca

SEQ ID NO: 9035718 - DNA, 22 bp, Homo sapiens
tataggtacttggaaaataagg

SEQ ID NO: 9035719 - DNA, 22 bp, Homo sapiens
tataggactgatcacattttca

SEQ ID NO: 9035720 - DNA, 22 bp, Homo sapiens
tataggaccgacttgtttatag

SEQ ID NO: 9035721 - DNA, 22 bp, Homo sapiens
tataggcagatctgagaatatt

SEQ ID NO: 9035722 - DNA, 22 bp, Homo sapiens
tataggactgatcacattttca

SEQ ID NO: 9035723 - DNA, 22 bp, Homo sapiens
tataggctcttgttaacctttt

SEQ ID NO: 9035724 - DNA, 22 bp, Homo sapiens
tataggctgatggcttcctgag

SEQ ID NO: 9035725 - DNA, 22 bp, Homo sapiens
tataggtatgtcgagaaatgaa

SEQ ID NO: 9035726 - DNA, 22 bp, Homo sapiens
tatagtaaaattttcatttatg

SEQ ID NO: 9035727 - DNA, 22 bp, Homo sapiens
tataggtgaataaatgagttta

SEQ ID NO: 9035728 - DNA, 22 bp, Homo sapiens
tataggtagccatatttgatag

SEQ ID NO: 9035729 - DNA, 22 bp, Homo sapiens
tataggtatgtcgagaaatgaa

SEQ ID NO: 9035730 - DNA, 22 bp, Homo sapiens
tatagtaaaattttcatttatg

SEQ ID NO: 9035731 - DNA, 22 bp, Homo sapiens
tatagtaaaattttcatttatg

SEQ ID NO: 9035732 - DNA, 22 bp, Homo sapiens
tatagtaaaattttcatttatg

SEQ ID NO: 9035733 - DNA, 22 bp, Homo sapiens
tatagttagtttcataatcatg

SEQ ID NO: 9035734 - DNA, 21 bp, Homo sapiens
tatagtgtggatatgctgatg

SEQ ID NO: 9035735 - DNA, 22 bp, Homo sapiens
tatagtgtgtgagagagtgaaa

SEQ ID NO: 9035736 - DNA, 22 bp, Homo sapiens
tatatatatgcacacacaccta

SEQ ID NO: 9035737 - DNA, 22 bp, Homo sapiens
tatatatatgcacacacaccta

SEQ ID NO: 9035738 - DNA, 22 bp, Homo sapiens
tatagtacatggaatcttcata

SEQ ID NO: 9035739 - DNA, 22 bp, Homo sapiens
tatagtacatggaatcttcata

SEQ ID NO: 9035740 - DNA, 22 bp, Homo sapiens
tatagtatacttaaagtctatt

SEQ ID NO: 9035741 - DNA, 22 bp, Homo sapiens
tatagtacatggaatcttcata

SEQ ID NO: 9035742 - DNA, 22 bp, Homo sapiens
tatagtacacttaggtacttca

SEQ ID NO: 9035743 - DNA, 21 bp, Homo sapiens
tatagtcacttgagcattatc

SEQ ID NO: 9035744 - DNA, 21 bp, Homo sapiens
tatagtcacttgagcattatc

SEQ ID NO: 9035745 - DNA, 22 bp, Homo sapiens
tatagtgcattatttacagtaa

SEQ ID NO: 9035746 - DNA, 21 bp, Homo sapiens
tatagtgtggatatgctgatg

SEQ ID NO: 9035747 - DNA, 22 bp, Homo sapiens
tataggaaaggagtggtcacaa

SEQ ID NO: 9035748 - DNA, 22 bp, Homo sapiens
tataggaaataggtcttctgtg

SEQ ID NO: 9035749 - DNA, 22 bp, Homo sapiens
tataggaaatttatctcctggg

SEQ ID NO: 9035750 - DNA, 22 bp, Homo sapiens
tataggaacagctagcacagaa

SEQ ID NO: 9035751 - DNA, 22 bp, Homo sapiens
tataggaaataggtcttctgtg

SEQ ID NO: 9035752 - DNA, 22 bp, Homo sapiens
tataggaaatttatctcctggg

SEQ ID NO: 9035753 - DNA, 22 bp, Homo sapiens
tataggaaggcagattttagct

SEQ ID NO: 9035754 - DNA, 22 bp, Homo sapiens
tataggaaggcagattttagct

SEQ ID NO: 9035755 - DNA, 22 bp, Homo sapiens
tataggaagtaattgttgcctg

SEQ ID NO: 9035756 - DNA, 22 bp, Homo sapiens
tataggaagtattcaaagactg

SEQ ID NO: 9035757 - DNA, 22 bp, Homo sapiens
tataggaagtgtagtgcttgga

SEQ ID NO: 9035758 - DNA, 22 bp, Homo sapiens
tataggaagtgtagtgcttgga

SEQ ID NO: 9035759 - DNA, 22 bp, Homo sapiens
tataggaagtaattgttgcctg

SEQ ID NO: 9035760 - DNA, 22 bp, Homo sapiens
tataggaaggcagattttagct

SEQ ID NO: 9035761 - DNA, 22 bp, Homo sapiens
tataggaatgacgtcatttcct

SEQ ID NO: 9035762 - DNA, 22 bp, Homo sapiens
tataggaatgacgtcatttcct

SEQ ID NO: 9035763 - DNA, 22 bp, Homo sapiens
tataggaataaagtggggtata

SEQ ID NO: 9035764 - DNA, 21 bp, Homo sapiens
tataggaatcagtcacatctg

SEQ ID NO: 9035765 - DNA, 19 bp, Homo sapiens
tataggaagtgtggttaag

SEQ ID NO: 9035766 - DNA, 22 bp, Homo sapiens
tatagctttgctgagaaaaaga

SEQ ID NO: 9035767 - DNA, 22 bp, Homo sapiens
tatagctttgctgagaaaaaga

SEQ ID NO: 9035768 - DNA, 22 bp, Homo sapiens
tataggaaacatacgtgactag

SEQ ID NO: 9035769 - DNA, 22 bp, Homo sapiens
tataggaaaggagtggtcacaa

SEQ ID NO: 9035770 - DNA, 22 bp, Homo sapiens
tataggaaacatacgtgactag

SEQ ID NO: 9035771 - DNA, 22 bp, Homo sapiens
tatagccaataatagtgtgtga

SEQ ID NO: 9035772 - DNA, 22 bp, Homo sapiens
tatagctaaggtcagactgttt

SEQ ID NO: 9035773 - DNA, 18 bp, Homo sapiens
tatagccactgaaatgtg

SEQ ID NO: 9035774 - DNA, 22 bp, Homo sapiens
tatagcaattcagaatacatgt

SEQ ID NO: 9035775 - DNA, 22 bp, Homo sapiens
tatagcacacagtttataaaag

SEQ ID NO: 9035776 - DNA, 22 bp, Homo sapiens
tatagcacacagtttataaaag

SEQ ID NO: 9035777 - DNA, 22 bp, Homo sapiens
tatgtacagtccttaacttaaa

SEQ ID NO: 9035778 - DNA, 22 bp, Homo sapiens
tatgtacagtccttaacttaaa

SEQ ID NO: 9035779 - DNA, 22 bp, Homo sapiens
tatgtacagtccttaacttaaa

SEQ ID NO: 9035780 - DNA, 22 bp, Homo sapiens
tatgtacataacatgaaatgca

SEQ ID NO: 9035781 - DNA, 22 bp, Homo sapiens
tatgtacataacatgaaatgca

SEQ ID NO: 9035782 - DNA, 22 bp, Homo sapiens
tatgtacataacatgaaatgca

SEQ ID NO: 9035783 - DNA, 22 bp, Homo sapiens
tatgtacagtccttaacttaaa

SEQ ID NO: 9035784 - DNA, 22 bp, Homo sapiens
tatgtacagtccttaacttaaa

SEQ ID NO: 9035785 - DNA, 22 bp, Homo sapiens
tatgtacagtccttaacttaaa

SEQ ID NO: 9035786 - DNA, 22 bp, Homo sapiens
tatgtacagtccttaacttaaa

SEQ ID NO: 9035787 - DNA, 22 bp, Homo sapiens
tatgtacagtccttaacttaaa

SEQ ID NO: 9035788 - DNA, 22 bp, Homo sapiens
tatgtacagggatagaacttga

SEQ ID NO: 9035789 - DNA, 22 bp, Homo sapiens
tatgtacatacatgtgcatacg

SEQ ID NO: 9035790 - DNA, 22 bp, Homo sapiens
tatgtacatacatgtgcatacg

SEQ ID NO: 9035791 - DNA, 22 bp, Homo sapiens
tatgtacataacatgaaatgca

SEQ ID NO: 9035792 - DNA, 22 bp, Homo sapiens
tatgtacataacatgaaatgca

SEQ ID NO: 9035793 - DNA, 22 bp, Homo sapiens
tatgtctggaagtgtacttgtc

SEQ ID NO: 9035794 - DNA, 22 bp, Homo sapiens
tatgtctctgaaccttagcaag

SEQ ID NO: 9035795 - DNA, 22 bp, Homo sapiens
tatgtctgaatcttatttaaat

SEQ ID NO: 9035796 - DNA, 22 bp, Homo sapiens
tatgtctgcttggttttggaat

SEQ ID NO: 9035797 - DNA, 22 bp, Homo sapiens
tatgtctgaatcttatttaaat

SEQ ID NO: 9035798 - DNA, 22 bp, Homo sapiens
tatgtcggggtttcttctggca

SEQ ID NO: 9035799 - DNA, 22 bp, Homo sapiens
tatgtctcatggaagggcatta

SEQ ID NO: 9035800 - DNA, 22 bp, Homo sapiens
tatgtcctgctactctctcatg

SEQ ID NO: 9035801 - DNA, 22 bp, Homo sapiens
tatgtcctgttcagatcagaga

SEQ ID NO: 9035802 - DNA, 22 bp, Homo sapiens
tatgtacacatacacttgtaat

SEQ ID NO: 9035803 - DNA, 22 bp, Homo sapiens
tatgtacacatacacttgtaat

SEQ ID NO: 9035804 - DNA, 22 bp, Homo sapiens
tatgtacacatacacttgtaat

SEQ ID NO: 9035805 - DNA, 22 bp, Homo sapiens
tatgtacacacacatgcatgta

SEQ ID NO: 9035806 - DNA, 22 bp, Homo sapiens
tatgtacacacacatgcatgta

SEQ ID NO: 9035807 - DNA, 22 bp, Homo sapiens
tatgtacaccaaggattgaaaa

SEQ ID NO: 9035808 - DNA, 22 bp, Homo sapiens
tatgtacacatacacttgtaat

SEQ ID NO: 9035809 - DNA, 22 bp, Homo sapiens
tatgtacaccaaggattgaaaa

SEQ ID NO: 9035810 - DNA, 22 bp, Homo sapiens
tatgtacacatacacttgtaat

SEQ ID NO: 9035811 - DNA, 22 bp, Homo sapiens
tatgtacacttaagtttgagaa

SEQ ID NO: 9035812 - DNA, 22 bp, Homo sapiens
tatgtacagggatagaacttga

SEQ ID NO: 9035813 - DNA, 22 bp, Homo sapiens
tatgtacagggatagaacttga

SEQ ID NO: 9035814 - DNA, 22 bp, Homo sapiens
tatgtacagggatagaacttga

SEQ ID NO: 9035815 - DNA, 22 bp, Homo sapiens
tatgtacagggatagaacttga

SEQ ID NO: 9035816 - DNA, 22 bp, Homo sapiens
tatgtacagggatagaacttga

SEQ ID NO: 9035817 - DNA, 22 bp, Homo sapiens
tatgtacaccggggaaggtggg

SEQ ID NO: 9035818 - DNA, 22 bp, Homo sapiens
tatgtacaccggggaaggtggg

SEQ ID NO: 9035819 - DNA, 22 bp, Homo sapiens
tatgtacaccggggaaggtggg

SEQ ID NO: 9035820 - DNA, 22 bp, Homo sapiens
tatgtacacggtggctctgaag

SEQ ID NO: 9035821 - DNA, 22 bp, Homo sapiens
tatgtacacggtggctctgaag

SEQ ID NO: 9035822 - DNA, 22 bp, Homo sapiens
tatgtacaatttgttgtatgtc

SEQ ID NO: 9035823 - DNA, 22 bp, Homo sapiens
tatgtacaatttgttgtatgtc

SEQ ID NO: 9035824 - DNA, 22 bp, Homo sapiens
tatgtacaatttgttgtatgtc

SEQ ID NO: 9035825 - DNA, 22 bp, Homo sapiens
tatgtacaatttgttgtatgtc

SEQ ID NO: 9035826 - DNA, 22 bp, Homo sapiens
tatgtacaatcagcagttcata

SEQ ID NO: 9035827 - DNA, 22 bp, Homo sapiens
tatgtacaatcagcagttcata

SEQ ID NO: 9035828 - DNA, 22 bp, Homo sapiens
tatgtacacacacatgcatgta

SEQ ID NO: 9035829 - DNA, 22 bp, Homo sapiens
tatgtacacacacatgcatgta

SEQ ID NO: 9035830 - DNA, 22 bp, Homo sapiens
tatgtacacacacatgcatgta

SEQ ID NO: 9035831 - DNA, 22 bp, Homo sapiens
tatgtacacacacatgcatgta

SEQ ID NO: 9035832 - DNA, 22 bp, Homo sapiens
tatgtacacacacatgcatgta

SEQ ID NO: 9035833 - DNA, 22 bp, Homo sapiens
tatgtacacacacatgcatgta

SEQ ID NO: 9035834 - DNA, 22 bp, Homo sapiens
tatgtacacacacatgcatgta

SEQ ID NO: 9035835 - DNA, 22 bp, Homo sapiens
tatgtacaatcagcagttcata

SEQ ID NO: 9035836 - DNA, 22 bp, Homo sapiens
tatgtacaatcagcagttcata

SEQ ID NO: 9035837 - DNA, 22 bp, Homo sapiens
tatgtacaatcagcagttcata

SEQ ID NO: 9035838 - DNA, 22 bp, Homo sapiens
tatgtacaatcagcagttcata

SEQ ID NO: 9035839 - DNA, 22 bp, Homo sapiens
tatgtacaatcagcagttcata

SEQ ID NO: 9035840 - DNA, 22 bp, Homo sapiens
tatgtacaatcagcagttcata

SEQ ID NO: 9035841 - DNA, 22 bp, Homo sapiens
tatgtacaatcagcagttcata

SEQ ID NO: 9035842 - DNA, 22 bp, Homo sapiens
tatgtacaatcagcagttcata

SEQ ID NO: 9035843 - DNA, 22 bp, Homo sapiens
tatgtacaatcagcagttcata

SEQ ID NO: 9035844 - DNA, 22 bp, Homo sapiens
tatgtacaagcacacatgtgac

SEQ ID NO: 9035845 - DNA, 22 bp, Homo sapiens
tatgtacaagcacacatgtgac

SEQ ID NO: 9035846 - DNA, 22 bp, Homo sapiens
tatgtacaagcacacatgtgac

SEQ ID NO: 9035847 - DNA, 22 bp, Homo sapiens
tatgtacaagcacacatgtgac

SEQ ID NO: 9035848 - DNA, 22 bp, Homo sapiens
tatgtacaagcacacatgtgac

SEQ ID NO: 9035849 - DNA, 22 bp, Homo sapiens
tatgtacaagcacacatgtgac

SEQ ID NO: 9035850 - DNA, 22 bp, Homo sapiens
tatgtacaatcagcagttcata

SEQ ID NO: 9035851 - DNA, 22 bp, Homo sapiens
tatgtacaagcacacatgtgac

SEQ ID NO: 9035852 - DNA, 22 bp, Homo sapiens
tatgtacaagcacacatgtgac

SEQ ID NO: 9035853 - DNA, 22 bp, Homo sapiens
tatgaggtaggtattatactta

SEQ ID NO: 9035854 - DNA, 22 bp, Homo sapiens
tatgaggtattacaggaaatat

SEQ ID NO: 9035855 - DNA, 22 bp, Homo sapiens
tatgaggttttggatctgtgtt

SEQ ID NO: 9035856 - DNA, 22 bp, Homo sapiens
tatgagtacaaggaaggatgga

SEQ ID NO: 9035857 - DNA, 22 bp, Homo sapiens
tatgagtacaaggaaggatgga

SEQ ID NO: 9035858 - DNA, 22 bp, Homo sapiens
tatgaggtaggtattatactta

SEQ ID NO: 9035859 - DNA, 22 bp, Homo sapiens
tatgaggtaagagggacttagc

SEQ ID NO: 9035860 - DNA, 22 bp, Homo sapiens
tatgaggcacttcattagctgg

SEQ ID NO: 9035861 - DNA, 22 bp, Homo sapiens
tatgagttcagttatcttaagt

SEQ ID NO: 9035862 - DNA, 22 bp, Homo sapiens
tatgagtggcgtagaggtaggg

SEQ ID NO: 9035863 - DNA, 22 bp, Homo sapiens
tatgagtactgtgaacgagaat

SEQ ID NO: 9035864 - DNA, 22 bp, Homo sapiens
tatgagtactgtgaacgagaat

SEQ ID NO: 9035865 - DNA, 22 bp, Homo sapiens
tatgagtacaaggaatcttcca

SEQ ID NO: 9035866 - DNA, 20 bp, Homo sapiens
tatgagtattactttcagga

SEQ ID NO: 9035867 - DNA, 20 bp, Homo sapiens
tatgagtattactttcagga

SEQ ID NO: 9035868 - DNA, 22 bp, Homo sapiens
tatgagcaagagtttgtgaagg

SEQ ID NO: 9035869 - DNA, 22 bp, Homo sapiens
tatgagcagacagtggttttac

SEQ ID NO: 9035870 - DNA, 19 bp, Homo sapiens
tatgtgtgcatttgtgcat

SEQ ID NO: 9035871 - DNA, 22 bp, Homo sapiens
tatgtgtgcatgtatacattaa

SEQ ID NO: 9035872 - DNA, 22 bp, Homo sapiens
tatgtgcatatgcatacacaca

SEQ ID NO: 9035873 - DNA, 22 bp, Homo sapiens
tatgtgcatatgcatacacaca

SEQ ID NO: 9035874 - DNA, 22 bp, Homo sapiens
tatgtgacttgacaaagcttcc

SEQ ID NO: 9035875 - DNA, 22 bp, Homo sapiens
tatgtgacatatctcagtttga

SEQ ID NO: 9035876 - DNA, 22 bp, Homo sapiens
tatgtgcaaattaattgctaga

SEQ ID NO: 9035877 - DNA, 22 bp, Homo sapiens
tatgtgcacattagagagatgg

SEQ ID NO: 9035878 - DNA, 22 bp, Homo sapiens
tatgtgcacattagagagatgg

SEQ ID NO: 9035879 - DNA, 22 bp, Homo sapiens
tatgtcttcgtcacctatctca

SEQ ID NO: 9035880 - DNA, 22 bp, Homo sapiens
tatgtcttagaacaaaacagtg

SEQ ID NO: 9035881 - DNA, 22 bp, Homo sapiens
tatgtcttgaaatgagaagcca

SEQ ID NO: 9035882 - DNA, 22 bp, Homo sapiens
tatgtcttgtgtttgctaatct

SEQ ID NO: 9035883 - DNA, 22 bp, Homo sapiens
tatgtcttactacagcaattaa

SEQ ID NO: 9035884 - DNA, 22 bp, Homo sapiens
tatgtcttactacagcaattaa

SEQ ID NO: 9035885 - DNA, 22 bp, Homo sapiens
tatgtcttaatccttccttagg

SEQ ID NO: 9035886 - DNA, 22 bp, Homo sapiens
tatgtcttaactctagaaaggt

SEQ ID NO: 9035887 - DNA, 22 bp, Homo sapiens
tatgtcttaactctagaaaggt

SEQ ID NO: 9035888 - DNA, 22 bp, Homo sapiens
tatgtctggcatgttgtaatta

SEQ ID NO: 9035889 - DNA, 22 bp, Homo sapiens
tatgtctttgtcccactcccag

SEQ ID NO: 9035890 - DNA, 22 bp, Homo sapiens
tatgtctttagtatcttttgga

SEQ ID NO: 9035891 - DNA, 22 bp, Homo sapiens
tatgtctttagtatcttttgga

SEQ ID NO: 9035892 - DNA, 22 bp, Homo sapiens
tatgtcttttgcttgcaaatag

SEQ ID NO: 9035893 - DNA, 22 bp, Homo sapiens
tatgtgacaaaagtaaactgca

SEQ ID NO: 9035894 - DNA, 22 bp, Homo sapiens
tattagcttctggttttgttct

SEQ ID NO: 9035895 - DNA, 22 bp, Homo sapiens
tattagcctggatctgtgactg

SEQ ID NO: 9035896 - DNA, 22 bp, Homo sapiens
tattagcagttgtatgtgtctg

SEQ ID NO: 9035897 - DNA, 22 bp, Homo sapiens
tattagcagccaacttagctgt

SEQ ID NO: 9035898 - DNA, 22 bp, Homo sapiens
tattagcagcatgagaatgggc

SEQ ID NO: 9035899 - DNA, 22 bp, Homo sapiens
tattagcagacaagctgctgga

SEQ ID NO: 9035900 - DNA, 22 bp, Homo sapiens
tattagcacaaagcaaggtatt

SEQ ID NO: 9035901 - DNA, 22 bp, Homo sapiens
tattagcacaaagcaaggtatt

SEQ ID NO: 9035902 - DNA, 23 bp, Homo sapiens
tattagcaattcccacagagcag

SEQ ID NO: 9035903 - DNA, 22 bp, Homo sapiens
tattagcaacagagctcttgtt

SEQ ID NO: 9035904 - DNA, 22 bp, Homo sapiens
tattagatttgtttctgtagat

SEQ ID NO: 9035905 - DNA, 22 bp, Homo sapiens
tattagattaactttaatgtct

SEQ ID NO: 9035906 - DNA, 22 bp, Homo sapiens
tattagaggaaccaaggtggag

SEQ ID NO: 9035907 - DNA, 22 bp, Homo sapiens
tattagattaactttaatgtct

SEQ ID NO: 9035908 - DNA, 22 bp, Homo sapiens
tattactgaggttttatggagt

SEQ ID NO: 9035909 - DNA, 22 bp, Homo sapiens
tattactgaggttttatggagt

SEQ ID NO: 9035910 - DNA, 22 bp, Homo sapiens
tattagaaagcttaatatcgtg

SEQ ID NO: 9035911 - DNA, 22 bp, Homo sapiens
tattagaaaggctattgcatag

SEQ ID NO: 9035912 - DNA, 22 bp, Homo sapiens
tattagaaaggctattgcatag

SEQ ID NO: 9035913 - DNA, 22 bp, Homo sapiens
tattagaggaaccaaggtggag

SEQ ID NO: 9035914 - DNA, 22 bp, Homo sapiens
tattagagaaaagatggatgtg

SEQ ID NO: 9035915 - DNA, 22 bp, Homo sapiens
tattagaaaggctattgcatag

SEQ ID NO: 9035916 - DNA, 22 bp, Homo sapiens
tattacagctttgattatctgg

SEQ ID NO: 9035917 - DNA, 22 bp, Homo sapiens
tattacagaatcaggcataact

SEQ ID NO: 9035918 - DNA, 22 bp, Homo sapiens
tattacagaatcaggcataact

SEQ ID NO: 9035919 - DNA, 22 bp, Homo sapiens
tattacagctttgattatctgg

SEQ ID NO: 9035920 - DNA, 22 bp, Homo sapiens
tattacatccacttttattgca

SEQ ID NO: 9035921 - DNA, 22 bp, Homo sapiens
tattacagttcgagtttctagg

SEQ ID NO: 9035922 - DNA, 22 bp, Homo sapiens
tattacagggctagttatgagt

SEQ ID NO: 9035923 - DNA, 22 bp, Homo sapiens
tatgtgtggcagctgggagtgt

SEQ ID NO: 9035924 - DNA, 22 bp, Homo sapiens
tatgtgtgctttttccatgcat

SEQ ID NO: 9035925 - DNA, 19 bp, Homo sapiens
tatgtgtgcatttgtgcat

SEQ ID NO: 9035926 - DNA, 19 bp, Homo sapiens
tatgtgtgcatttgtgcat

SEQ ID NO: 9035927 - DNA, 20 bp, Homo sapiens
tattacacacaatgagcagt

SEQ ID NO: 9035928 - DNA, 22 bp, Homo sapiens
tattacacagtgaaagcatgga

SEQ ID NO: 9035929 - DNA, 22 bp, Homo sapiens
tatgtgtggcagctgggagtgt

SEQ ID NO: 9035930 - DNA, 22 bp, Homo sapiens
tattacaatttacattgcactt

SEQ ID NO: 9035931 - DNA, 23 bp, Homo sapiens
tatgtgtgggtctactagaagtc

SEQ ID NO: 9035932 - DNA, 22 bp, Homo sapiens
tatgtgtggcagctgggagtgt

SEQ ID NO: 9035933 - DNA, 22 bp, Homo sapiens
tatttatgtggaccataagcct

SEQ ID NO: 9035934 - DNA, 22 bp, Homo sapiens
tatttatgtggaccataagcct

SEQ ID NO: 9035935 - DNA, 21 bp, Homo sapiens
tatttattaatttgtaaggct

SEQ ID NO: 9035936 - DNA, 22 bp, Homo sapiens
tatttatgtctctgcagagaat

SEQ ID NO: 9035937 - DNA, 22 bp, Homo sapiens
tatttatgtctctgcagagaat

SEQ ID NO: 9035938 - DNA, 22 bp, Homo sapiens
tatttatcgagtgtctactatg

SEQ ID NO: 9035939 - DNA, 22 bp, Homo sapiens
tatttatcaaggtaggagaata

SEQ ID NO: 9035940 - DNA, 22 bp, Homo sapiens
tatttatattctgccttctgct

SEQ ID NO: 9035941 - DNA, 22 bp, Homo sapiens
tatttataccaggtgatcggag

SEQ ID NO: 9035942 - DNA, 22 bp, Homo sapiens
tatttatattctgccttctgct

SEQ ID NO: 9035943 - DNA, 22 bp, Homo sapiens
tatttatattctgccttctgct

SEQ ID NO: 9035944 - DNA, 22 bp, Homo sapiens
tatttataatctgccaaagaga

SEQ ID NO: 9035945 - DNA, 22 bp, Homo sapiens
tatttataatctgccaaagaga

SEQ ID NO: 9035946 - DNA, 22 bp, Homo sapiens
tatttataatctgccaaagaga

SEQ ID NO: 9035947 - DNA, 22 bp, Homo sapiens
tatttataccaggtgatcggag

SEQ ID NO: 9035948 - DNA, 22 bp, Homo sapiens
tatttaatttgctcattgtgat

SEQ ID NO: 9035949 - DNA, 22 bp, Homo sapiens
tatttaatttgctcattgtgat

SEQ ID NO: 9035950 - DNA, 22 bp, Homo sapiens
tatttaattagtgattgtagag

SEQ ID NO: 9035951 - DNA, 22 bp, Homo sapiens
tatttaatttgctcattgtgat

SEQ ID NO: 9035952 - DNA, 22 bp, Homo sapiens
tatttaatttgctcattgtgat

SEQ ID NO: 9035953 - DNA, 20 bp, Homo sapiens
tatttacaacttagagcctc

SEQ ID NO: 9035954 - DNA, 22 bp, Homo sapiens
tatttataacagtgagaacggg

SEQ ID NO: 9035955 - DNA, 22 bp, Homo sapiens
tatttataatctgccaaagaga

SEQ ID NO: 9035956 - DNA, 22 bp, Homo sapiens
tatttataacagtgagaacggg

SEQ ID NO: 9035957 - DNA, 22 bp, Homo sapiens
tatttataatctgccaaagaga

SEQ ID NO: 9035958 - DNA, 22 bp, Homo sapiens
tattgacagtgactattggtag

SEQ ID NO: 9035959 - DNA, 22 bp, Homo sapiens
tattgacatttttatagcttga

SEQ ID NO: 9035960 - DNA, 22 bp, Homo sapiens
tattgacagtgactattggtag

SEQ ID NO: 9035961 - DNA, 22 bp, Homo sapiens
tatttaattagtgattgtagag

SEQ ID NO: 9035962 - DNA, 22 bp, Homo sapiens
tatttaattagtgattgtagag

SEQ ID NO: 9035963 - DNA, 22 bp, Homo sapiens
tatttaattagtgattgtagag

SEQ ID NO: 9035964 - DNA, 22 bp, Homo sapiens
tatttaattagtgattgtagag

SEQ ID NO: 9035965 - DNA, 22 bp, Homo sapiens
tatttaattagtgattgtagag

SEQ ID NO: 9035966 - DNA, 22 bp, Homo sapiens
tattgacactttttgtgtagcc

SEQ ID NO: 9035967 - DNA, 22 bp, Homo sapiens
tattgacaatttgtgaaactat

SEQ ID NO: 9035968 - DNA, 22 bp, Homo sapiens
tattgacactttttgtgtagcc

SEQ ID NO: 9035969 - DNA, 22 bp, Homo sapiens
tattgacagagggtcagaagag

SEQ ID NO: 9035970 - DNA, 22 bp, Homo sapiens
tattgacaggtgcctgcagaca

SEQ ID NO: 9035971 - DNA, 22 bp, Homo sapiens
tattgacagatgcattatgttg

SEQ ID NO: 9035972 - DNA, 22 bp, Homo sapiens
tatttctctcacggttgcctgg

SEQ ID NO: 9035973 - DNA, 22 bp, Homo sapiens
tatttctctcacggttgcctgg

SEQ ID NO: 9035974 - DNA, 22 bp, Homo sapiens
tatttctcttcaaaattgatgt

SEQ ID NO: 9035975 - DNA, 22 bp, Homo sapiens
tatttctcagcattttacatcc

SEQ ID NO: 9035976 - DNA, 22 bp, Homo sapiens
tatttctgaatccaaaaggtca

SEQ ID NO: 9035977 - DNA, 22 bp, Homo sapiens
tatttctgagaaccaacttacc

SEQ ID NO: 9035978 - DNA, 22 bp, Homo sapiens
tatttctcttcaaaattgatgt

SEQ ID NO: 9035979 - DNA, 22 bp, Homo sapiens
tatttctgaatccaaaaggtca

SEQ ID NO: 9035980 - DNA, 19 bp, Homo sapiens
tatttcaaagtgccgtcta

SEQ ID NO: 9035981 - DNA, 19 bp, Homo sapiens
tatttcaaagtgccgtcta

SEQ ID NO: 9035982 - DNA, 22 bp, Homo sapiens
tatttattggacagtgttgctg

SEQ ID NO: 9035983 - DNA, 22 bp, Homo sapiens
tatttctaagctgtaagtctga

SEQ ID NO: 9035984 - DNA, 22 bp, Homo sapiens
tatttctcagcattttacatcc

SEQ ID NO: 9035985 - DNA, 22 bp, Homo sapiens
tatttctcagcattttacatcc

SEQ ID NO: 9035986 - DNA, 22 bp, Homo sapiens
tatttctattccccaggcaagt

SEQ ID NO: 9035987 - DNA, 22 bp, Homo sapiens
tatttctaagctgtaagtctga

SEQ ID NO: 9035988 - DNA, 22 bp, Homo sapiens
tatttattctttgtactgcctt

SEQ ID NO: 9035989 - DNA, 22 bp, Homo sapiens
tatttattctttgtactgcctt

SEQ ID NO: 9035990 - DNA, 22 bp, Homo sapiens
tatttattcattcagcaagcat

SEQ ID NO: 9035991 - DNA, 22 bp, Homo sapiens
tatttattcattcagcaagcat

SEQ ID NO: 9035992 - DNA, 22 bp, Homo sapiens
tatttattcattcagcaagcat

SEQ ID NO: 9035993 - DNA, 22 bp, Homo sapiens
tatttattggacagtgttgctg

SEQ ID NO: 9035994 - DNA, 22 bp, Homo sapiens
tatttattctttgtactgcctt

SEQ ID NO: 9035995 - DNA, 22 bp, Homo sapiens
tatttattggacagtgttgctg

SEQ ID NO: 9035996 - DNA, 22 bp, Homo sapiens
tattcttgactgcttactatgt

SEQ ID NO: 9035997 - DNA, 22 bp, Homo sapiens
tattcttactctcgactgcatt

SEQ ID NO: 9035998 - DNA, 22 bp, Homo sapiens
tattcttgtaccttaaatgatt

SEQ ID NO: 9035999 - DNA, 22 bp, Homo sapiens
tattcttgtaccttaaatgatt

SEQ ID NO: 9036000 - DNA, 22 bp, Homo sapiens
tattcttgtaccttaaatgatt

SEQ ID NO: 9036001 - DNA, 22 bp, Homo sapiens
tattcttgtatactacaatctt

SEQ ID NO: 9036002 - DNA, 22 bp, Homo sapiens
tattcttgtatactacaatctt

SEQ ID NO: 9036003 - DNA, 22 bp, Homo sapiens
tattgaaatccattacgttctt

SEQ ID NO: 9036004 - DNA, 22 bp, Homo sapiens
tattcttgtcttttccagaaat

SEQ ID NO: 9036005 - DNA, 22 bp, Homo sapiens
tattgaaatgaatgacagtgat

SEQ ID NO: 9036006 - DNA, 22 bp, Homo sapiens
tattgaaatccattacgttctt

SEQ ID NO: 9036007 - DNA, 22 bp, Homo sapiens
tattgaaatccattacgttctt

SEQ ID NO: 9036008 - DNA, 22 bp, Homo sapiens
tattgaaatccattacgttctt

SEQ ID NO: 9036009 - DNA, 22 bp, Homo sapiens
tattgacaatttgtgaaactat

SEQ ID NO: 9036010 - DNA, 22 bp, Homo sapiens
tattgacaatttgtgaaactat

SEQ ID NO: 9036011 - DNA, 22 bp, Homo sapiens
tattgacaatttgtgaaactat

SEQ ID NO: 9036012 - DNA, 22 bp, Homo sapiens
tattgacaataggcaactgagg

SEQ ID NO: 9036013 - DNA, 22 bp, Homo sapiens
tattgaattagaccctaaaatg

SEQ ID NO: 9036014 - DNA, 22 bp, Homo sapiens
tattgaattagaccctaaaatg

SEQ ID NO: 9036015 - DNA, 22 bp, Homo sapiens
tattgaattagaccctaaaatg

SEQ ID NO: 9036016 - DNA, 22 bp, Homo sapiens
tattgacaataggcaactgagg

SEQ ID NO: 9036017 - DNA, 22 bp, Homo sapiens
tattgaaattcttcatgtcctc

SEQ ID NO: 9036018 - DNA, 22 bp, Homo sapiens
tattgaaattcttcatgtcctc

SEQ ID NO: 9036019 - DNA, 22 bp, Homo sapiens
tattgaaatgaatgacagtgat

SEQ ID NO: 9036020 - DNA, 22 bp, Homo sapiens
tattgaaattcttcatgtcctc

SEQ ID NO: 9036021 - DNA, 22 bp, Homo sapiens
tattgaaattcttcatgtcctc

SEQ ID NO: 9036022 - DNA, 22 bp, Homo sapiens
tattgaaattcttcatgtcctc

SEQ ID NO: 9036023 - DNA, 22 bp, Homo sapiens
tattgaagagataagtgacaga

SEQ ID NO: 9036024 - DNA, 22 bp, Homo sapiens
tattctcatcatcactggagct

SEQ ID NO: 9036025 - DNA, 22 bp, Homo sapiens
tattctccccggatcagggcaa

SEQ ID NO: 9036026 - DNA, 22 bp, Homo sapiens
tattctctccccaatcttgctt

SEQ ID NO: 9036027 - DNA, 22 bp, Homo sapiens
tattctcagcaacacacatgga

SEQ ID NO: 9036028 - DNA, 22 bp, Homo sapiens
tattctactagcattgttcact

SEQ ID NO: 9036029 - DNA, 22 bp, Homo sapiens
tattctactagcattgttcact

SEQ ID NO: 9036030 - DNA, 22 bp, Homo sapiens
tattctcagcaacacacatgga

SEQ ID NO: 9036031 - DNA, 22 bp, Homo sapiens
tattctcagcaacacacatgga

SEQ ID NO: 9036032 - DNA, 22 bp, Homo sapiens
tattctcagtgctataagtaga

SEQ ID NO: 9036033 - DNA, 22 bp, Homo sapiens
tattctctgcagctgaatgttt

SEQ ID NO: 9036034 - DNA, 22 bp, Homo sapiens
tattctctccccaatcttgctt

SEQ ID NO: 9036035 - DNA, 22 bp, Homo sapiens
tattctgggtaccaaacttcaa

SEQ ID NO: 9036036 - DNA, 22 bp, Homo sapiens
tattctgctaagtgatttctac

SEQ ID NO: 9036037 - DNA, 22 bp, Homo sapiens
tattctgcatgaaaataaacag

SEQ ID NO: 9036038 - DNA, 22 bp, Homo sapiens
tattctgcatgaaaataaacag

SEQ ID NO: 9036039 - DNA, 22 bp, Homo sapiens
tattctggtttccggatctcta

SEQ ID NO: 9036040 - DNA, 22 bp, Homo sapiens
tattctgtgtgatatgtaaatg

SEQ ID NO: 9036041 - DNA, 22 bp, Homo sapiens
tattctgtgtgatatgtaaatg

SEQ ID NO: 9036042 - DNA, 23 bp, Homo sapiens
tattagggccaggactggcaaat

SEQ ID NO: 9036043 - DNA, 22 bp, Homo sapiens
tattaggtagattttactgatt

SEQ ID NO: 9036044 - DNA, 22 bp, Homo sapiens
tattattatattggatgagact

SEQ ID NO: 9036045 - DNA, 22 bp, Homo sapiens
tattattatagttattgggaag

SEQ ID NO: 9036046 - DNA, 22 bp, Homo sapiens
tattattaaatggcagaatttt

SEQ ID NO: 9036047 - DNA, 22 bp, Homo sapiens
tattattaaatggcagaatttt

SEQ ID NO: 9036048 - DNA, 22 bp, Homo sapiens
tattattatgcatagcatgaaa

SEQ ID NO: 9036049 - DNA, 22 bp, Homo sapiens
tattattatgcatagcatgaaa

SEQ ID NO: 9036050 - DNA, 22 bp, Homo sapiens
tattattatgcatagcatgaaa

SEQ ID NO: 9036051 - DNA, 22 bp, Homo sapiens
tattattatattggatgagact

SEQ ID NO: 9036052 - DNA, 22 bp, Homo sapiens
tattattatctttgaatgggac

SEQ ID NO: 9036053 - DNA, 22 bp, Homo sapiens
tattattatctttgaatgggac

SEQ ID NO: 9036054 - DNA, 22 bp, Homo sapiens
tattattatgcatagcatgaaa

SEQ ID NO: 9036055 - DNA, 22 bp, Homo sapiens
tattattatagttattgggaag

SEQ ID NO: 9036056 - DNA, 22 bp, Homo sapiens
tattattgacatttacttggtg

SEQ ID NO: 9036057 - DNA, 22 bp, Homo sapiens
tattattgactattcagaatgt

SEQ ID NO: 9036058 - DNA, 22 bp, Homo sapiens
tattattgaatcagttctttga

SEQ ID NO: 9036059 - DNA, 19 bp, Homo sapiens
tattatttgtagcaaggcc

SEQ ID NO: 9036060 - DNA, 22 bp, Homo sapiens
tattcattatgaccaaatctag

SEQ ID NO: 9036061 - DNA, 22 bp, Homo sapiens
tattccaaaatagttaagcact

SEQ ID NO: 9036062 - DNA, 22 bp, Homo sapiens
tattccaaaatagttaagcact

SEQ ID NO: 9036063 - DNA, 22 bp, Homo sapiens
tattccaaaatagttaagcact

SEQ ID NO: 9036064 - DNA, 22 bp, Homo sapiens
tattcattatgaccaaatctag

SEQ ID NO: 9036065 - DNA, 22 bp, Homo sapiens
tattcatgtcggctgaaaaagc

SEQ ID NO: 9036066 - DNA, 22 bp, Homo sapiens
tattcatgggggtccaggtacc

SEQ ID NO: 9036067 - DNA, 22 bp, Homo sapiens
tattcatgtcggctgaaaaagc

SEQ ID NO: 9036068 - DNA, 22 bp, Homo sapiens
tattcctgttccccatcaccac

SEQ ID NO: 9036069 - DNA, 22 bp, Homo sapiens
tattccaaaatcccaaactgcc

SEQ ID NO: 9036070 - DNA, 22 bp, Homo sapiens
tattccaaaggtagggattact

SEQ ID NO: 9036071 - DNA, 22 bp, Homo sapiens
tattccaactgtcatagtcata

SEQ ID NO: 9036072 - DNA, 22 bp, Homo sapiens
tattattttagcactgaggatt

SEQ ID NO: 9036073 - DNA, 22 bp, Homo sapiens
tattattttagcactgaggatt

SEQ ID NO: 9036074 - DNA, 22 bp, Homo sapiens
tattattttagcactgaggatt

SEQ ID NO: 9036075 - DNA, 22 bp, Homo sapiens
tattattttagcactgaggatt

SEQ ID NO: 9036076 - DNA, 19 bp, Homo sapiens
tattatttgtagcaaggcc

SEQ ID NO: 9036077 - DNA, 19 bp, Homo sapiens
tattatttgtagcaaggcc

SEQ ID NO: 9036078 - DNA, 19 bp, Homo sapiens
tattatttgtagcaaggcc

SEQ ID NO: 9036079 - DNA, 22 bp, Homo sapiens
tattcaaagtaccttcattgcc

SEQ ID NO: 9036080 - DNA, 22 bp, Homo sapiens
tattatttttattcgagggaaa

SEQ ID NO: 9036081 - DNA, 22 bp, Homo sapiens
tattcaaagtaccttcattgcc

SEQ ID NO: 9036082 - DNA, 22 bp, Homo sapiens
tattcatgggaggtcacaactt

SEQ ID NO: 9036083 - DNA, 22 bp, Homo sapiens
tattcaaagtaccttcattgcc

SEQ ID NO: 9036084 - DNA, 22 bp, Homo sapiens
tccccagggctgcagagggtgt

SEQ ID NO: 9036085 - DNA, 22 bp, Homo sapiens
tccccaggggcatctctctgct

SEQ ID NO: 9036086 - DNA, 22 bp, Homo sapiens
tccccaggggcatctctctgct

SEQ ID NO: 9036087 - DNA, 22 bp, Homo sapiens
tccccagggctgcagagggtgt

SEQ ID NO: 9036088 - DNA, 20 bp, Homo sapiens
tccccagggcatcaggagca

SEQ ID NO: 9036089 - DNA, 22 bp, Homo sapiens
tccccaggggcctgggcacagt

SEQ ID NO: 9036090 - DNA, 22 bp, Homo sapiens
tccccaggggcctgggcacagt

SEQ ID NO: 9036091 - DNA, 22 bp, Homo sapiens
tccccaggggcctgggcacagt

SEQ ID NO: 9036092 - DNA, 22 bp, Homo sapiens
tccccaggggcctgggcacagt

SEQ ID NO: 9036093 - DNA, 22 bp, Homo sapiens
tccccagggtccctgcttccat

SEQ ID NO: 9036094 - DNA, 22 bp, Homo sapiens
tccccagggtccctgcttccat

SEQ ID NO: 9036095 - DNA, 22 bp, Homo sapiens
tccccagggtccctgcttccat

SEQ ID NO: 9036096 - DNA, 22 bp, Homo sapiens
tccccaggggcatctctctgct

SEQ ID NO: 9036097 - DNA, 22 bp, Homo sapiens
tccccaggggcatctctctgct

SEQ ID NO: 9036098 - DNA, 22 bp, Homo sapiens
tccccaccccagaactactagg

SEQ ID NO: 9036099 - DNA, 21 bp, Homo sapiens
tccccacatttctaaacagac

SEQ ID NO: 9036100 - DNA, 21 bp, Homo sapiens
tccccacatttctaaacagac

SEQ ID NO: 9036101 - DNA, 21 bp, Homo sapiens
tccccacatttctaaacagac

SEQ ID NO: 9036102 - DNA, 21 bp, Homo sapiens
tccccacatttctaaacagac

SEQ ID NO: 9036103 - DNA, 22 bp, Homo sapiens
tccccacatctctgcatcaggc

SEQ ID NO: 9036104 - DNA, 22 bp, Homo sapiens
tccccacatctctgcatcaggc

SEQ ID NO: 9036105 - DNA, 22 bp, Homo sapiens
tccccacatctctgcatcaggc

SEQ ID NO: 9036106 - DNA, 22 bp, Homo sapiens
tccccacagcagaagatctgag

SEQ ID NO: 9036107 - DNA, 22 bp, Homo sapiens
tccccacatctctgcatcaggc

SEQ ID NO: 9036108 - DNA, 22 bp, Homo sapiens
tccccacatctctgcatcaggc

SEQ ID NO: 9036109 - DNA, 22 bp, Homo sapiens
tccccacactttcactcctggc

SEQ ID NO: 9036110 - DNA, 22 bp, Homo sapiens
tccccacactttcactcctggc

SEQ ID NO: 9036111 - DNA, 22 bp, Homo sapiens
tcccatttcttgcatccttgct

SEQ ID NO: 9036112 - DNA, 22 bp, Homo sapiens
tcccatttcatgctggctgtgg

SEQ ID NO: 9036113 - DNA, 22 bp, Homo sapiens
tcccattttggatgcggattgg

SEQ ID NO: 9036114 - DNA, 22 bp, Homo sapiens
tccccaaaatacatggacgtgt

SEQ ID NO: 9036115 - DNA, 22 bp, Homo sapiens
tccccaaaatacatggacgtgt

SEQ ID NO: 9036116 - DNA, 22 bp, Homo sapiens
tccccaaagctttgtggtcagg

SEQ ID NO: 9036117 - DNA, 19 bp, Homo sapiens
tccccaagagttctagctc

SEQ ID NO: 9036118 - DNA, 22 bp, Homo sapiens
tccccacacagatacagagtag

SEQ ID NO: 9036119 - DNA, 22 bp, Homo sapiens
tccccacactttcactcctggc

SEQ ID NO: 9036120 - DNA, 22 bp, Homo sapiens
tccccaagtaaagatcctgaga

SEQ ID NO: 9036121 - DNA, 22 bp, Homo sapiens
tccccacacagatacagagtag

SEQ ID NO: 9036122 - DNA, 22 bp, Homo sapiens
tccccaggaatcaggtggttgc

SEQ ID NO: 9036123 - DNA, 22 bp, Homo sapiens
tccccaggactaagttgcaatc

SEQ ID NO: 9036124 - DNA, 22 bp, Homo sapiens
tccccaggaaattctgattctt

SEQ ID NO: 9036125 - DNA, 22 bp, Homo sapiens
tccccactcaccactggccaaa

SEQ ID NO: 9036126 - DNA, 22 bp, Homo sapiens
tccccactcaccactggccaaa

SEQ ID NO: 9036127 - DNA, 22 bp, Homo sapiens
tccccacctaagatacccatct

SEQ ID NO: 9036128 - DNA, 22 bp, Homo sapiens
tccccacctaagatacccatct

SEQ ID NO: 9036129 - DNA, 22 bp, Homo sapiens
tccccacctaagatacccatct

SEQ ID NO: 9036130 - DNA, 22 bp, Homo sapiens
tccccaccccagaactactagg

SEQ ID NO: 9036131 - DNA, 22 bp, Homo sapiens
tccccaccccagaactactagg

SEQ ID NO: 9036132 - DNA, 22 bp, Homo sapiens
tccccacctacacactgctcct

SEQ ID NO: 9036133 - DNA, 22 bp, Homo sapiens
tccccacctacacactgctcct

SEQ ID NO: 9036134 - DNA, 22 bp, Homo sapiens
tccccacctacacactgctcct

SEQ ID NO: 9036135 - DNA, 22 bp, Homo sapiens
tcccacaggggctctgtgggtt

SEQ ID NO: 9036136 - DNA, 22 bp, Homo sapiens
tcccacagggcttctctgtaca

SEQ ID NO: 9036137 - DNA, 22 bp, Homo sapiens
tcccacagggcttctctgtaca

SEQ ID NO: 9036138 - DNA, 22 bp, Homo sapiens
tcccacagggcttctctgtaca

SEQ ID NO: 9036139 - DNA, 22 bp, Homo sapiens
tcccacaggaggagttggaaat

SEQ ID NO: 9036140 - DNA, 22 bp, Homo sapiens
tcccacaggaggagttggaaat

SEQ ID NO: 9036141 - DNA, 22 bp, Homo sapiens
tcccacaggagcctgagtccca

SEQ ID NO: 9036142 - DNA, 22 bp, Homo sapiens
tcccacaggcccagggcggaaa

SEQ ID NO: 9036143 - DNA, 22 bp, Homo sapiens
tcccacaggcccagggcggaaa

SEQ ID NO: 9036144 - DNA, 22 bp, Homo sapiens
tcccacaggagcctgagtccca

SEQ ID NO: 9036145 - DNA, 22 bp, Homo sapiens
tcccacaggagcctgagtccca

SEQ ID NO: 9036146 - DNA, 22 bp, Homo sapiens
tcccacaggaaagtagacattg

SEQ ID NO: 9036147 - DNA, 22 bp, Homo sapiens
tcccacaggaaagtagacattg

SEQ ID NO: 9036148 - DNA, 22 bp, Homo sapiens
tcccacagcttcgtgcttcccc

SEQ ID NO: 9036149 - DNA, 22 bp, Homo sapiens
tcccagggactgggctaggctt

SEQ ID NO: 9036150 - DNA, 22 bp, Homo sapiens
tcccagggactgggctaggctt

SEQ ID NO: 9036151 - DNA, 22 bp, Homo sapiens
tcccacaggtggagcttgcagt

SEQ ID NO: 9036152 - DNA, 22 bp, Homo sapiens
tcccacaggtggagcttgcagt

SEQ ID NO: 9036153 - DNA, 22 bp, Homo sapiens
tcccacagtgaagttcatgata

SEQ ID NO: 9036154 - DNA, 22 bp, Homo sapiens
tcccacagtctcacaatgcata

SEQ ID NO: 9036155 - DNA, 22 bp, Homo sapiens
tcccacaggtggagcttgcagt

SEQ ID NO: 9036156 - DNA, 22 bp, Homo sapiens
tcccagggattaggacatggat

SEQ ID NO: 9036157 - DNA, 22 bp, Homo sapiens
tcccagggatcctccgggtcgc

SEQ ID NO: 9036158 - DNA, 22 bp, Homo sapiens
tcccagggtgaaatgcagtagg

SEQ ID NO: 9036159 - DNA, 22 bp, Homo sapiens
tcccagggtgaaatgcagtagg

SEQ ID NO: 9036160 - DNA, 21 bp, Homo sapiens
tcccagggtcttatgggatgt

SEQ ID NO: 9036161 - DNA, 21 bp, Homo sapiens
tcccagggtcttatgggatgt

SEQ ID NO: 9036162 - DNA, 21 bp, Homo sapiens
tcccagggtcttatgggatgt

SEQ ID NO: 9036163 - DNA, 22 bp, Homo sapiens
tcccagggttacagccagggca

SEQ ID NO: 9036164 - DNA, 22 bp, Homo sapiens
tcccagggttacagccagggca

SEQ ID NO: 9036165 - DNA, 22 bp, Homo sapiens
tcccagggtgcgcctgccctcg

SEQ ID NO: 9036166 - DNA, 22 bp, Homo sapiens
tcccagggtgcgcctgccctcg

SEQ ID NO: 9036167 - DNA, 22 bp, Homo sapiens
tcccagggttacagccagggca

SEQ ID NO: 9036168 - DNA, 22 bp, Homo sapiens
tcccaggtgatgctgaggccac

SEQ ID NO: 9036169 - DNA, 22 bp, Homo sapiens
tcccaggttccaccatccaggg

SEQ ID NO: 9036170 - DNA, 22 bp, Homo sapiens
tcccaggtctttgggttcctca

SEQ ID NO: 9036171 - DNA, 22 bp, Homo sapiens
tcccagggttacagccagggca

SEQ ID NO: 9036172 - DNA, 22 bp, Homo sapiens
tcccagggttacagccagggca

SEQ ID NO: 9036173 - DNA, 22 bp, Homo sapiens
tcccatagatttttcagggtta

SEQ ID NO: 9036174 - DNA, 22 bp, Homo sapiens
tcccagtttttctccactaagg

SEQ ID NO: 9036175 - DNA, 22 bp, Homo sapiens
tcccagtttttctccactaagg

SEQ ID NO: 9036176 - DNA, 22 bp, Homo sapiens
tcccagtggtcttgaaacaggg

SEQ ID NO: 9036177 - DNA, 22 bp, Homo sapiens
tcccagtgggtgactggaggct

SEQ ID NO: 9036178 - DNA, 22 bp, Homo sapiens
tcccagtctagagccggattgg

SEQ ID NO: 9036179 - DNA, 20 bp, Homo sapiens
tcccagtcagccagagtgag

SEQ ID NO: 9036180 - DNA, 20 bp, Homo sapiens
tcccagtcagccagagtgag

SEQ ID NO: 9036181 - DNA, 22 bp, Homo sapiens
tcccaggttccaccatccaggg

SEQ ID NO: 9036182 - DNA, 20 bp, Homo sapiens
tcccagtcagccagagtgag

SEQ ID NO: 9036183 - DNA, 22 bp, Homo sapiens
tcccagtgaggtcctggctgtc

SEQ ID NO: 9036184 - DNA, 20 bp, Homo sapiens
tcccagtctttggtctgagc

SEQ ID NO: 9036185 - DNA, 22 bp, Homo sapiens
tcccagtgctacagacagggca

SEQ ID NO: 9036186 - DNA, 22 bp, Homo sapiens
tcccagtgctgctaaagaggta

SEQ ID NO: 9036187 - DNA, 22 bp, Homo sapiens
tcccagtgctacagacagggca

SEQ ID NO: 9036188 - DNA, 22 bp, Homo sapiens
tcccatgttaccaaggagtcac

SEQ ID NO: 9036189 - DNA, 22 bp, Homo sapiens
tcccatttatctagatgtcaga

SEQ ID NO: 9036190 - DNA, 22 bp, Homo sapiens
tcccatttcacaacaaaactgg

SEQ ID NO: 9036191 - DNA, 22 bp, Homo sapiens
tcccatttattaattagtttgc

SEQ ID NO: 9036192 - DNA, 18 bp, Homo sapiens
tcccatcatcctctccag

SEQ ID NO: 9036193 - DNA, 22 bp, Homo sapiens
tcccatcactagcatctgcacc

SEQ ID NO: 9036194 - DNA, 22 bp, Homo sapiens
tcccatcactagcatctgcacc

SEQ ID NO: 9036195 - DNA, 20 bp, Homo sapiens
tcccatcacgcctgtgccag

SEQ ID NO: 9036196 - DNA, 20 bp, Homo sapiens
tcccatcacgcctgtgccag

SEQ ID NO: 9036197 - DNA, 22 bp, Homo sapiens
tcccatggtctatatagaggca

SEQ ID NO: 9036198 - DNA, 23 bp, Homo sapiens
tcccatgggctcactgccctgca

SEQ ID NO: 9036199 - DNA, 22 bp, Homo sapiens
tcccatctccaacatttttctt

SEQ ID NO: 9036200 - DNA, 22 bp, Homo sapiens
tcccatcatctgttctggctac

SEQ ID NO: 9036201 - DNA, 22 bp, Homo sapiens
tccagagatcacactgggcagg

SEQ ID NO: 9036202 - DNA, 22 bp, Homo sapiens
tccagagcaaagtttgctaaca

SEQ ID NO: 9036203 - DNA, 17 bp, Homo sapiens
tccagagcacagagctc

SEQ ID NO: 9036204 - DNA, 17 bp, Homo sapiens
tccagagcacagagctc

SEQ ID NO: 9036205 - DNA, 17 bp, Homo sapiens
tccagagcacagagctc

SEQ ID NO: 9036206 - DNA, 17 bp, Homo sapiens
tccagagcacagagctc

SEQ ID NO: 9036207 - DNA, 22 bp, Homo sapiens
tccagagcaggtggtcagaagg

SEQ ID NO: 9036208 - DNA, 22 bp, Homo sapiens
tccagagcaggtgtctacacag

SEQ ID NO: 9036209 - DNA, 18 bp, Homo sapiens
tccagagcagtctttggc

SEQ ID NO: 9036210 - DNA, 17 bp, Homo sapiens
tccagagcacagagctc

SEQ ID NO: 9036211 - DNA, 22 bp, Homo sapiens
tccagagcaggtgtctacacag

SEQ ID NO: 9036212 - DNA, 22 bp, Homo sapiens
tccagagcaggtggtcagaagg

SEQ ID NO: 9036213 - DNA, 22 bp, Homo sapiens
tccagagcaggtggtcagaagg

SEQ ID NO: 9036214 - DNA, 22 bp, Homo sapiens
tccagagccccaattcacctct

SEQ ID NO: 9036215 - DNA, 22 bp, Homo sapiens
tccagagccccagtctagtggg

SEQ ID NO: 9036216 - DNA, 22 bp, Homo sapiens
tccagagccccagtctagtggg

SEQ ID NO: 9036217 - DNA, 22 bp, Homo sapiens
tccagagccccagtctagtggg

SEQ ID NO: 9036218 - DNA, 22 bp, Homo sapiens
tccagagccccaattcacctct

SEQ ID NO: 9036219 - DNA, 22 bp, Homo sapiens
tccagagcatgcagatcatcaa

SEQ ID NO: 9036220 - DNA, 18 bp, Homo sapiens
tccagagcagtctttggc

SEQ ID NO: 9036221 - DNA, 18 bp, Homo sapiens
tccagagcagtctttggc

SEQ ID NO: 9036222 - DNA, 22 bp, Homo sapiens
tccagagcctggggtttgtaac

SEQ ID NO: 9036223 - DNA, 22 bp, Homo sapiens
tccagagccttcgataagaaga

SEQ ID NO: 9036224 - DNA, 22 bp, Homo sapiens
tccagagcctttccacccactt

SEQ ID NO: 9036225 - DNA, 22 bp, Homo sapiens
tccagagccttcgataagaaga

SEQ ID NO: 9036226 - DNA, 22 bp, Homo sapiens
tccagagcctttctgcttgaca

SEQ ID NO: 9036227 - DNA, 22 bp, Homo sapiens
tccagagcctgcgcactggctg

SEQ ID NO: 9036228 - DNA, 22 bp, Homo sapiens
tccagagcctgcgcactggctg

SEQ ID NO: 9036229 - DNA, 22 bp, Homo sapiens
tccagagcctgcgcactggctg

SEQ ID NO: 9036230 - DNA, 22 bp, Homo sapiens
tccagagcctgcgcactggctg

SEQ ID NO: 9036231 - DNA, 22 bp, Homo sapiens
tccagagcctgcgcactggctg

SEQ ID NO: 9036232 - DNA, 22 bp, Homo sapiens
tccagagcctatatgttcaact

SEQ ID NO: 9036233 - DNA, 22 bp, Homo sapiens
tccagagcctgcgcactggctg

SEQ ID NO: 9036234 - DNA, 18 bp, Homo sapiens
tccagagctactgtggtg

SEQ ID NO: 9036235 - DNA, 22 bp, Homo sapiens
tccagagctaattcagcagctg

SEQ ID NO: 9036236 - DNA, 22 bp, Homo sapiens
tccagagctaattcagcagctg

SEQ ID NO: 9036237 - DNA, 22 bp, Homo sapiens
tccagagctaattcagcagctg

SEQ ID NO: 9036238 - DNA, 22 bp, Homo sapiens
tccagagctaattcagcagctg

SEQ ID NO: 9036239 - DNA, 22 bp, Homo sapiens
tccagagctaattcagcagctg

SEQ ID NO: 9036240 - DNA, 22 bp, Homo sapiens
tccagagctaattcagcagctg

SEQ ID NO: 9036241 - DNA, 22 bp, Homo sapiens
tccagagctacttgctcaactt

SEQ ID NO: 9036242 - DNA, 22 bp, Homo sapiens
tccagagctacttgctcaactt

SEQ ID NO: 9036243 - DNA, 22 bp, Homo sapiens
tccagagctacttgctcaactt

SEQ ID NO: 9036244 - DNA, 22 bp, Homo sapiens
tccagagctacttgctcaactt

SEQ ID NO: 9036245 - DNA, 23 bp, Homo sapiens
tccagagctcatgctctcaacca

SEQ ID NO: 9036246 - DNA, 18 bp, Homo sapiens
tccagagctactgtggtg

SEQ ID NO: 9036247 - DNA, 18 bp, Homo sapiens
tccagagctactgtggtg

SEQ ID NO: 9036248 - DNA, 22 bp, Homo sapiens
tccagagctacttgctcaactt

SEQ ID NO: 9036249 - DNA, 18 bp, Homo sapiens
tccagagctactgtggtg

SEQ ID NO: 9036250 - DNA, 18 bp, Homo sapiens
tccagagctactgtggtg

SEQ ID NO: 9036251 - DNA, 22 bp, Homo sapiens
tcattgacagttgtttcaaata

SEQ ID NO: 9036252 - DNA, 22 bp, Homo sapiens
tcattgacttgaagaaaacaat

SEQ ID NO: 9036253 - DNA, 22 bp, Homo sapiens
tcattgacagttgtttcaaata

SEQ ID NO: 9036254 - DNA, 22 bp, Homo sapiens
tcattgaatgctctgcaggttg

SEQ ID NO: 9036255 - DNA, 22 bp, Homo sapiens
tcattgaatttggttcaatatg

SEQ ID NO: 9036256 - DNA, 22 bp, Homo sapiens
tcattgaatttggttcaatatg

SEQ ID NO: 9036257 - DNA, 22 bp, Homo sapiens
tcattgatggcttctttcttgc

SEQ ID NO: 9036258 - DNA, 22 bp, Homo sapiens
tcattgcaagctcatttatctg

SEQ ID NO: 9036259 - DNA, 22 bp, Homo sapiens
tcattgcaagctcatttatctg

SEQ ID NO: 9036260 - DNA, 23 bp, Homo sapiens
tcattgatcttgtcagagcattt

SEQ ID NO: 9036261 - DNA, 22 bp, Homo sapiens
tcattgaatgagatgcaataga

SEQ ID NO: 9036262 - DNA, 22 bp, Homo sapiens
tcattgaatgagatgcaataga

SEQ ID NO: 9036263 - DNA, 22 bp, Homo sapiens
tcattgaatatggggccataca

SEQ ID NO: 9036264 - DNA, 22 bp, Homo sapiens
tcattgaattctgggggttgag

SEQ ID NO: 9036265 - DNA, 22 bp, Homo sapiens
tcattgaatttcacagctttat

SEQ ID NO: 9036266 - DNA, 22 bp, Homo sapiens
tcattgaagcccttgacaagcc

SEQ ID NO: 9036267 - DNA, 22 bp, Homo sapiens
tcattgaagcccttgacaagcc

SEQ ID NO: 9036268 - DNA, 22 bp, Homo sapiens
tcattgaagcattttgtgtatt

SEQ ID NO: 9036269 - DNA, 22 bp, Homo sapiens
tcattgaagacttactggcttc

SEQ ID NO: 9036270 - DNA, 22 bp, Homo sapiens
tcattgaagtgactgaaagatt

SEQ ID NO: 9036271 - DNA, 22 bp, Homo sapiens
tcattgaatacatatttgggat

SEQ ID NO: 9036272 - DNA, 20 bp, Homo sapiens
tccagacatctagctcagtt

SEQ ID NO: 9036273 - DNA, 19 bp, Homo sapiens
tccagaagtccctgagcgg

SEQ ID NO: 9036274 - DNA, 22 bp, Homo sapiens
tccagaatactctgaaatcatt

SEQ ID NO: 9036275 - DNA, 20 bp, Homo sapiens
tccagacatctagctcagtt

SEQ ID NO: 9036276 - DNA, 22 bp, Homo sapiens
tccagacattttatagcagtct

SEQ ID NO: 9036277 - DNA, 20 bp, Homo sapiens
tccagagagtggcaaagctc

SEQ ID NO: 9036278 - DNA, 20 bp, Homo sapiens
tccagagagtggcaaagctc

SEQ ID NO: 9036279 - DNA, 20 bp, Homo sapiens
tccagagagtggcaaagctc

SEQ ID NO: 9036280 - DNA, 22 bp, Homo sapiens
tccagacattttatagcagtct

SEQ ID NO: 9036281 - DNA, 19 bp, Homo sapiens
tccagaactgccctggcct

SEQ ID NO: 9036282 - DNA, 22 bp, Homo sapiens
tcattgcagttgagttgtgtta

SEQ ID NO: 9036283 - DNA, 19 bp, Homo sapiens
tccagaagtccctgagcgg

SEQ ID NO: 9036284 - DNA, 19 bp, Homo sapiens
tccagaagtccctgagcgg

SEQ ID NO: 9036285 - DNA, 22 bp, Homo sapiens
tcattgcagtgatgttgtatgt

SEQ ID NO: 9036286 - DNA, 22 bp, Homo sapiens
tcattgcagaaataaaggtgaa

SEQ ID NO: 9036287 - DNA, 22 bp, Homo sapiens
tccagcagactcatcagcaagg

SEQ ID NO: 9036288 - DNA, 22 bp, Homo sapiens
tccagcagactcatcagcaagg

SEQ ID NO: 9036289 - DNA, 22 bp, Homo sapiens
tccagcagactcatcagcaagg

SEQ ID NO: 9036290 - DNA, 22 bp, Homo sapiens
tccagcagactcatcagcaagg

SEQ ID NO: 9036291 - DNA, 22 bp, Homo sapiens
tccagcagaccatcaaggctca

SEQ ID NO: 9036292 - DNA, 22 bp, Homo sapiens
tccagcagaccatcaaggctca

SEQ ID NO: 9036293 - DNA, 22 bp, Homo sapiens
tccagcagaccatcaaggctca

SEQ ID NO: 9036294 - DNA, 22 bp, Homo sapiens
tccagcagaccatcaaggctca

SEQ ID NO: 9036295 - DNA, 23 bp, Homo sapiens
tccagcagagccttccaggaggg

SEQ ID NO: 9036296 - DNA, 23 bp, Homo sapiens
tccagcagagccttccaggaggg

SEQ ID NO: 9036297 - DNA, 23 bp, Homo sapiens
tccagcagagccttccaggaggg

SEQ ID NO: 9036298 - DNA, 23 bp, Homo sapiens
tccagcagagccttccaggaggg

SEQ ID NO: 9036299 - DNA, 22 bp, Homo sapiens
tccagcagactcatcagcaagg

SEQ ID NO: 9036300 - DNA, 23 bp, Homo sapiens
tccagcagagccttccaggaggg

SEQ ID NO: 9036301 - DNA, 22 bp, Homo sapiens
tccagcagagtctctgaggggg

SEQ ID NO: 9036302 - DNA, 22 bp, Homo sapiens
tccagcagagtctctgaggggg

SEQ ID NO: 9036303 - DNA, 22 bp, Homo sapiens
tccagcagaggttgataatacc

SEQ ID NO: 9036304 - DNA, 22 bp, Homo sapiens
tccagcagaggttgataatacc

SEQ ID NO: 9036305 - DNA, 18 bp, Homo sapiens
tccagcagcatagtttcc

SEQ ID NO: 9036306 - DNA, 22 bp, Homo sapiens
tccagcagagtctctgaggggg

SEQ ID NO: 9036307 - DNA, 22 bp, Homo sapiens
tccagcagagtctctgaggggg

SEQ ID NO: 9036308 - DNA, 23 bp, Homo sapiens
tccagcagccaagaagggtagaa

SEQ ID NO: 9036309 - DNA, 23 bp, Homo sapiens
tccagcagccaagaagggtagaa

SEQ ID NO: 9036310 - DNA, 18 bp, Homo sapiens
tccagcagcatagtttcc

SEQ ID NO: 9036311 - DNA, 23 bp, Homo sapiens
tccagcagccaagaagggtagaa

SEQ ID NO: 9036312 - DNA, 23 bp, Homo sapiens
tccagcagccaagaagggtagaa

SEQ ID NO: 9036313 - DNA, 23 bp, Homo sapiens
tccagcagccaagaagggtagaa

SEQ ID NO: 9036314 - DNA, 18 bp, Homo sapiens
tccagcaggtctgaggtg

SEQ ID NO: 9036315 - DNA, 18 bp, Homo sapiens
tccagcaggtctgaggtg

SEQ ID NO: 9036316 - DNA, 18 bp, Homo sapiens
tccagcaggtctgaggtg

SEQ ID NO: 9036317 - DNA, 18 bp, Homo sapiens
tccagcaggtctgaggtg

SEQ ID NO: 9036318 - DNA, 22 bp, Homo sapiens
tccagcaggtgtttgccaactt

SEQ ID NO: 9036319 - DNA, 22 bp, Homo sapiens
tccagcaggtgtttgccaactt

SEQ ID NO: 9036320 - DNA, 22 bp, Homo sapiens
tccagcaggtgtttgccaactt

SEQ ID NO: 9036321 - DNA, 22 bp, Homo sapiens
tccagcaggtccgagacaagtt

SEQ ID NO: 9036322 - DNA, 22 bp, Homo sapiens
tccagcaggtccgagacaagtt

SEQ ID NO: 9036323 - DNA, 22 bp, Homo sapiens
tccagcaggtccgagacaagtt

SEQ ID NO: 9036324 - DNA, 22 bp, Homo sapiens
tccagcaggtccgagacaagtt

SEQ ID NO: 9036325 - DNA, 22 bp, Homo sapiens
tccagcaggtccgagacaagtt

SEQ ID NO: 9036326 - DNA, 22 bp, Homo sapiens
tccagcaggtccgagacaagtt

SEQ ID NO: 9036327 - DNA, 22 bp, Homo sapiens
tccagcaggtccgagacaagtt

SEQ ID NO: 9036328 - DNA, 22 bp, Homo sapiens
tccagcaggtccgagacaagtt

SEQ ID NO: 9036329 - DNA, 22 bp, Homo sapiens
tccagcaggtccgagacaagtt

SEQ ID NO: 9036330 - DNA, 22 bp, Homo sapiens
tccagcagcctgacttccctct

SEQ ID NO: 9036331 - DNA, 22 bp, Homo sapiens
tccagcagcctgacttccctct

SEQ ID NO: 9036332 - DNA, 22 bp, Homo sapiens
tccagcagggaattagtagtct

SEQ ID NO: 9036333 - DNA, 22 bp, Homo sapiens
tccagcagggaattagtagtct

SEQ ID NO: 9036334 - DNA, 22 bp, Homo sapiens
tccagcagcccgaaggcccatc

SEQ ID NO: 9036335 - DNA, 22 bp, Homo sapiens
tccagcagcccgaaggcccatc

SEQ ID NO: 9036336 - DNA, 22 bp, Homo sapiens
tccagcagcccgaaggcccatc

SEQ ID NO: 9036337 - DNA, 22 bp, Homo sapiens
tccagcagcccgaaggcccatc

SEQ ID NO: 9036338 - DNA, 22 bp, Homo sapiens
tccagcagccacacctctggac

SEQ ID NO: 9036339 - DNA, 22 bp, Homo sapiens
tccagcagccacacctctggac

SEQ ID NO: 9036340 - DNA, 22 bp, Homo sapiens
tccagcagccacacctctggac

SEQ ID NO: 9036341 - DNA, 22 bp, Homo sapiens
tccagcagccacacctctggac

SEQ ID NO: 9036342 - DNA, 22 bp, Homo sapiens
tccagcagcccgaaggcccatc

SEQ ID NO: 9036343 - DNA, 22 bp, Homo sapiens
tccagcagccacacctctggac

SEQ ID NO: 9036344 - DNA, 22 bp, Homo sapiens
tccagcagccacacctctggac

SEQ ID NO: 9036345 - DNA, 22 bp, Homo sapiens
tccagcagccacacctctggac

SEQ ID NO: 9036346 - DNA, 22 bp, Homo sapiens
tccagaggctccaaagggagat

SEQ ID NO: 9036347 - DNA, 20 bp, Homo sapiens
tccagaggccacatccagtg

SEQ ID NO: 9036348 - DNA, 22 bp, Homo sapiens
tccagaggcagctgcggtcagg

SEQ ID NO: 9036349 - DNA, 22 bp, Homo sapiens
tccagaggcagctgcggtcagg

SEQ ID NO: 9036350 - DNA, 20 bp, Homo sapiens
tccagaggccacatccagtg

SEQ ID NO: 9036351 - DNA, 20 bp, Homo sapiens
tccagaggccacatccagtg

SEQ ID NO: 9036352 - DNA, 22 bp, Homo sapiens
tccagaggctctgagggagagt

SEQ ID NO: 9036353 - DNA, 22 bp, Homo sapiens
tccagaggctctgagggagagt

SEQ ID NO: 9036354 - DNA, 22 bp, Homo sapiens
tccagaggctccaaagggagat

SEQ ID NO: 9036355 - DNA, 22 bp, Homo sapiens
tccagaggctccaaagggagat

SEQ ID NO: 9036356 - DNA, 22 bp, Homo sapiens
tccagaggctccaaagggagat

SEQ ID NO: 9036357 - DNA, 22 bp, Homo sapiens
tccagaggggcagccctgtgct

SEQ ID NO: 9036358 - DNA, 22 bp, Homo sapiens
tccagaggggcagccctgtgct

SEQ ID NO: 9036359 - DNA, 22 bp, Homo sapiens
tccagaggtatgtagagagtat

SEQ ID NO: 9036360 - DNA, 22 bp, Homo sapiens
tccagaggggcagccctgtgct

SEQ ID NO: 9036361 - DNA, 22 bp, Homo sapiens
tccagagggcgatggctggggg

SEQ ID NO: 9036362 - DNA, 22 bp, Homo sapiens
tccagagggcgatggctggggg

SEQ ID NO: 9036363 - DNA, 22 bp, Homo sapiens
tccagagggcgatggctggggg

SEQ ID NO: 9036364 - DNA, 22 bp, Homo sapiens
tccagagggcgatggctggggg

SEQ ID NO: 9036365 - DNA, 22 bp, Homo sapiens
tccagagggcgatggctggggg

SEQ ID NO: 9036366 - DNA, 22 bp, Homo sapiens
tccagagctctgggcatagctg

SEQ ID NO: 9036367 - DNA, 23 bp, Homo sapiens
tccagagctcatgctctcaacca

SEQ ID NO: 9036368 - DNA, 22 bp, Homo sapiens
tccagagctctgggcatagctg

SEQ ID NO: 9036369 - DNA, 22 bp, Homo sapiens
tccagagctctgggcatagctg

SEQ ID NO: 9036370 - DNA, 22 bp, Homo sapiens
tccagagctgagcagtcattct

SEQ ID NO: 9036371 - DNA, 22 bp, Homo sapiens
tccagagctgagcagtcattct

SEQ ID NO: 9036372 - DNA, 23 bp, Homo sapiens
tccagagctcatgctctcaacca

SEQ ID NO: 9036373 - DNA, 22 bp, Homo sapiens
tccagagctctgggcatagctg

SEQ ID NO: 9036374 - DNA, 22 bp, Homo sapiens
tccagagctgagcagtcattct

SEQ ID NO: 9036375 - DNA, 22 bp, Homo sapiens
tccagagctgggtctgtgctca

SEQ ID NO: 9036376 - DNA, 22 bp, Homo sapiens
tccagagctgggtctgtgctca

SEQ ID NO: 9036377 - DNA, 22 bp, Homo sapiens
tccagagctgggtctgtgctca

SEQ ID NO: 9036378 - DNA, 22 bp, Homo sapiens
tccagagctgggtctgtgctca

SEQ ID NO: 9036379 - DNA, 22 bp, Homo sapiens
tccagagctgggtctgtgctca

SEQ ID NO: 9036380 - DNA, 22 bp, Homo sapiens
tccagagctgagggtcagtaga

SEQ ID NO: 9036381 - DNA, 22 bp, Homo sapiens
tccagagctgggtctgtgctca

SEQ ID NO: 9036382 - DNA, 22 bp, Homo sapiens
tccagagctgggtctgtgctca

SEQ ID NO: 9036383 - DNA, 18 bp, Homo sapiens
tccagagctggtgcttct

SEQ ID NO: 9036384 - DNA, 22 bp, Homo sapiens
tccagagctgtatgattttttt

SEQ ID NO: 9036385 - DNA, 22 bp, Homo sapiens
tccagagctgtcctactgtgag

SEQ ID NO: 9036386 - DNA, 22 bp, Homo sapiens
tccagagctgtcctactgtgag

SEQ ID NO: 9036387 - DNA, 22 bp, Homo sapiens
tccagagctgtcctactgtgag

SEQ ID NO: 9036388 - DNA, 18 bp, Homo sapiens
tccagagctggtgcttct

SEQ ID NO: 9036389 - DNA, 22 bp, Homo sapiens
tccagagctgtatgattttttt

SEQ ID NO: 9036390 - DNA, 22 bp, Homo sapiens
tccagagctgtcctactgtgag

SEQ ID NO: 9036391 - DNA, 14 bp, Homo sapiens
tccagagctttccg

SEQ ID NO: 9036392 - DNA, 22 bp, Homo sapiens
tccagaggcaaaaaggtatgga

SEQ ID NO: 9036393 - DNA, 22 bp, Homo sapiens
tccagaggcaaaaaggtatgga

SEQ ID NO: 9036394 - DNA, 22 bp, Homo sapiens
tccagaggcaaaaaggtatgga

SEQ ID NO: 9036395 - DNA, 22 bp, Homo sapiens
tccagctgtagtggatttgaga

SEQ ID NO: 9036396 - DNA, 22 bp, Homo sapiens
tccagctgtactttgtcctggc

SEQ ID NO: 9036397 - DNA, 19 bp, Homo sapiens
tccagctggtatgcccaga

SEQ ID NO: 9036398 - DNA, 22 bp, Homo sapiens
tccagctggggccgaagtggat

SEQ ID NO: 9036399 - DNA, 19 bp, Homo sapiens
tccagctggtatgcccaga

SEQ ID NO: 9036400 - DNA, 20 bp, Homo sapiens
tccagctgtctttcagagac

SEQ ID NO: 9036401 - DNA, 20 bp, Homo sapiens
tccagctgtctttcagagac

SEQ ID NO: 9036402 - DNA, 21 bp, Homo sapiens
tccagctgtgattatgaatgt

SEQ ID NO: 9036403 - DNA, 22 bp, Homo sapiens
tccagctgtgctccaggaggtg

SEQ ID NO: 9036404 - DNA, 22 bp, Homo sapiens
tccagctgtgctccaggaggtg

SEQ ID NO: 9036405 - DNA, 22 bp, Homo sapiens
tccagctgttccatcagctctt

SEQ ID NO: 9036406 - DNA, 22 bp, Homo sapiens
tccagctgtgctccaggaggtg

SEQ ID NO: 9036407 - DNA, 22 bp, Homo sapiens
tccagctgtgctccaggaggtg

SEQ ID NO: 9036408 - DNA, 22 bp, Homo sapiens
tccagctctggcttggctagct

SEQ ID NO: 9036409 - DNA, 22 bp, Homo sapiens
tccagctctggcttggctagct

SEQ ID NO: 9036410 - DNA, 21 bp, Homo sapiens
tccagctcttatgttcatgaa

SEQ ID NO: 9036411 - DNA, 22 bp, Homo sapiens
tccagctctggcttggctagct

SEQ ID NO: 9036412 - DNA, 22 bp, Homo sapiens
tccagctggggcagtggctggg

SEQ ID NO: 9036413 - DNA, 22 bp, Homo sapiens
tccagctggggacatgggcttc

SEQ ID NO: 9036414 - DNA, 22 bp, Homo sapiens
tccagctcttcagttctgcaaa

SEQ ID NO: 9036415 - DNA, 22 bp, Homo sapiens
tccagctggggccgaagtggat

SEQ ID NO: 9036416 - DNA, 22 bp, Homo sapiens
tccagctggggcagtggctggg

SEQ ID NO: 9036417 - DNA, 22 bp, Homo sapiens
tccagctctaacatgctgggcc

SEQ ID NO: 9036418 - DNA, 22 bp, Homo sapiens
tccagctctaacatgctgggcc

SEQ ID NO: 9036419 - DNA, 22 bp, Homo sapiens
tccagctctaaggctgatagcc

SEQ ID NO: 9036420 - DNA, 22 bp, Homo sapiens
tccagctctaaggctgatagcc

SEQ ID NO: 9036421 - DNA, 22 bp, Homo sapiens
tccagctctaaggctgatagcc

SEQ ID NO: 9036422 - DNA, 22 bp, Homo sapiens
tccagctctaaggctgatagcc

SEQ ID NO: 9036423 - DNA, 22 bp, Homo sapiens
tccagctctaaggctgatagcc

SEQ ID NO: 9036424 - DNA, 21 bp, Homo sapiens
tccagctcctgccactcctta

SEQ ID NO: 9036425 - DNA, 21 bp, Homo sapiens
tccagctcctgccactcctta

SEQ ID NO: 9036426 - DNA, 22 bp, Homo sapiens
tccagctcctgagttcactgct

SEQ ID NO: 9036427 - DNA, 22 bp, Homo sapiens
tccagctcctgagttcactgct

SEQ ID NO: 9036428 - DNA, 18 bp, Homo sapiens
tccagctctgccacttac

SEQ ID NO: 9036429 - DNA, 18 bp, Homo sapiens
tccagctctgccacttac

SEQ ID NO: 9036430 - DNA, 22 bp, Homo sapiens
tccagctctgattctcactagc

SEQ ID NO: 9036431 - DNA, 22 bp, Homo sapiens
tccagctctgattctcactagc

SEQ ID NO: 9036432 - DNA, 21 bp, Homo sapiens
tccagctctcatagtgttcca

SEQ ID NO: 9036433 - DNA, 21 bp, Homo sapiens
tccagctctcatagtgttcca

SEQ ID NO: 9036434 - DNA, 22 bp, Homo sapiens
tccagctctgattctcactagc

SEQ ID NO: 9036435 - DNA, 22 bp, Homo sapiens
tccagctctgattctcactagc

SEQ ID NO: 9036436 - DNA, 22 bp, Homo sapiens
tccagctctgctgtgcgccggt

SEQ ID NO: 9036437 - DNA, 22 bp, Homo sapiens
tccagctctgcttcacagtctc

SEQ ID NO: 9036438 - DNA, 22 bp, Homo sapiens
tccagctctgcttcacagtctc

SEQ ID NO: 9036439 - DNA, 22 bp, Homo sapiens
tccagctctgcttcacagtctc

SEQ ID NO: 9036440 - DNA, 22 bp, Homo sapiens
tccagctctggcttggctagct

SEQ ID NO: 9036441 - DNA, 22 bp, Homo sapiens
tccagcttcttgacttggtggt

SEQ ID NO: 9036442 - DNA, 18 bp, Homo sapiens
tccagcttgcacttaaat

SEQ ID NO: 9036443 - DNA, 22 bp, Homo sapiens
tccagcttgacaaatgatttta

SEQ ID NO: 9036444 - DNA, 22 bp, Homo sapiens
tccagcttgcctggtcttttgg

SEQ ID NO: 9036445 - DNA, 22 bp, Homo sapiens
tccagctttcacgctcctgcct

SEQ ID NO: 9036446 - DNA, 22 bp, Homo sapiens
tccagctttcacgctcctgcct

SEQ ID NO: 9036447 - DNA, 22 bp, Homo sapiens
tccagcttgggtgggaggaggt

SEQ ID NO: 9036448 - DNA, 22 bp, Homo sapiens
tccagcttggagagaagtttct

SEQ ID NO: 9036449 - DNA, 22 bp, Homo sapiens
tccagcttggagagaagtttct

SEQ ID NO: 9036450 - DNA, 22 bp, Homo sapiens
tccagcttgcttcaggatggtc

SEQ ID NO: 9036451 - DNA, 22 bp, Homo sapiens
tccagcttcagctcttggatag

SEQ ID NO: 9036452 - DNA, 22 bp, Homo sapiens
tccagcttataggtagatttaa

SEQ ID NO: 9036453 - DNA, 19 bp, Homo sapiens
tccagctgttttgagtcac

SEQ ID NO: 9036454 - DNA, 19 bp, Homo sapiens
tccagctgttttgagtcac

SEQ ID NO: 9036455 - DNA, 22 bp, Homo sapiens
tccagctgttgttttatctcag

SEQ ID NO: 9036456 - DNA, 22 bp, Homo sapiens
tccagctgttgatattctaggt

SEQ ID NO: 9036457 - DNA, 22 bp, Homo sapiens
tccagctgttgatattctaggt

SEQ ID NO: 9036458 - DNA, 20 bp, Homo sapiens
tccagctgttgagatctgag

SEQ ID NO: 9036459 - DNA, 22 bp, Homo sapiens
tccagctgttccatcagctctt

SEQ ID NO: 9036460 - DNA, 22 bp, Homo sapiens
tccaggaaacactcaagccatg

SEQ ID NO: 9036461 - DNA, 22 bp, Homo sapiens
tccaggaaacactcaagccatg

SEQ ID NO: 9036462 - DNA, 22 bp, Homo sapiens
tccaggaaaaggcttgcagggg

SEQ ID NO: 9036463 - DNA, 22 bp, Homo sapiens
tccagcttttattggatgagga

SEQ ID NO: 9036464 - DNA, 22 bp, Homo sapiens
tccaggaaaaggcttgcagggg

SEQ ID NO: 9036465 - DNA, 22 bp, Homo sapiens
tccaggaaacagcatctcagca

SEQ ID NO: 9036466 - DNA, 22 bp, Homo sapiens
tccaggaaacagcatctcagca

SEQ ID NO: 9036467 - DNA, 22 bp, Homo sapiens
tccaggaaacatctccgcctaa

SEQ ID NO: 9036468 - DNA, 22 bp, Homo sapiens
tccaggaaacagcatctcagca

SEQ ID NO: 9036469 - DNA, 22 bp, Homo sapiens
tccagctttggctctagctaca

SEQ ID NO: 9036470 - DNA, 22 bp, Homo sapiens
tccagctttgcctgatcatata

SEQ ID NO: 9036471 - DNA, 22 bp, Homo sapiens
tccagctttgagattttatgga

SEQ ID NO: 9036472 - DNA, 22 bp, Homo sapiens
tccagctttgagattttatgga

SEQ ID NO: 9036473 - DNA, 22 bp, Homo sapiens
tccaggaggctctggttgacgt

SEQ ID NO: 9036474 - DNA, 22 bp, Homo sapiens
tccaggaggctctggttgacgt

SEQ ID NO: 9036475 - DNA, 22 bp, Homo sapiens
tccaggaggctctggttgacgt

SEQ ID NO: 9036476 - DNA, 22 bp, Homo sapiens
tccaggaggcctcatttcctgt

SEQ ID NO: 9036477 - DNA, 22 bp, Homo sapiens
tccaggaggcctcatttcctgt

SEQ ID NO: 9036478 - DNA, 22 bp, Homo sapiens
tccaggaggcctcatttcctgt

SEQ ID NO: 9036479 - DNA, 19 bp, Homo sapiens
tccaggaggctgccattga

SEQ ID NO: 9036480 - DNA, 22 bp, Homo sapiens
tccaggaggctctggttgacgt

SEQ ID NO: 9036481 - DNA, 22 bp, Homo sapiens
tccaggagggattgggctgtgg

SEQ ID NO: 9036482 - DNA, 22 bp, Homo sapiens
tccaggaaagtgggatgtgtgt

SEQ ID NO: 9036483 - DNA, 22 bp, Homo sapiens
tccaggaaagcactgggctggg

SEQ ID NO: 9036484 - DNA, 22 bp, Homo sapiens
tccaggaaagcactgggctggg

SEQ ID NO: 9036485 - DNA, 22 bp, Homo sapiens
tccaggaaagcactgggctggg

SEQ ID NO: 9036486 - DNA, 21 bp, Homo sapiens
tccaggaaagttttaagagtg

SEQ ID NO: 9036487 - DNA, 22 bp, Homo sapiens
tccaggaaatcagaagtggtaa

SEQ ID NO: 9036488 - DNA, 22 bp, Homo sapiens
tccaggaaagtgggatgtgtgt

SEQ ID NO: 9036489 - DNA, 22 bp, Homo sapiens
tccaggaaagtgggatgtgtgt

SEQ ID NO: 9036490 - DNA, 21 bp, Homo sapiens
tccaggaaagttttaagagtg

SEQ ID NO: 9036491 - DNA, 22 bp, Homo sapiens
tccaggaaagtgggatgtgtgt

SEQ ID NO: 9036492 - DNA, 22 bp, Homo sapiens
tccagcagtccatgtgagacac

SEQ ID NO: 9036493 - DNA, 22 bp, Homo sapiens
tccagcagtccatgtgagacac

SEQ ID NO: 9036494 - DNA, 22 bp, Homo sapiens
tccagcagtccatgtgagacac

SEQ ID NO: 9036495 - DNA, 22 bp, Homo sapiens
tccagcagtccatgtgagacac

SEQ ID NO: 9036496 - DNA, 20 bp, Homo sapiens
tccagcagtatgctatactt

SEQ ID NO: 9036497 - DNA, 22 bp, Homo sapiens
tccagcagtaaggaaagtacat

SEQ ID NO: 9036498 - DNA, 22 bp, Homo sapiens
tccagcagtaaggaaagtacat

SEQ ID NO: 9036499 - DNA, 20 bp, Homo sapiens
tccagcagtatgctatactt

SEQ ID NO: 9036500 - DNA, 22 bp, Homo sapiens
tccagcagtccatgtgagacac

SEQ ID NO: 9036501 - DNA, 22 bp, Homo sapiens
tccagcagtaaggaaagtacat

SEQ ID NO: 9036502 - DNA, 22 bp, Homo sapiens
tccagcaggttggtcaggtgca

SEQ ID NO: 9036503 - DNA, 22 bp, Homo sapiens
tccagcaggttggtcaggtgca

SEQ ID NO: 9036504 - DNA, 22 bp, Homo sapiens
tccagcaggttggtcaggtgca

SEQ ID NO: 9036505 - DNA, 22 bp, Homo sapiens
tccagcaggttggtcaggtgca

SEQ ID NO: 9036506 - DNA, 16 bp, Homo sapiens
tccagcagtctctgta

SEQ ID NO: 9036507 - DNA, 22 bp, Homo sapiens
tccagcagtgctcaggactcac

SEQ ID NO: 9036508 - DNA, 22 bp, Homo sapiens
tccagcagtgctcaggactcac

SEQ ID NO: 9036509 - DNA, 22 bp, Homo sapiens
tccagcagtgctcaggactcac

SEQ ID NO: 9036510 - DNA, 22 bp, Homo sapiens
tccagcagtgctcaggactcac

SEQ ID NO: 9036511 - DNA, 22 bp, Homo sapiens
tccagcagtgctcaggactcac

SEQ ID NO: 9036512 - DNA, 22 bp, Homo sapiens
tccagcagtgctctagagcgtg

SEQ ID NO: 9036513 - DNA, 19 bp, Homo sapiens
tccagcagtgcttgaaatc

SEQ ID NO: 9036514 - DNA, 19 bp, Homo sapiens
tccagcagtgcttgaaatc

SEQ ID NO: 9036515 - DNA, 19 bp, Homo sapiens
tccagcagtgcttgaaatc

SEQ ID NO: 9036516 - DNA, 22 bp, Homo sapiens
tccagcagtgctctagagcgtg

SEQ ID NO: 9036517 - DNA, 22 bp, Homo sapiens
tccagcagtgctctagagcgtg

SEQ ID NO: 9036518 - DNA, 22 bp, Homo sapiens
tccagcattcttagacctctat

SEQ ID NO: 9036519 - DNA, 22 bp, Homo sapiens
tccagcattagatgtgaaattg

SEQ ID NO: 9036520 - DNA, 22 bp, Homo sapiens
tccagcattagatgtgaaattg

SEQ ID NO: 9036521 - DNA, 20 bp, Homo sapiens
tccagcatataaactcctct

SEQ ID NO: 9036522 - DNA, 22 bp, Homo sapiens
tccagcatatatagagaatgag

SEQ ID NO: 9036523 - DNA, 23 bp, Homo sapiens
tccagccaaatctggctgacagt

SEQ ID NO: 9036524 - DNA, 22 bp, Homo sapiens
tccagccaactgcctagggagc

SEQ ID NO: 9036525 - DNA, 22 bp, Homo sapiens
tccagccaactgcctagggagc

SEQ ID NO: 9036526 - DNA, 22 bp, Homo sapiens
tccagcatttttcaatagaatt

SEQ ID NO: 9036527 - DNA, 23 bp, Homo sapiens
tccagccaaatctggctgacagt

SEQ ID NO: 9036528 - DNA, 22 bp, Homo sapiens
tccagcctttctactcactgag

SEQ ID NO: 9036529 - DNA, 22 bp, Homo sapiens
tccagcctttctactcactgag

SEQ ID NO: 9036530 - DNA, 22 bp, Homo sapiens
tccagccaatcagagctgaggc

SEQ ID NO: 9036531 - DNA, 22 bp, Homo sapiens
tccagccaatcagagctgaggc

SEQ ID NO: 9036532 - DNA, 22 bp, Homo sapiens
tccagccaagccttggtagctg

SEQ ID NO: 9036533 - DNA, 22 bp, Homo sapiens
tccagccaactgcctagggagc

SEQ ID NO: 9036534 - DNA, 22 bp, Homo sapiens
tccagccaagccttggtagctg

SEQ ID NO: 9036535 - DNA, 22 bp, Homo sapiens
tccagccaagccttggtagctg

SEQ ID NO: 9036536 - DNA, 22 bp, Homo sapiens
tccagccaagccttggtagctg

SEQ ID NO: 9036537 - DNA, 22 bp, Homo sapiens
tccagccaagggaggttactag

SEQ ID NO: 9036538 - DNA, 22 bp, Homo sapiens
tccagccaatcagagctgaggc

SEQ ID NO: 9036539 - DNA, 22 bp, Homo sapiens
tccagccaagggaggttactag

SEQ ID NO: 9036540 - DNA, 18 bp, Homo sapiens
tccagcgtgctccagggc

SEQ ID NO: 9036541 - DNA, 22 bp, Homo sapiens
tccagcctttctactcactgag

SEQ ID NO: 9036542 - DNA, 22 bp, Homo sapiens
tccagctcaaagtgctcctgtc

SEQ ID NO: 9036543 - DNA, 22 bp, Homo sapiens
tccagctaacacctactggcca

SEQ ID NO: 9036544 - DNA, 22 bp, Homo sapiens
tccagctcaaagtgctcctgtc

SEQ ID NO: 9036545 - DNA, 22 bp, Homo sapiens
tccagctcaaagtgctcctgtc

SEQ ID NO: 9036546 - DNA, 22 bp, Homo sapiens
tccagctcaaattcagcttcca

SEQ ID NO: 9036547 - DNA, 22 bp, Homo sapiens
tccagctcacagatagcgtggg

SEQ ID NO: 9036548 - DNA, 22 bp, Homo sapiens
tccagctcaaattcagcttcca

SEQ ID NO: 9036549 - DNA, 22 bp, Homo sapiens
tccagctcagatgcagggatca

SEQ ID NO: 9036550 - DNA, 18 bp, Homo sapiens
tccagctcacagatgggc

SEQ ID NO: 9036551 - DNA, 18 bp, Homo sapiens
tccagctcacagatgggc

SEQ ID NO: 9036552 - DNA, 18 bp, Homo sapiens
tccagctcacagatgggc

SEQ ID NO: 9036553 - DNA, 18 bp, Homo sapiens
tccagctcacagatgggc

SEQ ID NO: 9036554 - DNA, 22 bp, Homo sapiens
tccagctcacagatagcgtggg

SEQ ID NO: 9036555 - DNA, 18 bp, Homo sapiens
tccagctcacagatgggc

SEQ ID NO: 9036556 - DNA, 22 bp, Homo sapiens
tccagctcagatgcagggatca

SEQ ID NO: 9036557 - DNA, 22 bp, Homo sapiens
tccagctcagggttggctcaag

SEQ ID NO: 9036558 - DNA, 22 bp, Homo sapiens
tccagctcagggttggctcaag

SEQ ID NO: 9036559 - DNA, 22 bp, Homo sapiens
tccagctcagggttggctcaag

SEQ ID NO: 9036560 - DNA, 20 bp, Homo sapiens
tccagctcagtttttttgtc

SEQ ID NO: 9036561 - DNA, 22 bp, Homo sapiens
tccagctcagggttggctcaag

SEQ ID NO: 9036562 - DNA, 22 bp, Homo sapiens
tccagctcatctgtctccatta

SEQ ID NO: 9036563 - DNA, 22 bp, Homo sapiens
tccagctcatctgtctccatta

SEQ ID NO: 9036564 - DNA, 22 bp, Homo sapiens
tccagctcatctgtctccatta

SEQ ID NO: 9036565 - DNA, 22 bp, Homo sapiens
tccagctccacagcctccctgt

SEQ ID NO: 9036566 - DNA, 22 bp, Homo sapiens
tccagctccacagcctccctgt

SEQ ID NO: 9036567 - DNA, 22 bp, Homo sapiens
tccagctcccactctcactgct

SEQ ID NO: 9036568 - DNA, 22 bp, Homo sapiens
tccagctcccactctcactgct

SEQ ID NO: 9036569 - DNA, 22 bp, Homo sapiens
tccagctccacagcctccctgt

SEQ ID NO: 9036570 - DNA, 22 bp, Homo sapiens
tccagctcccactctcactgct

SEQ ID NO: 9036571 - DNA, 22 bp, Homo sapiens
tccagctcccactctcactgct

SEQ ID NO: 9036572 - DNA, 22 bp, Homo sapiens
tccagctcccactctcactgct

SEQ ID NO: 9036573 - DNA, 23 bp, Homo sapiens
tccagctcccttcaatggcactg

SEQ ID NO: 9036574 - DNA, 23 bp, Homo sapiens
tccagctcccttcaatggcactg

SEQ ID NO: 9036575 - DNA, 23 bp, Homo sapiens
tccagctcccttcaatggcactg

SEQ ID NO: 9036576 - DNA, 20 bp, Homo sapiens
tccagctccgtgttcttcct

SEQ ID NO: 9036577 - DNA, 20 bp, Homo sapiens
tccagctccgtgttcttcct

SEQ ID NO: 9036578 - DNA, 22 bp, Homo sapiens
tccagctcctctacccgatgcg

SEQ ID NO: 9036579 - DNA, 22 bp, Homo sapiens
tccagctcctctacccgatgcg

SEQ ID NO: 9036580 - DNA, 22 bp, Homo sapiens
tccagctcctgagttcactgct

SEQ ID NO: 9036581 - DNA, 17 bp, Homo sapiens
tccagctcctcattgtt

SEQ ID NO: 9036582 - DNA, 17 bp, Homo sapiens
tccagctcctcattgtt

SEQ ID NO: 9036583 - DNA, 17 bp, Homo sapiens
tccagctcctcattgtt

SEQ ID NO: 9036584 - DNA, 22 bp, Homo sapiens
tccaggctctcaggtgtcagca

SEQ ID NO: 9036585 - DNA, 22 bp, Homo sapiens
tccaggctctcaggtgtcagca

SEQ ID NO: 9036586 - DNA, 22 bp, Homo sapiens
tccaggctctaggctgctctcc

SEQ ID NO: 9036587 - DNA, 22 bp, Homo sapiens
tccaggctctaggctgctctcc

SEQ ID NO: 9036588 - DNA, 22 bp, Homo sapiens
tccaggctctcaggtgtcagca

SEQ ID NO: 9036589 - DNA, 22 bp, Homo sapiens
tccaggctctcaggtgtcagca

SEQ ID NO: 9036590 - DNA, 22 bp, Homo sapiens
tccaggctctaggctgctctcc

SEQ ID NO: 9036591 - DNA, 22 bp, Homo sapiens
tccaggctctaggctgctctcc

SEQ ID NO: 9036592 - DNA, 22 bp, Homo sapiens
tccaggctctaggctgctctcc

SEQ ID NO: 9036593 - DNA, 22 bp, Homo sapiens
tccaggccactgcagaggctct

SEQ ID NO: 9036594 - DNA, 22 bp, Homo sapiens
tccaggccactgcagaggctct

SEQ ID NO: 9036595 - DNA, 22 bp, Homo sapiens
tccaggccactgcagaggctct

SEQ ID NO: 9036596 - DNA, 22 bp, Homo sapiens
tccaggccactgcagaggctct

SEQ ID NO: 9036597 - DNA, 22 bp, Homo sapiens
tccaggccacgacctcctggat

SEQ ID NO: 9036598 - DNA, 22 bp, Homo sapiens
tccaggctcagcacttgctact

SEQ ID NO: 9036599 - DNA, 22 bp, Homo sapiens
tccaggctaggtttacaggaca

SEQ ID NO: 9036600 - DNA, 22 bp, Homo sapiens
tccaggctaggtttacaggaca

SEQ ID NO: 9036601 - DNA, 22 bp, Homo sapiens
tccaggctgcaaggccacaggg

SEQ ID NO: 9036602 - DNA, 22 bp, Homo sapiens
tccaggctgcaaggccacaggg

SEQ ID NO: 9036603 - DNA, 21 bp, Homo sapiens
tccaggctgatgatgtcaact

SEQ ID NO: 9036604 - DNA, 19 bp, Homo sapiens
tccaggctgagagtcagct

SEQ ID NO: 9036605 - DNA, 19 bp, Homo sapiens
tccaggctgagagtcagct

SEQ ID NO: 9036606 - DNA, 22 bp, Homo sapiens
tccaggctgatccatgaagaat

SEQ ID NO: 9036607 - DNA, 22 bp, Homo sapiens
tccaggctgatccatgaagaat

SEQ ID NO: 9036608 - DNA, 22 bp, Homo sapiens
tccaggctgatccatgaagaat

SEQ ID NO: 9036609 - DNA, 23 bp, Homo sapiens
tccaggctgaaggagcagatttt

SEQ ID NO: 9036610 - DNA, 22 bp, Homo sapiens
tccaggctgacgcagctattta

SEQ ID NO: 9036611 - DNA, 22 bp, Homo sapiens
tccaggctctcaggtgtcagca

SEQ ID NO: 9036612 - DNA, 23 bp, Homo sapiens
tccaggctgaaggagcagatttt

SEQ ID NO: 9036613 - DNA, 19 bp, Homo sapiens
tccaggctgagagtcagct

SEQ ID NO: 9036614 - DNA, 19 bp, Homo sapiens
tccaggctgagagtcagct

SEQ ID NO: 9036615 - DNA, 19 bp, Homo sapiens
tccaggctgagagtcagct

SEQ ID NO: 9036616 - DNA, 22 bp, Homo sapiens
tccaggctgacgcagctattta

SEQ ID NO: 9036617 - DNA, 22 bp, Homo sapiens
tccaggccaatgtagcaggccc

SEQ ID NO: 9036618 - DNA, 22 bp, Homo sapiens
tccaggccaatgtagcaggccc

SEQ ID NO: 9036619 - DNA, 22 bp, Homo sapiens
tccaggccaatgtagcaggccc

SEQ ID NO: 9036620 - DNA, 22 bp, Homo sapiens
tccaggcatgttgggaagatga

SEQ ID NO: 9036621 - DNA, 22 bp, Homo sapiens
tccaggcatgttgggaagatga

SEQ ID NO: 9036622 - DNA, 22 bp, Homo sapiens
tccaggccaatgtagcaggccc

SEQ ID NO: 9036623 - DNA, 22 bp, Homo sapiens
tccaggccaatgtagcaggccc

SEQ ID NO: 9036624 - DNA, 22 bp, Homo sapiens
tccaggccaatgtagcaggccc

SEQ ID NO: 9036625 - DNA, 22 bp, Homo sapiens
tccaggccaatgtagcaggccc

SEQ ID NO: 9036626 - DNA, 22 bp, Homo sapiens
tccaggccacatggatggcgat

SEQ ID NO: 9036627 - DNA, 22 bp, Homo sapiens
tccaggccacatggatggcgat

SEQ ID NO: 9036628 - DNA, 22 bp, Homo sapiens
tccaggccacatggatggcgat

SEQ ID NO: 9036629 - DNA, 22 bp, Homo sapiens
tccaggccacatggatggcgat

SEQ ID NO: 9036630 - DNA, 22 bp, Homo sapiens
tccaggccacgacctcctggat

SEQ ID NO: 9036631 - DNA, 22 bp, Homo sapiens
tccaggccacgacctcctggat

SEQ ID NO: 9036632 - DNA, 22 bp, Homo sapiens
tccaggccacgacctcctggat

SEQ ID NO: 9036633 - DNA, 22 bp, Homo sapiens
tccaggccacgacctcctggat

SEQ ID NO: 9036634 - DNA, 22 bp, Homo sapiens
tccaggccacgacctcctggat

SEQ ID NO: 9036635 - DNA, 22 bp, Homo sapiens
tccaggcatgtggccagtactc

SEQ ID NO: 9036636 - DNA, 23 bp, Homo sapiens
tccaggcatgagctctggatgga

SEQ ID NO: 9036637 - DNA, 23 bp, Homo sapiens
tccaggcatgagctctggatgga

SEQ ID NO: 9036638 - DNA, 23 bp, Homo sapiens
tccaggcatgagctctggatgga

SEQ ID NO: 9036639 - DNA, 23 bp, Homo sapiens
tccaggcatgagctctggatgga

SEQ ID NO: 9036640 - DNA, 22 bp, Homo sapiens
tccaggcatcccccaggacaga

SEQ ID NO: 9036641 - DNA, 22 bp, Homo sapiens
tccaggcatcccccaggacaga

SEQ ID NO: 9036642 - DNA, 22 bp, Homo sapiens
tccaggcagggttaagggtcct

SEQ ID NO: 9036643 - DNA, 22 bp, Homo sapiens
tccaggcagggttaagggtcct

SEQ ID NO: 9036644 - DNA, 22 bp, Homo sapiens
tccaggcagttttccaggttgt

SEQ ID NO: 9036645 - DNA, 22 bp, Homo sapiens
tccaggagtttgagactgcagt

SEQ ID NO: 9036646 - DNA, 22 bp, Homo sapiens
tccaggattgtcagccagaagg

SEQ ID NO: 9036647 - DNA, 22 bp, Homo sapiens
tccaggattgcaggtgcacaac

SEQ ID NO: 9036648 - DNA, 22 bp, Homo sapiens
tccaggattgcaggtgcacaac

SEQ ID NO: 9036649 - DNA, 22 bp, Homo sapiens
tccaggcagggcagccatcaag

SEQ ID NO: 9036650 - DNA, 22 bp, Homo sapiens
tccaggcagggcagccatcaag

SEQ ID NO: 9036651 - DNA, 20 bp, Homo sapiens
tccaggcagctcagagtgtc

SEQ ID NO: 9036652 - DNA, 22 bp, Homo sapiens
tccaggagtgctggttagagta

SEQ ID NO: 9036653 - DNA, 22 bp, Homo sapiens
tccaggagtgataaggccactg

SEQ ID NO: 9036654 - DNA, 22 bp, Homo sapiens
tccaggagtgataaggccactg

SEQ ID NO: 9036655 - DNA, 22 bp, Homo sapiens
tccaggagtgataaggccactg

SEQ ID NO: 9036656 - DNA, 22 bp, Homo sapiens
tccaggagtggggcagaggtct

SEQ ID NO: 9036657 - DNA, 22 bp, Homo sapiens
tccaggagtggggcagaggtct

SEQ ID NO: 9036658 - DNA, 21 bp, Homo sapiens
tccaggagtggctgggcaggg

SEQ ID NO: 9036659 - DNA, 21 bp, Homo sapiens
tccaggagtggctgggcaggg

SEQ ID NO: 9036660 - DNA, 22 bp, Homo sapiens
tccaggagtggggcagaggtct

SEQ ID NO: 9036661 - DNA, 22 bp, Homo sapiens
tccaggagtggggcagaggtct

SEQ ID NO: 9036662 - DNA, 22 bp, Homo sapiens
tccaggagtggggcagaggtct

SEQ ID NO: 9036663 - DNA, 22 bp, Homo sapiens
tccaggagtgtgtgctaatggg

SEQ ID NO: 9036664 - DNA, 21 bp, Homo sapiens
tccaggagttctaataggtgt

SEQ ID NO: 9036665 - DNA, 22 bp, Homo sapiens
tccaggagtgtgtgctaatggg

SEQ ID NO: 9036666 - DNA, 22 bp, Homo sapiens
tccaggagtttgacctgtgggc

SEQ ID NO: 9036667 - DNA, 22 bp, Homo sapiens
tccaggagtttgagactgcagt

SEQ ID NO: 9036668 - DNA, 22 bp, Homo sapiens
tccaggagtttgagactgcagt

SEQ ID NO: 9036669 - DNA, 22 bp, Homo sapiens
tccaggagtttgagactgcagt

SEQ ID NO: 9036670 - DNA, 22 bp, Homo sapiens
tccaggagtttgagactgcagt

SEQ ID NO: 9036671 - DNA, 22 bp, Homo sapiens
tccaggagtttgagactgcagt

SEQ ID NO: 9036672 - DNA, 22 bp, Homo sapiens
tccaggagtcctgggagtgatt

SEQ ID NO: 9036673 - DNA, 22 bp, Homo sapiens
tccaggagtcctgggagtgatt

SEQ ID NO: 9036674 - DNA, 22 bp, Homo sapiens
tccaggagtcctgggagtgatt

SEQ ID NO: 9036675 - DNA, 22 bp, Homo sapiens
tccaggagtcctgggagtgatt

SEQ ID NO: 9036676 - DNA, 22 bp, Homo sapiens
tccaggagtcctgggtggcccc

SEQ ID NO: 9036677 - DNA, 22 bp, Homo sapiens
tccaggagtcctgggtggcccc

SEQ ID NO: 9036678 - DNA, 22 bp, Homo sapiens
tccaggagtctagcctcaggcc

SEQ ID NO: 9036679 - DNA, 22 bp, Homo sapiens
tccaggagtctagcctcaggcc

SEQ ID NO: 9036680 - DNA, 22 bp, Homo sapiens
tccaggagtctagcctcaggcc

SEQ ID NO: 9036681 - DNA, 22 bp, Homo sapiens
tccaggagtcctgggtggcccc

SEQ ID NO: 9036682 - DNA, 22 bp, Homo sapiens
tccaggaggtttggaggaagca

SEQ ID NO: 9036683 - DNA, 22 bp, Homo sapiens
tccaggaggtttggaggaagca

SEQ ID NO: 9036684 - DNA, 22 bp, Homo sapiens
tccaggaggtttggaggaagca

SEQ ID NO: 9036685 - DNA, 22 bp, Homo sapiens
tccaggaggtttggaggaagca

SEQ ID NO: 9036686 - DNA, 22 bp, Homo sapiens
tccaggaggtttggaggaagca

SEQ ID NO: 9036687 - DNA, 22 bp, Homo sapiens
tccaggaggttgagtgagttcc

SEQ ID NO: 9036688 - DNA, 22 bp, Homo sapiens
tccaggaggttgagtgagttcc

SEQ ID NO: 9036689 - DNA, 22 bp, Homo sapiens
tccaggagtcagacagatggtg

SEQ ID NO: 9036690 - DNA, 22 bp, Homo sapiens
tccaggagtcagacagatggtg

SEQ ID NO: 9036691 - DNA, 22 bp, Homo sapiens
tccaggagtcagacagatggtg

SEQ ID NO: 9036692 - DNA, 22 bp, Homo sapiens
tccaggagtcagacagatggtg

SEQ ID NO: 9036693 - DNA, 22 bp, Homo sapiens
tccaggagtcctgggagtgatt

SEQ ID NO: 9036694 - DNA, 22 bp, Homo sapiens
tccaggagtcctgggagtgatt

SEQ ID NO: 9036695 - DNA, 22 bp, Homo sapiens
tccaggagtcagacagatggtg

SEQ ID NO: 9036696 - DNA, 22 bp, Homo sapiens
tccaggagtcagacagatggtg

SEQ ID NO: 9036697 - DNA, 22 bp, Homo sapiens
tccaggaggtagtgcttaattt

SEQ ID NO: 9036698 - DNA, 22 bp, Homo sapiens
tccaggagggttttctgccttc

SEQ ID NO: 9036699 - DNA, 22 bp, Homo sapiens
tccaggagggttttctgccttc

SEQ ID NO: 9036700 - DNA, 22 bp, Homo sapiens
tccaggagggttttctgccttc

SEQ ID NO: 9036701 - DNA, 22 bp, Homo sapiens
tccaggagggttttctgccttc

SEQ ID NO: 9036702 - DNA, 22 bp, Homo sapiens
tccaggagggttttctgccttc

SEQ ID NO: 9036703 - DNA, 22 bp, Homo sapiens
tccaggagggggagccgtgccg

SEQ ID NO: 9036704 - DNA, 22 bp, Homo sapiens
tccaggagggggagccgtgccg

SEQ ID NO: 9036705 - DNA, 22 bp, Homo sapiens
tccaggagggggagccgtgccg

SEQ ID NO: 9036706 - DNA, 22 bp, Homo sapiens
tccaggagggattgggctgtgg

SEQ ID NO: 9036707 - DNA, 22 bp, Homo sapiens
tccaggagggattgggctgtgg

SEQ ID NO: 9036708 - DNA, 22 bp, Homo sapiens
tccaggaggttgagactgcagt

SEQ ID NO: 9036709 - DNA, 22 bp, Homo sapiens
tccaggaggttgagactgcagt

SEQ ID NO: 9036710 - DNA, 22 bp, Homo sapiens
tccaggaggttgagactgcagt

SEQ ID NO: 9036711 - DNA, 22 bp, Homo sapiens
tccaggaggttgagactgcagt

SEQ ID NO: 9036712 - DNA, 22 bp, Homo sapiens
tccaggaggttgagactgcagt

SEQ ID NO: 9036713 - DNA, 20 bp, Homo sapiens
tccaggaggttagtgtggct

SEQ ID NO: 9036714 - DNA, 20 bp, Homo sapiens
tccaggaggttagtgtggct

SEQ ID NO: 9036715 - DNA, 20 bp, Homo sapiens
tccaggaggttagtgtggct

SEQ ID NO: 9036716 - DNA, 22 bp, Homo sapiens
tccaggaggttgagactgcagt

SEQ ID NO: 9036717 - DNA, 22 bp, Homo sapiens
tccaggaggtatgagtggcccc

SEQ ID NO: 9036718 - DNA, 22 bp, Homo sapiens
tccaggaggtgaggggaccaaa

SEQ ID NO: 9036719 - DNA, 22 bp, Homo sapiens
tccaggaggtgaggggaccaaa

SEQ ID NO: 9036720 - DNA, 22 bp, Homo sapiens
tccaggaggtgaggggaccaaa

SEQ ID NO: 9036721 - DNA, 22 bp, Homo sapiens
tccaggaggtgaggggaccaaa

SEQ ID NO: 9036722 - DNA, 22 bp, Homo sapiens
tccaggaggtgaggggaccaaa

SEQ ID NO: 9036723 - DNA, 20 bp, Homo sapiens
tccaggaggttagtgtggct

SEQ ID NO: 9036724 - DNA, 20 bp, Homo sapiens
tccaggaggttagtgtggct

SEQ ID NO: 9036725 - DNA, 20 bp, Homo sapiens
tccatgcaaatacagagttt

SEQ ID NO: 9036726 - DNA, 20 bp, Homo sapiens
tccatgcaaatacagagttt

SEQ ID NO: 9036727 - DNA, 22 bp, Homo sapiens
tccatgcagagaactgaagtac

SEQ ID NO: 9036728 - DNA, 22 bp, Homo sapiens
tccatgattggtcatcatagaa

SEQ ID NO: 9036729 - DNA, 22 bp, Homo sapiens
tccatgagggacactggatgct

SEQ ID NO: 9036730 - DNA, 22 bp, Homo sapiens
tccatgagggacactggatgct

SEQ ID NO: 9036731 - DNA, 22 bp, Homo sapiens
tccatgagaacccttggagata

SEQ ID NO: 9036732 - DNA, 22 bp, Homo sapiens
tccatgagaggtaactttacaa

SEQ ID NO: 9036733 - DNA, 22 bp, Homo sapiens
tccatgaggcagggaggctggc

SEQ ID NO: 9036734 - DNA, 22 bp, Homo sapiens
tccatgagctagggattcatca

SEQ ID NO: 9036735 - DNA, 23 bp, Homo sapiens
tccatgagatgtgggcttctagt

SEQ ID NO: 9036736 - DNA, 20 bp, Homo sapiens
tccatcttgggcagaagcag

SEQ ID NO: 9036737 - DNA, 22 bp, Homo sapiens
tccatctgtttactataaagat

SEQ ID NO: 9036738 - DNA, 23 bp, Homo sapiens
tccatctgtgagcatgccctgga

SEQ ID NO: 9036739 - DNA, 22 bp, Homo sapiens
tccatctgtcaaatatcatgct

SEQ ID NO: 9036740 - DNA, 22 bp, Homo sapiens
tccatctgtctttcccatccac

SEQ ID NO: 9036741 - DNA, 22 bp, Homo sapiens
tccatctgtctttcccatccac

SEQ ID NO: 9036742 - DNA, 22 bp, Homo sapiens
tccatctggtgagtgaggagcc

SEQ ID NO: 9036743 - DNA, 22 bp, Homo sapiens
tccatctggtgagtgaggagcc

SEQ ID NO: 9036744 - DNA, 22 bp, Homo sapiens
tccatctggtaaaattcattga

SEQ ID NO: 9036745 - DNA, 22 bp, Homo sapiens
tccatctggtaaaattcattga

SEQ ID NO: 9036746 - DNA, 20 bp, Homo sapiens
tccatctggtataagctgat

SEQ ID NO: 9036747 - DNA, 22 bp, Homo sapiens
tccatctggatggtatgtgtaa

SEQ ID NO: 9036748 - DNA, 22 bp, Homo sapiens
tccatctggagacttcctggtc

SEQ ID NO: 9036749 - DNA, 22 bp, Homo sapiens
tccatctgcatttggtttctgt

SEQ ID NO: 9036750 - DNA, 22 bp, Homo sapiens
tccatccctgactcctcctgga

SEQ ID NO: 9036751 - DNA, 22 bp, Homo sapiens
tccatctcacctgcactctgcg

SEQ ID NO: 9036752 - DNA, 22 bp, Homo sapiens
tccatctcacctgcactctgcg

SEQ ID NO: 9036753 - DNA, 22 bp, Homo sapiens
tccatccaccctgcattatatt

SEQ ID NO: 9036754 - DNA, 22 bp, Homo sapiens
tccatccagattttaagtgctg

SEQ ID NO: 9036755 - DNA, 22 bp, Homo sapiens
tccatccaggccagcagtaatc

SEQ ID NO: 9036756 - DNA, 22 bp, Homo sapiens
tccatccatgtaggaagatggt

SEQ ID NO: 9036757 - DNA, 22 bp, Homo sapiens
tccatccatgtaggaagatggt

SEQ ID NO: 9036758 - DNA, 22 bp, Homo sapiens
tccatccatggatggaaatgtg

SEQ ID NO: 9036759 - DNA, 21 bp, Homo sapiens
tccatccatcagtccagccag

SEQ ID NO: 9036760 - DNA, 22 bp, Homo sapiens
tcccaaggtgctcggcaacagg

SEQ ID NO: 9036761 - DNA, 22 bp, Homo sapiens
tcccaaggtgctcggcaacagg

SEQ ID NO: 9036762 - DNA, 22 bp, Homo sapiens
tcccaaggccaggcatctagaa

SEQ ID NO: 9036763 - DNA, 22 bp, Homo sapiens
tcccaaggccaggcatctagaa

SEQ ID NO: 9036764 - DNA, 22 bp, Homo sapiens
tcccaaggcacagggcagggac

SEQ ID NO: 9036765 - DNA, 22 bp, Homo sapiens
tcccaaggcacagggcagggac

SEQ ID NO: 9036766 - DNA, 20 bp, Homo sapiens
tcccaaggatgcctgggtgt

SEQ ID NO: 9036767 - DNA, 20 bp, Homo sapiens
tccatgcagtttccatacag

SEQ ID NO: 9036768 - DNA, 20 bp, Homo sapiens
tccatgcagtttccatacag

SEQ ID NO: 9036769 - DNA, 22 bp, Homo sapiens
tccatgccaggcagtcgatgca

SEQ ID NO: 9036770 - DNA, 22 bp, Homo sapiens
tcccaagcaatgagtcagggcc

SEQ ID NO: 9036771 - DNA, 20 bp, Homo sapiens
tccatgcagtttccatacag

SEQ ID NO: 9036772 - DNA, 22 bp, Homo sapiens
tcccaagcttagggctctcagt

SEQ ID NO: 9036773 - DNA, 22 bp, Homo sapiens
tcccaagtactaccaatctaat

SEQ ID NO: 9036774 - DNA, 22 bp, Homo sapiens
tcccaattaacaggtatcaggc

SEQ ID NO: 9036775 - DNA, 21 bp, Homo sapiens
tcccacagaaactgcgaaatt

SEQ ID NO: 9036776 - DNA, 21 bp, Homo sapiens
tcccacagaaactgcgaaatt

SEQ ID NO: 9036777 - DNA, 22 bp, Homo sapiens
tcccacagcttcgtgcttcccc

SEQ ID NO: 9036778 - DNA, 21 bp, Homo sapiens
tcccacagcgccagctcctgt

SEQ ID NO: 9036779 - DNA, 21 bp, Homo sapiens
tcccacagcgccagctcctgt

SEQ ID NO: 9036780 - DNA, 22 bp, Homo sapiens
tcccacagatgctgtccagagt

SEQ ID NO: 9036781 - DNA, 21 bp, Homo sapiens
tcccacagcgccagctcctgt

SEQ ID NO: 9036782 - DNA, 22 bp, Homo sapiens
tcccacagagtggctcacctag

SEQ ID NO: 9036783 - DNA, 22 bp, Homo sapiens
tcccacagatgctgtccagagt

SEQ ID NO: 9036784 - DNA, 22 bp, Homo sapiens
tcccacagatgctgtccagagt

SEQ ID NO: 9036785 - DNA, 22 bp, Homo sapiens
tcccacagatgctgtccagagt

SEQ ID NO: 9036786 - DNA, 22 bp, Homo sapiens
tcccacagaccatgagtggaag

SEQ ID NO: 9036787 - DNA, 22 bp, Homo sapiens
tcccacagagtggctcacctag

SEQ ID NO: 9036788 - DNA, 21 bp, Homo sapiens
tcccacagaaactgcgaaatt

SEQ ID NO: 9036789 - DNA, 21 bp, Homo sapiens
tcccacagaaactgcgaaatt

SEQ ID NO: 9036790 - DNA, 20 bp, Homo sapiens
tccagggctagggagctcat

SEQ ID NO: 9036791 - DNA, 20 bp, Homo sapiens
tccagggctagggagctcat

SEQ ID NO: 9036792 - DNA, 20 bp, Homo sapiens
tccagggctagggagctcat

SEQ ID NO: 9036793 - DNA, 20 bp, Homo sapiens
tccagggctagggagctcat

SEQ ID NO: 9036794 - DNA, 20 bp, Homo sapiens
tccagggctagggagctcat

SEQ ID NO: 9036795 - DNA, 22 bp, Homo sapiens
tccagggctacaaggcaccaga

SEQ ID NO: 9036796 - DNA, 22 bp, Homo sapiens
tccagggctacaaggcaccaga

SEQ ID NO: 9036797 - DNA, 22 bp, Homo sapiens
tccagggcgtgtgtgaaggaaa

SEQ ID NO: 9036798 - DNA, 22 bp, Homo sapiens
tccagggctacaaggcaccaga

SEQ ID NO: 9036799 - DNA, 22 bp, Homo sapiens
tccagggctacaaggcaccaga

SEQ ID NO: 9036800 - DNA, 22 bp, Homo sapiens
tccagggctacaaggcaccaga

SEQ ID NO: 9036801 - DNA, 22 bp, Homo sapiens
tccagggctacaaggcaccaga

SEQ ID NO: 9036802 - DNA, 22 bp, Homo sapiens
tccagggctacaaggcaccaga

SEQ ID NO: 9036803 - DNA, 22 bp, Homo sapiens
tccagggctacaaggcaccaga

SEQ ID NO: 9036804 - DNA, 22 bp, Homo sapiens
tccagggcgtgtgtgaaggaaa

SEQ ID NO: 9036805 - DNA, 22 bp, Homo sapiens
tccagggcgtgtgtgaaggaaa

SEQ ID NO: 9036806 - DNA, 22 bp, Homo sapiens
tccagggcgtgtgtgaaggaaa

SEQ ID NO: 9036807 - DNA, 22 bp, Homo sapiens
tccagggcgtgtgtgaaggaaa

SEQ ID NO: 9036808 - DNA, 21 bp, Homo sapiens
tccagggcgggcgcacggaga

SEQ ID NO: 9036809 - DNA, 21 bp, Homo sapiens
tccagggcgggcgcacggaga

SEQ ID NO: 9036810 - DNA, 21 bp, Homo sapiens
tccagggcgggcgcacggaga

SEQ ID NO: 9036811 - DNA, 22 bp, Homo sapiens
tccagggcctgaggttgaagtg

SEQ ID NO: 9036812 - DNA, 22 bp, Homo sapiens
tccagggccttacctcttcaga

SEQ ID NO: 9036813 - DNA, 22 bp, Homo sapiens
tccagggccttacctcttcaga

SEQ ID NO: 9036814 - DNA, 22 bp, Homo sapiens
tccagggcctgaggttgaagtg

SEQ ID NO: 9036815 - DNA, 20 bp, Homo sapiens
tccagggccctggctcctct

SEQ ID NO: 9036816 - DNA, 20 bp, Homo sapiens
tccagggccctggctcctct

SEQ ID NO: 9036817 - DNA, 20 bp, Homo sapiens
tccagggccctggctcctct

SEQ ID NO: 9036818 - DNA, 22 bp, Homo sapiens
tccagggcctgaggttgaagtg

SEQ ID NO: 9036819 - DNA, 22 bp, Homo sapiens
tccagggccttacctcttcaga

SEQ ID NO: 9036820 - DNA, 22 bp, Homo sapiens
tccagggccttacctcttcaga

SEQ ID NO: 9036821 - DNA, 22 bp, Homo sapiens
tccagggccttacctcttcaga

SEQ ID NO: 9036822 - DNA, 22 bp, Homo sapiens
tccagggctccccaacatccag

SEQ ID NO: 9036823 - DNA, 22 bp, Homo sapiens
tccagggctcattccctctgca

SEQ ID NO: 9036824 - DNA, 22 bp, Homo sapiens
tccagggctccccaacatccag

SEQ ID NO: 9036825 - DNA, 22 bp, Homo sapiens
tccagggctccccaacatccag

SEQ ID NO: 9036826 - DNA, 22 bp, Homo sapiens
tccagtttacagggttgctttt

SEQ ID NO: 9036827 - DNA, 22 bp, Homo sapiens
tccagggctcattccctctgca

SEQ ID NO: 9036828 - DNA, 22 bp, Homo sapiens
tccagggctcattccctctgca

SEQ ID NO: 9036829 - DNA, 22 bp, Homo sapiens
tccagggctcattccctctgca

SEQ ID NO: 9036830 - DNA, 22 bp, Homo sapiens
tccagggctcattccctctgca

SEQ ID NO: 9036831 - DNA, 22 bp, Homo sapiens
tccagggctcattccctctgca

SEQ ID NO: 9036832 - DNA, 20 bp, Homo sapiens
tccagggctagggagctcat

SEQ ID NO: 9036833 - DNA, 20 bp, Homo sapiens
tccagggctagggagctcat

SEQ ID NO: 9036834 - DNA, 22 bp, Homo sapiens
tccagggctcattccctctgca

SEQ ID NO: 9036835 - DNA, 22 bp, Homo sapiens
tccagggctcattccctctgca

SEQ ID NO: 9036836 - DNA, 22 bp, Homo sapiens
tccatcaggctcgtgggctctc

SEQ ID NO: 9036837 - DNA, 22 bp, Homo sapiens
tccatcatggcagcagcagtga

SEQ ID NO: 9036838 - DNA, 22 bp, Homo sapiens
tccatcagcatgcaggctgttc

SEQ ID NO: 9036839 - DNA, 22 bp, Homo sapiens
tccatcaggctcgtgggctctc

SEQ ID NO: 9036840 - DNA, 22 bp, Homo sapiens
tccatcatgttcacagctatat

SEQ ID NO: 9036841 - DNA, 22 bp, Homo sapiens
tccatccacattaacagatacg

SEQ ID NO: 9036842 - DNA, 22 bp, Homo sapiens
tccatccacattaacagatacg

SEQ ID NO: 9036843 - DNA, 22 bp, Homo sapiens
tccagtttccaatcactgcacg

SEQ ID NO: 9036844 - DNA, 22 bp, Homo sapiens
tccatcaccatttctgcgagct

SEQ ID NO: 9036845 - DNA, 22 bp, Homo sapiens
tccatcagattccctcctgaga

SEQ ID NO: 9036846 - DNA, 22 bp, Homo sapiens
tccagtttatttttggcagggt

SEQ ID NO: 9036847 - DNA, 22 bp, Homo sapiens
tccagtttccaatcactgcacg

SEQ ID NO: 9036848 - DNA, 22 bp, Homo sapiens
tccagggccaagtcatggaacc

SEQ ID NO: 9036849 - DNA, 22 bp, Homo sapiens
tccagggcagggtgcgcatggg

SEQ ID NO: 9036850 - DNA, 22 bp, Homo sapiens
tccagggccaagtcatggaacc

SEQ ID NO: 9036851 - DNA, 22 bp, Homo sapiens
tccagggcagggtgcgcatggg

SEQ ID NO: 9036852 - DNA, 22 bp, Homo sapiens
tccagggcagggtgcgcatggg

SEQ ID NO: 9036853 - DNA, 19 bp, Homo sapiens
tccagggcaggaacatgta

SEQ ID NO: 9036854 - DNA, 19 bp, Homo sapiens
tccagggcaggaacatgta

SEQ ID NO: 9036855 - DNA, 19 bp, Homo sapiens
tccagggcaggaacatgta

SEQ ID NO: 9036856 - DNA, 19 bp, Homo sapiens
tccagggcaggaacatgta

SEQ ID NO: 9036857 - DNA, 19 bp, Homo sapiens
tccagggcaggaacatgta

SEQ ID NO: 9036858 - DNA, 22 bp, Homo sapiens
tccagggcagccgcgggtgcgc

SEQ ID NO: 9036859 - DNA, 22 bp, Homo sapiens
tccagggcagccgcgggtgcgc

SEQ ID NO: 9036860 - DNA, 22 bp, Homo sapiens
tccagggcagccgcgggtgcgc

SEQ ID NO: 9036861 - DNA, 22 bp, Homo sapiens
tccagggcagccgcgggtgcgc

SEQ ID NO: 9036862 - DNA, 22 bp, Homo sapiens
tccaggctggaaatgtcaaact

SEQ ID NO: 9036863 - DNA, 22 bp, Homo sapiens
tccagggcagccgcgggtgcgc

SEQ ID NO: 9036864 - DNA, 19 bp, Homo sapiens
tccagggcaggaacatgta

SEQ ID NO: 9036865 - DNA, 22 bp, Homo sapiens
tccaggctgcagtcttgccctc

SEQ ID NO: 9036866 - DNA, 22 bp, Homo sapiens
tccaggctgcagtcttgccctc

SEQ ID NO: 9036867 - DNA, 22 bp, Homo sapiens
tccaggctgcaaggccacaggg

SEQ ID NO: 9036868 - DNA, 22 bp, Homo sapiens
tccaggctgccacagtgcaacg

SEQ ID NO: 9036869 - DNA, 22 bp, Homo sapiens
tccaggctgccacagtgcaacg

SEQ ID NO: 9036870 - DNA, 22 bp, Homo sapiens
tccaggctgccacagtgcaacg

SEQ ID NO: 9036871 - DNA, 22 bp, Homo sapiens
tccaggctggaaatgtcaaact

SEQ ID NO: 9036872 - DNA, 22 bp, Homo sapiens
tccaggctggaaatgtcaaact

SEQ ID NO: 9036873 - DNA, 22 bp, Homo sapiens
tccagggccacagaggatgcta

SEQ ID NO: 9036874 - DNA, 22 bp, Homo sapiens
tccagggccacagaggatgcta

SEQ ID NO: 9036875 - DNA, 22 bp, Homo sapiens
tccagggccacagaggatgcta

SEQ ID NO: 9036876 - DNA, 22 bp, Homo sapiens
tccagggccacagaggatgcta

SEQ ID NO: 9036877 - DNA, 22 bp, Homo sapiens
tccagggccacagaggatgcta

SEQ ID NO: 9036878 - DNA, 22 bp, Homo sapiens
tccagggccacagaggatgcta

SEQ ID NO: 9036879 - DNA, 22 bp, Homo sapiens
tccagggccacagaggatgcta

SEQ ID NO: 9036880 - DNA, 22 bp, Homo sapiens
tccagggccatctccatgaggc

SEQ ID NO: 9036881 - DNA, 22 bp, Homo sapiens
tccagggccatctccatgaggc

SEQ ID NO: 9036882 - DNA, 22 bp, Homo sapiens
tccagggccatctccatgaggc

SEQ ID NO: 9036883 - DNA, 22 bp, Homo sapiens
tccagggccagtccttgtctgt

SEQ ID NO: 9036884 - DNA, 22 bp, Homo sapiens
tccagggccatctccatgaggc

SEQ ID NO: 9036885 - DNA, 22 bp, Homo sapiens
tccagggccatctccatgaggc

SEQ ID NO: 9036886 - DNA, 22 bp, Homo sapiens
tccagggccagtccttgtctgt

SEQ ID NO: 9036887 - DNA, 22 bp, Homo sapiens
tccagggccacagaggatgcta

SEQ ID NO: 9036888 - DNA, 22 bp, Homo sapiens
tccagggccagtccttgtctgt

SEQ ID NO: 9036889 - DNA, 22 bp, Homo sapiens
tccagggccagtccttgtctgt

SEQ ID NO: 9036890 - DNA, 22 bp, Homo sapiens
tccagggccatctccatgaggc

SEQ ID NO: 9036891 - DNA, 22 bp, Homo sapiens
tccagggccatgaagttgcaca

SEQ ID NO: 9036892 - DNA, 22 bp, Homo sapiens
tccagggccatgaagttgcaca

SEQ ID NO: 9036893 - DNA, 22 bp, Homo sapiens
tccagggccccccagttgcacg

SEQ ID NO: 9036894 - DNA, 22 bp, Homo sapiens
tccagggccccccagttgcacg

SEQ ID NO: 9036895 - DNA, 20 bp, Homo sapiens
tccagggccctggctcctct

SEQ ID NO: 9036896 - DNA, 20 bp, Homo sapiens
tccagggccctggctcctct

SEQ ID NO: 9036897 - DNA, 20 bp, Homo sapiens
tccagggccctggctcctct

SEQ ID NO: 9036898 - DNA, 20 bp, Homo sapiens
tccagggccctggctcctct

SEQ ID NO: 9036899 - DNA, 20 bp, Homo sapiens
tccagggccctggctcctct

SEQ ID NO: 9036900 - DNA, 22 bp, Homo sapiens
tcagagcatgtgggctgcagtt

SEQ ID NO: 9036901 - DNA, 22 bp, Homo sapiens
tcagagcatgtgggctgcagtt

SEQ ID NO: 9036902 - DNA, 20 bp, Homo sapiens
tcagagcagttggcttgtct

SEQ ID NO: 9036903 - DNA, 22 bp, Homo sapiens
tcagagcattagaggtttgtat

SEQ ID NO: 9036904 - DNA, 22 bp, Homo sapiens
tcagagcattcgggtgacaaat

SEQ ID NO: 9036905 - DNA, 22 bp, Homo sapiens
tcagagcattcgggtgacaaat

SEQ ID NO: 9036906 - DNA, 22 bp, Homo sapiens
tcagagccaatcatggtgcatt

SEQ ID NO: 9036907 - DNA, 22 bp, Homo sapiens
tcagagccaatcatggtgcatt

SEQ ID NO: 9036908 - DNA, 22 bp, Homo sapiens
tcagagcactggtgctaccttg

SEQ ID NO: 9036909 - DNA, 22 bp, Homo sapiens
tcagagcaccacacagttccct

SEQ ID NO: 9036910 - DNA, 22 bp, Homo sapiens
tcagagaggcaatactgtttaa

SEQ ID NO: 9036911 - DNA, 23 bp, Homo sapiens
tcagagaggccccctgcagagat

SEQ ID NO: 9036912 - DNA, 23 bp, Homo sapiens
tcagagaggccccctgcagagat

SEQ ID NO: 9036913 - DNA, 23 bp, Homo sapiens
tcagagaggccccctgcagagat

SEQ ID NO: 9036914 - DNA, 22 bp, Homo sapiens
tcagagctgtgcttcaggaaag

SEQ ID NO: 9036915 - DNA, 22 bp, Homo sapiens
tcagagctgtgcttcaggaaag

SEQ ID NO: 9036916 - DNA, 20 bp, Homo sapiens
tcagagctgcaggagagaaa

SEQ ID NO: 9036917 - DNA, 22 bp, Homo sapiens
tcagagctttggagaccaggaa

SEQ ID NO: 9036918 - DNA, 22 bp, Homo sapiens
tcagagctttggagaccaggaa

SEQ ID NO: 9036919 - DNA, 22 bp, Homo sapiens
tcagagcttcacctgttacatt

SEQ ID NO: 9036920 - DNA, 22 bp, Homo sapiens
tcagagcttcacctgttacatt

SEQ ID NO: 9036921 - DNA, 22 bp, Homo sapiens
tcagagcttatctcttgctgga

SEQ ID NO: 9036922 - DNA, 22 bp, Homo sapiens
tcagagcttatctcttgctgga

SEQ ID NO: 9036923 - DNA, 22 bp, Homo sapiens
tcagagcccctccgctgtccca

SEQ ID NO: 9036924 - DNA, 22 bp, Homo sapiens
tcagagcccctccgctgtccca

SEQ ID NO: 9036925 - DNA, 22 bp, Homo sapiens
tcagagccaatcatggtgcatt

SEQ ID NO: 9036926 - DNA, 22 bp, Homo sapiens
tcagagccctgctcctccccaa

SEQ ID NO: 9036927 - DNA, 22 bp, Homo sapiens
tcagagccctgctcctccccaa

SEQ ID NO: 9036928 - DNA, 22 bp, Homo sapiens
tcagagccctgctcctccccaa

SEQ ID NO: 9036929 - DNA, 22 bp, Homo sapiens
tcagagctaaggggagagcaaa

SEQ ID NO: 9036930 - DNA, 22 bp, Homo sapiens
tcagagctaaggggagagcaaa

SEQ ID NO: 9036931 - DNA, 22 bp, Homo sapiens
tcagagctcctaagggctgatt

SEQ ID NO: 9036932 - DNA, 22 bp, Homo sapiens
tcagagctcctaagggctgatt

SEQ ID NO: 9036933 - DNA, 22 bp, Homo sapiens
tcagagctcatgagcagagcca

SEQ ID NO: 9036934 - DNA, 22 bp, Homo sapiens
tcagaggaaagggaacatagtc

SEQ ID NO: 9036935 - DNA, 22 bp, Homo sapiens
tcagaggaaagggaacatagtc

SEQ ID NO: 9036936 - DNA, 22 bp, Homo sapiens
tcagaggaaaggtcagatggct

SEQ ID NO: 9036937 - DNA, 22 bp, Homo sapiens
tcagaggaaaggtcagatggct

SEQ ID NO: 9036938 - DNA, 22 bp, Homo sapiens
tcagaggaacactgtttcatgc

SEQ ID NO: 9036939 - DNA, 22 bp, Homo sapiens
tcagcaaggctgcattctcatc

SEQ ID NO: 9036940 - DNA, 22 bp, Homo sapiens
tcagcaagcagggggatgttca

SEQ ID NO: 9036941 - DNA, 22 bp, Homo sapiens
tcagcaaggcagaagggaggta

SEQ ID NO: 9036942 - DNA, 22 bp, Homo sapiens
tcagcaaggcagaagggaggta

SEQ ID NO: 9036943 - DNA, 22 bp, Homo sapiens
tcagcaagtattttctgaatgc

SEQ ID NO: 9036944 - DNA, 22 bp, Homo sapiens
tcagcaagtattttctgaatgc

SEQ ID NO: 9036945 - DNA, 22 bp, Homo sapiens
tcagcaaggctgcattctcatc

SEQ ID NO: 9036946 - DNA, 22 bp, Homo sapiens
tcagcaagtggaccatcctggg

SEQ ID NO: 9036947 - DNA, 22 bp, Homo sapiens
tcagcaagtggaccatcctggg

SEQ ID NO: 9036948 - DNA, 22 bp, Homo sapiens
tcagcaagcagggggatgttca

SEQ ID NO: 9036949 - DNA, 22 bp, Homo sapiens
tcagcacaggtcttgcaaaaca

SEQ ID NO: 9036950 - DNA, 22 bp, Homo sapiens
tcagcaatgtgatactgtgcaa

SEQ ID NO: 9036951 - DNA, 22 bp, Homo sapiens
tcagcaagtggaccatcctggg

SEQ ID NO: 9036952 - DNA, 22 bp, Homo sapiens
tcagcaagtggaccatcctggg

SEQ ID NO: 9036953 - DNA, 22 bp, Homo sapiens
tcagcacaggtcttgcaaaaca

SEQ ID NO: 9036954 - DNA, 22 bp, Homo sapiens
tcagcaccagttatcctcaggg

SEQ ID NO: 9036955 - DNA, 22 bp, Homo sapiens
tcagcaccagttatcctcaggg

SEQ ID NO: 9036956 - DNA, 22 bp, Homo sapiens
tcagcaccagttatcctcaggg

SEQ ID NO: 9036957 - DNA, 22 bp, Homo sapiens
tcagcactcgctacctagtaaa

SEQ ID NO: 9036958 - DNA, 22 bp, Homo sapiens
tcagcactcgctacctagtaaa

SEQ ID NO: 9036959 - DNA, 22 bp, Homo sapiens
tcagcactggcgctgggcaggt

SEQ ID NO: 9036960 - DNA, 22 bp, Homo sapiens
tcagcactgatgtttcagaaga

SEQ ID NO: 9036961 - DNA, 22 bp, Homo sapiens
tcagcactgaatctggatttgc

SEQ ID NO: 9036962 - DNA, 22 bp, Homo sapiens
tcagcactgatagaagtcaata

SEQ ID NO: 9036963 - DNA, 22 bp, Homo sapiens
tcagcactgatagaagtcaata

SEQ ID NO: 9036964 - DNA, 22 bp, Homo sapiens
tcagcactgtgtccagtctccc

SEQ ID NO: 9036965 - DNA, 22 bp, Homo sapiens
tcagcactgtgtccagtctccc

SEQ ID NO: 9036966 - DNA, 22 bp, Homo sapiens
tcagcactgtgtccagtctccc

SEQ ID NO: 9036967 - DNA, 22 bp, Homo sapiens
tcagcacttggatttcagagat

SEQ ID NO: 9036968 - DNA, 22 bp, Homo sapiens
tcagcacttactagtggccttt

SEQ ID NO: 9036969 - DNA, 22 bp, Homo sapiens
tcagcactgtctattagtgaga

SEQ ID NO: 9036970 - DNA, 22 bp, Homo sapiens
tcagcactgtcttttatttgaa

SEQ ID NO: 9036971 - DNA, 22 bp, Homo sapiens
tcagacagattttgacacttgc

SEQ ID NO: 9036972 - DNA, 22 bp, Homo sapiens
tcagaaaataactgttagtttg

SEQ ID NO: 9036973 - DNA, 22 bp, Homo sapiens
tcagaaaaggtagctgtgacaa

SEQ ID NO: 9036974 - DNA, 22 bp, Homo sapiens
tcagaaaaggtagctgtgacaa

SEQ ID NO: 9036975 - DNA, 22 bp, Homo sapiens
tcagacagattttgacacttgc

SEQ ID NO: 9036976 - DNA, 22 bp, Homo sapiens
tcagacagcttgcagggaggtg

SEQ ID NO: 9036977 - DNA, 22 bp, Homo sapiens
tcagacagcttgggataactga

SEQ ID NO: 9036978 - DNA, 22 bp, Homo sapiens
tcagacaggcctctccagcctc

SEQ ID NO: 9036979 - DNA, 20 bp, Homo sapiens
tcagacagtcgcagttctgg

SEQ ID NO: 9036980 - DNA, 22 bp, Homo sapiens
tcagacagtcatcagagcttgt

SEQ ID NO: 9036981 - DNA, 22 bp, Homo sapiens
tcagacaggctggacagcttgc

SEQ ID NO: 9036982 - DNA, 22 bp, Homo sapiens
tcagacaggctggacagcttgc

SEQ ID NO: 9036983 - DNA, 22 bp, Homo sapiens
tcagacagggagtcagaaaata

SEQ ID NO: 9036984 - DNA, 22 bp, Homo sapiens
tcagaaaagagaaaatcttata

SEQ ID NO: 9036985 - DNA, 22 bp, Homo sapiens
tcagaaaagactcaggggctga

SEQ ID NO: 9036986 - DNA, 22 bp, Homo sapiens
tcagaaaagaccacattattct

SEQ ID NO: 9036987 - DNA, 22 bp, Homo sapiens
tcagaaaagaccacattattct

SEQ ID NO: 9036988 - DNA, 22 bp, Homo sapiens
tcagaaaagaccacattattct

SEQ ID NO: 9036989 - DNA, 22 bp, Homo sapiens
tcagaaaagaccacattattct

SEQ ID NO: 9036990 - DNA, 22 bp, Homo sapiens
tcagaaaaggtagctgtgacaa

SEQ ID NO: 9036991 - DNA, 22 bp, Homo sapiens
tcagaaaagagaaaatcttata

SEQ ID NO: 9036992 - DNA, 22 bp, Homo sapiens
tcagaaaagagaaaatcttata

SEQ ID NO: 9036993 - DNA, 22 bp, Homo sapiens
tcagaaaagagaaaatcttata

SEQ ID NO: 9036994 - DNA, 22 bp, Homo sapiens
tcagaaaagagaaaatcttata

SEQ ID NO: 9036995 - DNA, 22 bp, Homo sapiens
tcacttttgatccctatgcagt

SEQ ID NO: 9036996 - DNA, 22 bp, Homo sapiens
tcacttttgatccctatgcagt

SEQ ID NO: 9036997 - DNA, 22 bp, Homo sapiens
tcacttttgggtttccagtaga

SEQ ID NO: 9036998 - DNA, 22 bp, Homo sapiens
tcacttttgatccctatgcagt

SEQ ID NO: 9036999 - DNA, 22 bp, Homo sapiens
tcactttttgatatcattctgc

SEQ ID NO: 9037000 - DNA, 22 bp, Homo sapiens
tcactttttgatatcattctgc

SEQ ID NO: 9037001 - DNA, 22 bp, Homo sapiens
tcagaaaagaccacattattct

SEQ ID NO: 9037002 - DNA, 22 bp, Homo sapiens
tcagaaaagaccacattattct

SEQ ID NO: 9037003 - DNA, 22 bp, Homo sapiens
tcagagaagctgccaggcgagc

SEQ ID NO: 9037004 - DNA, 22 bp, Homo sapiens
tcagagaagacatcattgtgaa

SEQ ID NO: 9037005 - DNA, 22 bp, Homo sapiens
tcagagaagctgccaggcgagc

SEQ ID NO: 9037006 - DNA, 22 bp, Homo sapiens
tcagagaactggcatgtttaga

SEQ ID NO: 9037007 - DNA, 23 bp, Homo sapiens
tcagagaactcgggcagatgacc

SEQ ID NO: 9037008 - DNA, 22 bp, Homo sapiens
tcagagaaggcaattttatggt

SEQ ID NO: 9037009 - DNA, 22 bp, Homo sapiens
tcagagaaggctgagtcacggc

SEQ ID NO: 9037010 - DNA, 22 bp, Homo sapiens
tcagagaggcaatactgtttaa

SEQ ID NO: 9037011 - DNA, 22 bp, Homo sapiens
tcagagaagcttaagctgtaat

SEQ ID NO: 9037012 - DNA, 20 bp, Homo sapiens
tcagagaaggagctttcctg

SEQ ID NO: 9037013 - DNA, 20 bp, Homo sapiens
tcagagaaggagctttcctg

SEQ ID NO: 9037014 - DNA, 20 bp, Homo sapiens
tcagagaaggagctttcctg

SEQ ID NO: 9037015 - DNA, 22 bp, Homo sapiens
tcagacagtgtgatcagtctct

SEQ ID NO: 9037016 - DNA, 22 bp, Homo sapiens
tcagacagtgtgatcagtctct

SEQ ID NO: 9037017 - DNA, 22 bp, Homo sapiens
tcagacagtttgcagtgtgcct

SEQ ID NO: 9037018 - DNA, 22 bp, Homo sapiens
tcagacatatcaataggcactt

SEQ ID NO: 9037019 - DNA, 22 bp, Homo sapiens
tcagacatatttttaacaaagt

SEQ ID NO: 9037020 - DNA, 22 bp, Homo sapiens
tcagaccatcctgctgttagtg

SEQ ID NO: 9037021 - DNA, 21 bp, Homo sapiens
tcagagaacccggcaggcaag

SEQ ID NO: 9037022 - DNA, 21 bp, Homo sapiens
tcagagaacccggcaggcaag

SEQ ID NO: 9037023 - DNA, 22 bp, Homo sapiens
tcagagaactccacaccttagg

SEQ ID NO: 9037024 - DNA, 22 bp, Homo sapiens
tcagagaactccacaccttagg

SEQ ID NO: 9037025 - DNA, 22 bp, Homo sapiens
tcagaccatcctgctgttagtg

SEQ ID NO: 9037026 - DNA, 22 bp, Homo sapiens
tcagacctctgaccttgccaaa

SEQ ID NO: 9037027 - DNA, 22 bp, Homo sapiens
tcagacctctgaccttgccaaa

SEQ ID NO: 9037028 - DNA, 22 bp, Homo sapiens
tcagacctctgaccttgccaaa

SEQ ID NO: 9037029 - DNA, 22 bp, Homo sapiens
tcagaccatcctgctgttagtg

SEQ ID NO: 9037030 - DNA, 20 bp, Homo sapiens
tcagacccagattagcaggt

SEQ ID NO: 9037031 - DNA, 22 bp, Homo sapiens
tcactctgaatggtactgagga

SEQ ID NO: 9037032 - DNA, 22 bp, Homo sapiens
tcactagtggaatctgggagca

SEQ ID NO: 9037033 - DNA, 22 bp, Homo sapiens
tcactagtcgcggggggaggta

SEQ ID NO: 9037034 - DNA, 22 bp, Homo sapiens
tcactacacaatatatttcaga

SEQ ID NO: 9037035 - DNA, 22 bp, Homo sapiens
tcacccaggctggtgcgcagtg

SEQ ID NO: 9037036 - DNA, 22 bp, Homo sapiens
tcactacacaatatatttcaga

SEQ ID NO: 9037037 - DNA, 22 bp, Homo sapiens
tcactagcattgttgaaggact

SEQ ID NO: 9037038 - DNA, 22 bp, Homo sapiens
tcactctgagaggtcactggaa

SEQ ID NO: 9037039 - DNA, 22 bp, Homo sapiens
tcactctgagaggtcactggaa

SEQ ID NO: 9037040 - DNA, 22 bp, Homo sapiens
tcactctgatagataagctaac

SEQ ID NO: 9037041 - DNA, 22 bp, Homo sapiens
tcactctggcctctgcagcagt

SEQ ID NO: 9037042 - DNA, 22 bp, Homo sapiens
tcactctgctgcccgagggctg

SEQ ID NO: 9037043 - DNA, 22 bp, Homo sapiens
tcactctggagtccgctaccag

SEQ ID NO: 9037044 - DNA, 22 bp, Homo sapiens
tcacccaggctggtatgcagtg

SEQ ID NO: 9037045 - DNA, 22 bp, Homo sapiens
tcacccaggctggtatgcagtg

SEQ ID NO: 9037046 - DNA, 22 bp, Homo sapiens
tcacccaggctggagtgtagtg

SEQ ID NO: 9037047 - DNA, 22 bp, Homo sapiens
tcacccaggctggagtgcagtg

SEQ ID NO: 9037048 - DNA, 22 bp, Homo sapiens
tcacccaggctggagtgtagtg

SEQ ID NO: 9037049 - DNA, 22 bp, Homo sapiens
tcacccaggctggagtgcagtg

SEQ ID NO: 9037050 - DNA, 22 bp, Homo sapiens
tcacccaggctggagtgcagtg

SEQ ID NO: 9037051 - DNA, 19 bp, Homo sapiens
tcacccaggctgctggctc

SEQ ID NO: 9037052 - DNA, 22 bp, Homo sapiens
tcacccaggctggactgcagtg

SEQ ID NO: 9037053 - DNA, 22 bp, Homo sapiens
tcacccaggctggagtgcagtg

SEQ ID NO: 9037054 - DNA, 22 bp, Homo sapiens
tcacccaggctggactgcagtg

SEQ ID NO: 9037055 - DNA, 22 bp, Homo sapiens
tcacccaggctggagtgcagtg

SEQ ID NO: 9037056 - DNA, 22 bp, Homo sapiens
tcacccagccttggcgggtttg

SEQ ID NO: 9037057 - DNA, 22 bp, Homo sapiens
tcacccagccttggcgggtttg

SEQ ID NO: 9037058 - DNA, 22 bp, Homo sapiens
tcacccaggatattgaagtcag

SEQ ID NO: 9037059 - DNA, 22 bp, Homo sapiens
tcacccagcgggcgcacactcg

SEQ ID NO: 9037060 - DNA, 22 bp, Homo sapiens
tcacccagcgggcgcacactcg

SEQ ID NO: 9037061 - DNA, 22 bp, Homo sapiens
tcacccaggatattgaagtcag

SEQ ID NO: 9037062 - DNA, 19 bp, Homo sapiens
tcacccaggctgctggctc

SEQ ID NO: 9037063 - DNA, 19 bp, Homo sapiens
tcacccaggctgctggctc

SEQ ID NO: 9037064 - DNA, 22 bp, Homo sapiens
tcacccaggctggactgcagtg

SEQ ID NO: 9037065 - DNA, 22 bp, Homo sapiens
tcacccaggctggactgcagtg

SEQ ID NO: 9037066 - DNA, 22 bp, Homo sapiens
tcacccagcagctgcttctgct

SEQ ID NO: 9037067 - DNA, 22 bp, Homo sapiens
tcacccagcagctgcttctgct

SEQ ID NO: 9037068 - DNA, 22 bp, Homo sapiens
tcaccaggcaactatgtactcc

SEQ ID NO: 9037069 - DNA, 22 bp, Homo sapiens
tcaccaggctagagtgcagtgg

SEQ ID NO: 9037070 - DNA, 22 bp, Homo sapiens
tcaccaggattgggctgtaggc

SEQ ID NO: 9037071 - DNA, 22 bp, Homo sapiens
tcaccaggattgggctgtaggc

SEQ ID NO: 9037072 - DNA, 22 bp, Homo sapiens
tcaccaggcaactatgtactcc

SEQ ID NO: 9037073 - DNA, 22 bp, Homo sapiens
tcaccaggattcctatcagtag

SEQ ID NO: 9037074 - DNA, 22 bp, Homo sapiens
tcaccaggactgagaccttggg

SEQ ID NO: 9037075 - DNA, 22 bp, Homo sapiens
tcaccaggactgagaccttggg

SEQ ID NO: 9037076 - DNA, 22 bp, Homo sapiens
tcaccagatctctctgtaatgg

SEQ ID NO: 9037077 - DNA, 22 bp, Homo sapiens
tcaccaccagaagagctattct

SEQ ID NO: 9037078 - DNA, 22 bp, Homo sapiens
tcacattttttactggacttaa

SEQ ID NO: 9037079 - DNA, 22 bp, Homo sapiens
tcacattttttactggacttaa

SEQ ID NO: 9037080 - DNA, 22 bp, Homo sapiens
tcacagtatagagttattttgg

SEQ ID NO: 9037081 - DNA, 22 bp, Homo sapiens
tcacagtatagagttattttgg

SEQ ID NO: 9037082 - DNA, 22 bp, Homo sapiens
tcacattttatctgagattgac

SEQ ID NO: 9037083 - DNA, 22 bp, Homo sapiens
tcacattttcaaaagctggtgc

SEQ ID NO: 9037084 - DNA, 22 bp, Homo sapiens
tcacattttcaaaagctggtgc

SEQ ID NO: 9037085 - DNA, 22 bp, Homo sapiens
tcacagtataacctcatatagg

SEQ ID NO: 9037086 - DNA, 22 bp, Homo sapiens
tcacagtataacctcatatagg

SEQ ID NO: 9037087 - DNA, 22 bp, Homo sapiens
tcacagtataacctcatatagg

SEQ ID NO: 9037088 - DNA, 22 bp, Homo sapiens
tcacagtagccatttcatgagt

SEQ ID NO: 9037089 - DNA, 22 bp, Homo sapiens
tcacagtagttgttctctgttt

SEQ ID NO: 9037090 - DNA, 22 bp, Homo sapiens
tcacagtagttgttctctgttt

SEQ ID NO: 9037091 - DNA, 22 bp, Homo sapiens
tcacattttctactactgtacg

SEQ ID NO: 9037092 - DNA, 22 bp, Homo sapiens
tcacattttctactactgtacg

SEQ ID NO: 9037093 - DNA, 22 bp, Homo sapiens
tcacattttctactactgtacg

SEQ ID NO: 9037094 - DNA, 22 bp, Homo sapiens
tcacattttcttaggaaactta

SEQ ID NO: 9037095 - DNA, 22 bp, Homo sapiens
tcacattttgttcaaggctagt

SEQ ID NO: 9037096 - DNA, 22 bp, Homo sapiens
tcacattttcatattctctgag

SEQ ID NO: 9037097 - DNA, 22 bp, Homo sapiens
tcacattttccttggtatctgt

SEQ ID NO: 9037098 - DNA, 22 bp, Homo sapiens
tcacattttctactactgtacg

SEQ ID NO: 9037099 - DNA, 22 bp, Homo sapiens
tcactttcctcatcacgactag

SEQ ID NO: 9037100 - DNA, 22 bp, Homo sapiens
tcactttgacggccaacttcta

SEQ ID NO: 9037101 - DNA, 22 bp, Homo sapiens
tcactttgacggccaacttcta

SEQ ID NO: 9037102 - DNA, 22 bp, Homo sapiens
tcactttactttgttaatctgg

SEQ ID NO: 9037103 - DNA, 22 bp, Homo sapiens
tcactttaatgatttgtagaat

SEQ ID NO: 9037104 - DNA, 22 bp, Homo sapiens
tcactttactttgttaatctgg

SEQ ID NO: 9037105 - DNA, 22 bp, Homo sapiens
tcactttacctcattcaggcag

SEQ ID NO: 9037106 - DNA, 22 bp, Homo sapiens
tcactttagaggaaacattgag

SEQ ID NO: 9037107 - DNA, 22 bp, Homo sapiens
tcactttagaggaaacattgag

SEQ ID NO: 9037108 - DNA, 22 bp, Homo sapiens
tcactttaccaaagtacaggag

SEQ ID NO: 9037109 - DNA, 22 bp, Homo sapiens
tcactttaatgatttgtagaat

SEQ ID NO: 9037110 - DNA, 22 bp, Homo sapiens
tcactttaaactactgtggtct

SEQ ID NO: 9037111 - DNA, 23 bp, Homo sapiens
tcacttgaagctagaatctgccc

SEQ ID NO: 9037112 - DNA, 22 bp, Homo sapiens
tcacttgaacctgggaggcaga

SEQ ID NO: 9037113 - DNA, 22 bp, Homo sapiens
tcacttgaattcattctgcgaa

SEQ ID NO: 9037114 - DNA, 19 bp, Homo sapiens
tcacttgaagttcagaaat

SEQ ID NO: 9037115 - DNA, 22 bp, Homo sapiens
tcacttgaattcattctgcgaa

SEQ ID NO: 9037116 - DNA, 22 bp, Homo sapiens
tcacttgacctcttgaactcct

SEQ ID NO: 9037117 - DNA, 22 bp, Homo sapiens
tcacttgacccttctctagcct

SEQ ID NO: 9037118 - DNA, 22 bp, Homo sapiens
tcacttgacccttctctagcct

SEQ ID NO: 9037119 - DNA, 22 bp, Homo sapiens
tcacttgatccttccctgaaat

SEQ ID NO: 9037120 - DNA, 22 bp, Homo sapiens
tcacttgagatgtaccacaaac

SEQ ID NO: 9037121 - DNA, 22 bp, Homo sapiens
tcacttgactttccagtcttgg

SEQ ID NO: 9037122 - DNA, 22 bp, Homo sapiens
tcacttgagagatattagaagt

SEQ ID NO: 9037123 - DNA, 22 bp, Homo sapiens
tcacttgactccagtttcttct

SEQ ID NO: 9037124 - DNA, 22 bp, Homo sapiens
tcacttgactccagtttcttct

SEQ ID NO: 9037125 - DNA, 22 bp, Homo sapiens
tcacttgactttccagtcttgg

SEQ ID NO: 9037126 - DNA, 18 bp, Homo sapiens
tcactgtgtgtcttgggt

SEQ ID NO: 9037127 - DNA, 22 bp, Homo sapiens
tcactgttaataaatagcaaag

SEQ ID NO: 9037128 - DNA, 22 bp, Homo sapiens
tcactgtgtcctttctgcgtag

SEQ ID NO: 9037129 - DNA, 22 bp, Homo sapiens
tcacttcttcccttgcacatat

SEQ ID NO: 9037130 - DNA, 22 bp, Homo sapiens
tcacttcttcagctttccttga

SEQ ID NO: 9037131 - DNA, 22 bp, Homo sapiens
tcacttcttcagctttccttga

SEQ ID NO: 9037132 - DNA, 22 bp, Homo sapiens
tcacttcttcagctttccttga

SEQ ID NO: 9037133 - DNA, 22 bp, Homo sapiens
tcactgttagagcaaacgtatg

SEQ ID NO: 9037134 - DNA, 19 bp, Homo sapiens
tcacttctgttagcatgga

SEQ ID NO: 9037135 - DNA, 22 bp, Homo sapiens
tcactctgtggcccaggcagtg

SEQ ID NO: 9037136 - DNA, 22 bp, Homo sapiens
tcactctggcctctgcagcagt

SEQ ID NO: 9037137 - DNA, 22 bp, Homo sapiens
tcactctgggccctactgggct

SEQ ID NO: 9037138 - DNA, 22 bp, Homo sapiens
tcactctgtggcccaggcagtg

SEQ ID NO: 9037139 - DNA, 22 bp, Homo sapiens
tcactctgttttactcactgtt

SEQ ID NO: 9037140 - DNA, 22 bp, Homo sapiens
tcactctgttttactcactgtt

SEQ ID NO: 9037141 - DNA, 22 bp, Homo sapiens
tcactgaaaaccatacttcttt

SEQ ID NO: 9037142 - DNA, 22 bp, Homo sapiens
tcactgaactctcatagagaaa

SEQ ID NO: 9037143 - DNA, 22 bp, Homo sapiens
tcactgaaccagggatctctag

SEQ ID NO: 9037144 - DNA, 22 bp, Homo sapiens
tcactgaaccagggatctctag

SEQ ID NO: 9037145 - DNA, 22 bp, Homo sapiens
tcactgaaacctccacctctcg

SEQ ID NO: 9037146 - DNA, 22 bp, Homo sapiens
tcactgaaagaatgacattatg

SEQ ID NO: 9037147 - DNA, 22 bp, Homo sapiens
tcactgaaagtaattctagtga

SEQ ID NO: 9037148 - DNA, 22 bp, Homo sapiens
tcactgaaagaatgacattatg

SEQ ID NO: 9037149 - DNA, 22 bp, Homo sapiens
tcactgaaagtaattctagtga

SEQ ID NO: 9037150 - DNA, 21 bp, Homo sapiens
tcactgaagcctaagatgttt

SEQ ID NO: 9037151 - DNA, 22 bp, Homo sapiens
tcactgaaggaagacactgtca

SEQ ID NO: 9037152 - DNA, 22 bp, Homo sapiens
tcactgaactctcatagagaaa

SEQ ID NO: 9037153 - DNA, 21 bp, Homo sapiens
tcactgaagcctaagatgttt

SEQ ID NO: 9037154 - DNA, 22 bp, Homo sapiens
tcactgaagactgggctctaaa

SEQ ID NO: 9037155 - DNA, 22 bp, Homo sapiens
tcactgaagtcttcaagtagga

SEQ ID NO: 9037156 - DNA, 22 bp, Homo sapiens
tcactgaagtcttcaagtagga

SEQ ID NO: 9037157 - DNA, 22 bp, Homo sapiens
tcactgaagtcttcaagtagga

SEQ ID NO: 9037158 - DNA, 22 bp, Homo sapiens
tcactgaaggaagacactgtca

SEQ ID NO: 9037159 - DNA, 22 bp, Homo sapiens
tcactgaagtcttcaagtagga

SEQ ID NO: 9037160 - DNA, 22 bp, Homo sapiens
tcactgaatacttgtctcatcc

SEQ ID NO: 9037161 - DNA, 22 bp, Homo sapiens
tcactgaatgcagatacgtgac

SEQ ID NO: 9037162 - DNA, 22 bp, Homo sapiens
tcactgatgcttatgaaagtgt

SEQ ID NO: 9037163 - DNA, 22 bp, Homo sapiens
tcactgacgtggggctacttga

SEQ ID NO: 9037164 - DNA, 22 bp, Homo sapiens
tcactgaggcattcatgctctg

SEQ ID NO: 9037165 - DNA, 22 bp, Homo sapiens
tcactgaatacttgtctcatcc

SEQ ID NO: 9037166 - DNA, 22 bp, Homo sapiens
tcactgaatttcaagctagtgg

SEQ ID NO: 9037167 - DNA, 22 bp, Homo sapiens
tcactgaatttcaagctagtgg

SEQ ID NO: 9037168 - DNA, 22 bp, Homo sapiens
tcacaggctctagggattaaga

SEQ ID NO: 9037169 - DNA, 22 bp, Homo sapiens
tcacaggctctccaccatgagg

SEQ ID NO: 9037170 - DNA, 22 bp, Homo sapiens
tcacaggctggtctccgaggac

SEQ ID NO: 9037171 - DNA, 22 bp, Homo sapiens
tcacaggctggtctccgaggac

SEQ ID NO: 9037172 - DNA, 22 bp, Homo sapiens
tcacaggctggtctccgaggac

SEQ ID NO: 9037173 - DNA, 22 bp, Homo sapiens
tcacagggatggaatagaaata

SEQ ID NO: 9037174 - DNA, 22 bp, Homo sapiens
tcacagggatggaatagaaata

SEQ ID NO: 9037175 - DNA, 22 bp, Homo sapiens
tcacagggatggaatagaaata

SEQ ID NO: 9037176 - DNA, 23 bp, Homo sapiens
tcacagggcactggctggggttg

SEQ ID NO: 9037177 - DNA, 23 bp, Homo sapiens
tcacagggcactggctggggttg

SEQ ID NO: 9037178 - DNA, 23 bp, Homo sapiens
tcacagggcactggctggggttg

SEQ ID NO: 9037179 - DNA, 22 bp, Homo sapiens
tcacagggcattatggctccag

SEQ ID NO: 9037180 - DNA, 22 bp, Homo sapiens
tcacaggcctggggcagagggc

SEQ ID NO: 9037181 - DNA, 22 bp, Homo sapiens
tcacaggcctggggcagagggc

SEQ ID NO: 9037182 - DNA, 22 bp, Homo sapiens
tcacaggcctggggcagagggc

SEQ ID NO: 9037183 - DNA, 22 bp, Homo sapiens
tcacaggctaaatttatgcagg

SEQ ID NO: 9037184 - DNA, 22 bp, Homo sapiens
tcacaggctaaatttatgcagg

SEQ ID NO: 9037185 - DNA, 22 bp, Homo sapiens
tcacaggcctggggcagagggc

SEQ ID NO: 9037186 - DNA, 22 bp, Homo sapiens
tcacaggcccaaaccacgctta

SEQ ID NO: 9037187 - DNA, 22 bp, Homo sapiens
tcacaggcccaaaccacgctta

SEQ ID NO: 9037188 - DNA, 21 bp, Homo sapiens
tcacaggctcagggagagagt

SEQ ID NO: 9037189 - DNA, 22 bp, Homo sapiens
tcacaggctaaatttatgcagg

SEQ ID NO: 9037190 - DNA, 22 bp, Homo sapiens
tcacaggctccagggcctggat

SEQ ID NO: 9037191 - DNA, 21 bp, Homo sapiens
tcacaggctcagggagagagt

SEQ ID NO: 9037192 - DNA, 22 bp, Homo sapiens
tcacaggctccagggcctggat

SEQ ID NO: 9037193 - DNA, 22 bp, Homo sapiens
tcacagtagacttctcaagagc

SEQ ID NO: 9037194 - DNA, 22 bp, Homo sapiens
tcacagtagacttctcaagagc

SEQ ID NO: 9037195 - DNA, 22 bp, Homo sapiens
tcacagtactgtgtgacttgag

SEQ ID NO: 9037196 - DNA, 22 bp, Homo sapiens
tcacagtactccccaaagtttc

SEQ ID NO: 9037197 - DNA, 22 bp, Homo sapiens
tcacagtactccccaaagtttc

SEQ ID NO: 9037198 - DNA, 22 bp, Homo sapiens
tcacagtactccccaaagtttc

SEQ ID NO: 9037199 - DNA, 22 bp, Homo sapiens
tcacagtactgtgactattgac

SEQ ID NO: 9037200 - DNA, 22 bp, Homo sapiens
tcacagtactgtgactattgac

SEQ ID NO: 9037201 - DNA, 22 bp, Homo sapiens
tcacagtaactttgttgctttt

SEQ ID NO: 9037202 - DNA, 22 bp, Homo sapiens
tcacagtacatgattcagtggt

SEQ ID NO: 9037203 - DNA, 22 bp, Homo sapiens
tcacagtaaatccagaagaaat

SEQ ID NO: 9037204 - DNA, 22 bp, Homo sapiens
tcacagtaaatccagaagaaat

SEQ ID NO: 9037205 - DNA, 22 bp, Homo sapiens
tcacagtaactttgttgctttt

SEQ ID NO: 9037206 - DNA, 22 bp, Homo sapiens
tcacagtaaaagcatggaagag

SEQ ID NO: 9037207 - DNA, 22 bp, Homo sapiens
tcacagtaaatccagaagaaat

SEQ ID NO: 9037208 - DNA, 22 bp, Homo sapiens
tcacagtaaaagcatggaagag

SEQ ID NO: 9037209 - DNA, 22 bp, Homo sapiens
tcacaggttccagggatgagaa

SEQ ID NO: 9037210 - DNA, 22 bp, Homo sapiens
tcacagtaaaagcatggaagag

SEQ ID NO: 9037211 - DNA, 23 bp, Homo sapiens
tcacaggggccagcgctctgtgg

SEQ ID NO: 9037212 - DNA, 22 bp, Homo sapiens
tcacagggtatctgggatggat

SEQ ID NO: 9037213 - DNA, 23 bp, Homo sapiens
tcacaggggccagcgctctgtgg

SEQ ID NO: 9037214 - DNA, 23 bp, Homo sapiens
tcacaggggccagcgctctgtgg

SEQ ID NO: 9037215 - DNA, 20 bp, Homo sapiens
tcacaggggaccaggagcag

SEQ ID NO: 9037216 - DNA, 20 bp, Homo sapiens
tcacaggggaccaggagcag

SEQ ID NO: 9037217 - DNA, 20 bp, Homo sapiens
tcacaggggaccaggagcag

SEQ ID NO: 9037218 - DNA, 23 bp, Homo sapiens
tcacaggggccagcgctctgtgg

SEQ ID NO: 9037219 - DNA, 22 bp, Homo sapiens
tcacagggcattatggctccag

SEQ ID NO: 9037220 - DNA, 22 bp, Homo sapiens
tcacagggtatctgggatggat

SEQ ID NO: 9037221 - DNA, 22 bp, Homo sapiens
tcacagggtatctgggatggat

SEQ ID NO: 9037222 - DNA, 22 bp, Homo sapiens
tcacagggtatctgggatggat

SEQ ID NO: 9037223 - DNA, 22 bp, Homo sapiens
tcacagggtttggaagcctcct

SEQ ID NO: 9037224 - DNA, 22 bp, Homo sapiens
tcacagggtttggaagcctcct

SEQ ID NO: 9037225 - DNA, 22 bp, Homo sapiens
tcacagggtttggaagcctcct

SEQ ID NO: 9037226 - DNA, 22 bp, Homo sapiens
tcacagggtgtacatcacctat

SEQ ID NO: 9037227 - DNA, 21 bp, Homo sapiens
tcacaggtcaatgtgtgaagg

SEQ ID NO: 9037228 - DNA, 22 bp, Homo sapiens
tcacagaagcttgaagattttc

SEQ ID NO: 9037229 - DNA, 22 bp, Homo sapiens
tcacagaagcttgaagattttc

SEQ ID NO: 9037230 - DNA, 22 bp, Homo sapiens
tcacagaaggaccttgtttcat

SEQ ID NO: 9037231 - DNA, 22 bp, Homo sapiens
tcacagaaggagggaagctagt

SEQ ID NO: 9037232 - DNA, 22 bp, Homo sapiens
tcacagaaggcatcacagaaga

SEQ ID NO: 9037233 - DNA, 22 bp, Homo sapiens
tcacagaaggcatcacagaaga

SEQ ID NO: 9037234 - DNA, 22 bp, Homo sapiens
tcacagaaggcatcacagaaga

SEQ ID NO: 9037235 - DNA, 22 bp, Homo sapiens
tcacagaagccctcgcaaacta

SEQ ID NO: 9037236 - DNA, 22 bp, Homo sapiens
tcacagaagatgctggatgttg

SEQ ID NO: 9037237 - DNA, 22 bp, Homo sapiens
tcacagaagttgaatttgcatg

SEQ ID NO: 9037238 - DNA, 22 bp, Homo sapiens
tcacagaagggaaagatgccaa

SEQ ID NO: 9037239 - DNA, 22 bp, Homo sapiens
tcacaggcccaaaccacgctta

SEQ ID NO: 9037240 - DNA, 22 bp, Homo sapiens
tcacaggcccaaaccacgctta

SEQ ID NO: 9037241 - DNA, 19 bp, Homo sapiens
tcacaggcatctccccaga

SEQ ID NO: 9037242 - DNA, 22 bp, Homo sapiens
tcacaggataaggtggcatcac

SEQ ID NO: 9037243 - DNA, 22 bp, Homo sapiens
tcacaggcaaagaagattggtg

SEQ ID NO: 9037244 - DNA, 22 bp, Homo sapiens
tcacagctggacacgttggcat

SEQ ID NO: 9037245 - DNA, 22 bp, Homo sapiens
tcacagctggacacgttggcat

SEQ ID NO: 9037246 - DNA, 22 bp, Homo sapiens
tcacagctggacacgttggcat

SEQ ID NO: 9037247 - DNA, 22 bp, Homo sapiens
tcacaggagtcataattacagt

SEQ ID NO: 9037248 - DNA, 22 bp, Homo sapiens
tcacagaagttgaatttgcatg

SEQ ID NO: 9037249 - DNA, 22 bp, Homo sapiens
tcacagaataaatgtactggcc

SEQ ID NO: 9037250 - DNA, 22 bp, Homo sapiens
tcacagctattctcatgtattt

SEQ ID NO: 9037251 - DNA, 22 bp, Homo sapiens
tcacagaataaattgagaagac

SEQ ID NO: 9037252 - DNA, 22 bp, Homo sapiens
tcacagctcactgtagcctcga

SEQ ID NO: 9037253 - DNA, 22 bp, Homo sapiens
tcacagctattctcatgtattt

SEQ ID NO: 9037254 - DNA, 22 bp, Homo sapiens
tcacagctattctcatgtattt

SEQ ID NO: 9037255 - DNA, 22 bp, Homo sapiens
tcacagctctgtcaattttata

SEQ ID NO: 9037256 - DNA, 22 bp, Homo sapiens
tcacagctgagtttccatttct

SEQ ID NO: 9037257 - DNA, 22 bp, Homo sapiens
tcacagctgagtttccatttct

SEQ ID NO: 9037258 - DNA, 22 bp, Homo sapiens
tcacagctctgtcaattttata

SEQ ID NO: 9037259 - DNA, 22 bp, Homo sapiens
tcacagctccagactgcaactc

SEQ ID NO: 9037260 - DNA, 22 bp, Homo sapiens
tcacagctcactgtagcctcga

SEQ ID NO: 9037261 - DNA, 22 bp, Homo sapiens
tcacagctcactgtagcctcga

SEQ ID NO: 9037262 - DNA, 22 bp, Homo sapiens
tcacagctccagactgcaactc

SEQ ID NO: 9037263 - DNA, 22 bp, Homo sapiens
tcacagctccagactgcaactc

SEQ ID NO: 9037264 - DNA, 22 bp, Homo sapiens
tcacagaaatctgttttttcta

SEQ ID NO: 9037265 - DNA, 22 bp, Homo sapiens
tcacagaaatctgttttttcta

SEQ ID NO: 9037266 - DNA, 22 bp, Homo sapiens
tcacagaacaagcctggtggag

SEQ ID NO: 9037267 - DNA, 22 bp, Homo sapiens
tcacagaacaatgtttagttct

SEQ ID NO: 9037268 - DNA, 22 bp, Homo sapiens
tcacagaaagctgtgtcctgac

SEQ ID NO: 9037269 - DNA, 22 bp, Homo sapiens
tcacagaaataagatagttatt

SEQ ID NO: 9037270 - DNA, 22 bp, Homo sapiens
tcacagaaataagatagttatt

SEQ ID NO: 9037271 - DNA, 22 bp, Homo sapiens
tcacagaaataagatagttatt

SEQ ID NO: 9037272 - DNA, 22 bp, Homo sapiens
tcacagaaataagatagttatt

SEQ ID NO: 9037273 - DNA, 22 bp, Homo sapiens
tcacagaaataagatagttatt

SEQ ID NO: 9037274 - DNA, 22 bp, Homo sapiens
tcacagaacacaaatgccactt

SEQ ID NO: 9037275 - DNA, 22 bp, Homo sapiens
tcacagaagaagtagattgcat

SEQ ID NO: 9037276 - DNA, 22 bp, Homo sapiens
tcacagaacacaaatgccactt

SEQ ID NO: 9037277 - DNA, 22 bp, Homo sapiens
tcacagaagaagtagattgcat

SEQ ID NO: 9037278 - DNA, 22 bp, Homo sapiens
tcacagaagagcattaagatga

SEQ ID NO: 9037279 - DNA, 22 bp, Homo sapiens
tcacagaagagcattaagatga

SEQ ID NO: 9037280 - DNA, 22 bp, Homo sapiens
tcacagaagagcattaagatga

SEQ ID NO: 9037281 - DNA, 22 bp, Homo sapiens
tcacagaagagatattgacaga

SEQ ID NO: 9037282 - DNA, 22 bp, Homo sapiens
tcacagaagagatattgacaga

SEQ ID NO: 9037283 - DNA, 22 bp, Homo sapiens
tcacagaaaagctgagcatcag

SEQ ID NO: 9037284 - DNA, 20 bp, Homo sapiens
tcacagaaacaaatagagaa

SEQ ID NO: 9037285 - DNA, 20 bp, Homo sapiens
tcacagaaacaaatagagaa

SEQ ID NO: 9037286 - DNA, 20 bp, Homo sapiens
tcacagaaacaaatagagaa

SEQ ID NO: 9037287 - DNA, 20 bp, Homo sapiens
tcacagaaacaaatagagaa

SEQ ID NO: 9037288 - DNA, 22 bp, Homo sapiens
tcacacatgctaagccagagat

SEQ ID NO: 9037289 - DNA, 20 bp, Homo sapiens
tcacacatggtaagctatga

SEQ ID NO: 9037290 - DNA, 22 bp, Homo sapiens
tcacagaaaagctgagcatcag

SEQ ID NO: 9037291 - DNA, 22 bp, Homo sapiens
tcacaatgaaaaacactacata

SEQ ID NO: 9037292 - DNA, 22 bp, Homo sapiens
tcacaatgcaagtgttcagtgg

SEQ ID NO: 9037293 - DNA, 22 bp, Homo sapiens
tcacaatgcaagtgttcagtgg

SEQ ID NO: 9037294 - DNA, 22 bp, Homo sapiens
tcacacatgagtaaatacaggg

SEQ ID NO: 9037295 - DNA, 22 bp, Homo sapiens
tcacacatgagtaaatacaggg

SEQ ID NO: 9037296 - DNA, 22 bp, Homo sapiens
tcacaatgaaaaacactacata

SEQ ID NO: 9037297 - DNA, 22 bp, Homo sapiens
tcacaatatttatcttccaatt

SEQ ID NO: 9037298 - DNA, 22 bp, Homo sapiens
tcacaatatttatcttccaatt

SEQ ID NO: 9037299 - DNA, 22 bp, Homo sapiens
tcacaatatttatcttccaatt

SEQ ID NO: 9037300 - DNA, 20 bp, Homo sapiens
tcacaatatgagctcataca

SEQ ID NO: 9037301 - DNA, 20 bp, Homo sapiens
tcacaatatgagctcataca

SEQ ID NO: 9037302 - DNA, 22 bp, Homo sapiens
tcacaatactcactcaatggct

SEQ ID NO: 9037303 - DNA, 22 bp, Homo sapiens
tcacaatactcactcaatggct

SEQ ID NO: 9037304 - DNA, 20 bp, Homo sapiens
tcacaatatgagctcataca

SEQ ID NO: 9037305 - DNA, 22 bp, Homo sapiens
tcacaaagctttgataagcaga

SEQ ID NO: 9037306 - DNA, 22 bp, Homo sapiens
tcacaaaggatgatgaattctg

SEQ ID NO: 9037307 - DNA, 22 bp, Homo sapiens
tcacaaaggatgatgaattctg

SEQ ID NO: 9037308 - DNA, 22 bp, Homo sapiens
tcacaaagctttgataagcaga

SEQ ID NO: 9037309 - DNA, 22 bp, Homo sapiens
tcacaaagctttgataagcaga

SEQ ID NO: 9037310 - DNA, 22 bp, Homo sapiens
tcacaaacaatgctttggaatt

SEQ ID NO: 9037311 - DNA, 22 bp, Homo sapiens
tcacaaaaggccatgtggcttc

SEQ ID NO: 9037312 - DNA, 22 bp, Homo sapiens
tcacaaaaggccatgtggcttc

SEQ ID NO: 9037313 - DNA, 22 bp, Homo sapiens
tcacaaaagcttttgaatttgg

SEQ ID NO: 9037314 - DNA, 22 bp, Homo sapiens
tcacaaaagcttttgaatttgg

SEQ ID NO: 9037315 - DNA, 22 bp, Homo sapiens
tcacaaaagcttttgaatttgg

SEQ ID NO: 9037316 - DNA, 22 bp, Homo sapiens
tcacaaaagcttttgaatttgg

SEQ ID NO: 9037317 - DNA, 22 bp, Homo sapiens
tcacaaaagcttttgaatttgg

SEQ ID NO: 9037318 - DNA, 22 bp, Homo sapiens
tcacaaaagcttttgaatttgg

SEQ ID NO: 9037319 - DNA, 22 bp, Homo sapiens
tcacaaaagcttttgaatttgg

SEQ ID NO: 9037320 - DNA, 22 bp, Homo sapiens
tcacaaaagcttttgaatttgg

SEQ ID NO: 9037321 - DNA, 20 bp, Homo sapiens
tcaattttctacaacatttg

SEQ ID NO: 9037322 - DNA, 20 bp, Homo sapiens
tcaattttctacaacatttg

SEQ ID NO: 9037323 - DNA, 22 bp, Homo sapiens
tcacaaaagcttttgaatttgg

SEQ ID NO: 9037324 - DNA, 20 bp, Homo sapiens
tcaattttctacaacatttg

SEQ ID NO: 9037325 - DNA, 20 bp, Homo sapiens
tcaattttctacaacatttg

SEQ ID NO: 9037326 - DNA, 20 bp, Homo sapiens
tcaattttctacaacatttg

SEQ ID NO: 9037327 - DNA, 20 bp, Homo sapiens
tcaattttctacaacatttg

SEQ ID NO: 9037328 - DNA, 22 bp, Homo sapiens
tcacaaatagctatattaagga

SEQ ID NO: 9037329 - DNA, 22 bp, Homo sapiens
tcacaaagggagggatagctgg

SEQ ID NO: 9037330 - DNA, 22 bp, Homo sapiens
tcacaagagctggactgtcttt

SEQ ID NO: 9037331 - DNA, 22 bp, Homo sapiens
tcacaagagtaagttcatgcct

SEQ ID NO: 9037332 - DNA, 22 bp, Homo sapiens
tcacaagagctggactgtcttt

SEQ ID NO: 9037333 - DNA, 22 bp, Homo sapiens
tcacaagagtaagttcatgcct

SEQ ID NO: 9037334 - DNA, 22 bp, Homo sapiens
tcacaagagtaagttcatgcct

SEQ ID NO: 9037335 - DNA, 22 bp, Homo sapiens
tcacaagagtaagttcatgcct

SEQ ID NO: 9037336 - DNA, 22 bp, Homo sapiens
tcacaaatagctatattaagga

SEQ ID NO: 9037337 - DNA, 22 bp, Homo sapiens
tcacaagagctggactgtcttt

SEQ ID NO: 9037338 - DNA, 22 bp, Homo sapiens
tcacaagataaacatagctcca

SEQ ID NO: 9037339 - DNA, 22 bp, Homo sapiens
tcacaagagtaagttcatgcct

SEQ ID NO: 9037340 - DNA, 22 bp, Homo sapiens
tcacaagatacagttagaagca

SEQ ID NO: 9037341 - DNA, 22 bp, Homo sapiens
tcacaagatatttcagtccttt

SEQ ID NO: 9037342 - DNA, 22 bp, Homo sapiens
tcacaagatatttcagtccttt

SEQ ID NO: 9037343 - DNA, 22 bp, Homo sapiens
tcacaagatacagttagaagca

SEQ ID NO: 9037344 - DNA, 22 bp, Homo sapiens
tcacaagatatttcagtccttt

SEQ ID NO: 9037345 - DNA, 22 bp, Homo sapiens
tcacaaggataagccacatata

SEQ ID NO: 9037346 - DNA, 19 bp, Homo sapiens
tcacaaggcctcttagtct

SEQ ID NO: 9037347 - DNA, 22 bp, Homo sapiens
tcacaagatggctgctgcagcc

SEQ ID NO: 9037348 - DNA, 22 bp, Homo sapiens
tcacaagggccctgcagtccac

SEQ ID NO: 9037349 - DNA, 22 bp, Homo sapiens
tcacaaggttcactataaattg

SEQ ID NO: 9037350 - DNA, 22 bp, Homo sapiens
tcacaatactcactcaatggct

SEQ ID NO: 9037351 - DNA, 22 bp, Homo sapiens
tcacaaggtcctggtggataga

SEQ ID NO: 9037352 - DNA, 22 bp, Homo sapiens
tatttctgtcagccagatatgg

SEQ ID NO: 9037353 - DNA, 22 bp, Homo sapiens
tatttctgtatgcataaaagga

SEQ ID NO: 9037354 - DNA, 22 bp, Homo sapiens
tatttctgtaactcagggtctg

SEQ ID NO: 9037355 - DNA, 20 bp, Homo sapiens
tatttctgggcaaccattta

SEQ ID NO: 9037356 - DNA, 22 bp, Homo sapiens
tatttctgtttatttgtacatc

SEQ ID NO: 9037357 - DNA, 22 bp, Homo sapiens
tatttcttcgggattcaagcta

SEQ ID NO: 9037358 - DNA, 22 bp, Homo sapiens
tatttctgtttatttgtacatc

SEQ ID NO: 9037359 - DNA, 22 bp, Homo sapiens
tatttctgtttatttgtacatc

SEQ ID NO: 9037360 - DNA, 22 bp, Homo sapiens
tatttctgtttatttgtacatc

SEQ ID NO: 9037361 - DNA, 22 bp, Homo sapiens
tatttctgtcagccagatatgg

SEQ ID NO: 9037362 - DNA, 22 bp, Homo sapiens
tatttctgtcagccagatatgg

SEQ ID NO: 9037363 - DNA, 22 bp, Homo sapiens
tatttctgggagttcagaaatt

SEQ ID NO: 9037364 - DNA, 22 bp, Homo sapiens
tatttctgggagttcagaaatt

SEQ ID NO: 9037365 - DNA, 22 bp, Homo sapiens
tatttctgggagttcagaaatt

SEQ ID NO: 9037366 - DNA, 20 bp, Homo sapiens
tatttctgggcaaccattta

SEQ ID NO: 9037367 - DNA, 20 bp, Homo sapiens
tatttctgggcaaccattta

SEQ ID NO: 9037368 - DNA, 20 bp, Homo sapiens
tatttctgggcaaccattta

SEQ ID NO: 9037369 - DNA, 20 bp, Homo sapiens
tatttctgggcaaccattta

SEQ ID NO: 9037370 - DNA, 20 bp, Homo sapiens
tatttctgggcaaccattta

SEQ ID NO: 9037371 - DNA, 22 bp, Homo sapiens
tatttctgattgctcatgaggc

SEQ ID NO: 9037372 - DNA, 22 bp, Homo sapiens
tatttctgaggcccaggaagtg

SEQ ID NO: 9037373 - DNA, 22 bp, Homo sapiens
tatttctgggagttcagaaatt

SEQ ID NO: 9037374 - DNA, 22 bp, Homo sapiens
tatttctgattgctcatgaggc

SEQ ID NO: 9037375 - DNA, 22 bp, Homo sapiens
tatttctgaggcccaggaagtg

SEQ ID NO: 9037376 - DNA, 22 bp, Homo sapiens
tatttcttcgggattcaagcta

SEQ ID NO: 9037377 - DNA, 22 bp, Homo sapiens
tatttcttcgggattcaagcta

SEQ ID NO: 9037378 - DNA, 22 bp, Homo sapiens
tatttcttgagactcgtcttcc

SEQ ID NO: 9037379 - DNA, 22 bp, Homo sapiens
tatttcttgagactcgtcttcc

SEQ ID NO: 9037380 - DNA, 22 bp, Homo sapiens
tatttcttgagactcgtcttcc

SEQ ID NO: 9037381 - DNA, 22 bp, Homo sapiens
tatttcttgagactcgtcttcc

SEQ ID NO: 9037382 - DNA, 22 bp, Homo sapiens
tatttcttcgggattcaagcta

SEQ ID NO: 9037383 - DNA, 22 bp, Homo sapiens
tatttcttgagactcgtcttcc

SEQ ID NO: 9037384 - DNA, 22 bp, Homo sapiens
tatttcttgagtggtcagtttc

SEQ ID NO: 9037385 - DNA, 22 bp, Homo sapiens
tcaagaaggagactccactgtg

SEQ ID NO: 9037386 - DNA, 22 bp, Homo sapiens
tatttcttgagtggtcagtttc

SEQ ID NO: 9037387 - DNA, 22 bp, Homo sapiens
tatttcttgagtggtcagtttc

SEQ ID NO: 9037388 - DNA, 22 bp, Homo sapiens
tcaagaatagctgcaaacaggg

SEQ ID NO: 9037389 - DNA, 22 bp, Homo sapiens
tcaagaatttggataagaaatg

SEQ ID NO: 9037390 - DNA, 20 bp, Homo sapiens
tcaagacagacatggagttt

SEQ ID NO: 9037391 - DNA, 22 bp, Homo sapiens
tcaagaatttggataagaaatg

SEQ ID NO: 9037392 - DNA, 22 bp, Homo sapiens
tcaagacatattaaatgtgcga

SEQ ID NO: 9037393 - DNA, 22 bp, Homo sapiens
tcaagacatattaaatgtgcga

SEQ ID NO: 9037394 - DNA, 22 bp, Homo sapiens
tcaagacagtgtgatactggcc

SEQ ID NO: 9037395 - DNA, 22 bp, Homo sapiens
tcaagacatcactgtgcatttt

SEQ ID NO: 9037396 - DNA, 18 bp, Homo sapiens
tcaagacatcatgaaata

SEQ ID NO: 9037397 - DNA, 22 bp, Homo sapiens
tcaagacatcactgtgcatttt

SEQ ID NO: 9037398 - DNA, 22 bp, Homo sapiens
tcaagacagatgggtaacttgg

SEQ ID NO: 9037399 - DNA, 22 bp, Homo sapiens
tcaagaatttttaatgtgactg

SEQ ID NO: 9037400 - DNA, 22 bp, Homo sapiens
tcaagagcatgtatctccctaa

SEQ ID NO: 9037401 - DNA, 22 bp, Homo sapiens
tcaagagccaggtaagcacagg

SEQ ID NO: 9037402 - DNA, 22 bp, Homo sapiens
tcaagagattgaataataactg

SEQ ID NO: 9037403 - DNA, 22 bp, Homo sapiens
tcaagagcatgtatctccctaa

SEQ ID NO: 9037404 - DNA, 22 bp, Homo sapiens
tcaagagagtgctgcttggggt

SEQ ID NO: 9037405 - DNA, 18 bp, Homo sapiens
tcaagacatcatgaaata

SEQ ID NO: 9037406 - DNA, 22 bp, Homo sapiens
tcaaggaatgactatatgagga

SEQ ID NO: 9037407 - DNA, 22 bp, Homo sapiens
tcaaggaatgactatatgagga

SEQ ID NO: 9037408 - DNA, 22 bp, Homo sapiens
tcaaggaagggatattcttgaa

SEQ ID NO: 9037409 - DNA, 22 bp, Homo sapiens
tcaaggaaggtctgttgctcca

SEQ ID NO: 9037410 - DNA, 22 bp, Homo sapiens
tcaaggaatttagtttagtaaa

SEQ ID NO: 9037411 - DNA, 22 bp, Homo sapiens
tcaaggactattgcatgactcc

SEQ ID NO: 9037412 - DNA, 22 bp, Homo sapiens
tcaaggactattgcatgactcc

SEQ ID NO: 9037413 - DNA, 22 bp, Homo sapiens
tcaaggagacagaaagcaatgg

SEQ ID NO: 9037414 - DNA, 22 bp, Homo sapiens
tcaagctggctgttgctatttc

SEQ ID NO: 9037415 - DNA, 22 bp, Homo sapiens
tcaaggaagatagctattatga

SEQ ID NO: 9037416 - DNA, 22 bp, Homo sapiens
tcaaggaagggatattcttgaa

SEQ ID NO: 9037417 - DNA, 22 bp, Homo sapiens
tcaagataccaccattatatgt

SEQ ID NO: 9037418 - DNA, 22 bp, Homo sapiens
tcaagataccaccattatatgt

SEQ ID NO: 9037419 - DNA, 22 bp, Homo sapiens
tcaagataccaccattatatgt

SEQ ID NO: 9037420 - DNA, 22 bp, Homo sapiens
tcaagataagtcagtatatcaa

SEQ ID NO: 9037421 - DNA, 22 bp, Homo sapiens
tcaaggctattaattctgtgag

SEQ ID NO: 9037422 - DNA, 19 bp, Homo sapiens
tcaaggctccctgagggat

SEQ ID NO: 9037423 - DNA, 22 bp, Homo sapiens
tcaaggctattaattctgtgag

SEQ ID NO: 9037424 - DNA, 22 bp, Homo sapiens
tcaaggcttttggttttccata

SEQ ID NO: 9037425 - DNA, 22 bp, Homo sapiens
tcaaggcttttggttttccata

SEQ ID NO: 9037426 - DNA, 21 bp, Homo sapiens
tcaaggctgttgcattaatgc

SEQ ID NO: 9037427 - DNA, 22 bp, Homo sapiens
tcaagggaggagacacagccct

SEQ ID NO: 9037428 - DNA, 22 bp, Homo sapiens
tcaagggcaaatgctacctata

SEQ ID NO: 9037429 - DNA, 22 bp, Homo sapiens
tcaaggtctaggctcttctcca

SEQ ID NO: 9037430 - DNA, 22 bp, Homo sapiens
tcaaggcaaagtaaatattcaa

SEQ ID NO: 9037431 - DNA, 22 bp, Homo sapiens
tcaaggcaaagtaaatattcaa

SEQ ID NO: 9037432 - DNA, 22 bp, Homo sapiens
tcaaggagcccacagtctaatg

SEQ ID NO: 9037433 - DNA, 22 bp, Homo sapiens
tcaaggaggtgcttggcttcac

SEQ ID NO: 9037434 - DNA, 22 bp, Homo sapiens
tcaaggaggtgcttggcttcac

SEQ ID NO: 9037435 - DNA, 22 bp, Homo sapiens
tcaaggccagggaatgtagggg

SEQ ID NO: 9037436 - DNA, 22 bp, Homo sapiens
tcaaggcctatcctcatttgta

SEQ ID NO: 9037437 - DNA, 22 bp, Homo sapiens
tcaaggccacagtgagcagagt

SEQ ID NO: 9037438 - DNA, 22 bp, Homo sapiens
tcaagtcccagctcttcactta

SEQ ID NO: 9037439 - DNA, 19 bp, Homo sapiens
tcaagtcctaggcccacaa

SEQ ID NO: 9037440 - DNA, 19 bp, Homo sapiens
tcaagtcctaggcccacaa

SEQ ID NO: 9037441 - DNA, 22 bp, Homo sapiens
tcaagtatttatttctgctggc

SEQ ID NO: 9037442 - DNA, 22 bp, Homo sapiens
tcaagtattattacagatgtag

SEQ ID NO: 9037443 - DNA, 22 bp, Homo sapiens
tcaagtattattacagatgtag

SEQ ID NO: 9037444 - DNA, 22 bp, Homo sapiens
tcaagtattattacagatgtag

SEQ ID NO: 9037445 - DNA, 22 bp, Homo sapiens
tcaagtattatattctcatttt

SEQ ID NO: 9037446 - DNA, 22 bp, Homo sapiens
tcaaggtgactgaactataaac

SEQ ID NO: 9037447 - DNA, 22 bp, Homo sapiens
tcaaggtgctgtgctgtgctag

SEQ ID NO: 9037448 - DNA, 22 bp, Homo sapiens
tcaagtatgacatcaagtttct

SEQ ID NO: 9037449 - DNA, 22 bp, Homo sapiens
tcaagtatgacatcaagtttct

SEQ ID NO: 9037450 - DNA, 22 bp, Homo sapiens
tcaagtatatctagtcattagg

SEQ ID NO: 9037451 - DNA, 22 bp, Homo sapiens
tcaagtatgacatcaagtttct

SEQ ID NO: 9037452 - DNA, 22 bp, Homo sapiens
tcaataaatagcttggctcagc

SEQ ID NO: 9037453 - DNA, 22 bp, Homo sapiens
tcaataaatagcttggctcagc

SEQ ID NO: 9037454 - DNA, 22 bp, Homo sapiens
tcaataaatccctctgaccctg

SEQ ID NO: 9037455 - DNA, 22 bp, Homo sapiens
tcaataaatagcttggctcagc

SEQ ID NO: 9037456 - DNA, 22 bp, Homo sapiens
tcaataaatccctctgaccctg

SEQ ID NO: 9037457 - DNA, 22 bp, Homo sapiens
tcaataactttgtttagcattg

SEQ ID NO: 9037458 - DNA, 23 bp, Homo sapiens
tcaataactcgggttaaaataga

SEQ ID NO: 9037459 - DNA, 22 bp, Homo sapiens
tcaataaatccctctgaccctg

SEQ ID NO: 9037460 - DNA, 22 bp, Homo sapiens
tcaataaaattgttttcctatc

SEQ ID NO: 9037461 - DNA, 22 bp, Homo sapiens
tcaataaaattgttttcctatc

SEQ ID NO: 9037462 - DNA, 20 bp, Homo sapiens
tcaagttttgcttgacaaga

SEQ ID NO: 9037463 - DNA, 20 bp, Homo sapiens
tcaagttttgcttgacaaga

SEQ ID NO: 9037464 - DNA, 22 bp, Homo sapiens
tcaagtgtagtggtgtcaggtc

SEQ ID NO: 9037465 - DNA, 22 bp, Homo sapiens
tcaagtgtagtggtgtcaggtc

SEQ ID NO: 9037466 - DNA, 22 bp, Homo sapiens
tcaagttacctggtcattacta

SEQ ID NO: 9037467 - DNA, 22 bp, Homo sapiens
tcaagttaggtggttgttagga

SEQ ID NO: 9037468 - DNA, 20 bp, Homo sapiens
tcaagttttgcttgacaaga

SEQ ID NO: 9037469 - DNA, 22 bp, Homo sapiens
tcaagttaggtggttgttagga

SEQ ID NO: 9037470 - DNA, 22 bp, Homo sapiens
tcaagttaggtggttgttagga

SEQ ID NO: 9037471 - DNA, 22 bp, Homo sapiens
tcaattttatgaaacaaagtga

SEQ ID NO: 9037472 - DNA, 22 bp, Homo sapiens
tcaattttatgaaacaaagtga

SEQ ID NO: 9037473 - DNA, 22 bp, Homo sapiens
tcaattttatgaaacaaagtga

SEQ ID NO: 9037474 - DNA, 22 bp, Homo sapiens
tcaattttatgaaacaaagtga

SEQ ID NO: 9037475 - DNA, 22 bp, Homo sapiens
tcaattttatgaaacaaagtga

SEQ ID NO: 9037476 - DNA, 22 bp, Homo sapiens
tcaatttcttggtttgataata

SEQ ID NO: 9037477 - DNA, 22 bp, Homo sapiens
tcaatttcttggtttgataata

SEQ ID NO: 9037478 - DNA, 22 bp, Homo sapiens
tcaatttcttggtttgataata

SEQ ID NO: 9037479 - DNA, 22 bp, Homo sapiens
tcaatttcaacagctgataaga

SEQ ID NO: 9037480 - DNA, 22 bp, Homo sapiens
tcaatttcccctattgatagac

SEQ ID NO: 9037481 - DNA, 22 bp, Homo sapiens
tcaatacacatgccgctgttct

SEQ ID NO: 9037482 - DNA, 17 bp, Homo sapiens
tcaatacactgctttta

SEQ ID NO: 9037483 - DNA, 22 bp, Homo sapiens
tcaatttatgtggctattcatt

SEQ ID NO: 9037484 - DNA, 21 bp, Homo sapiens
tcaatacaggtgcatgtgtct

SEQ ID NO: 9037485 - DNA, 21 bp, Homo sapiens
tcaatacaggtgcatgtgtct

SEQ ID NO: 9037486 - DNA, 22 bp, Homo sapiens
tcaatacacatgccgctgttct

SEQ ID NO: 9037487 - DNA, 22 bp, Homo sapiens
tcaataatggcaggataaattt

SEQ ID NO: 9037488 - DNA, 22 bp, Homo sapiens
tcaataatggcaggataaattt

SEQ ID NO: 9037489 - DNA, 22 bp, Homo sapiens
tcaataatggcaggataaattt

SEQ ID NO: 9037490 - DNA, 22 bp, Homo sapiens
tcaataatggcaggataaattt

SEQ ID NO: 9037491 - DNA, 22 bp, Homo sapiens
tcaataatggcaggataaattt

SEQ ID NO: 9037492 - DNA, 22 bp, Homo sapiens
tcaataatggcaggataaattt

SEQ ID NO: 9037493 - DNA, 22 bp, Homo sapiens
tcaataatggcaggataaattt

SEQ ID NO: 9037494 - DNA, 22 bp, Homo sapiens
tcaataagtaggatatcaagat

SEQ ID NO: 9037495 - DNA, 22 bp, Homo sapiens
tcaataaggcaacattaagtta

SEQ ID NO: 9037496 - DNA, 22 bp, Homo sapiens
tcaataactttgtttagcattg

SEQ ID NO: 9037497 - DNA, 22 bp, Homo sapiens
tcaggaagcatcctgaggtgtc

SEQ ID NO: 9037498 - DNA, 22 bp, Homo sapiens
tcaggaagcatcctgaggtgtc

SEQ ID NO: 9037499 - DNA, 22 bp, Homo sapiens
tcaggaagattagtttcctacc

SEQ ID NO: 9037500 - DNA, 21 bp, Homo sapiens
tcaggaagagcttctcccact

SEQ ID NO: 9037501 - DNA, 21 bp, Homo sapiens
tcaggaagagcttctcccact

SEQ ID NO: 9037502 - DNA, 22 bp, Homo sapiens
tcaggaagattagtttcctacc

SEQ ID NO: 9037503 - DNA, 21 bp, Homo sapiens
tcaggaagagcttctcccact

SEQ ID NO: 9037504 - DNA, 21 bp, Homo sapiens
tcaggaagagccagttcatgc

SEQ ID NO: 9037505 - DNA, 21 bp, Homo sapiens
tcaggaagagccagttcatgc

SEQ ID NO: 9037506 - DNA, 21 bp, Homo sapiens
tcaggaagagccagttcatgc

SEQ ID NO: 9037507 - DNA, 21 bp, Homo sapiens
tcaggaagagccagttcatgc

SEQ ID NO: 9037508 - DNA, 22 bp, Homo sapiens
tcaggaagctactgccagcagc

SEQ ID NO: 9037509 - DNA, 22 bp, Homo sapiens
tcaggaagctactgccagcagc

SEQ ID NO: 9037510 - DNA, 22 bp, Homo sapiens
tcaggaagctcttgctgattct

SEQ ID NO: 9037511 - DNA, 22 bp, Homo sapiens
tcaggaagctactgccagcagc

SEQ ID NO: 9037512 - DNA, 22 bp, Homo sapiens
tcaggaagctcttgctgattct

SEQ ID NO: 9037513 - DNA, 22 bp, Homo sapiens
tcaggaagctcttgctgattct

SEQ ID NO: 9037514 - DNA, 22 bp, Homo sapiens
tcaggaagctcttgctgattct

SEQ ID NO: 9037515 - DNA, 22 bp, Homo sapiens
tcaggaagccggttaaatagat

SEQ ID NO: 9037516 - DNA, 22 bp, Homo sapiens
tcaggaagccactccacagaga

SEQ ID NO: 9037517 - DNA, 22 bp, Homo sapiens
tcaggaagccggttaaatagat

SEQ ID NO: 9037518 - DNA, 22 bp, Homo sapiens
tcaggaagccggttaaatagat

SEQ ID NO: 9037519 - DNA, 22 bp, Homo sapiens
tcaggaagccggttaaatagat

SEQ ID NO: 9037520 - DNA, 22 bp, Homo sapiens
tcaggaagccactccacagaga

SEQ ID NO: 9037521 - DNA, 22 bp, Homo sapiens
tcaggaagcatcctgaggtgtc

SEQ ID NO: 9037522 - DNA, 22 bp, Homo sapiens
tcaggaagcatcctgaggtgtc

SEQ ID NO: 9037523 - DNA, 22 bp, Homo sapiens
tcaggaagcatcctgaggtgtc

SEQ ID NO: 9037524 - DNA, 22 bp, Homo sapiens
tcaggaagccactccacagaga

SEQ ID NO: 9037525 - DNA, 22 bp, Homo sapiens
tcaggaagacaatctttggctc

SEQ ID NO: 9037526 - DNA, 22 bp, Homo sapiens
tcaggaagacaatctttggctc

SEQ ID NO: 9037527 - DNA, 22 bp, Homo sapiens
tcaggaagaagacggggcagga

SEQ ID NO: 9037528 - DNA, 22 bp, Homo sapiens
tcaggaagaagacggggcagga

SEQ ID NO: 9037529 - DNA, 22 bp, Homo sapiens
tcaggaagaagacggggcagga

SEQ ID NO: 9037530 - DNA, 22 bp, Homo sapiens
tcaggaagaaagaagggagtgt

SEQ ID NO: 9037531 - DNA, 22 bp, Homo sapiens
tcaggaagaaagaagggagtgt

SEQ ID NO: 9037532 - DNA, 22 bp, Homo sapiens
tcaggaagaaagaagggagtgt

SEQ ID NO: 9037533 - DNA, 22 bp, Homo sapiens
tcaggaagaaattctgtatctt

SEQ ID NO: 9037534 - DNA, 22 bp, Homo sapiens
tcaggaagaaattctgtatctt

SEQ ID NO: 9037535 - DNA, 22 bp, Homo sapiens
tcaggaaccctggtctcctgct

SEQ ID NO: 9037536 - DNA, 22 bp, Homo sapiens
tcaggaacccccgctgggtgaa

SEQ ID NO: 9037537 - DNA, 22 bp, Homo sapiens
tcaggaacttctaggaaagctg

SEQ ID NO: 9037538 - DNA, 22 bp, Homo sapiens
tcaggaaccctggtctcctgct

SEQ ID NO: 9037539 - DNA, 22 bp, Homo sapiens
tcaggaacataatgtgagtcag

SEQ ID NO: 9037540 - DNA, 22 bp, Homo sapiens
tcaggaacatttaaccacaggg

SEQ ID NO: 9037541 - DNA, 22 bp, Homo sapiens
tcaggaacataatgtgagtcag

SEQ ID NO: 9037542 - DNA, 22 bp, Homo sapiens
tcaggaacatttaaccacaggg

SEQ ID NO: 9037543 - DNA, 22 bp, Homo sapiens
tcaggaacacaggggcccatgc

SEQ ID NO: 9037544 - DNA, 22 bp, Homo sapiens
tcagctctgcactccactgtgg

SEQ ID NO: 9037545 - DNA, 22 bp, Homo sapiens
tcagctctgcaaggtcacctcc

SEQ ID NO: 9037546 - DNA, 22 bp, Homo sapiens
tcaggagtaaagacagagttcc

SEQ ID NO: 9037547 - DNA, 22 bp, Homo sapiens
tcaggagtaagggtaacccaga

SEQ ID NO: 9037548 - DNA, 22 bp, Homo sapiens
tcaggagtaagttataagtatt

SEQ ID NO: 9037549 - DNA, 22 bp, Homo sapiens
tcaggagtaaagacagagttcc

SEQ ID NO: 9037550 - DNA, 22 bp, Homo sapiens
tcaggagtaagggtaacccaga

SEQ ID NO: 9037551 - DNA, 22 bp, Homo sapiens
tcaggaggtttggattcagtta

SEQ ID NO: 9037552 - DNA, 22 bp, Homo sapiens
tcaggaggtttggattcagtta

SEQ ID NO: 9037553 - DNA, 22 bp, Homo sapiens
tcaggaggtttggattcagtta

SEQ ID NO: 9037554 - DNA, 22 bp, Homo sapiens
tcaggagtaaagaagacttgac

SEQ ID NO: 9037555 - DNA, 22 bp, Homo sapiens
tcaggagtaaagaagacttgac

SEQ ID NO: 9037556 - DNA, 22 bp, Homo sapiens
tcaggagtaagttataagtatt

SEQ ID NO: 9037557 - DNA, 22 bp, Homo sapiens
tcaggagtaagttataagtatt

SEQ ID NO: 9037558 - DNA, 22 bp, Homo sapiens
tcaggagtactggtgtctacag

SEQ ID NO: 9037559 - DNA, 22 bp, Homo sapiens
tcaggagtcctgcctgcagcct

SEQ ID NO: 9037560 - DNA, 22 bp, Homo sapiens
tcaggagtactggtgtctacag

SEQ ID NO: 9037561 - DNA, 22 bp, Homo sapiens
tcaggagtcctgcctgcagcct

SEQ ID NO: 9037562 - DNA, 22 bp, Homo sapiens
tcaggagtctgtgcagttccac

SEQ ID NO: 9037563 - DNA, 22 bp, Homo sapiens
tcaggaggttgaccacggggca

SEQ ID NO: 9037564 - DNA, 22 bp, Homo sapiens
tcaggaggtttggattcagtta

SEQ ID NO: 9037565 - DNA, 22 bp, Homo sapiens
tcaggaggttgaccacggggca

SEQ ID NO: 9037566 - DNA, 22 bp, Homo sapiens
tcaggaggttgaccacggggca

SEQ ID NO: 9037567 - DNA, 17 bp, Homo sapiens
tcaggaggtgtttctag

SEQ ID NO: 9037568 - DNA, 22 bp, Homo sapiens
tcaggaggtgtaacgaatacag

SEQ ID NO: 9037569 - DNA, 22 bp, Homo sapiens
tcaggaggtgtaggtcaagtga

SEQ ID NO: 9037570 - DNA, 22 bp, Homo sapiens
tcaggaggtgtaacgaatacag

SEQ ID NO: 9037571 - DNA, 22 bp, Homo sapiens
tcaggaggtgtaggtcaagtga

SEQ ID NO: 9037572 - DNA, 22 bp, Homo sapiens
tcaggaggtgtaggtcaagtga

SEQ ID NO: 9037573 - DNA, 17 bp, Homo sapiens
tcaggaggtgtttctag

SEQ ID NO: 9037574 - DNA, 17 bp, Homo sapiens
tcaggaggtgtttctag

SEQ ID NO: 9037575 - DNA, 22 bp, Homo sapiens
tcaggaaggcacttggtgtgtt

SEQ ID NO: 9037576 - DNA, 22 bp, Homo sapiens
tcaggaaggcacttggtgtgtt

SEQ ID NO: 9037577 - DNA, 22 bp, Homo sapiens
tcaggaaggcaaattgcatgat

SEQ ID NO: 9037578 - DNA, 22 bp, Homo sapiens
tcaggaaggcaaattgcatgat

SEQ ID NO: 9037579 - DNA, 22 bp, Homo sapiens
tcaggaaggcaaattgcatgat

SEQ ID NO: 9037580 - DNA, 22 bp, Homo sapiens
tcaggaaggcacttggtgtgtt

SEQ ID NO: 9037581 - DNA, 22 bp, Homo sapiens
tcaggaaggcgccccatcagga

SEQ ID NO: 9037582 - DNA, 22 bp, Homo sapiens
tcaggaaggcttcacacgagtg

SEQ ID NO: 9037583 - DNA, 22 bp, Homo sapiens
tcaggaagggctcagtctgtgc

SEQ ID NO: 9037584 - DNA, 22 bp, Homo sapiens
tcaggaagggctcagtctgtgc

SEQ ID NO: 9037585 - DNA, 22 bp, Homo sapiens
tcaggaaggcttcacacgagtg

SEQ ID NO: 9037586 - DNA, 22 bp, Homo sapiens
tcaggaaggcgccccatcagga

SEQ ID NO: 9037587 - DNA, 22 bp, Homo sapiens
tcaggaaggcgccccatcagga

SEQ ID NO: 9037588 - DNA, 22 bp, Homo sapiens
tcaggaagctgctctgggtggt

SEQ ID NO: 9037589 - DNA, 22 bp, Homo sapiens
tcaggaagctgctctgggtggt

SEQ ID NO: 9037590 - DNA, 22 bp, Homo sapiens
tcaggaagctgaattacaaaaa

SEQ ID NO: 9037591 - DNA, 22 bp, Homo sapiens
tcaggaagctgaattacaaaaa

SEQ ID NO: 9037592 - DNA, 22 bp, Homo sapiens
tcaggaaggagctggcctgcca

SEQ ID NO: 9037593 - DNA, 22 bp, Homo sapiens
tcaggaaggcaaattgcatgat

SEQ ID NO: 9037594 - DNA, 22 bp, Homo sapiens
tcaggaaggagctggcctgcca

SEQ ID NO: 9037595 - DNA, 22 bp, Homo sapiens
tcaggaagctgctctgggtggt

SEQ ID NO: 9037596 - DNA, 22 bp, Homo sapiens
tcaggaaggagctggcctgcca

SEQ ID NO: 9037597 - DNA, 21 bp, Homo sapiens
tcagcagcttttgcagtccct

SEQ ID NO: 9037598 - DNA, 22 bp, Homo sapiens
tcagcaggcacaccaaaaactg

SEQ ID NO: 9037599 - DNA, 22 bp, Homo sapiens
tcagcaggcacaccaaaaactg

SEQ ID NO: 9037600 - DNA, 22 bp, Homo sapiens
tcagcactttttaaagcagcat

SEQ ID NO: 9037601 - DNA, 21 bp, Homo sapiens
tcagcagaaagcaaggtcagt

SEQ ID NO: 9037602 - DNA, 22 bp, Homo sapiens
tcagcactttttaaagcagcat

SEQ ID NO: 9037603 - DNA, 22 bp, Homo sapiens
tcagcactttttaaagcagcat

SEQ ID NO: 9037604 - DNA, 22 bp, Homo sapiens
tcagcactttgaagcagaagga

SEQ ID NO: 9037605 - DNA, 22 bp, Homo sapiens
tcagcactttgaagcagaagga

SEQ ID NO: 9037606 - DNA, 22 bp, Homo sapiens
tcagcactttgaagcagaagga

SEQ ID NO: 9037607 - DNA, 22 bp, Homo sapiens
tcagcacttttactctctttgc

SEQ ID NO: 9037608 - DNA, 22 bp, Homo sapiens
tcagcactttgaagcagaagga

SEQ ID NO: 9037609 - DNA, 22 bp, Homo sapiens
tcagcacttggatttcagagat

SEQ ID NO: 9037610 - DNA, 21 bp, Homo sapiens
tcagcaggcaccagaaggctg

SEQ ID NO: 9037611 - DNA, 21 bp, Homo sapiens
tcagcaggcaccagaaggctg

SEQ ID NO: 9037612 - DNA, 22 bp, Homo sapiens
tcagcaggcaccggaagtgttt

SEQ ID NO: 9037613 - DNA, 21 bp, Homo sapiens
tcagcaggcaccagaaggctg

SEQ ID NO: 9037614 - DNA, 22 bp, Homo sapiens
tcagcaggcaccggaagtgttt

SEQ ID NO: 9037615 - DNA, 22 bp, Homo sapiens
tcagcaggcacggacaggctgc

SEQ ID NO: 9037616 - DNA, 22 bp, Homo sapiens
tcagcaggcacggacaggctgc

SEQ ID NO: 9037617 - DNA, 22 bp, Homo sapiens
tcagcaggcacggacaggctgc

SEQ ID NO: 9037618 - DNA, 22 bp, Homo sapiens
tcagcaggcacggacaggctgc

SEQ ID NO: 9037619 - DNA, 22 bp, Homo sapiens
tcagcctgcgtcatggtgacac

SEQ ID NO: 9037620 - DNA, 22 bp, Homo sapiens
tcagcaggcagaaatctgcaga

SEQ ID NO: 9037621 - DNA, 22 bp, Homo sapiens
tcagcaggcagaaatctgcaga

SEQ ID NO: 9037622 - DNA, 22 bp, Homo sapiens
tcagcctgctccaagtgctgcc

SEQ ID NO: 9037623 - DNA, 22 bp, Homo sapiens
tcagcctgctccaagtgctgcc

SEQ ID NO: 9037624 - DNA, 22 bp, Homo sapiens
tcagcctgctccaagtgctgcc

SEQ ID NO: 9037625 - DNA, 22 bp, Homo sapiens
tcagcctgctccaagtgctgcc

SEQ ID NO: 9037626 - DNA, 22 bp, Homo sapiens
tcagctccacagctcctctgcc

SEQ ID NO: 9037627 - DNA, 22 bp, Homo sapiens
tcagctccacagctcctctgcc

SEQ ID NO: 9037628 - DNA, 22 bp, Homo sapiens
tcagctcactctgcttcctggg

SEQ ID NO: 9037629 - DNA, 22 bp, Homo sapiens
tcagctacagcatctctgcttt

SEQ ID NO: 9037630 - DNA, 22 bp, Homo sapiens
tcagctatctgagaataaccct

SEQ ID NO: 9037631 - DNA, 18 bp, Homo sapiens
tcagcctgttgtctgcct

SEQ ID NO: 9037632 - DNA, 18 bp, Homo sapiens
tcagcctgttgtctgcct

SEQ ID NO: 9037633 - DNA, 18 bp, Homo sapiens
tcagcctgttgtctgcct

SEQ ID NO: 9037634 - DNA, 20 bp, Homo sapiens
tcagccttgaatgcttgaaa

SEQ ID NO: 9037635 - DNA, 22 bp, Homo sapiens
tcagcctggtgattcctctgtc

SEQ ID NO: 9037636 - DNA, 22 bp, Homo sapiens
tcagcctggtgattcctctgtc

SEQ ID NO: 9037637 - DNA, 22 bp, Homo sapiens
tcagcctggcaggatggcctgg

SEQ ID NO: 9037638 - DNA, 22 bp, Homo sapiens
tcagcctggcaggatggcctgg

SEQ ID NO: 9037639 - DNA, 22 bp, Homo sapiens
tcagcctggtgattcctctgtc

SEQ ID NO: 9037640 - DNA, 22 bp, Homo sapiens
tcagctccagagttgcacagtg

SEQ ID NO: 9037641 - DNA, 22 bp, Homo sapiens
tcagctccagagttgcacagtg

SEQ ID NO: 9037642 - DNA, 22 bp, Homo sapiens
tcagctcctcagagcctcagtt

SEQ ID NO: 9037643 - DNA, 22 bp, Homo sapiens
tcagctccatccctgcttttgc

SEQ ID NO: 9037644 - DNA, 22 bp, Homo sapiens
tcagctcctatactttgtcctg

SEQ ID NO: 9037645 - DNA, 22 bp, Homo sapiens
tcagctcctcatgcaggggata

SEQ ID NO: 9037646 - DNA, 22 bp, Homo sapiens
tcagctcctcatgcaggggata

SEQ ID NO: 9037647 - DNA, 22 bp, Homo sapiens
tcagctctaagttttatgcaaa

SEQ ID NO: 9037648 - DNA, 22 bp, Homo sapiens
tcagctcctcagagcctcagtt

SEQ ID NO: 9037649 - DNA, 22 bp, Homo sapiens
tcagctcctcagagcctcagtt

SEQ ID NO: 9037650 - DNA, 22 bp, Homo sapiens
tcagctcctcagagcctcagtt

SEQ ID NO: 9037651 - DNA, 22 bp, Homo sapiens
tcagctctctgggctcgaacct

SEQ ID NO: 9037652 - DNA, 22 bp, Homo sapiens
tcagctctcacagatctcaacc

SEQ ID NO: 9037653 - DNA, 22 bp, Homo sapiens
tcagctctacacacacctgtgt

SEQ ID NO: 9037654 - DNA, 22 bp, Homo sapiens
tcagctctaagttttatgcaaa

SEQ ID NO: 9037655 - DNA, 22 bp, Homo sapiens
tcagctctacacacacctgtgt

SEQ ID NO: 9037656 - DNA, 19 bp, Homo sapiens
tcaggagttagttgtgctc

SEQ ID NO: 9037657 - DNA, 22 bp, Homo sapiens
tcaggagttgaaggggatcctg

SEQ ID NO: 9037658 - DNA, 21 bp, Homo sapiens
tcaggagtggagagaattggt

SEQ ID NO: 9037659 - DNA, 19 bp, Homo sapiens
tcaggagttagttgtgctc

SEQ ID NO: 9037660 - DNA, 22 bp, Homo sapiens
tcaggagttgaaggggatcctg

SEQ ID NO: 9037661 - DNA, 22 bp, Homo sapiens
tcaggagtttcaggtgtaagtg

SEQ ID NO: 9037662 - DNA, 22 bp, Homo sapiens
tcaggagtttcaggtgtaagtg

SEQ ID NO: 9037663 - DNA, 22 bp, Homo sapiens
tcaggagtttcaggtgtaagtg

SEQ ID NO: 9037664 - DNA, 22 bp, Homo sapiens
tcaggagtttggcctacagagg

SEQ ID NO: 9037665 - DNA, 22 bp, Homo sapiens
tcaggagtttggcctacagagg

SEQ ID NO: 9037666 - DNA, 22 bp, Homo sapiens
tcaggagtgcagcagtttggag

SEQ ID NO: 9037667 - DNA, 22 bp, Homo sapiens
tcaggagtgccagtaccttttg

SEQ ID NO: 9037668 - DNA, 22 bp, Homo sapiens
tcaggagtgccagtaccttttg

SEQ ID NO: 9037669 - DNA, 21 bp, Homo sapiens
tcaggagtggagagaattggt

SEQ ID NO: 9037670 - DNA, 22 bp, Homo sapiens
tcaggagtgccagtaccttttg

SEQ ID NO: 9037671 - DNA, 22 bp, Homo sapiens
tcaggagtgcagcagtttggag

SEQ ID NO: 9037672 - DNA, 22 bp, Homo sapiens
tcaggagtgataccatttgtca

SEQ ID NO: 9037673 - DNA, 22 bp, Homo sapiens
tcaggagtgataccatttgtca

SEQ ID NO: 9037674 - DNA, 22 bp, Homo sapiens
tcaggagtcctgcctgcagcct

SEQ ID NO: 9037675 - DNA, 22 bp, Homo sapiens
tcaggagtctgtgcagttccac

SEQ ID NO: 9037676 - DNA, 22 bp, Homo sapiens
tcaggagtgataccatttgtca

SEQ ID NO: 9037677 - DNA, 18 bp, Homo sapiens
tcaggagtttgtggatgg

SEQ ID NO: 9037678 - DNA, 23 bp, Homo sapiens
tcaggatattgtgtgccaaggtg

SEQ ID NO: 9037679 - DNA, 22 bp, Homo sapiens
tcaggatcaggggcctttcctt

SEQ ID NO: 9037680 - DNA, 22 bp, Homo sapiens
tcaggagtttggcctacagagg

SEQ ID NO: 9037681 - DNA, 18 bp, Homo sapiens
tcaggagtttgtggatgg

SEQ ID NO: 9037682 - DNA, 22 bp, Homo sapiens
tcaggataaaatgtaatggcaa

SEQ ID NO: 9037683 - DNA, 22 bp, Homo sapiens
tcaggatgaagtcagaggggtc

SEQ ID NO: 9037684 - DNA, 22 bp, Homo sapiens
tcaggatccatagactcccaaa

SEQ ID NO: 9037685 - DNA, 22 bp, Homo sapiens
tcaggatgaccacgagcctcta

SEQ ID NO: 9037686 - DNA, 22 bp, Homo sapiens
tcaggatgacttcaaggaggaa

SEQ ID NO: 9037687 - DNA, 22 bp, Homo sapiens
tcaggatgacttcaaggaggaa

SEQ ID NO: 9037688 - DNA, 22 bp, Homo sapiens
tcaggatgaagtcagaggggtc

SEQ ID NO: 9037689 - DNA, 22 bp, Homo sapiens
tcaggatgaccacgagcctcta

SEQ ID NO: 9037690 - DNA, 22 bp, Homo sapiens
tcaggatgaccacgagcctcta

SEQ ID NO: 9037691 - DNA, 22 bp, Homo sapiens
tcaggcagtagaattgcttgaa

SEQ ID NO: 9037692 - DNA, 20 bp, Homo sapiens
tcaggatgtgctgagtgaag

SEQ ID NO: 9037693 - DNA, 20 bp, Homo sapiens
tcaggatgtgctgagtgaag

SEQ ID NO: 9037694 - DNA, 22 bp, Homo sapiens
tcaggatgttaatatagcatta

SEQ ID NO: 9037695 - DNA, 22 bp, Homo sapiens
tcaggatgtccaaaatccagcc

SEQ ID NO: 9037696 - DNA, 20 bp, Homo sapiens
tcaggatgtgctgagtgaag

SEQ ID NO: 9037697 - DNA, 21 bp, Homo sapiens
tcaggcagtgcaaatacatgg

SEQ ID NO: 9037698 - DNA, 20 bp, Homo sapiens
tcaggcagtggggaaaggca

SEQ ID NO: 9037699 - DNA, 21 bp, Homo sapiens
tcaggcagtgcaaatacatgg

SEQ ID NO: 9037700 - DNA, 21 bp, Homo sapiens
tcaggcagtgcaaatacatgg

SEQ ID NO: 9037701 - DNA, 22 bp, Homo sapiens
tcaggcagtctgactccggagg

SEQ ID NO: 9037702 - DNA, 21 bp, Homo sapiens
tcaggcagtgcaaatacatgg

SEQ ID NO: 9037703 - DNA, 22 bp, Homo sapiens
tcaggatggagggaagcacaga

SEQ ID NO: 9037704 - DNA, 22 bp, Homo sapiens
tcaggatggagtctatccagtg

SEQ ID NO: 9037705 - DNA, 22 bp, Homo sapiens
tcaggatgagctcataactatg

SEQ ID NO: 9037706 - DNA, 22 bp, Homo sapiens
tcaggatgagtcatcaagctgc

SEQ ID NO: 9037707 - DNA, 22 bp, Homo sapiens
tcaggatgagctcataactatg

SEQ ID NO: 9037708 - DNA, 22 bp, Homo sapiens
tcaggatggcacccaagctctt

SEQ ID NO: 9037709 - DNA, 17 bp, Homo sapiens
tcaggatgtagcagtag

SEQ ID NO: 9037710 - DNA, 22 bp, Homo sapiens
tcaggatggtgtggaggaaata

SEQ ID NO: 9037711 - DNA, 22 bp, Homo sapiens
tcaggatggtgtggaggaaata

SEQ ID NO: 9037712 - DNA, 22 bp, Homo sapiens
tcaggatggcttctgcatcaaa

SEQ ID NO: 9037713 - DNA, 22 bp, Homo sapiens
tcaggatggtcctttatgagaa

SEQ ID NO: 9037714 - DNA, 19 bp, Homo sapiens
tcaggcagttattcacaaa

SEQ ID NO: 9037715 - DNA, 19 bp, Homo sapiens
tcaggcagttattcacaaa

SEQ ID NO: 9037716 - DNA, 22 bp, Homo sapiens
tcaggcagtggtaaatgagtta

SEQ ID NO: 9037717 - DNA, 19 bp, Homo sapiens
tcaggcagttattcacaaa

SEQ ID NO: 9037718 - DNA, 20 bp, Homo sapiens
tcaggcagtggggaaaggca

SEQ ID NO: 9037719 - DNA, 20 bp, Homo sapiens
tcaggcagtggggaaaggca

SEQ ID NO: 9037720 - DNA, 22 bp, Homo sapiens
tcaggcagtggtaaatgagtta

SEQ ID NO: 9037721 - DNA, 20 bp, Homo sapiens
tcaggcagtggggaaaggca

SEQ ID NO: 9037722 - DNA, 20 bp, Homo sapiens
tcaggcagtggggaaaggca

SEQ ID NO: 9037723 - DNA, 22 bp, Homo sapiens
tcaggccaaagaaacagcatga

SEQ ID NO: 9037724 - DNA, 22 bp, Homo sapiens
tcaggccaaggtagacatgact

SEQ ID NO: 9037725 - DNA, 22 bp, Homo sapiens
tcaggccaaagaaacagcatga

SEQ ID NO: 9037726 - DNA, 22 bp, Homo sapiens
tcaggccaaggtagacatgact

SEQ ID NO: 9037727 - DNA, 22 bp, Homo sapiens
tcaggccaaggtagacatgact

SEQ ID NO: 9037728 - DNA, 22 bp, Homo sapiens
tcaggccaaggtagacatgact

SEQ ID NO: 9037729 - DNA, 22 bp, Homo sapiens
tcaggccacggctcactgagac

SEQ ID NO: 9037730 - DNA, 22 bp, Homo sapiens
tcaggccacggctcactgagac

SEQ ID NO: 9037731 - DNA, 19 bp, Homo sapiens
tcaggcagttattcacaaa

SEQ ID NO: 9037732 - DNA, 19 bp, Homo sapiens
tcaggcagttattcacaaa

SEQ ID NO: 9037733 - DNA, 22 bp, Homo sapiens
tcaggcatgcattctgcaggtt

SEQ ID NO: 9037734 - DNA, 22 bp, Homo sapiens
tcaggcattcccatgcataaga

SEQ ID NO: 9037735 - DNA, 22 bp, Homo sapiens
tcaggccacttcacaggtgatt

SEQ ID NO: 9037736 - DNA, 22 bp, Homo sapiens
tcaggccacttcacaggtgatt

SEQ ID NO: 9037737 - DNA, 22 bp, Homo sapiens
tcaggccacggctcactgagac

SEQ ID NO: 9037738 - DNA, 22 bp, Homo sapiens
tcaggccacggctcactgagac

SEQ ID NO: 9037739 - DNA, 22 bp, Homo sapiens
tcaggccacggctcactgagac

SEQ ID NO: 9037740 - DNA, 22 bp, Homo sapiens
tcaggccacttcacaggtgatt

SEQ ID NO: 9037741 - DNA, 22 bp, Homo sapiens
tcaggccagcaccatccctatc

SEQ ID NO: 9037742 - DNA, 22 bp, Homo sapiens
tcaggccaggagatcagattga

SEQ ID NO: 9037743 - DNA, 22 bp, Homo sapiens
tcaggcctgcaaatgaatggta

SEQ ID NO: 9037744 - DNA, 22 bp, Homo sapiens
tcaggcctgagaaaaatccttt

SEQ ID NO: 9037745 - DNA, 22 bp, Homo sapiens
tcaggcctgcaaatgaatggta

SEQ ID NO: 9037746 - DNA, 22 bp, Homo sapiens
tcaggcctgcaggcttcctgga

SEQ ID NO: 9037747 - DNA, 22 bp, Homo sapiens
tcaggcctgcaggcttcctgga

SEQ ID NO: 9037748 - DNA, 22 bp, Homo sapiens
tcaggcctgcaggcttcctgga

SEQ ID NO: 9037749 - DNA, 22 bp, Homo sapiens
tcaggcctgcaaggagagtccc

SEQ ID NO: 9037750 - DNA, 22 bp, Homo sapiens
tcaggcctgcaaggagagtccc

SEQ ID NO: 9037751 - DNA, 22 bp, Homo sapiens
tcaggcctgcaaggagagtccc

SEQ ID NO: 9037752 - DNA, 22 bp, Homo sapiens
tcaggcctgcaggcttcctgga

SEQ ID NO: 9037753 - DNA, 22 bp, Homo sapiens
tcaggcctgcaggcttcctgga

SEQ ID NO: 9037754 - DNA, 22 bp, Homo sapiens
tcaggcctgcaggcttcctgga

SEQ ID NO: 9037755 - DNA, 22 bp, Homo sapiens
tcaggcctgcagtgccaaccca

SEQ ID NO: 9037756 - DNA, 22 bp, Homo sapiens
tcaggcctgcagtgccaaccca

SEQ ID NO: 9037757 - DNA, 22 bp, Homo sapiens
tcaggcctgctgtatgatggat

SEQ ID NO: 9037758 - DNA, 22 bp, Homo sapiens
tcaggcctgccctgaaagcaca

SEQ ID NO: 9037759 - DNA, 22 bp, Homo sapiens
tcaggcctgcagtgccaaccca

SEQ ID NO: 9037760 - DNA, 22 bp, Homo sapiens
tcaggcctgctgtatgatggat

SEQ ID NO: 9037761 - DNA, 16 bp, Homo sapiens
tcaggcctggacgagc

SEQ ID NO: 9037762 - DNA, 22 bp, Homo sapiens
tcaggcctggagaaaggaatga

SEQ ID NO: 9037763 - DNA, 22 bp, Homo sapiens
tcaggccttcagacctggcccg

SEQ ID NO: 9037764 - DNA, 22 bp, Homo sapiens
tcaggcctgtgctggaggagat

SEQ ID NO: 9037765 - DNA, 22 bp, Homo sapiens
tcaggccttcagacctggcccg

SEQ ID NO: 9037766 - DNA, 22 bp, Homo sapiens
tcaggccttcagacctggcccg

SEQ ID NO: 9037767 - DNA, 22 bp, Homo sapiens
tcaggccttcagacctggcccg

SEQ ID NO: 9037768 - DNA, 22 bp, Homo sapiens
tcaggctgctggccagcaggct

SEQ ID NO: 9037769 - DNA, 22 bp, Homo sapiens
tcaggctgctggccagcaggct

SEQ ID NO: 9037770 - DNA, 22 bp, Homo sapiens
tcaggctgctggccagcaggct

SEQ ID NO: 9037771 - DNA, 22 bp, Homo sapiens
tcaggctgataggaggaactga

SEQ ID NO: 9037772 - DNA, 22 bp, Homo sapiens
tcaggctgataggaggaactga

SEQ ID NO: 9037773 - DNA, 21 bp, Homo sapiens
tcaggctgatgtcgatgttag

SEQ ID NO: 9037774 - DNA, 22 bp, Homo sapiens
tcaggctgctggccagcaggct

SEQ ID NO: 9037775 - DNA, 18 bp, Homo sapiens
tcaggctggaagtttgcc

SEQ ID NO: 9037776 - DNA, 18 bp, Homo sapiens
tcaggctggaagtttgcc

SEQ ID NO: 9037777 - DNA, 18 bp, Homo sapiens
tcaggctggaagtttgcc

SEQ ID NO: 9037778 - DNA, 22 bp, Homo sapiens
tcaggctgctgtactgtgaatg

SEQ ID NO: 9037779 - DNA, 22 bp, Homo sapiens
tcaggctgctgtactgtgaatg

SEQ ID NO: 9037780 - DNA, 22 bp, Homo sapiens
tcaggctgctttcatgcttaga

SEQ ID NO: 9037781 - DNA, 22 bp, Homo sapiens
tcaggctgctttcatgcttaga

SEQ ID NO: 9037782 - DNA, 22 bp, Homo sapiens
tcaggctggaatgcagtggggc

SEQ ID NO: 9037783 - DNA, 22 bp, Homo sapiens
tcaggctggaatgcagtggggc

SEQ ID NO: 9037784 - DNA, 22 bp, Homo sapiens
tcaggctggaatgcagtggggc

SEQ ID NO: 9037785 - DNA, 22 bp, Homo sapiens
tcaggctgaggtcatctgcatc

SEQ ID NO: 9037786 - DNA, 22 bp, Homo sapiens
tcaggctggaatgcagtggggc

SEQ ID NO: 9037787 - DNA, 22 bp, Homo sapiens
tcaggctggaatgcagtggggc

SEQ ID NO: 9037788 - DNA, 22 bp, Homo sapiens
tcaggctggagtgcagtggcgc

SEQ ID NO: 9037789 - DNA, 22 bp, Homo sapiens
tcaggctggagtgcagtggcgc

SEQ ID NO: 9037790 - DNA, 22 bp, Homo sapiens
tcaggctggagtgcagtggcgc

SEQ ID NO: 9037791 - DNA, 22 bp, Homo sapiens
tcaggctggagtgcagtggcgc

SEQ ID NO: 9037792 - DNA, 22 bp, Homo sapiens
tcagggaacaatgttatggctt

SEQ ID NO: 9037793 - DNA, 22 bp, Homo sapiens
tcagggaacaatgttatggctt

SEQ ID NO: 9037794 - DNA, 22 bp, Homo sapiens
tcagggaacctctcctgtttct

SEQ ID NO: 9037795 - DNA, 22 bp, Homo sapiens
tcagggaacatcgttaaactag

SEQ ID NO: 9037796 - DNA, 22 bp, Homo sapiens
tcagggaaattcaagggagatt

SEQ ID NO: 9037797 - DNA, 22 bp, Homo sapiens
tcagggaaatttccatgtgttt

SEQ ID NO: 9037798 - DNA, 22 bp, Homo sapiens
tcagggaaattcaagggagatt

SEQ ID NO: 9037799 - DNA, 22 bp, Homo sapiens
tcagggaaatttccatgtgttt

SEQ ID NO: 9037800 - DNA, 22 bp, Homo sapiens
tcagggaaattcaagggagatt

SEQ ID NO: 9037801 - DNA, 22 bp, Homo sapiens
tcagggaaatagcagggctgaa

SEQ ID NO: 9037802 - DNA, 22 bp, Homo sapiens
tcagggaaaggggagagtcatt

SEQ ID NO: 9037803 - DNA, 22 bp, Homo sapiens
tcagggaaatagcagggctgaa

SEQ ID NO: 9037804 - DNA, 22 bp, Homo sapiens
tcagggaaaggggagagtcatt

SEQ ID NO: 9037805 - DNA, 22 bp, Homo sapiens
tcagggaaaggggagagtcatt

SEQ ID NO: 9037806 - DNA, 22 bp, Homo sapiens
tcagggaaacctaaggaagcca

SEQ ID NO: 9037807 - DNA, 22 bp, Homo sapiens
tcagggaaacctaaggaagcca

SEQ ID NO: 9037808 - DNA, 22 bp, Homo sapiens
tcagggaaacaggttttccctt

SEQ ID NO: 9037809 - DNA, 22 bp, Homo sapiens
tcagggaaacctaaggaagcca

SEQ ID NO: 9037810 - DNA, 22 bp, Homo sapiens
tcagggaaaagtcacactgggt

SEQ ID NO: 9037811 - DNA, 22 bp, Homo sapiens
tcagggaaaacatcccgcctaa

SEQ ID NO: 9037812 - DNA, 18 bp, Homo sapiens
tcaggctgggcctccttc

SEQ ID NO: 9037813 - DNA, 22 bp, Homo sapiens
tcaggctgggctcctctcccca

SEQ ID NO: 9037814 - DNA, 18 bp, Homo sapiens
tcaggctgggcctccttc

SEQ ID NO: 9037815 - DNA, 22 bp, Homo sapiens
tcaggctgggctcctctcccca

SEQ ID NO: 9037816 - DNA, 22 bp, Homo sapiens
tcaggctggggtgctaaggtgt

SEQ ID NO: 9037817 - DNA, 22 bp, Homo sapiens
tcaggctggggtgctaaggtgt

SEQ ID NO: 9037818 - DNA, 22 bp, Homo sapiens
tcaggctttttctcaacctctt

SEQ ID NO: 9037819 - DNA, 22 bp, Homo sapiens
tcaggctttttctcaacctctt

SEQ ID NO: 9037820 - DNA, 22 bp, Homo sapiens
tcaggctgggagacaatcactg

SEQ ID NO: 9037821 - DNA, 22 bp, Homo sapiens
tcaggctggagtgcagtggcgc

SEQ ID NO: 9037822 - DNA, 22 bp, Homo sapiens
tcaggctgggctcctctcccca

SEQ ID NO: 9037823 - DNA, 22 bp, Homo sapiens
tcaggctgggagacaatcactg

SEQ ID NO: 9037824 - DNA, 18 bp, Homo sapiens
tcaggctgggcctccttc

SEQ ID NO: 9037825 - DNA, 18 bp, Homo sapiens
tcaggctgggcctccttc

SEQ ID NO: 9037826 - DNA, 22 bp, Homo sapiens
tcatatttaggcctttaattca

SEQ ID NO: 9037827 - DNA, 22 bp, Homo sapiens
tcatatttaggcctttaattca

SEQ ID NO: 9037828 - DNA, 22 bp, Homo sapiens
tcatatttaggcctttaattca

SEQ ID NO: 9037829 - DNA, 22 bp, Homo sapiens
tcatattagggtaatgataaga

SEQ ID NO: 9037830 - DNA, 22 bp, Homo sapiens
tcatattagggtaatgataaga

SEQ ID NO: 9037831 - DNA, 22 bp, Homo sapiens
tcatattagggtaatgataaga

SEQ ID NO: 9037832 - DNA, 22 bp, Homo sapiens
tcatatttatatgttggcacag

SEQ ID NO: 9037833 - DNA, 22 bp, Homo sapiens
tcatatttcaaaatggctggag

SEQ ID NO: 9037834 - DNA, 22 bp, Homo sapiens
tcatatttcaaaatggctggag

SEQ ID NO: 9037835 - DNA, 22 bp, Homo sapiens
tcatatttatatgttggcacag

SEQ ID NO: 9037836 - DNA, 22 bp, Homo sapiens
tcatatttagttcacgctcaat

SEQ ID NO: 9037837 - DNA, 22 bp, Homo sapiens
tcatatttagttcacgctcaat

SEQ ID NO: 9037838 - DNA, 21 bp, Homo sapiens
tcatatttctcttgctattgt

SEQ ID NO: 9037839 - DNA, 21 bp, Homo sapiens
tcatatttctcttgctattgt

SEQ ID NO: 9037840 - DNA, 21 bp, Homo sapiens
tcatatttctcttgctattgt

SEQ ID NO: 9037841 - DNA, 21 bp, Homo sapiens
tcatatttctcttgctattgt

SEQ ID NO: 9037842 - DNA, 19 bp, Homo sapiens
tcatgcatttctaagtgca

SEQ ID NO: 9037843 - DNA, 22 bp, Homo sapiens
tcatgcattgcagcacattcag

SEQ ID NO: 9037844 - DNA, 22 bp, Homo sapiens
tcatgctgaggatgctgtgaag

SEQ ID NO: 9037845 - DNA, 22 bp, Homo sapiens
tcatgctctggtttagctgttt

SEQ ID NO: 9037846 - DNA, 22 bp, Homo sapiens
tcatgctcatcattagagtgac

SEQ ID NO: 9037847 - DNA, 22 bp, Homo sapiens
tcatgctgagtcctggctttgt

SEQ ID NO: 9037848 - DNA, 22 bp, Homo sapiens
tcatgctgagtcctggctttgt

SEQ ID NO: 9037849 - DNA, 22 bp, Homo sapiens
tcatgctgcaggcccaggcagg

SEQ ID NO: 9037850 - DNA, 22 bp, Homo sapiens
tcatgctggcccagaatggagg

SEQ ID NO: 9037851 - DNA, 22 bp, Homo sapiens
tcatgctgggtactatggctgc

SEQ ID NO: 9037852 - DNA, 22 bp, Homo sapiens
tcatgcctgattatgttactca

SEQ ID NO: 9037853 - DNA, 23 bp, Homo sapiens
tcatgcccaggctccagatgtca

SEQ ID NO: 9037854 - DNA, 22 bp, Homo sapiens
tcatgctagttaagaacacaat

SEQ ID NO: 9037855 - DNA, 22 bp, Homo sapiens
tcatgctatttcgaatgtaata

SEQ ID NO: 9037856 - DNA, 20 bp, Homo sapiens
tcatatgtggttgtatacaa

SEQ ID NO: 9037857 - DNA, 22 bp, Homo sapiens
tcatattaacaatgaaactcag

SEQ ID NO: 9037858 - DNA, 20 bp, Homo sapiens
tcatatgtggttgtatacaa

SEQ ID NO: 9037859 - DNA, 22 bp, Homo sapiens
tcatatgtcactcatgggcata

SEQ ID NO: 9037860 - DNA, 21 bp, Homo sapiens
tcatatctgctttgctgtctg

SEQ ID NO: 9037861 - DNA, 22 bp, Homo sapiens
tcatatattttggcagtgatca

SEQ ID NO: 9037862 - DNA, 22 bp, Homo sapiens
tcatatatctgcaaagcagtat

SEQ ID NO: 9037863 - DNA, 22 bp, Homo sapiens
tcatatatctgcaaagcagtat

SEQ ID NO: 9037864 - DNA, 22 bp, Homo sapiens
tcatatatctgcaaagcagtat

SEQ ID NO: 9037865 - DNA, 22 bp, Homo sapiens
tcatatagagggcatacaaatg

SEQ ID NO: 9037866 - DNA, 22 bp, Homo sapiens
tcatatagagggcatacaaatg

SEQ ID NO: 9037867 - DNA, 22 bp, Homo sapiens
tcatatactgccttgtagatta

SEQ ID NO: 9037868 - DNA, 22 bp, Homo sapiens
tcatataccagagagtttatat

SEQ ID NO: 9037869 - DNA, 22 bp, Homo sapiens
tcatataccagagagtttatat

SEQ ID NO: 9037870 - DNA, 22 bp, Homo sapiens
tcatatactgccttgtagatta

SEQ ID NO: 9037871 - DNA, 22 bp, Homo sapiens
tcatatacctgcatgtgcatgt

SEQ ID NO: 9037872 - DNA, 22 bp, Homo sapiens
tcatataccagagagtttatat

SEQ ID NO: 9037873 - DNA, 22 bp, Homo sapiens
tcatataagtttaaaactatct

SEQ ID NO: 9037874 - DNA, 22 bp, Homo sapiens
tcatataagtttaaaactatct

SEQ ID NO: 9037875 - DNA, 22 bp, Homo sapiens
tcatataactggatattttcaa

SEQ ID NO: 9037876 - DNA, 22 bp, Homo sapiens
tcatataactggatattttcaa

SEQ ID NO: 9037877 - DNA, 22 bp, Homo sapiens
tcatataagagctttagagtca

SEQ ID NO: 9037878 - DNA, 22 bp, Homo sapiens
tcatataactggatattttcaa

SEQ ID NO: 9037879 - DNA, 22 bp, Homo sapiens
tcatagttctgttttgaaggat

SEQ ID NO: 9037880 - DNA, 22 bp, Homo sapiens
tcatagggcatcaagcagagca

SEQ ID NO: 9037881 - DNA, 22 bp, Homo sapiens
tcatataagagctttagagtca

SEQ ID NO: 9037882 - DNA, 22 bp, Homo sapiens
tcatataagtttaaaactatct

SEQ ID NO: 9037883 - DNA, 22 bp, Homo sapiens
tcatataagtttaaaactatct

SEQ ID NO: 9037884 - DNA, 22 bp, Homo sapiens
tcatataagtttaaaactatct

SEQ ID NO: 9037885 - DNA, 22 bp, Homo sapiens
tcatataactggatattttcaa

SEQ ID NO: 9037886 - DNA, 22 bp, Homo sapiens
tcagtgttagacaagtttggaa

SEQ ID NO: 9037887 - DNA, 22 bp, Homo sapiens
tcagtgttagacaagtttggaa

SEQ ID NO: 9037888 - DNA, 22 bp, Homo sapiens
tcagtgttacattatatagaac

SEQ ID NO: 9037889 - DNA, 22 bp, Homo sapiens
tcagtgttagacaagtttggaa

SEQ ID NO: 9037890 - DNA, 22 bp, Homo sapiens
tcagtgttattagatgaggttt

SEQ ID NO: 9037891 - DNA, 22 bp, Homo sapiens
tcagtgttattagatgaggttt

SEQ ID NO: 9037892 - DNA, 22 bp, Homo sapiens
tcagtgttattagatgaggttt

SEQ ID NO: 9037893 - DNA, 22 bp, Homo sapiens
tcagtgttcagcggtgtgtgca

SEQ ID NO: 9037894 - DNA, 22 bp, Homo sapiens
tcagtgttcgctcagggactcc

SEQ ID NO: 9037895 - DNA, 22 bp, Homo sapiens
tcagtgttcgctcagggactcc

SEQ ID NO: 9037896 - DNA, 16 bp, Homo sapiens
tcagtgttccagaata

SEQ ID NO: 9037897 - DNA, 22 bp, Homo sapiens
tcagtgttcagcggtgtgtgca

SEQ ID NO: 9037898 - DNA, 22 bp, Homo sapiens
tcagtgttcagggaccaggtcc

SEQ ID NO: 9037899 - DNA, 22 bp, Homo sapiens
tcatagctaagctccagagtgc

SEQ ID NO: 9037900 - DNA, 22 bp, Homo sapiens
tcataggagtagcagtgagagg

SEQ ID NO: 9037901 - DNA, 22 bp, Homo sapiens
tcatggaaacaatgcggaaaaa

SEQ ID NO: 9037902 - DNA, 22 bp, Homo sapiens
tcatggaaacagcaatgctaat

SEQ ID NO: 9037903 - DNA, 22 bp, Homo sapiens
tcatggaaacagcaatgctaat

SEQ ID NO: 9037904 - DNA, 22 bp, Homo sapiens
tcatgctgtgaactgtatacat

SEQ ID NO: 9037905 - DNA, 22 bp, Homo sapiens
tcatgctgggtactatggctgc

SEQ ID NO: 9037906 - DNA, 22 bp, Homo sapiens
tcatgctgtgaactgtatacat

SEQ ID NO: 9037907 - DNA, 22 bp, Homo sapiens
tcatgcttattgcatatttgga

SEQ ID NO: 9037908 - DNA, 22 bp, Homo sapiens
tcatggaatagagcagtggcaa

SEQ ID NO: 9037909 - DNA, 20 bp, Homo sapiens
tcatggaatctcactctagt

SEQ ID NO: 9037910 - DNA, 21 bp, Homo sapiens
tcatggaagtaacaaacatat

SEQ ID NO: 9037911 - DNA, 21 bp, Homo sapiens
tcatggaagtaacaaacatat

SEQ ID NO: 9037912 - DNA, 22 bp, Homo sapiens
tcatggaatagagcagtggcaa

SEQ ID NO: 9037913 - DNA, 19 bp, Homo sapiens
tcatggaagaaatgtgata

SEQ ID NO: 9037914 - DNA, 19 bp, Homo sapiens
tcatggaagaaatgtgata

SEQ ID NO: 9037915 - DNA, 23 bp, Homo sapiens
tcatggaactgggcaatcttgaa

SEQ ID NO: 9037916 - DNA, 22 bp, Homo sapiens
tcatggaaacagcaatgctaat

SEQ ID NO: 9037917 - DNA, 22 bp, Homo sapiens
tcatggcacttagcacagtcct

SEQ ID NO: 9037918 - DNA, 22 bp, Homo sapiens
tcatggcacttagcacagtcct

SEQ ID NO: 9037919 - DNA, 22 bp, Homo sapiens
tcatggcacatgccctccaggg

SEQ ID NO: 9037920 - DNA, 22 bp, Homo sapiens
tcatggattaaattattaagtt

SEQ ID NO: 9037921 - DNA, 22 bp, Homo sapiens
tcatggatggccgggaggtgat

SEQ ID NO: 9037922 - DNA, 22 bp, Homo sapiens
tcatggatgggcccagctctgt

SEQ ID NO: 9037923 - DNA, 22 bp, Homo sapiens
tcatggattaaattattaagtt

SEQ ID NO: 9037924 - DNA, 21 bp, Homo sapiens
tcatggattttctctgctttt

SEQ ID NO: 9037925 - DNA, 21 bp, Homo sapiens
tcatggattttctctgctttt

SEQ ID NO: 9037926 - DNA, 22 bp, Homo sapiens
tcatggagactttgagcctgtt

SEQ ID NO: 9037927 - DNA, 22 bp, Homo sapiens
tcatggataaaatattggttaa

SEQ ID NO: 9037928 - DNA, 22 bp, Homo sapiens
tcatggatgggcccagctctgt

SEQ ID NO: 9037929 - DNA, 22 bp, Homo sapiens
tcatggatggccgggaggtgat

SEQ ID NO: 9037930 - DNA, 22 bp, Homo sapiens
tcatggatgatagcttcattgc

SEQ ID NO: 9037931 - DNA, 22 bp, Homo sapiens
tcatggatgatagcttcattgc

SEQ ID NO: 9037932 - DNA, 19 bp, Homo sapiens
tcatggatcaggtagttta

SEQ ID NO: 9037933 - DNA, 22 bp, Homo sapiens
tcatggataaaatattggttaa

SEQ ID NO: 9037934 - DNA, 20 bp, Homo sapiens
tcatggcagccacccacagg

SEQ ID NO: 9037935 - DNA, 22 bp, Homo sapiens
tcatggcacttagtgtctcaaa

SEQ ID NO: 9037936 - DNA, 22 bp, Homo sapiens
tcatggcattgttaagggtttt

SEQ ID NO: 9037937 - DNA, 22 bp, Homo sapiens
tcatggcagtttaataagtggt

SEQ ID NO: 9037938 - DNA, 22 bp, Homo sapiens
tcatggcagccctttactagag

SEQ ID NO: 9037939 - DNA, 22 bp, Homo sapiens
tcatggcagtttaataagtggt

SEQ ID NO: 9037940 - DNA, 22 bp, Homo sapiens
tcatggcagtataattcctcaa

SEQ ID NO: 9037941 - DNA, 22 bp, Homo sapiens
tcatggctaaccaaggcctgat

SEQ ID NO: 9037942 - DNA, 22 bp, Homo sapiens
tcatggctaatgcagtatattc

SEQ ID NO: 9037943 - DNA, 22 bp, Homo sapiens
tcatggcattgttaagggtttt

SEQ ID NO: 9037944 - DNA, 18 bp, Homo sapiens
tcattattgtttctggag

SEQ ID NO: 9037945 - DNA, 18 bp, Homo sapiens
tcattattgtttctggag

SEQ ID NO: 9037946 - DNA, 22 bp, Homo sapiens
tcattatttgctttagttatgt

SEQ ID NO: 9037947 - DNA, 22 bp, Homo sapiens
tcattattctctttaatgttct

SEQ ID NO: 9037948 - DNA, 22 bp, Homo sapiens
tcattattctctttaatgttct

SEQ ID NO: 9037949 - DNA, 22 bp, Homo sapiens
tcattattctctttaatgttct

SEQ ID NO: 9037950 - DNA, 22 bp, Homo sapiens
tcattattctctttaatgttct

SEQ ID NO: 9037951 - DNA, 22 bp, Homo sapiens
tcattatcctagtatcttgaat

SEQ ID NO: 9037952 - DNA, 22 bp, Homo sapiens
tcattatcttggctcatttctg

SEQ ID NO: 9037953 - DNA, 22 bp, Homo sapiens
tcattatcctagtatcttgaat

SEQ ID NO: 9037954 - DNA, 22 bp, Homo sapiens
tcattatagagttgtattttag

SEQ ID NO: 9037955 - DNA, 22 bp, Homo sapiens
tcattataaacatatgctaaag

SEQ ID NO: 9037956 - DNA, 22 bp, Homo sapiens
tcattataaacatatgctaaag

SEQ ID NO: 9037957 - DNA, 22 bp, Homo sapiens
tcattatagagttgtattttag

SEQ ID NO: 9037958 - DNA, 22 bp, Homo sapiens
tcattagaaatgcagattctca

SEQ ID NO: 9037959 - DNA, 22 bp, Homo sapiens
tcattagaaatgcagattctca

SEQ ID NO: 9037960 - DNA, 18 bp, Homo sapiens
tcattagggattgcaaag

SEQ ID NO: 9037961 - DNA, 22 bp, Homo sapiens
tcattacagtgtttatatgtct

SEQ ID NO: 9037962 - DNA, 22 bp, Homo sapiens
tcattacagtgtttatatgtct

SEQ ID NO: 9037963 - DNA, 22 bp, Homo sapiens
tcattacagagatataatctac

SEQ ID NO: 9037964 - DNA, 20 bp, Homo sapiens
tcattacagtgctaagatgt

SEQ ID NO: 9037965 - DNA, 20 bp, Homo sapiens
tcattacagtgctaagatgt

SEQ ID NO: 9037966 - DNA, 22 bp, Homo sapiens
tcattacagagatataatctac

SEQ ID NO: 9037967 - DNA, 22 bp, Homo sapiens
tcattacagagatataatctac

SEQ ID NO: 9037968 - DNA, 22 bp, Homo sapiens
tcattacacagttcagtggaaa

SEQ ID NO: 9037969 - DNA, 22 bp, Homo sapiens
tcatggctgaaacagtaacaca

SEQ ID NO: 9037970 - DNA, 22 bp, Homo sapiens
tcattatttgctttagttatgt

SEQ ID NO: 9037971 - DNA, 22 bp, Homo sapiens
tcattatttgctttagttatgt

SEQ ID NO: 9037972 - DNA, 22 bp, Homo sapiens
tcattatttgctttagttatgt

SEQ ID NO: 9037973 - DNA, 18 bp, Homo sapiens
tcattcaaagtctactga

SEQ ID NO: 9037974 - DNA, 22 bp, Homo sapiens
tcattattttggactggagtgt

SEQ ID NO: 9037975 - DNA, 22 bp, Homo sapiens
tcattattttggactggagtgt

SEQ ID NO: 9037976 - DNA, 18 bp, Homo sapiens
tcattcaaagtctactga

SEQ ID NO: 9037977 - DNA, 22 bp, Homo sapiens
tcattcaagatttcaatagatt

SEQ ID NO: 9037978 - DNA, 22 bp, Homo sapiens
tcattcaagatttcaatagatt

SEQ ID NO: 9037979 - DNA, 23 bp, Homo sapiens
tcattcaaggctggtatctttca

SEQ ID NO: 9037980 - DNA, 23 bp, Homo sapiens
tcattcaaggctggtatctttca

SEQ ID NO: 9037981 - DNA, 22 bp, Homo sapiens
tcattcaatgtaagcatatata

SEQ ID NO: 9037982 - DNA, 16 bp, Homo sapiens
tcattgaagacagtac

SEQ ID NO: 9037983 - DNA, 22 bp, Homo sapiens
tcattgaacgaagagctccatt

SEQ ID NO: 9037984 - DNA, 22 bp, Homo sapiens
tcattcataaaaattagttggc

SEQ ID NO: 9037985 - DNA, 22 bp, Homo sapiens
tcattcaggttgggcaagtgtc

SEQ ID NO: 9037986 - DNA, 22 bp, Homo sapiens
tcattcactgcccagcagtgta

SEQ ID NO: 9037987 - DNA, 21 bp, Homo sapiens
tcattcacagggtattgtata

SEQ ID NO: 9037988 - DNA, 21 bp, Homo sapiens
tcattcacagggtattgtata

SEQ ID NO: 9037989 - DNA, 22 bp, Homo sapiens
tcattcactgcccagcagtgta

SEQ ID NO: 9037990 - DNA, 22 bp, Homo sapiens
tcattcactttgaaataaacga

SEQ ID NO: 9037991 - DNA, 22 bp, Homo sapiens
tcattcactttgaaataaacga

SEQ ID NO: 9037992 - DNA, 22 bp, Homo sapiens
tcattcagagagaatgttccag

SEQ ID NO: 9037993 - DNA, 22 bp, Homo sapiens
tcagggaagagagatctcctag

SEQ ID NO: 9037994 - DNA, 21 bp, Homo sapiens
tcagggaagtgtgcagaaggg

SEQ ID NO: 9037995 - DNA, 22 bp, Homo sapiens
tcagggaagagagatctcctag

SEQ ID NO: 9037996 - DNA, 22 bp, Homo sapiens
tcagggaagacttcttagagga

SEQ ID NO: 9037997 - DNA, 18 bp, Homo sapiens
tcagggaagagaatatga

SEQ ID NO: 9037998 - DNA, 18 bp, Homo sapiens
tcagggaagagaatatga

SEQ ID NO: 9037999 - DNA, 22 bp, Homo sapiens
tcagggaacctctcctgtttct

SEQ ID NO: 9038000 - DNA, 22 bp, Homo sapiens
tcagggaagaaatgggacttta

SEQ ID NO: 9038001 - DNA, 22 bp, Homo sapiens
tcagggaactacttctccctat

SEQ ID NO: 9038002 - DNA, 22 bp, Homo sapiens
tcagggaactacttctccctat

SEQ ID NO: 9038003 - DNA, 22 bp, Homo sapiens
tcagggaacatcgttaaactag

SEQ ID NO: 9038004 - DNA, 22 bp, Homo sapiens
tcagggaagaaatgggacttta

SEQ ID NO: 9038005 - DNA, 22 bp, Homo sapiens
tcagggaagaaatgggacttta

SEQ ID NO: 9038006 - DNA, 22 bp, Homo sapiens
tcagggaataagtagatgagtg

SEQ ID NO: 9038007 - DNA, 22 bp, Homo sapiens
tcagggaatcagactctgcagc

SEQ ID NO: 9038008 - DNA, 17 bp, Homo sapiens
tcagggaatgaggttgt

SEQ ID NO: 9038009 - DNA, 18 bp, Homo sapiens
tcagggaatcttggcctt

SEQ ID NO: 9038010 - DNA, 17 bp, Homo sapiens
tcagggaatgaggttgt

SEQ ID NO: 9038011 - DNA, 21 bp, Homo sapiens
tcagggaagtgtgcagaaggg

SEQ ID NO: 9038012 - DNA, 19 bp, Homo sapiens
tcagggaagttcaaagctc

SEQ ID NO: 9038013 - DNA, 21 bp, Homo sapiens
tcagggaagtgtgcagaaggg

SEQ ID NO: 9038014 - DNA, 19 bp, Homo sapiens
tcagggaagttcaaagctc

SEQ ID NO: 9038015 - DNA, 19 bp, Homo sapiens
tcagggaagttcaaagctc

SEQ ID NO: 9038016 - DNA, 22 bp, Homo sapiens
tcagggaatgatgcacacagtt

SEQ ID NO: 9038017 - DNA, 22 bp, Homo sapiens
tcagggaatgatgcacacagtt

SEQ ID NO: 9038018 - DNA, 17 bp, Homo sapiens
tcagggaatgaggttgt

SEQ ID NO: 9038019 - DNA, 22 bp, Homo sapiens
tcagggacaggatgggcatttc

SEQ ID NO: 9038020 - DNA, 22 bp, Homo sapiens
tcagggaccaccactcacccag

SEQ ID NO: 9038021 - DNA, 22 bp, Homo sapiens
tcagggacccctctgagtggag

SEQ ID NO: 9038022 - DNA, 22 bp, Homo sapiens
tcagggacgtgagctcagagtc

SEQ ID NO: 9038023 - DNA, 22 bp, Homo sapiens
tcaggtgtcaagcagggagctg

SEQ ID NO: 9038024 - DNA, 22 bp, Homo sapiens
tcaggtgtattgatgtctgtga

SEQ ID NO: 9038025 - DNA, 22 bp, Homo sapiens
tcaggtggccaaatgggagcgc

SEQ ID NO: 9038026 - DNA, 16 bp, Homo sapiens
tcaggtgtgacttttt

SEQ ID NO: 9038027 - DNA, 23 bp, Homo sapiens
tcaggtgtgcggactgctgagtc

SEQ ID NO: 9038028 - DNA, 22 bp, Homo sapiens
tcaggtgtcttgtgggatttta

SEQ ID NO: 9038029 - DNA, 22 bp, Homo sapiens
tcaggtgtgaactatttggaaa

SEQ ID NO: 9038030 - DNA, 22 bp, Homo sapiens
tcaggtgtctatctaacctggt

SEQ ID NO: 9038031 - DNA, 22 bp, Homo sapiens
tcaggtgtctgcctctttgagt

SEQ ID NO: 9038032 - DNA, 22 bp, Homo sapiens
tcaggtgtcaagcagggagctg

SEQ ID NO: 9038033 - DNA, 22 bp, Homo sapiens
tcaggtgtgggcagagaaacca

SEQ ID NO: 9038034 - DNA, 22 bp, Homo sapiens
tcaggtgtggaccgaggtcaga

SEQ ID NO: 9038035 - DNA, 22 bp, Homo sapiens
tcaggtgtggtcaccacagggt

SEQ ID NO: 9038036 - DNA, 22 bp, Homo sapiens
tcaggtgtgtggctctggacca

SEQ ID NO: 9038037 - DNA, 22 bp, Homo sapiens
tcaggtgttagaagaaatttca

SEQ ID NO: 9038038 - DNA, 22 bp, Homo sapiens
tcaggtgtgttgtattttacca

SEQ ID NO: 9038039 - DNA, 22 bp, Homo sapiens
tcaggtgtgtggtggaaggcag

SEQ ID NO: 9038040 - DNA, 22 bp, Homo sapiens
tcagtctctctatctgtaaaat

SEQ ID NO: 9038041 - DNA, 22 bp, Homo sapiens
tcagtctctctatctgtaaaat

SEQ ID NO: 9038042 - DNA, 22 bp, Homo sapiens
tcaggtttttctcaaatcaggt

SEQ ID NO: 9038043 - DNA, 22 bp, Homo sapiens
tcaggtttttctcaaatcaggt

SEQ ID NO: 9038044 - DNA, 22 bp, Homo sapiens
tcagtctctggctgtgtctgac

SEQ ID NO: 9038045 - DNA, 22 bp, Homo sapiens
tcagtctctggctgtgtctgac

SEQ ID NO: 9038046 - DNA, 22 bp, Homo sapiens
tcagtctctggggcttctgttt

SEQ ID NO: 9038047 - DNA, 22 bp, Homo sapiens
tcagtctctggggcttctgttt

SEQ ID NO: 9038048 - DNA, 22 bp, Homo sapiens
tcaggtgtttctggagaagtaa

SEQ ID NO: 9038049 - DNA, 18 bp, Homo sapiens
tcaggtgttttctgtata

SEQ ID NO: 9038050 - DNA, 22 bp, Homo sapiens
tcaggttcagactagtcccagt

SEQ ID NO: 9038051 - DNA, 22 bp, Homo sapiens
tcaggttctggtgagggccctt

SEQ ID NO: 9038052 - DNA, 22 bp, Homo sapiens
tcaggtgttctccactcagttt

SEQ ID NO: 9038053 - DNA, 22 bp, Homo sapiens
tcaggtgtttaaggatagtgat

SEQ ID NO: 9038054 - DNA, 22 bp, Homo sapiens
tcagtcttctagcaaatccagg

SEQ ID NO: 9038055 - DNA, 23 bp, Homo sapiens
tcagtcttccctgtcagtaatag

SEQ ID NO: 9038056 - DNA, 22 bp, Homo sapiens
tcagtcttccctccagtgcaac

SEQ ID NO: 9038057 - DNA, 17 bp, Homo sapiens
tcagtctctgtcctgga

SEQ ID NO: 9038058 - DNA, 17 bp, Homo sapiens
tcagtctctgtcctgga

SEQ ID NO: 9038059 - DNA, 22 bp, Homo sapiens
tcagtcttcaaatctgagtcgt

SEQ ID NO: 9038060 - DNA, 22 bp, Homo sapiens
tcagtcttcaaatctgagtcgt

SEQ ID NO: 9038061 - DNA, 22 bp, Homo sapiens
tcagtgcaatcaaggtatgttt

SEQ ID NO: 9038062 - DNA, 21 bp, Homo sapiens
tcagtgcaattctatggggaa

SEQ ID NO: 9038063 - DNA, 22 bp, Homo sapiens
tcagtgcaaaaaatgggctaga

SEQ ID NO: 9038064 - DNA, 22 bp, Homo sapiens
tcagtgcaaaaaatgggctaga

SEQ ID NO: 9038065 - DNA, 20 bp, Homo sapiens
tcagtgattttgaagaggaa

SEQ ID NO: 9038066 - DNA, 22 bp, Homo sapiens
tcagtgcaatcaaggtatgttt

SEQ ID NO: 9038067 - DNA, 21 bp, Homo sapiens
tcagtgcaattctatggggaa

SEQ ID NO: 9038068 - DNA, 22 bp, Homo sapiens
tcagtgcacaatgacggtggct

SEQ ID NO: 9038069 - DNA, 22 bp, Homo sapiens
tcagtgcagaatagtgatgcat

SEQ ID NO: 9038070 - DNA, 22 bp, Homo sapiens
tcagtgcagaatagtgatgcat

SEQ ID NO: 9038071 - DNA, 22 bp, Homo sapiens
tcagtgcacccaattctctcca

SEQ ID NO: 9038072 - DNA, 22 bp, Homo sapiens
tcagtgcagaatagtgatgcat

SEQ ID NO: 9038073 - DNA, 22 bp, Homo sapiens
tcagtgcagcggcagcagctct

SEQ ID NO: 9038074 - DNA, 22 bp, Homo sapiens
tcagtgcagcggcagcagctct

SEQ ID NO: 9038075 - DNA, 22 bp, Homo sapiens
tcagtgcagactgtaagttgga

SEQ ID NO: 9038076 - DNA, 22 bp, Homo sapiens
tcagtgcaggaatctctagcca

SEQ ID NO: 9038077 - DNA, 22 bp, Homo sapiens
tcagtgatctaagggtatggcc

SEQ ID NO: 9038078 - DNA, 22 bp, Homo sapiens
tcagtgatctaagggtatggcc

SEQ ID NO: 9038079 - DNA, 22 bp, Homo sapiens
tcagtgactgggtattaaatca

SEQ ID NO: 9038080 - DNA, 22 bp, Homo sapiens
tcagtgaaccttctgtggcagg

SEQ ID NO: 9038081 - DNA, 22 bp, Homo sapiens
tcagtgaatgagataactttag

SEQ ID NO: 9038082 - DNA, 22 bp, Homo sapiens
tcagtgaagtaatggtgagaga

SEQ ID NO: 9038083 - DNA, 22 bp, Homo sapiens
tcagtgacaactatgaatattt

SEQ ID NO: 9038084 - DNA, 22 bp, Homo sapiens
tcagtgaatgagataactttag

SEQ ID NO: 9038085 - DNA, 22 bp, Homo sapiens
tcagtgatttctggggtgaggg

SEQ ID NO: 9038086 - DNA, 22 bp, Homo sapiens
tcagtgatttctggggtgaggg

SEQ ID NO: 9038087 - DNA, 22 bp, Homo sapiens
tcagtgatctaagggtatggcc

SEQ ID NO: 9038088 - DNA, 22 bp, Homo sapiens
tcagtgatgaggtggctttcaa

SEQ ID NO: 9038089 - DNA, 22 bp, Homo sapiens
tcagtgattggtggactgccta

SEQ ID NO: 9038090 - DNA, 22 bp, Homo sapiens
tcagtgaaatgcatattcttcg

SEQ ID NO: 9038091 - DNA, 22 bp, Homo sapiens
tcagtgaaatgcatattcttcg

SEQ ID NO: 9038092 - DNA, 22 bp, Homo sapiens
tcagtgaaatgcatattcttcg

SEQ ID NO: 9038093 - DNA, 22 bp, Homo sapiens
tcagtgaaccttctgtggcagg

SEQ ID NO: 9038094 - DNA, 22 bp, Homo sapiens
tcagtctttgcttatgacaata

SEQ ID NO: 9038095 - DNA, 22 bp, Homo sapiens
tcagtcttttaactttctgcca

SEQ ID NO: 9038096 - DNA, 22 bp, Homo sapiens
tcagtgaaatgcatattcttcg

SEQ ID NO: 9038097 - DNA, 22 bp, Homo sapiens
tcagtctttcgaattcagccag

SEQ ID NO: 9038098 - DNA, 22 bp, Homo sapiens
tcagtctttcgaattcagccag

SEQ ID NO: 9038099 - DNA, 22 bp, Homo sapiens
tcagtctttcgaattcagccag

SEQ ID NO: 9038100 - DNA, 22 bp, Homo sapiens
tcagtctttcgaattcagccag

SEQ ID NO: 9038101 - DNA, 23 bp, Homo sapiens
tcagtcttggcttctgattttcc

SEQ ID NO: 9038102 - DNA, 22 bp, Homo sapiens
tcagtgtatggagtgctggatt

SEQ ID NO: 9038103 - DNA, 22 bp, Homo sapiens
tcagtgtcacaggatgctatgc

SEQ ID NO: 9038104 - DNA, 22 bp, Homo sapiens
tcagtgtcagtcttttagatat

SEQ ID NO: 9038105 - DNA, 22 bp, Homo sapiens
tcagtgtcatatcaagaagatg

SEQ ID NO: 9038106 - DNA, 22 bp, Homo sapiens
tcagtgtcatcacttaatataa

SEQ ID NO: 9038107 - DNA, 22 bp, Homo sapiens
tcagtgtaagtttttggatagg

SEQ ID NO: 9038108 - DNA, 18 bp, Homo sapiens
tcagtgtagatctgtgta

SEQ ID NO: 9038109 - DNA, 22 bp, Homo sapiens
tcagtgtagcagacttgtagcc

SEQ ID NO: 9038110 - DNA, 22 bp, Homo sapiens
tcagtgtaagttatgtagatgt

SEQ ID NO: 9038111 - DNA, 22 bp, Homo sapiens
tcagtgtaagttatgtagatgt

SEQ ID NO: 9038112 - DNA, 22 bp, Homo sapiens
tcagtggttggatgatggtcgc

SEQ ID NO: 9038113 - DNA, 22 bp, Homo sapiens
tcagtgtaagttatgtagatgt

SEQ ID NO: 9038114 - DNA, 22 bp, Homo sapiens
tcagtgcaggaatctctagcca

SEQ ID NO: 9038115 - DNA, 22 bp, Homo sapiens
tcagtggtgagtaacgtcagtt

SEQ ID NO: 9038116 - DNA, 22 bp, Homo sapiens
tcagtgcagggtgggagagaga

SEQ ID NO: 9038117 - DNA, 22 bp, Homo sapiens
tcagtgcagggtgggagagaga

SEQ ID NO: 9038118 - DNA, 22 bp, Homo sapiens
tcagtgcagggtgggagagaga

SEQ ID NO: 9038119 - DNA, 22 bp, Homo sapiens
tcagtgtccaaaaagaggcaag

SEQ ID NO: 9038120 - DNA, 23 bp, Homo sapiens
tcagtgtctagttgtggaattga

SEQ ID NO: 9038121 - DNA, 22 bp, Homo sapiens
tcagtgtccttcgttcttgttg

SEQ ID NO: 9038122 - DNA, 22 bp, Homo sapiens
tcagtgtcctgtgcggtgcagc

SEQ ID NO: 9038123 - DNA, 22 bp, Homo sapiens
tcagtgtccggagcctgagtgc

SEQ ID NO: 9038124 - DNA, 22 bp, Homo sapiens
tcagtgtctcatatgaggtttc

SEQ ID NO: 9038125 - DNA, 22 bp, Homo sapiens
tcagtgtctatagataaggttt

SEQ ID NO: 9038126 - DNA, 19 bp, Homo sapiens
tcagtgtgtgggaggtggt

SEQ ID NO: 9038127 - DNA, 22 bp, Homo sapiens
tcagtgtgttcaattggatagg

SEQ ID NO: 9038128 - DNA, 22 bp, Homo sapiens
tcagtgtgttattctactttca

SEQ ID NO: 9038129 - DNA, 22 bp, Homo sapiens
tcagtgttaatcagtggtacct

SEQ ID NO: 9038130 - DNA, 22 bp, Homo sapiens
tcagtgttaatcagtggtacct

SEQ ID NO: 9038131 - DNA, 22 bp, Homo sapiens
tcagtgttacattatatagaac

SEQ ID NO: 9038132 - DNA, 22 bp, Homo sapiens
tcagtgttaatcagtggtacct

SEQ ID NO: 9038133 - DNA, 22 bp, Homo sapiens
ttcagtaagcacttctagagct

SEQ ID NO: 9038134 - DNA, 22 bp, Homo sapiens
ttcagtaagcacttctagagct

SEQ ID NO: 9038135 - DNA, 22 bp, Homo sapiens
ttcagtaaaacactgcaatgtc

SEQ ID NO: 9038136 - DNA, 22 bp, Homo sapiens
ttcaggtgtcaaggataggctg

SEQ ID NO: 9038137 - DNA, 22 bp, Homo sapiens
ttcaggtgtggccagaggagaa

SEQ ID NO: 9038138 - DNA, 22 bp, Homo sapiens
ttcaggtgtggccagaggagaa

SEQ ID NO: 9038139 - DNA, 22 bp, Homo sapiens
ttcaggtttttaagttctgcct

SEQ ID NO: 9038140 - DNA, 22 bp, Homo sapiens
ttcaggtgtcaaggataggctg

SEQ ID NO: 9038141 - DNA, 22 bp, Homo sapiens
ttcaggtgggccttttgagcat

SEQ ID NO: 9038142 - DNA, 22 bp, Homo sapiens
ttcaggagctggctgcgaagga

SEQ ID NO: 9038143 - DNA, 20 bp, Homo sapiens
ttcagggctttggggacacc

SEQ ID NO: 9038144 - DNA, 22 bp, Homo sapiens
ttcaggaggtgagcaagaaggg

SEQ ID NO: 9038145 - DNA, 22 bp, Homo sapiens
ttcaggagaaagttcagtactt

SEQ ID NO: 9038146 - DNA, 22 bp, Homo sapiens
ttcaggagaattccaagaagta

SEQ ID NO: 9038147 - DNA, 22 bp, Homo sapiens
ttcagtatttgaaaccataggc

SEQ ID NO: 9038148 - DNA, 22 bp, Homo sapiens
ttcagtatttgaaaccataggc

SEQ ID NO: 9038149 - DNA, 22 bp, Homo sapiens
ttcagtattcaaatatgtctta

SEQ ID NO: 9038150 - DNA, 22 bp, Homo sapiens
ttcagtattcaaatatgtctta

SEQ ID NO: 9038151 - DNA, 22 bp, Homo sapiens
ttcagtcagtgactaagcagtt

SEQ ID NO: 9038152 - DNA, 22 bp, Homo sapiens
ttcagtccatcaggcgtggcat

SEQ ID NO: 9038153 - DNA, 22 bp, Homo sapiens
ttcagtctgatctgagctgaga

SEQ ID NO: 9038154 - DNA, 22 bp, Homo sapiens
ttcagtcttgttgaaaacttgg

SEQ ID NO: 9038155 - DNA, 20 bp, Homo sapiens
ttcagtctcctgcttccttc

SEQ ID NO: 9038156 - DNA, 22 bp, Homo sapiens
ttcagtctctccctatgtttct

SEQ ID NO: 9038157 - DNA, 22 bp, Homo sapiens
ttcagtctcctcattttacaaa

SEQ ID NO: 9038158 - DNA, 22 bp, Homo sapiens
ttcagtctcctcattttacaaa

SEQ ID NO: 9038159 - DNA, 22 bp, Homo sapiens
ttcagtctcctcattttacaaa

SEQ ID NO: 9038160 - DNA, 22 bp, Homo sapiens
ttcagtctcaatttaagtttaa

SEQ ID NO: 9038161 - DNA, 22 bp, Homo sapiens
ttcagtctcaagtgctgctcac

SEQ ID NO: 9038162 - DNA, 22 bp, Homo sapiens
ttcagtctcaagtgctgctcac

SEQ ID NO: 9038163 - DNA, 22 bp, Homo sapiens
ttcagtatacttcataacattt

SEQ ID NO: 9038164 - DNA, 22 bp, Homo sapiens
ttcagtatctgcaaaatgggga

SEQ ID NO: 9038165 - DNA, 22 bp, Homo sapiens
ttcagtataaaatcaaagtgat

SEQ ID NO: 9038166 - DNA, 22 bp, Homo sapiens
ttcagtataaaatcaaagtgat

SEQ ID NO: 9038167 - DNA, 22 bp, Homo sapiens
ttcagtatgattcctccagtag

SEQ ID NO: 9038168 - DNA, 22 bp, Homo sapiens
ttcagtatgtagaacaagtgtt

SEQ ID NO: 9038169 - DNA, 22 bp, Homo sapiens
ttcagtatgtagaacaagtgtt

SEQ ID NO: 9038170 - DNA, 22 bp, Homo sapiens
ttcagtatgctgaatgattttt

SEQ ID NO: 9038171 - DNA, 22 bp, Homo sapiens
ttcagtatgtgtaaactacttt

SEQ ID NO: 9038172 - DNA, 22 bp, Homo sapiens
ttcacattgaaggtgctttctt

SEQ ID NO: 9038173 - DNA, 22 bp, Homo sapiens
ttcacattgaaggtgctttctt

SEQ ID NO: 9038174 - DNA, 19 bp, Homo sapiens
ttcacattggaagaagtag

SEQ ID NO: 9038175 - DNA, 22 bp, Homo sapiens
ttcaggactaggggcttcaagg

SEQ ID NO: 9038176 - DNA, 22 bp, Homo sapiens
ttcacattctcacaagaggaaa

SEQ ID NO: 9038177 - DNA, 22 bp, Homo sapiens
ttcacattctcacaagaggaaa

SEQ ID NO: 9038178 - DNA, 22 bp, Homo sapiens
ttcacattccgcggctattttc

SEQ ID NO: 9038179 - DNA, 22 bp, Homo sapiens
ttcacattccgcggctattttc

SEQ ID NO: 9038180 - DNA, 22 bp, Homo sapiens
ttcacattatcaggattgtttc

SEQ ID NO: 9038181 - DNA, 22 bp, Homo sapiens
ttcacattatcaggattgtttc

SEQ ID NO: 9038182 - DNA, 22 bp, Homo sapiens
ttcacattcagaaaaagcccgt

SEQ ID NO: 9038183 - DNA, 22 bp, Homo sapiens
ttcacattatcaggattgtttc

SEQ ID NO: 9038184 - DNA, 22 bp, Homo sapiens
ttcacattcagaaaaagcccgt

SEQ ID NO: 9038185 - DNA, 22 bp, Homo sapiens
ttcacattagtggttctatata

SEQ ID NO: 9038186 - DNA, 22 bp, Homo sapiens
ttcacattagtggttctatata

SEQ ID NO: 9038187 - DNA, 22 bp, Homo sapiens
ttcacattagtggttctatata

SEQ ID NO: 9038188 - DNA, 22 bp, Homo sapiens
ttcacattagtggttctatata

SEQ ID NO: 9038189 - DNA, 22 bp, Homo sapiens
ttcacattagtggttctatata

SEQ ID NO: 9038190 - DNA, 22 bp, Homo sapiens
ttcacattataatcagttctgc

SEQ ID NO: 9038191 - DNA, 22 bp, Homo sapiens
ttcacattataatcagttctgc

SEQ ID NO: 9038192 - DNA, 21 bp, Homo sapiens
ttcacagtggataactttctg

SEQ ID NO: 9038193 - DNA, 22 bp, Homo sapiens
ttcacagtgctgcacctggctt

SEQ ID NO: 9038194 - DNA, 22 bp, Homo sapiens
ttcacagtggccctctctgagt

SEQ ID NO: 9038195 - DNA, 22 bp, Homo sapiens
ttcacagtggccctctctgagt

SEQ ID NO: 9038196 - DNA, 22 bp, Homo sapiens
ttcacagtggctaagttctgca

SEQ ID NO: 9038197 - DNA, 22 bp, Homo sapiens
ttcacagtggctaagttctgca

SEQ ID NO: 9038198 - DNA, 22 bp, Homo sapiens
ttcacagtggctaagttctgca

SEQ ID NO: 9038199 - DNA, 22 bp, Homo sapiens
ttcacagtggctaagttctgca

SEQ ID NO: 9038200 - DNA, 22 bp, Homo sapiens
ttcacagtggctaagttctgca

SEQ ID NO: 9038201 - DNA, 22 bp, Homo sapiens
ttcacattacaaggccatattt

SEQ ID NO: 9038202 - DNA, 22 bp, Homo sapiens
ttcacattacaaggccatattt

SEQ ID NO: 9038203 - DNA, 22 bp, Homo sapiens
ttcacattagtggttctatata

SEQ ID NO: 9038204 - DNA, 22 bp, Homo sapiens
ttcacattagccaagagatgga

SEQ ID NO: 9038205 - DNA, 22 bp, Homo sapiens
ttcacattagccaagagatgga

SEQ ID NO: 9038206 - DNA, 22 bp, Homo sapiens
ttcacagtggctgtgccatttg

SEQ ID NO: 9038207 - DNA, 22 bp, Homo sapiens
ttcacagtggctgacaggctgg

SEQ ID NO: 9038208 - DNA, 22 bp, Homo sapiens
ttcacagtggctgacaggctgg

SEQ ID NO: 9038209 - DNA, 22 bp, Homo sapiens
ttcacagtggctgacaggctgg

SEQ ID NO: 9038210 - DNA, 22 bp, Homo sapiens
ttcatggcgctgttctctccct

SEQ ID NO: 9038211 - DNA, 22 bp, Homo sapiens
ttcatggcatacatgtttccca

SEQ ID NO: 9038212 - DNA, 22 bp, Homo sapiens
ttcatgcttttaccgctgttaa

SEQ ID NO: 9038213 - DNA, 22 bp, Homo sapiens
ttcatgctgtgtctacaactta

SEQ ID NO: 9038214 - DNA, 22 bp, Homo sapiens
ttcatgcttgttcctccacctg

SEQ ID NO: 9038215 - DNA, 22 bp, Homo sapiens
ttcatgccagccctgtgtggta

SEQ ID NO: 9038216 - DNA, 22 bp, Homo sapiens
ttcatgccaccccttgaggagt

SEQ ID NO: 9038217 - DNA, 22 bp, Homo sapiens
ttcatgctcctgccctttttgg

SEQ ID NO: 9038218 - DNA, 22 bp, Homo sapiens
ttcatgctagtatgtgctgttc

SEQ ID NO: 9038219 - DNA, 22 bp, Homo sapiens
ttcatgctagtatgtgctgttc

SEQ ID NO: 9038220 - DNA, 23 bp, Homo sapiens
ttcatgatgattaatcagctaca

SEQ ID NO: 9038221 - DNA, 23 bp, Homo sapiens
ttcatgatgattaatcagctaca

SEQ ID NO: 9038222 - DNA, 22 bp, Homo sapiens
ttcatgatagtatctattcaat

SEQ ID NO: 9038223 - DNA, 22 bp, Homo sapiens
ttcatgatagtattttttgtga

SEQ ID NO: 9038224 - DNA, 22 bp, Homo sapiens
ttcatgatggcagcatttatag

SEQ ID NO: 9038225 - DNA, 22 bp, Homo sapiens
ttcatgatagtattttttgtga

SEQ ID NO: 9038226 - DNA, 22 bp, Homo sapiens
ttcatgattgactatcaagagc

SEQ ID NO: 9038227 - DNA, 22 bp, Homo sapiens
ttcatgattgactatcaagagc

SEQ ID NO: 9038228 - DNA, 22 bp, Homo sapiens
ttcatgcactatttcttctagc

SEQ ID NO: 9038229 - DNA, 20 bp, Homo sapiens
ttcatgcagtggttgctgtg

SEQ ID NO: 9038230 - DNA, 22 bp, Homo sapiens
ttcatgcatggccttactccct

SEQ ID NO: 9038231 - DNA, 22 bp, Homo sapiens
ttcatcattacagtcatgttat

SEQ ID NO: 9038232 - DNA, 22 bp, Homo sapiens
ttcatcattgccagtctttaaa

SEQ ID NO: 9038233 - DNA, 22 bp, Homo sapiens
ttcatcattacagtcatgttat

SEQ ID NO: 9038234 - DNA, 22 bp, Homo sapiens
ttcatcattgccagtctttaaa

SEQ ID NO: 9038235 - DNA, 22 bp, Homo sapiens
ttcatcattacagtcatgttat

SEQ ID NO: 9038236 - DNA, 21 bp, Homo sapiens
ttcatcattggtaaaaagtgg

SEQ ID NO: 9038237 - DNA, 21 bp, Homo sapiens
ttcatcattggtaaaaagtgg

SEQ ID NO: 9038238 - DNA, 22 bp, Homo sapiens
ttcagtgtatattttttgagta

SEQ ID NO: 9038239 - DNA, 22 bp, Homo sapiens
ttcagtgtatattttttgagta

SEQ ID NO: 9038240 - DNA, 22 bp, Homo sapiens
ttcagtgtacagtgaagggatt

SEQ ID NO: 9038241 - DNA, 22 bp, Homo sapiens
ttcagtgtacagtgaagggatt

SEQ ID NO: 9038242 - DNA, 22 bp, Homo sapiens
ttcatcatcagaactgttcact

SEQ ID NO: 9038243 - DNA, 22 bp, Homo sapiens
ttcatcatcagaactgttcact

SEQ ID NO: 9038244 - DNA, 18 bp, Homo sapiens
ttcatcatgactctgtgg

SEQ ID NO: 9038245 - DNA, 22 bp, Homo sapiens
ttcagtgtcaatttttaaatat

SEQ ID NO: 9038246 - DNA, 22 bp, Homo sapiens
ttcagtgcctgtccacagcttc

SEQ ID NO: 9038247 - DNA, 22 bp, Homo sapiens
ttcagtgcctgtccacagcttc

SEQ ID NO: 9038248 - DNA, 22 bp, Homo sapiens
ttcagtgccgtgctgggtcgct

SEQ ID NO: 9038249 - DNA, 22 bp, Homo sapiens
ttcagtgccgtgctgggtcgct

SEQ ID NO: 9038250 - DNA, 22 bp, Homo sapiens
ttcagtgcttacaggtttcttt

SEQ ID NO: 9038251 - DNA, 22 bp, Homo sapiens
ttcagtgcttacaggtttcttt

SEQ ID NO: 9038252 - DNA, 22 bp, Homo sapiens
ttcagtgctaaaaagtctcaag

SEQ ID NO: 9038253 - DNA, 22 bp, Homo sapiens
ttcagtgctaaaaagtctcaag

SEQ ID NO: 9038254 - DNA, 22 bp, Homo sapiens
ttcagtgcagtcggaactactg

SEQ ID NO: 9038255 - DNA, 22 bp, Homo sapiens
ttcagtgcacagtactgagact

SEQ ID NO: 9038256 - DNA, 22 bp, Homo sapiens
ttcagtgcagacgccgaagccc

SEQ ID NO: 9038257 - DNA, 22 bp, Homo sapiens
ttcagtgcagacgccgaagccc

SEQ ID NO: 9038258 - DNA, 22 bp, Homo sapiens
ttcagtgcacagtactgagact

SEQ ID NO: 9038259 - DNA, 22 bp, Homo sapiens
ttcagtgagtgaatgaatgaat

SEQ ID NO: 9038260 - DNA, 22 bp, Homo sapiens
ttcagtgagtgaatgaatgaat

SEQ ID NO: 9038261 - DNA, 22 bp, Homo sapiens
ttcagtctcatggatgtgaaat

SEQ ID NO: 9038262 - DNA, 22 bp, Homo sapiens
ttcagtgacttacctggagcca

SEQ ID NO: 9038263 - DNA, 22 bp, Homo sapiens
ttcatgtgataaatgtgtgact

SEQ ID NO: 9038264 - DNA, 22 bp, Homo sapiens
ttcatgtgataaatgtgtgact

SEQ ID NO: 9038265 - DNA, 22 bp, Homo sapiens
ttcatgtgatcacagattgtaa

SEQ ID NO: 9038266 - DNA, 22 bp, Homo sapiens
ttcatgtggaaaagggctttca

SEQ ID NO: 9038267 - DNA, 23 bp, Homo sapiens
ttcatgtggacctagaggcctgt

SEQ ID NO: 9038268 - DNA, 18 bp, Homo sapiens
ttcatgttggcttaggga

SEQ ID NO: 9038269 - DNA, 22 bp, Homo sapiens
ttcatgttgtagtatgtatcag

SEQ ID NO: 9038270 - DNA, 22 bp, Homo sapiens
ttcatgtttcctcttgtgctgc

SEQ ID NO: 9038271 - DNA, 22 bp, Homo sapiens
ttccaatttgtggtgagttaat

SEQ ID NO: 9038272 - DNA, 22 bp, Homo sapiens
ttccaatttgtggtgagttaat

SEQ ID NO: 9038273 - DNA, 22 bp, Homo sapiens
ttccaattgttctttggaatct

SEQ ID NO: 9038274 - DNA, 22 bp, Homo sapiens
ttcatgtccagaggaagttgag

SEQ ID NO: 9038275 - DNA, 22 bp, Homo sapiens
ttcatgtctgccttttcaagtg

SEQ ID NO: 9038276 - DNA, 22 bp, Homo sapiens
ttcatgtgaatatatttgtctt

SEQ ID NO: 9038277 - DNA, 22 bp, Homo sapiens
ttcatgtaccgtgtaccaggca

SEQ ID NO: 9038278 - DNA, 22 bp, Homo sapiens
ttcatgtaggctgcaatgcaca

SEQ ID NO: 9038279 - DNA, 22 bp, Homo sapiens
ttcatgtaggctgcaatgcaca

SEQ ID NO: 9038280 - DNA, 22 bp, Homo sapiens
ttcatgtagcttagcagagagg

SEQ ID NO: 9038281 - DNA, 20 bp, Homo sapiens
ttcatgggagcaaagaggcc

SEQ ID NO: 9038282 - DNA, 20 bp, Homo sapiens
ttcatgggagcaaagaggcc

SEQ ID NO: 9038283 - DNA, 20 bp, Homo sapiens
ttcatggtgtatttctttct

SEQ ID NO: 9038284 - DNA, 22 bp, Homo sapiens
ttcacaaaaatgctgaacagtt

SEQ ID NO: 9038285 - DNA, 22 bp, Homo sapiens
ttcacaaaaatgctgaacagtt

SEQ ID NO: 9038286 - DNA, 22 bp, Homo sapiens
ttcacaaaacactattttctgg

SEQ ID NO: 9038287 - DNA, 22 bp, Homo sapiens
ttcacaaaacactattttctgg

SEQ ID NO: 9038288 - DNA, 22 bp, Homo sapiens
ttcacaaaacactattttctgg

SEQ ID NO: 9038289 - DNA, 22 bp, Homo sapiens
ttcacaaaatggtttgttgatg

SEQ ID NO: 9038290 - DNA, 22 bp, Homo sapiens
ttcacaaaatggtttgttgatg

SEQ ID NO: 9038291 - DNA, 22 bp, Homo sapiens
ttcacaaaatggtttgttgatg

SEQ ID NO: 9038292 - DNA, 22 bp, Homo sapiens
ttcacaaacaccagaatggcta

SEQ ID NO: 9038293 - DNA, 22 bp, Homo sapiens
ttcacaaaatggtttgttgatg

SEQ ID NO: 9038294 - DNA, 22 bp, Homo sapiens
ttcacaaacaccagaatggcta

SEQ ID NO: 9038295 - DNA, 22 bp, Homo sapiens
ttcaatttgtgctaaggcaccg

SEQ ID NO: 9038296 - DNA, 22 bp, Homo sapiens
ttcaatttgtgctaaggcaccg

SEQ ID NO: 9038297 - DNA, 22 bp, Homo sapiens
ttcacaaaaatgctgaacagtt

SEQ ID NO: 9038298 - DNA, 22 bp, Homo sapiens
ttcacaaaaatgctgaacagtt

SEQ ID NO: 9038299 - DNA, 22 bp, Homo sapiens
ttcaatttcataatatctagct

SEQ ID NO: 9038300 - DNA, 22 bp, Homo sapiens
ttcaatttagtgatgttgttgg

SEQ ID NO: 9038301 - DNA, 22 bp, Homo sapiens
ttcaatgcatatagatatagaa

SEQ ID NO: 9038302 - DNA, 22 bp, Homo sapiens
ttcaatgcctagaacttagcat

SEQ ID NO: 9038303 - DNA, 22 bp, Homo sapiens
ttcaatgcatatagatatagaa

SEQ ID NO: 9038304 - DNA, 22 bp, Homo sapiens
ttcaatgcctttctctaagctc

SEQ ID NO: 9038305 - DNA, 22 bp, Homo sapiens
ttcaatgtggttataataacta

SEQ ID NO: 9038306 - DNA, 22 bp, Homo sapiens
ttcaatgtggttataataacta

SEQ ID NO: 9038307 - DNA, 22 bp, Homo sapiens
ttcaagaagcccaaagactagc

SEQ ID NO: 9038308 - DNA, 22 bp, Homo sapiens
ttcaagaagcccaaagactagc

SEQ ID NO: 9038309 - DNA, 22 bp, Homo sapiens
ttcaagaagcccaaagactagc

SEQ ID NO: 9038310 - DNA, 22 bp, Homo sapiens
ttcaatgcatatagatatagaa

SEQ ID NO: 9038311 - DNA, 22 bp, Homo sapiens
ttcaagaagcccaaagactagc

SEQ ID NO: 9038312 - DNA, 22 bp, Homo sapiens
ttcaagaagcccaaagactagc

SEQ ID NO: 9038313 - DNA, 22 bp, Homo sapiens
ttcaagaaagagtggctattcc

SEQ ID NO: 9038314 - DNA, 22 bp, Homo sapiens
ttcaactttggagatttaataa

SEQ ID NO: 9038315 - DNA, 22 bp, Homo sapiens
ttcaatgtttcttatcaagttg

SEQ ID NO: 9038316 - DNA, 22 bp, Homo sapiens
ttcaatgttaagaagaatatgt

SEQ ID NO: 9038317 - DNA, 22 bp, Homo sapiens
ttcaattctaaactaatattct

SEQ ID NO: 9038318 - DNA, 22 bp, Homo sapiens
ttcaattcaattctaaatatat

SEQ ID NO: 9038319 - DNA, 22 bp, Homo sapiens
ttcaattctaaactaatattct

SEQ ID NO: 9038320 - DNA, 22 bp, Homo sapiens
ttcaattcaattctaaatatat

SEQ ID NO: 9038321 - DNA, 22 bp, Homo sapiens
ttcaattctgctctgatcttag

SEQ ID NO: 9038322 - DNA, 22 bp, Homo sapiens
ttcaattctgatgaaggcaata

SEQ ID NO: 9038323 - DNA, 22 bp, Homo sapiens
ttcaatttagtgatgttgttgg

SEQ ID NO: 9038324 - DNA, 22 bp, Homo sapiens
ttcaatttagtgatgttgttgg

SEQ ID NO: 9038325 - DNA, 22 bp, Homo sapiens
ttcacaaagctggagcatttcc

SEQ ID NO: 9038326 - DNA, 22 bp, Homo sapiens
ttcacaaagctggagcatttcc

SEQ ID NO: 9038327 - DNA, 22 bp, Homo sapiens
ttcacaaagctggagcatttcc

SEQ ID NO: 9038328 - DNA, 22 bp, Homo sapiens
ttcacaaagctggagcatttcc

SEQ ID NO: 9038329 - DNA, 20 bp, Homo sapiens
ttcacaactcttagaagctg

SEQ ID NO: 9038330 - DNA, 22 bp, Homo sapiens
ttcacaaagctggagcatttcc

SEQ ID NO: 9038331 - DNA, 22 bp, Homo sapiens
ttcacaaagctggagcatttcc

SEQ ID NO: 9038332 - DNA, 22 bp, Homo sapiens
ttcacaagtcattagctgcata

SEQ ID NO: 9038333 - DNA, 22 bp, Homo sapiens
ttcacaagtcattagctgcata

SEQ ID NO: 9038334 - DNA, 22 bp, Homo sapiens
ttcacaagaggcccaggggagc

SEQ ID NO: 9038335 - DNA, 22 bp, Homo sapiens
ttcacaagtcattagctgcata

SEQ ID NO: 9038336 - DNA, 22 bp, Homo sapiens
ttcacaagaggcccaggggagc

SEQ ID NO: 9038337 - DNA, 18 bp, Homo sapiens
ttcacaagggcttggttt

SEQ ID NO: 9038338 - DNA, 22 bp, Homo sapiens
ttcacaatagctggcatcatct

SEQ ID NO: 9038339 - DNA, 22 bp, Homo sapiens
ttcacaataggagcatgcaaat

SEQ ID NO: 9038340 - DNA, 22 bp, Homo sapiens
ttcacaatagctggcatcatct

SEQ ID NO: 9038341 - DNA, 22 bp, Homo sapiens
ttcacaataatgtccatcctct

SEQ ID NO: 9038342 - DNA, 22 bp, Homo sapiens
ttcacaatagctggcatcatct

SEQ ID NO: 9038343 - DNA, 22 bp, Homo sapiens
ttcacaagtgtgaaggcagagc

SEQ ID NO: 9038344 - DNA, 22 bp, Homo sapiens
ttcacaagtgtgaaggcagagc

SEQ ID NO: 9038345 - DNA, 22 bp, Homo sapiens
ttcacaataatgtccatcctct

SEQ ID NO: 9038346 - DNA, 22 bp, Homo sapiens
ttcacaataatgtccatcctct

SEQ ID NO: 9038347 - DNA, 22 bp, Homo sapiens
ttcacagtgctgcacctggctt

SEQ ID NO: 9038348 - DNA, 22 bp, Homo sapiens
ttcacagtgctgcacctggctt

SEQ ID NO: 9038349 - DNA, 22 bp, Homo sapiens
ttcacagtgctcacagttcagt

SEQ ID NO: 9038350 - DNA, 22 bp, Homo sapiens
ttcacagtgagctatgtcttgt

SEQ ID NO: 9038351 - DNA, 22 bp, Homo sapiens
ttcacagtgagctatgtcttgt

SEQ ID NO: 9038352 - DNA, 22 bp, Homo sapiens
ttcacagtcacccttctccatg

SEQ ID NO: 9038353 - DNA, 22 bp, Homo sapiens
ttcacagtataggtttccagcg

SEQ ID NO: 9038354 - DNA, 22 bp, Homo sapiens
ttcacagtataggtttccagcg

SEQ ID NO: 9038355 - DNA, 22 bp, Homo sapiens
ttcacaggttgaagcctaatcc

SEQ ID NO: 9038356 - DNA, 22 bp, Homo sapiens
ttcacagtaatgtgcccaggta

SEQ ID NO: 9038357 - DNA, 22 bp, Homo sapiens
ttcaacatgttctacataaggg

SEQ ID NO: 9038358 - DNA, 22 bp, Homo sapiens
ttcaacatgttctacataaggg

SEQ ID NO: 9038359 - DNA, 22 bp, Homo sapiens
ttcaacatgttctacataaggg

SEQ ID NO: 9038360 - DNA, 22 bp, Homo sapiens
ttcaacatttatcagtttatca

SEQ ID NO: 9038361 - DNA, 22 bp, Homo sapiens
ttcaacatttatcagtttatca

SEQ ID NO: 9038362 - DNA, 22 bp, Homo sapiens
ttcaacatttgatacaagtcag

SEQ ID NO: 9038363 - DNA, 22 bp, Homo sapiens
ttcaaccattgtgtaagacagt

SEQ ID NO: 9038364 - DNA, 22 bp, Homo sapiens
ttcaaccaggttaattcactac

SEQ ID NO: 9038365 - DNA, 22 bp, Homo sapiens
ttcaactattatgaataaaatt

SEQ ID NO: 9038366 - DNA, 22 bp, Homo sapiens
ttcaactattatgaataaaatt

SEQ ID NO: 9038367 - DNA, 22 bp, Homo sapiens
ttcaactagatttatacaattc

SEQ ID NO: 9038368 - DNA, 22 bp, Homo sapiens
ttcaactagatttatacaattc

SEQ ID NO: 9038369 - DNA, 22 bp, Homo sapiens
ttcaactattatgaataaaatt

SEQ ID NO: 9038370 - DNA, 22 bp, Homo sapiens
ttcaactcttcaagatcacatc

SEQ ID NO: 9038371 - DNA, 22 bp, Homo sapiens
ttcaactttatgcatatgtatt

SEQ ID NO: 9038372 - DNA, 22 bp, Homo sapiens
ttcaactgggcggatctgagaa

SEQ ID NO: 9038373 - DNA, 22 bp, Homo sapiens
ttcaactttggagatttaataa

SEQ ID NO: 9038374 - DNA, 22 bp, Homo sapiens
ttcaacatgctttatttctaaa

SEQ ID NO: 9038375 - DNA, 22 bp, Homo sapiens
ttcaacatgcaaacatgtttgt

SEQ ID NO: 9038376 - DNA, 22 bp, Homo sapiens
ttcaacatgctttatttctaaa

SEQ ID NO: 9038377 - DNA, 22 bp, Homo sapiens
ttcaacatgttctacataaggg

SEQ ID NO: 9038378 - DNA, 22 bp, Homo sapiens
ttcaacatgttctacataaggg

SEQ ID NO: 9038379 - DNA, 22 bp, Homo sapiens
ttcaacatgctttatttctaaa

SEQ ID NO: 9038380 - DNA, 22 bp, Homo sapiens
ttcaacatcaagaatgcatgga

SEQ ID NO: 9038381 - DNA, 22 bp, Homo sapiens
ttcaacatcattgtaagcctct

SEQ ID NO: 9038382 - DNA, 22 bp, Homo sapiens
ttcaacatcttggagctggaac

SEQ ID NO: 9038383 - DNA, 22 bp, Homo sapiens
ttcaacagtgatggcctttgta

SEQ ID NO: 9038384 - DNA, 22 bp, Homo sapiens
ttcaacatagctgaggcatata

SEQ ID NO: 9038385 - DNA, 22 bp, Homo sapiens
ttcaacaattaagtatcagcct

SEQ ID NO: 9038386 - DNA, 22 bp, Homo sapiens
ttcaacaatgcacttgagtata

SEQ ID NO: 9038387 - DNA, 22 bp, Homo sapiens
ttcaacaatgcacttgagtata

SEQ ID NO: 9038388 - DNA, 22 bp, Homo sapiens
ttcaacaatgcacttgagtata

SEQ ID NO: 9038389 - DNA, 22 bp, Homo sapiens
ttcaacacaggaacatgatata

SEQ ID NO: 9038390 - DNA, 22 bp, Homo sapiens
ttcaacaattaagtatcagcct

SEQ ID NO: 9038391 - DNA, 22 bp, Homo sapiens
ttcaacagggcatgatgagacg

SEQ ID NO: 9038392 - DNA, 22 bp, Homo sapiens
ttcaacaggaaagcactttaca

SEQ ID NO: 9038393 - DNA, 22 bp, Homo sapiens
ttcaacagcttccaaagtgtgt

SEQ ID NO: 9038394 - DNA, 22 bp, Homo sapiens
ttcaacagcttccaaagtgtgt

SEQ ID NO: 9038395 - DNA, 22 bp, Homo sapiens
ttcaacagatatttattgagca

SEQ ID NO: 9038396 - DNA, 21 bp, Homo sapiens
ttcaacagcataatgtaggaa

SEQ ID NO: 9038397 - DNA, 22 bp, Homo sapiens
ttcaacagacccttctttcttt

SEQ ID NO: 9038398 - DNA, 22 bp, Homo sapiens
ttagataaattaagactttaca

SEQ ID NO: 9038399 - DNA, 22 bp, Homo sapiens
ttagataaagtgatgtaggcta

SEQ ID NO: 9038400 - DNA, 22 bp, Homo sapiens
ttagataaattaagactttaca

SEQ ID NO: 9038401 - DNA, 17 bp, Homo sapiens
ttcaaagcttatcaagg

SEQ ID NO: 9038402 - DNA, 22 bp, Homo sapiens
ttagataaattgcaacttgatt

SEQ ID NO: 9038403 - DNA, 23 bp, Homo sapiens
ttcaaagcttaagctctttccac

SEQ ID NO: 9038404 - DNA, 22 bp, Homo sapiens
ttagataaaagtgttcaataaa

SEQ ID NO: 9038405 - DNA, 22 bp, Homo sapiens
ttagataaaagtgttcaataaa

SEQ ID NO: 9038406 - DNA, 22 bp, Homo sapiens
ttagataaagtgatgtaggcta

SEQ ID NO: 9038407 - DNA, 22 bp, Homo sapiens
ttagagtttttgtaagtacaat

SEQ ID NO: 9038408 - DNA, 22 bp, Homo sapiens
ttagataaaagtgttcaataaa

SEQ ID NO: 9038409 - DNA, 22 bp, Homo sapiens
ttagataaaagtgttcaataaa

SEQ ID NO: 9038410 - DNA, 22 bp, Homo sapiens
ttagataaaagtgttcaataaa

SEQ ID NO: 9038411 - DNA, 21 bp, Homo sapiens
ttagagtagagaacatgatcc

SEQ ID NO: 9038412 - DNA, 22 bp, Homo sapiens
ttagagtgtagcaggaagaggc

SEQ ID NO: 9038413 - DNA, 22 bp, Homo sapiens
ttagaggttctatgtgtctgga

SEQ ID NO: 9038414 - DNA, 22 bp, Homo sapiens
ttagaggtgtcaggagcacagg

SEQ ID NO: 9038415 - DNA, 22 bp, Homo sapiens
ttagaggtgtcaggagcacagg

SEQ ID NO: 9038416 - DNA, 22 bp, Homo sapiens
ttagaggtgtgaccttgggcaa

SEQ ID NO: 9038417 - DNA, 20 bp, Homo sapiens
ttagagttagctgttatgca

SEQ ID NO: 9038418 - DNA, 22 bp, Homo sapiens
ttagagttaggatttgtcttta

SEQ ID NO: 9038419 - DNA, 21 bp, Homo sapiens
ttagagttgccattatatgta

SEQ ID NO: 9038420 - DNA, 22 bp, Homo sapiens
ttagagttttatcattgcctta

SEQ ID NO: 9038421 - DNA, 21 bp, Homo sapiens
ttagagttgccattatatgta

SEQ ID NO: 9038422 - DNA, 21 bp, Homo sapiens
ttcaacaaagggaataagttt

SEQ ID NO: 9038423 - DNA, 22 bp, Homo sapiens
ttcaacaaaatatatttttcca

SEQ ID NO: 9038424 - DNA, 22 bp, Homo sapiens
ttcaacaaaatatatttttcca

SEQ ID NO: 9038425 - DNA, 22 bp, Homo sapiens
ttcaacaaactgttcacgaatg

SEQ ID NO: 9038426 - DNA, 23 bp, Homo sapiens
ttcaaaggcaatatgctgagaaa

SEQ ID NO: 9038427 - DNA, 17 bp, Homo sapiens
ttcaaagcttatcaagg

SEQ ID NO: 9038428 - DNA, 17 bp, Homo sapiens
ttcaaagcttatcaagg

SEQ ID NO: 9038429 - DNA, 22 bp, Homo sapiens
ttcaaaggaaaggcagtgtcaa

SEQ ID NO: 9038430 - DNA, 22 bp, Homo sapiens
ttcaaaggaaaggcagtgtcaa

SEQ ID NO: 9038431 - DNA, 22 bp, Homo sapiens
ttcaacaagtagtacacacagt

SEQ ID NO: 9038432 - DNA, 22 bp, Homo sapiens
ttcaacaaggctgtcaaaagtt

SEQ ID NO: 9038433 - DNA, 22 bp, Homo sapiens
ttcaacaaggctgtcaaaagtt

SEQ ID NO: 9038434 - DNA, 22 bp, Homo sapiens
ttcaacaagtatttattgagca

SEQ ID NO: 9038435 - DNA, 22 bp, Homo sapiens
ttcaacaaatatttattgagct

SEQ ID NO: 9038436 - DNA, 21 bp, Homo sapiens
ttcaacaaagggaataagttt

SEQ ID NO: 9038437 - DNA, 22 bp, Homo sapiens
ttcaacaacttggttcaaatgg

SEQ ID NO: 9038438 - DNA, 22 bp, Homo sapiens
ttcaacaaggctgtcaaaagtt

SEQ ID NO: 9038439 - DNA, 22 bp, Homo sapiens
ttcctatttccatgaaacacaa

SEQ ID NO: 9038440 - DNA, 22 bp, Homo sapiens
ttcctcacactcccccattcga

SEQ ID NO: 9038441 - DNA, 22 bp, Homo sapiens
ttcctatggccagagtcaaaga

SEQ ID NO: 9038442 - DNA, 22 bp, Homo sapiens
ttcctatggctcagttgcattt

SEQ ID NO: 9038443 - DNA, 22 bp, Homo sapiens
ttcctatgtgggcagagacaca

SEQ ID NO: 9038444 - DNA, 22 bp, Homo sapiens
ttcctagggcagagccgctggg

SEQ ID NO: 9038445 - DNA, 22 bp, Homo sapiens
ttcctagggcagagccgctggg

SEQ ID NO: 9038446 - DNA, 22 bp, Homo sapiens
ttcctagggcagagccgctggg

SEQ ID NO: 9038447 - DNA, 22 bp, Homo sapiens
ttcctatggccagagtcaaaga

SEQ ID NO: 9038448 - DNA, 22 bp, Homo sapiens
ttcctaatgtctactttagttc

SEQ ID NO: 9038449 - DNA, 22 bp, Homo sapiens
ttcctacatttgtacaataaga

SEQ ID NO: 9038450 - DNA, 22 bp, Homo sapiens
ttcctacatttgcctcactccc

SEQ ID NO: 9038451 - DNA, 22 bp, Homo sapiens
ttcctagaatggttagaaaata

SEQ ID NO: 9038452 - DNA, 22 bp, Homo sapiens
ttcctagctataaagctcttcc

SEQ ID NO: 9038453 - DNA, 22 bp, Homo sapiens
ttcctagaatggttagaaaata

SEQ ID NO: 9038454 - DNA, 22 bp, Homo sapiens
ttcctaggatggtgaagcagga

SEQ ID NO: 9038455 - DNA, 22 bp, Homo sapiens
ttcctagggcagagccgctggg

SEQ ID NO: 9038456 - DNA, 22 bp, Homo sapiens
ttcctagggcagagccgctggg

SEQ ID NO: 9038457 - DNA, 18 bp, Homo sapiens
ttcctaggaactaagctt

SEQ ID NO: 9038458 - DNA, 22 bp, Homo sapiens
ttcctagggcagagccgctggg

SEQ ID NO: 9038459 - DNA, 22 bp, Homo sapiens
ttcctcagagagacagaaacta

SEQ ID NO: 9038460 - DNA, 22 bp, Homo sapiens
ttcctcagagggcgctggggaa

SEQ ID NO: 9038461 - DNA, 22 bp, Homo sapiens
ttcctcagagggcgctggggaa

SEQ ID NO: 9038462 - DNA, 22 bp, Homo sapiens
ttcctcagagggcgctggggaa

SEQ ID NO: 9038463 - DNA, 22 bp, Homo sapiens
ttcctcagaaaatactgtccaa

SEQ ID NO: 9038464 - DNA, 22 bp, Homo sapiens
ttcctcacctaattgggagggg

SEQ ID NO: 9038465 - DNA, 22 bp, Homo sapiens
ttcctcagaccctcattgtgag

SEQ ID NO: 9038466 - DNA, 22 bp, Homo sapiens
ttcctcagctggcctgattggg

SEQ ID NO: 9038467 - DNA, 22 bp, Homo sapiens
ttcctcagccagcacttagggg

SEQ ID NO: 9038468 - DNA, 22 bp, Homo sapiens
ttcctcagccagcacttagggg

SEQ ID NO: 9038469 - DNA, 22 bp, Homo sapiens
ttcctcagccagcacttagggg

SEQ ID NO: 9038470 - DNA, 22 bp, Homo sapiens
ttcctcagccaaggctgggatc

SEQ ID NO: 9038471 - DNA, 22 bp, Homo sapiens
ttcctcagccaaggctgggatc

SEQ ID NO: 9038472 - DNA, 22 bp, Homo sapiens
ttcctcagagggcgctggggaa

SEQ ID NO: 9038473 - DNA, 22 bp, Homo sapiens
ttcctcagagggcgctggggaa

SEQ ID NO: 9038474 - DNA, 22 bp, Homo sapiens
ttcctcagttagtgcctgaggc

SEQ ID NO: 9038475 - DNA, 22 bp, Homo sapiens
ttcctcagttagtgcctgaggc

SEQ ID NO: 9038476 - DNA, 22 bp, Homo sapiens
ttcctcagttagtgcctgaggc

SEQ ID NO: 9038477 - DNA, 22 bp, Homo sapiens
ttcctcaggcttccctttgtcc

SEQ ID NO: 9038478 - DNA, 22 bp, Homo sapiens
ttcctcagggaggctagcagta

SEQ ID NO: 9038479 - DNA, 22 bp, Homo sapiens
ttcctcagggcggatgggcagg

SEQ ID NO: 9038480 - DNA, 22 bp, Homo sapiens
ttcctcaggctgctttcacata

SEQ ID NO: 9038481 - DNA, 22 bp, Homo sapiens
ttcctcagctttagactatgaa

SEQ ID NO: 9038482 - DNA, 22 bp, Homo sapiens
ttcctcagctgtgtcctggcga

SEQ ID NO: 9038483 - DNA, 22 bp, Homo sapiens
ttcctcagctgtgtcctggcga

SEQ ID NO: 9038484 - DNA, 22 bp, Homo sapiens
ttcctctggaggctctaggaga

SEQ ID NO: 9038485 - DNA, 22 bp, Homo sapiens
ttcctctggaggctctaggaga

SEQ ID NO: 9038486 - DNA, 22 bp, Homo sapiens
ttcctctggaggctctaggaga

SEQ ID NO: 9038487 - DNA, 22 bp, Homo sapiens
ttcctctgtagttgctgatgaa

SEQ ID NO: 9038488 - DNA, 22 bp, Homo sapiens
ttcctccagaagctgtagggga

SEQ ID NO: 9038489 - DNA, 22 bp, Homo sapiens
ttcctcatggggttccttcaga

SEQ ID NO: 9038490 - DNA, 22 bp, Homo sapiens
ttcctcatggggttccttcaga

SEQ ID NO: 9038491 - DNA, 22 bp, Homo sapiens
ttcctcatctagcacagaaatt

SEQ ID NO: 9038492 - DNA, 22 bp, Homo sapiens
ttcctcatctgtgcacctcact

SEQ ID NO: 9038493 - DNA, 22 bp, Homo sapiens
ttcctcatctagcacagaaatt

SEQ ID NO: 9038494 - DNA, 22 bp, Homo sapiens
ttcctaatggcaaaacatgttt

SEQ ID NO: 9038495 - DNA, 22 bp, Homo sapiens
ttcctaatcacgaacattattt

SEQ ID NO: 9038496 - DNA, 22 bp, Homo sapiens
ttcctaatgtctactttagttc

SEQ ID NO: 9038497 - DNA, 22 bp, Homo sapiens
ttcctaatggcaaaacatgttt

SEQ ID NO: 9038498 - DNA, 22 bp, Homo sapiens
ttcctaatcacgaacattattt

SEQ ID NO: 9038499 - DNA, 22 bp, Homo sapiens
ttcctaagtcctgccagcagtc

SEQ ID NO: 9038500 - DNA, 22 bp, Homo sapiens
ttcctaactggcctttatggat

SEQ ID NO: 9038501 - DNA, 22 bp, Homo sapiens
ttcctaactctggcacctagtc

SEQ ID NO: 9038502 - DNA, 22 bp, Homo sapiens
ttcctaactctggcacctagtc

SEQ ID NO: 9038503 - DNA, 22 bp, Homo sapiens
ttcctaacctctagctgcatat

SEQ ID NO: 9038504 - DNA, 22 bp, Homo sapiens
ttcctaacgccagtattttcat

SEQ ID NO: 9038505 - DNA, 22 bp, Homo sapiens
ttcctaacacagtgtaagcaag

SEQ ID NO: 9038506 - DNA, 20 bp, Homo sapiens
ttccctggaaggagaagcag

SEQ ID NO: 9038507 - DNA, 22 bp, Homo sapiens
ttccctggaaagccatgcagtc

SEQ ID NO: 9038508 - DNA, 22 bp, Homo sapiens
ttccctggaggagtagtgaaat

SEQ ID NO: 9038509 - DNA, 20 bp, Homo sapiens
ttccctggaaggagaagcag

SEQ ID NO: 9038510 - DNA, 20 bp, Homo sapiens
ttccctggaaggagaagcag

SEQ ID NO: 9038511 - DNA, 20 bp, Homo sapiens
ttccctggaaggagaagcag

SEQ ID NO: 9038512 - DNA, 22 bp, Homo sapiens
ttcctaacaaggggtattcatc

SEQ ID NO: 9038513 - DNA, 22 bp, Homo sapiens
ttcctaacaagtctatctttga

SEQ ID NO: 9038514 - DNA, 22 bp, Homo sapiens
ttccctggcatgagtgtaagat

SEQ ID NO: 9038515 - DNA, 22 bp, Homo sapiens
ttccctggccctggcacgctct

SEQ ID NO: 9038516 - DNA, 22 bp, Homo sapiens
ttccagagagttattcccctgg

SEQ ID NO: 9038517 - DNA, 22 bp, Homo sapiens
ttccagagaggctcatgttccc

SEQ ID NO: 9038518 - DNA, 22 bp, Homo sapiens
ttccagagcctagaatcttgat

SEQ ID NO: 9038519 - DNA, 22 bp, Homo sapiens
ttccagagcccatgctctaggc

SEQ ID NO: 9038520 - DNA, 21 bp, Homo sapiens
ttccagagattgtttcacctg

SEQ ID NO: 9038521 - DNA, 22 bp, Homo sapiens
ttccagagcagttttcagatca

SEQ ID NO: 9038522 - DNA, 22 bp, Homo sapiens
ttccagaagcctccatattact

SEQ ID NO: 9038523 - DNA, 22 bp, Homo sapiens
ttccagaacttttgttaatttc

SEQ ID NO: 9038524 - DNA, 22 bp, Homo sapiens
ttccagaagatggcagcaaagg

SEQ ID NO: 9038525 - DNA, 22 bp, Homo sapiens
ttccagaaggaagccggggagc

SEQ ID NO: 9038526 - DNA, 22 bp, Homo sapiens
ttccagaattgggagccttgag

SEQ ID NO: 9038527 - DNA, 22 bp, Homo sapiens
ttccagaatagatggagctcta

SEQ ID NO: 9038528 - DNA, 22 bp, Homo sapiens
ttccagaattttgttctgcttg

SEQ ID NO: 9038529 - DNA, 22 bp, Homo sapiens
ttccagaccattccacgggaga

SEQ ID NO: 9038530 - DNA, 22 bp, Homo sapiens
ttccagagagagaaaatttgat

SEQ ID NO: 9038531 - DNA, 22 bp, Homo sapiens
ttccagagaaaaggtttatttc

SEQ ID NO: 9038532 - DNA, 22 bp, Homo sapiens
ttccagactatcagcagcagga

SEQ ID NO: 9038533 - DNA, 22 bp, Homo sapiens
ttccagaccattccacgggaga

SEQ ID NO: 9038534 - DNA, 22 bp, Homo sapiens
ttccacaattcagattgttgcc

SEQ ID NO: 9038535 - DNA, 23 bp, Homo sapiens
ttccacaatgaaaataaagcagg

SEQ ID NO: 9038536 - DNA, 22 bp, Homo sapiens
ttccacaatggttaagctcgtt

SEQ ID NO: 9038537 - DNA, 22 bp, Homo sapiens
ttccacaatggttaagctcgtt

SEQ ID NO: 9038538 - DNA, 22 bp, Homo sapiens
ttccacaattcagattgttgcc

SEQ ID NO: 9038539 - DNA, 22 bp, Homo sapiens
ttccacaatgtatgaataagat

SEQ ID NO: 9038540 - DNA, 22 bp, Homo sapiens
ttccacaatgtatgaataagat

SEQ ID NO: 9038541 - DNA, 22 bp, Homo sapiens
ttccacaatgtatgaataagat

SEQ ID NO: 9038542 - DNA, 22 bp, Homo sapiens
ttccacaagtgatatctagctg

SEQ ID NO: 9038543 - DNA, 17 bp, Homo sapiens
ttccacaatagtttgtc

SEQ ID NO: 9038544 - DNA, 17 bp, Homo sapiens
ttccacaatagtttgtc

SEQ ID NO: 9038545 - DNA, 23 bp, Homo sapiens
ttccacaatgaaaataaagcagg

SEQ ID NO: 9038546 - DNA, 22 bp, Homo sapiens
ttccacaatgccaggggcatca

SEQ ID NO: 9038547 - DNA, 22 bp, Homo sapiens
ttccacaatgccaggggcatca

SEQ ID NO: 9038548 - DNA, 23 bp, Homo sapiens
ttccacaatgaaaataaagcagg

SEQ ID NO: 9038549 - DNA, 23 bp, Homo sapiens
ttccacaatgaaaataaagcagg

SEQ ID NO: 9038550 - DNA, 23 bp, Homo sapiens
ttccacaatgaaaataaagcagg

SEQ ID NO: 9038551 - DNA, 22 bp, Homo sapiens
ttccacaaacacatcctgagca

SEQ ID NO: 9038552 - DNA, 22 bp, Homo sapiens
ttccacaaacacatcctgagca

SEQ ID NO: 9038553 - DNA, 22 bp, Homo sapiens
ttccacaaatacactccacatt

SEQ ID NO: 9038554 - DNA, 22 bp, Homo sapiens
ttccacaaacacatcctgagca

SEQ ID NO: 9038555 - DNA, 22 bp, Homo sapiens
ttccacaaatcaattctgctga

SEQ ID NO: 9038556 - DNA, 22 bp, Homo sapiens
ttccacaacaaccaagcatata

SEQ ID NO: 9038557 - DNA, 22 bp, Homo sapiens
ttccacaaatcaattctgctga

SEQ ID NO: 9038558 - DNA, 22 bp, Homo sapiens
ttccacaaatcaattctgctga

SEQ ID NO: 9038559 - DNA, 22 bp, Homo sapiens
ttccacaagatgtttcttagaa

SEQ ID NO: 9038560 - DNA, 22 bp, Homo sapiens
ttccacaagatgtttcttagaa

SEQ ID NO: 9038561 - DNA, 22 bp, Homo sapiens
ttccacaagtgatatctagctg

SEQ ID NO: 9038562 - DNA, 22 bp, Homo sapiens
ttccacaaggccttgtcctgct

SEQ ID NO: 9038563 - DNA, 22 bp, Homo sapiens
ttccacaagatgtttcttagaa

SEQ ID NO: 9038564 - DNA, 22 bp, Homo sapiens
ttccacaagacttgggttaaga

SEQ ID NO: 9038565 - DNA, 22 bp, Homo sapiens
ttccacaagatgtttcttagaa

SEQ ID NO: 9038566 - DNA, 22 bp, Homo sapiens
ttccacaacaaccaagcatata

SEQ ID NO: 9038567 - DNA, 22 bp, Homo sapiens
ttccacaacaaccaagcatata

SEQ ID NO: 9038568 - DNA, 22 bp, Homo sapiens
ttccacaacaaccaagcatata

SEQ ID NO: 9038569 - DNA, 22 bp, Homo sapiens
ttccacaacaaccaagcatata

SEQ ID NO: 9038570 - DNA, 22 bp, Homo sapiens
ttccacagatgtatgaagtggt

SEQ ID NO: 9038571 - DNA, 22 bp, Homo sapiens
ttccacagatgtatgaagtggt

SEQ ID NO: 9038572 - DNA, 22 bp, Homo sapiens
ttccacaggactaaatgtcatc

SEQ ID NO: 9038573 - DNA, 22 bp, Homo sapiens
ttccacaggtttcagactgttc

SEQ ID NO: 9038574 - DNA, 22 bp, Homo sapiens
ttccacagcccaagctggtggc

SEQ ID NO: 9038575 - DNA, 22 bp, Homo sapiens
ttccacagcccaagctggtggc

SEQ ID NO: 9038576 - DNA, 22 bp, Homo sapiens
ttccacaggactaaatgtcatc

SEQ ID NO: 9038577 - DNA, 22 bp, Homo sapiens
ttccacaggtttcagactgttc

SEQ ID NO: 9038578 - DNA, 22 bp, Homo sapiens
ttccacagtcatcctgggaatt

SEQ ID NO: 9038579 - DNA, 22 bp, Homo sapiens
ttccacagtcatcctgggaatt

SEQ ID NO: 9038580 - DNA, 22 bp, Homo sapiens
ttccacagtcatcctgggaatt

SEQ ID NO: 9038581 - DNA, 16 bp, Homo sapiens
ttccacagtcgaggtg

SEQ ID NO: 9038582 - DNA, 21 bp, Homo sapiens
ttccacagtcctgaggattca

SEQ ID NO: 9038583 - DNA, 21 bp, Homo sapiens
ttccacagtcctgaggattca

SEQ ID NO: 9038584 - DNA, 21 bp, Homo sapiens
ttccacagtgagaactgcaag

SEQ ID NO: 9038585 - DNA, 22 bp, Homo sapiens
ttccagaaccttcctgctggaa

SEQ ID NO: 9038586 - DNA, 22 bp, Homo sapiens
ttccagaactcaagaaatgccc

SEQ ID NO: 9038587 - DNA, 22 bp, Homo sapiens
ttccagaacaatgtggacgtat

SEQ ID NO: 9038588 - DNA, 22 bp, Homo sapiens
ttccacattccttacattcata

SEQ ID NO: 9038589 - DNA, 22 bp, Homo sapiens
ttccacattccttacattcata

SEQ ID NO: 9038590 - DNA, 20 bp, Homo sapiens
ttccacatctttgcacatgc

SEQ ID NO: 9038591 - DNA, 22 bp, Homo sapiens
ttccacagtggctgtagttctg

SEQ ID NO: 9038592 - DNA, 22 bp, Homo sapiens
ttccacatagatcacaggtgtt

SEQ ID NO: 9038593 - DNA, 22 bp, Homo sapiens
ttccacagtggctgtagttctg

SEQ ID NO: 9038594 - DNA, 22 bp, Homo sapiens
ttctacaaatatttactgttcc

SEQ ID NO: 9038595 - DNA, 20 bp, Homo sapiens
ttctacaaaactgattctga

SEQ ID NO: 9038596 - DNA, 22 bp, Homo sapiens
ttctacaatatgaataatgaag

SEQ ID NO: 9038597 - DNA, 22 bp, Homo sapiens
ttctacaaatatttactgttcc

SEQ ID NO: 9038598 - DNA, 22 bp, Homo sapiens
ttctacaatatgaataatgaag

SEQ ID NO: 9038599 - DNA, 22 bp, Homo sapiens
ttctacaaatatttactgttcc

SEQ ID NO: 9038600 - DNA, 22 bp, Homo sapiens
ttctacaatatgaataatgaag

SEQ ID NO: 9038601 - DNA, 22 bp, Homo sapiens
ttctacaatatgaataatgaag

SEQ ID NO: 9038602 - DNA, 22 bp, Homo sapiens
ttctacacagtgcgggttaaca

SEQ ID NO: 9038603 - DNA, 22 bp, Homo sapiens
ttctacacacctctgaggacat

SEQ ID NO: 9038604 - DNA, 22 bp, Homo sapiens
ttctacacacctctgaggacat

SEQ ID NO: 9038605 - DNA, 22 bp, Homo sapiens
ttctacaatatgaataatgaag

SEQ ID NO: 9038606 - DNA, 22 bp, Homo sapiens
ttctagaaacacatgcaaacag

SEQ ID NO: 9038607 - DNA, 21 bp, Homo sapiens
ttctagaaaagtatgggactg

SEQ ID NO: 9038608 - DNA, 16 bp, Homo sapiens
ttctagaaaagaaggt

SEQ ID NO: 9038609 - DNA, 16 bp, Homo sapiens
ttctagaaaagaaggt

SEQ ID NO: 9038610 - DNA, 22 bp, Homo sapiens
ttctactaggatgtcttgaaca

SEQ ID NO: 9038611 - DNA, 22 bp, Homo sapiens
ttctacttctgacactgtttgt

SEQ ID NO: 9038612 - DNA, 22 bp, Homo sapiens
ttctactttagcatgctcattc

SEQ ID NO: 9038613 - DNA, 22 bp, Homo sapiens
ttctactttctctgtcattaaa

SEQ ID NO: 9038614 - DNA, 22 bp, Homo sapiens
ttctactttggacataaaggac

SEQ ID NO: 9038615 - DNA, 16 bp, Homo sapiens
ttctagaaaagaaggt

SEQ ID NO: 9038616 - DNA, 22 bp, Homo sapiens
ttctaattgtgtttgcatatct

SEQ ID NO: 9038617 - DNA, 22 bp, Homo sapiens
ttctaattgtgtttgcatatct

SEQ ID NO: 9038618 - DNA, 22 bp, Homo sapiens
ttctaattgtgtttgcatatct

SEQ ID NO: 9038619 - DNA, 20 bp, Homo sapiens
ttctaatttgatggagtagc

SEQ ID NO: 9038620 - DNA, 22 bp, Homo sapiens
ttctaattgaccttaggctgtg

SEQ ID NO: 9038621 - DNA, 22 bp, Homo sapiens
ttctaattgcaagttttagtat

SEQ ID NO: 9038622 - DNA, 22 bp, Homo sapiens
ttctaattgaccttaggctgtg

SEQ ID NO: 9038623 - DNA, 22 bp, Homo sapiens
ttctaattattcccttgtccca

SEQ ID NO: 9038624 - DNA, 22 bp, Homo sapiens
ttctaatgatttcattcaaagc

SEQ ID NO: 9038625 - DNA, 22 bp, Homo sapiens
ttctaatgatttcattcaaagc

SEQ ID NO: 9038626 - DNA, 22 bp, Homo sapiens
ttctaattaaatctacgctagg

SEQ ID NO: 9038627 - DNA, 22 bp, Homo sapiens
ttctaatagctgcctatgtatt

SEQ ID NO: 9038628 - DNA, 22 bp, Homo sapiens
ttctaatacacggtatgacttt

SEQ ID NO: 9038629 - DNA, 22 bp, Homo sapiens
ttctaatcccagctctactact

SEQ ID NO: 9038630 - DNA, 22 bp, Homo sapiens
ttctaatctgggcttctgcagt

SEQ ID NO: 9038631 - DNA, 22 bp, Homo sapiens
ttctaatctgggcttctgcagt

SEQ ID NO: 9038632 - DNA, 22 bp, Homo sapiens
ttctaatgaaagtggaccatgg

SEQ ID NO: 9038633 - DNA, 22 bp, Homo sapiens
ttctaatgaaatctgtacagta

SEQ ID NO: 9038634 - DNA, 22 bp, Homo sapiens
ttctaagtctgctgtcttcatc

SEQ ID NO: 9038635 - DNA, 22 bp, Homo sapiens
ttctaagattcatgaggacagg

SEQ ID NO: 9038636 - DNA, 22 bp, Homo sapiens
ttctaagtcctacctgaaagca

SEQ ID NO: 9038637 - DNA, 19 bp, Homo sapiens
ttctaagttttgcttgctg

SEQ ID NO: 9038638 - DNA, 19 bp, Homo sapiens
ttctaagttttgcttgctg

SEQ ID NO: 9038639 - DNA, 22 bp, Homo sapiens
ttctagaaatccgtaagtgaat

SEQ ID NO: 9038640 - DNA, 22 bp, Homo sapiens
ttctagaaactggagcaaacag

SEQ ID NO: 9038641 - DNA, 22 bp, Homo sapiens
ttctagaaactggagcaaacag

SEQ ID NO: 9038642 - DNA, 22 bp, Homo sapiens
ttctagaacaggcaaaaccaat

SEQ ID NO: 9038643 - DNA, 22 bp, Homo sapiens
ttctagaacaggcaaaaccaat

SEQ ID NO: 9038644 - DNA, 22 bp, Homo sapiens
ttctagaaatccgtaagtgaat

SEQ ID NO: 9038645 - DNA, 21 bp, Homo sapiens
ttctagaaccgtgggcggttc

SEQ ID NO: 9038646 - DNA, 22 bp, Homo sapiens
ttctagaaccatgacttcaggg

SEQ ID NO: 9038647 - DNA, 22 bp, Homo sapiens
ttctagaagctctaggggagaa

SEQ ID NO: 9038648 - DNA, 22 bp, Homo sapiens
ttctagaagaactagccaggaa

SEQ ID NO: 9038649 - DNA, 22 bp, Homo sapiens
ttctagaagaactagccaggaa

SEQ ID NO: 9038650 - DNA, 19 bp, Homo sapiens
ttctagaactgttctctca

SEQ ID NO: 9038651 - DNA, 20 bp, Homo sapiens
ttctagaagtttgctaccca

SEQ ID NO: 9038652 - DNA, 22 bp, Homo sapiens
ttctagaagtgtctatgtctgt

SEQ ID NO: 9038653 - DNA, 22 bp, Homo sapiens
ttctagaagctgaaaaggggga

SEQ ID NO: 9038654 - DNA, 22 bp, Homo sapiens
ttctagaaggcaggctgggcca

SEQ ID NO: 9038655 - DNA, 22 bp, Homo sapiens
ttctagaagtgtctatgtctgt

SEQ ID NO: 9038656 - DNA, 22 bp, Homo sapiens
ttctagaatgttttgaaaggga

SEQ ID NO: 9038657 - DNA, 20 bp, Homo sapiens
ttctagaatgcccagggaca

SEQ ID NO: 9038658 - DNA, 22 bp, Homo sapiens
ttctagaatgatatgaggtact

SEQ ID NO: 9038659 - DNA, 22 bp, Homo sapiens
ttctagaatccttgtctacttt

SEQ ID NO: 9038660 - DNA, 22 bp, Homo sapiens
ttctaggatgctgatgagaccc

SEQ ID NO: 9038661 - DNA, 22 bp, Homo sapiens
ttctaggaccctgcgtgagaac

SEQ ID NO: 9038662 - DNA, 22 bp, Homo sapiens
ttctaggaagggaagcatggca

SEQ ID NO: 9038663 - DNA, 22 bp, Homo sapiens
ttctaggaccctgcgtgagaac

SEQ ID NO: 9038664 - DNA, 22 bp, Homo sapiens
ttctagctgttgctgtttatag

SEQ ID NO: 9038665 - DNA, 22 bp, Homo sapiens
ttctagcatgccttttagcaca

SEQ ID NO: 9038666 - DNA, 20 bp, Homo sapiens
ttctagcatacttacaagga

SEQ ID NO: 9038667 - DNA, 20 bp, Homo sapiens
ttctagcatacttacaagga

SEQ ID NO: 9038668 - DNA, 22 bp, Homo sapiens
ttctaggggagaggaagaagtg

SEQ ID NO: 9038669 - DNA, 22 bp, Homo sapiens
ttctaggggacataatatgaaa

SEQ ID NO: 9038670 - DNA, 22 bp, Homo sapiens
ttctagggaatgggatgaggat

SEQ ID NO: 9038671 - DNA, 19 bp, Homo sapiens
ttctaggctatgaagcagt

SEQ ID NO: 9038672 - DNA, 23 bp, Homo sapiens
ttctaggctctgattgggcttcc

SEQ ID NO: 9038673 - DNA, 22 bp, Homo sapiens
ttctagacttcaggcattctcc

SEQ ID NO: 9038674 - DNA, 22 bp, Homo sapiens
ttctagagaactcgagtgcctt

SEQ ID NO: 9038675 - DNA, 22 bp, Homo sapiens
ttctagactgtgtacagattca

SEQ ID NO: 9038676 - DNA, 22 bp, Homo sapiens
ttctagacaaatgtgttcattc

SEQ ID NO: 9038677 - DNA, 22 bp, Homo sapiens
ttctagaggggagatactagta

SEQ ID NO: 9038678 - DNA, 22 bp, Homo sapiens
ttctagaggggagatactagta

SEQ ID NO: 9038679 - DNA, 22 bp, Homo sapiens
ttctagaggggagatactagta

SEQ ID NO: 9038680 - DNA, 22 bp, Homo sapiens
ttctagatagagtgcaaattat

SEQ ID NO: 9038681 - DNA, 22 bp, Homo sapiens
ttctagatagagtgcaaattat

SEQ ID NO: 9038682 - DNA, 22 bp, Homo sapiens
ttctagcagagggcatctgctg

SEQ ID NO: 9038683 - DNA, 22 bp, Homo sapiens
ttctagcagagggcatctgctg

SEQ ID NO: 9038684 - DNA, 22 bp, Homo sapiens
ttctagcactgcctggaagaca

SEQ ID NO: 9038685 - DNA, 22 bp, Homo sapiens
ttctagcactgcctggaagaca

SEQ ID NO: 9038686 - DNA, 22 bp, Homo sapiens
ttctagcacaagatatgaaagt

SEQ ID NO: 9038687 - DNA, 22 bp, Homo sapiens
ttctagcacaagatatgaaagt

SEQ ID NO: 9038688 - DNA, 22 bp, Homo sapiens
ttctagcacaagatatgaaagt

SEQ ID NO: 9038689 - DNA, 22 bp, Homo sapiens
ttctagatgataaaccagcagc

SEQ ID NO: 9038690 - DNA, 22 bp, Homo sapiens
ttctagatgcttataggcatat

SEQ ID NO: 9038691 - DNA, 22 bp, Homo sapiens
ttctagattgacagagagcaca

SEQ ID NO: 9038692 - DNA, 22 bp, Homo sapiens
ttctagattgcctgtaagtaaa

SEQ ID NO: 9038693 - DNA, 22 bp, Homo sapiens
ttcctgtggccttacatctgtg

SEQ ID NO: 9038694 - DNA, 22 bp, Homo sapiens
ttcctgtggccttacatctgtg

SEQ ID NO: 9038695 - DNA, 22 bp, Homo sapiens
ttcctgtgcttattcttctctg

SEQ ID NO: 9038696 - DNA, 19 bp, Homo sapiens
ttcctgtgctgctgtgtcc

SEQ ID NO: 9038697 - DNA, 22 bp, Homo sapiens
ttcctgtgcctcaggtctcagc

SEQ ID NO: 9038698 - DNA, 22 bp, Homo sapiens
ttcctgtgtcctatttcgactt

SEQ ID NO: 9038699 - DNA, 22 bp, Homo sapiens
ttcctgtgtgaccgagacagtg

SEQ ID NO: 9038700 - DNA, 22 bp, Homo sapiens
ttcctgtggtgtttcccagaca

SEQ ID NO: 9038701 - DNA, 22 bp, Homo sapiens
ttcctgtggtccagagtcatcc

SEQ ID NO: 9038702 - DNA, 22 bp, Homo sapiens
ttcctgaaaatacagggagaga

SEQ ID NO: 9038703 - DNA, 22 bp, Homo sapiens
ttcctgaaaatacagggagacc

SEQ ID NO: 9038704 - DNA, 22 bp, Homo sapiens
ttcctgaaaatacagggagacc

SEQ ID NO: 9038705 - DNA, 22 bp, Homo sapiens
ttcctctttgcatcctcaactc

SEQ ID NO: 9038706 - DNA, 22 bp, Homo sapiens
ttcctcttattttcccagtgat

SEQ ID NO: 9038707 - DNA, 22 bp, Homo sapiens
ttcctcttccatcttcccaggg

SEQ ID NO: 9038708 - DNA, 22 bp, Homo sapiens
ttcctgtattttgcgaattttc

SEQ ID NO: 9038709 - DNA, 22 bp, Homo sapiens
ttcctgtccgcaatggcctggg

SEQ ID NO: 9038710 - DNA, 22 bp, Homo sapiens
ttcctgtgaaatataggtccat

SEQ ID NO: 9038711 - DNA, 20 bp, Homo sapiens
ttcctgtcctctctttcagg

SEQ ID NO: 9038712 - DNA, 22 bp, Homo sapiens
ttcctgtccgcaatggcctggg

SEQ ID NO: 9038713 - DNA, 22 bp, Homo sapiens
ttcctgaaaatacagggagaga

SEQ ID NO: 9038714 - DNA, 22 bp, Homo sapiens
ttccttacattcatatggcttc

SEQ ID NO: 9038715 - DNA, 22 bp, Homo sapiens
ttccttaatgaatcaggccatt

SEQ ID NO: 9038716 - DNA, 19 bp, Homo sapiens
ttccttagaggaggcggtg

SEQ ID NO: 9038717 - DNA, 22 bp, Homo sapiens
ttccttagcagacctggtatcc

SEQ ID NO: 9038718 - DNA, 22 bp, Homo sapiens
ttcctgttagccattattagct

SEQ ID NO: 9038719 - DNA, 22 bp, Homo sapiens
ttcctgtgtgttggtggcagaa

SEQ ID NO: 9038720 - DNA, 22 bp, Homo sapiens
ttcctgttcaggaaagttgtgt

SEQ ID NO: 9038721 - DNA, 23 bp, Homo sapiens
ttccttaactgttaagattgtct

SEQ ID NO: 9038722 - DNA, 22 bp, Homo sapiens
ttccttaatgaatcaggccatt

SEQ ID NO: 9038723 - DNA, 22 bp, Homo sapiens
ttcctgtttcatagaaaactga

SEQ ID NO: 9038724 - DNA, 22 bp, Homo sapiens
ttcctgttgtgttagagtcaat

SEQ ID NO: 9038725 - DNA, 22 bp, Homo sapiens
ttcctgttgtgttagagtcaat

SEQ ID NO: 9038726 - DNA, 22 bp, Homo sapiens
ttccttagttgactgtcttagt

SEQ ID NO: 9038727 - DNA, 22 bp, Homo sapiens
ttccttctagagcttgtttagg

SEQ ID NO: 9038728 - DNA, 22 bp, Homo sapiens
ttccttctagagcttgtttagg

SEQ ID NO: 9038729 - DNA, 22 bp, Homo sapiens
ttccttctagagcttgtttagg

SEQ ID NO: 9038730 - DNA, 22 bp, Homo sapiens
ttccttctaattttacacctga

SEQ ID NO: 9038731 - DNA, 22 bp, Homo sapiens
ttccttcaaacgcctcctgcac

SEQ ID NO: 9038732 - DNA, 22 bp, Homo sapiens
ttccttcaaacgcctcctgcac

SEQ ID NO: 9038733 - DNA, 22 bp, Homo sapiens
ttccttctagagcttgtttagg

SEQ ID NO: 9038734 - DNA, 22 bp, Homo sapiens
ttctaagtcactcagattttgg

SEQ ID NO: 9038735 - DNA, 22 bp, Homo sapiens
ttctaagctctgaaataaatct

SEQ ID NO: 9038736 - DNA, 22 bp, Homo sapiens
ttctaagctctgaaataaatct

SEQ ID NO: 9038737 - DNA, 22 bp, Homo sapiens
ttctaagaggctaatgaagaat

SEQ ID NO: 9038738 - DNA, 22 bp, Homo sapiens
ttctaagagagtacaagcaatt

SEQ ID NO: 9038739 - DNA, 22 bp, Homo sapiens
ttccttctgaagcctttgtgtt

SEQ ID NO: 9038740 - DNA, 22 bp, Homo sapiens
ttccttctgaagcctttgtgtt

SEQ ID NO: 9038741 - DNA, 22 bp, Homo sapiens
ttctaagaaatggaaaacgatt

SEQ ID NO: 9038742 - DNA, 22 bp, Homo sapiens
ttctaagagagtacaagcaatt

SEQ ID NO: 9038743 - DNA, 18 bp, Homo sapiens
ttccttctgatgtatatg

SEQ ID NO: 9038744 - DNA, 22 bp, Homo sapiens
ttccttctcagccctcgaggat

SEQ ID NO: 9038745 - DNA, 22 bp, Homo sapiens
ttccttctccagaacttctagg

SEQ ID NO: 9038746 - DNA, 22 bp, Homo sapiens
ttccttctccagaacttctagg

SEQ ID NO: 9038747 - DNA, 22 bp, Homo sapiens
ttccttctccagaacttctagg

SEQ ID NO: 9038748 - DNA, 22 bp, Homo sapiens
ttccttctcagccctcgaggat

SEQ ID NO: 9038749 - DNA, 20 bp, Homo sapiens
ttctgagagttcacagcccc

SEQ ID NO: 9038750 - DNA, 22 bp, Homo sapiens
ttctgagatacaaaatttactt

SEQ ID NO: 9038751 - DNA, 22 bp, Homo sapiens
ttctgagatacaaaatttactt

SEQ ID NO: 9038752 - DNA, 22 bp, Homo sapiens
ttctgagagtgccagaagttct

SEQ ID NO: 9038753 - DNA, 20 bp, Homo sapiens
ttctgagagttcacagcccc

SEQ ID NO: 9038754 - DNA, 22 bp, Homo sapiens
ttctgagagtgccagaagttct

SEQ ID NO: 9038755 - DNA, 22 bp, Homo sapiens
ttctgagagtgccagaagttct

SEQ ID NO: 9038756 - DNA, 22 bp, Homo sapiens
ttctgagatgcgttagaaattt

SEQ ID NO: 9038757 - DNA, 22 bp, Homo sapiens
ttctgagatgcgttagaaattt

SEQ ID NO: 9038758 - DNA, 22 bp, Homo sapiens
ttctgagatgaggaggaaaaag

SEQ ID NO: 9038759 - DNA, 22 bp, Homo sapiens
ttctgagatgaggaggaaaaag

SEQ ID NO: 9038760 - DNA, 22 bp, Homo sapiens
ttctgagatgaggaggaaaaag

SEQ ID NO: 9038761 - DNA, 22 bp, Homo sapiens
ttctgagatacttttggcacca

SEQ ID NO: 9038762 - DNA, 22 bp, Homo sapiens
ttctgagatgtgaatctgtcaa

SEQ ID NO: 9038763 - DNA, 22 bp, Homo sapiens
ttctgagatgtgaatctgtcaa

SEQ ID NO: 9038764 - DNA, 22 bp, Homo sapiens
ttctgagatgtgaatctgtcaa

SEQ ID NO: 9038765 - DNA, 22 bp, Homo sapiens
ttctgagattatcatacaacat

SEQ ID NO: 9038766 - DNA, 20 bp, Homo sapiens
ttctgagattaggttacaaa

SEQ ID NO: 9038767 - DNA, 22 bp, Homo sapiens
ttctgagagagcctctcatgtt

SEQ ID NO: 9038768 - DNA, 22 bp, Homo sapiens
ttctgagagagcctctcatgtt

SEQ ID NO: 9038769 - DNA, 21 bp, Homo sapiens
ttctgagactcatttgaactc

SEQ ID NO: 9038770 - DNA, 22 bp, Homo sapiens
ttctgagacttgagattaattt

SEQ ID NO: 9038771 - DNA, 22 bp, Homo sapiens
ttctgagacttgagattaattt

SEQ ID NO: 9038772 - DNA, 22 bp, Homo sapiens
ttctgagacagcaaagattctt

SEQ ID NO: 9038773 - DNA, 22 bp, Homo sapiens
ttctgagacagcaaagattctt

SEQ ID NO: 9038774 - DNA, 22 bp, Homo sapiens
ttctgagacatcatacttttag

SEQ ID NO: 9038775 - DNA, 22 bp, Homo sapiens
ttctgagagctgaagaaatgtt

SEQ ID NO: 9038776 - DNA, 22 bp, Homo sapiens
ttctgagagagcctctcatgtt

SEQ ID NO: 9038777 - DNA, 22 bp, Homo sapiens
ttctgagagagcctctcatgtt

SEQ ID NO: 9038778 - DNA, 22 bp, Homo sapiens
ttctgagagctgaagaaatgtt

SEQ ID NO: 9038779 - DNA, 22 bp, Homo sapiens
ttctgagagtaaacatagcctg

SEQ ID NO: 9038780 - DNA, 22 bp, Homo sapiens
ttctgagaggcagagcttgtga

SEQ ID NO: 9038781 - DNA, 22 bp, Homo sapiens
ttctgagaggtttgcattttca

SEQ ID NO: 9038782 - DNA, 22 bp, Homo sapiens
ttctgagagtaaacatagcctg

SEQ ID NO: 9038783 - DNA, 22 bp, Homo sapiens
ttctgacatatccagtctcagt

SEQ ID NO: 9038784 - DNA, 22 bp, Homo sapiens
ttctgacatttgtcaaaatgat

SEQ ID NO: 9038785 - DNA, 22 bp, Homo sapiens
ttctgacatgtgagattttgtt

SEQ ID NO: 9038786 - DNA, 22 bp, Homo sapiens
ttctgacagcaaaactcagcct

SEQ ID NO: 9038787 - DNA, 22 bp, Homo sapiens
ttctgacagtaatcagtttgct

SEQ ID NO: 9038788 - DNA, 22 bp, Homo sapiens
ttctgacatatccagtctcagt

SEQ ID NO: 9038789 - DNA, 22 bp, Homo sapiens
ttctgagaatgcttctggaatc

SEQ ID NO: 9038790 - DNA, 22 bp, Homo sapiens
ttctgagaaatgggttcacata

SEQ ID NO: 9038791 - DNA, 22 bp, Homo sapiens
ttctgacctcaggtgatccgtc

SEQ ID NO: 9038792 - DNA, 22 bp, Homo sapiens
ttctgagaaggctgtggacaca

SEQ ID NO: 9038793 - DNA, 22 bp, Homo sapiens
ttctgagaaggctgtggacaca

SEQ ID NO: 9038794 - DNA, 22 bp, Homo sapiens
ttctgaatttctgtgtatctta

SEQ ID NO: 9038795 - DNA, 22 bp, Homo sapiens
ttctgacaattcagtaacagca

SEQ ID NO: 9038796 - DNA, 22 bp, Homo sapiens
ttctgacaattcagtaacagca

SEQ ID NO: 9038797 - DNA, 22 bp, Homo sapiens
ttctgacacattactacatgga

SEQ ID NO: 9038798 - DNA, 22 bp, Homo sapiens
ttctgacacattactacatgga

SEQ ID NO: 9038799 - DNA, 22 bp, Homo sapiens
ttctgacacattactacatgga

SEQ ID NO: 9038800 - DNA, 22 bp, Homo sapiens
ttctgacacattactacatgga

SEQ ID NO: 9038801 - DNA, 22 bp, Homo sapiens
ttctgaattcatgagatttggg

SEQ ID NO: 9038802 - DNA, 22 bp, Homo sapiens
ttctgaattcatgagatttggg

SEQ ID NO: 9038803 - DNA, 22 bp, Homo sapiens
ttctgaatcctcgaaacatagc

SEQ ID NO: 9038804 - DNA, 22 bp, Homo sapiens
ttctgaatcctcgaaacatagc

SEQ ID NO: 9038805 - DNA, 22 bp, Homo sapiens
ttctgaatgatagtcttgaact

SEQ ID NO: 9038806 - DNA, 22 bp, Homo sapiens
ttctgaatggcaagcattaggc

SEQ ID NO: 9038807 - DNA, 22 bp, Homo sapiens
ttctagttaaagtatgtattag

SEQ ID NO: 9038808 - DNA, 22 bp, Homo sapiens
ttctagtgtccttggacttgct

SEQ ID NO: 9038809 - DNA, 22 bp, Homo sapiens
ttctagtgtccttggacttgct

SEQ ID NO: 9038810 - DNA, 22 bp, Homo sapiens
ttctagtgtccttggacttgct

SEQ ID NO: 9038811 - DNA, 22 bp, Homo sapiens
ttctagtctatggctagatagt

SEQ ID NO: 9038812 - DNA, 22 bp, Homo sapiens
ttctagtcctagaaactacatg

SEQ ID NO: 9038813 - DNA, 22 bp, Homo sapiens
ttctagttaatgtagcatcttg

SEQ ID NO: 9038814 - DNA, 22 bp, Homo sapiens
ttctagttaatgtagcatcttg

SEQ ID NO: 9038815 - DNA, 22 bp, Homo sapiens
ttctagttactcttaaatgctg

SEQ ID NO: 9038816 - DNA, 22 bp, Homo sapiens
ttctagttactcttaaatgctg

SEQ ID NO: 9038817 - DNA, 22 bp, Homo sapiens
ttctagttacagaagccttgct

SEQ ID NO: 9038818 - DNA, 22 bp, Homo sapiens
ttctagttacagaagccttgct

SEQ ID NO: 9038819 - DNA, 22 bp, Homo sapiens
ttctagttatagaaaaagcatt

SEQ ID NO: 9038820 - DNA, 22 bp, Homo sapiens
ttctagttatagaaaaagcatt

SEQ ID NO: 9038821 - DNA, 22 bp, Homo sapiens
ttctagttcatattctcaaaga

SEQ ID NO: 9038822 - DNA, 22 bp, Homo sapiens
ttctagttctgaaagcctgaca

SEQ ID NO: 9038823 - DNA, 22 bp, Homo sapiens
ttctagttccctctggaatgta

SEQ ID NO: 9038824 - DNA, 22 bp, Homo sapiens
ttctagttctgaaagcctgaca

SEQ ID NO: 9038825 - DNA, 22 bp, Homo sapiens
ttctagttcttaggaacagaca

SEQ ID NO: 9038826 - DNA, 22 bp, Homo sapiens
ttctagttgagggagacaaata

SEQ ID NO: 9038827 - DNA, 22 bp, Homo sapiens
ttctagttcttagagaattggt

SEQ ID NO: 9038828 - DNA, 22 bp, Homo sapiens
ttctagttcttagagaattggt

SEQ ID NO: 9038829 - DNA, 22 bp, Homo sapiens
ttctagttgagggagacaaata

SEQ ID NO: 9038830 - DNA, 22 bp, Homo sapiens
ttctagtttccattttaagaca

SEQ ID NO: 9038831 - DNA, 22 bp, Homo sapiens
ttctagtttccattttaagaca

SEQ ID NO: 9038832 - DNA, 22 bp, Homo sapiens
ttctagtttagggctcttcaac

SEQ ID NO: 9038833 - DNA, 22 bp, Homo sapiens
ttctagtttccattttaagaca

SEQ ID NO: 9038834 - DNA, 20 bp, Homo sapiens
ttctagtttggagttattaa

SEQ ID NO: 9038835 - DNA, 22 bp, Homo sapiens
ttctagttttcagtccaccagg

SEQ ID NO: 9038836 - DNA, 22 bp, Homo sapiens
ttctagttttcagtccaccagg

SEQ ID NO: 9038837 - DNA, 20 bp, Homo sapiens
ttctagtttggagttattaa

SEQ ID NO: 9038838 - DNA, 22 bp, Homo sapiens
ttctcttttagaggctccatga

SEQ ID NO: 9038839 - DNA, 22 bp, Homo sapiens
ttctcttttagaggctccatga

SEQ ID NO: 9038840 - DNA, 22 bp, Homo sapiens
ttctcttttagaggctccatga

SEQ ID NO: 9038841 - DNA, 22 bp, Homo sapiens
ttctcttttcaccagttgctaa

SEQ ID NO: 9038842 - DNA, 22 bp, Homo sapiens
ttctcttttagaggctccatga

SEQ ID NO: 9038843 - DNA, 22 bp, Homo sapiens
ttctcttttcaccagttgctaa

SEQ ID NO: 9038844 - DNA, 22 bp, Homo sapiens
ttctcttttcaccagttgctaa

SEQ ID NO: 9038845 - DNA, 22 bp, Homo sapiens
ttctcttttcaccagttgctaa

SEQ ID NO: 9038846 - DNA, 22 bp, Homo sapiens
ttctcttttgtgatgtgagatg

SEQ ID NO: 9038847 - DNA, 22 bp, Homo sapiens
ttctgaagggctaagtgtctat

SEQ ID NO: 9038848 - DNA, 22 bp, Homo sapiens
ttctgaagggctaagtgtctat

SEQ ID NO: 9038849 - DNA, 22 bp, Homo sapiens
ttctgaagggctaagtgtctat

SEQ ID NO: 9038850 - DNA, 22 bp, Homo sapiens
ttctgaaggtcagcagcttggt

SEQ ID NO: 9038851 - DNA, 22 bp, Homo sapiens
ttctgaatcctcgaaacatagc

SEQ ID NO: 9038852 - DNA, 22 bp, Homo sapiens
ttctgaatcctcgaaacatagc

SEQ ID NO: 9038853 - DNA, 22 bp, Homo sapiens
ttctgaatcctcgaaacatagc

SEQ ID NO: 9038854 - DNA, 22 bp, Homo sapiens
ttctatacaaagatttctcaca

SEQ ID NO: 9038855 - DNA, 22 bp, Homo sapiens
ttctcttttagaggctccatga

SEQ ID NO: 9038856 - DNA, 22 bp, Homo sapiens
ttctagttttgccttatcaaca

SEQ ID NO: 9038857 - DNA, 22 bp, Homo sapiens
ttctataaatgaatgtgtatat

SEQ ID NO: 9038858 - DNA, 22 bp, Homo sapiens
ttctagttttgccttatcaaca

SEQ ID NO: 9038859 - DNA, 22 bp, Homo sapiens
ttctagttttgccttatcaaca

SEQ ID NO: 9038860 - DNA, 22 bp, Homo sapiens
ttctagttttgccttatcaaca

SEQ ID NO: 9038861 - DNA, 22 bp, Homo sapiens
ttctagttttgccacaggatac

SEQ ID NO: 9038862 - DNA, 22 bp, Homo sapiens
ttctgggcagttggaaatttca

SEQ ID NO: 9038863 - DNA, 19 bp, Homo sapiens
ttctgggcattcatattta

SEQ ID NO: 9038864 - DNA, 19 bp, Homo sapiens
ttctgggcattcatattta

SEQ ID NO: 9038865 - DNA, 22 bp, Homo sapiens
ttctgggcatgttacattctgt

SEQ ID NO: 9038866 - DNA, 19 bp, Homo sapiens
ttctgggcagcacatgaat

SEQ ID NO: 9038867 - DNA, 19 bp, Homo sapiens
ttctgggcagcacatgaat

SEQ ID NO: 9038868 - DNA, 19 bp, Homo sapiens
ttctgggcagcacatgaat

SEQ ID NO: 9038869 - DNA, 22 bp, Homo sapiens
ttctgggcagagctggagctgc

SEQ ID NO: 9038870 - DNA, 22 bp, Homo sapiens
ttctgggcaccaccacagactt

SEQ ID NO: 9038871 - DNA, 22 bp, Homo sapiens
ttctgggcaccaccacagactt

SEQ ID NO: 9038872 - DNA, 22 bp, Homo sapiens
ttctggaaaagaaagttaagat

SEQ ID NO: 9038873 - DNA, 22 bp, Homo sapiens
ttctggaaaagaaagttaagat

SEQ ID NO: 9038874 - DNA, 22 bp, Homo sapiens
ttctggaaaccctcagccagtg

SEQ ID NO: 9038875 - DNA, 22 bp, Homo sapiens
ttctggaaaccctcagccagtg

SEQ ID NO: 9038876 - DNA, 22 bp, Homo sapiens
ttctggaaagaaggctaaggtc

SEQ ID NO: 9038877 - DNA, 22 bp, Homo sapiens
ttctggaaagcatttgaggccc

SEQ ID NO: 9038878 - DNA, 22 bp, Homo sapiens
ttctggaaatcagcagagggtg

SEQ ID NO: 9038879 - DNA, 22 bp, Homo sapiens
ttctggaaatcagcagagggtg

SEQ ID NO: 9038880 - DNA, 22 bp, Homo sapiens
ttctggaaagatttgcgtgtaa

SEQ ID NO: 9038881 - DNA, 22 bp, Homo sapiens
ttctggaaagatttgcgtgtaa

SEQ ID NO: 9038882 - DNA, 19 bp, Homo sapiens
ttctggaaacccaggtaat

SEQ ID NO: 9038883 - DNA, 22 bp, Homo sapiens
ttctggaaagaaggctaaggtc

SEQ ID NO: 9038884 - DNA, 22 bp, Homo sapiens
ttctggaaagcatttgaggccc

SEQ ID NO: 9038885 - DNA, 22 bp, Homo sapiens
ttctgcttctgtgtgtcccagg

SEQ ID NO: 9038886 - DNA, 22 bp, Homo sapiens
ttctgcttattcaaatgatctt

SEQ ID NO: 9038887 - DNA, 22 bp, Homo sapiens
ttctgcttattcaaatgatctt

SEQ ID NO: 9038888 - DNA, 20 bp, Homo sapiens
ttctgcttgcaaatatcaag

SEQ ID NO: 9038889 - DNA, 20 bp, Homo sapiens
ttctgcttgcaaatatcaag

SEQ ID NO: 9038890 - DNA, 22 bp, Homo sapiens
ttctgcttttagctaaactata

SEQ ID NO: 9038891 - DNA, 22 bp, Homo sapiens
ttctgctttggttccatggatg

SEQ ID NO: 9038892 - DNA, 22 bp, Homo sapiens
ttctgctttggttccatggatg

SEQ ID NO: 9038893 - DNA, 22 bp, Homo sapiens
ttctgctttcagttcttctggg

SEQ ID NO: 9038894 - DNA, 22 bp, Homo sapiens
ttctgctttcagttcttctggg

SEQ ID NO: 9038895 - DNA, 22 bp, Homo sapiens
ttctgcttttattgccagagtt

SEQ ID NO: 9038896 - DNA, 22 bp, Homo sapiens
ttctgcttttctctgtctgagt

SEQ ID NO: 9038897 - DNA, 22 bp, Homo sapiens
ttctgcttttctctgtctgagt

SEQ ID NO: 9038898 - DNA, 22 bp, Homo sapiens
ttctgcttttagctaaactata

SEQ ID NO: 9038899 - DNA, 22 bp, Homo sapiens
ttctgagattgttaggcactaa

SEQ ID NO: 9038900 - DNA, 22 bp, Homo sapiens
ttctgagcaagctggacagtct

SEQ ID NO: 9038901 - DNA, 22 bp, Homo sapiens
ttctgagattatcatacaacat

SEQ ID NO: 9038902 - DNA, 22 bp, Homo sapiens
ttctgagcctcattcatgaggc

SEQ ID NO: 9038903 - DNA, 22 bp, Homo sapiens
ttctgagccagagtcagttatg

SEQ ID NO: 9038904 - DNA, 22 bp, Homo sapiens
ttctgagcacgttcatttaaat

SEQ ID NO: 9038905 - DNA, 22 bp, Homo sapiens
ttctgagcacgttcatttaaat

SEQ ID NO: 9038906 - DNA, 17 bp, Homo sapiens
ttctgagccacttcctt

SEQ ID NO: 9038907 - DNA, 22 bp, Homo sapiens
ttctgcctgccccagagaggcc

SEQ ID NO: 9038908 - DNA, 22 bp, Homo sapiens
ttctgcctgccccagagaggcc

SEQ ID NO: 9038909 - DNA, 22 bp, Homo sapiens
ttctgagcctttctaagaaaca

SEQ ID NO: 9038910 - DNA, 22 bp, Homo sapiens
ttctgagctacatagtactggg

SEQ ID NO: 9038911 - DNA, 21 bp, Homo sapiens
ttctgccttcccctagctggg

SEQ ID NO: 9038912 - DNA, 22 bp, Homo sapiens
ttctgccttcagtcctctgact

SEQ ID NO: 9038913 - DNA, 22 bp, Homo sapiens
ttctgccttacgatattttcaa

SEQ ID NO: 9038914 - DNA, 21 bp, Homo sapiens
ttctgctaagaaaacattatt

SEQ ID NO: 9038915 - DNA, 18 bp, Homo sapiens
ttctgcggtgacagatat

SEQ ID NO: 9038916 - DNA, 22 bp, Homo sapiens
ttctgctccaccacttccagca

SEQ ID NO: 9038917 - DNA, 22 bp, Homo sapiens
ttctgctcagtagtaagagtgc

SEQ ID NO: 9038918 - DNA, 17 bp, Homo sapiens
ttctgctgtttcccctt

SEQ ID NO: 9038919 - DNA, 22 bp, Homo sapiens
ttctgctgtttgtagtaatgta

SEQ ID NO: 9038920 - DNA, 19 bp, Homo sapiens
ttctgctgttcctaggctg

SEQ ID NO: 9038921 - DNA, 22 bp, Homo sapiens
ttctgctgcgacccaggagtta

SEQ ID NO: 9038922 - DNA, 22 bp, Homo sapiens
ttctgctccaccacttccagca

SEQ ID NO: 9038923 - DNA, 21 bp, Homo sapiens
ttctgctccagctcctctggg

SEQ ID NO: 9038924 - DNA, 22 bp, Homo sapiens
ttctgctccaccacttccagca

SEQ ID NO: 9038925 - DNA, 21 bp, Homo sapiens
ttctgctccagctcctctggg

SEQ ID NO: 9038926 - DNA, 21 bp, Homo sapiens
ttctgctccagctcctctggg

SEQ ID NO: 9038927 - DNA, 21 bp, Homo sapiens
ttctgctccagctcctctggg

SEQ ID NO: 9038928 - DNA, 22 bp, Homo sapiens
ttctgctctaatgtacaccagc

SEQ ID NO: 9038929 - DNA, 22 bp, Homo sapiens
ttctgctctgacttgcaaggaa

SEQ ID NO: 9038930 - DNA, 22 bp, Homo sapiens
ttctgctgaagccagggagcaa

SEQ ID NO: 9038931 - DNA, 22 bp, Homo sapiens
ttctgctgagtgggcaggtgca

SEQ ID NO: 9038932 - DNA, 22 bp, Homo sapiens
ttctgctgaagtcactgggagc

SEQ ID NO: 9038933 - DNA, 22 bp, Homo sapiens
ttctgctgcctactcctgggga

SEQ ID NO: 9038934 - DNA, 22 bp, Homo sapiens
ttctgctgagtgggcaggtgca

SEQ ID NO: 9038935 - DNA, 22 bp, Homo sapiens
ttcttacagccctattactaaa

SEQ ID NO: 9038936 - DNA, 22 bp, Homo sapiens
ttcttacagccctattactaaa

SEQ ID NO: 9038937 - DNA, 22 bp, Homo sapiens
ttcttacagccctattactaaa

SEQ ID NO: 9038938 - DNA, 22 bp, Homo sapiens
ttcttacatattttcatatggt

SEQ ID NO: 9038939 - DNA, 22 bp, Homo sapiens
ttcttacatattttcatatggt

SEQ ID NO: 9038940 - DNA, 22 bp, Homo sapiens
ttcttacatattttcatatggt

SEQ ID NO: 9038941 - DNA, 22 bp, Homo sapiens
ttcttacagatttggtgaatga

SEQ ID NO: 9038942 - DNA, 22 bp, Homo sapiens
ttcttacagccctattactaaa

SEQ ID NO: 9038943 - DNA, 22 bp, Homo sapiens
ttcttacagccctattactaaa

SEQ ID NO: 9038944 - DNA, 22 bp, Homo sapiens
ttcttacagagtttacagagcc

SEQ ID NO: 9038945 - DNA, 22 bp, Homo sapiens
ttcttacagagtttacagagcc

SEQ ID NO: 9038946 - DNA, 22 bp, Homo sapiens
ttcttacagagtttacagagcc

SEQ ID NO: 9038947 - DNA, 22 bp, Homo sapiens
ttcttacattactttacatgtg

SEQ ID NO: 9038948 - DNA, 22 bp, Homo sapiens
ttcttacatctataaagttggg

SEQ ID NO: 9038949 - DNA, 22 bp, Homo sapiens
ttcttctttatctcagtatcct

SEQ ID NO: 9038950 - DNA, 22 bp, Homo sapiens
ttcttctttatctcagtatcct

SEQ ID NO: 9038951 - DNA, 22 bp, Homo sapiens
ttcttctttatctcagtatcct

SEQ ID NO: 9038952 - DNA, 22 bp, Homo sapiens
ttcttcttgtctgccctcacat

SEQ ID NO: 9038953 - DNA, 22 bp, Homo sapiens
ttcttgagtatctgcacagtgc

SEQ ID NO: 9038954 - DNA, 22 bp, Homo sapiens
ttcttgaatcactttagagata

SEQ ID NO: 9038955 - DNA, 22 bp, Homo sapiens
ttcttgaaggggatataaatag

SEQ ID NO: 9038956 - DNA, 22 bp, Homo sapiens
ttcttgaaggggatataaatag

SEQ ID NO: 9038957 - DNA, 22 bp, Homo sapiens
ttcttgaaaatagccatgtaca

SEQ ID NO: 9038958 - DNA, 22 bp, Homo sapiens
ttcttctttcctataattaatt

SEQ ID NO: 9038959 - DNA, 22 bp, Homo sapiens
ttcttctttcctataattaatt

SEQ ID NO: 9038960 - DNA, 22 bp, Homo sapiens
ttcttctttcctataattaatt

SEQ ID NO: 9038961 - DNA, 22 bp, Homo sapiens
ttcttctttccccctgtggtac

SEQ ID NO: 9038962 - DNA, 22 bp, Homo sapiens
ttcttctttccaattacatggt

SEQ ID NO: 9038963 - DNA, 22 bp, Homo sapiens
ttcttgatgaatgctaagaact

SEQ ID NO: 9038964 - DNA, 22 bp, Homo sapiens
ttcttgatgaatgctaagaact

SEQ ID NO: 9038965 - DNA, 22 bp, Homo sapiens
ttcttgattcttccttgaagga

SEQ ID NO: 9038966 - DNA, 22 bp, Homo sapiens
ttcttgcatcactctgctgttc

SEQ ID NO: 9038967 - DNA, 22 bp, Homo sapiens
ttcttgcatcactctgctgttc

SEQ ID NO: 9038968 - DNA, 22 bp, Homo sapiens
ttcttgccatatttcagccctt

SEQ ID NO: 9038969 - DNA, 22 bp, Homo sapiens
ttcttgatttcatgcagttaag

SEQ ID NO: 9038970 - DNA, 22 bp, Homo sapiens
ttcttgcaggtcactcactgag

SEQ ID NO: 9038971 - DNA, 22 bp, Homo sapiens
ttcttgcatcaagacagcctgt

SEQ ID NO: 9038972 - DNA, 22 bp, Homo sapiens
ttctttaaaatagtgagaaaga

SEQ ID NO: 9038973 - DNA, 22 bp, Homo sapiens
ttctttaaatgaattctctgta

SEQ ID NO: 9038974 - DNA, 22 bp, Homo sapiens
ttctttaaatgaattctctgta

SEQ ID NO: 9038975 - DNA, 22 bp, Homo sapiens
ttctttaaatgaattctctgta

SEQ ID NO: 9038976 - DNA, 22 bp, Homo sapiens
ttctttaaatgaattctctgta

SEQ ID NO: 9038977 - DNA, 22 bp, Homo sapiens
ttcttggaaactgattccttgt

SEQ ID NO: 9038978 - DNA, 22 bp, Homo sapiens
ttctttaaaatagtgagaaaga

SEQ ID NO: 9038979 - DNA, 22 bp, Homo sapiens
ttctttaaaatagtgagaaaga

SEQ ID NO: 9038980 - DNA, 22 bp, Homo sapiens
ttctttagcaacttggatttag

SEQ ID NO: 9038981 - DNA, 22 bp, Homo sapiens
ttctttatatctgctagtgggt

SEQ ID NO: 9038982 - DNA, 22 bp, Homo sapiens
ttctttatcagttactcatagg

SEQ ID NO: 9038983 - DNA, 22 bp, Homo sapiens
ttctttatcagttactcatagg

SEQ ID NO: 9038984 - DNA, 22 bp, Homo sapiens
ttctttatcagttactcatagg

SEQ ID NO: 9038985 - DNA, 22 bp, Homo sapiens
ttctttatcagttactcatagg

SEQ ID NO: 9038986 - DNA, 22 bp, Homo sapiens
ttctttatcagttactcatagg

SEQ ID NO: 9038987 - DNA, 22 bp, Homo sapiens
ttctttaccagtgaaatgttat

SEQ ID NO: 9038988 - DNA, 22 bp, Homo sapiens
ttctttaccagtgaaatgttat

SEQ ID NO: 9038989 - DNA, 20 bp, Homo sapiens
ttctttacgacctttctgca

SEQ ID NO: 9038990 - DNA, 22 bp, Homo sapiens
ttctttaccactactcttccaa

SEQ ID NO: 9038991 - DNA, 18 bp, Homo sapiens
ttctttaattcagtttga

SEQ ID NO: 9038992 - DNA, 18 bp, Homo sapiens
ttctttaattcagtttga

SEQ ID NO: 9038993 - DNA, 18 bp, Homo sapiens
ttctttaattcagtttga

SEQ ID NO: 9038994 - DNA, 18 bp, Homo sapiens
ttctttaattcagtttga

SEQ ID NO: 9038995 - DNA, 18 bp, Homo sapiens
ttctttaattcagtttga

SEQ ID NO: 9038996 - DNA, 22 bp, Homo sapiens
ttctgggctctctttctgtgtg

SEQ ID NO: 9038997 - DNA, 23 bp, Homo sapiens
ttctgggctgtggaagcctcggg

SEQ ID NO: 9038998 - DNA, 22 bp, Homo sapiens
ttctgggctcacagagcagcag

SEQ ID NO: 9038999 - DNA, 22 bp, Homo sapiens
ttctgggctcacagagcagcag

SEQ ID NO: 9039000 - DNA, 22 bp, Homo sapiens
ttctgggctcccacatatttca

SEQ ID NO: 9039001 - DNA, 22 bp, Homo sapiens
ttctggggacataacagtaagc

SEQ ID NO: 9039002 - DNA, 22 bp, Homo sapiens
ttctgggctgtccagagggtga

SEQ ID NO: 9039003 - DNA, 22 bp, Homo sapiens
ttctggggccccagtgtcctcg

SEQ ID NO: 9039004 - DNA, 22 bp, Homo sapiens
ttctggggccccagtgtcctcg

SEQ ID NO: 9039005 - DNA, 22 bp, Homo sapiens
ttctggggccaattgccactgc

SEQ ID NO: 9039006 - DNA, 22 bp, Homo sapiens
ttctgggcctcctaggacaggc

SEQ ID NO: 9039007 - DNA, 22 bp, Homo sapiens
ttctgggcctcctaggacaggc

SEQ ID NO: 9039008 - DNA, 22 bp, Homo sapiens
ttctgggcctcctaggacaggc

SEQ ID NO: 9039009 - DNA, 22 bp, Homo sapiens
ttctgggcccactgtagcatcc

SEQ ID NO: 9039010 - DNA, 22 bp, Homo sapiens
ttctgggcccaaccctagagtg

SEQ ID NO: 9039011 - DNA, 22 bp, Homo sapiens
ttctgggcccaaccctagagtg

SEQ ID NO: 9039012 - DNA, 22 bp, Homo sapiens
ttctgggggccaggacagtggt

SEQ ID NO: 9039013 - DNA, 19 bp, Homo sapiens
ttctggggcctggccttgg

SEQ ID NO: 9039014 - DNA, 22 bp, Homo sapiens
ttctggggctaatacagaggtc

SEQ ID NO: 9039015 - DNA, 22 bp, Homo sapiens
ttctgggggaatacagctatga

SEQ ID NO: 9039016 - DNA, 22 bp, Homo sapiens
ttctggggctaatacagaggtc

SEQ ID NO: 9039017 - DNA, 22 bp, Homo sapiens
ttctgggggccaggacagtggt

SEQ ID NO: 9039018 - DNA, 22 bp, Homo sapiens
ttctggtaccgtgtcagaaacc

SEQ ID NO: 9039019 - DNA, 22 bp, Homo sapiens
ttctggtggccagaagtctgaa

SEQ ID NO: 9039020 - DNA, 19 bp, Homo sapiens
ttctggtctggaatcaagg

SEQ ID NO: 9039021 - DNA, 19 bp, Homo sapiens
ttctggtctggaatcaagg

SEQ ID NO: 9039022 - DNA, 21 bp, Homo sapiens
ttctgggttgttaatctgaac

SEQ ID NO: 9039023 - DNA, 22 bp, Homo sapiens
ttctggtgtgttctctctaggc

SEQ ID NO: 9039024 - DNA, 22 bp, Homo sapiens
ttctgttacatggggcacagtg

SEQ ID NO: 9039025 - DNA, 22 bp, Homo sapiens
ttctgttacaagtgaaaaaatg

SEQ ID NO: 9039026 - DNA, 22 bp, Homo sapiens
ttctgttagaattttgaaaata

SEQ ID NO: 9039027 - DNA, 22 bp, Homo sapiens
ttctgttatcattaagcattat

SEQ ID NO: 9039028 - DNA, 22 bp, Homo sapiens
ttctgttatcattaagcattat

SEQ ID NO: 9039029 - DNA, 22 bp, Homo sapiens
ttctgttacttgcaaccacagg

SEQ ID NO: 9039030 - DNA, 22 bp, Homo sapiens
ttctgttactgttggtcataac

SEQ ID NO: 9039031 - DNA, 22 bp, Homo sapiens
ttctgttacttgcaaccacagg

SEQ ID NO: 9039032 - DNA, 22 bp, Homo sapiens
ttctgtttattcctaggagctc

SEQ ID NO: 9039033 - DNA, 22 bp, Homo sapiens
ttctgtttattcctaggagctc

SEQ ID NO: 9039034 - DNA, 22 bp, Homo sapiens
ttctgtttcctgccttcccatt

SEQ ID NO: 9039035 - DNA, 22 bp, Homo sapiens
ttctgtttataatttgcagttg

SEQ ID NO: 9039036 - DNA, 22 bp, Homo sapiens
ttctgtttataatttgcagttg

SEQ ID NO: 9039037 - DNA, 22 bp, Homo sapiens
ttctgtttactcagaaatacaa

SEQ ID NO: 9039038 - DNA, 22 bp, Homo sapiens
ttctgttctttatttaccatat

SEQ ID NO: 9039039 - DNA, 22 bp, Homo sapiens
ttctgttctttatttaccatat

SEQ ID NO: 9039040 - DNA, 22 bp, Homo sapiens
ttctgttctgatacttgtttct

SEQ ID NO: 9039041 - DNA, 22 bp, Homo sapiens
ttctgttctgatacttgtttct

SEQ ID NO: 9039042 - DNA, 22 bp, Homo sapiens
ttctgttccctaggacctgggg

SEQ ID NO: 9039043 - DNA, 22 bp, Homo sapiens
ttctgttttgcacagacttgaa

SEQ ID NO: 9039044 - DNA, 22 bp, Homo sapiens
ttcttaaaacttatggacaggt

SEQ ID NO: 9039045 - DNA, 22 bp, Homo sapiens
ttcttaaaacttatggacaggt

SEQ ID NO: 9039046 - DNA, 22 bp, Homo sapiens
ttcttacactcttaaaaatcat

SEQ ID NO: 9039047 - DNA, 22 bp, Homo sapiens
ttcttacagagtttacagagcc

SEQ ID NO: 9039048 - DNA, 22 bp, Homo sapiens
ttcttacaagtattccaggtcc

SEQ ID NO: 9039049 - DNA, 22 bp, Homo sapiens
ttcttacaagtattccaggtcc

SEQ ID NO: 9039050 - DNA, 22 bp, Homo sapiens
ttcttacaagtattccaggtcc

SEQ ID NO: 9039051 - DNA, 22 bp, Homo sapiens
ttcttaaaacttatggacaggt

SEQ ID NO: 9039052 - DNA, 22 bp, Homo sapiens
ttcttaaaacttatggacaggt

SEQ ID NO: 9039053 - DNA, 22 bp, Homo sapiens
ttctgttttagaaataagtagt

SEQ ID NO: 9039054 - DNA, 22 bp, Homo sapiens
ttctgttttagaaataagtagt

SEQ ID NO: 9039055 - DNA, 22 bp, Homo sapiens
ttctgttttagaaataagtagt

SEQ ID NO: 9039056 - DNA, 22 bp, Homo sapiens
ttctgttttagaaataagtagt

SEQ ID NO: 9039057 - DNA, 22 bp, Homo sapiens
ttctgttttagaaataagtagt

SEQ ID NO: 9039058 - DNA, 22 bp, Homo sapiens
ttctgtttgccatatatagtag

SEQ ID NO: 9039059 - DNA, 22 bp, Homo sapiens
ttctgtttctggggtctctgac

SEQ ID NO: 9039060 - DNA, 22 bp, Homo sapiens
ttctgtttctggggtctctgac

SEQ ID NO: 9039061 - DNA, 22 bp, Homo sapiens
ttgagcaggatggctatgcaca

SEQ ID NO: 9039062 - DNA, 22 bp, Homo sapiens
ttgagcaggatggctatgcaca

SEQ ID NO: 9039063 - DNA, 22 bp, Homo sapiens
ttgagcaggaactagaagatag

SEQ ID NO: 9039064 - DNA, 19 bp, Homo sapiens
ttgagcagtgcttagcacc

SEQ ID NO: 9039065 - DNA, 19 bp, Homo sapiens
ttgagcagtgcttagcacc

SEQ ID NO: 9039066 - DNA, 19 bp, Homo sapiens
ttgagcagtgcttagcacc

SEQ ID NO: 9039067 - DNA, 22 bp, Homo sapiens
ttgagcacattccctttcatgg

SEQ ID NO: 9039068 - DNA, 22 bp, Homo sapiens
ttgagcacttattggtgttagg

SEQ ID NO: 9039069 - DNA, 22 bp, Homo sapiens
ttgagcaattaggaaataaaga

SEQ ID NO: 9039070 - DNA, 22 bp, Homo sapiens
ttgagcaattaggaaataaaga

SEQ ID NO: 9039071 - DNA, 22 bp, Homo sapiens
ttgagcaaaggagtaaaatgca

SEQ ID NO: 9039072 - DNA, 22 bp, Homo sapiens
ttgagcaaaggagtaaaatgca

SEQ ID NO: 9039073 - DNA, 22 bp, Homo sapiens
ttgagcaaatcagattgtaatt

SEQ ID NO: 9039074 - DNA, 22 bp, Homo sapiens
ttgagcaaatcagaagtttaga

SEQ ID NO: 9039075 - DNA, 22 bp, Homo sapiens
ttgagcaatgctgcaaagagat

SEQ ID NO: 9039076 - DNA, 22 bp, Homo sapiens
ttgagcaatgtcactgaggctt

SEQ ID NO: 9039077 - DNA, 20 bp, Homo sapiens
ttgagcaatcagtaaaggat

SEQ ID NO: 9039078 - DNA, 22 bp, Homo sapiens
ttgagcaatgctgcaaagagat

SEQ ID NO: 9039079 - DNA, 22 bp, Homo sapiens
ttgagcaagagtaggaactgaa

SEQ ID NO: 9039080 - DNA, 20 bp, Homo sapiens
ttgagcaatcagtaaaggat

SEQ ID NO: 9039081 - DNA, 23 bp, Homo sapiens
ttgaggcaaacatgtaagtagga

SEQ ID NO: 9039082 - DNA, 22 bp, Homo sapiens
ttgaggagttgtgacagatact

SEQ ID NO: 9039083 - DNA, 22 bp, Homo sapiens
ttgaggagtgtttagggtgagg

SEQ ID NO: 9039084 - DNA, 22 bp, Homo sapiens
ttgagcatgtaactacacaggg

SEQ ID NO: 9039085 - DNA, 22 bp, Homo sapiens
ttgagcccaggaggcctgggtg

SEQ ID NO: 9039086 - DNA, 22 bp, Homo sapiens
ttgagcccaggaggcctgggtg

SEQ ID NO: 9039087 - DNA, 22 bp, Homo sapiens
ttgagcccaggaggcctgggtg

SEQ ID NO: 9039088 - DNA, 22 bp, Homo sapiens
ttgagcccaggaggcctgggtg

SEQ ID NO: 9039089 - DNA, 22 bp, Homo sapiens
ttgaagcaaattctgtgcagta

SEQ ID NO: 9039090 - DNA, 22 bp, Homo sapiens
ttgaagattctttttgttagta

SEQ ID NO: 9039091 - DNA, 22 bp, Homo sapiens
ttgaatgaataaaagagtaagg

SEQ ID NO: 9039092 - DNA, 22 bp, Homo sapiens
ttgaatgaatggtccatataga

SEQ ID NO: 9039093 - DNA, 17 bp, Homo sapiens
ttgaatgcattacttgg

SEQ ID NO: 9039094 - DNA, 22 bp, Homo sapiens
ttgaatgcatggttcactctgt

SEQ ID NO: 9039095 - DNA, 22 bp, Homo sapiens
ttgaatgcagtcatgaaaagtt

SEQ ID NO: 9039096 - DNA, 22 bp, Homo sapiens
ttgagataggtggaatctcttt

SEQ ID NO: 9039097 - DNA, 22 bp, Homo sapiens
ttgaattatatgtatgtccttt

SEQ ID NO: 9039098 - DNA, 22 bp, Homo sapiens
ttgaattataagtgtgtctact

SEQ ID NO: 9039099 - DNA, 22 bp, Homo sapiens
ttgaatgcttacaatatgttag

SEQ ID NO: 9039100 - DNA, 22 bp, Homo sapiens
ttgaattagactttgctacagg

SEQ ID NO: 9039101 - DNA, 22 bp, Homo sapiens
ttgaattagactttgctacagg

SEQ ID NO: 9039102 - DNA, 22 bp, Homo sapiens
ttgaattataagtgtgtctact

SEQ ID NO: 9039103 - DNA, 22 bp, Homo sapiens
ttgaattataagtgtgtctact

SEQ ID NO: 9039104 - DNA, 22 bp, Homo sapiens
ttgaagagaatcagaaggttga

SEQ ID NO: 9039105 - DNA, 22 bp, Homo sapiens
ttgaagagaatcagaaggttga

SEQ ID NO: 9039106 - DNA, 22 bp, Homo sapiens
ttgaagagaaccgcggcttatt

SEQ ID NO: 9039107 - DNA, 22 bp, Homo sapiens
ttgaagagacaatttggaaagc

SEQ ID NO: 9039108 - DNA, 22 bp, Homo sapiens
ttgaagagacaatttggaaagc

SEQ ID NO: 9039109 - DNA, 22 bp, Homo sapiens
ttgaagagcaccagcattttga

SEQ ID NO: 9039110 - DNA, 22 bp, Homo sapiens
ttgaagagctgcttgataccct

SEQ ID NO: 9039111 - DNA, 22 bp, Homo sapiens
ttgaagagctgcttgataccct

SEQ ID NO: 9039112 - DNA, 22 bp, Homo sapiens
ttgaagagacgatttttccacc

SEQ ID NO: 9039113 - DNA, 22 bp, Homo sapiens
ttgaagagacgatttttccacc

SEQ ID NO: 9039114 - DNA, 22 bp, Homo sapiens
ttgaagagacaatttggaaagc

SEQ ID NO: 9039115 - DNA, 22 bp, Homo sapiens
ttgaagagcaccagcattttga

SEQ ID NO: 9039116 - DNA, 22 bp, Homo sapiens
ttgaagagtcgcttaacctgtg

SEQ ID NO: 9039117 - DNA, 20 bp, Homo sapiens
ttgaagagtcaggtagggcc

SEQ ID NO: 9039118 - DNA, 22 bp, Homo sapiens
ttgaagagtcgcttaacctgtg

SEQ ID NO: 9039119 - DNA, 20 bp, Homo sapiens
ttgaagagtcaggtagggcc

SEQ ID NO: 9039120 - DNA, 22 bp, Homo sapiens
ttgaagagtagaaaatgcaaat

SEQ ID NO: 9039121 - DNA, 22 bp, Homo sapiens
ttgaagagtagaaaatgcaaat

SEQ ID NO: 9039122 - DNA, 22 bp, Homo sapiens
ttgaagaggactttgcagctgt

SEQ ID NO: 9039123 - DNA, 22 bp, Homo sapiens
ttgaagaggactttgcagctgt

SEQ ID NO: 9039124 - DNA, 22 bp, Homo sapiens
ttgaagagcaccagcattttga

SEQ ID NO: 9039125 - DNA, 22 bp, Homo sapiens
ttgaagaggactttgcagctgt

SEQ ID NO: 9039126 - DNA, 20 bp, Homo sapiens
ttgaagaggatatatcgctc

SEQ ID NO: 9039127 - DNA, 22 bp, Homo sapiens
ttgaagagtaaagtgttttctc

SEQ ID NO: 9039128 - DNA, 22 bp, Homo sapiens
ttgaagagtaaagtgttttctc

SEQ ID NO: 9039129 - DNA, 20 bp, Homo sapiens
ttgaagaggatatatcgctc

SEQ ID NO: 9039130 - DNA, 22 bp, Homo sapiens
ttgaagagtttgatagagttga

SEQ ID NO: 9039131 - DNA, 22 bp, Homo sapiens
ttgaagagttttatgccaacct

SEQ ID NO: 9039132 - DNA, 22 bp, Homo sapiens
ttgaagagtgtccttgtaaaaa

SEQ ID NO: 9039133 - DNA, 22 bp, Homo sapiens
ttgaagagtgccttccagacat

SEQ ID NO: 9039134 - DNA, 22 bp, Homo sapiens
ttgaagagtgtccttgtaaaaa

SEQ ID NO: 9039135 - DNA, 22 bp, Homo sapiens
ttgaagagtgccttccagacat

SEQ ID NO: 9039136 - DNA, 22 bp, Homo sapiens
ttgaagagtgtccttgtaaaaa

SEQ ID NO: 9039137 - DNA, 22 bp, Homo sapiens
ttgaagagtgcattagcatatt

SEQ ID NO: 9039138 - DNA, 22 bp, Homo sapiens
ttgaagagtgcattagcatatt

SEQ ID NO: 9039139 - DNA, 22 bp, Homo sapiens
ttgaagagtgccttccagacat

SEQ ID NO: 9039140 - DNA, 22 bp, Homo sapiens
ttgaagagtgcattagcatatt

SEQ ID NO: 9039141 - DNA, 22 bp, Homo sapiens
ttgaagagtctttctttccccc

SEQ ID NO: 9039142 - DNA, 22 bp, Homo sapiens
ttgaagagtctttctttccccc

SEQ ID NO: 9039143 - DNA, 22 bp, Homo sapiens
ttgaagagtctagattggttat

SEQ ID NO: 9039144 - DNA, 22 bp, Homo sapiens
ttgaagagtctagattggttat

SEQ ID NO: 9039145 - DNA, 22 bp, Homo sapiens
ttgaagagtctagattggttat

SEQ ID NO: 9039146 - DNA, 22 bp, Homo sapiens
ttgaagattctttttgttagta

SEQ ID NO: 9039147 - DNA, 22 bp, Homo sapiens
ttgaagatggtagcaatttcct

SEQ ID NO: 9039148 - DNA, 22 bp, Homo sapiens
ttgaagatctttgcattgcagg

SEQ ID NO: 9039149 - DNA, 22 bp, Homo sapiens
ttgaagagttttatgccaacct

SEQ ID NO: 9039150 - DNA, 22 bp, Homo sapiens
ttgaagagtttgatagagttga

SEQ ID NO: 9039151 - DNA, 22 bp, Homo sapiens
ttgaagatctttgcattgcagg

SEQ ID NO: 9039152 - DNA, 22 bp, Homo sapiens
ttgaagaattaacagctgtgga

SEQ ID NO: 9039153 - DNA, 22 bp, Homo sapiens
ttgaagaattaggacgtgagta

SEQ ID NO: 9039154 - DNA, 19 bp, Homo sapiens
ttgaagaataaaaacacat

SEQ ID NO: 9039155 - DNA, 19 bp, Homo sapiens
ttgaagaataaaaacacat

SEQ ID NO: 9039156 - DNA, 19 bp, Homo sapiens
ttgaagaataaaaacacat

SEQ ID NO: 9039157 - DNA, 19 bp, Homo sapiens
ttgaagaataaaaacacat

SEQ ID NO: 9039158 - DNA, 22 bp, Homo sapiens
ttgaagacctttagtgctatgt

SEQ ID NO: 9039159 - DNA, 22 bp, Homo sapiens
ttgaagacaagggcaggggttc

SEQ ID NO: 9039160 - DNA, 22 bp, Homo sapiens
ttgaagactaatttagataatg

SEQ ID NO: 9039161 - DNA, 22 bp, Homo sapiens
ttgaagacctttagtgctatgt

SEQ ID NO: 9039162 - DNA, 22 bp, Homo sapiens
ttgaagagaaccgcggcttatt

SEQ ID NO: 9039163 - DNA, 22 bp, Homo sapiens
ttgaagaagtaattttaagtct

SEQ ID NO: 9039164 - DNA, 22 bp, Homo sapiens
ttgaagaagtaattttaagtct

SEQ ID NO: 9039165 - DNA, 22 bp, Homo sapiens
ttgaagaagtaattttaagtct

SEQ ID NO: 9039166 - DNA, 22 bp, Homo sapiens
ttgaagaagtaattttaagtct

SEQ ID NO: 9039167 - DNA, 22 bp, Homo sapiens
ttctttctcaacatgaatgttt

SEQ ID NO: 9039168 - DNA, 22 bp, Homo sapiens
ttctttctcaacatgaatgttt

SEQ ID NO: 9039169 - DNA, 22 bp, Homo sapiens
ttctttccttgcctcagtgaag

SEQ ID NO: 9039170 - DNA, 22 bp, Homo sapiens
ttctttccttgcctcagtgaag

SEQ ID NO: 9039171 - DNA, 22 bp, Homo sapiens
ttctttccttgcctcagtgaag

SEQ ID NO: 9039172 - DNA, 22 bp, Homo sapiens
ttctttccttgcctcagtgaag

SEQ ID NO: 9039173 - DNA, 22 bp, Homo sapiens
ttctttccttgcctcagtgaag

SEQ ID NO: 9039174 - DNA, 22 bp, Homo sapiens
ttctttcctcccagcctttgga

SEQ ID NO: 9039175 - DNA, 22 bp, Homo sapiens
ttctttcctcccagcctttgga

SEQ ID NO: 9039176 - DNA, 22 bp, Homo sapiens
ttctttcccagtagatgtgaaa

SEQ ID NO: 9039177 - DNA, 22 bp, Homo sapiens
ttctttcccagtagatgtgaaa

SEQ ID NO: 9039178 - DNA, 21 bp, Homo sapiens
ttctttccccagaggactaaa

SEQ ID NO: 9039179 - DNA, 22 bp, Homo sapiens
ttctttcccttccagcagctcc

SEQ ID NO: 9039180 - DNA, 22 bp, Homo sapiens
ttctttccccatggagttcgga

SEQ ID NO: 9039181 - DNA, 22 bp, Homo sapiens
ttctttcccttccagcagctcc

SEQ ID NO: 9039182 - DNA, 22 bp, Homo sapiens
ttctttcccttccagcagctcc

SEQ ID NO: 9039183 - DNA, 22 bp, Homo sapiens
ttctttatcagttactcatagg

SEQ ID NO: 9039184 - DNA, 22 bp, Homo sapiens
ttctttatcctatttgtaggtg

SEQ ID NO: 9039185 - DNA, 22 bp, Homo sapiens
ttctttatgcttctgtttaggc

SEQ ID NO: 9039186 - DNA, 22 bp, Homo sapiens
ttctttatgcttctgtttaggc

SEQ ID NO: 9039187 - DNA, 22 bp, Homo sapiens
ttctttatgcttctgtttaggc

SEQ ID NO: 9039188 - DNA, 22 bp, Homo sapiens
ttctttatgttaatgaatctat

SEQ ID NO: 9039189 - DNA, 22 bp, Homo sapiens
ttctttatgttaatgaatctat

SEQ ID NO: 9039190 - DNA, 22 bp, Homo sapiens
ttctttatgttaatgaatctat

SEQ ID NO: 9039191 - DNA, 22 bp, Homo sapiens
ttctttatgttaatgaatctat

SEQ ID NO: 9039192 - DNA, 22 bp, Homo sapiens
ttctttatgttaatgaatctat

SEQ ID NO: 9039193 - DNA, 22 bp, Homo sapiens
ttctttatgttaatgaatctat

SEQ ID NO: 9039194 - DNA, 22 bp, Homo sapiens
ttctttattagtttagtgagct

SEQ ID NO: 9039195 - DNA, 22 bp, Homo sapiens
ttctttattagtttagtgagct

SEQ ID NO: 9039196 - DNA, 22 bp, Homo sapiens
ttctttattgagacttcattgt

SEQ ID NO: 9039197 - DNA, 23 bp, Homo sapiens
ttctttcaagaagttcacagtgc

SEQ ID NO: 9039198 - DNA, 23 bp, Homo sapiens
ttctttcaagaagttcacagtgc

SEQ ID NO: 9039199 - DNA, 23 bp, Homo sapiens
ttctttcaagaagttcacagtgc

SEQ ID NO: 9039200 - DNA, 22 bp, Homo sapiens
ttctttattgagacttcattgt

SEQ ID NO: 9039201 - DNA, 22 bp, Homo sapiens
ttctttattgagacttcattgt

SEQ ID NO: 9039202 - DNA, 22 bp, Homo sapiens
ttctttcactcaagaaggatct

SEQ ID NO: 9039203 - DNA, 22 bp, Homo sapiens
ttctttcagaacacaagtgatt

SEQ ID NO: 9039204 - DNA, 22 bp, Homo sapiens
ttctttcagaacacaagtgatt

SEQ ID NO: 9039205 - DNA, 23 bp, Homo sapiens
ttctttcaagaagttcacagtgc

SEQ ID NO: 9039206 - DNA, 22 bp, Homo sapiens
ttctttcaatagctggcatatg

SEQ ID NO: 9039207 - DNA, 22 bp, Homo sapiens
ttctttcaatagctggcatatg

SEQ ID NO: 9039208 - DNA, 22 bp, Homo sapiens
ttctttcaatagctggcatatg

SEQ ID NO: 9039209 - DNA, 22 bp, Homo sapiens
ttctttcaatagctggcatatg

SEQ ID NO: 9039210 - DNA, 20 bp, Homo sapiens
ttctttcatctacacgttgt

SEQ ID NO: 9039211 - DNA, 19 bp, Homo sapiens
ttctttccacatcttctct

SEQ ID NO: 9039212 - DNA, 19 bp, Homo sapiens
ttctttccacatcttctct

SEQ ID NO: 9039213 - DNA, 19 bp, Homo sapiens
ttctttccacatcttctct

SEQ ID NO: 9039214 - DNA, 19 bp, Homo sapiens
ttctttccacatcttctct

SEQ ID NO: 9039215 - DNA, 22 bp, Homo sapiens
ttgcaaatattgtttacctttc

SEQ ID NO: 9039216 - DNA, 22 bp, Homo sapiens
ttgcaaatcacaagagcagagc

SEQ ID NO: 9039217 - DNA, 22 bp, Homo sapiens
ttgcaaatcagaagtatagatt

SEQ ID NO: 9039218 - DNA, 22 bp, Homo sapiens
ttgcaaatcagaagtatagatt

SEQ ID NO: 9039219 - DNA, 22 bp, Homo sapiens
ttgcaaatcagaagtatagatt

SEQ ID NO: 9039220 - DNA, 22 bp, Homo sapiens
ttgcaaatattgtttacctttc

SEQ ID NO: 9039221 - DNA, 22 bp, Homo sapiens
ttgcaaatattgtttacctttc

SEQ ID NO: 9039222 - DNA, 22 bp, Homo sapiens
ttgcaaatgaccattgccacat

SEQ ID NO: 9039223 - DNA, 22 bp, Homo sapiens
ttgcaaatctttgccagaaggc

SEQ ID NO: 9039224 - DNA, 22 bp, Homo sapiens
ttgcaaatctcttgtgtttggt

SEQ ID NO: 9039225 - DNA, 22 bp, Homo sapiens
ttgcaaatctttgccagaaggc

SEQ ID NO: 9039226 - DNA, 22 bp, Homo sapiens
ttgcaaatcagaagtatagatt

SEQ ID NO: 9039227 - DNA, 22 bp, Homo sapiens
ttgcaaatctcttgtgtttggt

SEQ ID NO: 9039228 - DNA, 22 bp, Homo sapiens
ttgcaaataaacaagtatacat

SEQ ID NO: 9039229 - DNA, 22 bp, Homo sapiens
ttgcaaataaacaagtatacat

SEQ ID NO: 9039230 - DNA, 22 bp, Homo sapiens
ttgcaaataaacaagtatacat

SEQ ID NO: 9039231 - DNA, 22 bp, Homo sapiens
ttgcaaataaacaagtatacat

SEQ ID NO: 9039232 - DNA, 22 bp, Homo sapiens
ttgcaaataatagcctgaaact

SEQ ID NO: 9039233 - DNA, 20 bp, Homo sapiens
ttgcaaatatcgtgggtcag

SEQ ID NO: 9039234 - DNA, 20 bp, Homo sapiens
ttgcaaatatcgtgggtcag

SEQ ID NO: 9039235 - DNA, 20 bp, Homo sapiens
ttgcaaatatctattgattg

SEQ ID NO: 9039236 - DNA, 22 bp, Homo sapiens
ttgcaaatatgttctcctattc

SEQ ID NO: 9039237 - DNA, 22 bp, Homo sapiens
ttgcaaatatgttctcctattc

SEQ ID NO: 9039238 - DNA, 22 bp, Homo sapiens
ttgcaaatattcccctaggtct

SEQ ID NO: 9039239 - DNA, 22 bp, Homo sapiens
ttgcaaatatgttctcctattc

SEQ ID NO: 9039240 - DNA, 22 bp, Homo sapiens
ttgcaaatgtttcataacagta

SEQ ID NO: 9039241 - DNA, 22 bp, Homo sapiens
ttgcaaatgtttcataacagta

SEQ ID NO: 9039242 - DNA, 22 bp, Homo sapiens
ttgcaaatgtttcataacagta

SEQ ID NO: 9039243 - DNA, 22 bp, Homo sapiens
ttgcaaattaaagaggatagca

SEQ ID NO: 9039244 - DNA, 22 bp, Homo sapiens
ttgcaaatgttatactgccagt

SEQ ID NO: 9039245 - DNA, 22 bp, Homo sapiens
ttgcaaatgttatactgccagt

SEQ ID NO: 9039246 - DNA, 22 bp, Homo sapiens
ttgcaaatgtggttagggcttt

SEQ ID NO: 9039247 - DNA, 22 bp, Homo sapiens
ttgcaaatggtaccaagggtct

SEQ ID NO: 9039248 - DNA, 22 bp, Homo sapiens
ttgcaaatgtgaataattacac

SEQ ID NO: 9039249 - DNA, 22 bp, Homo sapiens
ttgcaaatgtgaataattacac

SEQ ID NO: 9039250 - DNA, 22 bp, Homo sapiens
ttgcaaatgtgagtttagactg

SEQ ID NO: 9039251 - DNA, 22 bp, Homo sapiens
ttgcaaatgtgagtttagactg

SEQ ID NO: 9039252 - DNA, 22 bp, Homo sapiens
ttgcaaatgtgagtttagactg

SEQ ID NO: 9039253 - DNA, 22 bp, Homo sapiens
ttgcaaatgtgaataattacac

SEQ ID NO: 9039254 - DNA, 22 bp, Homo sapiens
ttgcaaatgggcaaagcagatc

SEQ ID NO: 9039255 - DNA, 22 bp, Homo sapiens
ttgcaaatgaccattgccacat

SEQ ID NO: 9039256 - DNA, 22 bp, Homo sapiens
ttgcaaatggaggcctggcagc

SEQ ID NO: 9039257 - DNA, 22 bp, Homo sapiens
ttgcaaatggaggcctggcagc

SEQ ID NO: 9039258 - DNA, 22 bp, Homo sapiens
ttgcaaatgaccattgccacat

SEQ ID NO: 9039259 - DNA, 22 bp, Homo sapiens
ttgcaaagttccctacacatgt

SEQ ID NO: 9039260 - DNA, 22 bp, Homo sapiens
ttgcaaagttccctacacatgt

SEQ ID NO: 9039261 - DNA, 22 bp, Homo sapiens
ttgcaaagttccctacacatgt

SEQ ID NO: 9039262 - DNA, 20 bp, Homo sapiens
ttgcaaagtgaatagcaatt

SEQ ID NO: 9039263 - DNA, 20 bp, Homo sapiens
ttgcaaagtgaatagcaatt

SEQ ID NO: 9039264 - DNA, 22 bp, Homo sapiens
ttgcaaaggggaataaagcaat

SEQ ID NO: 9039265 - DNA, 22 bp, Homo sapiens
ttgcaaaggggaataaagcaat

SEQ ID NO: 9039266 - DNA, 22 bp, Homo sapiens
ttgcaaaggggaataaagcaat

SEQ ID NO: 9039267 - DNA, 22 bp, Homo sapiens
ttgcaaagactggcttaacagt

SEQ ID NO: 9039268 - DNA, 22 bp, Homo sapiens
ttgcaaagactggcttaacagt

SEQ ID NO: 9039269 - DNA, 22 bp, Homo sapiens
ttgcaaagaattttacattcta

SEQ ID NO: 9039270 - DNA, 22 bp, Homo sapiens
ttgcaaagagtcatgtaagtca

SEQ ID NO: 9039271 - DNA, 22 bp, Homo sapiens
ttgattttaaaatagtgacact

SEQ ID NO: 9039272 - DNA, 22 bp, Homo sapiens
ttgattttaaaatagtgacact

SEQ ID NO: 9039273 - DNA, 21 bp, Homo sapiens
ttgattttaggaagtttgtca

SEQ ID NO: 9039274 - DNA, 21 bp, Homo sapiens
ttgattttaggaagtttgtca

SEQ ID NO: 9039275 - DNA, 21 bp, Homo sapiens
ttgattttaggaagtttgtca

SEQ ID NO: 9039276 - DNA, 22 bp, Homo sapiens
ttgattttcaattcattgacaa

SEQ ID NO: 9039277 - DNA, 22 bp, Homo sapiens
ttgattttcaattcattgacaa

SEQ ID NO: 9039278 - DNA, 22 bp, Homo sapiens
ttgattttcaattcattgacaa

SEQ ID NO: 9039279 - DNA, 22 bp, Homo sapiens
ttgattttcaattcattgacaa

SEQ ID NO: 9039280 - DNA, 22 bp, Homo sapiens
ttgatttttccagcttctagag

SEQ ID NO: 9039281 - DNA, 22 bp, Homo sapiens
ttgattttgcctgatctgagag

SEQ ID NO: 9039282 - DNA, 22 bp, Homo sapiens
ttgattttgcctgatctgagag

SEQ ID NO: 9039283 - DNA, 22 bp, Homo sapiens
ttgatttcttactcttccaagg

SEQ ID NO: 9039284 - DNA, 22 bp, Homo sapiens
ttgatttcttgaggcattggag

SEQ ID NO: 9039285 - DNA, 22 bp, Homo sapiens
ttgattttaaaatagtgacact

SEQ ID NO: 9039286 - DNA, 22 bp, Homo sapiens
ttgatttgtattgcaggcccct

SEQ ID NO: 9039287 - DNA, 22 bp, Homo sapiens
ttgatttgggaatggtctggca

SEQ ID NO: 9039288 - DNA, 22 bp, Homo sapiens
ttgatttgtaggaatggagacc

SEQ ID NO: 9039289 - DNA, 22 bp, Homo sapiens
ttgatttgggaatggtctggca

SEQ ID NO: 9039290 - DNA, 22 bp, Homo sapiens
ttgatttgcagaaggtgtagag

SEQ ID NO: 9039291 - DNA, 22 bp, Homo sapiens
ttgatttgcagaaggtgtagag

SEQ ID NO: 9039292 - DNA, 22 bp, Homo sapiens
ttgatttgattgtaatggctct

SEQ ID NO: 9039293 - DNA, 22 bp, Homo sapiens
ttgatttgattgatgaactaag

SEQ ID NO: 9039294 - DNA, 22 bp, Homo sapiens
ttgatttatagaatgttcaagc

SEQ ID NO: 9039295 - DNA, 22 bp, Homo sapiens
ttgatttatagaatgttcaagc

SEQ ID NO: 9039296 - DNA, 23 bp, Homo sapiens
ttgatttcaaatgcagagaacac

SEQ ID NO: 9039297 - DNA, 23 bp, Homo sapiens
ttgatttagctgggattgcatgc

SEQ ID NO: 9039298 - DNA, 23 bp, Homo sapiens
ttgatttagctgggattgcatgc

SEQ ID NO: 9039299 - DNA, 22 bp, Homo sapiens
ttgatttatagaatgttcaagc

SEQ ID NO: 9039300 - DNA, 22 bp, Homo sapiens
ttgatttatagaatgttcaagc

SEQ ID NO: 9039301 - DNA, 23 bp, Homo sapiens
ttgatttagctgggattgcatgc

SEQ ID NO: 9039302 - DNA, 22 bp, Homo sapiens
ttgattgaattttgaaaatcta

SEQ ID NO: 9039303 - DNA, 21 bp, Homo sapiens
ttgatttagcagatctagctg

SEQ ID NO: 9039304 - DNA, 22 bp, Homo sapiens
ttgattggcagatggcttgaca

SEQ ID NO: 9039305 - DNA, 22 bp, Homo sapiens
ttgatgcactatgtaacttaca

SEQ ID NO: 9039306 - DNA, 22 bp, Homo sapiens
ttgatggaatattttttgaggt

SEQ ID NO: 9039307 - DNA, 22 bp, Homo sapiens
ttgatggaaaatttcatggtga

SEQ ID NO: 9039308 - DNA, 22 bp, Homo sapiens
ttgatggaaaatttcatggtga

SEQ ID NO: 9039309 - DNA, 22 bp, Homo sapiens
ttgatgcttaaggtaaaacaga

SEQ ID NO: 9039310 - DNA, 22 bp, Homo sapiens
ttgatgagaccattgccgcgtc

SEQ ID NO: 9039311 - DNA, 22 bp, Homo sapiens
ttgatgagttatccatttgact

SEQ ID NO: 9039312 - DNA, 22 bp, Homo sapiens
ttgatgtaaactttgatttcat

SEQ ID NO: 9039313 - DNA, 22 bp, Homo sapiens
ttgatgtaaaagccttggtggc

SEQ ID NO: 9039314 - DNA, 22 bp, Homo sapiens
ttgatggacagggaccactgtc

SEQ ID NO: 9039315 - DNA, 16 bp, Homo sapiens
ttgatggagttgggtt

SEQ ID NO: 9039316 - DNA, 22 bp, Homo sapiens
ttgatgtaaagtgattcatggg

SEQ ID NO: 9039317 - DNA, 22 bp, Homo sapiens
ttgatgtaaagtgattcatggg

SEQ ID NO: 9039318 - DNA, 22 bp, Homo sapiens
ttgatgtaatactttgcaacca

SEQ ID NO: 9039319 - DNA, 22 bp, Homo sapiens
ttgatgagaccattgccgcgtc

SEQ ID NO: 9039320 - DNA, 22 bp, Homo sapiens
ttgatcttacagtgttcttcca

SEQ ID NO: 9039321 - DNA, 22 bp, Homo sapiens
ttgatcttggactttccagcct

SEQ ID NO: 9039322 - DNA, 22 bp, Homo sapiens
ttgatcttggactttccagcct

SEQ ID NO: 9039323 - DNA, 22 bp, Homo sapiens
ttgatctttataatagttttga

SEQ ID NO: 9039324 - DNA, 22 bp, Homo sapiens
ttgatctttataatagttttga

SEQ ID NO: 9039325 - DNA, 22 bp, Homo sapiens
ttgatctttataatagttttga

SEQ ID NO: 9039326 - DNA, 22 bp, Homo sapiens
ttgatctctgttgctgtctttg

SEQ ID NO: 9039327 - DNA, 22 bp, Homo sapiens
ttgatcttacagtgttcttcca

SEQ ID NO: 9039328 - DNA, 22 bp, Homo sapiens
ttgatctgcctcattcttgttc

SEQ ID NO: 9039329 - DNA, 22 bp, Homo sapiens
ttgatcttcatcgaaatattgt

SEQ ID NO: 9039330 - DNA, 22 bp, Homo sapiens
ttgatcttcatcgaaatattgt

SEQ ID NO: 9039331 - DNA, 22 bp, Homo sapiens
ttgaggccaaaaagtcctatga

SEQ ID NO: 9039332 - DNA, 22 bp, Homo sapiens
ttgaggccccatggatgagaac

SEQ ID NO: 9039333 - DNA, 22 bp, Homo sapiens
ttgaggccaaaaagtcctatga

SEQ ID NO: 9039334 - DNA, 22 bp, Homo sapiens
ttgatctctgttgctgtctttg

SEQ ID NO: 9039335 - DNA, 22 bp, Homo sapiens
ttgatcaagtgggaaatagtaa

SEQ ID NO: 9039336 - DNA, 22 bp, Homo sapiens
ttgatcaagtgggaaatagtaa

SEQ ID NO: 9039337 - DNA, 22 bp, Homo sapiens
ttgagtgtaaggaatgtggggc

SEQ ID NO: 9039338 - DNA, 22 bp, Homo sapiens
ttgagtgagaattacatcagct

SEQ ID NO: 9039339 - DNA, 22 bp, Homo sapiens
ttgagtctgtgccctatgctgt

SEQ ID NO: 9039340 - DNA, 22 bp, Homo sapiens
ttgattctgatcctttgctagc

SEQ ID NO: 9039341 - DNA, 22 bp, Homo sapiens
ttgattctgatcctttgctagc

SEQ ID NO: 9039342 - DNA, 22 bp, Homo sapiens
ttgattctgatcctgtctggag

SEQ ID NO: 9039343 - DNA, 22 bp, Homo sapiens
ttgattctatgttgttgtctca

SEQ ID NO: 9039344 - DNA, 22 bp, Homo sapiens
ttgattctgggctcatttcttt

SEQ ID NO: 9039345 - DNA, 22 bp, Homo sapiens
ttgattctgctgatctcggacg

SEQ ID NO: 9039346 - DNA, 22 bp, Homo sapiens
ttgattcttctgaatttgcaga

SEQ ID NO: 9039347 - DNA, 22 bp, Homo sapiens
ttgattctggtgactgatggaa

SEQ ID NO: 9039348 - DNA, 22 bp, Homo sapiens
ttgattaaaatgagacatcatt

SEQ ID NO: 9039349 - DNA, 22 bp, Homo sapiens
ttgatgtttccccttggacatt

SEQ ID NO: 9039350 - DNA, 22 bp, Homo sapiens
ttgattaaaatgagacatcatt

SEQ ID NO: 9039351 - DNA, 22 bp, Homo sapiens
ttgattaaaatgagacatcatt

SEQ ID NO: 9039352 - DNA, 22 bp, Homo sapiens
ttgatgttcataaatgatacag

SEQ ID NO: 9039353 - DNA, 22 bp, Homo sapiens
ttgatgttcataaatgatacag

SEQ ID NO: 9039354 - DNA, 22 bp, Homo sapiens
ttgatgttcataaatgatacag

SEQ ID NO: 9039355 - DNA, 22 bp, Homo sapiens
ttgatgtcagtattatgagttt

SEQ ID NO: 9039356 - DNA, 22 bp, Homo sapiens
ttgatgtacagaattgttcaca

SEQ ID NO: 9039357 - DNA, 22 bp, Homo sapiens
ttgatgtacagaattgttcaca

SEQ ID NO: 9039358 - DNA, 22 bp, Homo sapiens
ttgatgtagcctaagacagaac

SEQ ID NO: 9039359 - DNA, 22 bp, Homo sapiens
ttgatgtaggtttatctattgt

SEQ ID NO: 9039360 - DNA, 22 bp, Homo sapiens
ttgatgtagcctaagacagaac

SEQ ID NO: 9039361 - DNA, 22 bp, Homo sapiens
ttgatgtagggattcctgtaaa

SEQ ID NO: 9039362 - DNA, 22 bp, Homo sapiens
ttgattaaaatgagacatcatt

SEQ ID NO: 9039363 - DNA, 22 bp, Homo sapiens
ttgattaaacaggcatattcaa

SEQ ID NO: 9039364 - DNA, 22 bp, Homo sapiens
ttgattaaacaggcatattcaa

SEQ ID NO: 9039365 - DNA, 22 bp, Homo sapiens
ttgattactatgtgttgaaagc

SEQ ID NO: 9039366 - DNA, 22 bp, Homo sapiens
ttgattaatcccatgtgagtag

SEQ ID NO: 9039367 - DNA, 22 bp, Homo sapiens
ttgattaatcccatgtgagtag

SEQ ID NO: 9039368 - DNA, 22 bp, Homo sapiens
ttgattaatcccatgtgagtag

SEQ ID NO: 9039369 - DNA, 22 bp, Homo sapiens
ttgattatagactcactaatct

SEQ ID NO: 9039370 - DNA, 22 bp, Homo sapiens
ttgattatagaatcttggcttt

SEQ ID NO: 9039371 - DNA, 22 bp, Homo sapiens
ttgattactatgtgttgaaagc

SEQ ID NO: 9039372 - DNA, 23 bp, Homo sapiens
tgtgtctgtttagggaggatgtg

SEQ ID NO: 9039373 - DNA, 22 bp, Homo sapiens
tgtgtctgttttgctcaccatt

SEQ ID NO: 9039374 - DNA, 22 bp, Homo sapiens
tgtgtcctttggaggatcagcg

SEQ ID NO: 9039375 - DNA, 22 bp, Homo sapiens
tgtgtctaaatggttccttaat

SEQ ID NO: 9039376 - DNA, 22 bp, Homo sapiens
tgtgtcgcaccctacacccagg

SEQ ID NO: 9039377 - DNA, 22 bp, Homo sapiens
tgtgtcctttctaatgcccaga

SEQ ID NO: 9039378 - DNA, 22 bp, Homo sapiens
tgtgtccttctgggagtcccag

SEQ ID NO: 9039379 - DNA, 22 bp, Homo sapiens
tgtgtcctcatgtggcagagag

SEQ ID NO: 9039380 - DNA, 22 bp, Homo sapiens
tgtgtcctgcaggtgctgcctg

SEQ ID NO: 9039381 - DNA, 22 bp, Homo sapiens
tgtgtcctgtccccttgctgct

SEQ ID NO: 9039382 - DNA, 22 bp, Homo sapiens
tgtgtcctcatgtggcagagag

SEQ ID NO: 9039383 - DNA, 22 bp, Homo sapiens
tgtgtcctgcagacagactcag

SEQ ID NO: 9039384 - DNA, 22 bp, Homo sapiens
tgtgtccatctgacaggagagg

SEQ ID NO: 9039385 - DNA, 22 bp, Homo sapiens
tgtgtccatctgacaggagagg

SEQ ID NO: 9039386 - DNA, 20 bp, Homo sapiens
tgtgtccatcatctgggcac

SEQ ID NO: 9039387 - DNA, 22 bp, Homo sapiens
tgtgtccatctgacaggagagg

SEQ ID NO: 9039388 - DNA, 22 bp, Homo sapiens
tgtgtccatctgacaggagagg

SEQ ID NO: 9039389 - DNA, 22 bp, Homo sapiens
tgtgtccacgcactggcatgat

SEQ ID NO: 9039390 - DNA, 22 bp, Homo sapiens
tgtgtccactgaatgtgtatta

SEQ ID NO: 9039391 - DNA, 22 bp, Homo sapiens
tgtgtccaacccagggacaagt

SEQ ID NO: 9039392 - DNA, 22 bp, Homo sapiens
tgtgtcatctgtgttacataat

SEQ ID NO: 9039393 - DNA, 22 bp, Homo sapiens
tgtgtcatattagtattgagag

SEQ ID NO: 9039394 - DNA, 22 bp, Homo sapiens
tgtgtcatctgtgttacataat

SEQ ID NO: 9039395 - DNA, 22 bp, Homo sapiens
tgtgtcaggccttatcggtggc

SEQ ID NO: 9039396 - DNA, 21 bp, Homo sapiens
tgtgtcagtctttggaagcaa

SEQ ID NO: 9039397 - DNA, 22 bp, Homo sapiens
tgtgtccattcaggcactgacc

SEQ ID NO: 9039398 - DNA, 22 bp, Homo sapiens
tgtgtcccttggaacctcagct

SEQ ID NO: 9039399 - DNA, 22 bp, Homo sapiens
tgtgtccattcaggcactgacc

SEQ ID NO: 9039400 - DNA, 22 bp, Homo sapiens
tgtgtccatctgacaggagagg

SEQ ID NO: 9039401 - DNA, 22 bp, Homo sapiens
tgtgtccattcaggcactgacc

SEQ ID NO: 9039402 - DNA, 22 bp, Homo sapiens
tgtgtcccttggaacctcagct

SEQ ID NO: 9039403 - DNA, 22 bp, Homo sapiens
tgtgtcctcagggaagcagaga

SEQ ID NO: 9039404 - DNA, 19 bp, Homo sapiens
tgtgtcctagcagccagtc

SEQ ID NO: 9039405 - DNA, 22 bp, Homo sapiens
tgtgtgaattctgagcagttta

SEQ ID NO: 9039406 - DNA, 22 bp, Homo sapiens
tgtgtgacacattgatatgtgc

SEQ ID NO: 9039407 - DNA, 22 bp, Homo sapiens
tgtgtgacacattgatatgtgc

SEQ ID NO: 9039408 - DNA, 22 bp, Homo sapiens
tgtgtgacccccagtgaagcct

SEQ ID NO: 9039409 - DNA, 22 bp, Homo sapiens
tgtgtgacctggggtgagatag

SEQ ID NO: 9039410 - DNA, 22 bp, Homo sapiens
tgtgtgaggtggttctgagaag

SEQ ID NO: 9039411 - DNA, 22 bp, Homo sapiens
tgtgtgagacaattggctgtgg

SEQ ID NO: 9039412 - DNA, 22 bp, Homo sapiens
tgtgtgacctggggtgagatag

SEQ ID NO: 9039413 - DNA, 22 bp, Homo sapiens
tgtgtgcaagtgacattagaaa

SEQ ID NO: 9039414 - DNA, 22 bp, Homo sapiens
tgtgtgcaagtgacattagaaa

SEQ ID NO: 9039415 - DNA, 22 bp, Homo sapiens
tgtgtgcaagtgacattagaaa

SEQ ID NO: 9039416 - DNA, 19 bp, Homo sapiens
tgtgtgcaaatggaagcca

SEQ ID NO: 9039417 - DNA, 22 bp, Homo sapiens
tgtgtgattgcaggagatgtgg

SEQ ID NO: 9039418 - DNA, 22 bp, Homo sapiens
tgtgtgattgcaggagatgtgg

SEQ ID NO: 9039419 - DNA, 22 bp, Homo sapiens
tgtgtgagtaaggctgagagag

SEQ ID NO: 9039420 - DNA, 22 bp, Homo sapiens
tgtgtgattccacttatatggg

SEQ ID NO: 9039421 - DNA, 22 bp, Homo sapiens
tgtgtgattgcacttatatgag

SEQ ID NO: 9039422 - DNA, 22 bp, Homo sapiens
tgtgtgaggtggttctgagaag

SEQ ID NO: 9039423 - DNA, 22 bp, Homo sapiens
tgtgtgaactctctgatgtaca

SEQ ID NO: 9039424 - DNA, 22 bp, Homo sapiens
tgtgtgaagcacatgttcaagg

SEQ ID NO: 9039425 - DNA, 22 bp, Homo sapiens
tgtgtgaaggagccactgttca

SEQ ID NO: 9039426 - DNA, 22 bp, Homo sapiens
tgtgtgaaggagccactgttca

SEQ ID NO: 9039427 - DNA, 20 bp, Homo sapiens
tgtgtgaacacggactctgt

SEQ ID NO: 9039428 - DNA, 22 bp, Homo sapiens
tgtgtctttggcgatgtctgga

SEQ ID NO: 9039429 - DNA, 22 bp, Homo sapiens
tgtgtctgttttgctcaccatt

SEQ ID NO: 9039430 - DNA, 22 bp, Homo sapiens
tgtgtcttaagttccaagacat

SEQ ID NO: 9039431 - DNA, 22 bp, Homo sapiens
tgtgtcttacataattacatgt

SEQ ID NO: 9039432 - DNA, 22 bp, Homo sapiens
tgtggcctcaaggctgccctca

SEQ ID NO: 9039433 - DNA, 22 bp, Homo sapiens
tgtggcctccccacttctgggg

SEQ ID NO: 9039434 - DNA, 22 bp, Homo sapiens
tgtggcctctaagctcacgaag

SEQ ID NO: 9039435 - DNA, 20 bp, Homo sapiens
tgtggcctctagagacagcc

SEQ ID NO: 9039436 - DNA, 22 bp, Homo sapiens
tgtggcctctaagctcacgaag

SEQ ID NO: 9039437 - DNA, 20 bp, Homo sapiens
tgtggcctctagagacagcc

SEQ ID NO: 9039438 - DNA, 22 bp, Homo sapiens
tgtggcctgattttgcatctct

SEQ ID NO: 9039439 - DNA, 22 bp, Homo sapiens
tgtggcctcctgttcctgggta

SEQ ID NO: 9039440 - DNA, 22 bp, Homo sapiens
tgtggcctggaaggggctgctc

SEQ ID NO: 9039441 - DNA, 22 bp, Homo sapiens
tgtggcctgattttgcatctct

SEQ ID NO: 9039442 - DNA, 17 bp, Homo sapiens
tgtggccttctgagctt

SEQ ID NO: 9039443 - DNA, 22 bp, Homo sapiens
tgtggggactttcaaagccaat

SEQ ID NO: 9039444 - DNA, 19 bp, Homo sapiens
tgtggcctggggacaggcc

SEQ ID NO: 9039445 - DNA, 17 bp, Homo sapiens
tgtggccttctgagctt

SEQ ID NO: 9039446 - DNA, 19 bp, Homo sapiens
tgtggcctggggacaggcc

SEQ ID NO: 9039447 - DNA, 19 bp, Homo sapiens
tgtggggagtcagggggct

SEQ ID NO: 9039448 - DNA, 19 bp, Homo sapiens
tgtggggagtcagggggct

SEQ ID NO: 9039449 - DNA, 19 bp, Homo sapiens
tgtggggagtcagggggct

SEQ ID NO: 9039450 - DNA, 19 bp, Homo sapiens
tgtggggagtcagggggct

SEQ ID NO: 9039451 - DNA, 22 bp, Homo sapiens
tgtggggaggctgcagtgctgc

SEQ ID NO: 9039452 - DNA, 22 bp, Homo sapiens
tgtggggaggctgcagtgctgc

SEQ ID NO: 9039453 - DNA, 22 bp, Homo sapiens
tgtggtcctggggagacatgaa

SEQ ID NO: 9039454 - DNA, 22 bp, Homo sapiens
tgtggtcctctcaactgaaggt

SEQ ID NO: 9039455 - DNA, 22 bp, Homo sapiens
tgtggtcccaaggcaactggaa

SEQ ID NO: 9039456 - DNA, 22 bp, Homo sapiens
tgtggtctccccagtgccagct

SEQ ID NO: 9039457 - DNA, 22 bp, Homo sapiens
tgtggtctcctgtcttggcctt

SEQ ID NO: 9039458 - DNA, 22 bp, Homo sapiens
tgtggtctcgttatgttgccca

SEQ ID NO: 9039459 - DNA, 19 bp, Homo sapiens
tgtggtctctgttctcagg

SEQ ID NO: 9039460 - DNA, 18 bp, Homo sapiens
tgtggtggagctgccttc

SEQ ID NO: 9039461 - DNA, 18 bp, Homo sapiens
tgtggtggagctgccttc

SEQ ID NO: 9039462 - DNA, 22 bp, Homo sapiens
tgtggtgccgagagtctggacg

SEQ ID NO: 9039463 - DNA, 21 bp, Homo sapiens
tgtggtcttttagttccatca

SEQ ID NO: 9039464 - DNA, 21 bp, Homo sapiens
tgtggtcttttagttccatca

SEQ ID NO: 9039465 - DNA, 22 bp, Homo sapiens
tgtggtcttggaagaagttgct

SEQ ID NO: 9039466 - DNA, 22 bp, Homo sapiens
tgtggtgccgagagtctggacg

SEQ ID NO: 9039467 - DNA, 22 bp, Homo sapiens
tgtgggtgttctcacttagata

SEQ ID NO: 9039468 - DNA, 22 bp, Homo sapiens
tgtggtcagctactggtcatct

SEQ ID NO: 9039469 - DNA, 22 bp, Homo sapiens
tgtggtagagggcagatgggca

SEQ ID NO: 9039470 - DNA, 22 bp, Homo sapiens
tgtggtagagggcagatgggca

SEQ ID NO: 9039471 - DNA, 22 bp, Homo sapiens
tgtgggtggagtgatattagct

SEQ ID NO: 9039472 - DNA, 19 bp, Homo sapiens
tgtggggagtcagggggct

SEQ ID NO: 9039473 - DNA, 22 bp, Homo sapiens
tgtgggtgctcagagtaccccc

SEQ ID NO: 9039474 - DNA, 19 bp, Homo sapiens
tgtggggagtcagggggct

SEQ ID NO: 9039475 - DNA, 22 bp, Homo sapiens
tgtgggtggcatcgtcctggcc

SEQ ID NO: 9039476 - DNA, 22 bp, Homo sapiens
tgtgggtggcatcgtcctggcc

SEQ ID NO: 9039477 - DNA, 22 bp, Homo sapiens
tgtgggtggcatcgtcctggcc

SEQ ID NO: 9039478 - DNA, 22 bp, Homo sapiens
tgtgggtggtaaaatacaatga

SEQ ID NO: 9039479 - DNA, 22 bp, Homo sapiens
tgtggtggctattctggtctca

SEQ ID NO: 9039480 - DNA, 18 bp, Homo sapiens
tgtggtggagctgccttc

SEQ ID NO: 9039481 - DNA, 22 bp, Homo sapiens
tgtggtggtaatgagccagatg

SEQ ID NO: 9039482 - DNA, 22 bp, Homo sapiens
tgtggtggtaatgagccagatg

SEQ ID NO: 9039483 - DNA, 22 bp, Homo sapiens
tgtggtttttcagttgctggag

SEQ ID NO: 9039484 - DNA, 19 bp, Homo sapiens
tgtggtttcccggcggcct

SEQ ID NO: 9039485 - DNA, 22 bp, Homo sapiens
tgtggtttactgtggcgctgct

SEQ ID NO: 9039486 - DNA, 22 bp, Homo sapiens
tgtgtaaagcttgttccagaaa

SEQ ID NO: 9039487 - DNA, 21 bp, Homo sapiens
tgtgtaaagttgaaatcctgt

SEQ ID NO: 9039488 - DNA, 21 bp, Homo sapiens
tgtgtaaagttgaaatcctgt

SEQ ID NO: 9039489 - DNA, 22 bp, Homo sapiens
tgtgtaaaatgagcctaaagtc

SEQ ID NO: 9039490 - DNA, 22 bp, Homo sapiens
tgtgtaaaatctgattaatact

SEQ ID NO: 9039491 - DNA, 22 bp, Homo sapiens
tgtgtaaagcttgttccagaaa

SEQ ID NO: 9039492 - DNA, 22 bp, Homo sapiens
tgtgtaaagcttgttccagaaa

SEQ ID NO: 9039493 - DNA, 22 bp, Homo sapiens
tgtgtaaaatctgattaatact

SEQ ID NO: 9039494 - DNA, 22 bp, Homo sapiens
tgtgtaaaatctgattaatact

SEQ ID NO: 9039495 - DNA, 22 bp, Homo sapiens
tgtgtaaaatctgattaatact

SEQ ID NO: 9039496 - DNA, 22 bp, Homo sapiens
tgtgtaaaagattagtttacta

SEQ ID NO: 9039497 - DNA, 22 bp, Homo sapiens
tgtggttttggttcagaaacaa

SEQ ID NO: 9039498 - DNA, 20 bp, Homo sapiens
tgtggtttttgccagttgaa

SEQ ID NO: 9039499 - DNA, 22 bp, Homo sapiens
tgtgtcagatttaggctcaaac

SEQ ID NO: 9039500 - DNA, 19 bp, Homo sapiens
tgtgtcagatttgctcctt

SEQ ID NO: 9039501 - DNA, 22 bp, Homo sapiens
tgtgtcagcacagtatcaatta

SEQ ID NO: 9039502 - DNA, 22 bp, Homo sapiens
tgtgtacaaactaacaacatat

SEQ ID NO: 9039503 - DNA, 22 bp, Homo sapiens
tgtgtacaaactaacaacatat

SEQ ID NO: 9039504 - DNA, 22 bp, Homo sapiens
tgtgtacaaactaacaacatat

SEQ ID NO: 9039505 - DNA, 22 bp, Homo sapiens
tgtgtacaaactaacaacatat

SEQ ID NO: 9039506 - DNA, 19 bp, Homo sapiens
tgtgtcagcagggggcttc

SEQ ID NO: 9039507 - DNA, 22 bp, Homo sapiens
tgtgtcagcacagtatcaatta

SEQ ID NO: 9039508 - DNA, 22 bp, Homo sapiens
tgtgtcagcaggggagggaact

SEQ ID NO: 9039509 - DNA, 22 bp, Homo sapiens
tgtgtcagcaggggagggaact

SEQ ID NO: 9039510 - DNA, 20 bp, Homo sapiens
tgtgtcaggccctgattaaa

SEQ ID NO: 9039511 - DNA, 22 bp, Homo sapiens
tgtgtcaggagatagcaaaggg

SEQ ID NO: 9039512 - DNA, 22 bp, Homo sapiens
tgtgtaaatggactgtgaatta

SEQ ID NO: 9039513 - DNA, 22 bp, Homo sapiens
tgtgtaaatggactgtgaatta

SEQ ID NO: 9039514 - DNA, 22 bp, Homo sapiens
tgtgtaaatggactgtgaatta

SEQ ID NO: 9039515 - DNA, 22 bp, Homo sapiens
tgtgtaaatggcatctctcagc

SEQ ID NO: 9039516 - DNA, 22 bp, Homo sapiens
tgtgtaaatggcatctctcagc

SEQ ID NO: 9039517 - DNA, 22 bp, Homo sapiens
tgtgtaaatttatttacataaa

SEQ ID NO: 9039518 - DNA, 22 bp, Homo sapiens
tgtgtaaatggcatctctcagc

SEQ ID NO: 9039519 - DNA, 22 bp, Homo sapiens
tgtgtaacaatctacacttagg

SEQ ID NO: 9039520 - DNA, 22 bp, Homo sapiens
tgtgtaaatttatttacataaa

SEQ ID NO: 9039521 - DNA, 22 bp, Homo sapiens
tgtggcagaaggctaaggtgtc

SEQ ID NO: 9039522 - DNA, 22 bp, Homo sapiens
tgtggcagaactgggactcaaa

SEQ ID NO: 9039523 - DNA, 21 bp, Homo sapiens
tgtggcagagacaatgctagt

SEQ ID NO: 9039524 - DNA, 21 bp, Homo sapiens
tgtggcagagacaatgctagt

SEQ ID NO: 9039525 - DNA, 22 bp, Homo sapiens
tgtggcagagagagcttccttg

SEQ ID NO: 9039526 - DNA, 22 bp, Homo sapiens
tgtggcagagtaaggacccagt

SEQ ID NO: 9039527 - DNA, 22 bp, Homo sapiens
tgtggcagaggaggcagcgtcc

SEQ ID NO: 9039528 - DNA, 22 bp, Homo sapiens
tgtggcagctgctgcaggagct

SEQ ID NO: 9039529 - DNA, 21 bp, Homo sapiens
tgtggcagatgttgggaggca

SEQ ID NO: 9039530 - DNA, 21 bp, Homo sapiens
tgtggcagatgttgggaggca

SEQ ID NO: 9039531 - DNA, 21 bp, Homo sapiens
tgtggcagatgttgggaggca

SEQ ID NO: 9039532 - DNA, 22 bp, Homo sapiens
tgtggcagattttataaattgc

SEQ ID NO: 9039533 - DNA, 22 bp, Homo sapiens
tgtggcagagtaaggacccagt

SEQ ID NO: 9039534 - DNA, 21 bp, Homo sapiens
tgtggcagatgttgggaggca

SEQ ID NO: 9039535 - DNA, 21 bp, Homo sapiens
tgtggcagatgttgggaggca

SEQ ID NO: 9039536 - DNA, 22 bp, Homo sapiens
tgtggaggtttaagtaatggga

SEQ ID NO: 9039537 - DNA, 22 bp, Homo sapiens
tgtggaggtttaagtaatggga

SEQ ID NO: 9039538 - DNA, 22 bp, Homo sapiens
tgtggaggtttaagtaatggga

SEQ ID NO: 9039539 - DNA, 22 bp, Homo sapiens
tgtggaggattctgatgccagc

SEQ ID NO: 9039540 - DNA, 22 bp, Homo sapiens
tgtggaggattctgatgccagc

SEQ ID NO: 9039541 - DNA, 22 bp, Homo sapiens
tgtggaggattctgatgccagc

SEQ ID NO: 9039542 - DNA, 22 bp, Homo sapiens
tgtggatgagggagtgaacaaa

SEQ ID NO: 9039543 - DNA, 20 bp, Homo sapiens
tgtggatgaggtaaggatag

SEQ ID NO: 9039544 - DNA, 22 bp, Homo sapiens
tgtggagtggtctgaaggctcc

SEQ ID NO: 9039545 - DNA, 22 bp, Homo sapiens
tgtggagtggtctgaaggctcc

SEQ ID NO: 9039546 - DNA, 22 bp, Homo sapiens
tgtggcacagaaagatgaaggg

SEQ ID NO: 9039547 - DNA, 22 bp, Homo sapiens
tgtggcacatacacaggagggc

SEQ ID NO: 9039548 - DNA, 22 bp, Homo sapiens
tgtggcacatacacaggagggc

SEQ ID NO: 9039549 - DNA, 22 bp, Homo sapiens
tgtggcagaaagcatgtggaca

SEQ ID NO: 9039550 - DNA, 22 bp, Homo sapiens
tgtggcacttctctccttgtaa

SEQ ID NO: 9039551 - DNA, 22 bp, Homo sapiens
tgtggcagaaagcatgtggaca

SEQ ID NO: 9039552 - DNA, 22 bp, Homo sapiens
tgtggcagaaccagaattcaaa

SEQ ID NO: 9039553 - DNA, 22 bp, Homo sapiens
tgtggcagaaccagaattcaaa

SEQ ID NO: 9039554 - DNA, 22 bp, Homo sapiens
tgtggcagaactgggactcaaa

SEQ ID NO: 9039555 - DNA, 22 bp, Homo sapiens
tgtggcagaactgggactcaaa

SEQ ID NO: 9039556 - DNA, 22 bp, Homo sapiens
tgtggccagggggccatgtccc

SEQ ID NO: 9039557 - DNA, 22 bp, Homo sapiens
tgtggccaggaaaaggagatgg

SEQ ID NO: 9039558 - DNA, 22 bp, Homo sapiens
tgtggccagccacaggcatggt

SEQ ID NO: 9039559 - DNA, 20 bp, Homo sapiens
tgtggccagctctctactgg

SEQ ID NO: 9039560 - DNA, 22 bp, Homo sapiens
tgtggccagcaggtggctgtgt

SEQ ID NO: 9039561 - DNA, 22 bp, Homo sapiens
tgtggccagggggccatgtccc

SEQ ID NO: 9039562 - DNA, 19 bp, Homo sapiens
tgtggccatggttcagctg

SEQ ID NO: 9039563 - DNA, 22 bp, Homo sapiens
tgtggcccagatgagtgtgcta

SEQ ID NO: 9039564 - DNA, 22 bp, Homo sapiens
tgtggcccagatgagtgtgcta

SEQ ID NO: 9039565 - DNA, 22 bp, Homo sapiens
tgtggcctagttaaggacgcct

SEQ ID NO: 9039566 - DNA, 22 bp, Homo sapiens
tgtggcctagttaaggacgcct

SEQ ID NO: 9039567 - DNA, 20 bp, Homo sapiens
tgtggccatgttccaactca

SEQ ID NO: 9039568 - DNA, 22 bp, Homo sapiens
tgtggcccagatgagtgtgcta

SEQ ID NO: 9039569 - DNA, 22 bp, Homo sapiens
tgtggcccagatgagtgtgcta

SEQ ID NO: 9039570 - DNA, 22 bp, Homo sapiens
tgtggcagtctcactggagggc

SEQ ID NO: 9039571 - DNA, 22 bp, Homo sapiens
tgtggcagtctcactggagggc

SEQ ID NO: 9039572 - DNA, 22 bp, Homo sapiens
tgtggccaccagagctgctatt

SEQ ID NO: 9039573 - DNA, 22 bp, Homo sapiens
tgtggcagctgctgcaggagct

SEQ ID NO: 9039574 - DNA, 22 bp, Homo sapiens
tgtggcagctgctgcaggagct

SEQ ID NO: 9039575 - DNA, 18 bp, Homo sapiens
tgtggcaggggtgggaga

SEQ ID NO: 9039576 - DNA, 18 bp, Homo sapiens
tgtggcaggggtgggaga

SEQ ID NO: 9039577 - DNA, 18 bp, Homo sapiens
tgtggcaggggtgggaga

SEQ ID NO: 9039578 - DNA, 22 bp, Homo sapiens
tgtggcagtataagagctagaa

SEQ ID NO: 9039579 - DNA, 22 bp, Homo sapiens
tgtggcagtataagagctagaa

SEQ ID NO: 9039580 - DNA, 22 bp, Homo sapiens
tcccccactctaaaggagcctt

SEQ ID NO: 9039581 - DNA, 22 bp, Homo sapiens
tcccccactctaaaggagcctt

SEQ ID NO: 9039582 - DNA, 22 bp, Homo sapiens
tcccccactctaaaggagcctt

SEQ ID NO: 9039583 - DNA, 22 bp, Homo sapiens
tcccccaaatgaatgaggaata

SEQ ID NO: 9039584 - DNA, 22 bp, Homo sapiens
tcccccaactcttagcactgta

SEQ ID NO: 9039585 - DNA, 22 bp, Homo sapiens
tcccccaactcttagcactgta

SEQ ID NO: 9039586 - DNA, 20 bp, Homo sapiens
tcccccactgtttctgctac

SEQ ID NO: 9039587 - DNA, 22 bp, Homo sapiens
tcccccaggctggagtgcagtg

SEQ ID NO: 9039588 - DNA, 22 bp, Homo sapiens
tcccccaggctggagtgcagtg

SEQ ID NO: 9039589 - DNA, 22 bp, Homo sapiens
tccccagtaagcctgcactgtg

SEQ ID NO: 9039590 - DNA, 22 bp, Homo sapiens
tccccagtcccggcggtgggtg

SEQ ID NO: 9039591 - DNA, 22 bp, Homo sapiens
tccccagggtccctgcttccat

SEQ ID NO: 9039592 - DNA, 22 bp, Homo sapiens
tccccaggtcctgtcggctcct

SEQ ID NO: 9039593 - DNA, 22 bp, Homo sapiens
tccccaggtcctgtcggctcct

SEQ ID NO: 9039594 - DNA, 22 bp, Homo sapiens
tccccaggtcctgtcggctcct

SEQ ID NO: 9039595 - DNA, 22 bp, Homo sapiens
tccccaggtcctgtcggctcct

SEQ ID NO: 9039596 - DNA, 23 bp, Homo sapiens
tcccctcaggcagccagtgccct

SEQ ID NO: 9039597 - DNA, 23 bp, Homo sapiens
tcccctcaggcagccagtgccct

SEQ ID NO: 9039598 - DNA, 23 bp, Homo sapiens
tcccctcaggcagccagtgccct

SEQ ID NO: 9039599 - DNA, 22 bp, Homo sapiens
tcccctcccttccaacagagct

SEQ ID NO: 9039600 - DNA, 22 bp, Homo sapiens
tcccctcctctcctgatatggg

SEQ ID NO: 9039601 - DNA, 22 bp, Homo sapiens
tccccccagcctttcacatgag

SEQ ID NO: 9039602 - DNA, 22 bp, Homo sapiens
tccccccagcctttcacatgag

SEQ ID NO: 9039603 - DNA, 22 bp, Homo sapiens
tccccccagcctttcacatgag

SEQ ID NO: 9039604 - DNA, 22 bp, Homo sapiens
tcccccagtctgggcgtggtca

SEQ ID NO: 9039605 - DNA, 17 bp, Homo sapiens
tcccccagggctctctc

SEQ ID NO: 9039606 - DNA, 22 bp, Homo sapiens
tccccctcattacctcattcaa

SEQ ID NO: 9039607 - DNA, 22 bp, Homo sapiens
tccccctcctgtggttttctgc

SEQ ID NO: 9039608 - DNA, 22 bp, Homo sapiens
tgtggagcagcgtcacagcctt

SEQ ID NO: 9039609 - DNA, 22 bp, Homo sapiens
tgtggagcactgttcctggcat

SEQ ID NO: 9039610 - DNA, 22 bp, Homo sapiens
tgtggagcagcgtcacagcctt

SEQ ID NO: 9039611 - DNA, 22 bp, Homo sapiens
tgtggagcccccaggagtgggg

SEQ ID NO: 9039612 - DNA, 22 bp, Homo sapiens
tgtggagctcagaagtagcagt

SEQ ID NO: 9039613 - DNA, 22 bp, Homo sapiens
tgtggagccaggaggtggggac

SEQ ID NO: 9039614 - DNA, 22 bp, Homo sapiens
tgtggaggattctgatgccagc

SEQ ID NO: 9039615 - DNA, 22 bp, Homo sapiens
tgtggactttattttagggagg

SEQ ID NO: 9039616 - DNA, 22 bp, Homo sapiens
tgtggagaagaaggccactgca

SEQ ID NO: 9039617 - DNA, 22 bp, Homo sapiens
tgtggactttagtaggtgagag

SEQ ID NO: 9039618 - DNA, 22 bp, Homo sapiens
tgtggagaagaaggccactgca

SEQ ID NO: 9039619 - DNA, 22 bp, Homo sapiens
tgtggagatgtgagcaagggga

SEQ ID NO: 9039620 - DNA, 22 bp, Homo sapiens
tgtggactcgcatggctgaggc

SEQ ID NO: 9039621 - DNA, 22 bp, Homo sapiens
tgtggactgtgctgccacagtg

SEQ ID NO: 9039622 - DNA, 22 bp, Homo sapiens
tcccctctggaggctgcagggg

SEQ ID NO: 9039623 - DNA, 22 bp, Homo sapiens
tcccctctggaggctgcagggg

SEQ ID NO: 9039624 - DNA, 22 bp, Homo sapiens
tcccctctggaggctgcagggg

SEQ ID NO: 9039625 - DNA, 22 bp, Homo sapiens
tcccctctctgcgctcccaggt

SEQ ID NO: 9039626 - DNA, 22 bp, Homo sapiens
tcccctctctgcgctcccaggt

SEQ ID NO: 9039627 - DNA, 22 bp, Homo sapiens
tcccctctggaggctgcagggg

SEQ ID NO: 9039628 - DNA, 22 bp, Homo sapiens
tcccctctggttgacccaggag

SEQ ID NO: 9039629 - DNA, 22 bp, Homo sapiens
tcccctctttctggaaacacaa

SEQ ID NO: 9039630 - DNA, 22 bp, Homo sapiens
tcccctgagacccctcagcact

SEQ ID NO: 9039631 - DNA, 22 bp, Homo sapiens
tcccctctggttgacccaggag

SEQ ID NO: 9039632 - DNA, 18 bp, Homo sapiens
tcccctgctctggtgctc

SEQ ID NO: 9039633 - DNA, 18 bp, Homo sapiens
tcccctgctctggtgctc

SEQ ID NO: 9039634 - DNA, 22 bp, Homo sapiens
tcccctgcagcgcctgcttcta

SEQ ID NO: 9039635 - DNA, 22 bp, Homo sapiens
tcccctgcagcgcctgcttcta

SEQ ID NO: 9039636 - DNA, 22 bp, Homo sapiens
tcccctgcagcgcctgcttcta

SEQ ID NO: 9039637 - DNA, 22 bp, Homo sapiens
tcccctgcagcgcctgcttcta

SEQ ID NO: 9039638 - DNA, 22 bp, Homo sapiens
tcccctgcagatgagggcagtg

SEQ ID NO: 9039639 - DNA, 22 bp, Homo sapiens
tgtggacagctcttcccatatg

SEQ ID NO: 9039640 - DNA, 22 bp, Homo sapiens
tgtggacacctattaccagtga

SEQ ID NO: 9039641 - DNA, 18 bp, Homo sapiens
tcccctgctctggtgctc

SEQ ID NO: 9039642 - DNA, 22 bp, Homo sapiens
tgtggacactagcagatacggt

SEQ ID NO: 9039643 - DNA, 22 bp, Homo sapiens
tgtttacaaggagtttatattg

SEQ ID NO: 9039644 - DNA, 22 bp, Homo sapiens
tgtttacaaggagaatttgagg

SEQ ID NO: 9039645 - DNA, 22 bp, Homo sapiens
tgtttacacaatagtctctctc

SEQ ID NO: 9039646 - DNA, 22 bp, Homo sapiens
tgtttacacaatagtctctctc

SEQ ID NO: 9039647 - DNA, 22 bp, Homo sapiens
tgtttacaaggagtttatattg

SEQ ID NO: 9039648 - DNA, 22 bp, Homo sapiens
tgtttacaaggagtttatattg

SEQ ID NO: 9039649 - DNA, 22 bp, Homo sapiens
tgtttacaagccacttgttaag

SEQ ID NO: 9039650 - DNA, 22 bp, Homo sapiens
tgtttacaagccacttgttaag

SEQ ID NO: 9039651 - DNA, 22 bp, Homo sapiens
tgtttacaaggagaatttgagg

SEQ ID NO: 9039652 - DNA, 22 bp, Homo sapiens
tgtttacaaggagaatttgagg

SEQ ID NO: 9039653 - DNA, 22 bp, Homo sapiens
tgtttacaaaaccgtggtactg

SEQ ID NO: 9039654 - DNA, 22 bp, Homo sapiens
tgtttacaaaaccgtggtactg

SEQ ID NO: 9039655 - DNA, 22 bp, Homo sapiens
tgtttacaagccacttgttaag

SEQ ID NO: 9039656 - DNA, 22 bp, Homo sapiens
tgtttacatagtagctgccctg

SEQ ID NO: 9039657 - DNA, 22 bp, Homo sapiens
tgtttacagggtgattttacct

SEQ ID NO: 9039658 - DNA, 22 bp, Homo sapiens
tgtttacagggtgattttacct

SEQ ID NO: 9039659 - DNA, 22 bp, Homo sapiens
tgtttacagggtgattttacct

SEQ ID NO: 9039660 - DNA, 22 bp, Homo sapiens
tgtttacagctgatcaggcatc

SEQ ID NO: 9039661 - DNA, 22 bp, Homo sapiens
tgtttacagggtgattttacct

SEQ ID NO: 9039662 - DNA, 22 bp, Homo sapiens
tgtttacagctgatcaggcatc

SEQ ID NO: 9039663 - DNA, 22 bp, Homo sapiens
tgtttacagggtgattttacct

SEQ ID NO: 9039664 - DNA, 22 bp, Homo sapiens
tgtttacagcactgcacactgc

SEQ ID NO: 9039665 - DNA, 22 bp, Homo sapiens
tgtttacagcactgcacactgc

SEQ ID NO: 9039666 - DNA, 22 bp, Homo sapiens
tgtttacagaaggcagacttcc

SEQ ID NO: 9039667 - DNA, 22 bp, Homo sapiens
tgtttacagaaggcagacttcc

SEQ ID NO: 9039668 - DNA, 22 bp, Homo sapiens
tgtttacagaaggcagacttcc

SEQ ID NO: 9039669 - DNA, 22 bp, Homo sapiens
tgtttacagaaggcagacttcc

SEQ ID NO: 9039670 - DNA, 22 bp, Homo sapiens
tgtttacacaatagtctctctc

SEQ ID NO: 9039671 - DNA, 22 bp, Homo sapiens
tgtttacacaatagtctctctc

SEQ ID NO: 9039672 - DNA, 22 bp, Homo sapiens
tgtttacacttcaaggttaagg

SEQ ID NO: 9039673 - DNA, 22 bp, Homo sapiens
tgtttacacttcaaggttaagg

SEQ ID NO: 9039674 - DNA, 22 bp, Homo sapiens
tgtttacacttcaaggttaagg

SEQ ID NO: 9039675 - DNA, 21 bp, Homo sapiens
tgtttaatacatatttgtgga

SEQ ID NO: 9039676 - DNA, 21 bp, Homo sapiens
tgtttaatacatatttgtgga

SEQ ID NO: 9039677 - DNA, 22 bp, Homo sapiens
tgtttaataattctatgatagt

SEQ ID NO: 9039678 - DNA, 22 bp, Homo sapiens
tgtttaataattctatgatagt

SEQ ID NO: 9039679 - DNA, 22 bp, Homo sapiens
tgtttaatcttcaggacagtct

SEQ ID NO: 9039680 - DNA, 22 bp, Homo sapiens
tgtttaatcttcaggacagtct

SEQ ID NO: 9039681 - DNA, 22 bp, Homo sapiens
tgtttaatgaagatggtttttc

SEQ ID NO: 9039682 - DNA, 22 bp, Homo sapiens
tgtttaattcaccatcatgttc

SEQ ID NO: 9039683 - DNA, 22 bp, Homo sapiens
tgtttaattcaccatcatgttc

SEQ ID NO: 9039684 - DNA, 22 bp, Homo sapiens
tgtttaattcaccatcatgttc

SEQ ID NO: 9039685 - DNA, 22 bp, Homo sapiens
tgtttaattcaccatcatgttc

SEQ ID NO: 9039686 - DNA, 22 bp, Homo sapiens
tgtttaattcaccatcatgttc

SEQ ID NO: 9039687 - DNA, 22 bp, Homo sapiens
tgtttaattcaccatcatgttc

SEQ ID NO: 9039688 - DNA, 22 bp, Homo sapiens
tgtttaatttcacaaagttgac

SEQ ID NO: 9039689 - DNA, 22 bp, Homo sapiens
tgtttaatttcacaaagttgac

SEQ ID NO: 9039690 - DNA, 22 bp, Homo sapiens
tgtttaatttcacaaagttgac

SEQ ID NO: 9039691 - DNA, 22 bp, Homo sapiens
tgtttaattgggccaacagcgg

SEQ ID NO: 9039692 - DNA, 22 bp, Homo sapiens
tgtttaatttcacaaagttgac

SEQ ID NO: 9039693 - DNA, 22 bp, Homo sapiens
tgtttaattgggccaacagcgg

SEQ ID NO: 9039694 - DNA, 22 bp, Homo sapiens
tgttccttcacagcagtggaca

SEQ ID NO: 9039695 - DNA, 22 bp, Homo sapiens
tgttccttcacagcagtggaca

SEQ ID NO: 9039696 - DNA, 22 bp, Homo sapiens
tgttccttcacagcagtggaca

SEQ ID NO: 9039697 - DNA, 21 bp, Homo sapiens
tgttcctgttctctaggatcc

SEQ ID NO: 9039698 - DNA, 21 bp, Homo sapiens
tgttcctgttctctaggatcc

SEQ ID NO: 9039699 - DNA, 23 bp, Homo sapiens
tgttcctgtcaaattttcttccc

SEQ ID NO: 9039700 - DNA, 22 bp, Homo sapiens
tgttccttgaatatatcagacg

SEQ ID NO: 9039701 - DNA, 22 bp, Homo sapiens
tgttctaagctgccaaaatgct

SEQ ID NO: 9039702 - DNA, 22 bp, Homo sapiens
tgttctaaatttgcatggtcca

SEQ ID NO: 9039703 - DNA, 22 bp, Homo sapiens
tgttctaagtgttttgttcatg

SEQ ID NO: 9039704 - DNA, 22 bp, Homo sapiens
tgttctaagctgccaaaatgct

SEQ ID NO: 9039705 - DNA, 22 bp, Homo sapiens
tgttctaagctgccaaaatgct

SEQ ID NO: 9039706 - DNA, 22 bp, Homo sapiens
tgttctctctccttttgaagtg

SEQ ID NO: 9039707 - DNA, 22 bp, Homo sapiens
tgttctctaagaaaagaagcat

SEQ ID NO: 9039708 - DNA, 22 bp, Homo sapiens
tgttctcatctggatctcagga

SEQ ID NO: 9039709 - DNA, 22 bp, Homo sapiens
tgttctcatctggatctcagga

SEQ ID NO: 9039710 - DNA, 22 bp, Homo sapiens
tgttctcagtaattctatttta

SEQ ID NO: 9039711 - DNA, 22 bp, Homo sapiens
tgttctcagtaattctatttta

SEQ ID NO: 9039712 - DNA, 22 bp, Homo sapiens
tgttctcactggatgcttcaca

SEQ ID NO: 9039713 - DNA, 22 bp, Homo sapiens
tgttctcactggatgcttcaca

SEQ ID NO: 9039714 - DNA, 22 bp, Homo sapiens
tgttctcactggatgcttcaca

SEQ ID NO: 9039715 - DNA, 19 bp, Homo sapiens
tgttctagcggcaccaggc

SEQ ID NO: 9039716 - DNA, 22 bp, Homo sapiens
tgttctagcaacacagttttgg

SEQ ID NO: 9039717 - DNA, 22 bp, Homo sapiens
tgttctaggcaaaagctgattt

SEQ ID NO: 9039718 - DNA, 22 bp, Homo sapiens
tgttctatcaatttaagggaaa

SEQ ID NO: 9039719 - DNA, 21 bp, Homo sapiens
tgttctatcagctcaggtgtc

SEQ ID NO: 9039720 - DNA, 22 bp, Homo sapiens
tgttctaggcaaaagctgattt

SEQ ID NO: 9039721 - DNA, 19 bp, Homo sapiens
tgttctagcggcaccaggc

SEQ ID NO: 9039722 - DNA, 22 bp, Homo sapiens
tgttctaggcaaaagctgattt

SEQ ID NO: 9039723 - DNA, 22 bp, Homo sapiens
tgttctggggttgagagacaat

SEQ ID NO: 9039724 - DNA, 22 bp, Homo sapiens
tgttctggggacagcgtcccat

SEQ ID NO: 9039725 - DNA, 22 bp, Homo sapiens
tgttctggggttgagagacaat

SEQ ID NO: 9039726 - DNA, 22 bp, Homo sapiens
tgttctgtacctgtcctggggc

SEQ ID NO: 9039727 - DNA, 22 bp, Homo sapiens
tgttctgtacctgtcctggggc

SEQ ID NO: 9039728 - DNA, 22 bp, Homo sapiens
tgttctgtgcatctagccagta

SEQ ID NO: 9039729 - DNA, 20 bp, Homo sapiens
tgttctgtcgtctttcttca

SEQ ID NO: 9039730 - DNA, 22 bp, Homo sapiens
tgttctgtgcatctagccagta

SEQ ID NO: 9039731 - DNA, 22 bp, Homo sapiens
tgtttaagttctgctccttatt

SEQ ID NO: 9039732 - DNA, 22 bp, Homo sapiens
tgttctggagataagaggtaga

SEQ ID NO: 9039733 - DNA, 22 bp, Homo sapiens
tgttctgccagcacttctcagc

SEQ ID NO: 9039734 - DNA, 22 bp, Homo sapiens
tgttctgccagcacttctcagc

SEQ ID NO: 9039735 - DNA, 22 bp, Homo sapiens
tgttctgcaatgctgcctcctt

SEQ ID NO: 9039736 - DNA, 22 bp, Homo sapiens
tgttctgcaatgctgcctcctt

SEQ ID NO: 9039737 - DNA, 22 bp, Homo sapiens
tgttctcttttcctgctgagcc

SEQ ID NO: 9039738 - DNA, 22 bp, Homo sapiens
tgttctcttttcctgctgagcc

SEQ ID NO: 9039739 - DNA, 22 bp, Homo sapiens
tgttctcttttcctgctgagcc

SEQ ID NO: 9039740 - DNA, 22 bp, Homo sapiens
tgttctgcaagccctgccacct

SEQ ID NO: 9039741 - DNA, 22 bp, Homo sapiens
tgttctgcaagccctgccacct

SEQ ID NO: 9039742 - DNA, 22 bp, Homo sapiens
tgttctgagtgcagcttaataa

SEQ ID NO: 9039743 - DNA, 22 bp, Homo sapiens
tgttctcttccacggcgctcgg

SEQ ID NO: 9039744 - DNA, 22 bp, Homo sapiens
tgttctcttttcctgctgagcc

SEQ ID NO: 9039745 - DNA, 22 bp, Homo sapiens
tgttctctctggctgccagtac

SEQ ID NO: 9039746 - DNA, 22 bp, Homo sapiens
tgttctctctggctgccagtac

SEQ ID NO: 9039747 - DNA, 20 bp, Homo sapiens
tgtttctttaaggtgagaca

SEQ ID NO: 9039748 - DNA, 22 bp, Homo sapiens
tgtttcttgggtgctcacatca

SEQ ID NO: 9039749 - DNA, 22 bp, Homo sapiens
tgtttcttgggtgctcacatca

SEQ ID NO: 9039750 - DNA, 22 bp, Homo sapiens
tgtttcttgataaagcagaaaa

SEQ ID NO: 9039751 - DNA, 22 bp, Homo sapiens
tgtttctttgtagatattcttt

SEQ ID NO: 9039752 - DNA, 22 bp, Homo sapiens
tgtttctttgtagatattcttt

SEQ ID NO: 9039753 - DNA, 22 bp, Homo sapiens
tgtttgaaaagtggagatttat

SEQ ID NO: 9039754 - DNA, 20 bp, Homo sapiens
tgtttcttttaatgagcggc

SEQ ID NO: 9039755 - DNA, 22 bp, Homo sapiens
tgtttccttctgtctctttgga

SEQ ID NO: 9039756 - DNA, 22 bp, Homo sapiens
tgtttcctaagtgtctctgaag

SEQ ID NO: 9039757 - DNA, 22 bp, Homo sapiens
tgtttcctaagtgtctctgaag

SEQ ID NO: 9039758 - DNA, 23 bp, Homo sapiens
tgtttctagaatcattgatgtct

SEQ ID NO: 9039759 - DNA, 23 bp, Homo sapiens
tgtttctagaatcattgatgtct

SEQ ID NO: 9039760 - DNA, 22 bp, Homo sapiens
tgtttcttgagagtattaccct

SEQ ID NO: 9039761 - DNA, 22 bp, Homo sapiens
tgtttcctttctggtgagcata

SEQ ID NO: 9039762 - DNA, 18 bp, Homo sapiens
tgtttcctcctggaggct

SEQ ID NO: 9039763 - DNA, 22 bp, Homo sapiens
tgtttcttgataaagcagaaaa

SEQ ID NO: 9039764 - DNA, 22 bp, Homo sapiens
tgttttcagatgcagggacaca

SEQ ID NO: 9039765 - DNA, 22 bp, Homo sapiens
tgttttcagtcatatagcaggt

SEQ ID NO: 9039766 - DNA, 22 bp, Homo sapiens
tgttttcagatgcagggacaca

SEQ ID NO: 9039767 - DNA, 22 bp, Homo sapiens
tgttttcagtcatatagcaggt

SEQ ID NO: 9039768 - DNA, 22 bp, Homo sapiens
tgttttctcttgaaaagcagtc

SEQ ID NO: 9039769 - DNA, 22 bp, Homo sapiens
tgttttctcttgaaaagcagtc

SEQ ID NO: 9039770 - DNA, 22 bp, Homo sapiens
tgttttctcttgaaaagcagtc

SEQ ID NO: 9039771 - DNA, 22 bp, Homo sapiens
tgttttcacaatgatgtcagat

SEQ ID NO: 9039772 - DNA, 22 bp, Homo sapiens
tgttttcacaatgatgtcagat

SEQ ID NO: 9039773 - DNA, 22 bp, Homo sapiens
tgttttcacaatgatgtcagat

SEQ ID NO: 9039774 - DNA, 22 bp, Homo sapiens
tgttttcacaatgatgtcagat

SEQ ID NO: 9039775 - DNA, 19 bp, Homo sapiens
tgttttcaagtgggattat

SEQ ID NO: 9039776 - DNA, 22 bp, Homo sapiens
tgttttcacaatgatgtcagat

SEQ ID NO: 9039777 - DNA, 22 bp, Homo sapiens
tgtttgaactgaataacatagt

SEQ ID NO: 9039778 - DNA, 22 bp, Homo sapiens
tgtttgaactgaataacatagt

SEQ ID NO: 9039779 - DNA, 22 bp, Homo sapiens
tgtttgaagttcttctgtgact

SEQ ID NO: 9039780 - DNA, 22 bp, Homo sapiens
tgtttgaaagcacctacatttt

SEQ ID NO: 9039781 - DNA, 22 bp, Homo sapiens
tgtttgaaaagtggagatttat

SEQ ID NO: 9039782 - DNA, 16 bp, Homo sapiens
tgtttgcaaagcaatc

SEQ ID NO: 9039783 - DNA, 22 bp, Homo sapiens
tgtttgacacctcagtgtttct

SEQ ID NO: 9039784 - DNA, 22 bp, Homo sapiens
tgtttgaattttgctaacgtgt

SEQ ID NO: 9039785 - DNA, 22 bp, Homo sapiens
tgtttcaagcaatagcatttca

SEQ ID NO: 9039786 - DNA, 22 bp, Homo sapiens
tgtttcaagcaatagcatttca

SEQ ID NO: 9039787 - DNA, 22 bp, Homo sapiens
tgtttcaagcaatagcatttca

SEQ ID NO: 9039788 - DNA, 22 bp, Homo sapiens
tgtttcaagtttgctcaaagga

SEQ ID NO: 9039789 - DNA, 22 bp, Homo sapiens
tgtttcactaagcagaaatata

SEQ ID NO: 9039790 - DNA, 22 bp, Homo sapiens
tgtttcaggcttctgggatttt

SEQ ID NO: 9039791 - DNA, 22 bp, Homo sapiens
tgtttactccagctgatggaac

SEQ ID NO: 9039792 - DNA, 22 bp, Homo sapiens
tgtttcaactgttaagatatgc

SEQ ID NO: 9039793 - DNA, 22 bp, Homo sapiens
tgtttactatgatgtaacctat

SEQ ID NO: 9039794 - DNA, 22 bp, Homo sapiens
tgtttactatgatgtaacctat

SEQ ID NO: 9039795 - DNA, 22 bp, Homo sapiens
tgtttactccagctgatggaac

SEQ ID NO: 9039796 - DNA, 22 bp, Homo sapiens
tgtttactcactgtatccacaa

SEQ ID NO: 9039797 - DNA, 22 bp, Homo sapiens
tgtttacatgcataagcttaag

SEQ ID NO: 9039798 - DNA, 22 bp, Homo sapiens
tgtttacatggaggttttcagc

SEQ ID NO: 9039799 - DNA, 22 bp, Homo sapiens
tgtttacatggaggttttcagc

SEQ ID NO: 9039800 - DNA, 22 bp, Homo sapiens
tgtttacatggaggttttcagc

SEQ ID NO: 9039801 - DNA, 19 bp, Homo sapiens
tgtttacatgtttcttcag

SEQ ID NO: 9039802 - DNA, 19 bp, Homo sapiens
tgtttacatgtttcttcag

SEQ ID NO: 9039803 - DNA, 22 bp, Homo sapiens
tgtttactagccaacatggaga

SEQ ID NO: 9039804 - DNA, 22 bp, Homo sapiens
tgtttacatgcataagcttaag

SEQ ID NO: 9039805 - DNA, 22 bp, Homo sapiens
tgtttacatgcataagcttaag

SEQ ID NO: 9039806 - DNA, 22 bp, Homo sapiens
tgtttacatgcataagcttaag

SEQ ID NO: 9039807 - DNA, 22 bp, Homo sapiens
tgtttacatgcataagcttaag

SEQ ID NO: 9039808 - DNA, 22 bp, Homo sapiens
tgtttacatatttggtctcaga

SEQ ID NO: 9039809 - DNA, 22 bp, Homo sapiens
tgtttacatatttggtctcaga

SEQ ID NO: 9039810 - DNA, 22 bp, Homo sapiens
tgtttacatgcataagcttaag

SEQ ID NO: 9039811 - DNA, 22 bp, Homo sapiens
tgtttccatggtgacagcagct

SEQ ID NO: 9039812 - DNA, 22 bp, Homo sapiens
tgtttccatggtgacagcagct

SEQ ID NO: 9039813 - DNA, 22 bp, Homo sapiens
tgtttccatggtgatccaagtg

SEQ ID NO: 9039814 - DNA, 22 bp, Homo sapiens
tgtttccagaatgtagctgctt

SEQ ID NO: 9039815 - DNA, 22 bp, Homo sapiens
tgtttccatggtgacagcagct

SEQ ID NO: 9039816 - DNA, 22 bp, Homo sapiens
tgtttcatgtggacatagttgt

SEQ ID NO: 9039817 - DNA, 22 bp, Homo sapiens
tgtttcattagtactgacaata

SEQ ID NO: 9039818 - DNA, 22 bp, Homo sapiens
tgtttccaaagtcttttcttaa

SEQ ID NO: 9039819 - DNA, 22 bp, Homo sapiens
tgtttccaactgtgatcttact

SEQ ID NO: 9039820 - DNA, 22 bp, Homo sapiens
tgtttccaaatggtataaagac

SEQ ID NO: 9039821 - DNA, 18 bp, Homo sapiens
tgtttccaaggaggaagt

SEQ ID NO: 9039822 - DNA, 22 bp, Homo sapiens
tgtttccaactgtgatcttact

SEQ ID NO: 9039823 - DNA, 22 bp, Homo sapiens
tgtttccagaaggacaaagaaa

SEQ ID NO: 9039824 - DNA, 18 bp, Homo sapiens
tgtttccaaggaggaagt

SEQ ID NO: 9039825 - DNA, 22 bp, Homo sapiens
tgtttcatgtggacatagttgt

SEQ ID NO: 9039826 - DNA, 22 bp, Homo sapiens
tgtttcatgtggacatagttgt

SEQ ID NO: 9039827 - DNA, 22 bp, Homo sapiens
tgtttcatgaagtctggatatc

SEQ ID NO: 9039828 - DNA, 22 bp, Homo sapiens
tgtttcatgattgctgtcattt

SEQ ID NO: 9039829 - DNA, 22 bp, Homo sapiens
tgtttcatgaagtctggatatc

SEQ ID NO: 9039830 - DNA, 22 bp, Homo sapiens
tgtttcagtccctgtgttcaat

SEQ ID NO: 9039831 - DNA, 20 bp, Homo sapiens
tgtttcataagctgtcctat

SEQ ID NO: 9039832 - DNA, 22 bp, Homo sapiens
tgtttcatgaaacatgtttagg

SEQ ID NO: 9039833 - DNA, 22 bp, Homo sapiens
tgtttcatgaaacatgtttagg

SEQ ID NO: 9039834 - DNA, 22 bp, Homo sapiens
tgtttcatgaaacatgtttagg

SEQ ID NO: 9039835 - DNA, 22 bp, Homo sapiens
tgttcacttatgttctcccatt

SEQ ID NO: 9039836 - DNA, 22 bp, Homo sapiens
tgttcactggaacacagctgta

SEQ ID NO: 9039837 - DNA, 22 bp, Homo sapiens
tgttcagaaaacagataactaa

SEQ ID NO: 9039838 - DNA, 22 bp, Homo sapiens
tgttcagaacaaaggtaaatga

SEQ ID NO: 9039839 - DNA, 20 bp, Homo sapiens
tgttcagaaatgcagagagg

SEQ ID NO: 9039840 - DNA, 22 bp, Homo sapiens
tgttcccatggatatctgcata

SEQ ID NO: 9039841 - DNA, 18 bp, Homo sapiens
tgttcccggggattctga

SEQ ID NO: 9039842 - DNA, 22 bp, Homo sapiens
tgttccgaccgtggggtttgat

SEQ ID NO: 9039843 - DNA, 22 bp, Homo sapiens
tgttccgaccgtggggtttgat

SEQ ID NO: 9039844 - DNA, 22 bp, Homo sapiens
tgttcctgctatggtttgttgc

SEQ ID NO: 9039845 - DNA, 22 bp, Homo sapiens
tgttcctggaaagccaggtggg

SEQ ID NO: 9039846 - DNA, 22 bp, Homo sapiens
tgttcctggttcctgcatgatg

SEQ ID NO: 9039847 - DNA, 22 bp, Homo sapiens
tgttcctgtactgctgtggctt

SEQ ID NO: 9039848 - DNA, 22 bp, Homo sapiens
tgttcctggtgagccatttttt

SEQ ID NO: 9039849 - DNA, 22 bp, Homo sapiens
tgttcctggttcctgcatgatg

SEQ ID NO: 9039850 - DNA, 22 bp, Homo sapiens
tgttcctgacggccaaagaggt

SEQ ID NO: 9039851 - DNA, 22 bp, Homo sapiens
tgttcctgaggcatgtgtcaat

SEQ ID NO: 9039852 - DNA, 21 bp, Homo sapiens
tgttcctgccccaatccttgg

SEQ ID NO: 9039853 - DNA, 22 bp, Homo sapiens
tgttcctgaatgcctggctggc

SEQ ID NO: 9039854 - DNA, 22 bp, Homo sapiens
tgttcctgacggccaaagaggt

SEQ ID NO: 9039855 - DNA, 22 bp, Homo sapiens
tgttatttgggaaagttgtaca

SEQ ID NO: 9039856 - DNA, 22 bp, Homo sapiens
tgttatttgggaaagttgtaca

SEQ ID NO: 9039857 - DNA, 22 bp, Homo sapiens
tgttatttgggaaagttgtaca

SEQ ID NO: 9039858 - DNA, 22 bp, Homo sapiens
tgttcaaaaatatcttctgcaa

SEQ ID NO: 9039859 - DNA, 22 bp, Homo sapiens
tgttatttgggaaagttgtaca

SEQ ID NO: 9039860 - DNA, 22 bp, Homo sapiens
tgttcaagtggatgtggctttt

SEQ ID NO: 9039861 - DNA, 22 bp, Homo sapiens
tgttcaaatcttttgcttattt

SEQ ID NO: 9039862 - DNA, 22 bp, Homo sapiens
tgttcaaatcttttgcttattt

SEQ ID NO: 9039863 - DNA, 21 bp, Homo sapiens
tgttcaaacgtacacatttct

SEQ ID NO: 9039864 - DNA, 21 bp, Homo sapiens
tgttcaaacgtacacatttct

SEQ ID NO: 9039865 - DNA, 21 bp, Homo sapiens
tgttcaaacgtacacatttct

SEQ ID NO: 9039866 - DNA, 21 bp, Homo sapiens
tgttcaaacgtacacatttct

SEQ ID NO: 9039867 - DNA, 21 bp, Homo sapiens
tgttcaaacgtacacatttct

SEQ ID NO: 9039868 - DNA, 22 bp, Homo sapiens
tgttcaaatcttttgcttattt

SEQ ID NO: 9039869 - DNA, 22 bp, Homo sapiens
tgttcacaacgtgcaggtttgt

SEQ ID NO: 9039870 - DNA, 22 bp, Homo sapiens
tgttcacaacgtgcaggtttgt

SEQ ID NO: 9039871 - DNA, 22 bp, Homo sapiens
tgttcacaagcagatgttgctt

SEQ ID NO: 9039872 - DNA, 22 bp, Homo sapiens
tgttcacaagatgtctgtggct

SEQ ID NO: 9039873 - DNA, 22 bp, Homo sapiens
tgttcacacagtctatacggat

SEQ ID NO: 9039874 - DNA, 22 bp, Homo sapiens
tgttcacacacggaggccacag

SEQ ID NO: 9039875 - DNA, 22 bp, Homo sapiens
tgttcacacagtctatacggat

SEQ ID NO: 9039876 - DNA, 22 bp, Homo sapiens
tgttcacaaggtgatgctttga

SEQ ID NO: 9039877 - DNA, 22 bp, Homo sapiens
tgttcacacacggaggccacag

SEQ ID NO: 9039878 - DNA, 22 bp, Homo sapiens
tgttcacatgtacatgaatatt

SEQ ID NO: 9039879 - DNA, 22 bp, Homo sapiens
tgttcacatgtacatgaatatt

SEQ ID NO: 9039880 - DNA, 22 bp, Homo sapiens
tgttcacatgtacatgaatatt

SEQ ID NO: 9039881 - DNA, 21 bp, Homo sapiens
tgttcacatggagcagaatgt

SEQ ID NO: 9039882 - DNA, 21 bp, Homo sapiens
tgttcacatggagcagaatgt

SEQ ID NO: 9039883 - DNA, 20 bp, Homo sapiens
tgttcacagtagttgctgct

SEQ ID NO: 9039884 - DNA, 22 bp, Homo sapiens
tgttcacaggaggggcttatgg

SEQ ID NO: 9039885 - DNA, 22 bp, Homo sapiens
tgttcacaggggagccatttat

SEQ ID NO: 9039886 - DNA, 21 bp, Homo sapiens
tgttcacatggagcagaatgt

SEQ ID NO: 9039887 - DNA, 22 bp, Homo sapiens
tgttcacatcgatggattttgc

SEQ ID NO: 9039888 - DNA, 20 bp, Homo sapiens
tgttcacagtagttgctgct

SEQ ID NO: 9039889 - DNA, 20 bp, Homo sapiens
tgttcacagtagttgctgct

SEQ ID NO: 9039890 - DNA, 22 bp, Homo sapiens
tgttatttatttcacctccaga

SEQ ID NO: 9039891 - DNA, 22 bp, Homo sapiens
tgttatttatctgagcatttat

SEQ ID NO: 9039892 - DNA, 22 bp, Homo sapiens
tgttatttatctgagcatttat

SEQ ID NO: 9039893 - DNA, 22 bp, Homo sapiens
tgttatttatctgagcatttat

SEQ ID NO: 9039894 - DNA, 22 bp, Homo sapiens
tgttatttatctgagcatttat

SEQ ID NO: 9039895 - DNA, 22 bp, Homo sapiens
tgttatttatttcacctccaga

SEQ ID NO: 9039896 - DNA, 22 bp, Homo sapiens
tgttatttatttcacctccaga

SEQ ID NO: 9039897 - DNA, 22 bp, Homo sapiens
tgttatttctttgccatatctt

SEQ ID NO: 9039898 - DNA, 22 bp, Homo sapiens
tgttatttctttgccatatctt

SEQ ID NO: 9039899 - DNA, 22 bp, Homo sapiens
tgttatttctttgccatatctt

SEQ ID NO: 9039900 - DNA, 22 bp, Homo sapiens
tgttattctctgcctacaagtc

SEQ ID NO: 9039901 - DNA, 22 bp, Homo sapiens
tgttattctgatgtgcaggata

SEQ ID NO: 9039902 - DNA, 22 bp, Homo sapiens
tgttattatctgttaggtgttc

SEQ ID NO: 9039903 - DNA, 22 bp, Homo sapiens
tgttattatctgttaggtgttc

SEQ ID NO: 9039904 - DNA, 22 bp, Homo sapiens
tgttattatctgttaggtgttc

SEQ ID NO: 9039905 - DNA, 20 bp, Homo sapiens
tgttattagcaagcttcttt

SEQ ID NO: 9039906 - DNA, 22 bp, Homo sapiens
tgttattatgtttccagagcct

SEQ ID NO: 9039907 - DNA, 23 bp, Homo sapiens
tgttattccaggttaatgtactt

SEQ ID NO: 9039908 - DNA, 22 bp, Homo sapiens
tgttattgatatctaatgctct

SEQ ID NO: 9039909 - DNA, 22 bp, Homo sapiens
tgttattgatatctaatgctct

SEQ ID NO: 9039910 - DNA, 22 bp, Homo sapiens
tgttattgaggttacttataag

SEQ ID NO: 9039911 - DNA, 22 bp, Homo sapiens
tgttattgggtcccaactaggt

SEQ ID NO: 9039912 - DNA, 22 bp, Homo sapiens
tgttattgtcgctgcactggga

SEQ ID NO: 9039913 - DNA, 22 bp, Homo sapiens
tgttatttatctgagcatttat

SEQ ID NO: 9039914 - DNA, 22 bp, Homo sapiens
tgttattgtcgctgcactggga

SEQ ID NO: 9039915 - DNA, 21 bp, Homo sapiens
tgttatgtgcttcaagaagtg

SEQ ID NO: 9039916 - DNA, 21 bp, Homo sapiens
tgttatgtgcttcaagaagtg

SEQ ID NO: 9039917 - DNA, 22 bp, Homo sapiens
tgttatgatctcactatgacta

SEQ ID NO: 9039918 - DNA, 22 bp, Homo sapiens
tgttatgtgccacacttgaggg

SEQ ID NO: 9039919 - DNA, 22 bp, Homo sapiens
tgttatgagaaagacattaggt

SEQ ID NO: 9039920 - DNA, 22 bp, Homo sapiens
tgttatgagaaagacattaggt

SEQ ID NO: 9039921 - DNA, 18 bp, Homo sapiens
tgttatgagactctagga

SEQ ID NO: 9039922 - DNA, 22 bp, Homo sapiens
tgttatgagtcctcatatacta

SEQ ID NO: 9039923 - DNA, 22 bp, Homo sapiens
tgttatgagtcctcatatacta

SEQ ID NO: 9039924 - DNA, 22 bp, Homo sapiens
tgttatctgagcaacgtcgacg

SEQ ID NO: 9039925 - DNA, 22 bp, Homo sapiens
tgttatctggttgtctgattac

SEQ ID NO: 9039926 - DNA, 22 bp, Homo sapiens
tgttatgaactgcctatggaga

SEQ ID NO: 9039927 - DNA, 22 bp, Homo sapiens
tgttatgaactgcctatggact

SEQ ID NO: 9039928 - DNA, 22 bp, Homo sapiens
tgttatgaacttctagaaaaca

SEQ ID NO: 9039929 - DNA, 19 bp, Homo sapiens
tgttatgactttgcctttt

SEQ ID NO: 9039930 - DNA, 22 bp, Homo sapiens
tgttatcctcagctcacctcta

SEQ ID NO: 9039931 - DNA, 22 bp, Homo sapiens
tgttatcctcagctcacctcta

SEQ ID NO: 9039932 - DNA, 22 bp, Homo sapiens
tgttatcctcagctcacctcta

SEQ ID NO: 9039933 - DNA, 22 bp, Homo sapiens
tgttatcacttagacatgctag

SEQ ID NO: 9039934 - DNA, 22 bp, Homo sapiens
tgttatcacttgtaaaagcaat

SEQ ID NO: 9039935 - DNA, 22 bp, Homo sapiens
tgttagttgttcatgttaagag

SEQ ID NO: 9039936 - DNA, 22 bp, Homo sapiens
tgttagttgttcatgttaagag

SEQ ID NO: 9039937 - DNA, 22 bp, Homo sapiens
tgttaaaaatgcagattcctat

SEQ ID NO: 9039938 - DNA, 22 bp, Homo sapiens
tgttaaaaatgcagattcctat

SEQ ID NO: 9039939 - DNA, 22 bp, Homo sapiens
tgttatacagacacgatggtat

SEQ ID NO: 9039940 - DNA, 22 bp, Homo sapiens
tgttatactatttagaggtaca

SEQ ID NO: 9039941 - DNA, 22 bp, Homo sapiens
tgttatagtagaatcattacaa

SEQ ID NO: 9039942 - DNA, 22 bp, Homo sapiens
tgtgtgcacgctgggagctgga

SEQ ID NO: 9039943 - DNA, 18 bp, Homo sapiens
tgtgtgcacctgccttga

SEQ ID NO: 9039944 - DNA, 22 bp, Homo sapiens
tgtgtgcacaggagtgtttgaa

SEQ ID NO: 9039945 - DNA, 22 bp, Homo sapiens
tgtgtgcacatgatttgaaatg

SEQ ID NO: 9039946 - DNA, 22 bp, Homo sapiens
tgtgtgcacatgatttgaaatg

SEQ ID NO: 9039947 - DNA, 22 bp, Homo sapiens
tgtgtgcacgctgggagctgga

SEQ ID NO: 9039948 - DNA, 22 bp, Homo sapiens
tgtgtgcactgccttttgtgga

SEQ ID NO: 9039949 - DNA, 22 bp, Homo sapiens
tgtgtgcacgtacatactgtat

SEQ ID NO: 9039950 - DNA, 22 bp, Homo sapiens
tgtgtgcactgccttttgtgga

SEQ ID NO: 9039951 - DNA, 22 bp, Homo sapiens
tgtgtgcacttaatgcaatcat

SEQ ID NO: 9039952 - DNA, 22 bp, Homo sapiens
tgtgtgcacaggagtgtttgaa

SEQ ID NO: 9039953 - DNA, 20 bp, Homo sapiens
tgtgtgcacacatgacattc

SEQ ID NO: 9039954 - DNA, 22 bp, Homo sapiens
tgtgtgcaattcttaacataca

SEQ ID NO: 9039955 - DNA, 20 bp, Homo sapiens
tgtgtgcacacatgacattc

SEQ ID NO: 9039956 - DNA, 22 bp, Homo sapiens
tgtgtgcacaaagagtacatgg

SEQ ID NO: 9039957 - DNA, 22 bp, Homo sapiens
tgtgtgcagcctctgtctttgg

SEQ ID NO: 9039958 - DNA, 22 bp, Homo sapiens
tgtgtgcaggcactgtgccaga

SEQ ID NO: 9039959 - DNA, 22 bp, Homo sapiens
tgtgtgcagcctctgtctttgg

SEQ ID NO: 9039960 - DNA, 22 bp, Homo sapiens
tgtgtgcagacagatattactt

SEQ ID NO: 9039961 - DNA, 22 bp, Homo sapiens
tgtgtgcagacagatattactt

SEQ ID NO: 9039962 - DNA, 22 bp, Homo sapiens
tgtgtgcacttaatgcaatcat

SEQ ID NO: 9039963 - DNA, 22 bp, Homo sapiens
tgtgtgcagcggcaggtgaagt

SEQ ID NO: 9039964 - DNA, 22 bp, Homo sapiens
tgtgtgcagctgaaaagcgctg

SEQ ID NO: 9039965 - DNA, 22 bp, Homo sapiens
tgtgtgcaggcactgtgccaga

SEQ ID NO: 9039966 - DNA, 22 bp, Homo sapiens
tgtgtgcatacacacggtaaca

SEQ ID NO: 9039967 - DNA, 21 bp, Homo sapiens
tgtgtgcatatgcatgtacat

SEQ ID NO: 9039968 - DNA, 20 bp, Homo sapiens
tgtgtgcatctgtatgtatt

SEQ ID NO: 9039969 - DNA, 22 bp, Homo sapiens
tgtgttaattttccctttctct

SEQ ID NO: 9039970 - DNA, 22 bp, Homo sapiens
tgtgttatgtgggccagggcaa

SEQ ID NO: 9039971 - DNA, 22 bp, Homo sapiens
tgtgttatgtgggccagggcaa

SEQ ID NO: 9039972 - DNA, 20 bp, Homo sapiens
tgtgtgcatctgtatgtatt

SEQ ID NO: 9039973 - DNA, 21 bp, Homo sapiens
tgtgtgcatatgcatgtacat

SEQ ID NO: 9039974 - DNA, 22 bp, Homo sapiens
tgtgttaattccacaaacattc

SEQ ID NO: 9039975 - DNA, 22 bp, Homo sapiens
tgtgttaattccacaaacattc

SEQ ID NO: 9039976 - DNA, 22 bp, Homo sapiens
tgtgttaattccacaaacattc

SEQ ID NO: 9039977 - DNA, 22 bp, Homo sapiens
tgtgttaattttccctttctct

SEQ ID NO: 9039978 - DNA, 22 bp, Homo sapiens
tgtgttctggaaagctcactga

SEQ ID NO: 9039979 - DNA, 22 bp, Homo sapiens
tgtgttcaagattagttctagt

SEQ ID NO: 9039980 - DNA, 22 bp, Homo sapiens
tgtgttcaagattagttctagt

SEQ ID NO: 9039981 - DNA, 22 bp, Homo sapiens
tgtgttcaagattagttctagt

SEQ ID NO: 9039982 - DNA, 22 bp, Homo sapiens
tgtgttcaatcaccaaaggtat

SEQ ID NO: 9039983 - DNA, 22 bp, Homo sapiens
tgtgttcaagattagttctagt

SEQ ID NO: 9039984 - DNA, 19 bp, Homo sapiens
tgtgttcaaactccatctc

SEQ ID NO: 9039985 - DNA, 22 bp, Homo sapiens
tgtgttgtgacattcttggatg

SEQ ID NO: 9039986 - DNA, 22 bp, Homo sapiens
tgtgttggaaatagggtctttg

SEQ ID NO: 9039987 - DNA, 21 bp, Homo sapiens
tgtgttcttctaggtcagcta

SEQ ID NO: 9039988 - DNA, 22 bp, Homo sapiens
tgtgttggctgccggcacagga

SEQ ID NO: 9039989 - DNA, 22 bp, Homo sapiens
tgtgttggctgccggcacagga

SEQ ID NO: 9039990 - DNA, 22 bp, Homo sapiens
tgtgttctggctgtgacagctg

SEQ ID NO: 9039991 - DNA, 22 bp, Homo sapiens
tgtgttcttaaaagcagtgata

SEQ ID NO: 9039992 - DNA, 22 bp, Homo sapiens
tgtgtttgagtcctcacagtgc

SEQ ID NO: 9039993 - DNA, 22 bp, Homo sapiens
tgtgtttgcaatgggaatgaga

SEQ ID NO: 9039994 - DNA, 22 bp, Homo sapiens
tgtgtttgggggagatgcattt

SEQ ID NO: 9039995 - DNA, 22 bp, Homo sapiens
tgtgtttgggggagatgcattt

SEQ ID NO: 9039996 - DNA, 22 bp, Homo sapiens
tgtgtttgggggagatgcattt

SEQ ID NO: 9039997 - DNA, 22 bp, Homo sapiens
tgtgtttgttagactaatgtta

SEQ ID NO: 9039998 - DNA, 22 bp, Homo sapiens
tgtgttttaaatggaaatttga

SEQ ID NO: 9039999 - DNA, 22 bp, Homo sapiens
tgtgttttacaaattctcttaa

SEQ ID NO: 9040000 - DNA, 22 bp, Homo sapiens
tgtgttttacaaattctcttaa

SEQ ID NO: 9040001 - DNA, 21 bp, Homo sapiens
tgtgttttaatgatattctgt

SEQ ID NO: 9040002 - DNA, 21 bp, Homo sapiens
tgtgttttaatgatattctgt

SEQ ID NO: 9040003 - DNA, 22 bp, Homo sapiens
tgtgttttgtgtgacccagctc

SEQ ID NO: 9040004 - DNA, 20 bp, Homo sapiens
tgtgttttgcagggcattta

SEQ ID NO: 9040005 - DNA, 22 bp, Homo sapiens
tgtgttttgaactcatctactg

SEQ ID NO: 9040006 - DNA, 22 bp, Homo sapiens
tgtgttttccagaatggtgttt

SEQ ID NO: 9040007 - DNA, 22 bp, Homo sapiens
tgtgttttggaaggaacatgca

SEQ ID NO: 9040008 - DNA, 22 bp, Homo sapiens
tgtgttttatctattgtatctt

SEQ ID NO: 9040009 - DNA, 22 bp, Homo sapiens
tgtgttttatctattgtatctt

SEQ ID NO: 9040010 - DNA, 21 bp, Homo sapiens
tgtgttttctctctgggaggt

SEQ ID NO: 9040011 - DNA, 22 bp, Homo sapiens
tgtgttttcctccctggcgttt

SEQ ID NO: 9040012 - DNA, 21 bp, Homo sapiens
tgtgtttgagactatgtttcc

SEQ ID NO: 9040013 - DNA, 22 bp, Homo sapiens
tgtgtttgaggcatgttgcaga

SEQ ID NO: 9040014 - DNA, 21 bp, Homo sapiens
tgtgtttgagactatgtttcc

SEQ ID NO: 9040015 - DNA, 22 bp, Homo sapiens
tgtgtttctctgaggggtccct

SEQ ID NO: 9040016 - DNA, 22 bp, Homo sapiens
tgtgtttctgagaatcccacct

SEQ ID NO: 9040017 - DNA, 21 bp, Homo sapiens
tgtgtttgagactatgtttcc

SEQ ID NO: 9040018 - DNA, 22 bp, Homo sapiens
tgtgtttctgagaatcccacct

SEQ ID NO: 9040019 - DNA, 22 bp, Homo sapiens
tgtgtttcagaaccttctttca

SEQ ID NO: 9040020 - DNA, 22 bp, Homo sapiens
tgtgtttcagaaccttctttca

SEQ ID NO: 9040021 - DNA, 22 bp, Homo sapiens
tgtgtttatagtgtatcttcca

SEQ ID NO: 9040022 - DNA, 22 bp, Homo sapiens
tgtgtttagagagcacattcag

SEQ ID NO: 9040023 - DNA, 22 bp, Homo sapiens
tgtgtttatagtgtatcttcca

SEQ ID NO: 9040024 - DNA, 22 bp, Homo sapiens
tgtgttgttttaagctgctgca

SEQ ID NO: 9040025 - DNA, 22 bp, Homo sapiens
tgtgttgtgacattcttggatg

SEQ ID NO: 9040026 - DNA, 22 bp, Homo sapiens
tgtgttgtgacattcttggatg

SEQ ID NO: 9040027 - DNA, 22 bp, Homo sapiens
tgtgttgtgacattcttggatg

SEQ ID NO: 9040028 - DNA, 22 bp, Homo sapiens
tgtgttgttagtaccagcagtc

SEQ ID NO: 9040029 - DNA, 22 bp, Homo sapiens
tgtgttgttttaagctgctgca

SEQ ID NO: 9040030 - DNA, 22 bp, Homo sapiens
tgtgtttaaagaggaagtgaga

SEQ ID NO: 9040031 - DNA, 22 bp, Homo sapiens
tgtgtttacttctatgcagttt

SEQ ID NO: 9040032 - DNA, 23 bp, Homo sapiens
tgtgtttacctgaggatcttgtt

SEQ ID NO: 9040033 - DNA, 22 bp, Homo sapiens
tgtgtttaaagaggaagtgaga

SEQ ID NO: 9040034 - DNA, 23 bp, Homo sapiens
tgtgtttacctgaggatcttgtt

SEQ ID NO: 9040035 - DNA, 22 bp, Homo sapiens
tgtgtttatagtgtatcttcca

SEQ ID NO: 9040036 - DNA, 22 bp, Homo sapiens
tgtgtttatagtgtatcttcca

SEQ ID NO: 9040037 - DNA, 22 bp, Homo sapiens
tgtgtttagagagcacattcag

SEQ ID NO: 9040038 - DNA, 22 bp, Homo sapiens
tgtgtttagagagcacattcag

SEQ ID NO: 9040039 - DNA, 22 bp, Homo sapiens
ttacacatgaaggtccaatgtt

SEQ ID NO: 9040040 - DNA, 22 bp, Homo sapiens
ttacacatgaaggtccaatgtt

SEQ ID NO: 9040041 - DNA, 22 bp, Homo sapiens
ttacacatgaaggtccaatgtt

SEQ ID NO: 9040042 - DNA, 22 bp, Homo sapiens
ttacacatgctttgtgtgtatg

SEQ ID NO: 9040043 - DNA, 22 bp, Homo sapiens
ttacacagtgcacaagcagagt

SEQ ID NO: 9040044 - DNA, 22 bp, Homo sapiens
ttacacagtgcacaagcagagt

SEQ ID NO: 9040045 - DNA, 22 bp, Homo sapiens
ttacacagtgcacaagcagagt

SEQ ID NO: 9040046 - DNA, 22 bp, Homo sapiens
ttacacagtgcacaagcagagt

SEQ ID NO: 9040047 - DNA, 22 bp, Homo sapiens
ttacacagtggttaagtctggg

SEQ ID NO: 9040048 - DNA, 22 bp, Homo sapiens
ttacacagtgcacaagcagagt

SEQ ID NO: 9040049 - DNA, 22 bp, Homo sapiens
ttacacagtggttaagtctggg

SEQ ID NO: 9040050 - DNA, 22 bp, Homo sapiens
ttacactcatattgcacttacc

SEQ ID NO: 9040051 - DNA, 22 bp, Homo sapiens
ttacactcatattgcacttacc

SEQ ID NO: 9040052 - DNA, 19 bp, Homo sapiens
ttacactcctgggcagtgg

SEQ ID NO: 9040053 - DNA, 22 bp, Homo sapiens
ttacactctggttgtgggcctt

SEQ ID NO: 9040054 - DNA, 19 bp, Homo sapiens
ttacactcctgggcagtgg

SEQ ID NO: 9040055 - DNA, 22 bp, Homo sapiens
ttacactctggttgtgggcctt

SEQ ID NO: 9040056 - DNA, 22 bp, Homo sapiens
ttacacattgcagatcaaaatg

SEQ ID NO: 9040057 - DNA, 22 bp, Homo sapiens
ttacacctcagtgagaagatct

SEQ ID NO: 9040058 - DNA, 18 bp, Homo sapiens
ttacactagccttggttc

SEQ ID NO: 9040059 - DNA, 22 bp, Homo sapiens
ttacacattaacaggcagctaa

SEQ ID NO: 9040060 - DNA, 22 bp, Homo sapiens
ttacacattgcagatcaaaatg

SEQ ID NO: 9040061 - DNA, 17 bp, Homo sapiens
ttacacaggagagctct

SEQ ID NO: 9040062 - DNA, 22 bp, Homo sapiens
ttacacaggcacttaaaatgca

SEQ ID NO: 9040063 - DNA, 17 bp, Homo sapiens
ttacacaggagagctct

SEQ ID NO: 9040064 - DNA, 22 bp, Homo sapiens
ttacacaggcacttaaaatgca

SEQ ID NO: 9040065 - DNA, 22 bp, Homo sapiens
ttacacaggcacttaaaatgca

SEQ ID NO: 9040066 - DNA, 22 bp, Homo sapiens
ttacacagtgaatttactcaag

SEQ ID NO: 9040067 - DNA, 22 bp, Homo sapiens
ttacacagatggttagtagagg

SEQ ID NO: 9040068 - DNA, 22 bp, Homo sapiens
ttacacagcttctatccttgaa

SEQ ID NO: 9040069 - DNA, 22 bp, Homo sapiens
ttacacagacatggcatcatga

SEQ ID NO: 9040070 - DNA, 22 bp, Homo sapiens
ttacacagatggttagtagagg

SEQ ID NO: 9040071 - DNA, 21 bp, Homo sapiens
ttacacactgcttctagaatg

SEQ ID NO: 9040072 - DNA, 21 bp, Homo sapiens
ttacacactgcttctagaatg

SEQ ID NO: 9040073 - DNA, 22 bp, Homo sapiens
ttacacactctgccctgctgtt

SEQ ID NO: 9040074 - DNA, 22 bp, Homo sapiens
ttacacactctgccctgctgtt

SEQ ID NO: 9040075 - DNA, 22 bp, Homo sapiens
ttacacactctgccctgctgtt

SEQ ID NO: 9040076 - DNA, 22 bp, Homo sapiens
ttacacagaaacactgttcaga

SEQ ID NO: 9040077 - DNA, 22 bp, Homo sapiens
ttacacagaaacactgttcaga

SEQ ID NO: 9040078 - DNA, 22 bp, Homo sapiens
ttacacagaaattttattgcct

SEQ ID NO: 9040079 - DNA, 22 bp, Homo sapiens
ttacacagaaattttattgcct

SEQ ID NO: 9040080 - DNA, 22 bp, Homo sapiens
ttacacaattttattgacctaa

SEQ ID NO: 9040081 - DNA, 22 bp, Homo sapiens
ttacacaattactcactcctgg

SEQ ID NO: 9040082 - DNA, 22 bp, Homo sapiens
ttacacacaattagcatagtaa

SEQ ID NO: 9040083 - DNA, 22 bp, Homo sapiens
ttacacacaattagcatagtaa

SEQ ID NO: 9040084 - DNA, 22 bp, Homo sapiens
ttacacacagagctgggcctgg

SEQ ID NO: 9040085 - DNA, 22 bp, Homo sapiens
ttacacacagagctgggcctgg

SEQ ID NO: 9040086 - DNA, 22 bp, Homo sapiens
ttacacacaattagcatagtaa

SEQ ID NO: 9040087 - DNA, 22 bp, Homo sapiens
ttacacacagagctgggcctgg

SEQ ID NO: 9040088 - DNA, 22 bp, Homo sapiens
ttaatttttatgtatagtgtgt

SEQ ID NO: 9040089 - DNA, 22 bp, Homo sapiens
ttacaaacaacagacatttatt

SEQ ID NO: 9040090 - DNA, 22 bp, Homo sapiens
ttaatttttatgtatagtgtgt

SEQ ID NO: 9040091 - DNA, 22 bp, Homo sapiens
ttacaaacaacagacatttatt

SEQ ID NO: 9040092 - DNA, 22 bp, Homo sapiens
ttacaaacaacagacatttatt

SEQ ID NO: 9040093 - DNA, 22 bp, Homo sapiens
ttacaaacaacagacatttatt

SEQ ID NO: 9040094 - DNA, 22 bp, Homo sapiens
ttacaaacaacagacatttatt

SEQ ID NO: 9040095 - DNA, 22 bp, Homo sapiens
ttaattttctcatctgtgaaat

SEQ ID NO: 9040096 - DNA, 22 bp, Homo sapiens
ttaattttctcatctgtgaaat

SEQ ID NO: 9040097 - DNA, 22 bp, Homo sapiens
ttaattttctcatctgtgaaat

SEQ ID NO: 9040098 - DNA, 22 bp, Homo sapiens
ttaattttaacctgtttgtgtc

SEQ ID NO: 9040099 - DNA, 22 bp, Homo sapiens
ttaattttctcatctgtgaaat

SEQ ID NO: 9040100 - DNA, 22 bp, Homo sapiens
ttaattttctcatctgtgaaat

SEQ ID NO: 9040101 - DNA, 22 bp, Homo sapiens
ttaattttctcatctgtgaaat

SEQ ID NO: 9040102 - DNA, 21 bp, Homo sapiens
ttaatttattcatgatagcta

SEQ ID NO: 9040103 - DNA, 21 bp, Homo sapiens
ttaatttattcatgatagcta

SEQ ID NO: 9040104 - DNA, 21 bp, Homo sapiens
ttaatttattcatgatagcta

SEQ ID NO: 9040105 - DNA, 22 bp, Homo sapiens
ttaatttatgtccaaaccagat

SEQ ID NO: 9040106 - DNA, 21 bp, Homo sapiens
ttaatttattcatgatagcta

SEQ ID NO: 9040107 - DNA, 21 bp, Homo sapiens
ttaatttattcatgatagcta

SEQ ID NO: 9040108 - DNA, 22 bp, Homo sapiens
ttacaaacaagatcttattctt

SEQ ID NO: 9040109 - DNA, 22 bp, Homo sapiens
ttacaaacaagatcttattctt

SEQ ID NO: 9040110 - DNA, 22 bp, Homo sapiens
ttacaaacaacagacatttatt

SEQ ID NO: 9040111 - DNA, 22 bp, Homo sapiens
ttacaaactgtcatatagtatt

SEQ ID NO: 9040112 - DNA, 22 bp, Homo sapiens
ttacaaactccagtgagtgagc

SEQ ID NO: 9040113 - DNA, 22 bp, Homo sapiens
ttacaaactccagtgagtgagc

SEQ ID NO: 9040114 - DNA, 22 bp, Homo sapiens
ttacaaactccagtgagtgagc

SEQ ID NO: 9040115 - DNA, 22 bp, Homo sapiens
ttacaaactgtcatatagtatt

SEQ ID NO: 9040116 - DNA, 22 bp, Homo sapiens
ttacaaactgtcatatagtatt

SEQ ID NO: 9040117 - DNA, 22 bp, Homo sapiens
ttacaaactgtcatatagtatt

SEQ ID NO: 9040118 - DNA, 22 bp, Homo sapiens
ttacaaagaaaattaggcattt

SEQ ID NO: 9040119 - DNA, 22 bp, Homo sapiens
ttacaaagaaaattaggcattt

SEQ ID NO: 9040120 - DNA, 22 bp, Homo sapiens
ttacacaaacacattccagata

SEQ ID NO: 9040121 - DNA, 22 bp, Homo sapiens
ttacacaaagttagctcttgca

SEQ ID NO: 9040122 - DNA, 22 bp, Homo sapiens
ttacacaacagtgcatcagcag

SEQ ID NO: 9040123 - DNA, 22 bp, Homo sapiens
ttacacaacatctgtattatta

SEQ ID NO: 9040124 - DNA, 22 bp, Homo sapiens
ttacacaagttctttaacctat

SEQ ID NO: 9040125 - DNA, 22 bp, Homo sapiens
ttacacaagttctttaacctat

SEQ ID NO: 9040126 - DNA, 22 bp, Homo sapiens
ttacacaagttctttaacctat

SEQ ID NO: 9040127 - DNA, 22 bp, Homo sapiens
ttacacaagttctttaacctat

SEQ ID NO: 9040128 - DNA, 22 bp, Homo sapiens
ttacacaacatctgtattatta

SEQ ID NO: 9040129 - DNA, 22 bp, Homo sapiens
ttacacaacatctgtattatta

SEQ ID NO: 9040130 - DNA, 22 bp, Homo sapiens
ttacattttggggtaaggataa

SEQ ID NO: 9040131 - DNA, 19 bp, Homo sapiens
ttacatctgcaacactggt

SEQ ID NO: 9040132 - DNA, 22 bp, Homo sapiens
ttacatgaatacataaccattc

SEQ ID NO: 9040133 - DNA, 22 bp, Homo sapiens
ttacatctaaactgtgaacaat

SEQ ID NO: 9040134 - DNA, 17 bp, Homo sapiens
ttacatccttctgaatt

SEQ ID NO: 9040135 - DNA, 22 bp, Homo sapiens
ttacatcattgagacatacata

SEQ ID NO: 9040136 - DNA, 22 bp, Homo sapiens
ttacatcattgagacatacata

SEQ ID NO: 9040137 - DNA, 22 bp, Homo sapiens
ttacatcattgagacatacata

SEQ ID NO: 9040138 - DNA, 22 bp, Homo sapiens
ttacatcactttacttaataat

SEQ ID NO: 9040139 - DNA, 22 bp, Homo sapiens
ttacatcagaaggaaacagcgt

SEQ ID NO: 9040140 - DNA, 22 bp, Homo sapiens
ttacatcagaaggaaacagcgt

SEQ ID NO: 9040141 - DNA, 22 bp, Homo sapiens
ttacatcatgcttatccctttc

SEQ ID NO: 9040142 - DNA, 22 bp, Homo sapiens
ttacatattgtctattgttcaa

SEQ ID NO: 9040143 - DNA, 22 bp, Homo sapiens
ttacatattatccaaaactgct

SEQ ID NO: 9040144 - DNA, 22 bp, Homo sapiens
ttacatattatccaaaactgct

SEQ ID NO: 9040145 - DNA, 22 bp, Homo sapiens
ttacagtattgttaaactcttt

SEQ ID NO: 9040146 - DNA, 22 bp, Homo sapiens
ttacagtcaggcatgaattcag

SEQ ID NO: 9040147 - DNA, 22 bp, Homo sapiens
ttacagtctggattaggaaaca

SEQ ID NO: 9040148 - DNA, 22 bp, Homo sapiens
ttacagtcttaaactcctgggc

SEQ ID NO: 9040149 - DNA, 22 bp, Homo sapiens
ttacagtattggtcacgtttgt

SEQ ID NO: 9040150 - DNA, 22 bp, Homo sapiens
ttacagtattgttaaactcttt

SEQ ID NO: 9040151 - DNA, 22 bp, Homo sapiens
ttacagtattgttaaactcttt

SEQ ID NO: 9040152 - DNA, 22 bp, Homo sapiens
ttacagtatgatcaacttttca

SEQ ID NO: 9040153 - DNA, 22 bp, Homo sapiens
ttacagtattggtcacgtttgt

SEQ ID NO: 9040154 - DNA, 22 bp, Homo sapiens
ttacagtagctttatttggagt

SEQ ID NO: 9040155 - DNA, 23 bp, Homo sapiens
ttacagtaggagttggaaaacca

SEQ ID NO: 9040156 - DNA, 22 bp, Homo sapiens
ttacagtatgatcaacttttca

SEQ ID NO: 9040157 - DNA, 22 bp, Homo sapiens
ttacagtgctcttcaagacttc

SEQ ID NO: 9040158 - DNA, 22 bp, Homo sapiens
ttacatagttaaatagtacagc

SEQ ID NO: 9040159 - DNA, 22 bp, Homo sapiens
ttacatagttaaatagtacagc

SEQ ID NO: 9040160 - DNA, 21 bp, Homo sapiens
ttacaggtcatccaagtcacc

SEQ ID NO: 9040161 - DNA, 22 bp, Homo sapiens
ttacaggtgggaaaactaagct

SEQ ID NO: 9040162 - DNA, 22 bp, Homo sapiens
ttacaggtggagaagtaaggct

SEQ ID NO: 9040163 - DNA, 22 bp, Homo sapiens
ttacagtaacattttcagtctg

SEQ ID NO: 9040164 - DNA, 22 bp, Homo sapiens
ttacaggtgggaaaactaagct

SEQ ID NO: 9040165 - DNA, 22 bp, Homo sapiens
ttacaggttaagtgacacttaa

SEQ ID NO: 9040166 - DNA, 22 bp, Homo sapiens
ttacagtacagaaaataacaga

SEQ ID NO: 9040167 - DNA, 22 bp, Homo sapiens
ttacagtaatgtattatttaac

SEQ ID NO: 9040168 - DNA, 22 bp, Homo sapiens
ttacagtaatcgagtgttgtgg

SEQ ID NO: 9040169 - DNA, 22 bp, Homo sapiens
ttacagtaacattttcagtctg

SEQ ID NO: 9040170 - DNA, 22 bp, Homo sapiens
ttacagtagattttgaatgtgg

SEQ ID NO: 9040171 - DNA, 22 bp, Homo sapiens
ttacagtagatacaatgagtaa

SEQ ID NO: 9040172 - DNA, 22 bp, Homo sapiens
ttacagtacctgtatggccact

SEQ ID NO: 9040173 - DNA, 22 bp, Homo sapiens
ttacagtagattttgaatgtgg

SEQ ID NO: 9040174 - DNA, 22 bp, Homo sapiens
ttacagtagatacaatgagtaa

SEQ ID NO: 9040175 - DNA, 22 bp, Homo sapiens
ttacacttacctgtccattgaa

SEQ ID NO: 9040176 - DNA, 22 bp, Homo sapiens
ttacacttagggtttgtcagag

SEQ ID NO: 9040177 - DNA, 22 bp, Homo sapiens
ttacacttctaaaaaaagcagg

SEQ ID NO: 9040178 - DNA, 22 bp, Homo sapiens
ttacacttctaaaaaaagcagg

SEQ ID NO: 9040179 - DNA, 22 bp, Homo sapiens
ttacacttgaaaacaggattta

SEQ ID NO: 9040180 - DNA, 22 bp, Homo sapiens
ttacacttctgaaagcctaggt

SEQ ID NO: 9040181 - DNA, 19 bp, Homo sapiens
ttacacttctgctttgtga

SEQ ID NO: 9040182 - DNA, 22 bp, Homo sapiens
ttacacttgtaattatataacg

SEQ ID NO: 9040183 - DNA, 22 bp, Homo sapiens
ttacacttgtaaatggcatgta

SEQ ID NO: 9040184 - DNA, 22 bp, Homo sapiens
ttacacttgggtgtggatttta

SEQ ID NO: 9040185 - DNA, 22 bp, Homo sapiens
ttacagggatcccataaatgtc

SEQ ID NO: 9040186 - DNA, 22 bp, Homo sapiens
ttacactttggcaagctattaa

SEQ ID NO: 9040187 - DNA, 22 bp, Homo sapiens
ttacaggaggtgctaggtgttt

SEQ ID NO: 9040188 - DNA, 22 bp, Homo sapiens
ttacactttggcaagctattaa

SEQ ID NO: 9040189 - DNA, 22 bp, Homo sapiens
ttacactttaaatccagcttgt

SEQ ID NO: 9040190 - DNA, 22 bp, Homo sapiens
ttagacatagaatattgtctag

SEQ ID NO: 9040191 - DNA, 22 bp, Homo sapiens
ttagaagtaaggtcagatttct

SEQ ID NO: 9040192 - DNA, 19 bp, Homo sapiens
ttagaagccataggtacag

SEQ ID NO: 9040193 - DNA, 19 bp, Homo sapiens
ttagaagccataggtacag

SEQ ID NO: 9040194 - DNA, 21 bp, Homo sapiens
ttagaagctaatgcagctggt

SEQ ID NO: 9040195 - DNA, 22 bp, Homo sapiens
ttagaagccaggatggagcagg

SEQ ID NO: 9040196 - DNA, 22 bp, Homo sapiens
ttagaagcatcacctgttctgg

SEQ ID NO: 9040197 - DNA, 22 bp, Homo sapiens
ttagaagcaggctgtgtcccca

SEQ ID NO: 9040198 - DNA, 21 bp, Homo sapiens
ttagaaagctcactacagtta

SEQ ID NO: 9040199 - DNA, 22 bp, Homo sapiens
ttagaaagctttccatagtcaa

SEQ ID NO: 9040200 - DNA, 22 bp, Homo sapiens
ttagactttaagctgggtgcag

SEQ ID NO: 9040201 - DNA, 22 bp, Homo sapiens
ttagacatgtttgctaaaatga

SEQ ID NO: 9040202 - DNA, 22 bp, Homo sapiens
ttagagaaaagcttgcttgctt

SEQ ID NO: 9040203 - DNA, 22 bp, Homo sapiens
ttagacatgtttgctaaaatga

SEQ ID NO: 9040204 - DNA, 22 bp, Homo sapiens
ttagacatcagtgcttctcagc

SEQ ID NO: 9040205 - DNA, 22 bp, Homo sapiens
ttagacatcagtgcttctcagc

SEQ ID NO: 9040206 - DNA, 22 bp, Homo sapiens
ttagacatagaatattgtctag

SEQ ID NO: 9040207 - DNA, 22 bp, Homo sapiens
ttagagaaagggtttgattccg

SEQ ID NO: 9040208 - DNA, 22 bp, Homo sapiens
ttagagaaccaatgaatagtct

SEQ ID NO: 9040209 - DNA, 17 bp, Homo sapiens
ttagagctacatgttga

SEQ ID NO: 9040210 - DNA, 17 bp, Homo sapiens
ttagagctacatgttga

SEQ ID NO: 9040211 - DNA, 22 bp, Homo sapiens
ttagagccccagaaaacagtgg

SEQ ID NO: 9040212 - DNA, 22 bp, Homo sapiens
ttagagctagatgaggtcatga

SEQ ID NO: 9040213 - DNA, 22 bp, Homo sapiens
ttagagctgatagtacactggt

SEQ ID NO: 9040214 - DNA, 22 bp, Homo sapiens
ttagagctgatagtacactggt

SEQ ID NO: 9040215 - DNA, 22 bp, Homo sapiens
ttagagccccagaaaacagtgg

SEQ ID NO: 9040216 - DNA, 22 bp, Homo sapiens
ttagagccagttacaaggtcaa

SEQ ID NO: 9040217 - DNA, 22 bp, Homo sapiens
ttagagatttgtctgatagtag

SEQ ID NO: 9040218 - DNA, 22 bp, Homo sapiens
ttagagattgtctagtattgtg

SEQ ID NO: 9040219 - DNA, 22 bp, Homo sapiens
ttagagattgtctagtattgtg

SEQ ID NO: 9040220 - DNA, 22 bp, Homo sapiens
ttagaggggctgctgaatggga

SEQ ID NO: 9040221 - DNA, 22 bp, Homo sapiens
ttagaggactgtaggtgggaat

SEQ ID NO: 9040222 - DNA, 22 bp, Homo sapiens
ttagaggggctgctgaatggga

SEQ ID NO: 9040223 - DNA, 22 bp, Homo sapiens
ttagaggactgtaggtgggaat

SEQ ID NO: 9040224 - DNA, 22 bp, Homo sapiens
ttagaggatatcatcagcctac

SEQ ID NO: 9040225 - DNA, 22 bp, Homo sapiens
ttagaggacaagaggcctggct

SEQ ID NO: 9040226 - DNA, 22 bp, Homo sapiens
ttagaggaaagtgactccgatg

SEQ ID NO: 9040227 - DNA, 22 bp, Homo sapiens
ttagaggaattattttctgctg

SEQ ID NO: 9040228 - DNA, 22 bp, Homo sapiens
ttagagctgggatggattttcc

SEQ ID NO: 9040229 - DNA, 22 bp, Homo sapiens
ttagaggacaagaggcctggct

SEQ ID NO: 9040230 - DNA, 22 bp, Homo sapiens
ttagaggaaagactgggactaa

SEQ ID NO: 9040231 - DNA, 22 bp, Homo sapiens
ttagaggaaagtgactccgatg

SEQ ID NO: 9040232 - DNA, 22 bp, Homo sapiens
ttagaggaaagactgggactaa

SEQ ID NO: 9040233 - DNA, 22 bp, Homo sapiens
ttagagaagttttacttaagaa

SEQ ID NO: 9040234 - DNA, 22 bp, Homo sapiens
ttagagaagctgtaattattca

SEQ ID NO: 9040235 - DNA, 22 bp, Homo sapiens
ttagagaagctgtaattattca

SEQ ID NO: 9040236 - DNA, 22 bp, Homo sapiens
ttagagaattccaaatgactac

SEQ ID NO: 9040237 - DNA, 22 bp, Homo sapiens
ttagagacaggcttcccaagga

SEQ ID NO: 9040238 - DNA, 22 bp, Homo sapiens
ttagagattgtctagtattgtg

SEQ ID NO: 9040239 - DNA, 22 bp, Homo sapiens
ttagagattggttgacagattt

SEQ ID NO: 9040240 - DNA, 22 bp, Homo sapiens
ttagagatgtcccaaaatgaag

SEQ ID NO: 9040241 - DNA, 22 bp, Homo sapiens
ttagagatgtcccaaaatgaag

SEQ ID NO: 9040242 - DNA, 22 bp, Homo sapiens
ttagagatacatttgtagcttg

SEQ ID NO: 9040243 - DNA, 23 bp, Homo sapiens
ttagagatgattaaaaaatcttg

SEQ ID NO: 9040244 - DNA, 22 bp, Homo sapiens
ttagagatacatttgtagcttg

SEQ ID NO: 9040245 - DNA, 22 bp, Homo sapiens
ttagagagaaccatcaggatct

SEQ ID NO: 9040246 - DNA, 22 bp, Homo sapiens
ttactttgggtcctgcttataa

SEQ ID NO: 9040247 - DNA, 22 bp, Homo sapiens
ttactttgggtcctgcttataa

SEQ ID NO: 9040248 - DNA, 18 bp, Homo sapiens
ttactttgtatagcctag

SEQ ID NO: 9040249 - DNA, 22 bp, Homo sapiens
ttactttgttctcaagatatgt

SEQ ID NO: 9040250 - DNA, 22 bp, Homo sapiens
ttactttgctttctcattacag

SEQ ID NO: 9040251 - DNA, 22 bp, Homo sapiens
ttactttggcaaactcctgccc

SEQ ID NO: 9040252 - DNA, 22 bp, Homo sapiens
ttactttggatggtcaagaaag

SEQ ID NO: 9040253 - DNA, 22 bp, Homo sapiens
ttactttccagctctagcttca

SEQ ID NO: 9040254 - DNA, 22 bp, Homo sapiens
ttactttcagttaggcaggagc

SEQ ID NO: 9040255 - DNA, 22 bp, Homo sapiens
ttactttgatgatcaatgagcg

SEQ ID NO: 9040256 - DNA, 22 bp, Homo sapiens
ttactttatgtgatggattagt

SEQ ID NO: 9040257 - DNA, 22 bp, Homo sapiens
ttactttatgtgatggattagt

SEQ ID NO: 9040258 - DNA, 22 bp, Homo sapiens
ttactttatctcctagattcca

SEQ ID NO: 9040259 - DNA, 22 bp, Homo sapiens
ttactttatctcctagattcca

SEQ ID NO: 9040260 - DNA, 22 bp, Homo sapiens
ttactttatagaacactggggg

SEQ ID NO: 9040261 - DNA, 22 bp, Homo sapiens
ttactttagggatgttttgctt

SEQ ID NO: 9040262 - DNA, 20 bp, Homo sapiens
ttagaaagagcgtgataaga

SEQ ID NO: 9040263 - DNA, 22 bp, Homo sapiens
ttagaaagaatagcctggctgc

SEQ ID NO: 9040264 - DNA, 20 bp, Homo sapiens
ttagaaagagcgtgataaga

SEQ ID NO: 9040265 - DNA, 22 bp, Homo sapiens
ttagaaagagtataccagaaac

SEQ ID NO: 9040266 - DNA, 21 bp, Homo sapiens
ttagaaagctcactacagtta

SEQ ID NO: 9040267 - DNA, 21 bp, Homo sapiens
ttagaaagctcactacagtta

SEQ ID NO: 9040268 - DNA, 22 bp, Homo sapiens
ttagaaactttggaggatagat

SEQ ID NO: 9040269 - DNA, 22 bp, Homo sapiens
ttagaaagaactttagatatca

SEQ ID NO: 9040270 - DNA, 22 bp, Homo sapiens
ttagaaactttggaggatagat

SEQ ID NO: 9040271 - DNA, 22 bp, Homo sapiens
ttagaaagaactttagatatca

SEQ ID NO: 9040272 - DNA, 22 bp, Homo sapiens
ttagaaagaactttagatatca

SEQ ID NO: 9040273 - DNA, 22 bp, Homo sapiens
ttagaaagaactttagatatca

SEQ ID NO: 9040274 - DNA, 22 bp, Homo sapiens
ttagaaagaactttagatatca

SEQ ID NO: 9040275 - DNA, 22 bp, Homo sapiens
ttagaaagaactttagatatca

SEQ ID NO: 9040276 - DNA, 22 bp, Homo sapiens
ttagaaacccagactcttaggt

SEQ ID NO: 9040277 - DNA, 22 bp, Homo sapiens
ttagaaacaaaatagttatttg

SEQ ID NO: 9040278 - DNA, 22 bp, Homo sapiens
ttagaaacaaaatagttatttg

SEQ ID NO: 9040279 - DNA, 19 bp, Homo sapiens
ttagaaactgttgacactg

SEQ ID NO: 9040280 - DNA, 22 bp, Homo sapiens
ttagaaactcaactctgggaat

SEQ ID NO: 9040281 - DNA, 19 bp, Homo sapiens
ttagaaactgttgacactg

SEQ ID NO: 9040282 - DNA, 22 bp, Homo sapiens
ttacttttctattcgatatgtg

SEQ ID NO: 9040283 - DNA, 22 bp, Homo sapiens
ttactttgtttgcacttcacct

SEQ ID NO: 9040284 - DNA, 22 bp, Homo sapiens
ttagaaaatttgcttctttgga

SEQ ID NO: 9040285 - DNA, 22 bp, Homo sapiens
ttagaaaatttgcttctttgga

SEQ ID NO: 9040286 - DNA, 22 bp, Homo sapiens
ttagaaaatttgcttctttgga

SEQ ID NO: 9040287 - DNA, 21 bp, Homo sapiens
ttactttagaaattgcctttt

SEQ ID NO: 9040288 - DNA, 22 bp, Homo sapiens
ttactttaagggtgtcttatta

SEQ ID NO: 9040289 - DNA, 22 bp, Homo sapiens
ttactttagatcatactgtgtg

SEQ ID NO: 9040290 - DNA, 22 bp, Homo sapiens
ttactttaagggtgtcttatta

SEQ ID NO: 9040291 - DNA, 22 bp, Homo sapiens
ttactttagaaatagtcatcaa

SEQ ID NO: 9040292 - DNA, 22 bp, Homo sapiens
ttactttagaaatagtcatcaa

SEQ ID NO: 9040293 - DNA, 22 bp, Homo sapiens
ttactttaagggtgtcttatta

SEQ ID NO: 9040294 - DNA, 22 bp, Homo sapiens
ttacttggtgttctgcccagga

SEQ ID NO: 9040295 - DNA, 22 bp, Homo sapiens
ttacttggtgttctgcccagga

SEQ ID NO: 9040296 - DNA, 22 bp, Homo sapiens
ttacttgatgtatgatgagtag

SEQ ID NO: 9040297 - DNA, 22 bp, Homo sapiens
ttacttgcttataatcaaaaca

SEQ ID NO: 9040298 - DNA, 22 bp, Homo sapiens
ttacttggaggcctgttaccag

SEQ ID NO: 9040299 - DNA, 22 bp, Homo sapiens
ttacttgattgtggagtctgag

SEQ ID NO: 9040300 - DNA, 22 bp, Homo sapiens
ttacttgacataaatgagttta

SEQ ID NO: 9040301 - DNA, 22 bp, Homo sapiens
ttacttaaacagaaatgcagaa

SEQ ID NO: 9040302 - DNA, 22 bp, Homo sapiens
ttacttaaacagaaatgcagaa

SEQ ID NO: 9040303 - DNA, 22 bp, Homo sapiens
ttacttaaacagaaatgcagaa

SEQ ID NO: 9040304 - DNA, 22 bp, Homo sapiens
ttacttacagacagtagactct

SEQ ID NO: 9040305 - DNA, 22 bp, Homo sapiens
ttacttaaacagaaatgcagaa

SEQ ID NO: 9040306 - DNA, 22 bp, Homo sapiens
ttacttaaaaattctaagcccc

SEQ ID NO: 9040307 - DNA, 22 bp, Homo sapiens
ttactgttcatgttgtacactt

SEQ ID NO: 9040308 - DNA, 18 bp, Homo sapiens
ttactgttatcaaaacag

SEQ ID NO: 9040309 - DNA, 19 bp, Homo sapiens
ttacttcaggagtgaaatt

SEQ ID NO: 9040310 - DNA, 19 bp, Homo sapiens
ttacttcaggagtgaaatt

SEQ ID NO: 9040311 - DNA, 22 bp, Homo sapiens
ttacttattaccaccaatgccg

SEQ ID NO: 9040312 - DNA, 20 bp, Homo sapiens
ttactgtagtactacatttt

SEQ ID NO: 9040313 - DNA, 22 bp, Homo sapiens
ttactgtagcttgacatatgtc

SEQ ID NO: 9040314 - DNA, 22 bp, Homo sapiens
ttactgtaaaggtcacatggtg

SEQ ID NO: 9040315 - DNA, 22 bp, Homo sapiens
ttactgctgttaggatattttt

SEQ ID NO: 9040316 - DNA, 22 bp, Homo sapiens
ttactgctaattctgtaggttt

SEQ ID NO: 9040317 - DNA, 22 bp, Homo sapiens
ttactgcaacataatgtagtct

SEQ ID NO: 9040318 - DNA, 22 bp, Homo sapiens
ttactggctgggcctgagggct

SEQ ID NO: 9040319 - DNA, 22 bp, Homo sapiens
ttactggctgggcctgagggct

SEQ ID NO: 9040320 - DNA, 21 bp, Homo sapiens
ttactggctctcaagtcagct

SEQ ID NO: 9040321 - DNA, 22 bp, Homo sapiens
ttactgggaatgttatggagaa

SEQ ID NO: 9040322 - DNA, 22 bp, Homo sapiens
ttactgaaggtggatagtgagt

SEQ ID NO: 9040323 - DNA, 22 bp, Homo sapiens
ttactgaaggtggatagtgagt

SEQ ID NO: 9040324 - DNA, 22 bp, Homo sapiens
ttactgaaggtggatagtgagt

SEQ ID NO: 9040325 - DNA, 22 bp, Homo sapiens
ttactgaattgcactccagcgt

SEQ ID NO: 9040326 - DNA, 22 bp, Homo sapiens
ttactgaattgcactccagcgt

SEQ ID NO: 9040327 - DNA, 22 bp, Homo sapiens
ttactgaaataatgaaacacat

SEQ ID NO: 9040328 - DNA, 22 bp, Homo sapiens
ttactgaaagtatacatttctg

SEQ ID NO: 9040329 - DNA, 22 bp, Homo sapiens
ttactgaaccctacttttacag

SEQ ID NO: 9040330 - DNA, 22 bp, Homo sapiens
ttactgaaataatgaaacacat

SEQ ID NO: 9040331 - DNA, 22 bp, Homo sapiens
ttactgaaataatgaaacacat

SEQ ID NO: 9040332 - DNA, 19 bp, Homo sapiens
ttactcgagaatgactaca

SEQ ID NO: 9040333 - DNA, 20 bp, Homo sapiens
ttactcataggaccacaagc

SEQ ID NO: 9040334 - DNA, 22 bp, Homo sapiens
ttactgaaaattcttcaggatt

SEQ ID NO: 9040335 - DNA, 22 bp, Homo sapiens
ttactgaaaattcttcaggatt

SEQ ID NO: 9040336 - DNA, 22 bp, Homo sapiens
ttactagtatatgtcaagcaac

SEQ ID NO: 9040337 - DNA, 22 bp, Homo sapiens
ttacattttggggtaaggataa

SEQ ID NO: 9040338 - DNA, 22 bp, Homo sapiens
ttacattttggggtaaggataa

SEQ ID NO: 9040339 - DNA, 22 bp, Homo sapiens
ttaccaaatcccgtgcacattc

SEQ ID NO: 9040340 - DNA, 22 bp, Homo sapiens
ttaccaaatcccgtgcacattc

SEQ ID NO: 9040341 - DNA, 22 bp, Homo sapiens
ttaccaaatgaaatagagattt

SEQ ID NO: 9040342 - DNA, 22 bp, Homo sapiens
ttactacagagagagctccagt

SEQ ID NO: 9040343 - DNA, 23 bp, Homo sapiens
ttactacacaagtaacgattccc

SEQ ID NO: 9040344 - DNA, 22 bp, Homo sapiens
ttactagccatgtgtgagaaga

SEQ ID NO: 9040345 - DNA, 22 bp, Homo sapiens
ttactagccatgtgtgagaaga

SEQ ID NO: 9040346 - DNA, 22 bp, Homo sapiens
ttactagctgagggaacttggg

SEQ ID NO: 9040347 - DNA, 22 bp, Homo sapiens
ttactacattgtaacacagtac

SEQ ID NO: 9040348 - DNA, 22 bp, Homo sapiens
ttactacattgtaacacagtac

SEQ ID NO: 9040349 - DNA, 22 bp, Homo sapiens
ttaagtgtagtgctaagggcag

SEQ ID NO: 9040350 - DNA, 22 bp, Homo sapiens
ttaagtgcttcaagggaagctc

SEQ ID NO: 9040351 - DNA, 22 bp, Homo sapiens
ttaagtgcttcaagggaagctc

SEQ ID NO: 9040352 - DNA, 22 bp, Homo sapiens
ttaagtgtagtgctaagggcag

SEQ ID NO: 9040353 - DNA, 22 bp, Homo sapiens
ttaagtgtcataatttccaaga

SEQ ID NO: 9040354 - DNA, 21 bp, Homo sapiens
ttaagtgtttctccattgtta

SEQ ID NO: 9040355 - DNA, 22 bp, Homo sapiens
ttaagtgcaaaaatgaaagtat

SEQ ID NO: 9040356 - DNA, 22 bp, Homo sapiens
ttaagtgcaaaaatgaaagtat

SEQ ID NO: 9040357 - DNA, 22 bp, Homo sapiens
ttaagtgccagtgctccctcag

SEQ ID NO: 9040358 - DNA, 22 bp, Homo sapiens
ttaagtgcacaatgaggtcaca

SEQ ID NO: 9040359 - DNA, 22 bp, Homo sapiens
ttaagtgcaaaaatgaaagtat

SEQ ID NO: 9040360 - DNA, 23 bp, Homo sapiens
ttaagtggtcagttttagacaac

SEQ ID NO: 9040361 - DNA, 18 bp, Homo sapiens
ttaagtgctatgcaattg

SEQ ID NO: 9040362 - DNA, 18 bp, Homo sapiens
ttaagtgctatgcaattg

SEQ ID NO: 9040363 - DNA, 22 bp, Homo sapiens
ttaagtgcctctaaaacaagcc

SEQ ID NO: 9040364 - DNA, 22 bp, Homo sapiens
ttaagtgcctacttgtgagtta

SEQ ID NO: 9040365 - DNA, 22 bp, Homo sapiens
ttaagtgcctctaaaacaagcc

SEQ ID NO: 9040366 - DNA, 22 bp, Homo sapiens
ttaagtgcctctaaaacaagcc

SEQ ID NO: 9040367 - DNA, 22 bp, Homo sapiens
ttaagtatatccatttgactgg

SEQ ID NO: 9040368 - DNA, 22 bp, Homo sapiens
ttaagtatatccatttgactgg

SEQ ID NO: 9040369 - DNA, 22 bp, Homo sapiens
ttaagtacagggttagtgacgg

SEQ ID NO: 9040370 - DNA, 22 bp, Homo sapiens
ttaagtacagggttagtgacgg

SEQ ID NO: 9040371 - DNA, 22 bp, Homo sapiens
ttaagtaacttgtccaaatgag

SEQ ID NO: 9040372 - DNA, 22 bp, Homo sapiens
ttaagtaagaccttatgtcttg

SEQ ID NO: 9040373 - DNA, 22 bp, Homo sapiens
ttaagtaacttgtccaaatgag

SEQ ID NO: 9040374 - DNA, 22 bp, Homo sapiens
ttaagtcatttctgattataga

SEQ ID NO: 9040375 - DNA, 22 bp, Homo sapiens
ttaagtccttggtaattttctt

SEQ ID NO: 9040376 - DNA, 22 bp, Homo sapiens
ttaagtgagcttgaataatctt

SEQ ID NO: 9040377 - DNA, 22 bp, Homo sapiens
ttaaggctggtcccctctgcgt

SEQ ID NO: 9040378 - DNA, 21 bp, Homo sapiens
ttaaggtcacttctgagccta

SEQ ID NO: 9040379 - DNA, 22 bp, Homo sapiens
ttaagggccattatggatgggt

SEQ ID NO: 9040380 - DNA, 22 bp, Homo sapiens
ttaagggccattatggatgggt

SEQ ID NO: 9040381 - DNA, 22 bp, Homo sapiens
ttaagggccattatggatgggt

SEQ ID NO: 9040382 - DNA, 22 bp, Homo sapiens
ttaagggccattatggatgggt

SEQ ID NO: 9040383 - DNA, 22 bp, Homo sapiens
ttaaggtgctttatttagctct

SEQ ID NO: 9040384 - DNA, 22 bp, Homo sapiens
ttaaggtagtcagcctctgtgt

SEQ ID NO: 9040385 - DNA, 17 bp, Homo sapiens
ttaaggtggatcagcac

SEQ ID NO: 9040386 - DNA, 22 bp, Homo sapiens
ttaaggttcagtgtggcaggac

SEQ ID NO: 9040387 - DNA, 23 bp, Homo sapiens
ttaaggttcagctttcccatgac

SEQ ID NO: 9040388 - DNA, 22 bp, Homo sapiens
ttaaggttaaataaggtcataa

SEQ ID NO: 9040389 - DNA, 22 bp, Homo sapiens
ttaaggttaaataaggtcatat

SEQ ID NO: 9040390 - DNA, 22 bp, Homo sapiens
ttaaggaatttatagttgtact

SEQ ID NO: 9040391 - DNA, 22 bp, Homo sapiens
ttaaggaattacgaaaatattt

SEQ ID NO: 9040392 - DNA, 22 bp, Homo sapiens
ttaaggaattacgaaaatattt

SEQ ID NO: 9040393 - DNA, 22 bp, Homo sapiens
ttaaggcattgatatggtgcta

SEQ ID NO: 9040394 - DNA, 22 bp, Homo sapiens
ttaaggcattctcctactaata

SEQ ID NO: 9040395 - DNA, 22 bp, Homo sapiens
ttaaggcacagagaggttaagt

SEQ ID NO: 9040396 - DNA, 22 bp, Homo sapiens
ttaaggattagtcaaagagggc

SEQ ID NO: 9040397 - DNA, 22 bp, Homo sapiens
ttaatttatgtccaaaccagat

SEQ ID NO: 9040398 - DNA, 22 bp, Homo sapiens
ttaatttatgtccaaaccagat

SEQ ID NO: 9040399 - DNA, 22 bp, Homo sapiens
ttaatttatgtccaaaccagat

SEQ ID NO: 9040400 - DNA, 22 bp, Homo sapiens
ttaatttatacataatcacagg

SEQ ID NO: 9040401 - DNA, 22 bp, Homo sapiens
ttaatttatacataatcacagg

SEQ ID NO: 9040402 - DNA, 22 bp, Homo sapiens
ttaatttatacataatcacagg

SEQ ID NO: 9040403 - DNA, 22 bp, Homo sapiens
ttaatttatacataatcacagg

SEQ ID NO: 9040404 - DNA, 22 bp, Homo sapiens
ttaattgttggaaatagattat

SEQ ID NO: 9040405 - DNA, 22 bp, Homo sapiens
ttaatttaagaaacggcaggcc

SEQ ID NO: 9040406 - DNA, 22 bp, Homo sapiens
ttaatttatacataatcacagg

SEQ ID NO: 9040407 - DNA, 22 bp, Homo sapiens
ttaattgatataaagaacttca

SEQ ID NO: 9040408 - DNA, 22 bp, Homo sapiens
ttaattgtctgtgagtacctga

SEQ ID NO: 9040409 - DNA, 22 bp, Homo sapiens
ttaattgtaaagtttgcctgtt

SEQ ID NO: 9040410 - DNA, 22 bp, Homo sapiens
ttaattcttccggactgtgaaa

SEQ ID NO: 9040411 - DNA, 22 bp, Homo sapiens
ttaattgagccagaaagtatct

SEQ ID NO: 9040412 - DNA, 22 bp, Homo sapiens
ttaattctgcctttcatgtaac

SEQ ID NO: 9040413 - DNA, 22 bp, Homo sapiens
ttaattctgcctttcatgtaac

SEQ ID NO: 9040414 - DNA, 22 bp, Homo sapiens
ttaattctgcctttcatgtaac

SEQ ID NO: 9040415 - DNA, 22 bp, Homo sapiens
ttaattctagtttaacacttag

SEQ ID NO: 9040416 - DNA, 22 bp, Homo sapiens
ttaattctagtttaacacttag

SEQ ID NO: 9040417 - DNA, 22 bp, Homo sapiens
ttaattagtagaggcatttagt

SEQ ID NO: 9040418 - DNA, 22 bp, Homo sapiens
ttaattatgagaaagggaaaag

SEQ ID NO: 9040419 - DNA, 22 bp, Homo sapiens
ttaattatgagaaagggaaaag

SEQ ID NO: 9040420 - DNA, 22 bp, Homo sapiens
ttaattagtagaggcatttagt

SEQ ID NO: 9040421 - DNA, 22 bp, Homo sapiens
ttaattatgcaaaaggccccat

SEQ ID NO: 9040422 - DNA, 22 bp, Homo sapiens
ttaattcagtcaaagaaaccat

SEQ ID NO: 9040423 - DNA, 22 bp, Homo sapiens
ttaattcagtcaaagaaaccat

SEQ ID NO: 9040424 - DNA, 22 bp, Homo sapiens
ttaattaattagttaagcatgt

SEQ ID NO: 9040425 - DNA, 22 bp, Homo sapiens
ttaattacaaaacacataggtt

SEQ ID NO: 9040426 - DNA, 22 bp, Homo sapiens
ttaattactggcatggtggttg

SEQ ID NO: 9040427 - DNA, 22 bp, Homo sapiens
ttaattagagctgatgttcata

SEQ ID NO: 9040428 - DNA, 22 bp, Homo sapiens
ttaattactaagcacaatgcaa

SEQ ID NO: 9040429 - DNA, 22 bp, Homo sapiens
ttaattactaagcacaatgcaa

SEQ ID NO: 9040430 - DNA, 22 bp, Homo sapiens
ttaataaacaggtgcagctgaa

SEQ ID NO: 9040431 - DNA, 22 bp, Homo sapiens
ttaataaacaggtgcagctgaa

SEQ ID NO: 9040432 - DNA, 22 bp, Homo sapiens
ttaataaacaggtgcagctgaa

SEQ ID NO: 9040433 - DNA, 22 bp, Homo sapiens
ttaataaacaggtgcagctgaa

SEQ ID NO: 9040434 - DNA, 22 bp, Homo sapiens
ttaataaacaggtgcagctgaa

SEQ ID NO: 9040435 - DNA, 22 bp, Homo sapiens
ttaataaacaggtgcagctgaa

SEQ ID NO: 9040436 - DNA, 22 bp, Homo sapiens
ttaataaacaggtgcagctgaa

SEQ ID NO: 9040437 - DNA, 22 bp, Homo sapiens
ttaattaattagttaagcatgt

SEQ ID NO: 9040438 - DNA, 22 bp, Homo sapiens
ttaattaattagttaagcatgt

SEQ ID NO: 9040439 - DNA, 22 bp, Homo sapiens
ttaataaacaggtgcagctgaa

SEQ ID NO: 9040440 - DNA, 22 bp, Homo sapiens
ttaataaacaggtgcagctgaa

SEQ ID NO: 9040441 - DNA, 22 bp, Homo sapiens
ttaataaacaggtgcagctgaa

SEQ ID NO: 9040442 - DNA, 22 bp, Homo sapiens
ttaataaacaggtgcagctgaa

SEQ ID NO: 9040443 - DNA, 22 bp, Homo sapiens
ttaataaacaggtgcagctgaa

SEQ ID NO: 9040444 - DNA, 22 bp, Homo sapiens
ttaactgtgacagtttctcaga

SEQ ID NO: 9040445 - DNA, 22 bp, Homo sapiens
ttaactgttccaaatgctgtag

SEQ ID NO: 9040446 - DNA, 22 bp, Homo sapiens
ttaactgtgacagtttctcaga

SEQ ID NO: 9040447 - DNA, 22 bp, Homo sapiens
ttaactgtatcatactgtttca

SEQ ID NO: 9040448 - DNA, 22 bp, Homo sapiens
ttaactggggaagcatttcatg

SEQ ID NO: 9040449 - DNA, 22 bp, Homo sapiens
ttaacgaattgtgcataattcc

SEQ ID NO: 9040450 - DNA, 22 bp, Homo sapiens
ttaacgaattgtgcataattcc

SEQ ID NO: 9040451 - DNA, 22 bp, Homo sapiens
ttaactctccctccttacatcc

SEQ ID NO: 9040452 - DNA, 22 bp, Homo sapiens
ttaactctccctccttacatcc

SEQ ID NO: 9040453 - DNA, 22 bp, Homo sapiens
ttaacctaactcatggaaaaca

SEQ ID NO: 9040454 - DNA, 22 bp, Homo sapiens
ttaacctaaagaaggatgtgtg

SEQ ID NO: 9040455 - DNA, 22 bp, Homo sapiens
ttaaccagtacttattgagcac

SEQ ID NO: 9040456 - DNA, 22 bp, Homo sapiens
ttaaccaaataaaagcagactc

SEQ ID NO: 9040457 - DNA, 22 bp, Homo sapiens
ttaaccaaataaaagcagactc

SEQ ID NO: 9040458 - DNA, 22 bp, Homo sapiens
ttaaccaggacatcagatggct

SEQ ID NO: 9040459 - DNA, 22 bp, Homo sapiens
ttaacatttcttttccactcat

SEQ ID NO: 9040460 - DNA, 22 bp, Homo sapiens
ttaacatttgtgaagcatttag

SEQ ID NO: 9040461 - DNA, 22 bp, Homo sapiens
ttaacatttgtgaagcatttag

SEQ ID NO: 9040462 - DNA, 22 bp, Homo sapiens
ttaacattgtccttagcagatt

SEQ ID NO: 9040463 - DNA, 22 bp, Homo sapiens
ttaacatttagtgtacccctgt

SEQ ID NO: 9040464 - DNA, 22 bp, Homo sapiens
ttaacattgtccttagcagatt

SEQ ID NO: 9040465 - DNA, 22 bp, Homo sapiens
ttaacattgtccttagcagatt

SEQ ID NO: 9040466 - DNA, 22 bp, Homo sapiens
ttaacattaaaagcagcatttt

SEQ ID NO: 9040467 - DNA, 22 bp, Homo sapiens
ttaacattaaaagcagcatttt

SEQ ID NO: 9040468 - DNA, 22 bp, Homo sapiens
ttaacatgtcttgacttcatct

SEQ ID NO: 9040469 - DNA, 22 bp, Homo sapiens
ttaacatgtcttgacttcatct

SEQ ID NO: 9040470 - DNA, 22 bp, Homo sapiens
ttaacatgtcttgacttcatct

SEQ ID NO: 9040471 - DNA, 22 bp, Homo sapiens
ttaacatgtcttgacttcatct

SEQ ID NO: 9040472 - DNA, 22 bp, Homo sapiens
ttaacatacatcatgaacaatg

SEQ ID NO: 9040473 - DNA, 22 bp, Homo sapiens
ttaacagtggctaagactgagg

SEQ ID NO: 9040474 - DNA, 22 bp, Homo sapiens
ttaacatacatcatgaacaatg

SEQ ID NO: 9040475 - DNA, 22 bp, Homo sapiens
ttaacatacatcatgaacaatg

SEQ ID NO: 9040476 - DNA, 22 bp, Homo sapiens
ttaacatacatcatgaacaatg

SEQ ID NO: 9040477 - DNA, 22 bp, Homo sapiens
ttaacatacatcatgaacaatg

SEQ ID NO: 9040478 - DNA, 22 bp, Homo sapiens
ttaacatcctgtttaaatttgg

SEQ ID NO: 9040479 - DNA, 22 bp, Homo sapiens
ttaacaggagtaactctagaaa

SEQ ID NO: 9040480 - DNA, 23 bp, Homo sapiens
ttaacaggatctcgggcaagagg

SEQ ID NO: 9040481 - DNA, 22 bp, Homo sapiens
ttaacagctttgggtctgatat

SEQ ID NO: 9040482 - DNA, 22 bp, Homo sapiens
ttaacaggttatattgtacagg

SEQ ID NO: 9040483 - DNA, 19 bp, Homo sapiens
ttaacagtcaccaaggaga

SEQ ID NO: 9040484 - DNA, 22 bp, Homo sapiens
ttaacagtggctaagactgagg

SEQ ID NO: 9040485 - DNA, 22 bp, Homo sapiens
ttaacagacatatatatttgta

SEQ ID NO: 9040486 - DNA, 22 bp, Homo sapiens
ttaacactcctaactacagtct

SEQ ID NO: 9040487 - DNA, 22 bp, Homo sapiens
ttaacactatctgtcataatta

SEQ ID NO: 9040488 - DNA, 22 bp, Homo sapiens
ttaacactatctgtcataatta

SEQ ID NO: 9040489 - DNA, 22 bp, Homo sapiens
ttaacactatctgtcataatta

SEQ ID NO: 9040490 - DNA, 22 bp, Homo sapiens
ttaacacatccctgctctaccc

SEQ ID NO: 9040491 - DNA, 22 bp, Homo sapiens
ttaagagatttaggaacattat

SEQ ID NO: 9040492 - DNA, 22 bp, Homo sapiens
ttaagagacaggagaatgatgt

SEQ ID NO: 9040493 - DNA, 22 bp, Homo sapiens
ttaagagacaggagaatgatgt

SEQ ID NO: 9040494 - DNA, 22 bp, Homo sapiens
ttaagagaagagtatctagaac

SEQ ID NO: 9040495 - DNA, 22 bp, Homo sapiens
ttaagagaagagtatctagaac

SEQ ID NO: 9040496 - DNA, 22 bp, Homo sapiens
ttaagactaaatgaggtcataa

SEQ ID NO: 9040497 - DNA, 22 bp, Homo sapiens
ttaagacttttcaaaggcaaac

SEQ ID NO: 9040498 - DNA, 22 bp, Homo sapiens
ttaagactattgtaatagggga

SEQ ID NO: 9040499 - DNA, 22 bp, Homo sapiens
ttaagacatgtgagcataactt

SEQ ID NO: 9040500 - DNA, 22 bp, Homo sapiens
ttaaggaaagccaaaatgaatt

SEQ ID NO: 9040501 - DNA, 22 bp, Homo sapiens
ttaagagatttaggaacattat

SEQ ID NO: 9040502 - DNA, 22 bp, Homo sapiens
ttaaggaaggtgaatttcttgg

SEQ ID NO: 9040503 - DNA, 22 bp, Homo sapiens
ttaaggaatattcatgaagttt

SEQ ID NO: 9040504 - DNA, 22 bp, Homo sapiens
ttaaggaaggcacagcagttga

SEQ ID NO: 9040505 - DNA, 22 bp, Homo sapiens
ttaaggaaggagtcttaaatgg

SEQ ID NO: 9040506 - DNA, 21 bp, Homo sapiens
ttaagacacacagattaagga

SEQ ID NO: 9040507 - DNA, 22 bp, Homo sapiens
ttaagacacatttctcagacgg

SEQ ID NO: 9040508 - DNA, 22 bp, Homo sapiens
ttaagacacatttctcagacgg

SEQ ID NO: 9040509 - DNA, 22 bp, Homo sapiens
ttaagaatggaatgaggaattt

SEQ ID NO: 9040510 - DNA, 22 bp, Homo sapiens
ttaagaatggaatgaggaattt

SEQ ID NO: 9040511 - DNA, 22 bp, Homo sapiens
ttaagaaggtactcaaagatct

SEQ ID NO: 9040512 - DNA, 22 bp, Homo sapiens
ttaagaaggtactcaaagatct

SEQ ID NO: 9040513 - DNA, 22 bp, Homo sapiens
ttaagaaggtactcaaagatct

SEQ ID NO: 9040514 - DNA, 22 bp, Homo sapiens
ttaagaaggtactcaaagatct

SEQ ID NO: 9040515 - DNA, 22 bp, Homo sapiens
ttaagaagtgagtagaagtaat

SEQ ID NO: 9040516 - DNA, 20 bp, Homo sapiens
ttaagaaaagcacatcctgc

SEQ ID NO: 9040517 - DNA, 20 bp, Homo sapiens
ttaagaaaagcacatcctgc

SEQ ID NO: 9040518 - DNA, 20 bp, Homo sapiens
ttaagaaaagcacatcctgc

SEQ ID NO: 9040519 - DNA, 20 bp, Homo sapiens
ttaagaaaagcacatcctgc

SEQ ID NO: 9040520 - DNA, 20 bp, Homo sapiens
ttaagaaaagcacatcctgc

SEQ ID NO: 9040521 - DNA, 20 bp, Homo sapiens
ttaagaaaagcacatcctgc

SEQ ID NO: 9040522 - DNA, 22 bp, Homo sapiens
ttaacttgtcagaaaatacagt

SEQ ID NO: 9040523 - DNA, 20 bp, Homo sapiens
ttaagaaaagcacatcctgc

SEQ ID NO: 9040524 - DNA, 20 bp, Homo sapiens
ttaagaaaagcacatcctgc

SEQ ID NO: 9040525 - DNA, 22 bp, Homo sapiens
tgttttcttcctaattgctcat

SEQ ID NO: 9040526 - DNA, 22 bp, Homo sapiens
tgttttcttcctaattgctcat

SEQ ID NO: 9040527 - DNA, 22 bp, Homo sapiens
tgttttcttctgtaccgtgcca

SEQ ID NO: 9040528 - DNA, 22 bp, Homo sapiens
tgttttctgtgtagagatcaca

SEQ ID NO: 9040529 - DNA, 22 bp, Homo sapiens
tgttttctgtgtagagatcaca

SEQ ID NO: 9040530 - DNA, 22 bp, Homo sapiens
tgttttctgggtggaaggtact

SEQ ID NO: 9040531 - DNA, 22 bp, Homo sapiens
tgttttctgtgtagagatcaca

SEQ ID NO: 9040532 - DNA, 22 bp, Homo sapiens
tgttttctgggtggaaggtact

SEQ ID NO: 9040533 - DNA, 17 bp, Homo sapiens
tgttttctgctaccttt

SEQ ID NO: 9040534 - DNA, 22 bp, Homo sapiens
tgttttctgattctcgtgtggt

SEQ ID NO: 9040535 - DNA, 22 bp, Homo sapiens
tgttttctgattctcgtgtggt

SEQ ID NO: 9040536 - DNA, 17 bp, Homo sapiens
tgttttctgctaccttt

SEQ ID NO: 9040537 - DNA, 22 bp, Homo sapiens
tgttttctgatggttaatgagt

SEQ ID NO: 9040538 - DNA, 22 bp, Homo sapiens
tgttttctgatggttaatgagt

SEQ ID NO: 9040539 - DNA, 22 bp, Homo sapiens
tgttttctgatggttaatgagt

SEQ ID NO: 9040540 - DNA, 19 bp, Homo sapiens
tgttttgttaaagcagtcc

SEQ ID NO: 9040541 - DNA, 19 bp, Homo sapiens
tgttttgttaaagcagtcc

SEQ ID NO: 9040542 - DNA, 19 bp, Homo sapiens
tgttttgttaaagcagtcc

SEQ ID NO: 9040543 - DNA, 22 bp, Homo sapiens
tgttttgttcactgcattgtcc

SEQ ID NO: 9040544 - DNA, 22 bp, Homo sapiens
tgttttgtttatgagagcacag

SEQ ID NO: 9040545 - DNA, 22 bp, Homo sapiens
tgttttgttagcactctgggaa

SEQ ID NO: 9040546 - DNA, 22 bp, Homo sapiens
tgttttgtgcatttacaacatg

SEQ ID NO: 9040547 - DNA, 22 bp, Homo sapiens
tgttttgctcatagctgcatcc

SEQ ID NO: 9040548 - DNA, 23 bp, Homo sapiens
tgttttcttgtcctggtataatt

SEQ ID NO: 9040549 - DNA, 22 bp, Homo sapiens
tgttttgggtcactttccttgg

SEQ ID NO: 9040550 - DNA, 22 bp, Homo sapiens
tgttttggtagattgattatgg

SEQ ID NO: 9040551 - DNA, 22 bp, Homo sapiens
tgttttggtttaagtatatgaa

SEQ ID NO: 9040552 - DNA, 22 bp, Homo sapiens
tgttttgtccttttctatatac

SEQ ID NO: 9040553 - DNA, 22 bp, Homo sapiens
tgttttgtagctaatagctatt

SEQ ID NO: 9040554 - DNA, 22 bp, Homo sapiens
tgttttggttttcaccgagtcc

SEQ ID NO: 9040555 - DNA, 22 bp, Homo sapiens
tgttttggtggtacatgctgga

SEQ ID NO: 9040556 - DNA, 22 bp, Homo sapiens
ttaaatattatgttgtctgcaa

SEQ ID NO: 9040557 - DNA, 22 bp, Homo sapiens
ttaaatattatgttgtctgcaa

SEQ ID NO: 9040558 - DNA, 22 bp, Homo sapiens
ttaaatattttcagcagggtca

SEQ ID NO: 9040559 - DNA, 22 bp, Homo sapiens
ttaaatattttcagcagggtca

SEQ ID NO: 9040560 - DNA, 22 bp, Homo sapiens
ttaaatattttcagcagggtca

SEQ ID NO: 9040561 - DNA, 22 bp, Homo sapiens
ttaaatattatgttgtctgcaa

SEQ ID NO: 9040562 - DNA, 22 bp, Homo sapiens
ttaaatattatgttgtctgcaa

SEQ ID NO: 9040563 - DNA, 22 bp, Homo sapiens
ttaaatattatgttgtctgcaa

SEQ ID NO: 9040564 - DNA, 22 bp, Homo sapiens
ttaaatattatgttgtctgcaa

SEQ ID NO: 9040565 - DNA, 22 bp, Homo sapiens
ttaaatattatgttgtctgcaa

SEQ ID NO: 9040566 - DNA, 22 bp, Homo sapiens
ttaaatattatgttgtctgcaa

SEQ ID NO: 9040567 - DNA, 22 bp, Homo sapiens
ttaaatattatgttgtctgcaa

SEQ ID NO: 9040568 - DNA, 22 bp, Homo sapiens
ttaaatattatgttgtctgcaa

SEQ ID NO: 9040569 - DNA, 22 bp, Homo sapiens
ttaaatattatgttgtctgcaa

SEQ ID NO: 9040570 - DNA, 22 bp, Homo sapiens
ttaaatagtcaaatcagtggca

SEQ ID NO: 9040571 - DNA, 22 bp, Homo sapiens
ttaaatagtcaaatcagtggca

SEQ ID NO: 9040572 - DNA, 22 bp, Homo sapiens
ttaaatattatgttgtctgcaa

SEQ ID NO: 9040573 - DNA, 22 bp, Homo sapiens
ttaaatattatgttgtctgcaa

SEQ ID NO: 9040574 - DNA, 22 bp, Homo sapiens
ttaaatattatgttgtctgcaa

SEQ ID NO: 9040575 - DNA, 22 bp, Homo sapiens
ttaaatattatgttgtctgcaa

SEQ ID NO: 9040576 - DNA, 22 bp, Homo sapiens
ttaaatagtaggtctattttgg

SEQ ID NO: 9040577 - DNA, 22 bp, Homo sapiens
ttaaagcctgactgtggactac

SEQ ID NO: 9040578 - DNA, 21 bp, Homo sapiens
ttaaagcctccctcataagga

SEQ ID NO: 9040579 - DNA, 21 bp, Homo sapiens
ttaaagcctccctcataagga

SEQ ID NO: 9040580 - DNA, 22 bp, Homo sapiens
ttaaagcccagcatatactagg

SEQ ID NO: 9040581 - DNA, 22 bp, Homo sapiens
ttaaatagtcaaatcagtggca

SEQ ID NO: 9040582 - DNA, 22 bp, Homo sapiens
ttaaatagtaggtctattttgg

SEQ ID NO: 9040583 - DNA, 22 bp, Homo sapiens
ttaaatagtaggtctattttgg

SEQ ID NO: 9040584 - DNA, 22 bp, Homo sapiens
ttaaatagtaggtctattttgg

SEQ ID NO: 9040585 - DNA, 22 bp, Homo sapiens
ttaaatagtaggtctattttgg

SEQ ID NO: 9040586 - DNA, 22 bp, Homo sapiens
tgtttttaaaatgtcctggtta

SEQ ID NO: 9040587 - DNA, 22 bp, Homo sapiens
tgtttttaaaatgtcctggtta

SEQ ID NO: 9040588 - DNA, 22 bp, Homo sapiens
tgttttgtttatgagagcacag

SEQ ID NO: 9040589 - DNA, 22 bp, Homo sapiens
tgtttttaaataatgatagaaa

SEQ ID NO: 9040590 - DNA, 22 bp, Homo sapiens
tgtttttactgtgatccagaaa

SEQ ID NO: 9040591 - DNA, 22 bp, Homo sapiens
tgtttttatctctgtgtacaac

SEQ ID NO: 9040592 - DNA, 22 bp, Homo sapiens
tgtttttactgtgatccagaaa

SEQ ID NO: 9040593 - DNA, 22 bp, Homo sapiens
tgtttttactgtgatccagaaa

SEQ ID NO: 9040594 - DNA, 22 bp, Homo sapiens
tgtttttactgtgatccagaaa

SEQ ID NO: 9040595 - DNA, 22 bp, Homo sapiens
tgtttttactgtgatccagaaa

SEQ ID NO: 9040596 - DNA, 22 bp, Homo sapiens
tgtttttaaataatgatagaaa

SEQ ID NO: 9040597 - DNA, 22 bp, Homo sapiens
tgtttttaaataatgatagaaa

SEQ ID NO: 9040598 - DNA, 22 bp, Homo sapiens
tgtttttaaataatgatagaaa

SEQ ID NO: 9040599 - DNA, 22 bp, Homo sapiens
tgtttttaaataatgatagaaa

SEQ ID NO: 9040600 - DNA, 22 bp, Homo sapiens
tgtttttatctctgtgtacaac

SEQ ID NO: 9040601 - DNA, 22 bp, Homo sapiens
tgtttttatctctgtgtacaac

SEQ ID NO: 9040602 - DNA, 22 bp, Homo sapiens
tgtttttatctctgtgtacaac

SEQ ID NO: 9040603 - DNA, 22 bp, Homo sapiens
ttaaagcatgctgcttttccat

SEQ ID NO: 9040604 - DNA, 22 bp, Homo sapiens
ttaaagcatcacactattaatt

SEQ ID NO: 9040605 - DNA, 22 bp, Homo sapiens
ttaaagccatctagattttgag

SEQ ID NO: 9040606 - DNA, 22 bp, Homo sapiens
ttaaagcatgttgcttaacagg

SEQ ID NO: 9040607 - DNA, 22 bp, Homo sapiens
ttaaatgaggctgatgtagatt

SEQ ID NO: 9040608 - DNA, 22 bp, Homo sapiens
ttaaatgaggctgatgtagatt

SEQ ID NO: 9040609 - DNA, 22 bp, Homo sapiens
ttaaatgagatgttcagatatt

SEQ ID NO: 9040610 - DNA, 22 bp, Homo sapiens
ttaaatgagatgttcagatatt

SEQ ID NO: 9040611 - DNA, 22 bp, Homo sapiens
ttaaatgaggctgatgtagatt

SEQ ID NO: 9040612 - DNA, 22 bp, Homo sapiens
ttaaatgaggctgatgtagatt

SEQ ID NO: 9040613 - DNA, 22 bp, Homo sapiens
ttaaatgatgcatatcatttag

SEQ ID NO: 9040614 - DNA, 22 bp, Homo sapiens
ttaaatgatgcatatcatttag

SEQ ID NO: 9040615 - DNA, 22 bp, Homo sapiens
ttaaatgatgcatatcatttag

SEQ ID NO: 9040616 - DNA, 22 bp, Homo sapiens
ttaaatgatgcatatcatttag

SEQ ID NO: 9040617 - DNA, 22 bp, Homo sapiens
ttaaatgatgcatatcatttag

SEQ ID NO: 9040618 - DNA, 22 bp, Homo sapiens
ttaaatgatgcatatcatttag

SEQ ID NO: 9040619 - DNA, 22 bp, Homo sapiens
ttaaatgctcacataaaggtag

SEQ ID NO: 9040620 - DNA, 22 bp, Homo sapiens
ttaaatgtcaatagattgcttg

SEQ ID NO: 9040621 - DNA, 22 bp, Homo sapiens
ttaaatgtcaatagattgcttg

SEQ ID NO: 9040622 - DNA, 22 bp, Homo sapiens
ttaaatgacttttattattctc

SEQ ID NO: 9040623 - DNA, 22 bp, Homo sapiens
ttaaatgacttttattattctc

SEQ ID NO: 9040624 - DNA, 22 bp, Homo sapiens
ttaaatgagatgttcagatatt

SEQ ID NO: 9040625 - DNA, 22 bp, Homo sapiens
ttaaatgagatgttcagatatt

SEQ ID NO: 9040626 - DNA, 22 bp, Homo sapiens
ttaaatgaacgagatatgcaac

SEQ ID NO: 9040627 - DNA, 22 bp, Homo sapiens
ttaaatgacgggactgggtttt

SEQ ID NO: 9040628 - DNA, 22 bp, Homo sapiens
ttaaatgacttttattattctc

SEQ ID NO: 9040629 - DNA, 22 bp, Homo sapiens
ttaaatattttcagcagggtca

SEQ ID NO: 9040630 - DNA, 22 bp, Homo sapiens
ttaaatattttcagcagggtca

SEQ ID NO: 9040631 - DNA, 22 bp, Homo sapiens
ttaaatattttcagcagggtca

SEQ ID NO: 9040632 - DNA, 22 bp, Homo sapiens
ttaaatattttcagcagggtca

SEQ ID NO: 9040633 - DNA, 22 bp, Homo sapiens
ttaaatcaggcatcatttcagt

SEQ ID NO: 9040634 - DNA, 22 bp, Homo sapiens
ttaaatctgttctcatgtctgt

SEQ ID NO: 9040635 - DNA, 22 bp, Homo sapiens
ttaaatcagtaggctactcctt

SEQ ID NO: 9040636 - DNA, 22 bp, Homo sapiens
ttaaatgaacgagatatgcaac

SEQ ID NO: 9040637 - DNA, 22 bp, Homo sapiens
ttaaatgaacgagatatgcaac

SEQ ID NO: 9040638 - DNA, 22 bp, Homo sapiens
ttaaatgaacgagatatgcaac

SEQ ID NO: 9040639 - DNA, 22 bp, Homo sapiens
ttaaatgtgcctaaacctgtaa

SEQ ID NO: 9040640 - DNA, 22 bp, Homo sapiens
ttaaatgtttaatctaacttga

SEQ ID NO: 9040641 - DNA, 22 bp, Homo sapiens
ttaaatgtttaatctaacttga

SEQ ID NO: 9040642 - DNA, 22 bp, Homo sapiens
ttaaatgtttaatctaacttga

SEQ ID NO: 9040643 - DNA, 22 bp, Homo sapiens
ttaaatgtttaatctaacttga

SEQ ID NO: 9040644 - DNA, 22 bp, Homo sapiens
ttaaatgtgatttcatttatgt

SEQ ID NO: 9040645 - DNA, 22 bp, Homo sapiens
ttaaatgtgatttcatttatgt

SEQ ID NO: 9040646 - DNA, 22 bp, Homo sapiens
ttaaatgtgatttcatttatgt

SEQ ID NO: 9040647 - DNA, 22 bp, Homo sapiens
ttaaatgtgatttcatttatgt

SEQ ID NO: 9040648 - DNA, 22 bp, Homo sapiens
ttaaatgtgatttcatttatgt

SEQ ID NO: 9040649 - DNA, 22 bp, Homo sapiens
ttaaatgtgatttcatttatgt

SEQ ID NO: 9040650 - DNA, 22 bp, Homo sapiens
ttaaatgtgatcctggtatgca

SEQ ID NO: 9040651 - DNA, 22 bp, Homo sapiens
ttaaatgtgatttcatttatgt

SEQ ID NO: 9040652 - DNA, 22 bp, Homo sapiens
ttaaatgtctgtagatgtgctg

SEQ ID NO: 9040653 - DNA, 22 bp, Homo sapiens
ttaaatgtctgtagatgtgctg

SEQ ID NO: 9040654 - DNA, 22 bp, Homo sapiens
ttaaatgtgatcctggtatgca

SEQ ID NO: 9040655 - DNA, 22 bp, Homo sapiens
ttaacaaaaatatcaggcatca

SEQ ID NO: 9040656 - DNA, 22 bp, Homo sapiens
ttaacaaaaatatcaggcatca

SEQ ID NO: 9040657 - DNA, 22 bp, Homo sapiens
ttaacaaaaatatcaggcatca

SEQ ID NO: 9040658 - DNA, 22 bp, Homo sapiens
ttaacaaaaatatcaggcatca

SEQ ID NO: 9040659 - DNA, 22 bp, Homo sapiens
ttaacaaaaatatcaggcatca

SEQ ID NO: 9040660 - DNA, 22 bp, Homo sapiens
ttaacaaaaatatcaggcatca

SEQ ID NO: 9040661 - DNA, 22 bp, Homo sapiens
ttaaattaggactctagttctg

SEQ ID NO: 9040662 - DNA, 22 bp, Homo sapiens
ttaaattaggactctagttctg

SEQ ID NO: 9040663 - DNA, 22 bp, Homo sapiens
ttaaattaggactctagttctg

SEQ ID NO: 9040664 - DNA, 22 bp, Homo sapiens
ttaaattaggactctagttctg

SEQ ID NO: 9040665 - DNA, 22 bp, Homo sapiens
ttaaattaggactctagttctg

SEQ ID NO: 9040666 - DNA, 22 bp, Homo sapiens
ttaaattaggactctagttctg

SEQ ID NO: 9040667 - DNA, 22 bp, Homo sapiens
ttaacacagggggagacaaagt

SEQ ID NO: 9040668 - DNA, 22 bp, Homo sapiens
ttaacacagggggagacaaagt

SEQ ID NO: 9040669 - DNA, 22 bp, Homo sapiens
ttaacacagggggagacaaagt

SEQ ID NO: 9040670 - DNA, 22 bp, Homo sapiens
ttaacacagggggagacaaagt

SEQ ID NO: 9040671 - DNA, 22 bp, Homo sapiens
ttaacaatagagtttcttcagg

SEQ ID NO: 9040672 - DNA, 22 bp, Homo sapiens
ttaacacatatttatcaattgc

SEQ ID NO: 9040673 - DNA, 22 bp, Homo sapiens
ttaacacatatttatcaattgc

SEQ ID NO: 9040674 - DNA, 22 bp, Homo sapiens
ttaacacagggggagacaaagt

SEQ ID NO: 9040675 - DNA, 22 bp, Homo sapiens
ttaacacagggggagacaaagt

SEQ ID NO: 9040676 - DNA, 22 bp, Homo sapiens
ttaacacagggggagacaaagt

SEQ ID NO: 9040677 - DNA, 22 bp, Homo sapiens
ttaacacatatttatcaattgc

SEQ ID NO: 9040678 - DNA, 22 bp, Homo sapiens
ttaacaaatatttcccatgccc

SEQ ID NO: 9040679 - DNA, 22 bp, Homo sapiens
ttaacaaatatttcccatgccc

SEQ ID NO: 9040680 - DNA, 22 bp, Homo sapiens
ttaacaaatatttcccatgccc

SEQ ID NO: 9040681 - DNA, 22 bp, Homo sapiens
ttaacaaagctctgttcctttt

SEQ ID NO: 9040682 - DNA, 22 bp, Homo sapiens
ttaacaaaaatatcaggcatca

SEQ ID NO: 9040683 - DNA, 22 bp, Homo sapiens
ttaacaaagctctgttcctttt

SEQ ID NO: 9040684 - DNA, 22 bp, Homo sapiens
ttaacaaagctctgttcctttt

SEQ ID NO: 9040685 - DNA, 22 bp, Homo sapiens
ttaacaaagctctgttcctttt

SEQ ID NO: 9040686 - DNA, 22 bp, Homo sapiens
ttaacaaagtaacgggaaaaga

SEQ ID NO: 9040687 - DNA, 22 bp, Homo sapiens
ttaacaaagtaacgggaaaaga

SEQ ID NO: 9040688 - DNA, 22 bp, Homo sapiens
ttaacaaagtaacgggaaaaga

SEQ ID NO: 9040689 - DNA, 22 bp, Homo sapiens
ttaacaaagtaacgggaaaaga

SEQ ID NO: 9040690 - DNA, 22 bp, Homo sapiens
ttaacaaagctctgttcctttt

SEQ ID NO: 9040691 - DNA, 22 bp, Homo sapiens
tttgcaaggcagcaggtgcagt

SEQ ID NO: 9040692 - DNA, 22 bp, Homo sapiens
tttgcaaggcagcaggtgcagt

SEQ ID NO: 9040693 - DNA, 22 bp, Homo sapiens
tttgcaatagtcctggcctgta

SEQ ID NO: 9040694 - DNA, 22 bp, Homo sapiens
tttgcaattttctgtccttgta

SEQ ID NO: 9040695 - DNA, 22 bp, Homo sapiens
tttgcaatttgtgctgcaaatg

SEQ ID NO: 9040696 - DNA, 23 bp, Homo sapiens
tttgcaaattttcctgactactc

SEQ ID NO: 9040697 - DNA, 23 bp, Homo sapiens
tttgcaaattttcctgactactc

SEQ ID NO: 9040698 - DNA, 23 bp, Homo sapiens
tttgcaaattttcctgactactc

SEQ ID NO: 9040699 - DNA, 22 bp, Homo sapiens
tttgcaaatttcgtctcctcag

SEQ ID NO: 9040700 - DNA, 22 bp, Homo sapiens
tttgcaaattagccaccctgtt

SEQ ID NO: 9040701 - DNA, 22 bp, Homo sapiens
tttgcaaattcttgtctagcct

SEQ ID NO: 9040702 - DNA, 23 bp, Homo sapiens
tttgcaaattggacacaaccaca

SEQ ID NO: 9040703 - DNA, 23 bp, Homo sapiens
tttgcaaattggacacaaccaca

SEQ ID NO: 9040704 - DNA, 22 bp, Homo sapiens
tttgcaaatgctctgcagagct

SEQ ID NO: 9040705 - DNA, 22 bp, Homo sapiens
tttgcagcctccctggcagaag

SEQ ID NO: 9040706 - DNA, 22 bp, Homo sapiens
tttgcaggcacggaggcagctg

SEQ ID NO: 9040707 - DNA, 22 bp, Homo sapiens
tttgcagcaaggagagagcatt

SEQ ID NO: 9040708 - DNA, 22 bp, Homo sapiens
tttgcagcaaggagagagcatt

SEQ ID NO: 9040709 - DNA, 22 bp, Homo sapiens
tttgcagagtgcagaagcatct

SEQ ID NO: 9040710 - DNA, 22 bp, Homo sapiens
tttgcagagtacctgaagagga

SEQ ID NO: 9040711 - DNA, 22 bp, Homo sapiens
tttgcagagtgcagaagcatct

SEQ ID NO: 9040712 - DNA, 22 bp, Homo sapiens
tttgcagagtacctgaagagga

SEQ ID NO: 9040713 - DNA, 22 bp, Homo sapiens
tttgcagaagaaaacatgaaca

SEQ ID NO: 9040714 - DNA, 22 bp, Homo sapiens
tttgcacagcctttctggctgc

SEQ ID NO: 9040715 - DNA, 22 bp, Homo sapiens
tttgcacacattcttagaaatg

SEQ ID NO: 9040716 - DNA, 22 bp, Homo sapiens
tttgcacacacaataacaaatg

SEQ ID NO: 9040717 - DNA, 22 bp, Homo sapiens
tttgcacacacaataacaaatg

SEQ ID NO: 9040718 - DNA, 22 bp, Homo sapiens
tttgcagaagaaaacatgaaca

SEQ ID NO: 9040719 - DNA, 22 bp, Homo sapiens
tttgcacttcctaatgtgtttt

SEQ ID NO: 9040720 - DNA, 22 bp, Homo sapiens
tttgcagaagaaaacatgaaca

SEQ ID NO: 9040721 - DNA, 22 bp, Homo sapiens
tttgcaaaatgaggtgaagagt

SEQ ID NO: 9040722 - DNA, 22 bp, Homo sapiens
tttgattttcagcaatagtggc

SEQ ID NO: 9040723 - DNA, 22 bp, Homo sapiens
tttgattttcagcaatagtggc

SEQ ID NO: 9040724 - DNA, 22 bp, Homo sapiens
tttgcaaataaataagtgctcg

SEQ ID NO: 9040725 - DNA, 22 bp, Homo sapiens
tttgcaaataaataagtgctcg

SEQ ID NO: 9040726 - DNA, 22 bp, Homo sapiens
tttgcaaataaataagtgctcg

SEQ ID NO: 9040727 - DNA, 22 bp, Homo sapiens
tttgcaaataaataagtgctcg

SEQ ID NO: 9040728 - DNA, 20 bp, Homo sapiens
tttgatttcacaaggccagt

SEQ ID NO: 9040729 - DNA, 22 bp, Homo sapiens
tttgatttactggatattctca

SEQ ID NO: 9040730 - DNA, 22 bp, Homo sapiens
tttgattttcagcaatagtggc

SEQ ID NO: 9040731 - DNA, 20 bp, Homo sapiens
tttgatttcacaaggccagt

SEQ ID NO: 9040732 - DNA, 20 bp, Homo sapiens
tttgatttcacaaggccagt

SEQ ID NO: 9040733 - DNA, 22 bp, Homo sapiens
tttgattttcagcaatagtggc

SEQ ID NO: 9040734 - DNA, 22 bp, Homo sapiens
tttgattttcagcaatagtggc

SEQ ID NO: 9040735 - DNA, 22 bp, Homo sapiens
tttgcaaataccatgaaacttg

SEQ ID NO: 9040736 - DNA, 22 bp, Homo sapiens
tttgcaaataccatgaaacttg

SEQ ID NO: 9040737 - DNA, 22 bp, Homo sapiens
tttgcaaatacagaggtcttgc

SEQ ID NO: 9040738 - DNA, 22 bp, Homo sapiens
tttgcaaatacagaggtcttgc

SEQ ID NO: 9040739 - DNA, 22 bp, Homo sapiens
tttgcaaatgaagctctgagga

SEQ ID NO: 9040740 - DNA, 22 bp, Homo sapiens
tttgcaaatatgtgtttctatt

SEQ ID NO: 9040741 - DNA, 22 bp, Homo sapiens
tttgcaaataccatgaaacttg

SEQ ID NO: 9040742 - DNA, 18 bp, Homo sapiens
tttctttctgcctggggc

SEQ ID NO: 9040743 - DNA, 18 bp, Homo sapiens
tttctttctgcctggggc

SEQ ID NO: 9040744 - DNA, 22 bp, Homo sapiens
tttgatttactggatattctca

SEQ ID NO: 9040745 - DNA, 22 bp, Homo sapiens
tttctttctcgtaaacttagtt

SEQ ID NO: 9040746 - DNA, 22 bp, Homo sapiens
tttctttccatgagcctatgta

SEQ ID NO: 9040747 - DNA, 22 bp, Homo sapiens
tttctttccatgagcctatgta

SEQ ID NO: 9040748 - DNA, 22 bp, Homo sapiens
tttctttccatgagcctatgta

SEQ ID NO: 9040749 - DNA, 22 bp, Homo sapiens
tttctttccatgagcctatgta

SEQ ID NO: 9040750 - DNA, 22 bp, Homo sapiens
tttctttccatgagcctatgta

SEQ ID NO: 9040751 - DNA, 22 bp, Homo sapiens
tttctttccatacatattgcta

SEQ ID NO: 9040752 - DNA, 22 bp, Homo sapiens
tttctttccatacatattgcta

SEQ ID NO: 9040753 - DNA, 22 bp, Homo sapiens
tttctttccagagtgattggca

SEQ ID NO: 9040754 - DNA, 22 bp, Homo sapiens
tttctttccatacatattgcta

SEQ ID NO: 9040755 - DNA, 22 bp, Homo sapiens
tttctttccatacatattgcta

SEQ ID NO: 9040756 - DNA, 22 bp, Homo sapiens
tttctttccagagtgattggca

SEQ ID NO: 9040757 - DNA, 22 bp, Homo sapiens
tttctttcaattctcctaatgc

SEQ ID NO: 9040758 - DNA, 22 bp, Homo sapiens
tttctttccagagtgattggca

SEQ ID NO: 9040759 - DNA, 22 bp, Homo sapiens
tttctttccagagtgattggca

SEQ ID NO: 9040760 - DNA, 22 bp, Homo sapiens
tttctttcaattctcctaatgc

SEQ ID NO: 9040761 - DNA, 22 bp, Homo sapiens
tttctttatcctcctttgcaca

SEQ ID NO: 9040762 - DNA, 22 bp, Homo sapiens
tttctttatcctcctttgcaca

SEQ ID NO: 9040763 - DNA, 22 bp, Homo sapiens
tttctttatcctcctttgcaca

SEQ ID NO: 9040764 - DNA, 22 bp, Homo sapiens
tttctttatcctcctttgcaca

SEQ ID NO: 9040765 - DNA, 22 bp, Homo sapiens
tttctttatcctcctttgcaca

SEQ ID NO: 9040766 - DNA, 22 bp, Homo sapiens
tttctttatcctcctttgcaca

SEQ ID NO: 9040767 - DNA, 22 bp, Homo sapiens
tttctttatcctcctttgcaca

SEQ ID NO: 9040768 - DNA, 22 bp, Homo sapiens
tttggcagaggaagaaggcaca

SEQ ID NO: 9040769 - DNA, 22 bp, Homo sapiens
tttggcagagtgtgggcatttg

SEQ ID NO: 9040770 - DNA, 22 bp, Homo sapiens
tttggcagagtcatttcagaaa

SEQ ID NO: 9040771 - DNA, 22 bp, Homo sapiens
tttggcagagtaaggcctgctt

SEQ ID NO: 9040772 - DNA, 19 bp, Homo sapiens
tttggcactctgaagtgtt

SEQ ID NO: 9040773 - DNA, 22 bp, Homo sapiens
tttggcactcacttatcattgg

SEQ ID NO: 9040774 - DNA, 20 bp, Homo sapiens
tttggcactgagtggtataa

SEQ ID NO: 9040775 - DNA, 22 bp, Homo sapiens
tttggcactgttctaggtgcaa

SEQ ID NO: 9040776 - DNA, 22 bp, Homo sapiens
tttggcactgttctaggtgcaa

SEQ ID NO: 9040777 - DNA, 22 bp, Homo sapiens
tttggcacttggcagttgagtt

SEQ ID NO: 9040778 - DNA, 22 bp, Homo sapiens
tttggcacattctgtcacattc

SEQ ID NO: 9040779 - DNA, 22 bp, Homo sapiens
tttggcaccaaaggagaagatc

SEQ ID NO: 9040780 - DNA, 22 bp, Homo sapiens
tttggcaccatttttattctct

SEQ ID NO: 9040781 - DNA, 22 bp, Homo sapiens
tttggcactataggtaaatttg

SEQ ID NO: 9040782 - DNA, 22 bp, Homo sapiens
tttggcacctccaaggactcgc

SEQ ID NO: 9040783 - DNA, 22 bp, Homo sapiens
tttggcacagtactttttggct

SEQ ID NO: 9040784 - DNA, 22 bp, Homo sapiens
tttggcaagaaaatgtgattga

SEQ ID NO: 9040785 - DNA, 22 bp, Homo sapiens
tttggcaacggagaacttactc

SEQ ID NO: 9040786 - DNA, 22 bp, Homo sapiens
tttggcaatgactgcatccatg

SEQ ID NO: 9040787 - DNA, 22 bp, Homo sapiens
tttggcaagtgggaaattagta

SEQ ID NO: 9040788 - DNA, 22 bp, Homo sapiens
tttggcaagtgggaaattagta

SEQ ID NO: 9040789 - DNA, 22 bp, Homo sapiens
tttgtacacaacctgtggtagt

SEQ ID NO: 9040790 - DNA, 22 bp, Homo sapiens
tttgtacacaacctgtggtagt

SEQ ID NO: 9040791 - DNA, 22 bp, Homo sapiens
tttgtacacaggatgttataat

SEQ ID NO: 9040792 - DNA, 22 bp, Homo sapiens
tttgtacacaggatgttataat

SEQ ID NO: 9040793 - DNA, 22 bp, Homo sapiens
tttgtacatcctaattctgagt

SEQ ID NO: 9040794 - DNA, 22 bp, Homo sapiens
tttgtacaattagcagaggcta

SEQ ID NO: 9040795 - DNA, 22 bp, Homo sapiens
tttgtacaattagcagaggcta

SEQ ID NO: 9040796 - DNA, 22 bp, Homo sapiens
tttgtacacaacctgtggtagt

SEQ ID NO: 9040797 - DNA, 17 bp, Homo sapiens
tttgtacaacattttaa

SEQ ID NO: 9040798 - DNA, 23 bp, Homo sapiens
tttgtacattgaggaggcagaat

SEQ ID NO: 9040799 - DNA, 23 bp, Homo sapiens
tttgtacattgaggaggcagaat

SEQ ID NO: 9040800 - DNA, 22 bp, Homo sapiens
tttgtacattcaaatgtcccat

SEQ ID NO: 9040801 - DNA, 22 bp, Homo sapiens
tttgtacatgaatgtgcaccca

SEQ ID NO: 9040802 - DNA, 22 bp, Homo sapiens
tttgtacatgaatgtgcaccca

SEQ ID NO: 9040803 - DNA, 19 bp, Homo sapiens
tttggcaggagataggatg

SEQ ID NO: 9040804 - DNA, 22 bp, Homo sapiens
tttggcaggtggcagctctggg

SEQ ID NO: 9040805 - DNA, 19 bp, Homo sapiens
tttggcaggagataggatg

SEQ ID NO: 9040806 - DNA, 17 bp, Homo sapiens
tttgtacaacattttaa

SEQ ID NO: 9040807 - DNA, 22 bp, Homo sapiens
tttgtaatgataatgttaaatt

SEQ ID NO: 9040808 - DNA, 22 bp, Homo sapiens
tttggcagcttccatattcact

SEQ ID NO: 9040809 - DNA, 19 bp, Homo sapiens
tttggcagcattaatatca

SEQ ID NO: 9040810 - DNA, 22 bp, Homo sapiens
tttggcagcacccgccatctat

SEQ ID NO: 9040811 - DNA, 22 bp, Homo sapiens
tttggcaacctcaatggctcta

SEQ ID NO: 9040812 - DNA, 22 bp, Homo sapiens
tttggcaaaggtcagagactcc

SEQ ID NO: 9040813 - DNA, 22 bp, Homo sapiens
tttggcaaaggtcagagactcc

SEQ ID NO: 9040814 - DNA, 22 bp, Homo sapiens
tttggcaaacttttaggacttt

SEQ ID NO: 9040815 - DNA, 22 bp, Homo sapiens
tttggcaaagatcaacatgtta

SEQ ID NO: 9040816 - DNA, 22 bp, Homo sapiens
tttggatatgtttctgtcttct

SEQ ID NO: 9040817 - DNA, 22 bp, Homo sapiens
tttggatatgtttctgtcttct

SEQ ID NO: 9040818 - DNA, 22 bp, Homo sapiens
tttggagtttaacaacttgaag

SEQ ID NO: 9040819 - DNA, 22 bp, Homo sapiens
tttggatcactgttcctctggg

SEQ ID NO: 9040820 - DNA, 22 bp, Homo sapiens
tttggatcactgttcctctggg

SEQ ID NO: 9040821 - DNA, 22 bp, Homo sapiens
tttggcaaacataagcctttct

SEQ ID NO: 9040822 - DNA, 22 bp, Homo sapiens
tttggaggggaagaccttggag

SEQ ID NO: 9040823 - DNA, 22 bp, Homo sapiens
tttggagatggagagagggcat

SEQ ID NO: 9040824 - DNA, 22 bp, Homo sapiens
tttggagagcagctaggccctt

SEQ ID NO: 9040825 - DNA, 22 bp, Homo sapiens
tttggagatagggcctagcaat

SEQ ID NO: 9040826 - DNA, 22 bp, Homo sapiens
tttggagagagttaaatatgtt

SEQ ID NO: 9040827 - DNA, 22 bp, Homo sapiens
tttggagagatgaagttctgtg

SEQ ID NO: 9040828 - DNA, 22 bp, Homo sapiens
tttggagagagttaaatatgtt

SEQ ID NO: 9040829 - DNA, 22 bp, Homo sapiens
tttggagagatgaagttctgtg

SEQ ID NO: 9040830 - DNA, 22 bp, Homo sapiens
tttggagagatgaagttctgtg

SEQ ID NO: 9040831 - DNA, 22 bp, Homo sapiens
tttggagagcagctaggccctt

SEQ ID NO: 9040832 - DNA, 22 bp, Homo sapiens
tttggagaagttgctaaagtgt

SEQ ID NO: 9040833 - DNA, 22 bp, Homo sapiens
tttggagaaaagttgagaccat

SEQ ID NO: 9040834 - DNA, 22 bp, Homo sapiens
tttggagaagttgctaaagtgt

SEQ ID NO: 9040835 - DNA, 20 bp, Homo sapiens
tttggagagaaagaagtagt

SEQ ID NO: 9040836 - DNA, 20 bp, Homo sapiens
tttggagagaaagaagtagt

SEQ ID NO: 9040837 - DNA, 22 bp, Homo sapiens
tttggagagagttaaatatgtt

SEQ ID NO: 9040838 - DNA, 22 bp, Homo sapiens
tttggacttagcctgcagaatt

SEQ ID NO: 9040839 - DNA, 22 bp, Homo sapiens
tttggacttagcctgcagaatt

SEQ ID NO: 9040840 - DNA, 22 bp, Homo sapiens
tttggacatgttgagtctgata

SEQ ID NO: 9040841 - DNA, 22 bp, Homo sapiens
tttggactatctgtgtggcttt

SEQ ID NO: 9040842 - DNA, 19 bp, Homo sapiens
tttggacagagtgtccagg

SEQ ID NO: 9040843 - DNA, 22 bp, Homo sapiens
tttggacatgttgagtctgata

SEQ ID NO: 9040844 - DNA, 22 bp, Homo sapiens
tttggacatgagtctttaatct

SEQ ID NO: 9040845 - DNA, 22 bp, Homo sapiens
tttggacatgagtctttaatct

SEQ ID NO: 9040846 - DNA, 22 bp, Homo sapiens
tttggacaaatgtctgactttc

SEQ ID NO: 9040847 - DNA, 22 bp, Homo sapiens
tttggaaggtgaggcatgaagg

SEQ ID NO: 9040848 - DNA, 22 bp, Homo sapiens
tttggaaggtgaggcatgaagg

SEQ ID NO: 9040849 - DNA, 19 bp, Homo sapiens
tttggaactttttgatgcc

SEQ ID NO: 9040850 - DNA, 22 bp, Homo sapiens
tttggaagacagggcaggaaag

SEQ ID NO: 9040851 - DNA, 22 bp, Homo sapiens
tttggaagggaaccaaaacatg

SEQ ID NO: 9040852 - DNA, 22 bp, Homo sapiens
tttggaagggaaccaaaacatg

SEQ ID NO: 9040853 - DNA, 22 bp, Homo sapiens
tttggaagggaaccaaaacatg

SEQ ID NO: 9040854 - DNA, 22 bp, Homo sapiens
tttggaagggaaccaaaacatg

SEQ ID NO: 9040855 - DNA, 22 bp, Homo sapiens
tttggaagggaaagaaagtact

SEQ ID NO: 9040856 - DNA, 22 bp, Homo sapiens
tttggaagggaaagaaagtact

SEQ ID NO: 9040857 - DNA, 22 bp, Homo sapiens
tttggaagacagggcaggaaag

SEQ ID NO: 9040858 - DNA, 22 bp, Homo sapiens
tttggaagatagttcggcagtt

SEQ ID NO: 9040859 - DNA, 22 bp, Homo sapiens
ttttatattgagtgagagttcc

SEQ ID NO: 9040860 - DNA, 22 bp, Homo sapiens
ttttatattgagtgagagttcc

SEQ ID NO: 9040861 - DNA, 22 bp, Homo sapiens
ttttatattgagtgagagttcc

SEQ ID NO: 9040862 - DNA, 20 bp, Homo sapiens
ttttatatgtagggtatatg

SEQ ID NO: 9040863 - DNA, 22 bp, Homo sapiens
ttttatatggcacattggttgg

SEQ ID NO: 9040864 - DNA, 22 bp, Homo sapiens
ttttatatggcacattggttgg

SEQ ID NO: 9040865 - DNA, 20 bp, Homo sapiens
ttttatatgtagggtatatg

SEQ ID NO: 9040866 - DNA, 22 bp, Homo sapiens
ttttatcagcagggataacaag

SEQ ID NO: 9040867 - DNA, 22 bp, Homo sapiens
ttttatcagcagggataacaag

SEQ ID NO: 9040868 - DNA, 22 bp, Homo sapiens
ttttatcagcagggataacaag

SEQ ID NO: 9040869 - DNA, 22 bp, Homo sapiens
ttttatcagcagggataacaag

SEQ ID NO: 9040870 - DNA, 22 bp, Homo sapiens
ttttatcagcagggataacaag

SEQ ID NO: 9040871 - DNA, 22 bp, Homo sapiens
ttttatcaatcattaagacatt

SEQ ID NO: 9040872 - DNA, 22 bp, Homo sapiens
ttttatcaatcattaagacatt

SEQ ID NO: 9040873 - DNA, 22 bp, Homo sapiens
ttttatcaatcattaagacatt

SEQ ID NO: 9040874 - DNA, 22 bp, Homo sapiens
ttttataagcaagaaagggaaa

SEQ ID NO: 9040875 - DNA, 22 bp, Homo sapiens
ttttataagcaagaaagggaaa

SEQ ID NO: 9040876 - DNA, 22 bp, Homo sapiens
ttttataagcaagaaagggaaa

SEQ ID NO: 9040877 - DNA, 22 bp, Homo sapiens
ttttatacacatgaacatgcag

SEQ ID NO: 9040878 - DNA, 22 bp, Homo sapiens
ttttatacacatgaacatgcag

SEQ ID NO: 9040879 - DNA, 22 bp, Homo sapiens
ttttatacacatgaacatgcag

SEQ ID NO: 9040880 - DNA, 22 bp, Homo sapiens
ttttatacttaagacagagttt

SEQ ID NO: 9040881 - DNA, 22 bp, Homo sapiens
ttttatacttaagacagagttt

SEQ ID NO: 9040882 - DNA, 22 bp, Homo sapiens
ttttatacttaagacagagttt

SEQ ID NO: 9040883 - DNA, 22 bp, Homo sapiens
ttttagtttggatttctaaagc

SEQ ID NO: 9040884 - DNA, 22 bp, Homo sapiens
ttttataaagagagtcagttgg

SEQ ID NO: 9040885 - DNA, 22 bp, Homo sapiens
ttttataaagagagtcagttgg

SEQ ID NO: 9040886 - DNA, 22 bp, Homo sapiens
ttttagtttggatttctaaagc

SEQ ID NO: 9040887 - DNA, 22 bp, Homo sapiens
ttttataaagagagtcagttgg

SEQ ID NO: 9040888 - DNA, 22 bp, Homo sapiens
ttttagtttggatttctaaagc

SEQ ID NO: 9040889 - DNA, 22 bp, Homo sapiens
ttttataaagagagtcagttgg

SEQ ID NO: 9040890 - DNA, 22 bp, Homo sapiens
ttttagtttggatttctaaagc

SEQ ID NO: 9040891 - DNA, 22 bp, Homo sapiens
ttttagaagttcatgtgggatt

SEQ ID NO: 9040892 - DNA, 22 bp, Homo sapiens
ttttagaagttcatgtgggatt

SEQ ID NO: 9040893 - DNA, 22 bp, Homo sapiens
ttttagtttggatttctaaagc

SEQ ID NO: 9040894 - DNA, 22 bp, Homo sapiens
tttgtttgaaagtctctacagc

SEQ ID NO: 9040895 - DNA, 22 bp, Homo sapiens
tttgtttgccacacaaaacagt

SEQ ID NO: 9040896 - DNA, 22 bp, Homo sapiens
tttgtttgaaagtctctacagc

SEQ ID NO: 9040897 - DNA, 22 bp, Homo sapiens
tttgtttgcggcacatagtttg

SEQ ID NO: 9040898 - DNA, 22 bp, Homo sapiens
tttgtttggcaacttggtaaag

SEQ ID NO: 9040899 - DNA, 22 bp, Homo sapiens
tttgtttgcggcacatagtttg

SEQ ID NO: 9040900 - DNA, 22 bp, Homo sapiens
tttgtttgccacacaaaacagt

SEQ ID NO: 9040901 - DNA, 22 bp, Homo sapiens
tttgttttcaatgtgtcattca

SEQ ID NO: 9040902 - DNA, 22 bp, Homo sapiens
tttgttttcaatgtgtcattca

SEQ ID NO: 9040903 - DNA, 22 bp, Homo sapiens
tttgttttcaatgtgtcattca

SEQ ID NO: 9040904 - DNA, 21 bp, Homo sapiens
tttgtttgtatcagaatggcc

SEQ ID NO: 9040905 - DNA, 22 bp, Homo sapiens
tttgtttagatggtaaatcagt

SEQ ID NO: 9040906 - DNA, 22 bp, Homo sapiens
tttgtttagagaattgaagcag

SEQ ID NO: 9040907 - DNA, 22 bp, Homo sapiens
tttgtttagatggtaaatcagt

SEQ ID NO: 9040908 - DNA, 22 bp, Homo sapiens
tttgtttagagaattgaagcag

SEQ ID NO: 9040909 - DNA, 22 bp, Homo sapiens
tttgtttagagaattgaagcag

SEQ ID NO: 9040910 - DNA, 22 bp, Homo sapiens
tttgtttactcattcattgatg

SEQ ID NO: 9040911 - DNA, 22 bp, Homo sapiens
tttgtttagatggtaaatcagt

SEQ ID NO: 9040912 - DNA, 22 bp, Homo sapiens
tttgtttagatggtaaatcagt

SEQ ID NO: 9040913 - DNA, 22 bp, Homo sapiens
tttgtttagatggtaaatcagt

SEQ ID NO: 9040914 - DNA, 22 bp, Homo sapiens
tttgtttcgcagcctctctctg

SEQ ID NO: 9040915 - DNA, 22 bp, Homo sapiens
tttgtttcgcagcctctctctg

SEQ ID NO: 9040916 - DNA, 22 bp, Homo sapiens
tttgtttctgcaatacctatag

SEQ ID NO: 9040917 - DNA, 22 bp, Homo sapiens
tttgtttatcaaggtctagcat

SEQ ID NO: 9040918 - DNA, 22 bp, Homo sapiens
tttgtttagatggtaaatcagt

SEQ ID NO: 9040919 - DNA, 22 bp, Homo sapiens
ttttaaactcccctagttggtg

SEQ ID NO: 9040920 - DNA, 22 bp, Homo sapiens
ttttaaactcccctagttggtg

SEQ ID NO: 9040921 - DNA, 22 bp, Homo sapiens
ttttagaagtgcctatcctatg

SEQ ID NO: 9040922 - DNA, 22 bp, Homo sapiens
ttttagaagttcacttgggttt

SEQ ID NO: 9040923 - DNA, 22 bp, Homo sapiens
ttttagaagtgcctatcctatg

SEQ ID NO: 9040924 - DNA, 22 bp, Homo sapiens
tttgttttgaactagctcagaa

SEQ ID NO: 9040925 - DNA, 22 bp, Homo sapiens
ttttaaactatagctggatgct

SEQ ID NO: 9040926 - DNA, 22 bp, Homo sapiens
tttgttttgaactagctcagaa

SEQ ID NO: 9040927 - DNA, 22 bp, Homo sapiens
tttgttttgaactagctcagaa

SEQ ID NO: 9040928 - DNA, 22 bp, Homo sapiens
tttgttttcaatgtgtcattca

SEQ ID NO: 9040929 - DNA, 22 bp, Homo sapiens
tttgttttcaatgtgtcattca

SEQ ID NO: 9040930 - DNA, 22 bp, Homo sapiens
tttgttttcaatgtgtcattca

SEQ ID NO: 9040931 - DNA, 22 bp, Homo sapiens
tttgttttcaatgtgtcattca

SEQ ID NO: 9040932 - DNA, 22 bp, Homo sapiens
tttgttttgaactagctcagaa

SEQ ID NO: 9040933 - DNA, 22 bp, Homo sapiens
tttgttttctgtaggcctttcc

SEQ ID NO: 9040934 - DNA, 22 bp, Homo sapiens
tttgttttctgtaggcctttcc

SEQ ID NO: 9040935 - DNA, 22 bp, Homo sapiens
tttgtataagaacattctagca

SEQ ID NO: 9040936 - DNA, 22 bp, Homo sapiens
tttgtataagaacattctagca

SEQ ID NO: 9040937 - DNA, 22 bp, Homo sapiens
tttgtatgggcagaaattagat

SEQ ID NO: 9040938 - DNA, 22 bp, Homo sapiens
tttgtatgggcagaaattagat

SEQ ID NO: 9040939 - DNA, 22 bp, Homo sapiens
tttgtatgaactggtatgtagg

SEQ ID NO: 9040940 - DNA, 22 bp, Homo sapiens
tttgtattacaaagtcacagta

SEQ ID NO: 9040941 - DNA, 22 bp, Homo sapiens
tttgtattacaaagtcacagta

SEQ ID NO: 9040942 - DNA, 22 bp, Homo sapiens
tttgtattccatatcatgccat

SEQ ID NO: 9040943 - DNA, 22 bp, Homo sapiens
tttgtattacaaagtcacagta

SEQ ID NO: 9040944 - DNA, 22 bp, Homo sapiens
tttgtatgtgataagactattc

SEQ ID NO: 9040945 - DNA, 22 bp, Homo sapiens
tttgtataaattggagcaatgt

SEQ ID NO: 9040946 - DNA, 22 bp, Homo sapiens
tttgtataaattggagcaatgt

SEQ ID NO: 9040947 - DNA, 22 bp, Homo sapiens
tttgtataaatgaagatgctgg

SEQ ID NO: 9040948 - DNA, 22 bp, Homo sapiens
tttgtataagaacattctagca

SEQ ID NO: 9040949 - DNA, 22 bp, Homo sapiens
tttgtataagaacattctagca

SEQ ID NO: 9040950 - DNA, 22 bp, Homo sapiens
tttgtataagaacattctagca

SEQ ID NO: 9040951 - DNA, 22 bp, Homo sapiens
tttgtataaattttgaggtgag

SEQ ID NO: 9040952 - DNA, 22 bp, Homo sapiens
tttgtataagaacattctagca

SEQ ID NO: 9040953 - DNA, 22 bp, Homo sapiens
tttgtagcagcatgatttataa

SEQ ID NO: 9040954 - DNA, 22 bp, Homo sapiens
tttgtagcagcatgatttataa

SEQ ID NO: 9040955 - DNA, 22 bp, Homo sapiens
tttgtagatagaaaaatgatta

SEQ ID NO: 9040956 - DNA, 22 bp, Homo sapiens
tttgtagcagcatgatttataa

SEQ ID NO: 9040957 - DNA, 22 bp, Homo sapiens
tttgtagcagcatgatttataa

SEQ ID NO: 9040958 - DNA, 22 bp, Homo sapiens
tttgtagattcattgaactttt

SEQ ID NO: 9040959 - DNA, 22 bp, Homo sapiens
tttgtagagaatgttaagcact

SEQ ID NO: 9040960 - DNA, 22 bp, Homo sapiens
tttgtagagaataaaacaaatt

SEQ ID NO: 9040961 - DNA, 22 bp, Homo sapiens
tttgtagagaatgttaagcact

SEQ ID NO: 9040962 - DNA, 22 bp, Homo sapiens
tttgtagactaccagtaattgt

SEQ ID NO: 9040963 - DNA, 22 bp, Homo sapiens
tttgtagagaataaaacaaatt

SEQ ID NO: 9040964 - DNA, 22 bp, Homo sapiens
tttgtagagggtaattgacaga

SEQ ID NO: 9040965 - DNA, 22 bp, Homo sapiens
tttgtagagaatgttaagcact

SEQ ID NO: 9040966 - DNA, 22 bp, Homo sapiens
tttgtagatagaaaaatgatta

SEQ ID NO: 9040967 - DNA, 22 bp, Homo sapiens
tttgtagaataatatctttctg

SEQ ID NO: 9040968 - DNA, 22 bp, Homo sapiens
tttgtagaactgtagaacaatg

SEQ ID NO: 9040969 - DNA, 22 bp, Homo sapiens
tttgtagaactatacttacatt

SEQ ID NO: 9040970 - DNA, 22 bp, Homo sapiens
tttgtagaactgtagaacaatg

SEQ ID NO: 9040971 - DNA, 22 bp, Homo sapiens
tttgtactatggtttttcacta

SEQ ID NO: 9040972 - DNA, 23 bp, Homo sapiens
tttgtacattgaggaggcagaat

SEQ ID NO: 9040973 - DNA, 22 bp, Homo sapiens
tttgtacatttcactccattgt

SEQ ID NO: 9040974 - DNA, 22 bp, Homo sapiens
tttgtacatttcactccattgt

SEQ ID NO: 9040975 - DNA, 22 bp, Homo sapiens
tttgtactgaccaattatttga

SEQ ID NO: 9040976 - DNA, 23 bp, Homo sapiens
tttgtactgcattatgagacaca

SEQ ID NO: 9040977 - DNA, 22 bp, Homo sapiens
tttgtactctcagaattcagaa

SEQ ID NO: 9040978 - DNA, 22 bp, Homo sapiens
tttgtactggaagaacatgcaa

SEQ ID NO: 9040979 - DNA, 22 bp, Homo sapiens
tttgtactggaagaacatgcaa

SEQ ID NO: 9040980 - DNA, 22 bp, Homo sapiens
tttgtactgccacagctgacgt

SEQ ID NO: 9040981 - DNA, 22 bp, Homo sapiens
tttgtactgccacagctgacgt

SEQ ID NO: 9040982 - DNA, 23 bp, Homo sapiens
tttgtactgcattatgagacaca

SEQ ID NO: 9040983 - DNA, 22 bp, Homo sapiens
tttgttgtgaacagaataatat

SEQ ID NO: 9040984 - DNA, 22 bp, Homo sapiens
tttgtttactcattcattgatg

SEQ ID NO: 9040985 - DNA, 22 bp, Homo sapiens
tttgtttactcattcattgatg

SEQ ID NO: 9040986 - DNA, 22 bp, Homo sapiens
tttgtttactcattcattgatg

SEQ ID NO: 9040987 - DNA, 22 bp, Homo sapiens
tttgtttacaaaaataagcagt

SEQ ID NO: 9040988 - DNA, 22 bp, Homo sapiens
tttgtttacaaaaataagcagt

SEQ ID NO: 9040989 - DNA, 22 bp, Homo sapiens
tttgtttacaaaaataagcagt

SEQ ID NO: 9040990 - DNA, 22 bp, Homo sapiens
tttgttctgcatcacagaaaaa

SEQ ID NO: 9040991 - DNA, 22 bp, Homo sapiens
tttgttcttagtatctgtgtgc

SEQ ID NO: 9040992 - DNA, 22 bp, Homo sapiens
tttgttcttgcaacagttatta

SEQ ID NO: 9040993 - DNA, 22 bp, Homo sapiens
tttgttcttgcaacagttatta

SEQ ID NO: 9040994 - DNA, 22 bp, Homo sapiens
tttgttcttgcaacagttatta

SEQ ID NO: 9040995 - DNA, 22 bp, Homo sapiens
tttgttcacctagcaaactttt

SEQ ID NO: 9040996 - DNA, 22 bp, Homo sapiens
tttgtcagtcatgtctgctttt

SEQ ID NO: 9040997 - DNA, 22 bp, Homo sapiens
tttgttcagctctcattgatta

SEQ ID NO: 9040998 - DNA, 23 bp, Homo sapiens
tttgttcactcctgggaaagaca

SEQ ID NO: 9040999 - DNA, 22 bp, Homo sapiens
tttgtcagggatcagatcggta

SEQ ID NO: 9041000 - DNA, 22 bp, Homo sapiens
tttgtcaataactaccaacagg

SEQ ID NO: 9041001 - DNA, 22 bp, Homo sapiens
tttgtcaatcccttgaaaacct

SEQ ID NO: 9041002 - DNA, 22 bp, Homo sapiens
tttgtcaataactaccaacagg

SEQ ID NO: 9041003 - DNA, 22 bp, Homo sapiens
tttgtatttttcccagctagct

SEQ ID NO: 9041004 - DNA, 22 bp, Homo sapiens
tttgtatttttcccagctagct

SEQ ID NO: 9041005 - DNA, 22 bp, Homo sapiens
ttttatctacctatgctcattt

SEQ ID NO: 9041006 - DNA, 22 bp, Homo sapiens
ttttatctacctatgctcattt

SEQ ID NO: 9041007 - DNA, 22 bp, Homo sapiens
ttttatctacctatgctcattt

SEQ ID NO: 9041008 - DNA, 22 bp, Homo sapiens
ttttatctacctatgctcattt

SEQ ID NO: 9041009 - DNA, 22 bp, Homo sapiens
ttttatctacctatgctcattt

SEQ ID NO: 9041010 - DNA, 22 bp, Homo sapiens
ttttatcattacccagctgaaa

SEQ ID NO: 9041011 - DNA, 22 bp, Homo sapiens
ttttatctgcttcattagttga

SEQ ID NO: 9041012 - DNA, 22 bp, Homo sapiens
ttttatctgcttcattagttga

SEQ ID NO: 9041013 - DNA, 22 bp, Homo sapiens
ttttatctgtgacatctggcag

SEQ ID NO: 9041014 - DNA, 22 bp, Homo sapiens
ttttatctgcttcattagttga

SEQ ID NO: 9041015 - DNA, 22 bp, Homo sapiens
ttttatctgcttcattagttga

SEQ ID NO: 9041016 - DNA, 22 bp, Homo sapiens
ttttatctgcttcattagttga

SEQ ID NO: 9041017 - DNA, 22 bp, Homo sapiens
ttttatctacctatgctcattt

SEQ ID NO: 9041018 - DNA, 19 bp, Homo sapiens
ttttccttctcctcttaat

SEQ ID NO: 9041019 - DNA, 19 bp, Homo sapiens
ttttccttctcctcttaat

SEQ ID NO: 9041020 - DNA, 19 bp, Homo sapiens
ttttccttctcctcttaat

SEQ ID NO: 9041021 - DNA, 20 bp, Homo sapiens
ttttccttctgagtatgttg

SEQ ID NO: 9041022 - DNA, 19 bp, Homo sapiens
ttttccttctcctcttaat

SEQ ID NO: 9041023 - DNA, 19 bp, Homo sapiens
ttttccttctcctcttaat

SEQ ID NO: 9041024 - DNA, 19 bp, Homo sapiens
ttttccttctcctcttaat

SEQ ID NO: 9041025 - DNA, 22 bp, Homo sapiens
ttttatcttcattcctatctac

SEQ ID NO: 9041026 - DNA, 22 bp, Homo sapiens
ttttatctgtgacatctggcag

SEQ ID NO: 9041027 - DNA, 22 bp, Homo sapiens
ttttatcttcattcctatctac

SEQ ID NO: 9041028 - DNA, 22 bp, Homo sapiens
ttttatgaagataattttctga

SEQ ID NO: 9041029 - DNA, 22 bp, Homo sapiens
ttttatgaagataattttctga

SEQ ID NO: 9041030 - DNA, 22 bp, Homo sapiens
ttttatgaagataattttctga

SEQ ID NO: 9041031 - DNA, 20 bp, Homo sapiens
ttttccttctgagtatgttg

SEQ ID NO: 9041032 - DNA, 20 bp, Homo sapiens
ttttccttctgagtatgttg

SEQ ID NO: 9041033 - DNA, 22 bp, Homo sapiens
ttttccttctgatactccattt

SEQ ID NO: 9041034 - DNA, 20 bp, Homo sapiens
ttttccttctgagtatgttg

SEQ ID NO: 9041035 - DNA, 20 bp, Homo sapiens
ttttccttctgagtatgttg

SEQ ID NO: 9041036 - DNA, 20 bp, Homo sapiens
ttttccttctgagtatgttg

SEQ ID NO: 9041037 - DNA, 20 bp, Homo sapiens
ttttccttgttgccgctgct

SEQ ID NO: 9041038 - DNA, 20 bp, Homo sapiens
ttttccttgttgccgctgct

SEQ ID NO: 9041039 - DNA, 22 bp, Homo sapiens
ttttccttctgatactccattt

SEQ ID NO: 9041040 - DNA, 22 bp, Homo sapiens
ttttccttctgatactccattt

SEQ ID NO: 9041041 - DNA, 22 bp, Homo sapiens
ttttccttctgatactccattt

SEQ ID NO: 9041042 - DNA, 22 bp, Homo sapiens
ttttccttctgatactccattt

SEQ ID NO: 9041043 - DNA, 22 bp, Homo sapiens
ttttccttctgatactccattt

SEQ ID NO: 9041044 - DNA, 22 bp, Homo sapiens
ttttccttctgatactccattt

SEQ ID NO: 9041045 - DNA, 22 bp, Homo sapiens
ttttccttctgatactccattt

SEQ ID NO: 9041046 - DNA, 22 bp, Homo sapiens
ttttcctttgattcccagatgt

SEQ ID NO: 9041047 - DNA, 22 bp, Homo sapiens
ttttcctttgaaaggtgagggc

SEQ ID NO: 9041048 - DNA, 22 bp, Homo sapiens
ttttcctttggaagatgcatat

SEQ ID NO: 9041049 - DNA, 22 bp, Homo sapiens
ttttcctttgattcccagatgt

SEQ ID NO: 9041050 - DNA, 22 bp, Homo sapiens
ttttcctttgattcccagatgt

SEQ ID NO: 9041051 - DNA, 22 bp, Homo sapiens
ttttcctttgattcccagatgt

SEQ ID NO: 9041052 - DNA, 22 bp, Homo sapiens
ttttcctttgattcccagatgt

SEQ ID NO: 9041053 - DNA, 22 bp, Homo sapiens
ttttcctttgattcccagatgt

SEQ ID NO: 9041054 - DNA, 22 bp, Homo sapiens
ttttcctttcatcaggacaaag

SEQ ID NO: 9041055 - DNA, 20 bp, Homo sapiens
ttttccttgttgccgctgct

SEQ ID NO: 9041056 - DNA, 22 bp, Homo sapiens
ttttcctttcatcaggacaaag

SEQ ID NO: 9041057 - DNA, 22 bp, Homo sapiens
ttttcctttcatcaggacaaag

SEQ ID NO: 9041058 - DNA, 22 bp, Homo sapiens
ttttcctttcatcaggacaaag

SEQ ID NO: 9041059 - DNA, 22 bp, Homo sapiens
ttttcctttgaaaggtgagggc

SEQ ID NO: 9041060 - DNA, 22 bp, Homo sapiens
ttttctattaactcattttgca

SEQ ID NO: 9041061 - DNA, 22 bp, Homo sapiens
ttttctattaactcattttgca

SEQ ID NO: 9041062 - DNA, 22 bp, Homo sapiens
ttttctattaactcattttgca

SEQ ID NO: 9041063 - DNA, 22 bp, Homo sapiens
ttttctattaactcattttgca

SEQ ID NO: 9041064 - DNA, 22 bp, Homo sapiens
ttttctattaactcattttgca

SEQ ID NO: 9041065 - DNA, 22 bp, Homo sapiens
ttttctatctcctagaactgcc

SEQ ID NO: 9041066 - DNA, 22 bp, Homo sapiens
ttttctaatttagttaccctcc

SEQ ID NO: 9041067 - DNA, 22 bp, Homo sapiens
ttttctaatttagttaccctcc

SEQ ID NO: 9041068 - DNA, 22 bp, Homo sapiens
ttttctatctcctagaactgcc

SEQ ID NO: 9041069 - DNA, 22 bp, Homo sapiens
ttttctaagggaaacgtcctcc

SEQ ID NO: 9041070 - DNA, 22 bp, Homo sapiens
ttttctaactttacactcgaaa

SEQ ID NO: 9041071 - DNA, 22 bp, Homo sapiens
ttttcttctacctgctgtccaa

SEQ ID NO: 9041072 - DNA, 22 bp, Homo sapiens
ttttcttggagtggctgtcctt

SEQ ID NO: 9041073 - DNA, 22 bp, Homo sapiens
ttttcctttggaagatgcatat

SEQ ID NO: 9041074 - DNA, 23 bp, Homo sapiens
ttttcctttggacaggctgtatt

SEQ ID NO: 9041075 - DNA, 22 bp, Homo sapiens
ttttcctttgattcccagatgt

SEQ ID NO: 9041076 - DNA, 22 bp, Homo sapiens
ttttcctttggaagatgcatat

SEQ ID NO: 9041077 - DNA, 22 bp, Homo sapiens
ttttcctttggaagatgcatat

SEQ ID NO: 9041078 - DNA, 22 bp, Homo sapiens
ttttcctttggaagatgcatat

SEQ ID NO: 9041079 - DNA, 22 bp, Homo sapiens
ttttcctttggaagatgcatat

SEQ ID NO: 9041080 - DNA, 23 bp, Homo sapiens
ttttcctttggacaggctgtatt

SEQ ID NO: 9041081 - DNA, 23 bp, Homo sapiens
ttttcctttggacaggctgtatt

SEQ ID NO: 9041082 - DNA, 23 bp, Homo sapiens
ttttcctttggacaggctgtatt

SEQ ID NO: 9041083 - DNA, 22 bp, Homo sapiens
ttttcgtttatttgacatgtaa

SEQ ID NO: 9041084 - DNA, 22 bp, Homo sapiens
ttttcgtttatttgacatgtaa

SEQ ID NO: 9041085 - DNA, 22 bp, Homo sapiens
ttttctaaaagaagtcactgat

SEQ ID NO: 9041086 - DNA, 22 bp, Homo sapiens
ttttctaaaagaagtcactgat

SEQ ID NO: 9041087 - DNA, 22 bp, Homo sapiens
ttttctaaaagaagtcactgat

SEQ ID NO: 9041088 - DNA, 22 bp, Homo sapiens
ttttctaaaatatccaggacag

SEQ ID NO: 9041089 - DNA, 22 bp, Homo sapiens
ttttctaaaatatccaggacag

SEQ ID NO: 9041090 - DNA, 22 bp, Homo sapiens
ttttctaacatctagtaatttg

SEQ ID NO: 9041091 - DNA, 22 bp, Homo sapiens
ttttctaacatctagtaatttg

SEQ ID NO: 9041092 - DNA, 22 bp, Homo sapiens
ttttctaacatctagtaatttg

SEQ ID NO: 9041093 - DNA, 22 bp, Homo sapiens
ttttctaacatctagtaatttg

SEQ ID NO: 9041094 - DNA, 22 bp, Homo sapiens
ttttctaacatctagtaatttg

SEQ ID NO: 9041095 - DNA, 22 bp, Homo sapiens
ttttctaactttacactcgaaa

SEQ ID NO: 9041096 - DNA, 22 bp, Homo sapiens
ttttctaacatctagtaatttg

SEQ ID NO: 9041097 - DNA, 22 bp, Homo sapiens
ttttctaacatctagtaatttg

SEQ ID NO: 9041098 - DNA, 22 bp, Homo sapiens
ttttctaacatctagtaatttg

SEQ ID NO: 9041099 - DNA, 22 bp, Homo sapiens
ttttctaacatctagtaatttg

SEQ ID NO: 9041100 - DNA, 22 bp, Homo sapiens
ttttctaacatctagtaatttg

SEQ ID NO: 9041101 - DNA, 23 bp, Homo sapiens
ttttgcaataagtcactggaata

SEQ ID NO: 9041102 - DNA, 22 bp, Homo sapiens
ttttgcaaagtacattatcagg

SEQ ID NO: 9041103 - DNA, 23 bp, Homo sapiens
ttttgacaggaggaaggtgttga

SEQ ID NO: 9041104 - DNA, 22 bp, Homo sapiens
ttttgatatcatgatgaacaga

SEQ ID NO: 9041105 - DNA, 22 bp, Homo sapiens
ttttgccgaaggtatctgagat

SEQ ID NO: 9041106 - DNA, 22 bp, Homo sapiens
ttttgcaatgagatgcttgtca

SEQ ID NO: 9041107 - DNA, 22 bp, Homo sapiens
ttttgcagccacatctgacctg

SEQ ID NO: 9041108 - DNA, 22 bp, Homo sapiens
ttttgcatctggtgaagaccag

SEQ ID NO: 9041109 - DNA, 22 bp, Homo sapiens
ttttgcaacacaggctacttca

SEQ ID NO: 9041110 - DNA, 22 bp, Homo sapiens
ttttgcagaatgggaaggtagt

SEQ ID NO: 9041111 - DNA, 22 bp, Homo sapiens
ttttggcaagctgggagatatt

SEQ ID NO: 9041112 - DNA, 22 bp, Homo sapiens
ttttggcaagctgggagatatt

SEQ ID NO: 9041113 - DNA, 21 bp, Homo sapiens
ttttggcaaggtgcatgtttc

SEQ ID NO: 9041114 - DNA, 22 bp, Homo sapiens
ttttggaatttatacagtaatg

SEQ ID NO: 9041115 - DNA, 22 bp, Homo sapiens
ttttggcaaaggcattctcttt

SEQ ID NO: 9041116 - DNA, 22 bp, Homo sapiens
ttttggaatctgggaaaacagt

SEQ ID NO: 9041117 - DNA, 22 bp, Homo sapiens
ttttggaatctgggaaaacagt

SEQ ID NO: 9041118 - DNA, 22 bp, Homo sapiens
ttttggatgagcccagatttct

SEQ ID NO: 9041119 - DNA, 22 bp, Homo sapiens
ttttggaatttatacagtaatg

SEQ ID NO: 9041120 - DNA, 22 bp, Homo sapiens
ttttggaatttatacagtaatg

SEQ ID NO: 9041121 - DNA, 22 bp, Homo sapiens
ttttgacaatgctaatctcaat

SEQ ID NO: 9041122 - DNA, 22 bp, Homo sapiens
ttttgatatcatgatgaacaga

SEQ ID NO: 9041123 - DNA, 20 bp, Homo sapiens
ttttgatagcaaagacggta

SEQ ID NO: 9041124 - DNA, 20 bp, Homo sapiens
ttttgatagcaaagacggta

SEQ ID NO: 9041125 - DNA, 22 bp, Homo sapiens
ttttgaataattcagaaacagc

SEQ ID NO: 9041126 - DNA, 19 bp, Homo sapiens
ttttgaagtatgagacagg

SEQ ID NO: 9041127 - DNA, 22 bp, Homo sapiens
ttttgaataattcagaaacagc

SEQ ID NO: 9041128 - DNA, 19 bp, Homo sapiens
ttttgaagtatgagacagg

SEQ ID NO: 9041129 - DNA, 22 bp, Homo sapiens
ttttgaagaagatgggaattta

SEQ ID NO: 9041130 - DNA, 19 bp, Homo sapiens
ttttgaagtatgagacagg

SEQ ID NO: 9041131 - DNA, 22 bp, Homo sapiens
ttttgaaagagtcctgctacag

SEQ ID NO: 9041132 - DNA, 22 bp, Homo sapiens
ttttgaaagagtcctgctacag

SEQ ID NO: 9041133 - DNA, 22 bp, Homo sapiens
ttttgaaagagtcctgctacag

SEQ ID NO: 9041134 - DNA, 22 bp, Homo sapiens
ttttgaaagccaggtttgtatg

SEQ ID NO: 9041135 - DNA, 22 bp, Homo sapiens
ttttgaaagccaggtttgtatg

SEQ ID NO: 9041136 - DNA, 22 bp, Homo sapiens
ttttgaaagggtgatttggctt

SEQ ID NO: 9041137 - DNA, 22 bp, Homo sapiens
ttttgaaagccaggtttgtatg

SEQ ID NO: 9041138 - DNA, 22 bp, Homo sapiens
ttttgaaagccaggtttgtatg

SEQ ID NO: 9041139 - DNA, 22 bp, Homo sapiens
ttttgaaagggtgatttggctt

SEQ ID NO: 9041140 - DNA, 22 bp, Homo sapiens
ttttgaaagggtgatttggctt

SEQ ID NO: 9041141 - DNA, 22 bp, Homo sapiens
ttttgaaagggtgatttggctt

SEQ ID NO: 9041142 - DNA, 22 bp, Homo sapiens
ttttggcactgcgtctacatgg

SEQ ID NO: 9041143 - DNA, 22 bp, Homo sapiens
ttttggcagattacttaatatg

SEQ ID NO: 9041144 - DNA, 22 bp, Homo sapiens
ttttggcatcacttgccatcta

SEQ ID NO: 9041145 - DNA, 22 bp, Homo sapiens
ttttggccacatccttttgagt

SEQ ID NO: 9041146 - DNA, 22 bp, Homo sapiens
ttttggcagcaggtatggggca

SEQ ID NO: 9041147 - DNA, 22 bp, Homo sapiens
ttttggcaggatatgcaccagc

SEQ ID NO: 9041148 - DNA, 22 bp, Homo sapiens
tttttcatgagactagaagtca

SEQ ID NO: 9041149 - DNA, 22 bp, Homo sapiens
tttttcatgagactagaagtca

SEQ ID NO: 9041150 - DNA, 22 bp, Homo sapiens
tttttcatgagactagaagtca

SEQ ID NO: 9041151 - DNA, 22 bp, Homo sapiens
tttttcatgagactagaagtca

SEQ ID NO: 9041152 - DNA, 22 bp, Homo sapiens
tttttcatgagactagaagtca

SEQ ID NO: 9041153 - DNA, 22 bp, Homo sapiens
tttttcattgcagcctctctcc

SEQ ID NO: 9041154 - DNA, 22 bp, Homo sapiens
tttttcatgagactagaagtca

SEQ ID NO: 9041155 - DNA, 22 bp, Homo sapiens
tttttcatgagactagaagtca

SEQ ID NO: 9041156 - DNA, 22 bp, Homo sapiens
tttttcatgagactagaagtca

SEQ ID NO: 9041157 - DNA, 22 bp, Homo sapiens
ttttggctccagtggtttgtgc

SEQ ID NO: 9041158 - DNA, 22 bp, Homo sapiens
ttttggctccagtggtttgtgc

SEQ ID NO: 9041159 - DNA, 22 bp, Homo sapiens
ttttggccacatccttttgagt

SEQ ID NO: 9041160 - DNA, 22 bp, Homo sapiens
tttttcatctgattgataactc

SEQ ID NO: 9041161 - DNA, 22 bp, Homo sapiens
tttttcatctgattgataactc

SEQ ID NO: 9041162 - DNA, 22 bp, Homo sapiens
ttttggctctgcaggtttgcac

SEQ ID NO: 9041163 - DNA, 22 bp, Homo sapiens
ttttggctctgcaggtttgcac

SEQ ID NO: 9041164 - DNA, 22 bp, Homo sapiens
tttttcctaagcagtggagctg

SEQ ID NO: 9041165 - DNA, 22 bp, Homo sapiens
tttttcctaagcagtggagctg

SEQ ID NO: 9041166 - DNA, 22 bp, Homo sapiens
tttttcctagcgatttgtcagc

SEQ ID NO: 9041167 - DNA, 22 bp, Homo sapiens
tttttcctagcgatttgtcagc

SEQ ID NO: 9041168 - DNA, 22 bp, Homo sapiens
tttttcctagcgatttgtcagc

SEQ ID NO: 9041169 - DNA, 22 bp, Homo sapiens
tttttcctagcgatttgtcagc

SEQ ID NO: 9041170 - DNA, 22 bp, Homo sapiens
tttttcctagtgctttctggta

SEQ ID NO: 9041171 - DNA, 22 bp, Homo sapiens
tttttcctagtgctttctggta

SEQ ID NO: 9041172 - DNA, 22 bp, Homo sapiens
tttttcctagtgctttctggta

SEQ ID NO: 9041173 - DNA, 22 bp, Homo sapiens
tttttccttaggggttactcac

SEQ ID NO: 9041174 - DNA, 22 bp, Homo sapiens
tttttccttaggggttactcac

SEQ ID NO: 9041175 - DNA, 22 bp, Homo sapiens
tttttccttaggggttactcac

SEQ ID NO: 9041176 - DNA, 20 bp, Homo sapiens
tttttccttctctacaggca

SEQ ID NO: 9041177 - DNA, 20 bp, Homo sapiens
tttttccttctctacaggca

SEQ ID NO: 9041178 - DNA, 22 bp, Homo sapiens
tttttcattgcagcctctctcc

SEQ ID NO: 9041179 - DNA, 22 bp, Homo sapiens
tttttcattgcagcctctctcc

SEQ ID NO: 9041180 - DNA, 22 bp, Homo sapiens
tttttcattgcagcctctctcc

SEQ ID NO: 9041181 - DNA, 22 bp, Homo sapiens
tttttcattgcagcctctctcc

SEQ ID NO: 9041182 - DNA, 22 bp, Homo sapiens
tttttccacataccctaggcca

SEQ ID NO: 9041183 - DNA, 22 bp, Homo sapiens
tttttccacataccctaggcca

SEQ ID NO: 9041184 - DNA, 22 bp, Homo sapiens
tttttcattgcagcctctctcc

SEQ ID NO: 9041185 - DNA, 22 bp, Homo sapiens
tttttccacataccctaggcca

SEQ ID NO: 9041186 - DNA, 22 bp, Homo sapiens
tttttccaccgtacttcctgag

SEQ ID NO: 9041187 - DNA, 22 bp, Homo sapiens
tttttccaccgtacttcctgag

SEQ ID NO: 9041188 - DNA, 22 bp, Homo sapiens
tttttcccatatagaaagccaa

SEQ ID NO: 9041189 - DNA, 22 bp, Homo sapiens
tttttccagggttagatgttta

SEQ ID NO: 9041190 - DNA, 22 bp, Homo sapiens
tttttccagggttagatgttta

SEQ ID NO: 9041191 - DNA, 22 bp, Homo sapiens
tttttccagggttagatgttta

SEQ ID NO: 9041192 - DNA, 22 bp, Homo sapiens
tttttccagggttagatgttta

SEQ ID NO: 9041193 - DNA, 23 bp, Homo sapiens
ttttttgtcttgctaggctgccc

SEQ ID NO: 9041194 - DNA, 23 bp, Homo sapiens
ttttttgtcttgctaggctgccc

SEQ ID NO: 9041195 - DNA, 22 bp, Homo sapiens
ttttttgtcccagagagcctgg

SEQ ID NO: 9041196 - DNA, 22 bp, Homo sapiens
ttttttgtcccagagagcctgg

SEQ ID NO: 9041197 - DNA, 22 bp, Homo sapiens
tttttgtagtcattagaagagg

SEQ ID NO: 9041198 - DNA, 22 bp, Homo sapiens
tttttgggtccaggctgtatct

SEQ ID NO: 9041199 - DNA, 22 bp, Homo sapiens
tttttgggtccaggctgtatct

SEQ ID NO: 9041200 - DNA, 22 bp, Homo sapiens
tttttgggtccaggctgtatct

SEQ ID NO: 9041201 - DNA, 22 bp, Homo sapiens
tttttgggtccaggctgtatct

SEQ ID NO: 9041202 - DNA, 22 bp, Homo sapiens
tttttgggtccaggctgtatct

SEQ ID NO: 9041203 - DNA, 22 bp, Homo sapiens
tttttgggtccaggctgtatct

SEQ ID NO: 9041204 - DNA, 22 bp, Homo sapiens
ttttttgtcttgaagaaatggt

SEQ ID NO: 9041205 - DNA, 22 bp, Homo sapiens
ttttttgtcttgaagaaatggt

SEQ ID NO: 9041206 - DNA, 22 bp, Homo sapiens
ttttttgtcttgaagaaatggt

SEQ ID NO: 9041207 - DNA, 22 bp, Homo sapiens
ttttttgtcttgaagaaatggt

SEQ ID NO: 9041208 - DNA, 22 bp, Homo sapiens
ttttttgtcttgaagaaatggt

SEQ ID NO: 9041209 - DNA, 22 bp, Homo sapiens
tttttgcaccaacctaatagaa

SEQ ID NO: 9041210 - DNA, 22 bp, Homo sapiens
tttttgcaccaacctaatagaa

SEQ ID NO: 9041211 - DNA, 22 bp, Homo sapiens
tttttgcaccaacctaatagaa

SEQ ID NO: 9041212 - DNA, 22 bp, Homo sapiens
tttttgcaccaacctaatagaa

SEQ ID NO: 9041213 - DNA, 22 bp, Homo sapiens
tttttgctaatccccagccact

SEQ ID NO: 9041214 - DNA, 22 bp, Homo sapiens
tttttgctccacaactttgaag

SEQ ID NO: 9041215 - DNA, 22 bp, Homo sapiens
tttttgctgataagcagaattc

SEQ ID NO: 9041216 - DNA, 22 bp, Homo sapiens
tttttgaaggctgatgtgatta

SEQ ID NO: 9041217 - DNA, 22 bp, Homo sapiens
tttttgaaggctgatgtgatta

SEQ ID NO: 9041218 - DNA, 22 bp, Homo sapiens
tttttgaaggctgatgtgatta

SEQ ID NO: 9041219 - DNA, 22 bp, Homo sapiens
tttttgaaggctgatgtgatta

SEQ ID NO: 9041220 - DNA, 22 bp, Homo sapiens
tttttctactggtgttggtgta

SEQ ID NO: 9041221 - DNA, 22 bp, Homo sapiens
tttttctactggtgttggtgta

SEQ ID NO: 9041222 - DNA, 22 bp, Homo sapiens
tttttctagaccttaaaggcca

SEQ ID NO: 9041223 - DNA, 22 bp, Homo sapiens
tttttcttgtgctggatctaat

SEQ ID NO: 9041224 - DNA, 22 bp, Homo sapiens
tttttgaaggctgatgtgatta

SEQ ID NO: 9041225 - DNA, 22 bp, Homo sapiens
tttttcttgtgctggatctaat

SEQ ID NO: 9041226 - DNA, 22 bp, Homo sapiens
tttttctaatggcttaggatgt

SEQ ID NO: 9041227 - DNA, 22 bp, Homo sapiens
tttttctaatggcttaggatgt

SEQ ID NO: 9041228 - DNA, 22 bp, Homo sapiens
tttttctactgcccacattgta

SEQ ID NO: 9041229 - DNA, 22 bp, Homo sapiens
tttttctactgcccacattgta

SEQ ID NO: 9041230 - DNA, 22 bp, Homo sapiens
tttttctactgcccacattgta

SEQ ID NO: 9041231 - DNA, 22 bp, Homo sapiens
tttttctactgcccacattgta

SEQ ID NO: 9041232 - DNA, 22 bp, Homo sapiens
tttttctactgcccacattgta

SEQ ID NO: 9041233 - DNA, 22 bp, Homo sapiens
tttttctactgcccacattgta

SEQ ID NO: 9041234 - DNA, 22 bp, Homo sapiens
tttttccttggatgtgtctctc

SEQ ID NO: 9041235 - DNA, 22 bp, Homo sapiens
tttttccttggatgtgtctctc

SEQ ID NO: 9041236 - DNA, 22 bp, Homo sapiens
tttttccttggatgtgtctctc

SEQ ID NO: 9041237 - DNA, 22 bp, Homo sapiens
tttttctaatggcttaggatgt

SEQ ID NO: 9041238 - DNA, 20 bp, Homo sapiens
tttttccttctctacaggca

SEQ ID NO: 9041239 - DNA, 20 bp, Homo sapiens
tttttccttctctacaggca

SEQ ID NO: 9041240 - DNA, 22 bp, Homo sapiens
ttgtgttaaggtgcatctagtg

SEQ ID NO: 9041241 - DNA, 22 bp, Homo sapiens
ttgtgttaaggtgcatctagtg

SEQ ID NO: 9041242 - DNA, 22 bp, Homo sapiens
ttgtgtgtttgtagaaaatcca

SEQ ID NO: 9041243 - DNA, 22 bp, Homo sapiens
ttgtgtgtttgtagaaaatcca

SEQ ID NO: 9041244 - DNA, 22 bp, Homo sapiens
ttgtgtgtttgtagaaaatcca

SEQ ID NO: 9041245 - DNA, 22 bp, Homo sapiens
ttgtgtgtgtaactttatgaga

SEQ ID NO: 9041246 - DNA, 22 bp, Homo sapiens
ttgtgtgtgtaactttatgaga

SEQ ID NO: 9041247 - DNA, 22 bp, Homo sapiens
ttgtgtgtgtaactttatgaga

SEQ ID NO: 9041248 - DNA, 22 bp, Homo sapiens
ttgtgtttctggccaagatgga

SEQ ID NO: 9041249 - DNA, 22 bp, Homo sapiens
ttgtgtttctggccaagatgga

SEQ ID NO: 9041250 - DNA, 22 bp, Homo sapiens
ttgtgtttctgtgatatgtaaa

SEQ ID NO: 9041251 - DNA, 22 bp, Homo sapiens
ttgtgtttctgtgatatgtaaa

SEQ ID NO: 9041252 - DNA, 22 bp, Homo sapiens
ttgtgttttcttatggcataaa

SEQ ID NO: 9041253 - DNA, 22 bp, Homo sapiens
ttgtgttaaggtgcatctagtg

SEQ ID NO: 9041254 - DNA, 21 bp, Homo sapiens
ttgtgtttccccagtcacttt

SEQ ID NO: 9041255 - DNA, 22 bp, Homo sapiens
ttgtgtttcccttgcatattcc

SEQ ID NO: 9041256 - DNA, 22 bp, Homo sapiens
ttgtgtttcccttgcatattcc

SEQ ID NO: 9041257 - DNA, 22 bp, Homo sapiens
ttgtgtttcccttgcatattcc

SEQ ID NO: 9041258 - DNA, 22 bp, Homo sapiens
ttgtgtgtcttcttcactgccc

SEQ ID NO: 9041259 - DNA, 22 bp, Homo sapiens
ttgtgtgtcttcttcactgccc

SEQ ID NO: 9041260 - DNA, 22 bp, Homo sapiens
ttgtgtgtcttcttcactgccc

SEQ ID NO: 9041261 - DNA, 22 bp, Homo sapiens
ttgtgtgtcttcttcactgccc

SEQ ID NO: 9041262 - DNA, 22 bp, Homo sapiens
ttgtgtgtgagccttcaccaca

SEQ ID NO: 9041263 - DNA, 22 bp, Homo sapiens
ttgtgtgtgagccttcaccaca

SEQ ID NO: 9041264 - DNA, 22 bp, Homo sapiens
ttgtgtgtgagccttcaccaca

SEQ ID NO: 9041265 - DNA, 22 bp, Homo sapiens
ttgtgaatggtgccgcaataaa

SEQ ID NO: 9041266 - DNA, 22 bp, Homo sapiens
ttgtgaatgcttaatatgtttc

SEQ ID NO: 9041267 - DNA, 22 bp, Homo sapiens
ttgtgaatggtgccgcaataaa

SEQ ID NO: 9041268 - DNA, 19 bp, Homo sapiens
ttgtgtgtcagtcagagtt

SEQ ID NO: 9041269 - DNA, 19 bp, Homo sapiens
ttgtgtgtcagtcagagtt

SEQ ID NO: 9041270 - DNA, 19 bp, Homo sapiens
ttgtgtgtcagtcagagtt

SEQ ID NO: 9041271 - DNA, 19 bp, Homo sapiens
ttgtgactggctctgcata

SEQ ID NO: 9041272 - DNA, 22 bp, Homo sapiens
ttgttactaagcctttaaatag

SEQ ID NO: 9041273 - DNA, 22 bp, Homo sapiens
ttgttactgttctacatacagt

SEQ ID NO: 9041274 - DNA, 22 bp, Homo sapiens
ttgttactgttctacatacagt

SEQ ID NO: 9041275 - DNA, 22 bp, Homo sapiens
ttgttacttgcatgtagactaa

SEQ ID NO: 9041276 - DNA, 22 bp, Homo sapiens
ttgttactaagcctttaaatag

SEQ ID NO: 9041277 - DNA, 21 bp, Homo sapiens
ttgttacattcttatggcata

SEQ ID NO: 9041278 - DNA, 21 bp, Homo sapiens
ttgttacattcttatggcata

SEQ ID NO: 9041279 - DNA, 22 bp, Homo sapiens
ttgttacatggacaactgtatg

SEQ ID NO: 9041280 - DNA, 22 bp, Homo sapiens
ttgttacatggacaactgtatg

SEQ ID NO: 9041281 - DNA, 22 bp, Homo sapiens
ttgttacatcttatgtaagtgg

SEQ ID NO: 9041282 - DNA, 22 bp, Homo sapiens
ttgttacatggacaactgtatg

SEQ ID NO: 9041283 - DNA, 22 bp, Homo sapiens
ttgttacatcttatgtaagtgg

SEQ ID NO: 9041284 - DNA, 22 bp, Homo sapiens
ttgttacatcttatgtaagtgg

SEQ ID NO: 9041285 - DNA, 22 bp, Homo sapiens
ttgttagatatttcttagaaga

SEQ ID NO: 9041286 - DNA, 22 bp, Homo sapiens
ttgttagatatttcttagaaga

SEQ ID NO: 9041287 - DNA, 20 bp, Homo sapiens
ttgttagaggaatgccatag

SEQ ID NO: 9041288 - DNA, 20 bp, Homo sapiens
ttgttagaggaatgccatag

SEQ ID NO: 9041289 - DNA, 20 bp, Homo sapiens
ttgttagaggaatgccatag

SEQ ID NO: 9041290 - DNA, 22 bp, Homo sapiens
ttgtgttttcttatggcataaa

SEQ ID NO: 9041291 - DNA, 22 bp, Homo sapiens
ttgttaaaaatagatttccagg

SEQ ID NO: 9041292 - DNA, 22 bp, Homo sapiens
ttgttaaaaatagatttccagg

SEQ ID NO: 9041293 - DNA, 22 bp, Homo sapiens
ttgttacagcagcaatagaaaa

SEQ ID NO: 9041294 - DNA, 22 bp, Homo sapiens
ttgttaaaaatagatttccagg

SEQ ID NO: 9041295 - DNA, 22 bp, Homo sapiens
ttgttaaaaatagatttccagg

SEQ ID NO: 9041296 - DNA, 22 bp, Homo sapiens
ttgttacagcagtgatttcaga

SEQ ID NO: 9041297 - DNA, 22 bp, Homo sapiens
ttgttacagcagtgatttcaga

SEQ ID NO: 9041298 - DNA, 22 bp, Homo sapiens
ttgttacatcttatgtaagtgg

SEQ ID NO: 9041299 - DNA, 22 bp, Homo sapiens
ttgttacatacagcagaacata

SEQ ID NO: 9041300 - DNA, 22 bp, Homo sapiens
ttgttacatacagcagaacata

SEQ ID NO: 9041301 - DNA, 22 bp, Homo sapiens
ttgttacatacagcagaacata

SEQ ID NO: 9041302 - DNA, 22 bp, Homo sapiens
ttgttacaggtcctagtggctg

SEQ ID NO: 9041303 - DNA, 20 bp, Homo sapiens
ttgtttaaaggtgaagaggc

SEQ ID NO: 9041304 - DNA, 20 bp, Homo sapiens
ttgtttaaaggtgaagaggc

SEQ ID NO: 9041305 - DNA, 22 bp, Homo sapiens
ttgtttaagccacccaatctgt

SEQ ID NO: 9041306 - DNA, 22 bp, Homo sapiens
ttgtttaagccacccaatctgt

SEQ ID NO: 9041307 - DNA, 22 bp, Homo sapiens
ttgtttaagccacccaatctgt

SEQ ID NO: 9041308 - DNA, 22 bp, Homo sapiens
ttgtttcatggggatgtttatt

SEQ ID NO: 9041309 - DNA, 22 bp, Homo sapiens
ttgtttccataattaagtgtga

SEQ ID NO: 9041310 - DNA, 22 bp, Homo sapiens
ttgtttccagcaaatagtccat

SEQ ID NO: 9041311 - DNA, 22 bp, Homo sapiens
ttgtttcattttggctaaactg

SEQ ID NO: 9041312 - DNA, 21 bp, Homo sapiens
ttgtttcccagagctcgctcc

SEQ ID NO: 9041313 - DNA, 21 bp, Homo sapiens
ttgtttcccagagctcgctcc

SEQ ID NO: 9041314 - DNA, 22 bp, Homo sapiens
ttgtttccattgcagactgtgt

SEQ ID NO: 9041315 - DNA, 22 bp, Homo sapiens
ttgtttaaagaacttctgactt

SEQ ID NO: 9041316 - DNA, 22 bp, Homo sapiens
ttgtttaaaatgtagcaagaaa

SEQ ID NO: 9041317 - DNA, 22 bp, Homo sapiens
ttgttattattactaagtcttc

SEQ ID NO: 9041318 - DNA, 22 bp, Homo sapiens
ttgttattattactaagtcttc

SEQ ID NO: 9041319 - DNA, 22 bp, Homo sapiens
ttgttattattactaagtcttc

SEQ ID NO: 9041320 - DNA, 22 bp, Homo sapiens
ttgttataaagactaaatatgt

SEQ ID NO: 9041321 - DNA, 22 bp, Homo sapiens
ttgttataaagactaaatatgt

SEQ ID NO: 9041322 - DNA, 22 bp, Homo sapiens
ttgttagtaagtgacaaaaatc

SEQ ID NO: 9041323 - DNA, 22 bp, Homo sapiens
ttgttagtaagtgacaaaaatc

SEQ ID NO: 9041324 - DNA, 22 bp, Homo sapiens
ttgttagtaagtgacaaaaatc

SEQ ID NO: 9041325 - DNA, 22 bp, Homo sapiens
ttgttagtttatataatgtagt

SEQ ID NO: 9041326 - DNA, 22 bp, Homo sapiens
ttgttttcacagctttgcccgg

SEQ ID NO: 9041327 - DNA, 22 bp, Homo sapiens
ttgttttcctgggataccaacc

SEQ ID NO: 9041328 - DNA, 22 bp, Homo sapiens
ttgttttattctgcaatttccc

SEQ ID NO: 9041329 - DNA, 22 bp, Homo sapiens
ttgttttatctttctacagact

SEQ ID NO: 9041330 - DNA, 22 bp, Homo sapiens
ttgttttatctttctacagact

SEQ ID NO: 9041331 - DNA, 22 bp, Homo sapiens
ttgttttatctttctacagact

SEQ ID NO: 9041332 - DNA, 22 bp, Homo sapiens
ttgttttattctgcaatttccc

SEQ ID NO: 9041333 - DNA, 22 bp, Homo sapiens
ttgttttattctgcaatttccc

SEQ ID NO: 9041334 - DNA, 22 bp, Homo sapiens
ttgttttctccactgcatctta

SEQ ID NO: 9041335 - DNA, 22 bp, Homo sapiens
ttgttttgctaaagggtcatca

SEQ ID NO: 9041336 - DNA, 22 bp, Homo sapiens
ttgttttggaagaacttactct

SEQ ID NO: 9041337 - DNA, 22 bp, Homo sapiens
ttgttttggaagaacttactct

SEQ ID NO: 9041338 - DNA, 22 bp, Homo sapiens
ttgttttggaagaacttactct

SEQ ID NO: 9041339 - DNA, 22 bp, Homo sapiens
ttgttttggagatgagctaaaa

SEQ ID NO: 9041340 - DNA, 22 bp, Homo sapiens
ttgttttggagatgagctaaaa

SEQ ID NO: 9041341 - DNA, 22 bp, Homo sapiens
ttgttttggagatgagctaaaa

SEQ ID NO: 9041342 - DNA, 22 bp, Homo sapiens
ttgtttttaaacatgtgactga

SEQ ID NO: 9041343 - DNA, 22 bp, Homo sapiens
ttgtttttaaacatgtgactga

SEQ ID NO: 9041344 - DNA, 22 bp, Homo sapiens
ttgtttttaaacatgtgactga

SEQ ID NO: 9041345 - DNA, 18 bp, Homo sapiens
ttgttttaagactctgtc

SEQ ID NO: 9041346 - DNA, 22 bp, Homo sapiens
ttgttttaacgactcagcttgt

SEQ ID NO: 9041347 - DNA, 22 bp, Homo sapiens
ttgttttaagccagtctgccta

SEQ ID NO: 9041348 - DNA, 22 bp, Homo sapiens
ttgttttaatgagggaggttga

SEQ ID NO: 9041349 - DNA, 22 bp, Homo sapiens
ttgttttagtaggtacactgag

SEQ ID NO: 9041350 - DNA, 22 bp, Homo sapiens
ttgttttagtaggtacactgag

SEQ ID NO: 9041351 - DNA, 22 bp, Homo sapiens
ttgttttagtaggtacactgag

SEQ ID NO: 9041352 - DNA, 22 bp, Homo sapiens
ttgttttaatgagggaggttga

SEQ ID NO: 9041353 - DNA, 22 bp, Homo sapiens
ttgtttgtgctatttaatgtag

SEQ ID NO: 9041354 - DNA, 20 bp, Homo sapiens
ttgttttaaatcctggatga

SEQ ID NO: 9041355 - DNA, 22 bp, Homo sapiens
ttgttttaacctagtgtttatg

SEQ ID NO: 9041356 - DNA, 22 bp, Homo sapiens
ttgttttaacgactcagcttgt

SEQ ID NO: 9041357 - DNA, 22 bp, Homo sapiens
ttgttttaacctagtgtttatg

SEQ ID NO: 9041358 - DNA, 22 bp, Homo sapiens
ttgttttaacctagtgtttatg

SEQ ID NO: 9041359 - DNA, 22 bp, Homo sapiens
ttgttttaacctagtgtttatg

SEQ ID NO: 9041360 - DNA, 22 bp, Homo sapiens
ttgtttctcctggtgcctgata

SEQ ID NO: 9041361 - DNA, 22 bp, Homo sapiens
ttgtttctcctggtgcctgata

SEQ ID NO: 9041362 - DNA, 22 bp, Homo sapiens
ttgtttctccagtctaggaaaa

SEQ ID NO: 9041363 - DNA, 22 bp, Homo sapiens
ttgtttctcctggtgcctgata

SEQ ID NO: 9041364 - DNA, 22 bp, Homo sapiens
ttgtttctccagtctaggaaaa

SEQ ID NO: 9041365 - DNA, 20 bp, Homo sapiens
ttgtttcctggctgttctgc

SEQ ID NO: 9041366 - DNA, 20 bp, Homo sapiens
ttgtttcctggctgttctgc

SEQ ID NO: 9041367 - DNA, 22 bp, Homo sapiens
ttgtttcctttctatacaggat

SEQ ID NO: 9041368 - DNA, 22 bp, Homo sapiens
ttgtttcctttctatacaggat

SEQ ID NO: 9041369 - DNA, 22 bp, Homo sapiens
ttgtttccctggatctagagct

SEQ ID NO: 9041370 - DNA, 21 bp, Homo sapiens
ttgtttcccagagctcgctcc

SEQ ID NO: 9041371 - DNA, 21 bp, Homo sapiens
ttgtttcccagagctcgctcc

SEQ ID NO: 9041372 - DNA, 21 bp, Homo sapiens
ttgtttcctcccaaaatgcca

SEQ ID NO: 9041373 - DNA, 22 bp, Homo sapiens
ttgtttccctggatctagagct

SEQ ID NO: 9041374 - DNA, 20 bp, Homo sapiens
ttgtttctgctattttctaa

SEQ ID NO: 9041375 - DNA, 22 bp, Homo sapiens
ttgtttctggaaaaggcgagaa

SEQ ID NO: 9041376 - DNA, 22 bp, Homo sapiens
ttgtttcttcaggcttttagga

SEQ ID NO: 9041377 - DNA, 22 bp, Homo sapiens
ttgtttctggaaaaggcgagaa

SEQ ID NO: 9041378 - DNA, 20 bp, Homo sapiens
ttgtttctgctattttctaa

SEQ ID NO: 9041379 - DNA, 20 bp, Homo sapiens
ttgtttctgctattttctaa

SEQ ID NO: 9041380 - DNA, 20 bp, Homo sapiens
ttgtttctgctattttctaa

SEQ ID NO: 9041381 - DNA, 22 bp, Homo sapiens
ttgtttctctggtcttgagtga

SEQ ID NO: 9041382 - DNA, 22 bp, Homo sapiens
ttgtttggaacttggtgccacc

SEQ ID NO: 9041383 - DNA, 22 bp, Homo sapiens
ttgtttgactaaattggtatca

SEQ ID NO: 9041384 - DNA, 22 bp, Homo sapiens
ttgtttgactaaattggtatca

SEQ ID NO: 9041385 - DNA, 23 bp, Homo sapiens
ttgtttctttgtattgtctctat

SEQ ID NO: 9041386 - DNA, 23 bp, Homo sapiens
ttgtttctttgtattgtctctat

SEQ ID NO: 9041387 - DNA, 22 bp, Homo sapiens
ttgtttcttcatttagaagctt

SEQ ID NO: 9041388 - DNA, 17 bp, Homo sapiens
ttgtttcttctctgtgg

SEQ ID NO: 9041389 - DNA, 22 bp, Homo sapiens
ttgtttcttcaggcttttagga

SEQ ID NO: 9041390 - DNA, 22 bp, Homo sapiens
ttgtttctttgaagtttctaga

SEQ ID NO: 9041391 - DNA, 17 bp, Homo sapiens
ttgtttcttctctgtgg

SEQ ID NO: 9041392 - DNA, 22 bp, Homo sapiens
ttgtttctttgaagtttctaga

SEQ ID NO: 9041393 - DNA, 17 bp, Homo sapiens
ttgtttcttctctgtgg

SEQ ID NO: 9041394 - DNA, 22 bp, Homo sapiens
ttgcaaattatataagggatgc

SEQ ID NO: 9041395 - DNA, 22 bp, Homo sapiens
ttgcaaattattttagtccctt

SEQ ID NO: 9041396 - DNA, 22 bp, Homo sapiens
ttgcaaattattttagtccctt

SEQ ID NO: 9041397 - DNA, 22 bp, Homo sapiens
ttgcaaattattttagtccctt

SEQ ID NO: 9041398 - DNA, 22 bp, Homo sapiens
ttgcaaattccaatccaatatt

SEQ ID NO: 9041399 - DNA, 22 bp, Homo sapiens
ttgcaaattccaatccaatatt

SEQ ID NO: 9041400 - DNA, 22 bp, Homo sapiens
ttgcaaattcatggatctgaat

SEQ ID NO: 9041401 - DNA, 18 bp, Homo sapiens
ttgcaaattcttccctgt

SEQ ID NO: 9041402 - DNA, 18 bp, Homo sapiens
ttgcaaattcttccctgt

SEQ ID NO: 9041403 - DNA, 18 bp, Homo sapiens
ttgcaaattcttccctgt

SEQ ID NO: 9041404 - DNA, 22 bp, Homo sapiens
ttgcaaattcgtcactgttaaa

SEQ ID NO: 9041405 - DNA, 22 bp, Homo sapiens
ttgcaaattcgtcactgttaaa

SEQ ID NO: 9041406 - DNA, 22 bp, Homo sapiens
ttgcaaattccaatccaatatt

SEQ ID NO: 9041407 - DNA, 22 bp, Homo sapiens
ttgcaaattgcaagagttggat

SEQ ID NO: 9041408 - DNA, 23 bp, Homo sapiens
ttgcaaatttcagttagttcatg

SEQ ID NO: 9041409 - DNA, 23 bp, Homo sapiens
ttgcaaatttcagttagttcatg

SEQ ID NO: 9041410 - DNA, 21 bp, Homo sapiens
ttgcaacaacctatatatttt

SEQ ID NO: 9041411 - DNA, 23 bp, Homo sapiens
ttgcaaatttcagttagttcatg

SEQ ID NO: 9041412 - DNA, 23 bp, Homo sapiens
ttgcaaatttcagttagttcatg

SEQ ID NO: 9041413 - DNA, 22 bp, Homo sapiens
ttgcaactcttgaaaagcattg

SEQ ID NO: 9041414 - DNA, 22 bp, Homo sapiens
ttgcaactaaaagaacttgaca

SEQ ID NO: 9041415 - DNA, 22 bp, Homo sapiens
ttgcaaggtcatcatgcattgg

SEQ ID NO: 9041416 - DNA, 20 bp, Homo sapiens
ttgcaagctttcaagatagc

SEQ ID NO: 9041417 - DNA, 20 bp, Homo sapiens
ttgcaactgtaagaagcagg

SEQ ID NO: 9041418 - DNA, 22 bp, Homo sapiens
ttgcaagaaattaggaagtgaa

SEQ ID NO: 9041419 - DNA, 22 bp, Homo sapiens
ttgcaagacacttggaagcaca

SEQ ID NO: 9041420 - DNA, 22 bp, Homo sapiens
ttgcaagacacttggaagcaca

SEQ ID NO: 9041421 - DNA, 22 bp, Homo sapiens
ttgcaagacacttggaagcaca

SEQ ID NO: 9041422 - DNA, 22 bp, Homo sapiens
ttgcaagttttacttacctgga

SEQ ID NO: 9041423 - DNA, 22 bp, Homo sapiens
ttgcaagttttacttacctgga

SEQ ID NO: 9041424 - DNA, 22 bp, Homo sapiens
ttgcaagttccttatgagaatc

SEQ ID NO: 9041425 - DNA, 22 bp, Homo sapiens
ttgcaatgcctcaattaaagcc

SEQ ID NO: 9041426 - DNA, 21 bp, Homo sapiens
ttgcaatgggcattttggagg

SEQ ID NO: 9041427 - DNA, 22 bp, Homo sapiens
ttgcaatcaaaaagaagtacag

SEQ ID NO: 9041428 - DNA, 22 bp, Homo sapiens
ttgcaattaacatatgtcaact

SEQ ID NO: 9041429 - DNA, 18 bp, Homo sapiens
ttggggtgaggccaggaa

SEQ ID NO: 9041430 - DNA, 18 bp, Homo sapiens
ttggggtgaggccaggaa

SEQ ID NO: 9041431 - DNA, 22 bp, Homo sapiens
ttggtctgtagttttcttatgt

SEQ ID NO: 9041432 - DNA, 22 bp, Homo sapiens
ttggtctgctctgatgttttct

SEQ ID NO: 9041433 - DNA, 22 bp, Homo sapiens
ttggtctgcagggagggctgga

SEQ ID NO: 9041434 - DNA, 22 bp, Homo sapiens
ttggtcttgagtggcttgttaa

SEQ ID NO: 9041435 - DNA, 22 bp, Homo sapiens
ttggtctgtgttacatcattta

SEQ ID NO: 9041436 - DNA, 22 bp, Homo sapiens
ttggtcttcatccgtcacagca

SEQ ID NO: 9041437 - DNA, 22 bp, Homo sapiens
ttggtcttcagagatctggtgg

SEQ ID NO: 9041438 - DNA, 22 bp, Homo sapiens
ttggtcctttatcctttaggca

SEQ ID NO: 9041439 - DNA, 22 bp, Homo sapiens
ttggtcctgggcactgattaac

SEQ ID NO: 9041440 - DNA, 22 bp, Homo sapiens
ttggtcctggtctaggcagagt

SEQ ID NO: 9041441 - DNA, 22 bp, Homo sapiens
ttggtcctgccccctccaggtc

SEQ ID NO: 9041442 - DNA, 22 bp, Homo sapiens
ttggtcctgcagaggggtctgg

SEQ ID NO: 9041443 - DNA, 22 bp, Homo sapiens
ttggtccctcatggacacatga

SEQ ID NO: 9041444 - DNA, 22 bp, Homo sapiens
ttggtcctcagtttccctatct

SEQ ID NO: 9041445 - DNA, 22 bp, Homo sapiens
ttggggtgttggatggagcaag

SEQ ID NO: 9041446 - DNA, 22 bp, Homo sapiens
ttggtcagctcaatggagaggg

SEQ ID NO: 9041447 - DNA, 22 bp, Homo sapiens
ttggggtgttggatggagcaag

SEQ ID NO: 9041448 - DNA, 22 bp, Homo sapiens
ttggtcatcttccgtttcctca

SEQ ID NO: 9041449 - DNA, 22 bp, Homo sapiens
ttggtgtgactaaggcagtgtg

SEQ ID NO: 9041450 - DNA, 23 bp, Homo sapiens
ttggtgtcagggaactttggaat

SEQ ID NO: 9041451 - DNA, 22 bp, Homo sapiens
ttggttacaagtttgctctgcc

SEQ ID NO: 9041452 - DNA, 22 bp, Homo sapiens
ttggttaaaatcaaattaatca

SEQ ID NO: 9041453 - DNA, 22 bp, Homo sapiens
ttggttaaaatcaaattaatca

SEQ ID NO: 9041454 - DNA, 22 bp, Homo sapiens
ttggtgggcacaggggagaagt

SEQ ID NO: 9041455 - DNA, 22 bp, Homo sapiens
ttggtgggcacaggggagaagt

SEQ ID NO: 9041456 - DNA, 22 bp, Homo sapiens
ttggtgggcacaggggagaagt

SEQ ID NO: 9041457 - DNA, 22 bp, Homo sapiens
ttggtgggagagatgagggttg

SEQ ID NO: 9041458 - DNA, 22 bp, Homo sapiens
ttggtgggagagatgagggttg

SEQ ID NO: 9041459 - DNA, 22 bp, Homo sapiens
ttggtgggttaatgagtgactg

SEQ ID NO: 9041460 - DNA, 22 bp, Homo sapiens
ttggtgtacatctccccttcat

SEQ ID NO: 9041461 - DNA, 22 bp, Homo sapiens
ttggtgccgaggatctgcaggt

SEQ ID NO: 9041462 - DNA, 19 bp, Homo sapiens
ttggtgcacacatgggccc

SEQ ID NO: 9041463 - DNA, 22 bp, Homo sapiens
ttggtgcaaattcctgtaagag

SEQ ID NO: 9041464 - DNA, 22 bp, Homo sapiens
ttggtgggagagatgagggttg

SEQ ID NO: 9041465 - DNA, 22 bp, Homo sapiens
ttggtgggagaagactctggtt

SEQ ID NO: 9041466 - DNA, 22 bp, Homo sapiens
ttggtgactccccaccatgatg

SEQ ID NO: 9041467 - DNA, 22 bp, Homo sapiens
ttggtgagtatggacacagaga

SEQ ID NO: 9041468 - DNA, 22 bp, Homo sapiens
ttggtcttttctattaaatata

SEQ ID NO: 9041469 - DNA, 22 bp, Homo sapiens
ttgtctctcattcctgcaactc

SEQ ID NO: 9041470 - DNA, 22 bp, Homo sapiens
ttgtctctaagtgtgatcttca

SEQ ID NO: 9041471 - DNA, 22 bp, Homo sapiens
ttgtctctcattcctgcaactc

SEQ ID NO: 9041472 - DNA, 22 bp, Homo sapiens
ttgtctctcattcctgcaactc

SEQ ID NO: 9041473 - DNA, 22 bp, Homo sapiens
ttgtctctcattcctgcaactc

SEQ ID NO: 9041474 - DNA, 22 bp, Homo sapiens
ttgtctctacagagagtagtag

SEQ ID NO: 9041475 - DNA, 22 bp, Homo sapiens
ttgtctctaagtgtgatcttca

SEQ ID NO: 9041476 - DNA, 22 bp, Homo sapiens
ttgtctctaagtgtgatcttca

SEQ ID NO: 9041477 - DNA, 22 bp, Homo sapiens
ttgtctctgggacatggtatta

SEQ ID NO: 9041478 - DNA, 22 bp, Homo sapiens
ttgtctctggaaggaaaaagca

SEQ ID NO: 9041479 - DNA, 22 bp, Homo sapiens
ttgtctctgtgtggcttcccta

SEQ ID NO: 9041480 - DNA, 22 bp, Homo sapiens
ttgtctctgtgtggcttcccta

SEQ ID NO: 9041481 - DNA, 22 bp, Homo sapiens
ttgtctctgccatgcttgaggg

SEQ ID NO: 9041482 - DNA, 22 bp, Homo sapiens
ttgtctgaaccatctccctggc

SEQ ID NO: 9041483 - DNA, 22 bp, Homo sapiens
ttgtctgaagtcacacagatgc

SEQ ID NO: 9041484 - DNA, 22 bp, Homo sapiens
ttgtctgagagatggcagaggt

SEQ ID NO: 9041485 - DNA, 22 bp, Homo sapiens
ttgtctgagggtttgagagaat

SEQ ID NO: 9041486 - DNA, 22 bp, Homo sapiens
ttgtctgagaaagtgagttgct

SEQ ID NO: 9041487 - DNA, 22 bp, Homo sapiens
ttgtctgatgttccctcatgat

SEQ ID NO: 9041488 - DNA, 22 bp, Homo sapiens
ttgtctgacttctttagttact

SEQ ID NO: 9041489 - DNA, 22 bp, Homo sapiens
ttgtctgaattcttctaggcag

SEQ ID NO: 9041490 - DNA, 22 bp, Homo sapiens
ttgtctgaatatgtatgtatcc

SEQ ID NO: 9041491 - DNA, 22 bp, Homo sapiens
ttgtctgaatctggagctctct

SEQ ID NO: 9041492 - DNA, 22 bp, Homo sapiens
ttgtctgtaaagacggccacca

SEQ ID NO: 9041493 - DNA, 22 bp, Homo sapiens
ttgtgaaatcgtgtttggaagc

SEQ ID NO: 9041494 - DNA, 22 bp, Homo sapiens
ttgtgaaatcgtgtttggaagc

SEQ ID NO: 9041495 - DNA, 22 bp, Homo sapiens
ttgtgaaatcgtgtttggaagc

SEQ ID NO: 9041496 - DNA, 22 bp, Homo sapiens
ttgtgaaatgtttcaaaatagt

SEQ ID NO: 9041497 - DNA, 22 bp, Homo sapiens
ttgtgaaatgtttcaaaatagt

SEQ ID NO: 9041498 - DNA, 22 bp, Homo sapiens
ttgtgaagtgttctgagacagg

SEQ ID NO: 9041499 - DNA, 22 bp, Homo sapiens
ttgtgaagtgttctgagacagg

SEQ ID NO: 9041500 - DNA, 22 bp, Homo sapiens
ttgtgaatagtgccacaataaa

SEQ ID NO: 9041501 - DNA, 22 bp, Homo sapiens
ttgtgaatagtgccgcaataaa

SEQ ID NO: 9041502 - DNA, 22 bp, Homo sapiens
ttgtgaatagtgccgcaataaa

SEQ ID NO: 9041503 - DNA, 22 bp, Homo sapiens
ttgtgaatagtgccgctataaa

SEQ ID NO: 9041504 - DNA, 22 bp, Homo sapiens
ttgtgaatagtgccgcaataaa

SEQ ID NO: 9041505 - DNA, 22 bp, Homo sapiens
ttgtgaatagtgccgctataaa

SEQ ID NO: 9041506 - DNA, 22 bp, Homo sapiens
ttgtgaatagtgccgctataaa

SEQ ID NO: 9041507 - DNA, 22 bp, Homo sapiens
ttgtgaatagtgctgcaataaa

SEQ ID NO: 9041508 - DNA, 22 bp, Homo sapiens
ttgtgaatagtgccgctataaa

SEQ ID NO: 9041509 - DNA, 22 bp, Homo sapiens
ttgtgaatagtgctgcaataaa

SEQ ID NO: 9041510 - DNA, 22 bp, Homo sapiens
ttgtgaatgcttaatatgtttc

SEQ ID NO: 9041511 - DNA, 22 bp, Homo sapiens
ttgtgaatggtgccgcaataaa

SEQ ID NO: 9041512 - DNA, 22 bp, Homo sapiens
ttgtccttcatgttggatttat

SEQ ID NO: 9041513 - DNA, 23 bp, Homo sapiens
ttgtccttctgaaatatatctgg

SEQ ID NO: 9041514 - DNA, 23 bp, Homo sapiens
ttgtccttctgaaatatatctgg

SEQ ID NO: 9041515 - DNA, 23 bp, Homo sapiens
ttgtaaaacagtgtgacggttcc

SEQ ID NO: 9041516 - DNA, 22 bp, Homo sapiens
ttgtccttcatgttggatttat

SEQ ID NO: 9041517 - DNA, 22 bp, Homo sapiens
ttggttttgggatgtacaaagg

SEQ ID NO: 9041518 - DNA, 22 bp, Homo sapiens
ttggttttgggatgtacaaagg

SEQ ID NO: 9041519 - DNA, 22 bp, Homo sapiens
ttggttttgggatgtacaaagg

SEQ ID NO: 9041520 - DNA, 22 bp, Homo sapiens
ttggttttctcagctggaccat

SEQ ID NO: 9041521 - DNA, 21 bp, Homo sapiens
ttggttttctgagtctgtaca

SEQ ID NO: 9041522 - DNA, 22 bp, Homo sapiens
ttgtccttggctctagaggtga

SEQ ID NO: 9041523 - DNA, 22 bp, Homo sapiens
ttgtccttgtgcaagacccagc

SEQ ID NO: 9041524 - DNA, 22 bp, Homo sapiens
ttgtccttggctctagaggtga

SEQ ID NO: 9041525 - DNA, 22 bp, Homo sapiens
ttgtccttggctctagaggtga

SEQ ID NO: 9041526 - DNA, 22 bp, Homo sapiens
ttgtcgggcttacgcagggcca

SEQ ID NO: 9041527 - DNA, 22 bp, Homo sapiens
ttgtccttgttcctaacccctc

SEQ ID NO: 9041528 - DNA, 22 bp, Homo sapiens
ttgtcctttaatgtttagtatt

SEQ ID NO: 9041529 - DNA, 22 bp, Homo sapiens
ttgtctaatgagctccacttca

SEQ ID NO: 9041530 - DNA, 22 bp, Homo sapiens
ttgtctaaggaggtagaggact

SEQ ID NO: 9041531 - DNA, 22 bp, Homo sapiens
ttgtctactaagaaagacaatt

SEQ ID NO: 9041532 - DNA, 22 bp, Homo sapiens
ttgtctactaagaaagacaatt

SEQ ID NO: 9041533 - DNA, 22 bp, Homo sapiens
ttggttcaatactaacttgaac

SEQ ID NO: 9041534 - DNA, 22 bp, Homo sapiens
ttggttcaacttttctaagtag

SEQ ID NO: 9041535 - DNA, 22 bp, Homo sapiens
ttggttcaaagggattcaattt

SEQ ID NO: 9041536 - DNA, 22 bp, Homo sapiens
ttggttcaaagggattcaattt

SEQ ID NO: 9041537 - DNA, 22 bp, Homo sapiens
ttggttcaggacatatttgagt

SEQ ID NO: 9041538 - DNA, 22 bp, Homo sapiens
ttggttcaaagggattcaattt

SEQ ID NO: 9041539 - DNA, 22 bp, Homo sapiens
ttggttcattattgaatgtgct

SEQ ID NO: 9041540 - DNA, 22 bp, Homo sapiens
ttggttcattttctcatctaga

SEQ ID NO: 9041541 - DNA, 22 bp, Homo sapiens
ttggttcattttctcatctaga

SEQ ID NO: 9041542 - DNA, 20 bp, Homo sapiens
ttggttgagccagggcctgg

SEQ ID NO: 9041543 - DNA, 22 bp, Homo sapiens
ttggttccttctgaaagtattg

SEQ ID NO: 9041544 - DNA, 22 bp, Homo sapiens
ttggtttatttcttcctatgag

SEQ ID NO: 9041545 - DNA, 22 bp, Homo sapiens
ttggtttagtacctgccagcgt

SEQ ID NO: 9041546 - DNA, 22 bp, Homo sapiens
ttggtttgttcaccatcaagca

SEQ ID NO: 9041547 - DNA, 22 bp, Homo sapiens
ttggttttctaatgtattaagg

SEQ ID NO: 9041548 - DNA, 22 bp, Homo sapiens
ttggttttcaggggcaggataa

SEQ ID NO: 9041549 - DNA, 22 bp, Homo sapiens
ttggttttcaggggcaggataa

SEQ ID NO: 9041550 - DNA, 22 bp, Homo sapiens
ttggttttcaggggcaggataa

SEQ ID NO: 9041551 - DNA, 22 bp, Homo sapiens
tttagttttgatgaaaatgcca

SEQ ID NO: 9041552 - DNA, 22 bp, Homo sapiens
tttagttttgatgaaaatgcca

SEQ ID NO: 9041553 - DNA, 22 bp, Homo sapiens
tttagttttgatgaaaatgcca

SEQ ID NO: 9041554 - DNA, 22 bp, Homo sapiens
tttagtttgatgttctactcct

SEQ ID NO: 9041555 - DNA, 22 bp, Homo sapiens
tttagtttgatgttctactcct

SEQ ID NO: 9041556 - DNA, 22 bp, Homo sapiens
tttagtttgatgttctactcct

SEQ ID NO: 9041557 - DNA, 22 bp, Homo sapiens
tttagttttaactgaaagctat

SEQ ID NO: 9041558 - DNA, 22 bp, Homo sapiens
tttagttttaactgaaagctat

SEQ ID NO: 9041559 - DNA, 22 bp, Homo sapiens
tttagttcataaaaccagggtg

SEQ ID NO: 9041560 - DNA, 22 bp, Homo sapiens
tttagttcataaaaccagggtg

SEQ ID NO: 9041561 - DNA, 22 bp, Homo sapiens
tttagttctcccagtcttgatt

SEQ ID NO: 9041562 - DNA, 22 bp, Homo sapiens
tttagttctcccagtcttgatt

SEQ ID NO: 9041563 - DNA, 22 bp, Homo sapiens
tttagttctcccagtcttgatt

SEQ ID NO: 9041564 - DNA, 22 bp, Homo sapiens
tttagttgaaggcagtcctcaa

SEQ ID NO: 9041565 - DNA, 20 bp, Homo sapiens
tttagtttcttctgaggtgt

SEQ ID NO: 9041566 - DNA, 20 bp, Homo sapiens
tttagtttcttctgaggtgt

SEQ ID NO: 9041567 - DNA, 22 bp, Homo sapiens
tttagttcacaccagggtagca

SEQ ID NO: 9041568 - DNA, 22 bp, Homo sapiens
tttagttcacaccagggtagca

SEQ ID NO: 9041569 - DNA, 22 bp, Homo sapiens
tttagttattgttacagtatga

SEQ ID NO: 9041570 - DNA, 22 bp, Homo sapiens
tttagttattgttacagtatga

SEQ ID NO: 9041571 - DNA, 22 bp, Homo sapiens
tttataaacagtaccacggtgc

SEQ ID NO: 9041572 - DNA, 22 bp, Homo sapiens
tttataaacagtaccacggtgc

SEQ ID NO: 9041573 - DNA, 22 bp, Homo sapiens
tttataaacagtaccacggtgc

SEQ ID NO: 9041574 - DNA, 22 bp, Homo sapiens
tttataaacagtaccacggtgc

SEQ ID NO: 9041575 - DNA, 22 bp, Homo sapiens
tttataacatttcttacctgtg

SEQ ID NO: 9041576 - DNA, 22 bp, Homo sapiens
tttataaaatagactgggtcta

SEQ ID NO: 9041577 - DNA, 22 bp, Homo sapiens
tttataaaatagactgggtcta

SEQ ID NO: 9041578 - DNA, 22 bp, Homo sapiens
tttataaacagtaccacggtgc

SEQ ID NO: 9041579 - DNA, 22 bp, Homo sapiens
tttataaaatagactgggtcta

SEQ ID NO: 9041580 - DNA, 22 bp, Homo sapiens
tttataaaatagactgggtcta

SEQ ID NO: 9041581 - DNA, 22 bp, Homo sapiens
tttataaaatagactgggtcta

SEQ ID NO: 9041582 - DNA, 22 bp, Homo sapiens
tttataaaatagactgggtcta

SEQ ID NO: 9041583 - DNA, 22 bp, Homo sapiens
tttagttttgatgaaaatgcca

SEQ ID NO: 9041584 - DNA, 22 bp, Homo sapiens
tttatacttcataatgtctatt

SEQ ID NO: 9041585 - DNA, 22 bp, Homo sapiens
tttatacttcataatgtctatt

SEQ ID NO: 9041586 - DNA, 22 bp, Homo sapiens
tttatacttcataatgtctatt

SEQ ID NO: 9041587 - DNA, 22 bp, Homo sapiens
tttatagatgtctgtattataa

SEQ ID NO: 9041588 - DNA, 22 bp, Homo sapiens
tttatagatgtctgtattataa

SEQ ID NO: 9041589 - DNA, 22 bp, Homo sapiens
tttatagatgtctgtattataa

SEQ ID NO: 9041590 - DNA, 22 bp, Homo sapiens
tttatagatgtctgtattataa

SEQ ID NO: 9041591 - DNA, 22 bp, Homo sapiens
tttatagatgtctgtattataa

SEQ ID NO: 9041592 - DNA, 22 bp, Homo sapiens
tttatacttcataatgtctatt

SEQ ID NO: 9041593 - DNA, 22 bp, Homo sapiens
tttatactccactctgcaagcg

SEQ ID NO: 9041594 - DNA, 22 bp, Homo sapiens
tttatactccactctgcaagcg

SEQ ID NO: 9041595 - DNA, 22 bp, Homo sapiens
tttatacatggagaatttttgc

SEQ ID NO: 9041596 - DNA, 22 bp, Homo sapiens
tttatacatggagaatttttgc

SEQ ID NO: 9041597 - DNA, 22 bp, Homo sapiens
tttatacatggagaatttttgc

SEQ ID NO: 9041598 - DNA, 22 bp, Homo sapiens
tttataattatctctactctta

SEQ ID NO: 9041599 - DNA, 23 bp, Homo sapiens
tttatacaagaaaccgctggcct

SEQ ID NO: 9041600 - DNA, 23 bp, Homo sapiens
tttatacaagaaaccgctggcct

SEQ ID NO: 9041601 - DNA, 22 bp, Homo sapiens
tttataattatctctactctta

SEQ ID NO: 9041602 - DNA, 22 bp, Homo sapiens
tttataagaagcaatgtctgag

SEQ ID NO: 9041603 - DNA, 22 bp, Homo sapiens
tttataattatctctactctta

SEQ ID NO: 9041604 - DNA, 22 bp, Homo sapiens
tttataattatctctactctta

SEQ ID NO: 9041605 - DNA, 17 bp, Homo sapiens
tttataattggcctctt

SEQ ID NO: 9041606 - DNA, 22 bp, Homo sapiens
tttataattatctctactctta

SEQ ID NO: 9041607 - DNA, 21 bp, Homo sapiens
tttattaacaactgtggacgt

SEQ ID NO: 9041608 - DNA, 22 bp, Homo sapiens
tttattaaaactgttggctctg

SEQ ID NO: 9041609 - DNA, 21 bp, Homo sapiens
tttattaacaactgtggacgt

SEQ ID NO: 9041610 - DNA, 21 bp, Homo sapiens
tttattaacaactgtggacgt

SEQ ID NO: 9041611 - DNA, 21 bp, Homo sapiens
tttattaacaactgtggacgt

SEQ ID NO: 9041612 - DNA, 21 bp, Homo sapiens
tttattaacaactgtggacgt

SEQ ID NO: 9041613 - DNA, 21 bp, Homo sapiens
tttattaacaactgtggacgt

SEQ ID NO: 9041614 - DNA, 22 bp, Homo sapiens
tttattaaaactgttggctctg

SEQ ID NO: 9041615 - DNA, 22 bp, Homo sapiens
tttattaaaactgttggctctg

SEQ ID NO: 9041616 - DNA, 22 bp, Homo sapiens
tttattaaaactgttggctctg

SEQ ID NO: 9041617 - DNA, 22 bp, Homo sapiens
tttattaaaactgttggctctg

SEQ ID NO: 9041618 - DNA, 22 bp, Homo sapiens
tttatgtttgcattttcaaaga

SEQ ID NO: 9041619 - DNA, 22 bp, Homo sapiens
tttatgtttgcattttcaaaga

SEQ ID NO: 9041620 - DNA, 22 bp, Homo sapiens
tttattaaaactgttggctctg

SEQ ID NO: 9041621 - DNA, 22 bp, Homo sapiens
tttattaaaactgttggctctg

SEQ ID NO: 9041622 - DNA, 22 bp, Homo sapiens
tttatgtttgcattttcaaaga

SEQ ID NO: 9041623 - DNA, 22 bp, Homo sapiens
tttattaatgtagcatccatgg

SEQ ID NO: 9041624 - DNA, 22 bp, Homo sapiens
tttattaagatgcgaatgctga

SEQ ID NO: 9041625 - DNA, 22 bp, Homo sapiens
tttattaatgtagcatccatgg

SEQ ID NO: 9041626 - DNA, 22 bp, Homo sapiens
tttattaatgtagcatccatgg

SEQ ID NO: 9041627 - DNA, 22 bp, Homo sapiens
tttattaatgtagcatccatgg

SEQ ID NO: 9041628 - DNA, 22 bp, Homo sapiens
tttattaatgtagcatccatgg

SEQ ID NO: 9041629 - DNA, 22 bp, Homo sapiens
tttattaagatgcgaatgctga

SEQ ID NO: 9041630 - DNA, 22 bp, Homo sapiens
tttattaagatgcgaatgctga

SEQ ID NO: 9041631 - DNA, 22 bp, Homo sapiens
tttattaagatgcgaatgctga

SEQ ID NO: 9041632 - DNA, 22 bp, Homo sapiens
tttattaagatgcgaatgctga

SEQ ID NO: 9041633 - DNA, 22 bp, Homo sapiens
tttattaagatgcgaatgctga

SEQ ID NO: 9041634 - DNA, 22 bp, Homo sapiens
tttattaagatgcgaatgctga

SEQ ID NO: 9041635 - DNA, 22 bp, Homo sapiens
tttattaagatgcgaatgctga

SEQ ID NO: 9041636 - DNA, 22 bp, Homo sapiens
tttattaagatgcgaatgctga

SEQ ID NO: 9041637 - DNA, 23 bp, Homo sapiens
tttatagcagcatgatttatagt

SEQ ID NO: 9041638 - DNA, 23 bp, Homo sapiens
tttatagcagcatgatttatagt

SEQ ID NO: 9041639 - DNA, 23 bp, Homo sapiens
tttatagcagcatgatttatagt

SEQ ID NO: 9041640 - DNA, 22 bp, Homo sapiens
tttatagcagcatgatttatag

SEQ ID NO: 9041641 - DNA, 22 bp, Homo sapiens
tttatagcagcatgatttataa

SEQ ID NO: 9041642 - DNA, 22 bp, Homo sapiens
tttatagcagcatgatttataa

SEQ ID NO: 9041643 - DNA, 23 bp, Homo sapiens
tttatagcagcatgatttataat

SEQ ID NO: 9041644 - DNA, 23 bp, Homo sapiens
tttatagcagcatgatttataat

SEQ ID NO: 9041645 - DNA, 23 bp, Homo sapiens
tttatagcagcatgatttataat

SEQ ID NO: 9041646 - DNA, 22 bp, Homo sapiens
tttatagtcgtctcagtaataa

SEQ ID NO: 9041647 - DNA, 22 bp, Homo sapiens
tttatagtcgtctcagtaataa

SEQ ID NO: 9041648 - DNA, 22 bp, Homo sapiens
tttatagggtagctaggattga

SEQ ID NO: 9041649 - DNA, 22 bp, Homo sapiens
tttatagggacagttcttggag

SEQ ID NO: 9041650 - DNA, 22 bp, Homo sapiens
tttatagctgtgagaccttggg

SEQ ID NO: 9041651 - DNA, 22 bp, Homo sapiens
tttataggatatgggggaagga

SEQ ID NO: 9041652 - DNA, 22 bp, Homo sapiens
tttatagttatatacagatgtt

SEQ ID NO: 9041653 - DNA, 22 bp, Homo sapiens
tttatagttatatacagatgtt

SEQ ID NO: 9041654 - DNA, 22 bp, Homo sapiens
tttatagcagcatgatttatag

SEQ ID NO: 9041655 - DNA, 22 bp, Homo sapiens
tttatagtcgtctcagtaataa

SEQ ID NO: 9041656 - DNA, 20 bp, Homo sapiens
tttatagtgatcaatttata

SEQ ID NO: 9041657 - DNA, 20 bp, Homo sapiens
tttatagtgatcaatttata

SEQ ID NO: 9041658 - DNA, 22 bp, Homo sapiens
tttatataacagagactgctat

SEQ ID NO: 9041659 - DNA, 22 bp, Homo sapiens
tttatataacagagactgctat

SEQ ID NO: 9041660 - DNA, 22 bp, Homo sapiens
tttatgtttgcattttcaaaga

SEQ ID NO: 9041661 - DNA, 22 bp, Homo sapiens
tttatataacagagactgctat

SEQ ID NO: 9041662 - DNA, 22 bp, Homo sapiens
tttatataacagagactgctat

SEQ ID NO: 9041663 - DNA, 22 bp, Homo sapiens
tttattacaccaggttaactca

SEQ ID NO: 9041664 - DNA, 22 bp, Homo sapiens
tttattagattatcaaagaggt

SEQ ID NO: 9041665 - DNA, 22 bp, Homo sapiens
tttattaatgtagcatccatgg

SEQ ID NO: 9041666 - DNA, 22 bp, Homo sapiens
tttattaattagtgacccaatg

SEQ ID NO: 9041667 - DNA, 22 bp, Homo sapiens
tttattaattagtgacccaatg

SEQ ID NO: 9041668 - DNA, 22 bp, Homo sapiens
tttattaattagtgacccaatg

SEQ ID NO: 9041669 - DNA, 22 bp, Homo sapiens
tttattaattagtgacccaatg

SEQ ID NO: 9041670 - DNA, 22 bp, Homo sapiens
tttattaattagtgacccaatg

SEQ ID NO: 9041671 - DNA, 22 bp, Homo sapiens
tttattaattagtgacccaatg

SEQ ID NO: 9041672 - DNA, 22 bp, Homo sapiens
tttattaattagtgacccaatg

SEQ ID NO: 9041673 - DNA, 22 bp, Homo sapiens
tttattagtgcttgtatcactg

SEQ ID NO: 9041674 - DNA, 22 bp, Homo sapiens
tttattatagtggtggggactg

SEQ ID NO: 9041675 - DNA, 22 bp, Homo sapiens
tttattagtgcttgtatcactg

SEQ ID NO: 9041676 - DNA, 22 bp, Homo sapiens
tttattatagtggtggggactg

SEQ ID NO: 9041677 - DNA, 22 bp, Homo sapiens
tttattatccagtgttgtcatg

SEQ ID NO: 9041678 - DNA, 22 bp, Homo sapiens
tttattatagtggtggggactg

SEQ ID NO: 9041679 - DNA, 22 bp, Homo sapiens
tttattatccagtgttgtcatg

SEQ ID NO: 9041680 - DNA, 22 bp, Homo sapiens
tttattatccagtgttgtcatg

SEQ ID NO: 9041681 - DNA, 22 bp, Homo sapiens
tttattatccagtgttgtcatg

SEQ ID NO: 9041682 - DNA, 22 bp, Homo sapiens
tttattatgatggacaccttcg

SEQ ID NO: 9041683 - DNA, 22 bp, Homo sapiens
tttattatgatggacaccttcg

SEQ ID NO: 9041684 - DNA, 22 bp, Homo sapiens
tttattatgatggacaccttcg

SEQ ID NO: 9041685 - DNA, 22 bp, Homo sapiens
tttattatgatggacaccttcg

SEQ ID NO: 9041686 - DNA, 22 bp, Homo sapiens
tttattatgtacaggcactata

SEQ ID NO: 9041687 - DNA, 22 bp, Homo sapiens
tttattatgtacaggcactata

SEQ ID NO: 9041688 - DNA, 22 bp, Homo sapiens
tttattattctctggagaatgt

SEQ ID NO: 9041689 - DNA, 22 bp, Homo sapiens
tttattattctctggagaatgt

SEQ ID NO: 9041690 - DNA, 22 bp, Homo sapiens
tttattattctctggagaatgt

SEQ ID NO: 9041691 - DNA, 22 bp, Homo sapiens
tttattattctgttctctctac

SEQ ID NO: 9041692 - DNA, 22 bp, Homo sapiens
tttattattctgttctctctac

SEQ ID NO: 9041693 - DNA, 22 bp, Homo sapiens
tttattattctctggagaatgt

SEQ ID NO: 9041694 - DNA, 22 bp, Homo sapiens
tttatttcactctccggatact

SEQ ID NO: 9041695 - DNA, 22 bp, Homo sapiens
tttatttcttagtttgccacag

SEQ ID NO: 9041696 - DNA, 22 bp, Homo sapiens
tttattattctgttctctctac

SEQ ID NO: 9041697 - DNA, 22 bp, Homo sapiens
tttatttcactctccggatact

SEQ ID NO: 9041698 - DNA, 22 bp, Homo sapiens
tttatttcttagtttgccacag

SEQ ID NO: 9041699 - DNA, 22 bp, Homo sapiens
tttatttcttagtttgccacag

SEQ ID NO: 9041700 - DNA, 22 bp, Homo sapiens
tttatttgaatcaggggagaat

SEQ ID NO: 9041701 - DNA, 22 bp, Homo sapiens
tttatttggcatccagggagaa

SEQ ID NO: 9041702 - DNA, 19 bp, Homo sapiens
tttatttgagacatgcctt

SEQ ID NO: 9041703 - DNA, 22 bp, Homo sapiens
tttatttggcatctctgccaag

SEQ ID NO: 9041704 - DNA, 22 bp, Homo sapiens
tttatttggcatctctgccaag

SEQ ID NO: 9041705 - DNA, 22 bp, Homo sapiens
tttatttggcatccagggagaa

SEQ ID NO: 9041706 - DNA, 22 bp, Homo sapiens
tttatttggcatccagggagaa

SEQ ID NO: 9041707 - DNA, 22 bp, Homo sapiens
tttatttggcatccagggagaa

SEQ ID NO: 9041708 - DNA, 22 bp, Homo sapiens
tttatttggcatccagggagaa

SEQ ID NO: 9041709 - DNA, 19 bp, Homo sapiens
tttatttgagacatgcctt

SEQ ID NO: 9041710 - DNA, 22 bp, Homo sapiens
tttatttgtcttgccatttagt

SEQ ID NO: 9041711 - DNA, 22 bp, Homo sapiens
tttatttgtcttgccatttagt

SEQ ID NO: 9041712 - DNA, 22 bp, Homo sapiens
tttatttgtcttgccatttagt

SEQ ID NO: 9041713 - DNA, 22 bp, Homo sapiens
tttatttggcatctctgccaag

SEQ ID NO: 9041714 - DNA, 22 bp, Homo sapiens
tttatttggcatctctgccaag

SEQ ID NO: 9041715 - DNA, 22 bp, Homo sapiens
tttatttggcatctctgccaag

SEQ ID NO: 9041716 - DNA, 20 bp, Homo sapiens
tttcaaactgcacctttgct

SEQ ID NO: 9041717 - DNA, 22 bp, Homo sapiens
tttcaaacctacttgtatgttt

SEQ ID NO: 9041718 - DNA, 22 bp, Homo sapiens
tttcaaactatgtgtcaggcag

SEQ ID NO: 9041719 - DNA, 22 bp, Homo sapiens
tttcaaacattcctgggagact

SEQ ID NO: 9041720 - DNA, 22 bp, Homo sapiens
tttcaaaccactgaggttctga

SEQ ID NO: 9041721 - DNA, 22 bp, Homo sapiens
tttcaaactgcccagcacacct

SEQ ID NO: 9041722 - DNA, 22 bp, Homo sapiens
tttcaaactgggagtgagggga

SEQ ID NO: 9041723 - DNA, 22 bp, Homo sapiens
tttcaaactccagctcaccaat

SEQ ID NO: 9041724 - DNA, 22 bp, Homo sapiens
tttcaaacttaaatacctttcc

SEQ ID NO: 9041725 - DNA, 22 bp, Homo sapiens
tttcaaactgtactttccccta

SEQ ID NO: 9041726 - DNA, 22 bp, Homo sapiens
tttcaaacatagatctgaatat

SEQ ID NO: 9041727 - DNA, 22 bp, Homo sapiens
tttcaaacatatcttcattact

SEQ ID NO: 9041728 - DNA, 22 bp, Homo sapiens
tttcaaacatatcttcattact

SEQ ID NO: 9041729 - DNA, 22 bp, Homo sapiens
tttcaaaattttgcagtggtaa

SEQ ID NO: 9041730 - DNA, 22 bp, Homo sapiens
tttcaaaattttgcagtggtaa

SEQ ID NO: 9041731 - DNA, 22 bp, Homo sapiens
tttcaaaattttgcagtggtaa

SEQ ID NO: 9041732 - DNA, 22 bp, Homo sapiens
tttcaaaattttgcagtggtaa

SEQ ID NO: 9041733 - DNA, 22 bp, Homo sapiens
tttcaaaagcgtacgtagtgaa

SEQ ID NO: 9041734 - DNA, 22 bp, Homo sapiens
tttcaaaagcgtacgtagtgaa

SEQ ID NO: 9041735 - DNA, 22 bp, Homo sapiens
tttcaaaagcgtacgtagtgaa

SEQ ID NO: 9041736 - DNA, 22 bp, Homo sapiens
tttcaaaagcgtacgtagtgaa

SEQ ID NO: 9041737 - DNA, 15 bp, Homo sapiens
tttcaaaatgaggcc

SEQ ID NO: 9041738 - DNA, 15 bp, Homo sapiens
tttcaaaatgaggcc

SEQ ID NO: 9041739 - DNA, 22 bp, Homo sapiens
tttaatgtttgagtcagtatat

SEQ ID NO: 9041740 - DNA, 22 bp, Homo sapiens
tttaattagcaagccagagagc

SEQ ID NO: 9041741 - DNA, 22 bp, Homo sapiens
tttaattaggaaatgggcaggg

SEQ ID NO: 9041742 - DNA, 22 bp, Homo sapiens
tttaattatatctgggcagtta

SEQ ID NO: 9041743 - DNA, 22 bp, Homo sapiens
tttaattatgttaagccactga

SEQ ID NO: 9041744 - DNA, 22 bp, Homo sapiens
tttaattctggcataatagctc

SEQ ID NO: 9041745 - DNA, 22 bp, Homo sapiens
tttaattgattcacagtctgta

SEQ ID NO: 9041746 - DNA, 22 bp, Homo sapiens
tttaattgattcacagtctgta

SEQ ID NO: 9041747 - DNA, 22 bp, Homo sapiens
tttaattgcatttaaagatgga

SEQ ID NO: 9041748 - DNA, 22 bp, Homo sapiens
tttaattgcatttaaagatgga

SEQ ID NO: 9041749 - DNA, 22 bp, Homo sapiens
tttaattgcatttaaagatgga

SEQ ID NO: 9041750 - DNA, 22 bp, Homo sapiens
tttaattgcatttaaagatgga

SEQ ID NO: 9041751 - DNA, 22 bp, Homo sapiens
tttaattgattcacagtctgta

SEQ ID NO: 9041752 - DNA, 22 bp, Homo sapiens
tttaatttgaaatgagtaaccc

SEQ ID NO: 9041753 - DNA, 22 bp, Homo sapiens
tttaattgttgtgggtacatag

SEQ ID NO: 9041754 - DNA, 22 bp, Homo sapiens
tttaattgttgtgggtacatag

SEQ ID NO: 9041755 - DNA, 22 bp, Homo sapiens
tttaattgttgtgggtacatag

SEQ ID NO: 9041756 - DNA, 22 bp, Homo sapiens
tttaatttgaaatgagtaaccc

SEQ ID NO: 9041757 - DNA, 22 bp, Homo sapiens
tttaattttcctcttcctggag

SEQ ID NO: 9041758 - DNA, 22 bp, Homo sapiens
tttaattttcctcttcctggag

SEQ ID NO: 9041759 - DNA, 22 bp, Homo sapiens
tttaattttcctcttcctggag

SEQ ID NO: 9041760 - DNA, 22 bp, Homo sapiens
tttaattttcctggtaggcctg

SEQ ID NO: 9041761 - DNA, 22 bp, Homo sapiens
tttacaacctcatattctgatg

SEQ ID NO: 9041762 - DNA, 22 bp, Homo sapiens
tttacaacataggccccaagaa

SEQ ID NO: 9041763 - DNA, 22 bp, Homo sapiens
tttaattttctgggcccagcag

SEQ ID NO: 9041764 - DNA, 22 bp, Homo sapiens
tttaattttcctggtaggcctg

SEQ ID NO: 9041765 - DNA, 22 bp, Homo sapiens
tttaattttctgggcccagcag

SEQ ID NO: 9041766 - DNA, 22 bp, Homo sapiens
tttaattttcctcttcctggag

SEQ ID NO: 9041767 - DNA, 22 bp, Homo sapiens
tttaatttgtatttctagaggg

SEQ ID NO: 9041768 - DNA, 22 bp, Homo sapiens
tttaattttcctcttcctggag

SEQ ID NO: 9041769 - DNA, 22 bp, Homo sapiens
tttaatttgtatttctagaggg

SEQ ID NO: 9041770 - DNA, 22 bp, Homo sapiens
tttaatttgtatttctagaggg

SEQ ID NO: 9041771 - DNA, 22 bp, Homo sapiens
tttaatttgaaatgagtaaccc

SEQ ID NO: 9041772 - DNA, 21 bp, Homo sapiens
tttaatttgcatgtatgacgc

SEQ ID NO: 9041773 - DNA, 21 bp, Homo sapiens
tttaatttgcatgtatgacgc

SEQ ID NO: 9041774 - DNA, 21 bp, Homo sapiens
tttaatttgcatgtatgacgc

SEQ ID NO: 9041775 - DNA, 21 bp, Homo sapiens
tttaatttgcatgtatgacgc

SEQ ID NO: 9041776 - DNA, 21 bp, Homo sapiens
tttaatttgcatgtatgacgc

SEQ ID NO: 9041777 - DNA, 22 bp, Homo sapiens
ttgtttttatgaacatccagga

SEQ ID NO: 9041778 - DNA, 22 bp, Homo sapiens
ttgtttttatgaacatccagga

SEQ ID NO: 9041779 - DNA, 23 bp, Homo sapiens
ttgtttttagaggtggcatgaga

SEQ ID NO: 9041780 - DNA, 22 bp, Homo sapiens
ttgtttttagagaagccctgaa

SEQ ID NO: 9041781 - DNA, 22 bp, Homo sapiens
ttgtttttaaacatgtgactga

SEQ ID NO: 9041782 - DNA, 22 bp, Homo sapiens
ttgtttttagagaagccctgaa

SEQ ID NO: 9041783 - DNA, 22 bp, Homo sapiens
ttgtttttagagaagccctgaa

SEQ ID NO: 9041784 - DNA, 22 bp, Homo sapiens
tttaaaagttatcatctgtcca

SEQ ID NO: 9041785 - DNA, 22 bp, Homo sapiens
tttaaaagttatcatctgtcca

SEQ ID NO: 9041786 - DNA, 22 bp, Homo sapiens
tttaaaagttatcatctgtcca

SEQ ID NO: 9041787 - DNA, 22 bp, Homo sapiens
tttaaaagttatcatctgtcca

SEQ ID NO: 9041788 - DNA, 22 bp, Homo sapiens
tttaaaagttatcatctgtcca

SEQ ID NO: 9041789 - DNA, 23 bp, Homo sapiens
tttaaaagttgtaatgtaggctt

SEQ ID NO: 9041790 - DNA, 22 bp, Homo sapiens
tttaaaagttatcatctgtcca

SEQ ID NO: 9041791 - DNA, 22 bp, Homo sapiens
tttaaaaaactagtctgagtct

SEQ ID NO: 9041792 - DNA, 23 bp, Homo sapiens
tttaaaagttgtaatgtaggctt

SEQ ID NO: 9041793 - DNA, 23 bp, Homo sapiens
tttaaaagttgtaatgtaggctt

SEQ ID NO: 9041794 - DNA, 23 bp, Homo sapiens
tttaaaagttgtaatgtaggctt

SEQ ID NO: 9041795 - DNA, 22 bp, Homo sapiens
tttaaaatcagatgggagttgg

SEQ ID NO: 9041796 - DNA, 22 bp, Homo sapiens
tttaaaatcagatgggagttgg

SEQ ID NO: 9041797 - DNA, 22 bp, Homo sapiens
tttaaaatcagatgggagttgg

SEQ ID NO: 9041798 - DNA, 22 bp, Homo sapiens
tttaatgttaaatttgtagatg

SEQ ID NO: 9041799 - DNA, 22 bp, Homo sapiens
tttaatgtttgagtcagtatat

SEQ ID NO: 9041800 - DNA, 19 bp, Homo sapiens
tttaatgtgtgctgcaatc

SEQ ID NO: 9041801 - DNA, 22 bp, Homo sapiens
tttaatgttaaatttgtagatg

SEQ ID NO: 9041802 - DNA, 22 bp, Homo sapiens
tttaaacatatctgttgaggga

SEQ ID NO: 9041803 - DNA, 22 bp, Homo sapiens
tttaatgtgagtccctttcaag

SEQ ID NO: 9041804 - DNA, 22 bp, Homo sapiens
tttaaacatatctgttgaggga

SEQ ID NO: 9041805 - DNA, 22 bp, Homo sapiens
tttaaacaaataggattgccta

SEQ ID NO: 9041806 - DNA, 22 bp, Homo sapiens
tttaaacaaataggattgccta

SEQ ID NO: 9041807 - DNA, 22 bp, Homo sapiens
tttaaacaaataggattgccta

SEQ ID NO: 9041808 - DNA, 22 bp, Homo sapiens
tttaaacaaataggattgccta

SEQ ID NO: 9041809 - DNA, 22 bp, Homo sapiens
tttaaaatttagacctctccac

SEQ ID NO: 9041810 - DNA, 22 bp, Homo sapiens
tttaaaatttagacctctccac

SEQ ID NO: 9041811 - DNA, 22 bp, Homo sapiens
tttaaaatttagacctctccac

SEQ ID NO: 9041812 - DNA, 22 bp, Homo sapiens
tttaaaatttagacctctccac

SEQ ID NO: 9041813 - DNA, 22 bp, Homo sapiens
tttaaaatttagacctctccac

SEQ ID NO: 9041814 - DNA, 22 bp, Homo sapiens
tttaaaatcagatgggagttgg

SEQ ID NO: 9041815 - DNA, 22 bp, Homo sapiens
tttaaaatcagatgggagttgg

SEQ ID NO: 9041816 - DNA, 22 bp, Homo sapiens
tttaaaatttagacctctccac

SEQ ID NO: 9041817 - DNA, 22 bp, Homo sapiens
tttaaaatttagacctctccac

SEQ ID NO: 9041818 - DNA, 22 bp, Homo sapiens
tttaaaatcagatgggagttgg

SEQ ID NO: 9041819 - DNA, 22 bp, Homo sapiens
tttacccatattagcatcaagt

SEQ ID NO: 9041820 - DNA, 22 bp, Homo sapiens
tttacccagtaactgcttggct

SEQ ID NO: 9041821 - DNA, 22 bp, Homo sapiens
tttaccatctgccacagatatg

SEQ ID NO: 9041822 - DNA, 22 bp, Homo sapiens
tttaccatctgccacagatatg

SEQ ID NO: 9041823 - DNA, 22 bp, Homo sapiens
tttaccattattaaaattaagt

SEQ ID NO: 9041824 - DNA, 22 bp, Homo sapiens
tttaccatacatcaaaatattt

SEQ ID NO: 9041825 - DNA, 22 bp, Homo sapiens
tttaccttcttttaactacagt

SEQ ID NO: 9041826 - DNA, 22 bp, Homo sapiens
tttacccattcagactcacttg

SEQ ID NO: 9041827 - DNA, 22 bp, Homo sapiens
tttacctagtataatgcaacct

SEQ ID NO: 9041828 - DNA, 22 bp, Homo sapiens
tttactaagtacttgtatccct

SEQ ID NO: 9041829 - DNA, 22 bp, Homo sapiens
tttactaagtacttgtatccct

SEQ ID NO: 9041830 - DNA, 22 bp, Homo sapiens
tttactaagtacttgtatccct

SEQ ID NO: 9041831 - DNA, 22 bp, Homo sapiens
tttactaagcccagttatatgc

SEQ ID NO: 9041832 - DNA, 22 bp, Homo sapiens
tttactaagcccagttatatgc

SEQ ID NO: 9041833 - DNA, 22 bp, Homo sapiens
tttactacttgtgataactgaa

SEQ ID NO: 9041834 - DNA, 22 bp, Homo sapiens
tttactacttcattgacttacg

SEQ ID NO: 9041835 - DNA, 22 bp, Homo sapiens
tttactaagtacttgtatccct

SEQ ID NO: 9041836 - DNA, 22 bp, Homo sapiens
tttactaacaccatacatgctg

SEQ ID NO: 9041837 - DNA, 22 bp, Homo sapiens
tttactaacaccatacatgctg

SEQ ID NO: 9041838 - DNA, 22 bp, Homo sapiens
tttactaacaccatacatgctg

SEQ ID NO: 9041839 - DNA, 22 bp, Homo sapiens
tttacgctcttcaggtaaaacc

SEQ ID NO: 9041840 - DNA, 22 bp, Homo sapiens
tttacaagaaatcatgatgcta

SEQ ID NO: 9041841 - DNA, 22 bp, Homo sapiens
tttacaactttctgttctgtat

SEQ ID NO: 9041842 - DNA, 22 bp, Homo sapiens
tttacaagaaatcatgatgcta

SEQ ID NO: 9041843 - DNA, 22 bp, Homo sapiens
tttacaagaaatcatgatgcta

SEQ ID NO: 9041844 - DNA, 22 bp, Homo sapiens
tttacaaggatcaagggatctc

SEQ ID NO: 9041845 - DNA, 22 bp, Homo sapiens
tttacaaggatcaagggatctc

SEQ ID NO: 9041846 - DNA, 22 bp, Homo sapiens
tttacaagaaatcatgatgcta

SEQ ID NO: 9041847 - DNA, 22 bp, Homo sapiens
tttacaaggcagaactgattaa

SEQ ID NO: 9041848 - DNA, 22 bp, Homo sapiens
tttacaacctcatattctgatg

SEQ ID NO: 9041849 - DNA, 22 bp, Homo sapiens
tttacaacgttcctggtgctaa

SEQ ID NO: 9041850 - DNA, 22 bp, Homo sapiens
tttacaactttctgttctgtat

SEQ ID NO: 9041851 - DNA, 22 bp, Homo sapiens
tttacaacgttcctggtgctaa

SEQ ID NO: 9041852 - DNA, 22 bp, Homo sapiens
tttacaacctcatattctgatg

SEQ ID NO: 9041853 - DNA, 22 bp, Homo sapiens
tttacaacccaagtccagagag

SEQ ID NO: 9041854 - DNA, 22 bp, Homo sapiens
tttacaacctcatattctgatg

SEQ ID NO: 9041855 - DNA, 22 bp, Homo sapiens
tttaccatacatcaaaatattt

SEQ ID NO: 9041856 - DNA, 22 bp, Homo sapiens
tttaccagtgttaaacaccagc

SEQ ID NO: 9041857 - DNA, 22 bp, Homo sapiens
tttaccagtgaggaaaatgagg

SEQ ID NO: 9041858 - DNA, 22 bp, Homo sapiens
tttaccagtgaggaaaatgagg

SEQ ID NO: 9041859 - DNA, 22 bp, Homo sapiens
tttacaagtacacctaacagct

SEQ ID NO: 9041860 - DNA, 22 bp, Homo sapiens
tttaccaggagtcagaaggact

SEQ ID NO: 9041861 - DNA, 22 bp, Homo sapiens
tttaccaggagtcagaaggact

SEQ ID NO: 9041862 - DNA, 22 bp, Homo sapiens
tttacaaggcagaactgattaa

SEQ ID NO: 9041863 - DNA, 22 bp, Homo sapiens
tttacaaggcagttattttcct

SEQ ID NO: 9041864 - DNA, 22 bp, Homo sapiens
tttacaaggcagttattttcct

SEQ ID NO: 9041865 - DNA, 22 bp, Homo sapiens
tttacaaggcagaactgattaa

SEQ ID NO: 9041866 - DNA, 22 bp, Homo sapiens
tttacaaggcagttattttcct

SEQ ID NO: 9041867 - DNA, 22 bp, Homo sapiens
tttacaaggcagttattttcct

SEQ ID NO: 9041868 - DNA, 22 bp, Homo sapiens
tttactttctcaagtatatagg

SEQ ID NO: 9041869 - DNA, 22 bp, Homo sapiens
tttactttctcaagtatatagg

SEQ ID NO: 9041870 - DNA, 22 bp, Homo sapiens
tttactttctcaagtatatagg

SEQ ID NO: 9041871 - DNA, 22 bp, Homo sapiens
tttactttctcaagtatatagg

SEQ ID NO: 9041872 - DNA, 22 bp, Homo sapiens
tttactttgtgtcaagtcaaga

SEQ ID NO: 9041873 - DNA, 22 bp, Homo sapiens
tttactttgtgtcaagtcaaga

SEQ ID NO: 9041874 - DNA, 22 bp, Homo sapiens
tttactttgtgtcaagtcaaga

SEQ ID NO: 9041875 - DNA, 22 bp, Homo sapiens
tttactttgtgtcaagtcaaga

SEQ ID NO: 9041876 - DNA, 22 bp, Homo sapiens
tttactttgtgtcaagtcaaga

SEQ ID NO: 9041877 - DNA, 22 bp, Homo sapiens
tttagaacagatattgtaactt

SEQ ID NO: 9041878 - DNA, 22 bp, Homo sapiens
tttagttattgcacagaattag

SEQ ID NO: 9041879 - DNA, 22 bp, Homo sapiens
tttagttattgcacagaattag

SEQ ID NO: 9041880 - DNA, 22 bp, Homo sapiens
tttagaaattgcagagtgggtg

SEQ ID NO: 9041881 - DNA, 22 bp, Homo sapiens
tttagaaattgcagagtgggtg

SEQ ID NO: 9041882 - DNA, 22 bp, Homo sapiens
tttagttattgttacagtatga

SEQ ID NO: 9041883 - DNA, 22 bp, Homo sapiens
tttagttattgttacagtatga

SEQ ID NO: 9041884 - DNA, 22 bp, Homo sapiens
tttagttattgttacagtatga

SEQ ID NO: 9041885 - DNA, 22 bp, Homo sapiens
tttagttattgttacagtatga

SEQ ID NO: 9041886 - DNA, 22 bp, Homo sapiens
tttagttattgttacagtatga

SEQ ID NO: 9041887 - DNA, 22 bp, Homo sapiens
tttacttttggtaaggtcattt

SEQ ID NO: 9041888 - DNA, 22 bp, Homo sapiens
tttacttttggtaaggtcattt

SEQ ID NO: 9041889 - DNA, 22 bp, Homo sapiens
tttacttttggtaaggtcattt

SEQ ID NO: 9041890 - DNA, 22 bp, Homo sapiens
tttacttttggtaaggtcattt

SEQ ID NO: 9041891 - DNA, 22 bp, Homo sapiens
tttagaaattcatctatggcct

SEQ ID NO: 9041892 - DNA, 22 bp, Homo sapiens
tttagaaattcatctatggcct

SEQ ID NO: 9041893 - DNA, 22 bp, Homo sapiens
tttacttgatatggagctgagg

SEQ ID NO: 9041894 - DNA, 22 bp, Homo sapiens
tttactgttcaacttgcaagta

SEQ ID NO: 9041895 - DNA, 22 bp, Homo sapiens
tttactgttcaacttgcaagta

SEQ ID NO: 9041896 - DNA, 22 bp, Homo sapiens
tttactgttcaacttgcaagta

SEQ ID NO: 9041897 - DNA, 22 bp, Homo sapiens
tttactgttacacctaccttct

SEQ ID NO: 9041898 - DNA, 22 bp, Homo sapiens
tttactgtgtaaggggaatgtt

SEQ ID NO: 9041899 - DNA, 22 bp, Homo sapiens
tttactgtgcattagaatcacc

SEQ ID NO: 9041900 - DNA, 22 bp, Homo sapiens
tttactgagtgacctagaataa

SEQ ID NO: 9041901 - DNA, 22 bp, Homo sapiens
tttactgagtgacctagaataa

SEQ ID NO: 9041902 - DNA, 22 bp, Homo sapiens
tttactgtctcagagagacaaa

SEQ ID NO: 9041903 - DNA, 22 bp, Homo sapiens
tttactgtctcagagagacaaa

SEQ ID NO: 9041904 - DNA, 22 bp, Homo sapiens
tttactgagtgacctagaataa

SEQ ID NO: 9041905 - DNA, 22 bp, Homo sapiens
tttactgagtgacctagaataa

SEQ ID NO: 9041906 - DNA, 21 bp, Homo sapiens
tttactgagcacttactatgt

SEQ ID NO: 9041907 - DNA, 21 bp, Homo sapiens
tttactgagcacttactatgt

SEQ ID NO: 9041908 - DNA, 21 bp, Homo sapiens
tttactgagcacttactatgt

SEQ ID NO: 9041909 - DNA, 22 bp, Homo sapiens
tttactgacctccaatcccact

SEQ ID NO: 9041910 - DNA, 22 bp, Homo sapiens
tttactgaatttggtatattcc

SEQ ID NO: 9041911 - DNA, 22 bp, Homo sapiens
tttactgaatttggtatattcc

SEQ ID NO: 9041912 - DNA, 22 bp, Homo sapiens
tttactgaactgctagtacagg

SEQ ID NO: 9041913 - DNA, 22 bp, Homo sapiens
tttactgaactgctagtacagg

SEQ ID NO: 9041914 - DNA, 18 bp, Homo sapiens
tttactcataggcctgac

SEQ ID NO: 9041915 - DNA, 22 bp, Homo sapiens
tttctcatggacccttcatgat

SEQ ID NO: 9041916 - DNA, 22 bp, Homo sapiens
tttctcatggacccttcatgat

SEQ ID NO: 9041917 - DNA, 22 bp, Homo sapiens
tttctcatggcccttggctttt

SEQ ID NO: 9041918 - DNA, 21 bp, Homo sapiens
tttctccaagtgactgattcc

SEQ ID NO: 9041919 - DNA, 22 bp, Homo sapiens
tttctcatctggaaacagtgct

SEQ ID NO: 9041920 - DNA, 22 bp, Homo sapiens
tttctcatctggaaacagtgct

SEQ ID NO: 9041921 - DNA, 22 bp, Homo sapiens
tttctcatagtcatgcctctta

SEQ ID NO: 9041922 - DNA, 23 bp, Homo sapiens
tttctcatccagagagtcagtcc

SEQ ID NO: 9041923 - DNA, 22 bp, Homo sapiens
tttctcatagtcatgcctctta

SEQ ID NO: 9041924 - DNA, 22 bp, Homo sapiens
tttctcatggaacatagctcct

SEQ ID NO: 9041925 - DNA, 22 bp, Homo sapiens
tttctcatggaacatagctcct

SEQ ID NO: 9041926 - DNA, 22 bp, Homo sapiens
tttctcatggaacatagctcct

SEQ ID NO: 9041927 - DNA, 22 bp, Homo sapiens
tttctcatggacccttcatgat

SEQ ID NO: 9041928 - DNA, 22 bp, Homo sapiens
tttctcctcatgactggttgtg

SEQ ID NO: 9041929 - DNA, 22 bp, Homo sapiens
tttctcctctccagagtgcagt

SEQ ID NO: 9041930 - DNA, 20 bp, Homo sapiens
tttctccggtcttgagatcc

SEQ ID NO: 9041931 - DNA, 22 bp, Homo sapiens
tttctcctaactcaaatttaag

SEQ ID NO: 9041932 - DNA, 22 bp, Homo sapiens
tttctcctaactcaaatttaag

SEQ ID NO: 9041933 - DNA, 22 bp, Homo sapiens
tttctccctttataagactgta

SEQ ID NO: 9041934 - DNA, 22 bp, Homo sapiens
tttctccctttataagactgta

SEQ ID NO: 9041935 - DNA, 22 bp, Homo sapiens
tttctcctcatgactggttgtg

SEQ ID NO: 9041936 - DNA, 22 bp, Homo sapiens
tttctcctcatgactggttgtg

SEQ ID NO: 9041937 - DNA, 20 bp, Homo sapiens
tttctcccaagtgcaagggt

SEQ ID NO: 9041938 - DNA, 22 bp, Homo sapiens
tttctccctccactacaggctc

SEQ ID NO: 9041939 - DNA, 20 bp, Homo sapiens
tttctcccaagtgcaagggt

SEQ ID NO: 9041940 - DNA, 22 bp, Homo sapiens
tttctcccaaagtgcaaccaca

SEQ ID NO: 9041941 - DNA, 22 bp, Homo sapiens
tttctccatcaccccctcggtg

SEQ ID NO: 9041942 - DNA, 22 bp, Homo sapiens
tttctcccaaagtgcaaccaca

SEQ ID NO: 9041943 - DNA, 21 bp, Homo sapiens
tttctcataaaatactcatta

SEQ ID NO: 9041944 - DNA, 22 bp, Homo sapiens
tttctcagttactagctgtggt

SEQ ID NO: 9041945 - DNA, 22 bp, Homo sapiens
tttctcagtgcagtttctacgt

SEQ ID NO: 9041946 - DNA, 22 bp, Homo sapiens
tttctcagtgtagcttttcaag

SEQ ID NO: 9041947 - DNA, 22 bp, Homo sapiens
tttctcagtagtaatggcagtc

SEQ ID NO: 9041948 - DNA, 22 bp, Homo sapiens
tttctcagtaatgtcctggaat

SEQ ID NO: 9041949 - DNA, 22 bp, Homo sapiens
tttctcagtagtaatggcagtc

SEQ ID NO: 9041950 - DNA, 22 bp, Homo sapiens
tttctcagggaggagtcaagcc

SEQ ID NO: 9041951 - DNA, 22 bp, Homo sapiens
tttctcagctcagcatctgggt

SEQ ID NO: 9041952 - DNA, 19 bp, Homo sapiens
tttctcaggaagtttgtgt

SEQ ID NO: 9041953 - DNA, 19 bp, Homo sapiens
tttctcaggaagtttgtgt

SEQ ID NO: 9041954 - DNA, 22 bp, Homo sapiens
tttctcagcctccttgctggag

SEQ ID NO: 9041955 - DNA, 22 bp, Homo sapiens
tttctcagcctccttgctggag

SEQ ID NO: 9041956 - DNA, 22 bp, Homo sapiens
tttctcagcgttcttagggctc

SEQ ID NO: 9041957 - DNA, 22 bp, Homo sapiens
tttctcagctcagcatctgggt

SEQ ID NO: 9041958 - DNA, 22 bp, Homo sapiens
tttctcagctcagcatctgggt

SEQ ID NO: 9041959 - DNA, 22 bp, Homo sapiens
tttctcagctcagcatctgggt

SEQ ID NO: 9041960 - DNA, 22 bp, Homo sapiens
tttctattgtaagtctcctata

SEQ ID NO: 9041961 - DNA, 22 bp, Homo sapiens
tttctattggcgtcactgttgt

SEQ ID NO: 9041962 - DNA, 22 bp, Homo sapiens
tttctagaatgactcatctgag

SEQ ID NO: 9041963 - DNA, 22 bp, Homo sapiens
tttctattggcgtcactgttgt

SEQ ID NO: 9041964 - DNA, 22 bp, Homo sapiens
tttctattgtaagtctcctata

SEQ ID NO: 9041965 - DNA, 22 bp, Homo sapiens
tttctatttacagtgctaggta

SEQ ID NO: 9041966 - DNA, 22 bp, Homo sapiens
tttctattgtaagtctcctata

SEQ ID NO: 9041967 - DNA, 22 bp, Homo sapiens
tttctatttacagtgctaggta

SEQ ID NO: 9041968 - DNA, 22 bp, Homo sapiens
tttctagaaatagagatagagt

SEQ ID NO: 9041969 - DNA, 22 bp, Homo sapiens
tttctagaatgactcatctgag

SEQ ID NO: 9041970 - DNA, 22 bp, Homo sapiens
tttctagaatgactcatctgag

SEQ ID NO: 9041971 - DNA, 22 bp, Homo sapiens
tttctagaaagttcatgtgttt

SEQ ID NO: 9041972 - DNA, 22 bp, Homo sapiens
tttctagaaagttcatgtgttt

SEQ ID NO: 9041973 - DNA, 22 bp, Homo sapiens
tttctagaaaccaagatattgt

SEQ ID NO: 9041974 - DNA, 22 bp, Homo sapiens
tttctagaaaccaagatattgt

SEQ ID NO: 9041975 - DNA, 22 bp, Homo sapiens
tttctacttctcctgaatgtct

SEQ ID NO: 9041976 - DNA, 22 bp, Homo sapiens
tttctacttctcctgaatgtct

SEQ ID NO: 9041977 - DNA, 22 bp, Homo sapiens
tttctacttctcctgaatgtct

SEQ ID NO: 9041978 - DNA, 22 bp, Homo sapiens
tttctacttctcctgaatgtct

SEQ ID NO: 9041979 - DNA, 22 bp, Homo sapiens
tttctacttctcctgaatgtct

SEQ ID NO: 9041980 - DNA, 22 bp, Homo sapiens
tttctaagtgtattgagcttgg

SEQ ID NO: 9041981 - DNA, 22 bp, Homo sapiens
tttctaagtgtattgagcttgg

SEQ ID NO: 9041982 - DNA, 21 bp, Homo sapiens
tttctaagtgcttggtttggg

SEQ ID NO: 9041983 - DNA, 22 bp, Homo sapiens
tttctaagtgtattgagcttgg

SEQ ID NO: 9041984 - DNA, 22 bp, Homo sapiens
tttctaagtgtgattttagatt

SEQ ID NO: 9041985 - DNA, 22 bp, Homo sapiens
tttctaagtgtgtttcatagga

SEQ ID NO: 9041986 - DNA, 22 bp, Homo sapiens
tttctaagtgtgattttagatt

SEQ ID NO: 9041987 - DNA, 22 bp, Homo sapiens
tttctaagtgtgattttagatt

SEQ ID NO: 9041988 - DNA, 22 bp, Homo sapiens
tttctaagtgtgtttcatagga

SEQ ID NO: 9041989 - DNA, 22 bp, Homo sapiens
tttctaagtgtgtttcatagga

SEQ ID NO: 9041990 - DNA, 22 bp, Homo sapiens
tttctaatatcacttccagctg

SEQ ID NO: 9041991 - DNA, 22 bp, Homo sapiens
tttctaatatgctctaagtcaa

SEQ ID NO: 9041992 - DNA, 21 bp, Homo sapiens
tttctaagtaactggcagcat

SEQ ID NO: 9041993 - DNA, 22 bp, Homo sapiens
tttctaagtaagattaacttct

SEQ ID NO: 9041994 - DNA, 22 bp, Homo sapiens
tttctaagtatcttgcagtttt

SEQ ID NO: 9041995 - DNA, 22 bp, Homo sapiens
tttctaagtaaacacagcatac

SEQ ID NO: 9041996 - DNA, 22 bp, Homo sapiens
tttctaagtaaacacagcatac

SEQ ID NO: 9041997 - DNA, 22 bp, Homo sapiens
tttctaagtaaacacagcatac

SEQ ID NO: 9041998 - DNA, 22 bp, Homo sapiens
tttctaagtgaacattcaagtt

SEQ ID NO: 9041999 - DNA, 21 bp, Homo sapiens
tttctaagtgcttggtttggg

SEQ ID NO: 9042000 - DNA, 22 bp, Homo sapiens
tttctaagtctgagggagtata

SEQ ID NO: 9042001 - DNA, 22 bp, Homo sapiens
tttctaagtgaacattcaagtt

SEQ ID NO: 9042002 - DNA, 22 bp, Homo sapiens
tttctaagtatcttgcagtttt

SEQ ID NO: 9042003 - DNA, 22 bp, Homo sapiens
tttctaagtatcttgcagtttt

SEQ ID NO: 9042004 - DNA, 22 bp, Homo sapiens
tttctactaagaaagttgatta

SEQ ID NO: 9042005 - DNA, 22 bp, Homo sapiens
tttctactaagaaagttgatta

SEQ ID NO: 9042006 - DNA, 22 bp, Homo sapiens
tttctactcaactgagagttgt

SEQ ID NO: 9042007 - DNA, 22 bp, Homo sapiens
tttctactcaactgagagttgt

SEQ ID NO: 9042008 - DNA, 22 bp, Homo sapiens
tttctactaagaaagttgatta

SEQ ID NO: 9042009 - DNA, 22 bp, Homo sapiens
tttctacatttgtaaccagatt

SEQ ID NO: 9042010 - DNA, 22 bp, Homo sapiens
tttctacatttgtaaccagatt

SEQ ID NO: 9042011 - DNA, 22 bp, Homo sapiens
tttctacattcaaaaactacca

SEQ ID NO: 9042012 - DNA, 22 bp, Homo sapiens
tttctacattcaaaaactacca

SEQ ID NO: 9042013 - DNA, 22 bp, Homo sapiens
tttctacatttgtaaccagatt

SEQ ID NO: 9042014 - DNA, 22 bp, Homo sapiens
tttctacattcaaaaactacca

SEQ ID NO: 9042015 - DNA, 22 bp, Homo sapiens
tttctacatttgtaaccagatt

SEQ ID NO: 9042016 - DNA, 22 bp, Homo sapiens
tttctacattcaaaaactacca

SEQ ID NO: 9042017 - DNA, 22 bp, Homo sapiens
tttctacattcaaaaactacca

SEQ ID NO: 9042018 - DNA, 22 bp, Homo sapiens
tttctacattcaaaaactacca

SEQ ID NO: 9042019 - DNA, 22 bp, Homo sapiens
tttctacattcaaaaactacca

SEQ ID NO: 9042020 - DNA, 22 bp, Homo sapiens
tttctaatctttagttacaaaa

SEQ ID NO: 9042021 - DNA, 22 bp, Homo sapiens
tttctaatctgattctcctacc

SEQ ID NO: 9042022 - DNA, 22 bp, Homo sapiens
tttctaatctgattctcctacc

SEQ ID NO: 9042023 - DNA, 22 bp, Homo sapiens
tttctaatctttagttacaaaa

SEQ ID NO: 9042024 - DNA, 22 bp, Homo sapiens
tttctaatctttagttacaaaa

SEQ ID NO: 9042025 - DNA, 22 bp, Homo sapiens
tttctaatctttagttacaaaa

SEQ ID NO: 9042026 - DNA, 22 bp, Homo sapiens
tttctacatgttttctattgaa

SEQ ID NO: 9042027 - DNA, 22 bp, Homo sapiens
tttctacatgttttctattgaa

SEQ ID NO: 9042028 - DNA, 22 bp, Homo sapiens
tttctacatgttttctattgaa

SEQ ID NO: 9042029 - DNA, 19 bp, Homo sapiens
tttctaatgtgtttttctt

SEQ ID NO: 9042030 - DNA, 19 bp, Homo sapiens
tttctaatgtgtttttctt

SEQ ID NO: 9042031 - DNA, 22 bp, Homo sapiens
tttctaattctaactggcagag

SEQ ID NO: 9042032 - DNA, 22 bp, Homo sapiens
tttccttccaggttcctaaggc

SEQ ID NO: 9042033 - DNA, 22 bp, Homo sapiens
tttccttccaggttcctaaggc

SEQ ID NO: 9042034 - DNA, 22 bp, Homo sapiens
tttccttccaggttcctaaggc

SEQ ID NO: 9042035 - DNA, 22 bp, Homo sapiens
tttccttccaggttcctaaggc

SEQ ID NO: 9042036 - DNA, 22 bp, Homo sapiens
tttccttccaggttcctaaggc

SEQ ID NO: 9042037 - DNA, 22 bp, Homo sapiens
tttccttccctggatgagaagt

SEQ ID NO: 9042038 - DNA, 22 bp, Homo sapiens
tttccttccatgttgggcaaaa

SEQ ID NO: 9042039 - DNA, 22 bp, Homo sapiens
tttccttccatgttgggcaaaa

SEQ ID NO: 9042040 - DNA, 22 bp, Homo sapiens
tttccttccatgttgggcaaaa

SEQ ID NO: 9042041 - DNA, 22 bp, Homo sapiens
tttccttaaatctgtttctagt

SEQ ID NO: 9042042 - DNA, 22 bp, Homo sapiens
tttcctgttgccatcaagaatg

SEQ ID NO: 9042043 - DNA, 22 bp, Homo sapiens
tttccttcatcatctgagagct

SEQ ID NO: 9042044 - DNA, 22 bp, Homo sapiens
tttccttcatcatctgagagct

SEQ ID NO: 9042045 - DNA, 22 bp, Homo sapiens
tttccttcatcatctgagagct

SEQ ID NO: 9042046 - DNA, 22 bp, Homo sapiens
tttccttcatcatctgagagct

SEQ ID NO: 9042047 - DNA, 22 bp, Homo sapiens
tttccttcatcatctgagagct

SEQ ID NO: 9042048 - DNA, 22 bp, Homo sapiens
tttccttccaaatgcccgggag

SEQ ID NO: 9042049 - DNA, 22 bp, Homo sapiens
tttccttctcagggagcttcaa

SEQ ID NO: 9042050 - DNA, 22 bp, Homo sapiens
tttccttctcagggagcttcaa

SEQ ID NO: 9042051 - DNA, 22 bp, Homo sapiens
tttccttctcagggagcttcaa

SEQ ID NO: 9042052 - DNA, 22 bp, Homo sapiens
tttccttctcagggagcttcaa

SEQ ID NO: 9042053 - DNA, 22 bp, Homo sapiens
tttctaaggtgaggtagaaaat

SEQ ID NO: 9042054 - DNA, 22 bp, Homo sapiens
tttccttcttagcggtgttctt

SEQ ID NO: 9042055 - DNA, 22 bp, Homo sapiens
tttctaaggtgatcctttctta

SEQ ID NO: 9042056 - DNA, 22 bp, Homo sapiens
tttctaaggtgatcctttctta

SEQ ID NO: 9042057 - DNA, 22 bp, Homo sapiens
tttccttccttgctagcctgag

SEQ ID NO: 9042058 - DNA, 22 bp, Homo sapiens
tttccttccttgctagcctgag

SEQ ID NO: 9042059 - DNA, 22 bp, Homo sapiens
tttccttcctaaggtgaagcaa

SEQ ID NO: 9042060 - DNA, 22 bp, Homo sapiens
tttccttcctaaggtgaagcaa

SEQ ID NO: 9042061 - DNA, 22 bp, Homo sapiens
tttcctgtcttttgtgaaggat

SEQ ID NO: 9042062 - DNA, 22 bp, Homo sapiens
tttcctgtcctggtacttggca

SEQ ID NO: 9042063 - DNA, 22 bp, Homo sapiens
tttcctgtgactaatctggaca

SEQ ID NO: 9042064 - DNA, 22 bp, Homo sapiens
tttcctgtgcttaacaaatatt

SEQ ID NO: 9042065 - DNA, 22 bp, Homo sapiens
tttcctgttctagttgttgcca

SEQ ID NO: 9042066 - DNA, 22 bp, Homo sapiens
tttcctgttgccatcaagaatg

SEQ ID NO: 9042067 - DNA, 22 bp, Homo sapiens
tttcctgttgccatcaagaatg

SEQ ID NO: 9042068 - DNA, 22 bp, Homo sapiens
tttcctggaagttattcctcat

SEQ ID NO: 9042069 - DNA, 22 bp, Homo sapiens
tttcctgtcctggtacttggca

SEQ ID NO: 9042070 - DNA, 22 bp, Homo sapiens
tttcctggttggggacgtggtt

SEQ ID NO: 9042071 - DNA, 21 bp, Homo sapiens
tttcctgccctttgtcatcac

SEQ ID NO: 9042072 - DNA, 22 bp, Homo sapiens
tttcctgcacccgctgatgcca

SEQ ID NO: 9042073 - DNA, 22 bp, Homo sapiens
tttcctctttgtaccttgacta

SEQ ID NO: 9042074 - DNA, 22 bp, Homo sapiens
tttcctctttgtaccttgacta

SEQ ID NO: 9042075 - DNA, 22 bp, Homo sapiens
tttcagatggtatatacagtag

SEQ ID NO: 9042076 - DNA, 22 bp, Homo sapiens
tttcagattatctcaactttgg

SEQ ID NO: 9042077 - DNA, 22 bp, Homo sapiens
tttcagatggtatatacagtag

SEQ ID NO: 9042078 - DNA, 22 bp, Homo sapiens
tttcagatggtatatacagtag

SEQ ID NO: 9042079 - DNA, 22 bp, Homo sapiens
tttcagatggtatatacagtag

SEQ ID NO: 9042080 - DNA, 23 bp, Homo sapiens
tttcagcattctagttcaggttc

SEQ ID NO: 9042081 - DNA, 23 bp, Homo sapiens
tttcagcattctagttcaggttc

SEQ ID NO: 9042082 - DNA, 20 bp, Homo sapiens
tttcagatttacagaaatgt

SEQ ID NO: 9042083 - DNA, 20 bp, Homo sapiens
tttcagatttacagaaatgt

SEQ ID NO: 9042084 - DNA, 17 bp, Homo sapiens
tttcagattcactttct

SEQ ID NO: 9042085 - DNA, 22 bp, Homo sapiens
tttcagatgcaattaattttca

SEQ ID NO: 9042086 - DNA, 22 bp, Homo sapiens
tttcagatgcaattaattttca

SEQ ID NO: 9042087 - DNA, 22 bp, Homo sapiens
tttcagatgaaatgtgtatatt

SEQ ID NO: 9042088 - DNA, 22 bp, Homo sapiens
tttcagatgcaattaattttca

SEQ ID NO: 9042089 - DNA, 22 bp, Homo sapiens
tttcagatcactttcaggaaag

SEQ ID NO: 9042090 - DNA, 22 bp, Homo sapiens
tttcagatcattttttaagtac

SEQ ID NO: 9042091 - DNA, 22 bp, Homo sapiens
tttcagatgaaatgtgtatatt

SEQ ID NO: 9042092 - DNA, 22 bp, Homo sapiens
tttcagatcactttcaggaaag

SEQ ID NO: 9042093 - DNA, 22 bp, Homo sapiens
tttcagataaatatgggactaa

SEQ ID NO: 9042094 - DNA, 22 bp, Homo sapiens
tttcagagttgtcttcttgacc

SEQ ID NO: 9042095 - DNA, 22 bp, Homo sapiens
tttcagagttggggaaaagcag

SEQ ID NO: 9042096 - DNA, 22 bp, Homo sapiens
tttcagagttgtcttcttgacc

SEQ ID NO: 9042097 - DNA, 22 bp, Homo sapiens
tttcaggaaggacttcggtaat

SEQ ID NO: 9042098 - DNA, 22 bp, Homo sapiens
tttcaggaaacatttaatggca

SEQ ID NO: 9042099 - DNA, 22 bp, Homo sapiens
tttcaggaaggtgaggcacatg

SEQ ID NO: 9042100 - DNA, 22 bp, Homo sapiens
tttcaggactcaaaacgataat

SEQ ID NO: 9042101 - DNA, 22 bp, Homo sapiens
tttcaggacacctttaaaaacg

SEQ ID NO: 9042102 - DNA, 22 bp, Homo sapiens
tttcaggactcaaaacgataat

SEQ ID NO: 9042103 - DNA, 22 bp, Homo sapiens
tttcaggaatacacacacatct

SEQ ID NO: 9042104 - DNA, 22 bp, Homo sapiens
tttcaggaaggtgaggcacatg

SEQ ID NO: 9042105 - DNA, 22 bp, Homo sapiens
tttcaggacacctttaaaaacg

SEQ ID NO: 9042106 - DNA, 22 bp, Homo sapiens
tttcaggattttatgagatagt

SEQ ID NO: 9042107 - DNA, 22 bp, Homo sapiens
tttcaggcaggtggaatgagta

SEQ ID NO: 9042108 - DNA, 22 bp, Homo sapiens
tttcaggattttatgagatagt

SEQ ID NO: 9042109 - DNA, 22 bp, Homo sapiens
tttcaggattagtttaagcagg

SEQ ID NO: 9042110 - DNA, 22 bp, Homo sapiens
tttcaggattttatgagatagt

SEQ ID NO: 9042111 - DNA, 22 bp, Homo sapiens
tttcaggagagaccagaaatga

SEQ ID NO: 9042112 - DNA, 22 bp, Homo sapiens
tttcaggatcaaatgaaatcgt

SEQ ID NO: 9042113 - DNA, 19 bp, Homo sapiens
tttcaggagctatgcaggg

SEQ ID NO: 9042114 - DNA, 22 bp, Homo sapiens
tttcaggatcaaatgaaatcgt

SEQ ID NO: 9042115 - DNA, 19 bp, Homo sapiens
tttcaggagctatgcaggg

SEQ ID NO: 9042116 - DNA, 22 bp, Homo sapiens
tttcagtgcccagagctttgca

SEQ ID NO: 9042117 - DNA, 22 bp, Homo sapiens
tttcagtgcccagagctttgca

SEQ ID NO: 9042118 - DNA, 22 bp, Homo sapiens
tttcagtgcacgtagtttattt

SEQ ID NO: 9042119 - DNA, 22 bp, Homo sapiens
tttcagtgaaagctactgttag

SEQ ID NO: 9042120 - DNA, 22 bp, Homo sapiens
tttcagtgaaagctactgttag

SEQ ID NO: 9042121 - DNA, 22 bp, Homo sapiens
tttcagtcatgagttgttttca

SEQ ID NO: 9042122 - DNA, 22 bp, Homo sapiens
tttcagggtcagcctgtatgtg

SEQ ID NO: 9042123 - DNA, 22 bp, Homo sapiens
tttcaggagagaccagaaatga

SEQ ID NO: 9042124 - DNA, 22 bp, Homo sapiens
tttcagggagcctagaagagct

SEQ ID NO: 9042125 - DNA, 22 bp, Homo sapiens
tttcagggaagtgttgaaaagg

SEQ ID NO: 9042126 - DNA, 22 bp, Homo sapiens
tttcagggagcctagaagagct

SEQ ID NO: 9042127 - DNA, 22 bp, Homo sapiens
tttcaggccatagcacagggaa

SEQ ID NO: 9042128 - DNA, 22 bp, Homo sapiens
tttcagggaagtgttgaaaagg

SEQ ID NO: 9042129 - DNA, 20 bp, Homo sapiens
tttcaggctggctatctttg

SEQ ID NO: 9042130 - DNA, 22 bp, Homo sapiens
tttcagaggtgcttggaatgct

SEQ ID NO: 9042131 - DNA, 22 bp, Homo sapiens
tttcagaggtgcttggaatgct

SEQ ID NO: 9042132 - DNA, 22 bp, Homo sapiens
tttcagaggtatgctgcttatc

SEQ ID NO: 9042133 - DNA, 22 bp, Homo sapiens
tttcagagtcagctcctctcta

SEQ ID NO: 9042134 - DNA, 22 bp, Homo sapiens
tttcagagtctggctgcagcct

SEQ ID NO: 9042135 - DNA, 22 bp, Homo sapiens
tttcagagtcagctcctctcta

SEQ ID NO: 9042136 - DNA, 20 bp, Homo sapiens
tttcagagtgtctttccatt

SEQ ID NO: 9042137 - DNA, 22 bp, Homo sapiens
tttcagagttagtagagcatgt

SEQ ID NO: 9042138 - DNA, 22 bp, Homo sapiens
tttcagagttatgtaagaaaat

SEQ ID NO: 9042139 - DNA, 22 bp, Homo sapiens
tttcagagttatgtaagaaaat

SEQ ID NO: 9042140 - DNA, 22 bp, Homo sapiens
tttcagaggaggaaggcagtta

SEQ ID NO: 9042141 - DNA, 22 bp, Homo sapiens
tttcagaggtatgctgcttatc

SEQ ID NO: 9042142 - DNA, 22 bp, Homo sapiens
tttcagagggcagatctggggc

SEQ ID NO: 9042143 - DNA, 22 bp, Homo sapiens
tttcagaggtatgctgcttatc

SEQ ID NO: 9042144 - DNA, 22 bp, Homo sapiens
tttcagaggaggaaggcagtta

SEQ ID NO: 9042145 - DNA, 22 bp, Homo sapiens
tttcagaggaaatctcattgag

SEQ ID NO: 9042146 - DNA, 22 bp, Homo sapiens
tttcagagctgagatgccacag

SEQ ID NO: 9042147 - DNA, 22 bp, Homo sapiens
tttcaaagggaagttatgaagt

SEQ ID NO: 9042148 - DNA, 22 bp, Homo sapiens
tttcaaagggaagttatgaagt

SEQ ID NO: 9042149 - DNA, 20 bp, Homo sapiens
tttcaaaggcacctatgaag

SEQ ID NO: 9042150 - DNA, 20 bp, Homo sapiens
tttcaaaggcacctatgaag

SEQ ID NO: 9042151 - DNA, 22 bp, Homo sapiens
tttcaaactttactcttgaatc

SEQ ID NO: 9042152 - DNA, 22 bp, Homo sapiens
tttcaaagacagccatatttgt

SEQ ID NO: 9042153 - DNA, 22 bp, Homo sapiens
tttcaaagacagccatatttgt

SEQ ID NO: 9042154 - DNA, 22 bp, Homo sapiens
tttcaaagaccattaactatca

SEQ ID NO: 9042155 - DNA, 22 bp, Homo sapiens
tttcaaagacagccatatttgt

SEQ ID NO: 9042156 - DNA, 22 bp, Homo sapiens
tttcaaagaccattaactatca

SEQ ID NO: 9042157 - DNA, 23 bp, Homo sapiens
tttcaaagactttcccttagagt

SEQ ID NO: 9042158 - DNA, 22 bp, Homo sapiens
tttcaaagagttgtaaattact

SEQ ID NO: 9042159 - DNA, 22 bp, Homo sapiens
tttcaaagagaggcagaaggaa

SEQ ID NO: 9042160 - DNA, 22 bp, Homo sapiens
tttcaaagagttgtaaattact

SEQ ID NO: 9042161 - DNA, 22 bp, Homo sapiens
tttcaaagcaactgaaaaggaa

SEQ ID NO: 9042162 - DNA, 17 bp, Homo sapiens
tttcaaagcagtcagga

SEQ ID NO: 9042163 - DNA, 17 bp, Homo sapiens
tttcaaagcagtcagga

SEQ ID NO: 9042164 - DNA, 22 bp, Homo sapiens
tttcattttggttatgccataa

SEQ ID NO: 9042165 - DNA, 22 bp, Homo sapiens
tttcattttggttatgccataa

SEQ ID NO: 9042166 - DNA, 22 bp, Homo sapiens
tttcattttggttatgccataa

SEQ ID NO: 9042167 - DNA, 22 bp, Homo sapiens
tttcatttcatagaattgtgtt

SEQ ID NO: 9042168 - DNA, 22 bp, Homo sapiens
tttcattttggttatgccataa

SEQ ID NO: 9042169 - DNA, 22 bp, Homo sapiens
tttcatttcatagaattgtgtt

SEQ ID NO: 9042170 - DNA, 22 bp, Homo sapiens
tttcatttcatagaattgtgtt

SEQ ID NO: 9042171 - DNA, 22 bp, Homo sapiens
tttcatttcatagaattgtgtt

SEQ ID NO: 9042172 - DNA, 22 bp, Homo sapiens
tttcatttcatagaattgtgtt

SEQ ID NO: 9042173 - DNA, 22 bp, Homo sapiens
tttcatttcatagaattgtgtt

SEQ ID NO: 9042174 - DNA, 22 bp, Homo sapiens
tttccaaaagtttgttctgtgc

SEQ ID NO: 9042175 - DNA, 22 bp, Homo sapiens
tttccaaaagtttgttctgtgc

SEQ ID NO: 9042176 - DNA, 22 bp, Homo sapiens
tttccaaaagtttgttctgtgc

SEQ ID NO: 9042177 - DNA, 22 bp, Homo sapiens
tttccaaaagtttgttctgtgc

SEQ ID NO: 9042178 - DNA, 22 bp, Homo sapiens
tttccaaaatgaatctaatgca

SEQ ID NO: 9042179 - DNA, 22 bp, Homo sapiens
tttccaaaagtttgttctgtgc

SEQ ID NO: 9042180 - DNA, 22 bp, Homo sapiens
tttccaaaagtttgttctgtgc

SEQ ID NO: 9042181 - DNA, 22 bp, Homo sapiens
tttcattttggttatgccataa

SEQ ID NO: 9042182 - DNA, 22 bp, Homo sapiens
tttcattttggttatgccataa

SEQ ID NO: 9042183 - DNA, 22 bp, Homo sapiens
tttccaaagctgagttgagcaa

SEQ ID NO: 9042184 - DNA, 22 bp, Homo sapiens
tttccaaacccagcgagctaca

SEQ ID NO: 9042185 - DNA, 22 bp, Homo sapiens
tttccaaagctgagttgagcaa

SEQ ID NO: 9042186 - DNA, 22 bp, Homo sapiens
tttccaaacccagcgagctaca

SEQ ID NO: 9042187 - DNA, 22 bp, Homo sapiens
tttccaaaatgaatctaatgca

SEQ ID NO: 9042188 - DNA, 22 bp, Homo sapiens
tttccaaaatgaatctaatgca

SEQ ID NO: 9042189 - DNA, 22 bp, Homo sapiens
tttccaaaatgaatctaatgca

SEQ ID NO: 9042190 - DNA, 22 bp, Homo sapiens
tttccaaaatgaatctaatgca

SEQ ID NO: 9042191 - DNA, 22 bp, Homo sapiens
tttcattgtccccaggcaagac

SEQ ID NO: 9042192 - DNA, 22 bp, Homo sapiens
tttcattgtccccaggcaagac

SEQ ID NO: 9042193 - DNA, 22 bp, Homo sapiens
tttcattgtctacatatgacat

SEQ ID NO: 9042194 - DNA, 22 bp, Homo sapiens
tttcattgtctacatatgacat

SEQ ID NO: 9042195 - DNA, 22 bp, Homo sapiens
tttcattgtgatgcttttatca

SEQ ID NO: 9042196 - DNA, 22 bp, Homo sapiens
tttcattgtctacatatgacat

SEQ ID NO: 9042197 - DNA, 22 bp, Homo sapiens
tttcattgtcatctatcttaga

SEQ ID NO: 9042198 - DNA, 22 bp, Homo sapiens
tttcattgtcagagctttgaat

SEQ ID NO: 9042199 - DNA, 20 bp, Homo sapiens
tttcattgtcagaatcttat

SEQ ID NO: 9042200 - DNA, 22 bp, Homo sapiens
tttcattgtcaataaactgtat

SEQ ID NO: 9042201 - DNA, 22 bp, Homo sapiens
tttcattgtcaataaactgtat

SEQ ID NO: 9042202 - DNA, 22 bp, Homo sapiens
tttcattggctccctgatgaat

SEQ ID NO: 9042203 - DNA, 22 bp, Homo sapiens
tttcattgtcaataaactgtat

SEQ ID NO: 9042204 - DNA, 22 bp, Homo sapiens
tttcattgtcaataaactgtat

SEQ ID NO: 9042205 - DNA, 22 bp, Homo sapiens
tttcattggctccctgatgaat

SEQ ID NO: 9042206 - DNA, 22 bp, Homo sapiens
tttcattggcagagcctgtttt

SEQ ID NO: 9042207 - DNA, 22 bp, Homo sapiens
tttcagtggagtgacatgatct

SEQ ID NO: 9042208 - DNA, 22 bp, Homo sapiens
tttcattgccataaggtgggat

SEQ ID NO: 9042209 - DNA, 22 bp, Homo sapiens
tttcagtggaccacagtttgat

SEQ ID NO: 9042210 - DNA, 22 bp, Homo sapiens
tttcagtggaccacagtttgat

SEQ ID NO: 9042211 - DNA, 22 bp, Homo sapiens
tttcagtgcttctgtttaccgg

SEQ ID NO: 9042212 - DNA, 22 bp, Homo sapiens
tttcagtggaccacagtttgat

SEQ ID NO: 9042213 - DNA, 22 bp, Homo sapiens
tttccaaaggaggaaccagttt

SEQ ID NO: 9042214 - DNA, 22 bp, Homo sapiens
tttccaaaggaggaaccagttt

SEQ ID NO: 9042215 - DNA, 22 bp, Homo sapiens
tttccaaaggaggaaccagttt

SEQ ID NO: 9042216 - DNA, 22 bp, Homo sapiens
tttccaaaggagtaccacgcat

SEQ ID NO: 9042217 - DNA, 22 bp, Homo sapiens
tttccaaaggaggaaccagttt

SEQ ID NO: 9042218 - DNA, 22 bp, Homo sapiens
tttccaaaggagtaccacgcat

SEQ ID NO: 9042219 - DNA, 22 bp, Homo sapiens
tttccaaaggaggaaccagttt

SEQ ID NO: 9042220 - DNA, 22 bp, Homo sapiens
tttccaaaggaggaaccagttt

SEQ ID NO: 9042221 - DNA, 22 bp, Homo sapiens
tttccaaaggaggaaccagttt

SEQ ID NO: 9042222 - DNA, 22 bp, Homo sapiens
tttccaaagctgagttgagcaa

SEQ ID NO: 9042223 - DNA, 22 bp, Homo sapiens
tttccaaagctgagttgagcaa

SEQ ID NO: 9042224 - DNA, 22 bp, Homo sapiens
tttccaaacccagcgagctaca

SEQ ID NO: 9042225 - DNA, 22 bp, Homo sapiens
tttccaaaggctaaactcagtt

SEQ ID NO: 9042226 - DNA, 22 bp, Homo sapiens
tttccaaaggctaaactcagtt

SEQ ID NO: 9042227 - DNA, 22 bp, Homo sapiens
tttccaaaggagtaccacgcat

SEQ ID NO: 9042228 - DNA, 22 bp, Homo sapiens
tttccaaaggctaaactcagtt

SEQ ID NO: 9042229 - DNA, 16 bp, Homo sapiens
tttccaaagggcagct

SEQ ID NO: 9042230 - DNA, 16 bp, Homo sapiens
tttccaaagggcagct

SEQ ID NO: 9042231 - DNA, 22 bp, Homo sapiens
tttccaaaggctaaactcagtt

SEQ ID NO: 9042232 - DNA, 22 bp, Homo sapiens
tttccaaaggctaaactcagtt

SEQ ID NO: 9042233 - DNA, 22 bp, Homo sapiens
tttccaaaggtggcaggaacaa

SEQ ID NO: 9042234 - DNA, 22 bp, Homo sapiens
tttccaaaggtggcaggaacaa

SEQ ID NO: 9042235 - DNA, 22 bp, Homo sapiens
tttccaaaggtggcaggaacaa

SEQ ID NO: 9042236 - DNA, 16 bp, Homo sapiens
tttccaaagggcagct

SEQ ID NO: 9042237 - DNA, 22 bp, Homo sapiens
tttccaaaggtggcaggaacaa

SEQ ID NO: 9042238 - DNA, 22 bp, Homo sapiens
tttccaaaggtggcaggaacaa

SEQ ID NO: 9042239 - DNA, 22 bp, Homo sapiens
tttccaaaggtggcaggaacaa

SEQ ID NO: 9042240 - DNA, 22 bp, Homo sapiens
tttccaaaggtggcaggaacaa

SEQ ID NO: 9042241 - DNA, 22 bp, Homo sapiens
tttccaaagttgccataagctt

SEQ ID NO: 9042242 - DNA, 22 bp, Homo sapiens
tttccaaaggtggcaggaacaa

SEQ ID NO: 9042243 - DNA, 22 bp, Homo sapiens
tttccaaataaggtcacactca

SEQ ID NO: 9042244 - DNA, 22 bp, Homo sapiens
tttccaaataaggtcacactca

SEQ ID NO: 9042245 - DNA, 22 bp, Homo sapiens
tttccaaataaggtcacactca

SEQ ID NO: 9042246 - DNA, 22 bp, Homo sapiens
tttccaaataaggtcacactca

SEQ ID NO: 9042247 - DNA, 22 bp, Homo sapiens
tttccaaagttgccataagctt

SEQ ID NO: 9042248 - DNA, 22 bp, Homo sapiens
tttccaaagttgccataagctt

SEQ ID NO: 9042249 - DNA, 22 bp, Homo sapiens
tttccaaagttgccataagctt

SEQ ID NO: 9042250 - DNA, 22 bp, Homo sapiens
tttccaaagttgccataagctt

SEQ ID NO: 9042251 - DNA, 22 bp, Homo sapiens
tttccaaagttgccataagctt

SEQ ID NO: 9042252 - DNA, 22 bp, Homo sapiens
tttcctctgggccctgccaccc

SEQ ID NO: 9042253 - DNA, 22 bp, Homo sapiens
tttcctctgtcatgacagctga

SEQ ID NO: 9042254 - DNA, 22 bp, Homo sapiens
tttcctcttatacagtgtttat

SEQ ID NO: 9042255 - DNA, 22 bp, Homo sapiens
tttcctctgtcatgacagctga

SEQ ID NO: 9042256 - DNA, 22 bp, Homo sapiens
tttcctctgatgctgacttgga

SEQ ID NO: 9042257 - DNA, 22 bp, Homo sapiens
tttcctctgatgctgacttgga

SEQ ID NO: 9042258 - DNA, 22 bp, Homo sapiens
tttcctctgctgccattgcccc

SEQ ID NO: 9042259 - DNA, 22 bp, Homo sapiens
tttcctctgctgccattgcccc

SEQ ID NO: 9042260 - DNA, 22 bp, Homo sapiens
tttcctctgggccctgccaccc

SEQ ID NO: 9042261 - DNA, 22 bp, Homo sapiens
tttcctcttcttcccatgtcat

SEQ ID NO: 9042262 - DNA, 22 bp, Homo sapiens
tttcctcttcttcccatgtcat

SEQ ID NO: 9042263 - DNA, 22 bp, Homo sapiens
tttcctcttcttcccatgtcat

SEQ ID NO: 9042264 - DNA, 22 bp, Homo sapiens
tttcctcttcttcccatgtcat

SEQ ID NO: 9042265 - DNA, 22 bp, Homo sapiens
tttcctcttcttcccatgtcat

SEQ ID NO: 9042266 - DNA, 22 bp, Homo sapiens
tttcctcttcttcccatgtcat

SEQ ID NO: 9042267 - DNA, 22 bp, Homo sapiens
tttcctcttcgattaagtttgg

SEQ ID NO: 9042268 - DNA, 22 bp, Homo sapiens
tttcctcttcgattaagtttgg

SEQ ID NO: 9042269 - DNA, 22 bp, Homo sapiens
tttcctcttctggcaggcaggg

SEQ ID NO: 9042270 - DNA, 22 bp, Homo sapiens
tttcctcttatacagtgtttat

SEQ ID NO: 9042271 - DNA, 22 bp, Homo sapiens
tttcttcaattgctaacaagga

SEQ ID NO: 9042272 - DNA, 22 bp, Homo sapiens
tttcttcaattgctaacaagga

SEQ ID NO: 9042273 - DNA, 22 bp, Homo sapiens
tttcttatggggtagtccttta

SEQ ID NO: 9042274 - DNA, 22 bp, Homo sapiens
tttcttatgagcaagactctat

SEQ ID NO: 9042275 - DNA, 22 bp, Homo sapiens
tttcttatgagcaagactctat

SEQ ID NO: 9042276 - DNA, 22 bp, Homo sapiens
tttcttatggggtagtccttta

SEQ ID NO: 9042277 - DNA, 22 bp, Homo sapiens
tttcttatggggtagtccttta

SEQ ID NO: 9042278 - DNA, 22 bp, Homo sapiens
tttcttatgagcaagactctat

SEQ ID NO: 9042279 - DNA, 22 bp, Homo sapiens
tttcttatggggtagtccttta

SEQ ID NO: 9042280 - DNA, 22 bp, Homo sapiens
tttcttcacagggtattgggtg

SEQ ID NO: 9042281 - DNA, 22 bp, Homo sapiens
tttcttcacagggtattgggtg

SEQ ID NO: 9042282 - DNA, 22 bp, Homo sapiens
tttcttcaattgctaacaagga

SEQ ID NO: 9042283 - DNA, 22 bp, Homo sapiens
tttcttcaattgctaacaagga

SEQ ID NO: 9042284 - DNA, 21 bp, Homo sapiens
tttcttcactttgccccatgt

SEQ ID NO: 9042285 - DNA, 21 bp, Homo sapiens
tttcttcactttgccccatgt

SEQ ID NO: 9042286 - DNA, 23 bp, Homo sapiens
tttcttcagaagccttgcgaggc

SEQ ID NO: 9042287 - DNA, 22 bp, Homo sapiens
tttcttcagcaggtttgtgaga

SEQ ID NO: 9042288 - DNA, 22 bp, Homo sapiens
tttcttcagagagagctttccc

SEQ ID NO: 9042289 - DNA, 22 bp, Homo sapiens
tttcttcagagagagctttccc

SEQ ID NO: 9042290 - DNA, 22 bp, Homo sapiens
tttcttcccaagcagtttcaga

SEQ ID NO: 9042291 - DNA, 22 bp, Homo sapiens
tttcttcccaagcagtttcaga

SEQ ID NO: 9042292 - DNA, 22 bp, Homo sapiens
tttcttcccaagcagtttcaga

SEQ ID NO: 9042293 - DNA, 22 bp, Homo sapiens
tttcttccccactgcaggctct

SEQ ID NO: 9042294 - DNA, 21 bp, Homo sapiens
tttcttcccttggcttctgag

SEQ ID NO: 9042295 - DNA, 21 bp, Homo sapiens
tttcttcccttggcttctgag

SEQ ID NO: 9042296 - DNA, 22 bp, Homo sapiens
tttcttcctaaatatgatttcc

SEQ ID NO: 9042297 - DNA, 22 bp, Homo sapiens
tttcttccaaaggcacgttctc

SEQ ID NO: 9042298 - DNA, 19 bp, Homo sapiens
tttcttccaaagactatgg

SEQ ID NO: 9042299 - DNA, 22 bp, Homo sapiens
tttcttcattgacaaggaaaaa

SEQ ID NO: 9042300 - DNA, 22 bp, Homo sapiens
tttcttcattgatgtcaggtgg

SEQ ID NO: 9042301 - DNA, 22 bp, Homo sapiens
tttcttcattgatgtcaggtgg

SEQ ID NO: 9042302 - DNA, 22 bp, Homo sapiens
tttcttcatagaccttgtcttg

SEQ ID NO: 9042303 - DNA, 22 bp, Homo sapiens
tttcttcatagaccttgtcttg

SEQ ID NO: 9042304 - DNA, 22 bp, Homo sapiens
tttcttcattcaccttcacccc

SEQ ID NO: 9042305 - DNA, 22 bp, Homo sapiens
tttcttcattcaccttcacccc

SEQ ID NO: 9042306 - DNA, 22 bp, Homo sapiens
tttcttcattcaccttcacccc

SEQ ID NO: 9042307 - DNA, 22 bp, Homo sapiens
tttcttcattgacaaggaaaaa

SEQ ID NO: 9042308 - DNA, 22 bp, Homo sapiens
tttcttcagccactccaaactg

SEQ ID NO: 9042309 - DNA, 22 bp, Homo sapiens
tttcttcagccactccaaactg

SEQ ID NO: 9042310 - DNA, 22 bp, Homo sapiens
tttcttcagccttcacaacctg

SEQ ID NO: 9042311 - DNA, 22 bp, Homo sapiens
tttcttcagtaacacaaaccat

SEQ ID NO: 9042312 - DNA, 22 bp, Homo sapiens
tttctgtagggatttcacagtt

SEQ ID NO: 9042313 - DNA, 22 bp, Homo sapiens
tttctgtagtgtggtatgtagg

SEQ ID NO: 9042314 - DNA, 22 bp, Homo sapiens
tttctgtatttaaaagatctgg

SEQ ID NO: 9042315 - DNA, 22 bp, Homo sapiens
tttctgtatttaggacaggtgg

SEQ ID NO: 9042316 - DNA, 22 bp, Homo sapiens
tttctgtatttaggacaggtgg

SEQ ID NO: 9042317 - DNA, 22 bp, Homo sapiens
tttctgtatttaggacaggtgg

SEQ ID NO: 9042318 - DNA, 22 bp, Homo sapiens
tttctgtatttaggacaggtgg

SEQ ID NO: 9042319 - DNA, 22 bp, Homo sapiens
tttctgtattttgtcataacct

SEQ ID NO: 9042320 - DNA, 22 bp, Homo sapiens
tttctgtcatagttatctttgt

SEQ ID NO: 9042321 - DNA, 22 bp, Homo sapiens
tttctgtattttgtcataacct

SEQ ID NO: 9042322 - DNA, 22 bp, Homo sapiens
tttctgtcattactttcctccc

SEQ ID NO: 9042323 - DNA, 21 bp, Homo sapiens
tttctgtcctttccatcagct

SEQ ID NO: 9042324 - DNA, 22 bp, Homo sapiens
tttctgtcattactttcctccc

SEQ ID NO: 9042325 - DNA, 20 bp, Homo sapiens
tttctgtgatagagaggtgt

SEQ ID NO: 9042326 - DNA, 20 bp, Homo sapiens
tttctgtgatagagaggtgt

SEQ ID NO: 9042327 - DNA, 20 bp, Homo sapiens
tttctgtgcccaggtctgtt

SEQ ID NO: 9042328 - DNA, 20 bp, Homo sapiens
tttctgtgcccaggtctgtt

SEQ ID NO: 9042329 - DNA, 22 bp, Homo sapiens
tttctgtctgacatccctgcct

SEQ ID NO: 9042330 - DNA, 22 bp, Homo sapiens
tttctgtctgacatccctgcct

SEQ ID NO: 9042331 - DNA, 21 bp, Homo sapiens
tttctgtctctgccactagtt

SEQ ID NO: 9042332 - DNA, 22 bp, Homo sapiens
tttctgtctgacatccctgcct

SEQ ID NO: 9042333 - DNA, 21 bp, Homo sapiens
tttctgtctctgccactagtt

SEQ ID NO: 9042334 - DNA, 21 bp, Homo sapiens
tttctgtctctgccactagtt

SEQ ID NO: 9042335 - DNA, 23 bp, Homo sapiens
tttctgttgggtatatatccaag

SEQ ID NO: 9042336 - DNA, 23 bp, Homo sapiens
tttctgttgggtatatatccaag

SEQ ID NO: 9042337 - DNA, 23 bp, Homo sapiens
tttctgttcctctagctttgcat

SEQ ID NO: 9042338 - DNA, 23 bp, Homo sapiens
tttctgttgggtatatatccaag

SEQ ID NO: 9042339 - DNA, 23 bp, Homo sapiens
tttctgttgggtatatatccaag

SEQ ID NO: 9042340 - DNA, 22 bp, Homo sapiens
tttctgttgtacttaaactagg

SEQ ID NO: 9042341 - DNA, 21 bp, Homo sapiens
tttcttatctgtaaagtggga

SEQ ID NO: 9042342 - DNA, 19 bp, Homo sapiens
tttctgttagaaggataca

SEQ ID NO: 9042343 - DNA, 19 bp, Homo sapiens
tttctgttagaaggataca

SEQ ID NO: 9042344 - DNA, 22 bp, Homo sapiens
tttctgttaggcatcattttaa

SEQ ID NO: 9042345 - DNA, 22 bp, Homo sapiens
tttctgttaggcatcattttaa

SEQ ID NO: 9042346 - DNA, 22 bp, Homo sapiens
tttctgttaggcatcattttaa

SEQ ID NO: 9042347 - DNA, 22 bp, Homo sapiens
tttctgttaggcatcattttaa

SEQ ID NO: 9042348 - DNA, 22 bp, Homo sapiens
tttcttctcacccaggacagag

SEQ ID NO: 9042349 - DNA, 22 bp, Homo sapiens
tttcttctcatccctgaaatca

SEQ ID NO: 9042350 - DNA, 22 bp, Homo sapiens
tttcttctcatccctgaaatca

SEQ ID NO: 9042351 - DNA, 22 bp, Homo sapiens
tttcttctcacccaggacagag

SEQ ID NO: 9042352 - DNA, 22 bp, Homo sapiens
tttcttctatgtgtgatatttt

SEQ ID NO: 9042353 - DNA, 22 bp, Homo sapiens
tttcttctatgtgtgatatttt

SEQ ID NO: 9042354 - DNA, 22 bp, Homo sapiens
tttcttctatgtgtgatatttt

SEQ ID NO: 9042355 - DNA, 22 bp, Homo sapiens
tttcttctccatggcaggtcct

SEQ ID NO: 9042356 - DNA, 23 bp, Homo sapiens
tttcttctcgaagagggagctta

SEQ ID NO: 9042357 - DNA, 22 bp, Homo sapiens
tttcttctcgacaccttatccc

SEQ ID NO: 9042358 - DNA, 22 bp, Homo sapiens
tttcttctcgacaccttatccc

SEQ ID NO: 9042359 - DNA, 22 bp, Homo sapiens
tttcttctcgacaccttatccc

SEQ ID NO: 9042360 - DNA, 22 bp, Homo sapiens
tttcttctcatccctgaaatca

SEQ ID NO: 9042361 - DNA, 22 bp, Homo sapiens
tttcttctcatccctgaaatca

SEQ ID NO: 9042362 - DNA, 22 bp, Homo sapiens
tttcttctcatccctgaaatca

SEQ ID NO: 9042363 - DNA, 22 bp, Homo sapiens
tttcttctcatccctgaaatca

SEQ ID NO: 9042364 - DNA, 22 bp, Homo sapiens
tttcttctaggactaataagag

SEQ ID NO: 9042365 - DNA, 22 bp, Homo sapiens
tttcttctaggactaataagag

SEQ ID NO: 9042366 - DNA, 22 bp, Homo sapiens
tttcttctaggactaataagag

SEQ ID NO: 9042367 - DNA, 22 bp, Homo sapiens
tttcttctaggactaataagag

SEQ ID NO: 9042368 - DNA, 22 bp, Homo sapiens
tttcttctaagatttcaaacta

SEQ ID NO: 9042369 - DNA, 22 bp, Homo sapiens
tttcttctaagatttcaaacta

SEQ ID NO: 9042370 - DNA, 22 bp, Homo sapiens
tttcttctaagatttcaaacta

SEQ ID NO: 9042371 - DNA, 22 bp, Homo sapiens
tttcttctaagatttcaaacta

SEQ ID NO: 9042372 - DNA, 22 bp, Homo sapiens
tttcttccttaccttactagag

SEQ ID NO: 9042373 - DNA, 22 bp, Homo sapiens
tttcttctaagatttcaaacta

SEQ ID NO: 9042374 - DNA, 22 bp, Homo sapiens
tttcttcctggattcctacttc

SEQ ID NO: 9042375 - DNA, 22 bp, Homo sapiens
tttcttcctggattcctacttc

SEQ ID NO: 9042376 - DNA, 22 bp, Homo sapiens
tttcttcctgctttgtcccatg

SEQ ID NO: 9042377 - DNA, 22 bp, Homo sapiens
tttcttcctgctttgtcccatg

SEQ ID NO: 9042378 - DNA, 22 bp, Homo sapiens
tttcttcctgctttgtcccatg

SEQ ID NO: 9042379 - DNA, 22 bp, Homo sapiens
tttcttcctggattcctacttc

SEQ ID NO: 9042380 - DNA, 22 bp, Homo sapiens
tttcttcctggattcctacttc

SEQ ID NO: 9042381 - DNA, 22 bp, Homo sapiens
tttcttccttaccttactagag

SEQ ID NO: 9042382 - DNA, 22 bp, Homo sapiens
tttcttcctatgtatcttgctg

SEQ ID NO: 9042383 - DNA, 22 bp, Homo sapiens
tttcttcctatgtatcttgctg

SEQ ID NO: 9042384 - DNA, 22 bp, Homo sapiens
tttcttcctatgtatcttgctg

SEQ ID NO: 9042385 - DNA, 22 bp, Homo sapiens
tttcttcctgctttgtcccatg

SEQ ID NO: 9042386 - DNA, 22 bp, Homo sapiens
tttcttcctgctttgtcccatg

SEQ ID NO: 9042387 - DNA, 22 bp, Homo sapiens
tttcttcctgctttgtcccatg

SEQ ID NO: 9042388 - DNA, 22 bp, Homo sapiens
tttcttcctgctttgtcccatg

SEQ ID NO: 9042389 - DNA, 22 bp, Homo sapiens
tttcttcctaaatatgatttcc

SEQ ID NO: 9042390 - DNA, 22 bp, Homo sapiens
tttcttcctaaatatgatttcc

SEQ ID NO: 9042391 - DNA, 22 bp, Homo sapiens
tttctttaattctcacagcaat

SEQ ID NO: 9042392 - DNA, 22 bp, Homo sapiens
tttctttaattctcacagcaat

SEQ ID NO: 9042393 - DNA, 22 bp, Homo sapiens
tttctttaggctgtgttgccaa

SEQ ID NO: 9042394 - DNA, 22 bp, Homo sapiens
tttctttatcatagcatctttg

SEQ ID NO: 9042395 - DNA, 22 bp, Homo sapiens
tttctttatcatagcatctttg

SEQ ID NO: 9042396 - DNA, 22 bp, Homo sapiens
tttcttgtctttagtatctggc

SEQ ID NO: 9042397 - DNA, 22 bp, Homo sapiens
tttcttgtctttagtatctggc

SEQ ID NO: 9042398 - DNA, 22 bp, Homo sapiens
tttcttgtttcatggtgtctca

SEQ ID NO: 9042399 - DNA, 22 bp, Homo sapiens
tttcttgtttcatggtgtctca

SEQ ID NO: 9042400 - DNA, 22 bp, Homo sapiens
tttcttgtttcatggtgtctca

SEQ ID NO: 9042401 - DNA, 22 bp, Homo sapiens
tttcttgtttcatggtgtctca

SEQ ID NO: 9042402 - DNA, 22 bp, Homo sapiens
tttctttaaaggaactctgttt

SEQ ID NO: 9042403 - DNA, 22 bp, Homo sapiens
tttctttaaaggaactctgttt

SEQ ID NO: 9042404 - DNA, 22 bp, Homo sapiens
tttcttctctgattaaggctca

SEQ ID NO: 9042405 - DNA, 22 bp, Homo sapiens
tttcttctctgattaaggctca

SEQ ID NO: 9042406 - DNA, 22 bp, Homo sapiens
tttcttctctgattaaggctca

SEQ ID NO: 9042407 - DNA, 22 bp, Homo sapiens
tttcttctctgattaaggctca

SEQ ID NO: 9042408 - DNA, 22 bp, Homo sapiens
tttcttctgagatcagggagaa

SEQ ID NO: 9042409 - DNA, 22 bp, Homo sapiens
tttcttctctaatctcaatgat

SEQ ID NO: 9042410 - DNA, 22 bp, Homo sapiens
tttcttctctaatctcaatgat

SEQ ID NO: 9042411 - DNA, 22 bp, Homo sapiens
tttcttctctgattaaggctca

SEQ ID NO: 9042412 - DNA, 22 bp, Homo sapiens
tttcttctctaatctcaatgat

SEQ ID NO: 9042413 - DNA, 20 bp, Homo sapiens
tttcttgtacttggagaagg

SEQ ID NO: 9042414 - DNA, 20 bp, Homo sapiens
tttcttgtacttggagaagg

SEQ ID NO: 9042415 - DNA, 22 bp, Homo sapiens
tttcttgtacactggaatttat

SEQ ID NO: 9042416 - DNA, 22 bp, Homo sapiens
tttcttgtaagatgtttattaa

SEQ ID NO: 9042417 - DNA, 22 bp, Homo sapiens
tttcttctgagatcagggagaa

SEQ ID NO: 9042418 - DNA, 20 bp, Homo sapiens
tttcttgtcggctgttgctg

SEQ ID NO: 9042419 - DNA, 20 bp, Homo sapiens
tttcttgtcggctgttgctg

SEQ ID NO: 9042420 - DNA, 20 bp, Homo sapiens
tttcttgtcggctgttgctg

SEQ ID NO: 9042421 - DNA, 20 bp, Homo sapiens
tttcttgtcggctgttgctg

SEQ ID NO: 9042422 - DNA, 20 bp, Homo sapiens
tttcttgtcggctgttgctg

SEQ ID NO: 9042423 - DNA, 22 bp, Homo sapiens
tttctgaaatctcttttgagga

SEQ ID NO: 9042424 - DNA, 22 bp, Homo sapiens
tttctgaaacatggtctttgta

SEQ ID NO: 9042425 - DNA, 22 bp, Homo sapiens
tttctgaaacatggtctttgta

SEQ ID NO: 9042426 - DNA, 22 bp, Homo sapiens
tttctgaaaactgaagtagtgc

SEQ ID NO: 9042427 - DNA, 22 bp, Homo sapiens
tttctgaacaaagccattatca

SEQ ID NO: 9042428 - DNA, 22 bp, Homo sapiens
tttctgaacaaagccattatca

SEQ ID NO: 9042429 - DNA, 22 bp, Homo sapiens
tttctgaaatgctggctttgga

SEQ ID NO: 9042430 - DNA, 22 bp, Homo sapiens
tttctgaaatctcttttgagga

SEQ ID NO: 9042431 - DNA, 22 bp, Homo sapiens
tttctgaaatctcttttgagga

SEQ ID NO: 9042432 - DNA, 21 bp, Homo sapiens
tttctgaaggcaacatctatc

SEQ ID NO: 9042433 - DNA, 21 bp, Homo sapiens
tttctgaaggcaacatctatc

SEQ ID NO: 9042434 - DNA, 21 bp, Homo sapiens
tttctgaaggcaacatctatc

SEQ ID NO: 9042435 - DNA, 21 bp, Homo sapiens
tttctgaaggcaacatctatc

SEQ ID NO: 9042436 - DNA, 22 bp, Homo sapiens
tttctgaacttggtactggagc

SEQ ID NO: 9042437 - DNA, 22 bp, Homo sapiens
tttctgaagatacagctttgct

SEQ ID NO: 9042438 - DNA, 22 bp, Homo sapiens
tttctgaacttggtactggagc

SEQ ID NO: 9042439 - DNA, 22 bp, Homo sapiens
tttctgaacttggtactggagc

SEQ ID NO: 9042440 - DNA, 22 bp, Homo sapiens
tttctgaagatacagctttgct

SEQ ID NO: 9042441 - DNA, 22 bp, Homo sapiens
tttctgaagatacagctttgct

SEQ ID NO: 9042442 - DNA, 22 bp, Homo sapiens
tttctgaagatacagctttgct

SEQ ID NO: 9042443 - DNA, 22 bp, Homo sapiens
tttctgaaaactgaagtagtgc

SEQ ID NO: 9042444 - DNA, 22 bp, Homo sapiens
tttctgaaaactgaagtagtgc

SEQ ID NO: 9042445 - DNA, 22 bp, Homo sapiens
tttctctttggaggggctgaat

SEQ ID NO: 9042446 - DNA, 22 bp, Homo sapiens
tttctctttgacaggaatcaga

SEQ ID NO: 9042447 - DNA, 22 bp, Homo sapiens
tttctctttgacaggaatcaga

SEQ ID NO: 9042448 - DNA, 22 bp, Homo sapiens
tttctctttgacaggaatcaga

SEQ ID NO: 9042449 - DNA, 22 bp, Homo sapiens
tttctctttgacaggaatcaga

SEQ ID NO: 9042450 - DNA, 22 bp, Homo sapiens
tttctctttgacaggaatcaga

SEQ ID NO: 9042451 - DNA, 22 bp, Homo sapiens
tttctctttgacaggaatcaga

SEQ ID NO: 9042452 - DNA, 22 bp, Homo sapiens
tttctctttcaatctgcagtac

SEQ ID NO: 9042453 - DNA, 22 bp, Homo sapiens
tttctctttcaatctgcagtac

SEQ ID NO: 9042454 - DNA, 22 bp, Homo sapiens
tttctctttcaatctgcagtac

SEQ ID NO: 9042455 - DNA, 22 bp, Homo sapiens
tttctctttcaatctgcagtac

SEQ ID NO: 9042456 - DNA, 22 bp, Homo sapiens
tttctcttcactgtgtgcctca

SEQ ID NO: 9042457 - DNA, 22 bp, Homo sapiens
tttctcttcactgtgtgcctca

SEQ ID NO: 9042458 - DNA, 22 bp, Homo sapiens
tttctcttcactgtgtgcctca

SEQ ID NO: 9042459 - DNA, 22 bp, Homo sapiens
tttctcttcactgtgtgcctca

SEQ ID NO: 9042460 - DNA, 22 bp, Homo sapiens
tttctcttgcgatatgctacac

SEQ ID NO: 9042461 - DNA, 22 bp, Homo sapiens
tttctcttgcgatatgctacac

SEQ ID NO: 9042462 - DNA, 22 bp, Homo sapiens
tttctcttgcgatatgctacac

SEQ ID NO: 9042463 - DNA, 22 bp, Homo sapiens
tttctcttgcgatatgctacac

SEQ ID NO: 9042464 - DNA, 22 bp, Homo sapiens
tttctctttcaatctgcagtac

SEQ ID NO: 9042465 - DNA, 22 bp, Homo sapiens
tttctctttcaatctgcagtac

SEQ ID NO: 9042466 - DNA, 22 bp, Homo sapiens
tttctctttcaatctgcagtac

SEQ ID NO: 9042467 - DNA, 22 bp, Homo sapiens
tttctctttcaatctgcagtac

SEQ ID NO: 9042468 - DNA, 22 bp, Homo sapiens
tttctcttgcgatatgctacac

SEQ ID NO: 9042469 - DNA, 22 bp, Homo sapiens
tttctcttgcgatatgctacac

SEQ ID NO: 9042470 - DNA, 22 bp, Homo sapiens
tttctctggcctcagtttaaca

SEQ ID NO: 9042471 - DNA, 22 bp, Homo sapiens
tttctctagctattcattaaat

SEQ ID NO: 9042472 - DNA, 22 bp, Homo sapiens
tttctctgtgccatttccataa

SEQ ID NO: 9042473 - DNA, 22 bp, Homo sapiens
tttctctaaatagggaggctta

SEQ ID NO: 9042474 - DNA, 22 bp, Homo sapiens
tttctctagctattcattaaat

SEQ ID NO: 9042475 - DNA, 22 bp, Homo sapiens
tttctctagctattcattaaat

SEQ ID NO: 9042476 - DNA, 22 bp, Homo sapiens
tttctctagctattcattaaat

SEQ ID NO: 9042477 - DNA, 22 bp, Homo sapiens
tttctccttgtgtctcctttga

SEQ ID NO: 9042478 - DNA, 22 bp, Homo sapiens
tttctctaaatagggaggctta

SEQ ID NO: 9042479 - DNA, 22 bp, Homo sapiens
tttctcggcagagatgatgggc

SEQ ID NO: 9042480 - DNA, 22 bp, Homo sapiens
tttctctgttctctaactgtaa

SEQ ID NO: 9042481 - DNA, 22 bp, Homo sapiens
tttctcttaatgtctctgtgct

SEQ ID NO: 9042482 - DNA, 22 bp, Homo sapiens
tttctctgttctctaactgtaa

SEQ ID NO: 9042483 - DNA, 22 bp, Homo sapiens
tttctcttaatgtctctgtgct

SEQ ID NO: 9042484 - DNA, 22 bp, Homo sapiens
tttctcttaatgtctctgtgct

SEQ ID NO: 9042485 - DNA, 22 bp, Homo sapiens
tttctcttaatgtctctgtgct

SEQ ID NO: 9042486 - DNA, 22 bp, Homo sapiens
tttctcttaatgtctctgtgct

SEQ ID NO: 9042487 - DNA, 22 bp, Homo sapiens
tttctcttaatgtctctgtgct

SEQ ID NO: 9042488 - DNA, 22 bp, Homo sapiens
tttctcttcactgtgtgcctca

SEQ ID NO: 9042489 - DNA, 22 bp, Homo sapiens
tttctcttaatgtctctgtgct

SEQ ID NO: 9042490 - DNA, 22 bp, Homo sapiens
tttctcctgtgtaagccgccca

SEQ ID NO: 9042491 - DNA, 22 bp, Homo sapiens
tttctcctgtgaggtcagaagt

SEQ ID NO: 9042492 - DNA, 22 bp, Homo sapiens
tttctcctgtgaggtcagaagt

SEQ ID NO: 9042493 - DNA, 22 bp, Homo sapiens
tttctcctgtgaggtcagaagt

SEQ ID NO: 9042494 - DNA, 17 bp, Homo sapiens
tttctccttccatctca

SEQ ID NO: 9042495 - DNA, 17 bp, Homo sapiens
tttctccttccatctca

SEQ ID NO: 9042496 - DNA, 17 bp, Homo sapiens
tttctccttccatctca

SEQ ID NO: 9042497 - DNA, 17 bp, Homo sapiens
tttctccttccatctca

SEQ ID NO: 9042498 - DNA, 22 bp, Homo sapiens
tttctccttgtgtctcctttga

SEQ ID NO: 9042499 - DNA, 22 bp, Homo sapiens
tttctcctgcccagatgcctgg

SEQ ID NO: 9042500 - DNA, 22 bp, Homo sapiens
tttctcctgcccagatgcctgg

SEQ ID NO: 9042501 - DNA, 22 bp, Homo sapiens
tttctcctgctagaacaaggag

SEQ ID NO: 9042502 - DNA, 22 bp, Homo sapiens
tttctcctgagttccacgctac

SEQ ID NO: 9042503 - DNA, 22 bp, Homo sapiens
tttctcctctccagagtgcagt

SEQ ID NO: 9042504 - DNA, 22 bp, Homo sapiens
tttctcctctccagagtgcagt

SEQ ID NO: 9042505 - DNA, 22 bp, Homo sapiens
tttctcctgagttccacgctac

SEQ ID NO: 9042506 - DNA, 22 bp, Homo sapiens
tttctcctgagttccacgctac

SEQ ID NO: 9042507 - DNA, 22 bp, Homo sapiens
tttctcctgagttccacgctac

SEQ ID NO: 9042508 - DNA, 22 bp, Homo sapiens
tttctgaataactctatgatat

SEQ ID NO: 9042509 - DNA, 22 bp, Homo sapiens
tttctgaataactctatgatat

SEQ ID NO: 9042510 - DNA, 18 bp, Homo sapiens
tttctgaatgtctatttc

SEQ ID NO: 9042511 - DNA, 22 bp, Homo sapiens
tttctgaattcctaggatgttg

SEQ ID NO: 9042512 - DNA, 22 bp, Homo sapiens
tttctgactccagagaggaata

SEQ ID NO: 9042513 - DNA, 22 bp, Homo sapiens
tttctgacagagtgctcagagt

SEQ ID NO: 9042514 - DNA, 22 bp, Homo sapiens
tttctgaattcctaggatgttg

SEQ ID NO: 9042515 - DNA, 22 bp, Homo sapiens
tttctgaatttactcaaggtca

SEQ ID NO: 9042516 - DNA, 22 bp, Homo sapiens
tttctgaagtcttctaacagat

SEQ ID NO: 9042517 - DNA, 22 bp, Homo sapiens
tttctgaagtcttctaacagat

SEQ ID NO: 9042518 - DNA, 22 bp, Homo sapiens
tttctgaataactctatgatat

SEQ ID NO: 9042519 - DNA, 23 bp, Homo sapiens
tttctgaagttgagatggacttt

SEQ ID NO: 9042520 - DNA, 22 bp, Homo sapiens
tttctgaagggcagcagactct

SEQ ID NO: 9042521 - DNA, 22 bp, Homo sapiens
tttctgaaggttaaggaattag

SEQ ID NO: 9042522 - DNA, 22 bp, Homo sapiens
tttctgaaggttaaggaattag

SEQ ID NO: 9042523 - DNA, 22 bp, Homo sapiens
tttctgaaggttaaggaattag

SEQ ID NO: 9042524 - DNA, 22 bp, Homo sapiens
tttctgaagtcttctaacagat

SEQ ID NO: 9042525 - DNA, 22 bp, Homo sapiens
tttctgaagtcttctaacagat

SEQ ID NO: 9042526 - DNA, 22 bp, Homo sapiens
tttctgccgttccctgctctgt

SEQ ID NO: 9042527 - DNA, 22 bp, Homo sapiens
tttctgccttatctttgctgag

SEQ ID NO: 9042528 - DNA, 22 bp, Homo sapiens
tttctgccttgtagactagaat

SEQ ID NO: 9042529 - DNA, 22 bp, Homo sapiens
tttctgctaatcttttactgag

SEQ ID NO: 9042530 - DNA, 22 bp, Homo sapiens
tttctgctaatcttttactgag

SEQ ID NO: 9042531 - DNA, 22 bp, Homo sapiens
tttctgctaatcttttactgag

SEQ ID NO: 9042532 - DNA, 22 bp, Homo sapiens
tttctgctcatcctagtggagc

SEQ ID NO: 9042533 - DNA, 22 bp, Homo sapiens
tttctgctaatcttttactgag

SEQ ID NO: 9042534 - DNA, 22 bp, Homo sapiens
tttctgctcgctctcaatcagg

SEQ ID NO: 9042535 - DNA, 22 bp, Homo sapiens
tttctgcattgtcctcttggtt

SEQ ID NO: 9042536 - DNA, 22 bp, Homo sapiens
tttctgcatttacaaaatgagg

SEQ ID NO: 9042537 - DNA, 22 bp, Homo sapiens
tttctgccaaccatttaaactc

SEQ ID NO: 9042538 - DNA, 22 bp, Homo sapiens
tttctgccagtcactgctctag

SEQ ID NO: 9042539 - DNA, 22 bp, Homo sapiens
tttctgcccccgagggcggtgc

SEQ ID NO: 9042540 - DNA, 22 bp, Homo sapiens
tttctgccaggtttctggatga

SEQ ID NO: 9042541 - DNA, 22 bp, Homo sapiens
tttctgccaaccatttaaactc

SEQ ID NO: 9042542 - DNA, 22 bp, Homo sapiens
tttctgcattgtcctcttggtt

SEQ ID NO: 9042543 - DNA, 22 bp, Homo sapiens
tttctgcatcttgaaacagagc

SEQ ID NO: 9042544 - DNA, 22 bp, Homo sapiens
tttctgataattttgtgaaatc

SEQ ID NO: 9042545 - DNA, 22 bp, Homo sapiens
tttctgcatctctacagttgtt

SEQ ID NO: 9042546 - DNA, 17 bp, Homo sapiens
tttctgcatgattggac

SEQ ID NO: 9042547 - DNA, 17 bp, Homo sapiens
tttctgcatgattggac

SEQ ID NO: 9042548 - DNA, 22 bp, Homo sapiens
tttctgcatgcatttaattaaa

SEQ ID NO: 9042549 - DNA, 22 bp, Homo sapiens
tttctgaggaattaatacagaa

SEQ ID NO: 9042550 - DNA, 22 bp, Homo sapiens
tttctgaggaattaatacagaa

SEQ ID NO: 9042551 - DNA, 22 bp, Homo sapiens
tttctgagaaattaaacacttt

SEQ ID NO: 9042552 - DNA, 22 bp, Homo sapiens
tttctgactccagagaggaata

SEQ ID NO: 9042553 - DNA, 22 bp, Homo sapiens
tttctgagaaattaaacacttt

SEQ ID NO: 9042554 - DNA, 22 bp, Homo sapiens
tttctgagaaattaaacacttt

SEQ ID NO: 9042555 - DNA, 22 bp, Homo sapiens
tttctggcagcgggacaggggt

SEQ ID NO: 9042556 - DNA, 22 bp, Homo sapiens
tttctggcagcgggacaggggt

SEQ ID NO: 9042557 - DNA, 22 bp, Homo sapiens
tttctgggactggggagattct

SEQ ID NO: 9042558 - DNA, 20 bp, Homo sapiens
tttctgggtactctccctct

SEQ ID NO: 9042559 - DNA, 21 bp, Homo sapiens
tttctgggtggctgcatagtg

SEQ ID NO: 9042560 - DNA, 22 bp, Homo sapiens
tttctgtaaagaccaagccagc

SEQ ID NO: 9042561 - DNA, 22 bp, Homo sapiens
tttctgtaaagaccaagccagc

SEQ ID NO: 9042562 - DNA, 22 bp, Homo sapiens
tttctgtaaagaccaagccagc

SEQ ID NO: 9042563 - DNA, 22 bp, Homo sapiens
tttctgggtttatgtcacagct

SEQ ID NO: 9042564 - DNA, 22 bp, Homo sapiens
tttctgtaaggacttaatgcaa

SEQ ID NO: 9042565 - DNA, 20 bp, Homo sapiens
tttctgtagctcagtattca

SEQ ID NO: 9042566 - DNA, 22 bp, Homo sapiens
tttctgtacctcctcttgcccc

SEQ ID NO: 9042567 - DNA, 20 bp, Homo sapiens
tttctgtagctcagtattca

SEQ ID NO: 9042568 - DNA, 22 bp, Homo sapiens
tttctgtagggatttcacagtt

SEQ ID NO: 9042569 - DNA, 22 bp, Homo sapiens
tttctgtaagttcaggctttcc

SEQ ID NO: 9042570 - DNA, 22 bp, Homo sapiens
tttctgtaagttcaggctttcc

SEQ ID NO: 9042571 - DNA, 22 bp, Homo sapiens
tttctgtaagttcaggctttcc

SEQ ID NO: 9042572 - DNA, 22 bp, Homo sapiens
tttctgtaattaaaagggcagg

SEQ ID NO: 9042573 - DNA, 22 bp, Homo sapiens
tttctgtaattggccaagtcac

SEQ ID NO: 9042574 - DNA, 22 bp, Homo sapiens
tttctgtaagtggcaaataatg

SEQ ID NO: 9042575 - DNA, 22 bp, Homo sapiens
tttctgcttccttgagaaggag

SEQ ID NO: 9042576 - DNA, 22 bp, Homo sapiens
tttctgcttctcagaccctgaa

SEQ ID NO: 9042577 - DNA, 22 bp, Homo sapiens
tttctgcttgagagaattgctg

SEQ ID NO: 9042578 - DNA, 22 bp, Homo sapiens
tttctgctttctatccttgtca

SEQ ID NO: 9042579 - DNA, 22 bp, Homo sapiens
tttctgctttcagagtgagaca

SEQ ID NO: 9042580 - DNA, 22 bp, Homo sapiens
tttctggaaacgggttcaagct

SEQ ID NO: 9042581 - DNA, 22 bp, Homo sapiens
tttctgctgtgctttcttgcgt

SEQ ID NO: 9042582 - DNA, 22 bp, Homo sapiens
tttctgctgtgctttcttgcgt

SEQ ID NO: 9042583 - DNA, 22 bp, Homo sapiens
tttctgctgtgctttcttgcgt

SEQ ID NO: 9042584 - DNA, 22 bp, Homo sapiens
tttctgcttaggactctgtgga

SEQ ID NO: 9042585 - DNA, 22 bp, Homo sapiens
tttctgcttaggactctgtgga

SEQ ID NO: 9042586 - DNA, 22 bp, Homo sapiens
tttctgcttaggactctgtgga

SEQ ID NO: 9042587 - DNA, 22 bp, Homo sapiens
tttctgctgtgtaaaatgaggg

SEQ ID NO: 9042588 - DNA, 22 bp, Homo sapiens
tttctgctgtgctttcttgcgt

SEQ ID NO: 9042589 - DNA, 22 bp, Homo sapiens
tttctggacccttctgtgagtg

SEQ ID NO: 9042590 - DNA, 22 bp, Homo sapiens
tttctggacagcaagatcagtt

SEQ ID NO: 9042591 - DNA, 17 bp, Homo sapiens
tttctggaatgggcaaa

SEQ ID NO: 9042592 - DNA, 22 bp, Homo sapiens
tttctggacagcaagatcagtt

SEQ ID NO: 9042593 - DNA, 22 bp, Homo sapiens
tttctggacagcaagatcagtt

SEQ ID NO: 9042594 - DNA, 22 bp, Homo sapiens
tttctggaaagcaagatacatt

SEQ ID NO: 9042595 - DNA, 22 bp, Homo sapiens
tttctggaaactgtaaagagga

SEQ ID NO: 9042596 - DNA, 22 bp, Homo sapiens
tttctggaaagcaagatacatt

SEQ ID NO: 9042597 - DNA, 22 bp, Homo sapiens
tttctggaaagcaagatacatt

SEQ ID NO: 9042598 - DNA, 20 bp, Homo sapiens
cattgcatatttcattgagg

SEQ ID NO: 9042599 - DNA, 20 bp, Homo sapiens
cattgcaggcagagtaagtg

SEQ ID NO: 9042600 - DNA, 22 bp, Homo sapiens
cattgctcttgctcccaatgtt

SEQ ID NO: 9042601 - DNA, 22 bp, Homo sapiens
cattgctcaggcccagcaggaa

SEQ ID NO: 9042602 - DNA, 21 bp, Homo sapiens
aggcaataaagttttgtctac

SEQ ID NO: 9042603 - DNA, 22 bp, Homo sapiens
aggcaatcccctgaggatactt

SEQ ID NO: 9042604 - DNA, 23 bp, Homo sapiens
aggcaatacaaggcatctctgga

SEQ ID NO: 9042605 - DNA, 22 bp, Homo sapiens
aggcaataagcctcaactgtct

SEQ ID NO: 9042606 - DNA, 22 bp, Homo sapiens
aggcaatacacagcatttcaca

SEQ ID NO: 9042607 - DNA, 22 bp, Homo sapiens
catttattggcatgtagtaggt

SEQ ID NO: 9042608 - DNA, 22 bp, Homo sapiens
catttactgtaaaagattctct

SEQ ID NO: 9042609 - DNA, 22 bp, Homo sapiens
cattggcacaagtagcttcatc

SEQ ID NO: 9042610 - DNA, 22 bp, Homo sapiens
catttctcctgggtgataaatt

SEQ ID NO: 9042611 - DNA, 22 bp, Homo sapiens
catttctccgccgagatcactg

SEQ ID NO: 9042612 - DNA, 22 bp, Homo sapiens
catttctcataatattagcact

SEQ ID NO: 9042613 - DNA, 22 bp, Homo sapiens
catttctcataatattagcact

SEQ ID NO: 9042614 - DNA, 22 bp, Homo sapiens
catttcacaaatggccacatca

SEQ ID NO: 9042615 - DNA, 22 bp, Homo sapiens
catttcacacataaacttgggt

SEQ ID NO: 9042616 - DNA, 22 bp, Homo sapiens
catttcacacataaacttgggt

SEQ ID NO: 9042617 - DNA, 22 bp, Homo sapiens
catttcacagtaaagtgatttc

SEQ ID NO: 9042618 - DNA, 22 bp, Homo sapiens
catttcaatactatctgagaat

SEQ ID NO: 9042619 - DNA, 22 bp, Homo sapiens
catttcaatacagtttgtaaat

SEQ ID NO: 9042620 - DNA, 22 bp, Homo sapiens
catttcaagcattgacttctat

SEQ ID NO: 9042621 - DNA, 22 bp, Homo sapiens
catttcaaggaccaccctggga

SEQ ID NO: 9042622 - DNA, 22 bp, Homo sapiens
catttcaagtaacagattgctt

SEQ ID NO: 9042623 - DNA, 21 bp, Homo sapiens
catttcaaagagctggaaatc

SEQ ID NO: 9042624 - DNA, 23 bp, Homo sapiens
catttcaacgaattttccttctg

SEQ ID NO: 9042625 - DNA, 22 bp, Homo sapiens
catttcaagcattgacttctat

SEQ ID NO: 9042626 - DNA, 22 bp, Homo sapiens
catttattggttaggccagcag

SEQ ID NO: 9042627 - DNA, 22 bp, Homo sapiens
catttattggttaggccagcag

SEQ ID NO: 9042628 - DNA, 22 bp, Homo sapiens
aggcaggaggatcatggatgca

SEQ ID NO: 9042629 - DNA, 22 bp, Homo sapiens
aggcaggagtgaccctgacagg

SEQ ID NO: 9042630 - DNA, 22 bp, Homo sapiens
ccacagaccttggcttccacct

SEQ ID NO: 9042631 - DNA, 22 bp, Homo sapiens
catttgaaacctggaatctacc

SEQ ID NO: 9042632 - DNA, 22 bp, Homo sapiens
ccaatgatggtgcccacgatga

SEQ ID NO: 9042633 - DNA, 22 bp, Homo sapiens
ccacatacaaatggggtgctgt

SEQ ID NO: 9042634 - DNA, 22 bp, Homo sapiens
ccacatcatggatacagttatg

SEQ ID NO: 9042635 - DNA, 22 bp, Homo sapiens
ccacccagccagatgcaggaag

SEQ ID NO: 9042636 - DNA, 21 bp, Homo sapiens
ccactcatgactccactcacc

SEQ ID NO: 9042637 - DNA, 22 bp, Homo sapiens
cagtgtttaatcattgtgaatt

SEQ ID NO: 9042638 - DNA, 22 bp, Homo sapiens
cagtgtttagatcaagaaggcc

SEQ ID NO: 9042639 - DNA, 21 bp, Homo sapiens
cagtgtggtgaccagggtctc

SEQ ID NO: 9042640 - DNA, 22 bp, Homo sapiens
cagtgtgtctcttgtcctggct

SEQ ID NO: 9042641 - DNA, 22 bp, Homo sapiens
aggagccaggccccatggggct

SEQ ID NO: 9042642 - DNA, 22 bp, Homo sapiens
cagtccagccagtagggtgtgg

SEQ ID NO: 9042643 - DNA, 22 bp, Homo sapiens
cagtccagctcatcagtggcac

SEQ ID NO: 9042644 - DNA, 22 bp, Homo sapiens
cagtccaggcctggaggagcca

SEQ ID NO: 9042645 - DNA, 20 bp, Homo sapiens
cagtccaggctagaaaacaa

SEQ ID NO: 9042646 - DNA, 22 bp, Homo sapiens
aggagctgtgaatgggaggggt

SEQ ID NO: 9042647 - DNA, 22 bp, Homo sapiens
aggagctgtgaatgggaggggt

SEQ ID NO: 9042648 - DNA, 22 bp, Homo sapiens
aggagctgtcatttgattcaca

SEQ ID NO: 9042649 - DNA, 22 bp, Homo sapiens
aggagctgtcagagtgccagag

SEQ ID NO: 9042650 - DNA, 16 bp, Homo sapiens
aggagctgggtaggag

SEQ ID NO: 9042651 - DNA, 22 bp, Homo sapiens
aggagctgggttcctttggtgg

SEQ ID NO: 9042652 - DNA, 22 bp, Homo sapiens
aggagctggtagtctcattggg

SEQ ID NO: 9042653 - DNA, 22 bp, Homo sapiens
cataactggggacacttctcta

SEQ ID NO: 9042654 - DNA, 22 bp, Homo sapiens
cataagaaggtaacatccttaa

SEQ ID NO: 9042655 - DNA, 22 bp, Homo sapiens
cataagaatattccatcctttg

SEQ ID NO: 9042656 - DNA, 17 bp, Homo sapiens
aggagctgggggtggtg

SEQ ID NO: 9042657 - DNA, 22 bp, Homo sapiens
cataacattaagcctctatttc

SEQ ID NO: 9042658 - DNA, 22 bp, Homo sapiens
cataacattaagcctctatttc

SEQ ID NO: 9042659 - DNA, 22 bp, Homo sapiens
cataacatccttgctactttga

SEQ ID NO: 9042660 - DNA, 22 bp, Homo sapiens
catcttgcttgtctttagtaag

SEQ ID NO: 9042661 - DNA, 22 bp, Homo sapiens
catcttgcttcatctgctgtgt

SEQ ID NO: 9042662 - DNA, 22 bp, Homo sapiens
catcttgagacatgaaaggtgt

SEQ ID NO: 9042663 - DNA, 22 bp, Homo sapiens
catcttgactgggataagggat

SEQ ID NO: 9042664 - DNA, 22 bp, Homo sapiens
catcttgatgctttgacaggtt

SEQ ID NO: 9042665 - DNA, 22 bp, Homo sapiens
catcttgaaggtttctttagct

SEQ ID NO: 9042666 - DNA, 20 bp, Homo sapiens
catcttgaaggtcttccaca

SEQ ID NO: 9042667 - DNA, 22 bp, Homo sapiens
catcttctgggacttctcagtt

SEQ ID NO: 9042668 - DNA, 22 bp, Homo sapiens
catgagaatgaagaagacttaa

SEQ ID NO: 9042669 - DNA, 22 bp, Homo sapiens
catgagcataaatcagtcacga

SEQ ID NO: 9042670 - DNA, 22 bp, Homo sapiens
aggattttagataagacagcaa

SEQ ID NO: 9042671 - DNA, 22 bp, Homo sapiens
cataatttttttaagtcagaac

SEQ ID NO: 9042672 - DNA, 22 bp, Homo sapiens
catctcatgggcatgccaagct

SEQ ID NO: 9042673 - DNA, 22 bp, Homo sapiens
catacatatgtggatgtcatat

SEQ ID NO: 9042674 - DNA, 22 bp, Homo sapiens
catctcatcagtgagagtcagc

SEQ ID NO: 9042675 - DNA, 22 bp, Homo sapiens
catctcagtgtacagggagtct

SEQ ID NO: 9042676 - DNA, 22 bp, Homo sapiens
catcttaatttctaacaggcac

SEQ ID NO: 9042677 - DNA, 21 bp, Homo sapiens
catcttaattgaaagcagaga

SEQ ID NO: 9042678 - DNA, 22 bp, Homo sapiens
cagggattcagctgaaggaggc

SEQ ID NO: 9042679 - DNA, 22 bp, Homo sapiens
agctttcttctagttgtacagt

SEQ ID NO: 9042680 - DNA, 19 bp, Homo sapiens
agctttgccaaaaacttag

SEQ ID NO: 9042681 - DNA, 19 bp, Homo sapiens
agctttggacttgcatttc

SEQ ID NO: 9042682 - DNA, 22 bp, Homo sapiens
cagggctgttagctgctgctct

SEQ ID NO: 9042683 - DNA, 18 bp, Homo sapiens
cagggctgtggggtcact

SEQ ID NO: 9042684 - DNA, 18 bp, Homo sapiens
cagggctgtggggtcact

SEQ ID NO: 9042685 - DNA, 23 bp, Homo sapiens
aggaagaggcaatttctcttaga

SEQ ID NO: 9042686 - DNA, 22 bp, Homo sapiens
aggaaaggcctcagcagaaacc

SEQ ID NO: 9042687 - DNA, 22 bp, Homo sapiens
aggaagaaaactaattagatgg

SEQ ID NO: 9042688 - DNA, 22 bp, Homo sapiens
cagggctggctgtggcaatctc

SEQ ID NO: 9042689 - DNA, 23 bp, Homo sapiens
cagggctgggcttggtgttaggc

SEQ ID NO: 9042690 - DNA, 22 bp, Homo sapiens
caggtgggccatgaaaaatgac

SEQ ID NO: 9042691 - DNA, 22 bp, Homo sapiens
caggtgggattttgctgcttga

SEQ ID NO: 9042692 - DNA, 22 bp, Homo sapiens
aggaatagaccacttcactgag

SEQ ID NO: 9042693 - DNA, 22 bp, Homo sapiens
cagtaaatgagaagctagtaat

SEQ ID NO: 9042694 - DNA, 22 bp, Homo sapiens
cagtaaatggtacgtatatttt

SEQ ID NO: 9042695 - DNA, 22 bp, Homo sapiens
cagtaaatgtgatttttcttgt

SEQ ID NO: 9042696 - DNA, 22 bp, Homo sapiens
cagtaaaagatggaaatagaat

SEQ ID NO: 9042697 - DNA, 18 bp, Homo sapiens
cagtaactatgttgttac

SEQ ID NO: 9042698 - DNA, 22 bp, Homo sapiens
cagtaactgatgtgatcaaacg

SEQ ID NO: 9042699 - DNA, 22 bp, Homo sapiens
cagtaaggatgcacataactag

SEQ ID NO: 9042700 - DNA, 22 bp, Homo sapiens
cagtatgtccttcctcgttggc

SEQ ID NO: 9042701 - DNA, 22 bp, Homo sapiens
cagtatgactacaaacagcttt

SEQ ID NO: 9042702 - DNA, 22 bp, Homo sapiens
cagtatgagagttgaatcaagg

SEQ ID NO: 9042703 - DNA, 22 bp, Homo sapiens
agctggttcagtttctgggcct

SEQ ID NO: 9042704 - DNA, 22 bp, Homo sapiens
caggcaggtcagtgaagaagga

SEQ ID NO: 9042705 - DNA, 22 bp, Homo sapiens
caggcagggagctggaaaggat

SEQ ID NO: 9042706 - DNA, 22 bp, Homo sapiens
caggcagggagctggaaaggat

SEQ ID NO: 9042707 - DNA, 22 bp, Homo sapiens
caggcagagtgaggtggtctaa

SEQ ID NO: 9042708 - DNA, 22 bp, Homo sapiens
caggcagcgtcctgcttcctgt

SEQ ID NO: 9042709 - DNA, 22 bp, Homo sapiens
agctgtctttcattacctcatt

SEQ ID NO: 9042710 - DNA, 22 bp, Homo sapiens
agctgtctgtgaacacagcatt

SEQ ID NO: 9042711 - DNA, 23 bp, Homo sapiens
agcttcctagtgacctggagtct

SEQ ID NO: 9042712 - DNA, 22 bp, Homo sapiens
agcttcctgttgagagagggag

SEQ ID NO: 9042713 - DNA, 22 bp, Homo sapiens
agcttcctgatgcaagagggct

SEQ ID NO: 9042714 - DNA, 22 bp, Homo sapiens
agcttctagcccatccagcagg

SEQ ID NO: 9042715 - DNA, 22 bp, Homo sapiens
cagctgttactctgagtaaatg

SEQ ID NO: 9042716 - DNA, 22 bp, Homo sapiens
cagctgttcggggctggcatgt

SEQ ID NO: 9042717 - DNA, 22 bp, Homo sapiens
cagctgttcacatttccaaaac

SEQ ID NO: 9042718 - DNA, 22 bp, Homo sapiens
cagctgttcttgggacagacag

SEQ ID NO: 9042719 - DNA, 22 bp, Homo sapiens
caggagcatgctgatgccagaa

SEQ ID NO: 9042720 - DNA, 20 bp, Homo sapiens
aggctcagatacccagggaa

SEQ ID NO: 9042721 - DNA, 22 bp, Homo sapiens
ccaggaggtgctggaagaaagc

SEQ ID NO: 9042722 - DNA, 22 bp, Homo sapiens
ccagctccaggactgggagctg

SEQ ID NO: 9042723 - DNA, 22 bp, Homo sapiens
ccagctccaggtagatgggcag

SEQ ID NO: 9042724 - DNA, 22 bp, Homo sapiens
aggccctgctttccagagctca

SEQ ID NO: 9042725 - DNA, 22 bp, Homo sapiens
ccagctcccctcagcaggtaat

SEQ ID NO: 9042726 - DNA, 22 bp, Homo sapiens
ccagctcccctcagcaggtaat

SEQ ID NO: 9042727 - DNA, 23 bp, Homo sapiens
ccagctcccaggtctgaggactg

SEQ ID NO: 9042728 - DNA, 22 bp, Homo sapiens
ccagagtcaggagctcatgtga

SEQ ID NO: 9042729 - DNA, 20 bp, Homo sapiens
ccagagctgatggctgcccg

SEQ ID NO: 9042730 - DNA, 20 bp, Homo sapiens
ccagagctgatggctgcccg

SEQ ID NO: 9042731 - DNA, 22 bp, Homo sapiens
ccactcccttccggtccagggc

SEQ ID NO: 9042732 - DNA, 22 bp, Homo sapiens
ccagccctgattagagaatgtc

SEQ ID NO: 9042733 - DNA, 22 bp, Homo sapiens
ccagccctgaaccctgctgcat

SEQ ID NO: 9042734 - DNA, 22 bp, Homo sapiens
ccagccctcctccatcagagga

SEQ ID NO: 9042735 - DNA, 22 bp, Homo sapiens
ccagagtctttatattcctgaa

SEQ ID NO: 9042736 - DNA, 22 bp, Homo sapiens
ccagagtcattttgagtcataa

SEQ ID NO: 9042737 - DNA, 22 bp, Homo sapiens
ccaggccttctgaggacactct

SEQ ID NO: 9042738 - DNA, 22 bp, Homo sapiens
ccaggcctgtgttgtgtggagg

SEQ ID NO: 9042739 - DNA, 20 bp, Homo sapiens
ccaggcctgggcctgctcta

SEQ ID NO: 9042740 - DNA, 22 bp, Homo sapiens
ccaggcctgtgcaaggagggag

SEQ ID NO: 9042741 - DNA, 22 bp, Homo sapiens
aggctctggttcatcatgatgg

SEQ ID NO: 9042742 - DNA, 22 bp, Homo sapiens
aggctctggttggcaagtaaag

SEQ ID NO: 9042743 - DNA, 17 bp, Homo sapiens
ccagtagcctgagatgt

SEQ ID NO: 9042744 - DNA, 18 bp, Homo sapiens
ccaggtggtgacagagat

SEQ ID NO: 9042745 - DNA, 22 bp, Homo sapiens
ccaggtggtgcctctgttcgca

SEQ ID NO: 9042746 - DNA, 22 bp, Homo sapiens
ccaggtggtgaaagtgggccct

SEQ ID NO: 9042747 - DNA, 20 bp, Homo sapiens
ccaggtggtgcctggagagg

SEQ ID NO: 9042748 - DNA, 22 bp, Homo sapiens
ccaggtggttcaggtcaccata

SEQ ID NO: 9042749 - DNA, 16 bp, Homo sapiens
ccaggtggggctgtga

SEQ ID NO: 9042750 - DNA, 22 bp, Homo sapiens
ccaggtgggcgtgtcttcacct

SEQ ID NO: 9042751 - DNA, 22 bp, Homo sapiens
cccaccctgggctacacatcca

SEQ ID NO: 9042752 - DNA, 19 bp, Homo sapiens
aggctgcccagtctctgcc

SEQ ID NO: 9042753 - DNA, 22 bp, Homo sapiens
aggctgccctgccgccagtggg

SEQ ID NO: 9042754 - DNA, 22 bp, Homo sapiens
ccattttgtctgacttcttgct

SEQ ID NO: 9042755 - DNA, 22 bp, Homo sapiens
ccattttgtctcctgaaatcta

SEQ ID NO: 9042756 - DNA, 18 bp, Homo sapiens
cccacacagcagtagctc

SEQ ID NO: 9042757 - DNA, 20 bp, Homo sapiens
cccacacccttcccacttgg

SEQ ID NO: 9042758 - DNA, 22 bp, Homo sapiens
cccacacatttttcacttaccg

SEQ ID NO: 9042759 - DNA, 22 bp, Homo sapiens
cccacacatttttcacttaccg

SEQ ID NO: 9042760 - DNA, 22 bp, Homo sapiens
cccacacacatttatgatagga

SEQ ID NO: 9042761 - DNA, 22 bp, Homo sapiens
cccacacactggctgctgccaa

SEQ ID NO: 9042762 - DNA, 22 bp, Homo sapiens
cccacacaaatcatggggagaa

SEQ ID NO: 9042763 - DNA, 22 bp, Homo sapiens
cccaattttgggcacaacgaaa

SEQ ID NO: 9042764 - DNA, 22 bp, Homo sapiens
agggggagacatgtgtgtgttt

SEQ ID NO: 9042765 - DNA, 22 bp, Homo sapiens
agggggagcttggctactcctg

SEQ ID NO: 9042766 - DNA, 22 bp, Homo sapiens
cctctgtgtcagggaagagact

SEQ ID NO: 9042767 - DNA, 22 bp, Homo sapiens
agggggtgggaagtctagaatc

SEQ ID NO: 9042768 - DNA, 22 bp, Homo sapiens
agggggtgcccagatgaaggat

SEQ ID NO: 9042769 - DNA, 22 bp, Homo sapiens
agggggtgcatttgtgaatgaa

SEQ ID NO: 9042770 - DNA, 22 bp, Homo sapiens
agggggtgatcaaggtgcggcg

SEQ ID NO: 9042771 - DNA, 22 bp, Homo sapiens
cctccttctggggccttctgct

SEQ ID NO: 9042772 - DNA, 22 bp, Homo sapiens
aggggctctaaagatcatggaa

SEQ ID NO: 9042773 - DNA, 22 bp, Homo sapiens
ccccttcagagtagccacatta

SEQ ID NO: 9042774 - DNA, 20 bp, Homo sapiens
ccccttcatctacagcctga

SEQ ID NO: 9042775 - DNA, 19 bp, Homo sapiens
agggccacggggaggtatt

SEQ ID NO: 9042776 - DNA, 22 bp, Homo sapiens
agggagctttaccccagatcac

SEQ ID NO: 9042777 - DNA, 21 bp, Homo sapiens
agggagctttaggtagaagtt

SEQ ID NO: 9042778 - DNA, 21 bp, Homo sapiens
agggagctttaggtagaagtt

SEQ ID NO: 9042779 - DNA, 22 bp, Homo sapiens
cccaggtctgtgccagctctga

SEQ ID NO: 9042780 - DNA, 22 bp, Homo sapiens
agggcagactaggatggaagtg

SEQ ID NO: 9042781 - DNA, 22 bp, Homo sapiens
agggcagaagtacagacactta

SEQ ID NO: 9042782 - DNA, 22 bp, Homo sapiens
agggacagtctactgttcactg

SEQ ID NO: 9042783 - DNA, 22 bp, Homo sapiens
agggactatttacccatctcac

SEQ ID NO: 9042784 - DNA, 22 bp, Homo sapiens
agggactatttacccatctcac

SEQ ID NO: 9042785 - DNA, 22 bp, Homo sapiens
agggagctgagctgtgagcagc

SEQ ID NO: 9042786 - DNA, 21 bp, Homo sapiens
agggagctgcgtcttgaaaga

SEQ ID NO: 9042787 - DNA, 22 bp, Homo sapiens
agggagctgctctgcttccgtg

SEQ ID NO: 9042788 - DNA, 22 bp, Homo sapiens
agggagctgctctgcttccgtg

SEQ ID NO: 9042789 - DNA, 22 bp, Homo sapiens
agggagcttctggcctcagcct

SEQ ID NO: 9042790 - DNA, 22 bp, Homo sapiens
agggagcttctggcctcagcct

SEQ ID NO: 9042791 - DNA, 22 bp, Homo sapiens
agggagcttccgaactacagct

SEQ ID NO: 9042792 - DNA, 22 bp, Homo sapiens
cccagagtcacatggggtgttc

SEQ ID NO: 9042793 - DNA, 21 bp, Homo sapiens
agggaaaaggctgagtgaggg

SEQ ID NO: 9042794 - DNA, 22 bp, Homo sapiens
agggaaactagactgcctttct

SEQ ID NO: 9042795 - DNA, 22 bp, Homo sapiens
aggcttttctccagaatgtact

SEQ ID NO: 9042796 - DNA, 22 bp, Homo sapiens
cgcaggggaggaaggtacacct

SEQ ID NO: 9042797 - DNA, 22 bp, Homo sapiens
cgcagggatttcaaggggcctt

SEQ ID NO: 9042798 - DNA, 19 bp, Homo sapiens
cgcaggcttcgggtcgctc

SEQ ID NO: 9042799 - DNA, 22 bp, Homo sapiens
cgcaggctggcgcggagtggca

SEQ ID NO: 9042800 - DNA, 17 bp, Homo sapiens
cctgtgtttgctccttc

SEQ ID NO: 9042801 - DNA, 22 bp, Homo sapiens
ctaagaaatgttgtgaatgcca

SEQ ID NO: 9042802 - DNA, 20 bp, Homo sapiens
ctaagaggtccttccacatc

SEQ ID NO: 9042803 - DNA, 22 bp, Homo sapiens
ctaagaggaagtactctgttat

SEQ ID NO: 9042804 - DNA, 22 bp, Homo sapiens
ctaagaaggaggaaaagtgcca

SEQ ID NO: 9042805 - DNA, 22 bp, Homo sapiens
ctaaacttcttggcaattttat

SEQ ID NO: 9042806 - DNA, 22 bp, Homo sapiens
agtacacagtagactttctcat

SEQ ID NO: 9042807 - DNA, 22 bp, Homo sapiens
agtacacagagttattttgtgt

SEQ ID NO: 9042808 - DNA, 22 bp, Homo sapiens
agtacacaagacacatttaaaa

SEQ ID NO: 9042809 - DNA, 22 bp, Homo sapiens
agtccagggagcccaggctttg

SEQ ID NO: 9042810 - DNA, 22 bp, Homo sapiens
agtccagggctctctgtgggat

SEQ ID NO: 9042811 - DNA, 22 bp, Homo sapiens
agtccagggctctctgtgggat

SEQ ID NO: 9042812 - DNA, 22 bp, Homo sapiens
agtccagggctctctgtgggat

SEQ ID NO: 9042813 - DNA, 22 bp, Homo sapiens
agtccagggcttagtcagcggg

SEQ ID NO: 9042814 - DNA, 22 bp, Homo sapiens
agtccaggtctctgagtcacaa

SEQ ID NO: 9042815 - DNA, 22 bp, Homo sapiens
agtccagggcttagtcagcggg

SEQ ID NO: 9042816 - DNA, 22 bp, Homo sapiens
agtccagggcttagtcagcggg

SEQ ID NO: 9042817 - DNA, 22 bp, Homo sapiens
agtccaggtggaccttggccag

SEQ ID NO: 9042818 - DNA, 22 bp, Homo sapiens
agtccaggctcttcctgaagaa

SEQ ID NO: 9042819 - DNA, 19 bp, Homo sapiens
agtccatgaatggaggatg

SEQ ID NO: 9042820 - DNA, 22 bp, Homo sapiens
ctagtccactgtcctgcctcca

SEQ ID NO: 9042821 - DNA, 22 bp, Homo sapiens
ctagtccagtctcaaaatgcta

SEQ ID NO: 9042822 - DNA, 21 bp, Homo sapiens
ctacagaatcgagcattctgg

SEQ ID NO: 9042823 - DNA, 22 bp, Homo sapiens
agtatttcctggcttatctgct

SEQ ID NO: 9042824 - DNA, 22 bp, Homo sapiens
agtatttcagttactttaaaat

SEQ ID NO: 9042825 - DNA, 22 bp, Homo sapiens
agtatgtcagagtgaaaatggt

SEQ ID NO: 9042826 - DNA, 22 bp, Homo sapiens
ctaaggaattggagcatgtgtt

SEQ ID NO: 9042827 - DNA, 22 bp, Homo sapiens
ctaaggaatcctaaaacagctg

SEQ ID NO: 9042828 - DNA, 22 bp, Homo sapiens
ctaaggaattcaaatagttagt

SEQ ID NO: 9042829 - DNA, 22 bp, Homo sapiens
ctaaggaagtgacagtgggatt

SEQ ID NO: 9042830 - DNA, 22 bp, Homo sapiens
ctaaggaacatcacaggccgtc

SEQ ID NO: 9042831 - DNA, 22 bp, Homo sapiens
ctaaggaacagatgtcagcaga

SEQ ID NO: 9042832 - DNA, 22 bp, Homo sapiens
ctaaggaacaccaggagatggt

SEQ ID NO: 9042833 - DNA, 22 bp, Homo sapiens
ctaaggaaaaggatatatatgt

SEQ ID NO: 9042834 - DNA, 22 bp, Homo sapiens
ctaaggaaaggaaatacagtaa

SEQ ID NO: 9042835 - DNA, 22 bp, Homo sapiens
ctaaggaaatatgtcacttgct

SEQ ID NO: 9042836 - DNA, 22 bp, Homo sapiens
ctaccatccttaggctgaagtg

SEQ ID NO: 9042837 - DNA, 22 bp, Homo sapiens
ctacattttgtgattatgaaat

SEQ ID NO: 9042838 - DNA, 22 bp, Homo sapiens
aggtccagttttctgacaaggg

SEQ ID NO: 9042839 - DNA, 22 bp, Homo sapiens
cctggcacacggtggcattcaa

SEQ ID NO: 9042840 - DNA, 22 bp, Homo sapiens
aggtccctgagtcagcggcgct

SEQ ID NO: 9042841 - DNA, 22 bp, Homo sapiens
aggtaggatgggtggagatgat

SEQ ID NO: 9042842 - DNA, 22 bp, Homo sapiens
cctgcagaggtcaggccagaaa

SEQ ID NO: 9042843 - DNA, 22 bp, Homo sapiens
cctgcagagggactggcaggaa

SEQ ID NO: 9042844 - DNA, 22 bp, Homo sapiens
cctgcagagcaggagaggcatc

SEQ ID NO: 9042845 - DNA, 22 bp, Homo sapiens
cctgcagagccacgtgccagcg

SEQ ID NO: 9042846 - DNA, 20 bp, Homo sapiens
cctgggctccaggagccccg

SEQ ID NO: 9042847 - DNA, 22 bp, Homo sapiens
cctgggctttcggcggcttcct

SEQ ID NO: 9042848 - DNA, 22 bp, Homo sapiens
cctgggctttcaaaaccagcct

SEQ ID NO: 9042849 - DNA, 22 bp, Homo sapiens
cctgggctcacagccaaggctc

SEQ ID NO: 9042850 - DNA, 22 bp, Homo sapiens
cctgtccagggactgagggaga

SEQ ID NO: 9042851 - DNA, 22 bp, Homo sapiens
cctgtcctccggagcgggctgt

SEQ ID NO: 9042852 - DNA, 22 bp, Homo sapiens
aggtggggccaaatgctacagt

SEQ ID NO: 9042853 - DNA, 22 bp, Homo sapiens
aggtggggagtatatgtaattg

SEQ ID NO: 9042854 - DNA, 22 bp, Homo sapiens
aggtggggcccaccaatttgca

SEQ ID NO: 9042855 - DNA, 21 bp, Homo sapiens
aggtggggctgcacctctgct

SEQ ID NO: 9042856 - DNA, 21 bp, Homo sapiens
aggtggggctgcacctctgct

SEQ ID NO: 9042857 - DNA, 22 bp, Homo sapiens
aggtggggaggagtgtctcttt

SEQ ID NO: 9042858 - DNA, 22 bp, Homo sapiens
ctgagaaaagtatgagctctgg

SEQ ID NO: 9042859 - DNA, 22 bp, Homo sapiens
ctgagaaaatttcaggaagtgt

SEQ ID NO: 9042860 - DNA, 22 bp, Homo sapiens
ctgagaaaagctttcttataca

SEQ ID NO: 9042861 - DNA, 20 bp, Homo sapiens
ctgacagaaaatatttcatc

SEQ ID NO: 9042862 - DNA, 22 bp, Homo sapiens
ctgacaaacttaattttctgaa

SEQ ID NO: 9042863 - DNA, 21 bp, Homo sapiens
ctgaatgccccaaatgacctt

SEQ ID NO: 9042864 - DNA, 22 bp, Homo sapiens
ctgaagctttacttcaaataca

SEQ ID NO: 9042865 - DNA, 22 bp, Homo sapiens
ctgagaaacatatttccatcta

SEQ ID NO: 9042866 - DNA, 22 bp, Homo sapiens
ctgagaaaccaggtgctctgat

SEQ ID NO: 9042867 - DNA, 22 bp, Homo sapiens
agttactttctgatcagtgtgt

SEQ ID NO: 9042868 - DNA, 22 bp, Homo sapiens
agttaagagtgtgaaaatgtta

SEQ ID NO: 9042869 - DNA, 22 bp, Homo sapiens
agttagagacacatgcacatgc

SEQ ID NO: 9042870 - DNA, 22 bp, Homo sapiens
agttagagcgcatattttatta

SEQ ID NO: 9042871 - DNA, 22 bp, Homo sapiens
agttatataactatctagatgc

SEQ ID NO: 9042872 - DNA, 22 bp, Homo sapiens
ctgaggagaacaatgagatcaa

SEQ ID NO: 9042873 - DNA, 17 bp, Homo sapiens
ctgaggagaacagaaag

SEQ ID NO: 9042874 - DNA, 22 bp, Homo sapiens
ctgaggagagatcacgtggtgt

SEQ ID NO: 9042875 - DNA, 22 bp, Homo sapiens
ctgaggagacagaagccaaata

SEQ ID NO: 9042876 - DNA, 22 bp, Homo sapiens
ctgaggagaccatcaactaatt

SEQ ID NO: 9042877 - DNA, 22 bp, Homo sapiens
ctgaggagaggtggcctgtgtt

SEQ ID NO: 9042878 - DNA, 22 bp, Homo sapiens
ctctgcgccaccctcgcctgct

SEQ ID NO: 9042879 - DNA, 22 bp, Homo sapiens
ctctgcattttaacagatgatt

SEQ ID NO: 9042880 - DNA, 22 bp, Homo sapiens
ctctgcatcagcttcattctgt

SEQ ID NO: 9042881 - DNA, 22 bp, Homo sapiens
ctctgcatcaggcattatggat

SEQ ID NO: 9042882 - DNA, 22 bp, Homo sapiens
ctctgcatgccacatgagtgac

SEQ ID NO: 9042883 - DNA, 22 bp, Homo sapiens
ctctcatgcaaaatttagttct

SEQ ID NO: 9042884 - DNA, 22 bp, Homo sapiens
ctctcagtgcctgccctaggct

SEQ ID NO: 9042885 - DNA, 22 bp, Homo sapiens
ctctcagtgccacacagccatt

SEQ ID NO: 9042886 - DNA, 22 bp, Homo sapiens
ctctcagtcctgcgcgcctctg

SEQ ID NO: 9042887 - DNA, 22 bp, Homo sapiens
ctctcagtaaatttctgcccca

SEQ ID NO: 9042888 - DNA, 21 bp, Homo sapiens
ctctgcagtgcccaccttgcc

SEQ ID NO: 9042889 - DNA, 17 bp, Homo sapiens
ctctgcagtgcatggct

SEQ ID NO: 9042890 - DNA, 17 bp, Homo sapiens
ctctgcagtgcatggct

SEQ ID NO: 9042891 - DNA, 22 bp, Homo sapiens
ctctgcaggccttgagtgtggt

SEQ ID NO: 9042892 - DNA, 23 bp, Homo sapiens
ctctgcaggagagtgggcagggc

SEQ ID NO: 9042893 - DNA, 22 bp, Homo sapiens
ctctgcaggcacccagggtggg

SEQ ID NO: 9042894 - DNA, 22 bp, Homo sapiens
ctctgcaggcctgtgaagggtg

SEQ ID NO: 9042895 - DNA, 22 bp, Homo sapiens
ctctggctttgctcatgcatcc

SEQ ID NO: 9042896 - DNA, 22 bp, Homo sapiens
ctccagggaaaggggcgtccgc

SEQ ID NO: 9042897 - DNA, 22 bp, Homo sapiens
agtcttctcatttcacatgctt

SEQ ID NO: 9042898 - DNA, 22 bp, Homo sapiens
agtcttctcatttcacatgctt

SEQ ID NO: 9042899 - DNA, 22 bp, Homo sapiens
agtcctggccccaaggaaggat

SEQ ID NO: 9042900 - DNA, 19 bp, Homo sapiens
agtcctggcctgggggacc

SEQ ID NO: 9042901 - DNA, 22 bp, Homo sapiens
ctcatggagggagtgctcttcc

SEQ ID NO: 9042902 - DNA, 22 bp, Homo sapiens
ctcatgtcaggggtgtcaatgt

SEQ ID NO: 9042903 - DNA, 22 bp, Homo sapiens
ctcatgtcttcacccattctaa

SEQ ID NO: 9042904 - DNA, 22 bp, Homo sapiens
ctcattagacaggtatacttta

SEQ ID NO: 9042905 - DNA, 18 bp, Homo sapiens
agtcctggagatcaccaa

SEQ ID NO: 9042906 - DNA, 22 bp, Homo sapiens
agtcctggacttggagtcaggg

SEQ ID NO: 9042907 - DNA, 22 bp, Homo sapiens
ctcctggctcgcccccagctga

SEQ ID NO: 9042908 - DNA, 22 bp, Homo sapiens
ctcctggctcgcccccagctga

SEQ ID NO: 9042909 - DNA, 20 bp, Homo sapiens
ctccagggaacagactggag

SEQ ID NO: 9042910 - DNA, 20 bp, Homo sapiens
ctccagggaacagactggag

SEQ ID NO: 9042911 - DNA, 22 bp, Homo sapiens
ctccagggaaaggggcgtccgc

SEQ ID NO: 9042912 - DNA, 18 bp, Homo sapiens
ctccagggaactcagtca

SEQ ID NO: 9042913 - DNA, 22 bp, Homo sapiens
ctctcagatggagtgtgaatgg

SEQ ID NO: 9042914 - DNA, 22 bp, Homo sapiens
ctctcagacacccatttggaaa

SEQ ID NO: 9042915 - DNA, 22 bp, Homo sapiens
atactacaatcataattgtaca

SEQ ID NO: 9042916 - DNA, 22 bp, Homo sapiens
atactacaatcataattgtaca

SEQ ID NO: 9042917 - DNA, 22 bp, Homo sapiens
atactacatactatgtaaacat

SEQ ID NO: 9042918 - DNA, 22 bp, Homo sapiens
ctggctggccggagcgaggcgg

SEQ ID NO: 9042919 - DNA, 22 bp, Homo sapiens
atacagtaaccacattctatag

SEQ ID NO: 9042920 - DNA, 22 bp, Homo sapiens
ctggagaattctatgaaatatt

SEQ ID NO: 9042921 - DNA, 22 bp, Homo sapiens
ctggagaagtactgagacattt

SEQ ID NO: 9042922 - DNA, 22 bp, Homo sapiens
ctggagaagccaaactagtcac

SEQ ID NO: 9042923 - DNA, 20 bp, Homo sapiens
atacagtaggtgctcaatat

SEQ ID NO: 9042924 - DNA, 22 bp, Homo sapiens
atacagtataactaataaaccc

SEQ ID NO: 9042925 - DNA, 22 bp, Homo sapiens
atacagtgtactatttagcagt

SEQ ID NO: 9042926 - DNA, 22 bp, Homo sapiens
atacagtgaatacttacagtgt

SEQ ID NO: 9042927 - DNA, 22 bp, Homo sapiens
atacagtgccccttttcacatg

SEQ ID NO: 9042928 - DNA, 22 bp, Homo sapiens
atacatacgtacatacgtatgt

SEQ ID NO: 9042929 - DNA, 23 bp, Homo sapiens
atacatacagtcttactgacttt

SEQ ID NO: 9042930 - DNA, 22 bp, Homo sapiens
ataccaccatctatgaaaggta

SEQ ID NO: 9042931 - DNA, 21 bp, Homo sapiens
ataccatttgccaaaaggatc

SEQ ID NO: 9042932 - DNA, 22 bp, Homo sapiens
atacctgtgtatccacaagcgt

SEQ ID NO: 9042933 - DNA, 22 bp, Homo sapiens
atacctgcagtattttattgtt

SEQ ID NO: 9042934 - DNA, 21 bp, Homo sapiens
atacattctattaagcattta

SEQ ID NO: 9042935 - DNA, 22 bp, Homo sapiens
ataccaaagcacatactgtttg

SEQ ID NO: 9042936 - DNA, 22 bp, Homo sapiens
atacattcatcacttttggtcc

SEQ ID NO: 9042937 - DNA, 22 bp, Homo sapiens
atacatgtgtgtgcatacatgt

SEQ ID NO: 9042938 - DNA, 22 bp, Homo sapiens
atacattcaaaggaaggataga

SEQ ID NO: 9042939 - DNA, 22 bp, Homo sapiens
ctgaggagcaaccccgtgccct

SEQ ID NO: 9042940 - DNA, 22 bp, Homo sapiens
ctgaggagcagctggcccgcta

SEQ ID NO: 9042941 - DNA, 22 bp, Homo sapiens
ctgaggagatccccccagaagt

SEQ ID NO: 9042942 - DNA, 22 bp, Homo sapiens
ctgaggagatgataatgtcatt

SEQ ID NO: 9042943 - DNA, 22 bp, Homo sapiens
ctgaggagatgggctttttagg

SEQ ID NO: 9042944 - DNA, 22 bp, Homo sapiens
ctgaggagccccctctcagcat

SEQ ID NO: 9042945 - DNA, 22 bp, Homo sapiens
ctgaggagcgttggtcacgtgt

SEQ ID NO: 9042946 - DNA, 22 bp, Homo sapiens
ctgaggagctgaaggccctcca

SEQ ID NO: 9042947 - DNA, 22 bp, Homo sapiens
ctgcaaataggggtgtgaataa

SEQ ID NO: 9042948 - DNA, 22 bp, Homo sapiens
ctgcaagatgttgtcatatgct

SEQ ID NO: 9042949 - DNA, 22 bp, Homo sapiens
ctgcaagattggaagatgcaat

SEQ ID NO: 9042950 - DNA, 22 bp, Homo sapiens
ctgcagagaattgtggggcttc

SEQ ID NO: 9042951 - DNA, 22 bp, Homo sapiens
ctgcagagatgaagaaggtggc

SEQ ID NO: 9042952 - DNA, 22 bp, Homo sapiens
ctgcagagagtgccgggcagcc

SEQ ID NO: 9042953 - DNA, 22 bp, Homo sapiens
ctgcagagagtaactgaaatat

SEQ ID NO: 9042954 - DNA, 22 bp, Homo sapiens
ctgcagagacctaggtcaggtt

SEQ ID NO: 9042955 - DNA, 22 bp, Homo sapiens
ctgcagagatgaagaaggtggc

SEQ ID NO: 9042956 - DNA, 22 bp, Homo sapiens
ctgcaggggtgtcctgtattgg

SEQ ID NO: 9042957 - DNA, 22 bp, Homo sapiens
ctgcagggtgacgttgcccacc

SEQ ID NO: 9042958 - DNA, 20 bp, Homo sapiens
ctgcagggtgagtgggcgat

SEQ ID NO: 9042959 - DNA, 20 bp, Homo sapiens
ctgcagggttagaggctcca

SEQ ID NO: 9042960 - DNA, 22 bp, Homo sapiens
ctgcagggtttcgccagttgtg

SEQ ID NO: 9042961 - DNA, 22 bp, Homo sapiens
ctgcagggttcggagagttccc

SEQ ID NO: 9042962 - DNA, 22 bp, Homo sapiens
ctgcagggttttaacaatggac

SEQ ID NO: 9042963 - DNA, 22 bp, Homo sapiens
ctgcatcctaacctccatgcag

SEQ ID NO: 9042964 - DNA, 22 bp, Homo sapiens
ctgcatcctggaaatagctaag

SEQ ID NO: 9042965 - DNA, 22 bp, Homo sapiens
ctgcatctgttagattatcacc

SEQ ID NO: 9042966 - DNA, 21 bp, Homo sapiens
ctgcatctcatagaacatgtc

SEQ ID NO: 9042967 - DNA, 21 bp, Homo sapiens
ctgcatctgagtcattatgcc

SEQ ID NO: 9042968 - DNA, 22 bp, Homo sapiens
ctgcatctgcataatcaacttc

SEQ ID NO: 9042969 - DNA, 20 bp, Homo sapiens
ctgcatctgtgacttgcaaa

SEQ ID NO: 9042970 - DNA, 22 bp, Homo sapiens
ctgcatgtgtttctgctgggtt

SEQ ID NO: 9042971 - DNA, 22 bp, Homo sapiens
ctgcatgtcactctgctgtccc

SEQ ID NO: 9042972 - DNA, 22 bp, Homo sapiens
ataaatgtgaattagagctttg

SEQ ID NO: 9042973 - DNA, 22 bp, Homo sapiens
ataactgagagcaatctttctt

SEQ ID NO: 9042974 - DNA, 22 bp, Homo sapiens
ataactctgtttttttcatgca

SEQ ID NO: 9042975 - DNA, 22 bp, Homo sapiens
ataacattttgacaactggtga

SEQ ID NO: 9042976 - DNA, 22 bp, Homo sapiens
ataacagatgcttcagcataaa

SEQ ID NO: 9042977 - DNA, 22 bp, Homo sapiens
ataacatgacctgtgcttcaca

SEQ ID NO: 9042978 - DNA, 22 bp, Homo sapiens
ctgctgcaatctggcttccatg

SEQ ID NO: 9042979 - DNA, 22 bp, Homo sapiens
atacaaagtattgatcctgagt

SEQ ID NO: 9042980 - DNA, 22 bp, Homo sapiens
atacaacagaaaatgattattc

SEQ ID NO: 9042981 - DNA, 22 bp, Homo sapiens
atacaaagtattaatcctggat

SEQ ID NO: 9042982 - DNA, 22 bp, Homo sapiens
atacaaaggaacacaggcatgt

SEQ ID NO: 9042983 - DNA, 22 bp, Homo sapiens
atacaaaggaacacaggcatgt

SEQ ID NO: 9042984 - DNA, 22 bp, Homo sapiens
atacaaagtattgatcctgagt

SEQ ID NO: 9042985 - DNA, 22 bp, Homo sapiens
ataagaaacattattctttcca

SEQ ID NO: 9042986 - DNA, 23 bp, Homo sapiens
ataagaaaacagtaggctcagag

SEQ ID NO: 9042987 - DNA, 22 bp, Homo sapiens
ataagagtcttgttttcttatt

SEQ ID NO: 9042988 - DNA, 22 bp, Homo sapiens
atacaaagctaaatatggtttc

SEQ ID NO: 9042989 - DNA, 22 bp, Homo sapiens
atacaaagctaaatatggtttc

SEQ ID NO: 9042990 - DNA, 22 bp, Homo sapiens
atacaaagctttctgtctggta

SEQ ID NO: 9042991 - DNA, 17 bp, Homo sapiens
atacaaagccataaacc

SEQ ID NO: 9042992 - DNA, 22 bp, Homo sapiens
atatttaactggtcccaatata

SEQ ID NO: 9042993 - DNA, 22 bp, Homo sapiens
atatttaaacagggtaccaata

SEQ ID NO: 9042994 - DNA, 22 bp, Homo sapiens
atatttaactggtcccaatata

SEQ ID NO: 9042995 - DNA, 22 bp, Homo sapiens
atcaaagaatgtgactgaaata

SEQ ID NO: 9042996 - DNA, 23 bp, Homo sapiens
atcaaactggtgagaatgtcagt

SEQ ID NO: 9042997 - DNA, 23 bp, Homo sapiens
atcaaaggatgtagagaagaagc

SEQ ID NO: 9042998 - DNA, 22 bp, Homo sapiens
atcaaaggtatctatgctgtct

SEQ ID NO: 9042999 - DNA, 22 bp, Homo sapiens
atcaaagtgatttgtaaacagg

SEQ ID NO: 9043000 - DNA, 22 bp, Homo sapiens
atattgtactagggttacatgt

SEQ ID NO: 9043001 - DNA, 22 bp, Homo sapiens
atatttaaacagggtaccaata

SEQ ID NO: 9043002 - DNA, 22 bp, Homo sapiens
atatttaaacagggtaccaata

SEQ ID NO: 9043003 - DNA, 22 bp, Homo sapiens
atattgcattggctggtcttga

SEQ ID NO: 9043004 - DNA, 22 bp, Homo sapiens
atattgcatggctttgctggtt

SEQ ID NO: 9043005 - DNA, 22 bp, Homo sapiens
atattgatggaggtgttagaca

SEQ ID NO: 9043006 - DNA, 20 bp, Homo sapiens
atattgcaaggaagctggat

SEQ ID NO: 9043007 - DNA, 22 bp, Homo sapiens
atattgcaatagatgcatcatt

SEQ ID NO: 9043008 - DNA, 22 bp, Homo sapiens
atattgcagtgtgtttatgtga

SEQ ID NO: 9043009 - DNA, 22 bp, Homo sapiens
atattgcagggacagtctggat

SEQ ID NO: 9043010 - DNA, 22 bp, Homo sapiens
atattcttgaagggagattata

SEQ ID NO: 9043011 - DNA, 22 bp, Homo sapiens
atattcttgtgattataaagta

SEQ ID NO: 9043012 - DNA, 22 bp, Homo sapiens
atattcttgtgattataaagta

SEQ ID NO: 9043013 - DNA, 22 bp, Homo sapiens
atcaaatcattgcattaatgtt

SEQ ID NO: 9043014 - DNA, 22 bp, Homo sapiens
atcagaaaaacataatgttatt

SEQ ID NO: 9043015 - DNA, 22 bp, Homo sapiens
atcagaaagttcatcatgtttg

SEQ ID NO: 9043016 - DNA, 22 bp, Homo sapiens
atcagaaatagtcatgttactt

SEQ ID NO: 9043017 - DNA, 22 bp, Homo sapiens
atcagaaaaacataatgttatt

SEQ ID NO: 9043018 - DNA, 21 bp, Homo sapiens
atcagaaaatgtaatggagca

SEQ ID NO: 9043019 - DNA, 22 bp, Homo sapiens
atcagaaattgcccagctgttt

SEQ ID NO: 9043020 - DNA, 22 bp, Homo sapiens
atcagaagcttgtagtctctct

SEQ ID NO: 9043021 - DNA, 22 bp, Homo sapiens
atatgccagctccaagtaagag

SEQ ID NO: 9043022 - DNA, 22 bp, Homo sapiens
atatgcattaacattgtaggag

SEQ ID NO: 9043023 - DNA, 22 bp, Homo sapiens
atattatagacagagtcttctg

SEQ ID NO: 9043024 - DNA, 22 bp, Homo sapiens
ctgggctctgcggtgtcgctct

SEQ ID NO: 9043025 - DNA, 22 bp, Homo sapiens
atattcttgaaagatcctggta

SEQ ID NO: 9043026 - DNA, 22 bp, Homo sapiens
atattcttcttgttcagactat

SEQ ID NO: 9043027 - DNA, 22 bp, Homo sapiens
atattcttcttgttcagactat

SEQ ID NO: 9043028 - DNA, 19 bp, Homo sapiens
ctgggctgaggtctgcctt

SEQ ID NO: 9043029 - DNA, 19 bp, Homo sapiens
ctgggctgaggtctgcctt

SEQ ID NO: 9043030 - DNA, 20 bp, Homo sapiens
ctgggctcaagtgatcctcc

SEQ ID NO: 9043031 - DNA, 20 bp, Homo sapiens
ctgggctcaagtgatcctcc

SEQ ID NO: 9043032 - DNA, 22 bp, Homo sapiens
ctgggctcacctgtggctggca

SEQ ID NO: 9043033 - DNA, 22 bp, Homo sapiens
atatgcacatacatacataggt

SEQ ID NO: 9043034 - DNA, 22 bp, Homo sapiens
atctgacaagttgtgtgtatag

SEQ ID NO: 9043035 - DNA, 22 bp, Homo sapiens
atctgcatcagactttgcatga

SEQ ID NO: 9043036 - DNA, 22 bp, Homo sapiens
cttcctctagcctagtaatgcc

SEQ ID NO: 9043037 - DNA, 22 bp, Homo sapiens
atctgaaaaatctcctttgtca

SEQ ID NO: 9043038 - DNA, 22 bp, Homo sapiens
atctgaaactctgacattgtct

SEQ ID NO: 9043039 - DNA, 22 bp, Homo sapiens
atctgaaaagcctcttactcct

SEQ ID NO: 9043040 - DNA, 23 bp, Homo sapiens
atctgaaaaggcattttcttccc

SEQ ID NO: 9043041 - DNA, 22 bp, Homo sapiens
atctgaaatagtcttatctgag

SEQ ID NO: 9043042 - DNA, 22 bp, Homo sapiens
cttcccactagtatcacagagc

SEQ ID NO: 9043043 - DNA, 22 bp, Homo sapiens
cttcctcacggtgcaacaggaa

SEQ ID NO: 9043044 - DNA, 22 bp, Homo sapiens
cttcctcaggcattagctggac

SEQ ID NO: 9043045 - DNA, 17 bp, Homo sapiens
cttcccaccatctcctg

SEQ ID NO: 9043046 - DNA, 22 bp, Homo sapiens
cttagagatgggttttacttag

SEQ ID NO: 9043047 - DNA, 22 bp, Homo sapiens
cttagaaattgttactcattca

SEQ ID NO: 9043048 - DNA, 22 bp, Homo sapiens
atccttaagaaagttttctata

SEQ ID NO: 9043049 - DNA, 22 bp, Homo sapiens
atccttaaaggaattctgattt

SEQ ID NO: 9043050 - DNA, 20 bp, Homo sapiens
atccttaaagagaatttcta

SEQ ID NO: 9043051 - DNA, 22 bp, Homo sapiens
atcagagattgtagtatgtgca

SEQ ID NO: 9043052 - DNA, 20 bp, Homo sapiens
atcagacttttaggaacata

SEQ ID NO: 9043053 - DNA, 22 bp, Homo sapiens
atcctgtctatgagtagataat

SEQ ID NO: 9043054 - DNA, 22 bp, Homo sapiens
atcctgtctttgttttaaatat

SEQ ID NO: 9043055 - DNA, 22 bp, Homo sapiens
atccagtagtgacttttacatt

SEQ ID NO: 9043056 - DNA, 22 bp, Homo sapiens
ggccactgtcctctagcccaga

SEQ ID NO: 9043057 - DNA, 22 bp, Homo sapiens
ggccactgcctccgccatggct

SEQ ID NO: 9043058 - DNA, 22 bp, Homo sapiens
ggccactgacctacatctgggg

SEQ ID NO: 9043059 - DNA, 23 bp, Homo sapiens
ggccactgaattttctgcatctt

SEQ ID NO: 9043060 - DNA, 22 bp, Homo sapiens
ggccctgtccccttcagttttg

SEQ ID NO: 9043061 - DNA, 22 bp, Homo sapiens
ggcccttggagcctccacagtg

SEQ ID NO: 9043062 - DNA, 22 bp, Homo sapiens
ggcagggcaggaaagtcaggaa

SEQ ID NO: 9043063 - DNA, 22 bp, Homo sapiens
ggcaggtgcccagagagcacga

SEQ ID NO: 9043064 - DNA, 22 bp, Homo sapiens
ggccaccttcctgtggtctctg

SEQ ID NO: 9043065 - DNA, 22 bp, Homo sapiens
ggcattatctgagcacgtaata

SEQ ID NO: 9043066 - DNA, 22 bp, Homo sapiens
ggcattctaggccaaaatcagg

SEQ ID NO: 9043067 - DNA, 22 bp, Homo sapiens
ggaggtgacgaaaagaaattgt

SEQ ID NO: 9043068 - DNA, 22 bp, Homo sapiens
cacagtgttccagagcagtggt

SEQ ID NO: 9043069 - DNA, 22 bp, Homo sapiens
cacagtgtgggcatggtgcctg

SEQ ID NO: 9043070 - DNA, 22 bp, Homo sapiens
cacatacaatggtgttatttgg

SEQ ID NO: 9043071 - DNA, 22 bp, Homo sapiens
cacatacaaggcacactggagg

SEQ ID NO: 9043072 - DNA, 22 bp, Homo sapiens
cacataagaaatgaatatgaga

SEQ ID NO: 9043073 - DNA, 22 bp, Homo sapiens
cacataagaaatgaatatgaga

SEQ ID NO: 9043074 - DNA, 22 bp, Homo sapiens
cacatacttgtgtgtacatatg

SEQ ID NO: 9043075 - DNA, 22 bp, Homo sapiens
cacatactgagaatcacaccca

SEQ ID NO: 9043076 - DNA, 22 bp, Homo sapiens
cacatacattcatgttactcta

SEQ ID NO: 9043077 - DNA, 22 bp, Homo sapiens
cacatacattcatgttactcta

SEQ ID NO: 9043078 - DNA, 22 bp, Homo sapiens
cacatacatacgtatgtataca

SEQ ID NO: 9043079 - DNA, 22 bp, Homo sapiens
cacatacatacgtatgtataca

SEQ ID NO: 9043080 - DNA, 22 bp, Homo sapiens
ggcaggcatggggtctgccatt

SEQ ID NO: 9043081 - DNA, 22 bp, Homo sapiens
ggcaggcatcatgtggtcatta

SEQ ID NO: 9043082 - DNA, 22 bp, Homo sapiens
ggcaggcatggccactccctag

SEQ ID NO: 9043083 - DNA, 22 bp, Homo sapiens
ggcaggcagtgtggtgtgaaac

SEQ ID NO: 9043084 - DNA, 22 bp, Homo sapiens
ggcaggcatcatcagttgatca

SEQ ID NO: 9043085 - DNA, 20 bp, Homo sapiens
ggcaggcaggaggtttccag

SEQ ID NO: 9043086 - DNA, 22 bp, Homo sapiens
ggcaggcaggtcttcatggccc

SEQ ID NO: 9043087 - DNA, 22 bp, Homo sapiens
ggcaggcaggagctctgtctcc

SEQ ID NO: 9043088 - DNA, 22 bp, Homo sapiens
ggcaggcaggagcgtgcttggg

SEQ ID NO: 9043089 - DNA, 22 bp, Homo sapiens
cacatttagaggttagcatggt

SEQ ID NO: 9043090 - DNA, 22 bp, Homo sapiens
cacatacttgtgtgtacatatg

SEQ ID NO: 9043091 - DNA, 22 bp, Homo sapiens
cacatagaaaacttagcaggga

SEQ ID NO: 9043092 - DNA, 22 bp, Homo sapiens
ggctcacacatgactgggctct

SEQ ID NO: 9043093 - DNA, 22 bp, Homo sapiens
cactttaactcacatttcagct

SEQ ID NO: 9043094 - DNA, 18 bp, Homo sapiens
ggctccagtcttcagtgg

SEQ ID NO: 9043095 - DNA, 22 bp, Homo sapiens
ggctccagtttccccttggggc

SEQ ID NO: 9043096 - DNA, 22 bp, Homo sapiens
ggctccaggtttaagggtatgt

SEQ ID NO: 9043097 - DNA, 22 bp, Homo sapiens
ggctccaggtgcatgccaggct

SEQ ID NO: 9043098 - DNA, 18 bp, Homo sapiens
ggctccagtcttcagtgg

SEQ ID NO: 9043099 - DNA, 22 bp, Homo sapiens
ggctccaggtacgtatgggagg

SEQ ID NO: 9043100 - DNA, 22 bp, Homo sapiens
ggctccaggtgcatgccaggct

SEQ ID NO: 9043101 - DNA, 22 bp, Homo sapiens
ggctccagggtctctccttgtg

SEQ ID NO: 9043102 - DNA, 22 bp, Homo sapiens
ggctccagggtctctccttgtg

SEQ ID NO: 9043103 - DNA, 22 bp, Homo sapiens
ggctccagggtacccctggatg

SEQ ID NO: 9043104 - DNA, 22 bp, Homo sapiens
ggctgcctactttcccagagtt

SEQ ID NO: 9043105 - DNA, 22 bp, Homo sapiens
cagaaagccaactccaactgtc

SEQ ID NO: 9043106 - DNA, 22 bp, Homo sapiens
cagaaagccgacttacaatgga

SEQ ID NO: 9043107 - DNA, 22 bp, Homo sapiens
cagaaatagacaatggcagtgg

SEQ ID NO: 9043108 - DNA, 22 bp, Homo sapiens
cagaaatacccagcatttggag

SEQ ID NO: 9043109 - DNA, 23 bp, Homo sapiens
cagaaataaactggtttgtagat

SEQ ID NO: 9043110 - DNA, 23 bp, Homo sapiens
cagaaataaactggtttgtagat

SEQ ID NO: 9043111 - DNA, 22 bp, Homo sapiens
cagaaataaacttctcacatcg

SEQ ID NO: 9043112 - DNA, 23 bp, Homo sapiens
cagaaagtttgagaagatacatc

SEQ ID NO: 9043113 - DNA, 22 bp, Homo sapiens
cagaaagcttggtacaatatgc

SEQ ID NO: 9043114 - DNA, 22 bp, Homo sapiens
cagaaagcttaggcaagttgga

SEQ ID NO: 9043115 - DNA, 22 bp, Homo sapiens
ggctgtccacctaccatgccgg

SEQ ID NO: 9043116 - DNA, 20 bp, Homo sapiens
ggctgtcccgcggctgccgg

SEQ ID NO: 9043117 - DNA, 22 bp, Homo sapiens
cacagacagtgtccctttgttg

SEQ ID NO: 9043118 - DNA, 22 bp, Homo sapiens
ggaaggggagctggaaagggta

SEQ ID NO: 9043119 - DNA, 22 bp, Homo sapiens
ggaaggggagctaaatctactg

SEQ ID NO: 9043120 - DNA, 22 bp, Homo sapiens
cacagaagtgtgtataactctt

SEQ ID NO: 9043121 - DNA, 22 bp, Homo sapiens
cacactgttgaggacgagatgt

SEQ ID NO: 9043122 - DNA, 22 bp, Homo sapiens
cacacagctcaggggcactgcc

SEQ ID NO: 9043123 - DNA, 22 bp, Homo sapiens
cacacagatggtaagggaggga

SEQ ID NO: 9043124 - DNA, 15 bp, Homo sapiens
cacacagacagcttg

SEQ ID NO: 9043125 - DNA, 22 bp, Homo sapiens
cacacagacagctctctgaaga

SEQ ID NO: 9043126 - DNA, 22 bp, Homo sapiens
cacaattttaatacacagtcaa

SEQ ID NO: 9043127 - DNA, 22 bp, Homo sapiens
cacaattttaatacacagtcaa

SEQ ID NO: 9043128 - DNA, 22 bp, Homo sapiens
cacagagttgaatattgacatt

SEQ ID NO: 9043129 - DNA, 20 bp, Homo sapiens
cacagagtcttgcagcgttc

SEQ ID NO: 9043130 - DNA, 22 bp, Homo sapiens
cacagatgaagtaaacaactct

SEQ ID NO: 9043131 - DNA, 19 bp, Homo sapiens
ggagccgccgcccttcatt

SEQ ID NO: 9043132 - DNA, 22 bp, Homo sapiens
ggagcctgacagtgcccagcat

SEQ ID NO: 9043133 - DNA, 22 bp, Homo sapiens
ggagcctgagcggcccagggcc

SEQ ID NO: 9043134 - DNA, 22 bp, Homo sapiens
ggagcctgcgggagctcccatt

SEQ ID NO: 9043135 - DNA, 22 bp, Homo sapiens
caagccagctcctgccacagag

SEQ ID NO: 9043136 - DNA, 22 bp, Homo sapiens
caagccagcagtttaatgactc

SEQ ID NO: 9043137 - DNA, 22 bp, Homo sapiens
caagcatgtcttcttaagcaat

SEQ ID NO: 9043138 - DNA, 22 bp, Homo sapiens
gctggaggatggactggaagaa

SEQ ID NO: 9043139 - DNA, 20 bp, Homo sapiens
caaatggcttttatttcctt

SEQ ID NO: 9043140 - DNA, 22 bp, Homo sapiens
caaatgtaaattcttttgaagc

SEQ ID NO: 9043141 - DNA, 22 bp, Homo sapiens
caaatgtaaattcttttgaagc

SEQ ID NO: 9043142 - DNA, 22 bp, Homo sapiens
gctggctggctgtgcaaaggca

SEQ ID NO: 9043143 - DNA, 22 bp, Homo sapiens
caaggccttcgtctcctagctt

SEQ ID NO: 9043144 - DNA, 22 bp, Homo sapiens
gctggctgggtccctgagaggc

SEQ ID NO: 9043145 - DNA, 22 bp, Homo sapiens
gctggctgtatcacctggccag

SEQ ID NO: 9043146 - DNA, 21 bp, Homo sapiens
gctggctgtcccagggaagca

SEQ ID NO: 9043147 - DNA, 21 bp, Homo sapiens
gctggctgtcccagggaagca

SEQ ID NO: 9043148 - DNA, 22 bp, Homo sapiens
caaggcaggaagcctgtcttat

SEQ ID NO: 9043149 - DNA, 22 bp, Homo sapiens
gctggaggcagttcagacacca

SEQ ID NO: 9043150 - DNA, 22 bp, Homo sapiens
gctggaggcagttcagacacca

SEQ ID NO: 9043151 - DNA, 22 bp, Homo sapiens
caatgtatcaagaagcatcagt

SEQ ID NO: 9043152 - DNA, 21 bp, Homo sapiens
caatgtctgctctctgcctag

SEQ ID NO: 9043153 - DNA, 22 bp, Homo sapiens
gctttgcacaacctttaagaca

SEQ ID NO: 9043154 - DNA, 22 bp, Homo sapiens
caagtttacaatgtgtatgtgt

SEQ ID NO: 9043155 - DNA, 22 bp, Homo sapiens
caagtttggattatgaaaaagt

SEQ ID NO: 9043156 - DNA, 22 bp, Homo sapiens
caataactagtaattattccgg

SEQ ID NO: 9043157 - DNA, 22 bp, Homo sapiens
caataaagaagatttttgcaat

SEQ ID NO: 9043158 - DNA, 21 bp, Homo sapiens
gctttctgtggactctgcacc

SEQ ID NO: 9043159 - DNA, 20 bp, Homo sapiens
caagggtttgcattggcttt

SEQ ID NO: 9043160 - DNA, 22 bp, Homo sapiens
caaggtgaacttgctgtacagc

SEQ ID NO: 9043161 - DNA, 22 bp, Homo sapiens
caagtaaagaatcacatttctt

SEQ ID NO: 9043162 - DNA, 22 bp, Homo sapiens
caagtacaaaatgatatttagt

SEQ ID NO: 9043163 - DNA, 22 bp, Homo sapiens
caagtatttgcggagttccacg

SEQ ID NO: 9043164 - DNA, 22 bp, Homo sapiens
gctgttctttgcatctctggtg

SEQ ID NO: 9043165 - DNA, 22 bp, Homo sapiens
caagtttacaatgtgtatgtgt

SEQ ID NO: 9043166 - DNA, 22 bp, Homo sapiens
caagtttaaggcactgataagt

SEQ ID NO: 9043167 - DNA, 22 bp, Homo sapiens
cagagcctcatcatccactcca

SEQ ID NO: 9043168 - DNA, 22 bp, Homo sapiens
cagagcctaaaacgactccact

SEQ ID NO: 9043169 - DNA, 22 bp, Homo sapiens
gggctgacgaaggccatgtgtg

SEQ ID NO: 9043170 - DNA, 22 bp, Homo sapiens
cagagctgggtttgggaaacct

SEQ ID NO: 9043171 - DNA, 22 bp, Homo sapiens
cagagctgggcatggtgaaagg

SEQ ID NO: 9043172 - DNA, 20 bp, Homo sapiens
cagagctgggatttgaacac

SEQ ID NO: 9043173 - DNA, 22 bp, Homo sapiens
cagagctggggactgttggatg

SEQ ID NO: 9043174 - DNA, 22 bp, Homo sapiens
cagagctgggatcccatgggcg

SEQ ID NO: 9043175 - DNA, 23 bp, Homo sapiens
cagagctggcttcatgggtgtgc

SEQ ID NO: 9043176 - DNA, 22 bp, Homo sapiens
cagagcctccctcctctgccat

SEQ ID NO: 9043177 - DNA, 22 bp, Homo sapiens
cagagctggctctgcatgtaca

SEQ ID NO: 9043178 - DNA, 22 bp, Homo sapiens
cagagacagcctgggagggaca

SEQ ID NO: 9043179 - DNA, 22 bp, Homo sapiens
cagagacagtttcacagggtct

SEQ ID NO: 9043180 - DNA, 22 bp, Homo sapiens
cagagacaggcttgccctccac

SEQ ID NO: 9043181 - DNA, 22 bp, Homo sapiens
cagagacagggcagggagtgtg

SEQ ID NO: 9043182 - DNA, 22 bp, Homo sapiens
cagactgggagtcaggaagaag

SEQ ID NO: 9043183 - DNA, 22 bp, Homo sapiens
cagacctgggtccctggcctgt

SEQ ID NO: 9043184 - DNA, 22 bp, Homo sapiens
cagacctggaaaacaggcttgc

SEQ ID NO: 9043185 - DNA, 17 bp, Homo sapiens
ggcttcagggagctggg

SEQ ID NO: 9043186 - DNA, 22 bp, Homo sapiens
ggtcctgggaagatgctcatga

SEQ ID NO: 9043187 - DNA, 22 bp, Homo sapiens
ggggagaccatctgaaggtgat

SEQ ID NO: 9043188 - DNA, 22 bp, Homo sapiens
ggggagctgccacagttctctg

SEQ ID NO: 9043189 - DNA, 22 bp, Homo sapiens
ggggagctgacaaccacatcct

SEQ ID NO: 9043190 - DNA, 22 bp, Homo sapiens
ggggagcagaagcagcaacaac

SEQ ID NO: 9043191 - DNA, 22 bp, Homo sapiens
ggggagcaatagttgaggtgtg

SEQ ID NO: 9043192 - DNA, 22 bp, Homo sapiens
cagcaaaggtagaagcacagga

SEQ ID NO: 9043193 - DNA, 22 bp, Homo sapiens
ggtgagaaagggattcctgttc

SEQ ID NO: 9043194 - DNA, 22 bp, Homo sapiens
cagcaagatttttaaagcaagg

SEQ ID NO: 9043195 - DNA, 21 bp, Homo sapiens
cagcaagacatgtttatcaag

SEQ ID NO: 9043196 - DNA, 22 bp, Homo sapiens
cagcaagagaggcagggcaaat

SEQ ID NO: 9043197 - DNA, 22 bp, Homo sapiens
cagcaagagggtaaggttgaag

SEQ ID NO: 9043198 - DNA, 22 bp, Homo sapiens
cagcacagtgaccagacccact

SEQ ID NO: 9043199 - DNA, 22 bp, Homo sapiens
cagctatattgttttctactgt

SEQ ID NO: 9043200 - DNA, 22 bp, Homo sapiens
cagcctggattgcagaatgcta

SEQ ID NO: 9043201 - DNA, 22 bp, Homo sapiens
cagccctggaacagctgactca

SEQ ID NO: 9043202 - DNA, 22 bp, Homo sapiens
cagccctgcttccccgctagtt

SEQ ID NO: 9043203 - DNA, 23 bp, Homo sapiens
cagccctggagatgtgggaggca

SEQ ID NO: 9043204 - DNA, 20 bp, Homo sapiens
cagcctccactcactcagct

SEQ ID NO: 9043205 - DNA, 22 bp, Homo sapiens
cagccctgcagccatggcctgt

SEQ ID NO: 9043206 - DNA, 22 bp, Homo sapiens
cagccctgctcttagtgtctcc

SEQ ID NO: 9043207 - DNA, 22 bp, Homo sapiens
cagccctgctgacactgtctga

SEQ ID NO: 9043208 - DNA, 18 bp, Homo sapiens
gtgctgtgggcagtggcc

SEQ ID NO: 9043209 - DNA, 22 bp, Homo sapiens
cagcaggaaagacatctgagca

SEQ ID NO: 9043210 - DNA, 22 bp, Homo sapiens
cagcaggaagtactagctttga

SEQ ID NO: 9043211 - DNA, 22 bp, Homo sapiens
gtcatattgaagaagactggca

SEQ ID NO: 9043212 - DNA, 22 bp, Homo sapiens
gtcatcttaaggactgctatag

SEQ ID NO: 9043213 - DNA, 22 bp, Homo sapiens
gtcataggtagggggaaggatg

SEQ ID NO: 9043214 - DNA, 22 bp, Homo sapiens
gtcataggttcaaaaggcagat

SEQ ID NO: 9043215 - DNA, 22 bp, Homo sapiens
gtcatattataaatgttctgtt

SEQ ID NO: 9043216 - DNA, 22 bp, Homo sapiens
gtcatggtgctagcgggaatgt

SEQ ID NO: 9043217 - DNA, 22 bp, Homo sapiens
gtccagccagctggtccttgcc

SEQ ID NO: 9043218 - DNA, 22 bp, Homo sapiens
gtccagccaccctggaggcacg

SEQ ID NO: 9043219 - DNA, 22 bp, Homo sapiens
gtcccaggcaggccactggcag

SEQ ID NO: 9043220 - DNA, 22 bp, Homo sapiens
cagccctcaggtcctcagcagc

SEQ ID NO: 9043221 - DNA, 22 bp, Homo sapiens
cagccccttcctggcatctgga

SEQ ID NO: 9043222 - DNA, 22 bp, Homo sapiens
cagcccctccctcaggcaggtg

SEQ ID NO: 9043223 - DNA, 22 bp, Homo sapiens
cagcccaggccgacagttcctc

SEQ ID NO: 9043224 - DNA, 19 bp, Homo sapiens
gtccctgggcagaggcacc

SEQ ID NO: 9043225 - DNA, 22 bp, Homo sapiens
gtcccagggaagaaggcagcac

SEQ ID NO: 9043226 - DNA, 22 bp, Homo sapiens
gaataatcatatcgtctcacat

SEQ ID NO: 9043227 - DNA, 22 bp, Homo sapiens
gaatacaaacttaaggctttac

SEQ ID NO: 9043228 - DNA, 22 bp, Homo sapiens
atgcacaattaggatatagctt

SEQ ID NO: 9043229 - DNA, 22 bp, Homo sapiens
gacatttattagaaaactatca

SEQ ID NO: 9043230 - DNA, 21 bp, Homo sapiens
gacacaaagggtagtaatggt

SEQ ID NO: 9043231 - DNA, 22 bp, Homo sapiens
gacaatttctcaatatagaaac

SEQ ID NO: 9043232 - DNA, 22 bp, Homo sapiens
gacacaaagtttgtcagaaatt

SEQ ID NO: 9043233 - DNA, 22 bp, Homo sapiens
gacacaaagtttgtcagaaatt

SEQ ID NO: 9043234 - DNA, 22 bp, Homo sapiens
gacacaaagtttgtcagaaatt

SEQ ID NO: 9043235 - DNA, 22 bp, Homo sapiens
gacacattgatgtgagtacata

SEQ ID NO: 9043236 - DNA, 18 bp, Homo sapiens
gacacatccccaggcctc

SEQ ID NO: 9043237 - DNA, 22 bp, Homo sapiens
gacacatagatctatctcactc

SEQ ID NO: 9043238 - DNA, 22 bp, Homo sapiens
gacacatatgcgtatagtttag

SEQ ID NO: 9043239 - DNA, 22 bp, Homo sapiens
gacacatatgcgtatagtttag

SEQ ID NO: 9043240 - DNA, 22 bp, Homo sapiens
gacaccagcaaggctgtgagga

SEQ ID NO: 9043241 - DNA, 23 bp, Homo sapiens
atgctctatttgggatatgacag

SEQ ID NO: 9043242 - DNA, 22 bp, Homo sapiens
atgctctataaatatgacatgt

SEQ ID NO: 9043243 - DNA, 17 bp, Homo sapiens
atgctctatagtcagtg

SEQ ID NO: 9043244 - DNA, 22 bp, Homo sapiens
atgctccagtgtgatgcttcat

SEQ ID NO: 9043245 - DNA, 18 bp, Homo sapiens
atgctctagtctttcctg

SEQ ID NO: 9043246 - DNA, 22 bp, Homo sapiens
atgctctagagctcttttcact

SEQ ID NO: 9043247 - DNA, 22 bp, Homo sapiens
atgctctagacatactggctat

SEQ ID NO: 9043248 - DNA, 22 bp, Homo sapiens
atgctctaagcttagtgaggca

SEQ ID NO: 9043249 - DNA, 22 bp, Homo sapiens
atgctctacttacggctttcag

SEQ ID NO: 9043250 - DNA, 22 bp, Homo sapiens
atgctccttggcttcaaagcca

SEQ ID NO: 9043251 - DNA, 22 bp, Homo sapiens
gactggatttatagatatcata

SEQ ID NO: 9043252 - DNA, 22 bp, Homo sapiens
gaaagtcatggatgaacactac

SEQ ID NO: 9043253 - DNA, 20 bp, Homo sapiens
gaaatacttacccaactgtt

SEQ ID NO: 9043254 - DNA, 22 bp, Homo sapiens
gaaatagaagctgccaatttct

SEQ ID NO: 9043255 - DNA, 22 bp, Homo sapiens
gaaatagacactttctatgaat

SEQ ID NO: 9043256 - DNA, 22 bp, Homo sapiens
gaaatacaggaatgccacacag

SEQ ID NO: 9043257 - DNA, 22 bp, Homo sapiens
gaaatacagttgggaggaggta

SEQ ID NO: 9043258 - DNA, 22 bp, Homo sapiens
atgatcaagaattttgtattcc

SEQ ID NO: 9043259 - DNA, 22 bp, Homo sapiens
gaaatagaggacagctggatca

SEQ ID NO: 9043260 - DNA, 22 bp, Homo sapiens
gaaatagatctctgggatgcaa

SEQ ID NO: 9043261 - DNA, 22 bp, Homo sapiens
atgatctgataatcatccacta

SEQ ID NO: 9043262 - DNA, 22 bp, Homo sapiens
atgatgctgtttatcatatact

SEQ ID NO: 9043263 - DNA, 22 bp, Homo sapiens
atgatgcataatttatacatgc

SEQ ID NO: 9043264 - DNA, 22 bp, Homo sapiens
atgatgctgtttatcatatact

SEQ ID NO: 9043265 - DNA, 22 bp, Homo sapiens
atgatgaagagtaacaggctga

SEQ ID NO: 9043266 - DNA, 22 bp, Homo sapiens
gaaacagggagtagtaatttac

SEQ ID NO: 9043267 - DNA, 22 bp, Homo sapiens
gaaacaggccaggttccaggcc

SEQ ID NO: 9043268 - DNA, 22 bp, Homo sapiens
gaaacaggtggcaggctagatt

SEQ ID NO: 9043269 - DNA, 22 bp, Homo sapiens
ctttcttggtcctgaagatggc

SEQ ID NO: 9043270 - DNA, 22 bp, Homo sapiens
ctttctttcgaagacgtgatta

SEQ ID NO: 9043271 - DNA, 22 bp, Homo sapiens
gaaacattgtgttctacagatt

SEQ ID NO: 9043272 - DNA, 20 bp, Homo sapiens
gaaacattggcagcaactga

SEQ ID NO: 9043273 - DNA, 20 bp, Homo sapiens
gaaaccagaacgcagccctg

SEQ ID NO: 9043274 - DNA, 22 bp, Homo sapiens
gaaacatttgttgagtacttgc

SEQ ID NO: 9043275 - DNA, 22 bp, Homo sapiens
gaaacattgtgttctacagatt

SEQ ID NO: 9043276 - DNA, 22 bp, Homo sapiens
atgaaacagtgaattagtcaag

SEQ ID NO: 9043277 - DNA, 22 bp, Homo sapiens
atgaaacagagtacttaatata

SEQ ID NO: 9043278 - DNA, 22 bp, Homo sapiens
atgaaacagtgtgtatagcaaa

SEQ ID NO: 9043279 - DNA, 22 bp, Homo sapiens
atgaaacagtgtgtatagcaaa

SEQ ID NO: 9043280 - DNA, 22 bp, Homo sapiens
atgaaaagttcgatctagaagg

SEQ ID NO: 9043281 - DNA, 22 bp, Homo sapiens
atgaaaatgtacatgtgtataa

SEQ ID NO: 9043282 - DNA, 19 bp, Homo sapiens
atgaaacacagtggcctgg

SEQ ID NO: 9043283 - DNA, 22 bp, Homo sapiens
ctttctggagtggaaaggtatt

SEQ ID NO: 9043284 - DNA, 23 bp, Homo sapiens
atgaacattagtttcagatattg

SEQ ID NO: 9043285 - DNA, 22 bp, Homo sapiens
cttctttaccaagagatagagt

SEQ ID NO: 9043286 - DNA, 22 bp, Homo sapiens
cttcttgtcaatttgccattgt

SEQ ID NO: 9043287 - DNA, 22 bp, Homo sapiens
ctttccctgcttagaaggattt

SEQ ID NO: 9043288 - DNA, 22 bp, Homo sapiens
atctggctcacttagtctagga

SEQ ID NO: 9043289 - DNA, 22 bp, Homo sapiens
atgtctatatagtcaataatca

SEQ ID NO: 9043290 - DNA, 22 bp, Homo sapiens
atgtctctctctgagtgccaga

SEQ ID NO: 9043291 - DNA, 22 bp, Homo sapiens
atgtctctcaggtttaacttta

SEQ ID NO: 9043292 - DNA, 19 bp, Homo sapiens
atgtctctgtagcacatac

SEQ ID NO: 9043293 - DNA, 22 bp, Homo sapiens
atgtagaaataatttcagttcc

SEQ ID NO: 9043294 - DNA, 22 bp, Homo sapiens
atgtagaattccttctactttg

SEQ ID NO: 9043295 - DNA, 22 bp, Homo sapiens
atgtagaagctgacagtgctgt

SEQ ID NO: 9043296 - DNA, 22 bp, Homo sapiens
atgtagaagctgacagtgctgt

SEQ ID NO: 9043297 - DNA, 22 bp, Homo sapiens
atgtagatgttggtttaaattt

SEQ ID NO: 9043298 - DNA, 22 bp, Homo sapiens
atgtagatgttcacttgatttt

SEQ ID NO: 9043299 - DNA, 22 bp, Homo sapiens
atgtagctgcagatgataatgc

SEQ ID NO: 9043300 - DNA, 22 bp, Homo sapiens
atgtcattgccaagatgctaat

SEQ ID NO: 9043301 - DNA, 22 bp, Homo sapiens
gagggctcaactactactaggc

SEQ ID NO: 9043302 - DNA, 19 bp, Homo sapiens
gagggctcatttgaacaat

SEQ ID NO: 9043303 - DNA, 22 bp, Homo sapiens
gagggctcctcacattctctat

SEQ ID NO: 9043304 - DNA, 22 bp, Homo sapiens
gagggctctaccaagtaactct

SEQ ID NO: 9043305 - DNA, 23 bp, Homo sapiens
gagggctctgagtgcttgggcca

SEQ ID NO: 9043306 - DNA, 22 bp, Homo sapiens
gaggtggatgttgcagtgagct

SEQ ID NO: 9043307 - DNA, 22 bp, Homo sapiens
atgtttaaggaactggtttgct

SEQ ID NO: 9043308 - DNA, 22 bp, Homo sapiens
gataatattagaagatacaaat

SEQ ID NO: 9043309 - DNA, 22 bp, Homo sapiens
atgttggactaggctcttaatt

SEQ ID NO: 9043310 - DNA, 22 bp, Homo sapiens
atgttggagtcgtaaggcatgg

SEQ ID NO: 9043311 - DNA, 22 bp, Homo sapiens
atgttggagtcgtaaggcatgg

SEQ ID NO: 9043312 - DNA, 22 bp, Homo sapiens
gatatgtatgaggagtatgtat

SEQ ID NO: 9043313 - DNA, 22 bp, Homo sapiens
gatatgtaccacctcttaaaag

SEQ ID NO: 9043314 - DNA, 22 bp, Homo sapiens
atgttatttctgaaagatcatt

SEQ ID NO: 9043315 - DNA, 20 bp, Homo sapiens
atgtgtcttagagcatcagg

SEQ ID NO: 9043316 - DNA, 22 bp, Homo sapiens
atgttcttgttcaaatgtcagt

SEQ ID NO: 9043317 - DNA, 22 bp, Homo sapiens
atgttgaactaggatctcttga

SEQ ID NO: 9043318 - DNA, 22 bp, Homo sapiens
atgttctttcagccagtgcatc

SEQ ID NO: 9043319 - DNA, 22 bp, Homo sapiens
atgttctttcagccagtgcatc

SEQ ID NO: 9043320 - DNA, 22 bp, Homo sapiens
gagacatcataatgaagtttcc

SEQ ID NO: 9043321 - DNA, 22 bp, Homo sapiens
atggagggtggtaagacagaga

SEQ ID NO: 9043322 - DNA, 21 bp, Homo sapiens
atggagggaccagggaagcag

SEQ ID NO: 9043323 - DNA, 22 bp, Homo sapiens
atggagggaaaagtggagagcc

SEQ ID NO: 9043324 - DNA, 22 bp, Homo sapiens
atggccaccatctctaaaacac

SEQ ID NO: 9043325 - DNA, 22 bp, Homo sapiens
atggccaagaatatttctcaac

SEQ ID NO: 9043326 - DNA, 22 bp, Homo sapiens
atggcatttttagacagtcctt

SEQ ID NO: 9043327 - DNA, 22 bp, Homo sapiens
atggcatttgaccgctttgtgg

SEQ ID NO: 9043328 - DNA, 22 bp, Homo sapiens
atggcatttatgttgacaatgg

SEQ ID NO: 9043329 - DNA, 22 bp, Homo sapiens
atggcattgctgtgctccactg

SEQ ID NO: 9043330 - DNA, 22 bp, Homo sapiens
atggcattcacatttccagaga

SEQ ID NO: 9043331 - DNA, 22 bp, Homo sapiens
atggcattaggaccatgagcct

SEQ ID NO: 9043332 - DNA, 17 bp, Homo sapiens
atggcttccattgacca

SEQ ID NO: 9043333 - DNA, 21 bp, Homo sapiens
atggcttctcaggtgcactga

SEQ ID NO: 9043334 - DNA, 22 bp, Homo sapiens
atggctttttagactttggtac

SEQ ID NO: 9043335 - DNA, 22 bp, Homo sapiens
atggctttccggactttggcca

SEQ ID NO: 9043336 - DNA, 22 bp, Homo sapiens
gaggcagcagggctggttcctt

SEQ ID NO: 9043337 - DNA, 22 bp, Homo sapiens
gaggcagcatggtaccttggag

SEQ ID NO: 9043338 - DNA, 22 bp, Homo sapiens
gaggcagcctcagtggacctcg

SEQ ID NO: 9043339 - DNA, 22 bp, Homo sapiens
gaggagaagctaagaaacacag

SEQ ID NO: 9043340 - DNA, 22 bp, Homo sapiens
gaggagaaatttggggacctga

SEQ ID NO: 9043341 - DNA, 22 bp, Homo sapiens
gaggagaagctattggaaggac

SEQ ID NO: 9043342 - DNA, 22 bp, Homo sapiens
gaggagaagggcacggagaaaa

SEQ ID NO: 9043343 - DNA, 22 bp, Homo sapiens
gaggagaatgcgcaccacatat

SEQ ID NO: 9043344 - DNA, 22 bp, Homo sapiens
attcaaagtaataaccagaact

SEQ ID NO: 9043345 - DNA, 22 bp, Homo sapiens
attagtgtctgtgaataattct

SEQ ID NO: 9043346 - DNA, 22 bp, Homo sapiens
attagtgttcttatcttctagg

SEQ ID NO: 9043347 - DNA, 22 bp, Homo sapiens
attagtgtacatctcacacgca

SEQ ID NO: 9043348 - DNA, 22 bp, Homo sapiens
attcaaagtactagctattttt

SEQ ID NO: 9043349 - DNA, 22 bp, Homo sapiens
attcaaattaagttaattcagc

SEQ ID NO: 9043350 - DNA, 22 bp, Homo sapiens
attcaacatattctgagtaaaa

SEQ ID NO: 9043351 - DNA, 22 bp, Homo sapiens
attagcttatcacacaagctgc

SEQ ID NO: 9043352 - DNA, 22 bp, Homo sapiens
attagatgtgaccttagataaa

SEQ ID NO: 9043353 - DNA, 22 bp, Homo sapiens
gatatgtattgaatgatcattt

SEQ ID NO: 9043354 - DNA, 22 bp, Homo sapiens
gatatgtgcttgtaatatttat

SEQ ID NO: 9043355 - DNA, 21 bp, Homo sapiens
attacatccctggtgatacat

SEQ ID NO: 9043356 - DNA, 22 bp, Homo sapiens
attacctatgctctagtaatca

SEQ ID NO: 9043357 - DNA, 22 bp, Homo sapiens
attacctatttcattttctgtc

SEQ ID NO: 9043358 - DNA, 22 bp, Homo sapiens
gatttcacctgatcttgtcatc

SEQ ID NO: 9043359 - DNA, 22 bp, Homo sapiens
gatttcactggctttaagcaca

SEQ ID NO: 9043360 - DNA, 22 bp, Homo sapiens
gatttcactaggtttctaggtg

SEQ ID NO: 9043361 - DNA, 22 bp, Homo sapiens
gatttcacgggaggtggctgga

SEQ ID NO: 9043362 - DNA, 21 bp, Homo sapiens
gatttcacttaccttcattta

SEQ ID NO: 9043363 - DNA, 22 bp, Homo sapiens
gatttcactttctggatgtgca

SEQ ID NO: 9043364 - DNA, 22 bp, Homo sapiens
gatttccaggacgggaggtggg

SEQ ID NO: 9043365 - DNA, 22 bp, Homo sapiens
gatttccaggtcattaataaag

SEQ ID NO: 9043366 - DNA, 22 bp, Homo sapiens
gatttccatgattgggccagaa

SEQ ID NO: 9043367 - DNA, 22 bp, Homo sapiens
gatttccattttcaactcctgc

SEQ ID NO: 9043368 - DNA, 22 bp, Homo sapiens
attagaggttgttttgtaaaga

SEQ ID NO: 9043369 - DNA, 22 bp, Homo sapiens
attcagaaatagaaaatttgat

SEQ ID NO: 9043370 - DNA, 22 bp, Homo sapiens
attcactggtgtcagggatcag

SEQ ID NO: 9043371 - DNA, 22 bp, Homo sapiens
attcactggcagacagaactca

SEQ ID NO: 9043372 - DNA, 22 bp, Homo sapiens
attcacatttagcctctgacat

SEQ ID NO: 9043373 - DNA, 22 bp, Homo sapiens
attcacaatgatacataagcga

SEQ ID NO: 9043374 - DNA, 22 bp, Homo sapiens
attcacaatagcagcttgcatg

SEQ ID NO: 9043375 - DNA, 22 bp, Homo sapiens
attcataacggcaaatgtcacc

SEQ ID NO: 9043376 - DNA, 22 bp, Homo sapiens
attcatcagctaatggacattt

SEQ ID NO: 9043377 - DNA, 22 bp, Homo sapiens
attcagttccttgtgattgtag

SEQ ID NO: 9043378 - DNA, 22 bp, Homo sapiens
attcagaagctattcttagttc

SEQ ID NO: 9043379 - DNA, 22 bp, Homo sapiens
attgtacttttattacatgtag

SEQ ID NO: 9043380 - DNA, 17 bp, Homo sapiens
gcatcacagataacacg

SEQ ID NO: 9043381 - DNA, 22 bp, Homo sapiens
gcatattttcacaagctcttgg

SEQ ID NO: 9043382 - DNA, 22 bp, Homo sapiens
attgtcagagtttgagaaagta

SEQ ID NO: 9043383 - DNA, 22 bp, Homo sapiens
attgtcacttaaaagtgcatgt

SEQ ID NO: 9043384 - DNA, 22 bp, Homo sapiens
gcagtgttacttggagtactaa

SEQ ID NO: 9043385 - DNA, 22 bp, Homo sapiens
gcagtgttaccttgggctggtt

SEQ ID NO: 9043386 - DNA, 22 bp, Homo sapiens
gcagtgttaaacaactgctgct

SEQ ID NO: 9043387 - DNA, 22 bp, Homo sapiens
gcagtgttacctcttcagtggg

SEQ ID NO: 9043388 - DNA, 22 bp, Homo sapiens
gcagtgttaatgcgagtgttca

SEQ ID NO: 9043389 - DNA, 22 bp, Homo sapiens
gcatacttcttgctgctttcag

SEQ ID NO: 9043390 - DNA, 22 bp, Homo sapiens
gcagtgttacttggtttgcaga

SEQ ID NO: 9043391 - DNA, 20 bp, Homo sapiens
gccaacgcgctggggctgcc

SEQ ID NO: 9043392 - DNA, 21 bp, Homo sapiens
gccaagaacaagacagacatg

SEQ ID NO: 9043393 - DNA, 22 bp, Homo sapiens
gccaagagaatgtgagagaaat

SEQ ID NO: 9043394 - DNA, 22 bp, Homo sapiens
attccttgggctgccttattat

SEQ ID NO: 9043395 - DNA, 22 bp, Homo sapiens
attccttgggaattattgaatg

SEQ ID NO: 9043396 - DNA, 22 bp, Homo sapiens
attccttggcattctggacttg

SEQ ID NO: 9043397 - DNA, 22 bp, Homo sapiens
attccttgtatatctacatgca

SEQ ID NO: 9043398 - DNA, 22 bp, Homo sapiens
attccttgtttcactgaaaagg

SEQ ID NO: 9043399 - DNA, 22 bp, Homo sapiens
attctttcaaggaatagttatt

SEQ ID NO: 9043400 - DNA, 22 bp, Homo sapiens
attctttaattcaattgaagga

SEQ ID NO: 9043401 - DNA, 19 bp, Homo sapiens
attcttgttaagtgtcatc

SEQ ID NO: 9043402 - DNA, 22 bp, Homo sapiens
attccttgcacatcagatagtt

SEQ ID NO: 9043403 - DNA, 22 bp, Homo sapiens
attccttgctctcatcaacctt

SEQ ID NO: 9043404 - DNA, 22 bp, Homo sapiens
attccttggaacagatgcgaag

SEQ ID NO: 9043405 - DNA, 22 bp, Homo sapiens
gcagctgctgtggcatcaagct

SEQ ID NO: 9043406 - DNA, 22 bp, Homo sapiens
gcagcgagtgcggctgccacag

SEQ ID NO: 9043407 - DNA, 22 bp, Homo sapiens
attgatttttgaggactggtat

SEQ ID NO: 9043408 - DNA, 22 bp, Homo sapiens
attgatttagctcaagacacat

SEQ ID NO: 9043409 - DNA, 22 bp, Homo sapiens
attgatttaggcttgttatgac

SEQ ID NO: 9043410 - DNA, 22 bp, Homo sapiens
attgatttgaacaaagatatta

SEQ ID NO: 9043411 - DNA, 18 bp, Homo sapiens
gcagggctgcacacgcat

SEQ ID NO: 9043412 - DNA, 22 bp, Homo sapiens
gcagggctgatggcttccctca

SEQ ID NO: 9043413 - DNA, 22 bp, Homo sapiens
attgatcatgcagatgcttcac

SEQ ID NO: 9043414 - DNA, 17 bp, Homo sapiens
attgactcatttatcat

SEQ ID NO: 9043415 - DNA, 22 bp, Homo sapiens
attgataaattgcaatggggct

SEQ ID NO: 9043416 - DNA, 22 bp, Homo sapiens
caaacattcagatgcaatggta

SEQ ID NO: 9043417 - DNA, 22 bp, Homo sapiens
caaacattcaagtacaagtctt

SEQ ID NO: 9043418 - DNA, 22 bp, Homo sapiens
caaagccatagagtagataaga

SEQ ID NO: 9043419 - DNA, 22 bp, Homo sapiens
caaagccaggctttctaatgta

SEQ ID NO: 9043420 - DNA, 18 bp, Homo sapiens
caaagcaggtgacagtgt

SEQ ID NO: 9043421 - DNA, 22 bp, Homo sapiens
caaaattagggagtgagctgga

SEQ ID NO: 9043422 - DNA, 22 bp, Homo sapiens
caaaattgttgatgctgctttg

SEQ ID NO: 9043423 - DNA, 22 bp, Homo sapiens
caaaattgatgaatgtatgatt

SEQ ID NO: 9043424 - DNA, 22 bp, Homo sapiens
caaaattgattgtggtgatggt

SEQ ID NO: 9043425 - DNA, 22 bp, Homo sapiens
caaacatagtgaagcaatgaca

SEQ ID NO: 9043426 - DNA, 22 bp, Homo sapiens
caaaataccacgacttgtttta

SEQ ID NO: 9043427 - DNA, 22 bp, Homo sapiens
attttagagctccaagtacagc

SEQ ID NO: 9043428 - DNA, 22 bp, Homo sapiens
attttactttgtgaatattgac

SEQ ID NO: 9043429 - DNA, 22 bp, Homo sapiens
attttgtttcctttggagtaga

SEQ ID NO: 9043430 - DNA, 22 bp, Homo sapiens
caaatgcatgagaaataagagg

SEQ ID NO: 9043431 - DNA, 22 bp, Homo sapiens
caaatgctactaataggcaagt

SEQ ID NO: 9043432 - DNA, 22 bp, Homo sapiens
caaaggacccataattaaaacc

SEQ ID NO: 9043433 - DNA, 21 bp, Homo sapiens
caaaggactgtagctcactga

SEQ ID NO: 9043434 - DNA, 22 bp, Homo sapiens
caaatactgagtttattttcaa

SEQ ID NO: 9043435 - DNA, 22 bp, Homo sapiens
caaatactacgattcttgcagt

SEQ ID NO: 9043436 - DNA, 22 bp, Homo sapiens
caaatagacaagatggcaggaa

SEQ ID NO: 9043437 - DNA, 22 bp, Homo sapiens
caaatagaaggtactcagagaa

SEQ ID NO: 9043438 - DNA, 22 bp, Homo sapiens
caaatagaactcacagacaaga

SEQ ID NO: 9043439 - DNA, 22 bp, Homo sapiens
atttggaatggtctggcatttg

SEQ ID NO: 9043440 - DNA, 22 bp, Homo sapiens
gcctggagttgtggtgaagcca

SEQ ID NO: 9043441 - DNA, 22 bp, Homo sapiens
gcctctgcaactccgccttggt

SEQ ID NO: 9043442 - DNA, 22 bp, Homo sapiens
gcctattttattatgcatgtaa

SEQ ID NO: 9043443 - DNA, 22 bp, Homo sapiens
gcctcaaatgtggagcactatt

SEQ ID NO: 9043444 - DNA, 22 bp, Homo sapiens
gccaggtgagaggactgaggct

SEQ ID NO: 9043445 - DNA, 22 bp, Homo sapiens
gccaggtgcacctgccctggcc

SEQ ID NO: 9043446 - DNA, 22 bp, Homo sapiens
gccaggtgagtgcgcgccgtcc

SEQ ID NO: 9043447 - DNA, 22 bp, Homo sapiens
gccaggtgatttcaaagtcctt

SEQ ID NO: 9043448 - DNA, 22 bp, Homo sapiens
gccaggtgctatccctgcgctg

SEQ ID NO: 9043449 - DNA, 22 bp, Homo sapiens
gccaggtgcatattagaagcat

SEQ ID NO: 9043450 - DNA, 22 bp, Homo sapiens
gccaggtgcatggctgagtctc

SEQ ID NO: 9043451 - DNA, 22 bp, Homo sapiens
gccaggtggaggttgcagtgag

SEQ ID NO: 9043452 - DNA, 22 bp, Homo sapiens
atttctgtagtccacattcttt

SEQ ID NO: 9043453 - DNA, 22 bp, Homo sapiens
gcccccacaggcgggctcgggt

SEQ ID NO: 9043454 - DNA, 22 bp, Homo sapiens
atttctgttgcttataaattac

SEQ ID NO: 9043455 - DNA, 22 bp, Homo sapiens
atttccatgaaggcagatttta

SEQ ID NO: 9043456 - DNA, 22 bp, Homo sapiens
atttccatgtccaaaaattagt

SEQ ID NO: 9043457 - DNA, 22 bp, Homo sapiens
atacacactgctatcctttttt

SEQ ID NO: 9043458 - DNA, 20 bp, Homo sapiens
atacacattcatagaaaaat

SEQ ID NO: 9043459 - DNA, 22 bp, Homo sapiens
atacacatttgctagagatggg

SEQ ID NO: 9043460 - DNA, 22 bp, Homo sapiens
atacacaattgtgtttttatga

SEQ ID NO: 9043461 - DNA, 22 bp, Homo sapiens
atacaattattctgcagatatt

SEQ ID NO: 9043462 - DNA, 22 bp, Homo sapiens
atacacaattgtgtttttatga

SEQ ID NO: 9043463 - DNA, 22 bp, Homo sapiens
atacaatctagtctgtcagcaa

SEQ ID NO: 9043464 - DNA, 22 bp, Homo sapiens
atacaatgaagtatagatgaaa

SEQ ID NO: 9043465 - DNA, 20 bp, Homo sapiens
atacaatcatgaggaaaaag

SEQ ID NO: 9043466 - DNA, 22 bp, Homo sapiens
atacaatccagccattgccaca

SEQ ID NO: 9043467 - DNA, 22 bp, Homo sapiens
ataaggtaagggtattgtcaga

SEQ ID NO: 9043468 - DNA, 22 bp, Homo sapiens
atacaaagacaaatctcaatct

SEQ ID NO: 9043469 - DNA, 20 bp, Homo sapiens
atacaaagagattgatgtat

SEQ ID NO: 9043470 - DNA, 22 bp, Homo sapiens
ataaggacttgaattagacatt

SEQ ID NO: 9043471 - DNA, 22 bp, Homo sapiens
ataaggaatgatgtatcagttt

SEQ ID NO: 9043472 - DNA, 22 bp, Homo sapiens
ataagctgtactctataaatgt

SEQ ID NO: 9043473 - DNA, 22 bp, Homo sapiens
agttcacaagtgcatttcagga

SEQ ID NO: 9043474 - DNA, 22 bp, Homo sapiens
ataacactaaatgtatgtaaca

SEQ ID NO: 9043475 - DNA, 22 bp, Homo sapiens
ataacagactgatttttaaatg

SEQ ID NO: 9043476 - DNA, 22 bp, Homo sapiens
ataacagacttagagttacaag

SEQ ID NO: 9043477 - DNA, 22 bp, Homo sapiens
ataacagacttagagttacaag

SEQ ID NO: 9043478 - DNA, 20 bp, Homo sapiens
actttacagagaagactgac

SEQ ID NO: 9043479 - DNA, 22 bp, Homo sapiens
actttagaaaagcatccataga

SEQ ID NO: 9043480 - DNA, 22 bp, Homo sapiens
actttagaaaaggaacagagga

SEQ ID NO: 9043481 - DNA, 22 bp, Homo sapiens
atacactggacatcattgcatt

SEQ ID NO: 9043482 - DNA, 22 bp, Homo sapiens
atagaaatgtattttggactag

SEQ ID NO: 9043483 - DNA, 22 bp, Homo sapiens
atagaagatagcttttgtttct

SEQ ID NO: 9043484 - DNA, 22 bp, Homo sapiens
atagaagcaagaacagaatgga

SEQ ID NO: 9043485 - DNA, 22 bp, Homo sapiens
atagttctggatgtacttatag

SEQ ID NO: 9043486 - DNA, 23 bp, Homo sapiens
agaaaagcttggacacatggcct

SEQ ID NO: 9043487 - DNA, 22 bp, Homo sapiens
ataggagatcaatatgcaattt

SEQ ID NO: 9043488 - DNA, 22 bp, Homo sapiens
atagtgtcagaaaatcataaga

SEQ ID NO: 9043489 - DNA, 22 bp, Homo sapiens
atagcttacaggtgatatcagc

SEQ ID NO: 9043490 - DNA, 21 bp, Homo sapiens
atcaatgacctggcatgaggg

SEQ ID NO: 9043491 - DNA, 22 bp, Homo sapiens
atcaagagttatatttcatagt

SEQ ID NO: 9043492 - DNA, 22 bp, Homo sapiens
agaaatgcctacgagataggga

SEQ ID NO: 9043493 - DNA, 22 bp, Homo sapiens
agaaatcttggagtctgtggta

SEQ ID NO: 9043494 - DNA, 22 bp, Homo sapiens
agaaatctttcctgaagtgttt

SEQ ID NO: 9043495 - DNA, 22 bp, Homo sapiens
atcaatgttgggccaaagcaaa

SEQ ID NO: 9043496 - DNA, 22 bp, Homo sapiens
agaaatagtcacattggaggaa

SEQ ID NO: 9043497 - DNA, 23 bp, Homo sapiens
agaaagtttgtgccttgtgacac

SEQ ID NO: 9043498 - DNA, 19 bp, Homo sapiens
agaaatagccttccttgtc

SEQ ID NO: 9043499 - DNA, 22 bp, Homo sapiens
agaaatagcagagtcaggcggg

SEQ ID NO: 9043500 - DNA, 22 bp, Homo sapiens
agaaatcacaggaggcagaagg

SEQ ID NO: 9043501 - DNA, 22 bp, Homo sapiens
atatagcacttgttttgcatgt

SEQ ID NO: 9043502 - DNA, 22 bp, Homo sapiens
atatagaatacacagggaaagt

SEQ ID NO: 9043503 - DNA, 22 bp, Homo sapiens
agaaaagggcaggagggataca

SEQ ID NO: 9043504 - DNA, 22 bp, Homo sapiens
agaaacttcagctattcttttg

SEQ ID NO: 9043505 - DNA, 20 bp, Homo sapiens
agaaacatttcttgagaact

SEQ ID NO: 9043506 - DNA, 20 bp, Homo sapiens
agaaacatttcttgagaact

SEQ ID NO: 9043507 - DNA, 22 bp, Homo sapiens
atattaaatggattttgggagc

SEQ ID NO: 9043508 - DNA, 22 bp, Homo sapiens
atattaaaactatggttttcag

SEQ ID NO: 9043509 - DNA, 22 bp, Homo sapiens
atattaatgagcaagtaagtga

SEQ ID NO: 9043510 - DNA, 22 bp, Homo sapiens
agaaagagctcgggattaacag

SEQ ID NO: 9043511 - DNA, 22 bp, Homo sapiens
agaaagaacgttggttatctta

SEQ ID NO: 9043512 - DNA, 21 bp, Homo sapiens
agaagccatgccagtaaaatt

SEQ ID NO: 9043513 - DNA, 22 bp, Homo sapiens
agaagccatggggtcaccagag

SEQ ID NO: 9043514 - DNA, 22 bp, Homo sapiens
atcctgcttgttacttatagag

SEQ ID NO: 9043515 - DNA, 22 bp, Homo sapiens
atcctgcagggggttttattca

SEQ ID NO: 9043516 - DNA, 21 bp, Homo sapiens
agaagccatttgttaggactt

SEQ ID NO: 9043517 - DNA, 22 bp, Homo sapiens
agaagccatgtttagtaggatg

SEQ ID NO: 9043518 - DNA, 22 bp, Homo sapiens
agaagcattggaccaggggccc

SEQ ID NO: 9043519 - DNA, 22 bp, Homo sapiens
agaaatgttgaatacacaaaat

SEQ ID NO: 9043520 - DNA, 22 bp, Homo sapiens
agaagcaggcagatttcagctc

SEQ ID NO: 9043521 - DNA, 22 bp, Homo sapiens
agaaatgttacagttgttattt

SEQ ID NO: 9043522 - DNA, 22 bp, Homo sapiens
agaaatgtggaggaacagggct

SEQ ID NO: 9043523 - DNA, 21 bp, Homo sapiens
agaaatgtatcattcttttcc

SEQ ID NO: 9043524 - DNA, 22 bp, Homo sapiens
agttaccacccacaagcttgtt

SEQ ID NO: 9043525 - DNA, 22 bp, Homo sapiens
agttattttggaaaatgagtca

SEQ ID NO: 9043526 - DNA, 19 bp, Homo sapiens
agttatttctaaatttacc

SEQ ID NO: 9043527 - DNA, 22 bp, Homo sapiens
agttcaacaccagcctgaccaa

SEQ ID NO: 9043528 - DNA, 23 bp, Homo sapiens
agttcaaaatcaaccaggacact

SEQ ID NO: 9043529 - DNA, 22 bp, Homo sapiens
agttacacataaacattaaagg

SEQ ID NO: 9043530 - DNA, 22 bp, Homo sapiens
actggggcaggaaagtatgctg

SEQ ID NO: 9043531 - DNA, 22 bp, Homo sapiens
agtgggggcagagcctctctcg

SEQ ID NO: 9043532 - DNA, 22 bp, Homo sapiens
agtgggggctggctctgtctgt

SEQ ID NO: 9043533 - DNA, 22 bp, Homo sapiens
agtgggggccaacgagggcagc

SEQ ID NO: 9043534 - DNA, 22 bp, Homo sapiens
agtgggggccaacgagggcagc

SEQ ID NO: 9043535 - DNA, 22 bp, Homo sapiens
agtgtgtactcatatacttcca

SEQ ID NO: 9043536 - DNA, 22 bp, Homo sapiens
agtgtctttcatatcctccatc

SEQ ID NO: 9043537 - DNA, 22 bp, Homo sapiens
agtgtctttatagactgacaat

SEQ ID NO: 9043538 - DNA, 22 bp, Homo sapiens
agtgtctttcatatcctccatc

SEQ ID NO: 9043539 - DNA, 22 bp, Homo sapiens
agtgtcttacatgaattgattt

SEQ ID NO: 9043540 - DNA, 22 bp, Homo sapiens
agtgtgggtgagggaggccctc

SEQ ID NO: 9043541 - DNA, 22 bp, Homo sapiens
agtgagagtattaatgtgaact

SEQ ID NO: 9043542 - DNA, 22 bp, Homo sapiens
agtcctttgggaaaaatgacta

SEQ ID NO: 9043543 - DNA, 22 bp, Homo sapiens
agtggcagacacaatgtgggca

SEQ ID NO: 9043544 - DNA, 22 bp, Homo sapiens
agtgctttccctgaaaccttcc

SEQ ID NO: 9043545 - DNA, 22 bp, Homo sapiens
agtgggaggaagtggtgatatt

SEQ ID NO: 9043546 - DNA, 22 bp, Homo sapiens
agtgggagcggcagtcggggac

SEQ ID NO: 9043547 - DNA, 22 bp, Homo sapiens
agtgggagcggcagtcggggac

SEQ ID NO: 9043548 - DNA, 22 bp, Homo sapiens
agtgggaggcggctgacgggcg

SEQ ID NO: 9043549 - DNA, 16 bp, Homo sapiens
agtgggaggagaaaga

SEQ ID NO: 9043550 - DNA, 22 bp, Homo sapiens
agtgggagataacttaacagct

SEQ ID NO: 9043551 - DNA, 22 bp, Homo sapiens
agtgggagccagcagcttgggg

SEQ ID NO: 9043552 - DNA, 20 bp, Homo sapiens
agtgggagagggcagactgc

SEQ ID NO: 9043553 - DNA, 22 bp, Homo sapiens
aggtgcagtggctcatgcctgt

SEQ ID NO: 9043554 - DNA, 22 bp, Homo sapiens
aggtgcttggctcgtgcacaca

SEQ ID NO: 9043555 - DNA, 19 bp, Homo sapiens
aggtgcaggtcacagggga

SEQ ID NO: 9043556 - DNA, 22 bp, Homo sapiens
aggtgcaggagctgtgcaggga

SEQ ID NO: 9043557 - DNA, 22 bp, Homo sapiens
agggtccatcaaggactgcaca

SEQ ID NO: 9043558 - DNA, 22 bp, Homo sapiens
agggtccatgtttccagttaat

SEQ ID NO: 9043559 - DNA, 22 bp, Homo sapiens
agggtccattctttgccttttc

SEQ ID NO: 9043560 - DNA, 22 bp, Homo sapiens
agggtccagtaacagatgccag

SEQ ID NO: 9043561 - DNA, 19 bp, Homo sapiens
agggtccagggagcggctc

SEQ ID NO: 9043562 - DNA, 23 bp, Homo sapiens
agggtccagggatcaccaggtgt

SEQ ID NO: 9043563 - DNA, 19 bp, Homo sapiens
agggtccaggccctgtgga

SEQ ID NO: 9043564 - DNA, 22 bp, Homo sapiens
agggtccaactgaggctgaact

SEQ ID NO: 9043565 - DNA, 22 bp, Homo sapiens
agggtccacttggacattgatc

SEQ ID NO: 9043566 - DNA, 22 bp, Homo sapiens
aggtggagaagagatgggcagt

SEQ ID NO: 9043567 - DNA, 22 bp, Homo sapiens
aggtgggtgccgtctgtcctct

SEQ ID NO: 9043568 - DNA, 22 bp, Homo sapiens
aggtgggtcctggctctgccat

SEQ ID NO: 9043569 - DNA, 22 bp, Homo sapiens
aggtggggttcagtctcagccg

SEQ ID NO: 9043570 - DNA, 22 bp, Homo sapiens
agtaacttaagcaattgtgtat

SEQ ID NO: 9043571 - DNA, 22 bp, Homo sapiens
actcagcttcctacagctagaa

SEQ ID NO: 9043572 - DNA, 22 bp, Homo sapiens
agtaacatctttgacatttgtt

SEQ ID NO: 9043573 - DNA, 22 bp, Homo sapiens
actcagctcaggagctggctgg

SEQ ID NO: 9043574 - DNA, 22 bp, Homo sapiens
actcagctgatgaagcacaagt

SEQ ID NO: 9043575 - DNA, 22 bp, Homo sapiens
actcagagttttacccagagac

SEQ ID NO: 9043576 - DNA, 21 bp, Homo sapiens
agtccaggcctgcccacttcc

SEQ ID NO: 9043577 - DNA, 22 bp, Homo sapiens
agtccaggcattccagccattc

SEQ ID NO: 9043578 - DNA, 22 bp, Homo sapiens
agtccaggcattccagccattc

SEQ ID NO: 9043579 - DNA, 22 bp, Homo sapiens
agtccaggcctcctcttttcct

SEQ ID NO: 9043580 - DNA, 22 bp, Homo sapiens
agtccaggcctccctctcctgc

SEQ ID NO: 9043581 - DNA, 22 bp, Homo sapiens
agtccaggagttgggtgacatt

SEQ ID NO: 9043582 - DNA, 22 bp, Homo sapiens
agtccaggagttgggtgacatt

SEQ ID NO: 9043583 - DNA, 22 bp, Homo sapiens
agtccaggcaagttgttgtgta

SEQ ID NO: 9043584 - DNA, 21 bp, Homo sapiens
agtccaggagtcacccaagcc

SEQ ID NO: 9043585 - DNA, 21 bp, Homo sapiens
agtccaggaggaggccaggtt

SEQ ID NO: 9043586 - DNA, 21 bp, Homo sapiens
agtccaggaggaggccaggtt

SEQ ID NO: 9043587 - DNA, 22 bp, Homo sapiens
agtccaggaaaataagctaggt

SEQ ID NO: 9043588 - DNA, 22 bp, Homo sapiens
agtccaggaagcatcatggtct

SEQ ID NO: 9043589 - DNA, 22 bp, Homo sapiens
agtccaggactgtttcagctga

SEQ ID NO: 9043590 - DNA, 22 bp, Homo sapiens
agtcctgggttctggtgttttg

SEQ ID NO: 9043591 - DNA, 22 bp, Homo sapiens
acagtgttcctttgttgtgact

SEQ ID NO: 9043592 - DNA, 22 bp, Homo sapiens
acagtgttcctttgttgtgact

SEQ ID NO: 9043593 - DNA, 22 bp, Homo sapiens
acagtgttcacttaacaatgga

SEQ ID NO: 9043594 - DNA, 20 bp, Homo sapiens
acagtgttagttatcatctc

SEQ ID NO: 9043595 - DNA, 22 bp, Homo sapiens
acagtgttatttctgagtaatg

SEQ ID NO: 9043596 - DNA, 22 bp, Homo sapiens
acagtgttcactaaggttagct

SEQ ID NO: 9043597 - DNA, 22 bp, Homo sapiens
acagtgttcaaaccactaggct

SEQ ID NO: 9043598 - DNA, 22 bp, Homo sapiens
acagtgttctgaaagttgaggg

SEQ ID NO: 9043599 - DNA, 22 bp, Homo sapiens
acagtgttctcttcctgtatag

SEQ ID NO: 9043600 - DNA, 22 bp, Homo sapiens
aggcactttttgcattttagaa

SEQ ID NO: 9043601 - DNA, 20 bp, Homo sapiens
acagtgttaggtttttcctt

SEQ ID NO: 9043602 - DNA, 22 bp, Homo sapiens
aggcactctgggtttaaattct

SEQ ID NO: 9043603 - DNA, 22 bp, Homo sapiens
acagtgttacttgatagtgtat

SEQ ID NO: 9043604 - DNA, 22 bp, Homo sapiens
aggcacagcacacctggccccc

SEQ ID NO: 9043605 - DNA, 17 bp, Homo sapiens
aggcacctcttcctgct

SEQ ID NO: 9043606 - DNA, 22 bp, Homo sapiens
acagtgaaaattctattgattt

SEQ ID NO: 9043607 - DNA, 22 bp, Homo sapiens
acagtgaaaattctattgattt

SEQ ID NO: 9043608 - DNA, 22 bp, Homo sapiens
acagtgaaaagaatattagaat

SEQ ID NO: 9043609 - DNA, 23 bp, Homo sapiens
acagtgaaacacgcagtaagagt

SEQ ID NO: 9043610 - DNA, 22 bp, Homo sapiens
acagtgaatccaaattcctacc

SEQ ID NO: 9043611 - DNA, 22 bp, Homo sapiens
acagtgaataagacatgtgctt

SEQ ID NO: 9043612 - DNA, 22 bp, Homo sapiens
acagtgaatgcccaagaaaagt

SEQ ID NO: 9043613 - DNA, 22 bp, Homo sapiens
aggaggccaggccctcaagcct

SEQ ID NO: 9043614 - DNA, 22 bp, Homo sapiens
acatctcatgaatgataaatca

SEQ ID NO: 9043615 - DNA, 22 bp, Homo sapiens
acatctgattacatgagaatat

SEQ ID NO: 9043616 - DNA, 22 bp, Homo sapiens
acatctgaggagaccagcctct

SEQ ID NO: 9043617 - DNA, 22 bp, Homo sapiens
acatctgttcaaatatgcattt

SEQ ID NO: 9043618 - DNA, 22 bp, Homo sapiens
acatctgttcttctcttgtccc

SEQ ID NO: 9043619 - DNA, 22 bp, Homo sapiens
aggcagtgtattgctagcggct

SEQ ID NO: 9043620 - DNA, 20 bp, Homo sapiens
aggcagtgtagagatgagta

SEQ ID NO: 9043621 - DNA, 22 bp, Homo sapiens
aggcagatgtgtcttctaaaat

SEQ ID NO: 9043622 - DNA, 22 bp, Homo sapiens
aggcagatgtgattaatttcct

SEQ ID NO: 9043623 - DNA, 22 bp, Homo sapiens
aggcagattaggattaggaaat

SEQ ID NO: 9043624 - DNA, 22 bp, Homo sapiens
aggcagatcagtacagggttaa

SEQ ID NO: 9043625 - DNA, 22 bp, Homo sapiens
aggcagatgggagctggaagtt

SEQ ID NO: 9043626 - DNA, 22 bp, Homo sapiens
aggcagatgggcgtctataaat

SEQ ID NO: 9043627 - DNA, 22 bp, Homo sapiens
aggcagatatttcagttcacat

SEQ ID NO: 9043628 - DNA, 22 bp, Homo sapiens
aggcagattttctttactcagt

SEQ ID NO: 9043629 - DNA, 22 bp, Homo sapiens
acagggctatattcctcagagc

SEQ ID NO: 9043630 - DNA, 23 bp, Homo sapiens
acagggctagctgacagtggtat

SEQ ID NO: 9043631 - DNA, 22 bp, Homo sapiens
acagggctatattcctcagagt

SEQ ID NO: 9043632 - DNA, 22 bp, Homo sapiens
aggacagggattcaaactccca

SEQ ID NO: 9043633 - DNA, 22 bp, Homo sapiens
aggacaggtgtagtgggctctg

SEQ ID NO: 9043634 - DNA, 22 bp, Homo sapiens
aggaaaggttcagtgattgaaa

SEQ ID NO: 9043635 - DNA, 22 bp, Homo sapiens
aggaaataggaccagacaaagc

SEQ ID NO: 9043636 - DNA, 19 bp, Homo sapiens
agcttctttggaaacattt

SEQ ID NO: 9043637 - DNA, 22 bp, Homo sapiens
agcttcttagttcacttttaat

SEQ ID NO: 9043638 - DNA, 22 bp, Homo sapiens
agcttcttggctcagcacttgg

SEQ ID NO: 9043639 - DNA, 22 bp, Homo sapiens
agcttcttgggctttacacaaa

SEQ ID NO: 9043640 - DNA, 22 bp, Homo sapiens
agcttcttctgatttgtcagtc

SEQ ID NO: 9043641 - DNA, 22 bp, Homo sapiens
acagccagaggagccaggctgg

SEQ ID NO: 9043642 - DNA, 22 bp, Homo sapiens
acagcagtggtgcactgagcca

SEQ ID NO: 9043643 - DNA, 22 bp, Homo sapiens
acagcagtttagaggacagcca

SEQ ID NO: 9043644 - DNA, 22 bp, Homo sapiens
aggctgcttcagctgcagggag

SEQ ID NO: 9043645 - DNA, 22 bp, Homo sapiens
aggctgctggcaggcgtggacg

SEQ ID NO: 9043646 - DNA, 22 bp, Homo sapiens
acatttctccctgcatgcctgc

SEQ ID NO: 9043647 - DNA, 23 bp, Homo sapiens
aggctggcttcaggagcctctcc

SEQ ID NO: 9043648 - DNA, 22 bp, Homo sapiens
aggctggctttggtagcatggt

SEQ ID NO: 9043649 - DNA, 22 bp, Homo sapiens
accagaaaggaataatagaatt

SEQ ID NO: 9043650 - DNA, 22 bp, Homo sapiens
accagaaaggaataatagaatt

SEQ ID NO: 9043651 - DNA, 22 bp, Homo sapiens
accactgcccatggtgaaaact

SEQ ID NO: 9043652 - DNA, 20 bp, Homo sapiens
aggctcagctgagctcttgg

SEQ ID NO: 9043653 - DNA, 22 bp, Homo sapiens
acatgtctccacccatcttaaa

SEQ ID NO: 9043654 - DNA, 22 bp, Homo sapiens
acatgtctcttctgaaagacaa

SEQ ID NO: 9043655 - DNA, 22 bp, Homo sapiens
acatgtaagactagcttaaagt

SEQ ID NO: 9043656 - DNA, 22 bp, Homo sapiens
aggcagtgtgtagctggaagag

SEQ ID NO: 9043657 - DNA, 22 bp, Homo sapiens
acatgtaaaagataaattaaca

SEQ ID NO: 9043658 - DNA, 21 bp, Homo sapiens
acatgtaagagagtttcaaga

SEQ ID NO: 9043659 - DNA, 22 bp, Homo sapiens
acatgtatgtgtgcaaacacat

SEQ ID NO: 9043660 - DNA, 22 bp, Homo sapiens
aggctccagtctcctctggcag

SEQ ID NO: 9043661 - DNA, 22 bp, Homo sapiens
acattaacactggtgctggtgt

SEQ ID NO: 9043662 - DNA, 22 bp, Homo sapiens
acattaacaccgtgagtttggt

SEQ ID NO: 9043663 - DNA, 22 bp, Homo sapiens
acattaacaccataagtgtgtt

SEQ ID NO: 9043664 - DNA, 22 bp, Homo sapiens
aggggagccgaggggcatctgt

SEQ ID NO: 9043665 - DNA, 22 bp, Homo sapiens
aggggcagttccaagttttgtg

SEQ ID NO: 9043666 - DNA, 22 bp, Homo sapiens
agggctcagcatctcattctgt

SEQ ID NO: 9043667 - DNA, 22 bp, Homo sapiens
aggggtgtgcatcctggaggat

SEQ ID NO: 9043668 - DNA, 22 bp, Homo sapiens
acctcagttcaattcagttaga

SEQ ID NO: 9043669 - DNA, 22 bp, Homo sapiens
agggcacctgttttagcttggt

SEQ ID NO: 9043670 - DNA, 22 bp, Homo sapiens
agggaggtctttgaggggctta

SEQ ID NO: 9043671 - DNA, 20 bp, Homo sapiens
agggaggtgctgggcctgag

SEQ ID NO: 9043672 - DNA, 22 bp, Homo sapiens
agggaggatctgctccttgtct

SEQ ID NO: 9043673 - DNA, 22 bp, Homo sapiens
agggaggagtcctcaaagtcat

SEQ ID NO: 9043674 - DNA, 22 bp, Homo sapiens
agggagctgactggctgccatt

SEQ ID NO: 9043675 - DNA, 22 bp, Homo sapiens
accagagactctttctagtcct

SEQ ID NO: 9043676 - DNA, 21 bp, Homo sapiens
agggctcaaatgtgcttgctg

SEQ ID NO: 9043677 - DNA, 22 bp, Homo sapiens
agggctcaccactgtgcactcc

SEQ ID NO: 9043678 - DNA, 22 bp, Homo sapiens
atggacaatgtgaaactacaag

SEQ ID NO: 9043679 - DNA, 18 bp, Homo sapiens
agagatgggagttggaaa

SEQ ID NO: 9043680 - DNA, 22 bp, Homo sapiens
atgggctctatgtctaggagat

SEQ ID NO: 9043681 - DNA, 22 bp, Homo sapiens
atgggctctatgtctaggagat

SEQ ID NO: 9043682 - DNA, 22 bp, Homo sapiens
atgggctcggcgctgctgggat

SEQ ID NO: 9043683 - DNA, 22 bp, Homo sapiens
atgtacatactgcattttcaaa

SEQ ID NO: 9043684 - DNA, 22 bp, Homo sapiens
atgttcctggtatatcatgacc

SEQ ID NO: 9043685 - DNA, 22 bp, Homo sapiens
atgttcctgatcctcgttctat

SEQ ID NO: 9043686 - DNA, 22 bp, Homo sapiens
atgttctacagatggaaagggg

SEQ ID NO: 9043687 - DNA, 22 bp, Homo sapiens
attaagtgactaaagtaatgct

SEQ ID NO: 9043688 - DNA, 22 bp, Homo sapiens
attaagtgactaaagtaatgct

SEQ ID NO: 9043689 - DNA, 22 bp, Homo sapiens
attaaggcgttggcgtgcttat

SEQ ID NO: 9043690 - DNA, 22 bp, Homo sapiens
attaaggattatactctccttt

SEQ ID NO: 9043691 - DNA, 22 bp, Homo sapiens
attaaggagggctgggcatgat

SEQ ID NO: 9043692 - DNA, 22 bp, Homo sapiens
attaaggaggtaaactatggtt

SEQ ID NO: 9043693 - DNA, 22 bp, Homo sapiens
attaaggaatgtaggcaagaag

SEQ ID NO: 9043694 - DNA, 22 bp, Homo sapiens
attaaggaagcctattctctcc

SEQ ID NO: 9043695 - DNA, 18 bp, Homo sapiens
attaaggaattctttaga

SEQ ID NO: 9043696 - DNA, 21 bp, Homo sapiens
agagctcaaggcaaaaataat

SEQ ID NO: 9043697 - DNA, 22 bp, Homo sapiens
attaaggaacaaagccttttga

SEQ ID NO: 9043698 - DNA, 21 bp, Homo sapiens
atgtgattatatgacttttac

SEQ ID NO: 9043699 - DNA, 22 bp, Homo sapiens
atgtctttaaacttgagttgtt

SEQ ID NO: 9043700 - DNA, 22 bp, Homo sapiens
agagattacagcagggtccagc

SEQ ID NO: 9043701 - DNA, 18 bp, Homo sapiens
agagatggtgtagagttt

SEQ ID NO: 9043702 - DNA, 22 bp, Homo sapiens
atgttattttggaaaatacaaa

SEQ ID NO: 9043703 - DNA, 22 bp, Homo sapiens
atgttacagaaagcaaagatga

SEQ ID NO: 9043704 - DNA, 22 bp, Homo sapiens
atgttacacataggcataaatg

SEQ ID NO: 9043705 - DNA, 22 bp, Homo sapiens
atgtgcatgtgcacacatgcgt

SEQ ID NO: 9043706 - DNA, 20 bp, Homo sapiens
atgattctgggctacactgg

SEQ ID NO: 9043707 - DNA, 22 bp, Homo sapiens
atgatttaaagtcattgtgaac

SEQ ID NO: 9043708 - DNA, 22 bp, Homo sapiens
atgattttctgataaagaactg

SEQ ID NO: 9043709 - DNA, 22 bp, Homo sapiens
atcttacattccctcaccattt

SEQ ID NO: 9043710 - DNA, 23 bp, Homo sapiens
atcttacatatttagcacctgaa

SEQ ID NO: 9043711 - DNA, 18 bp, Homo sapiens
atcttaacttgatggagt

SEQ ID NO: 9043712 - DNA, 22 bp, Homo sapiens
atcttacacgataactgttagt

SEQ ID NO: 9043713 - DNA, 22 bp, Homo sapiens
atcttacactgttgggtttctc

SEQ ID NO: 9043714 - DNA, 22 bp, Homo sapiens
atgacttaatcatacttgcatt

SEQ ID NO: 9043715 - DNA, 22 bp, Homo sapiens
atgacctgaggccttactctag

SEQ ID NO: 9043716 - DNA, 21 bp, Homo sapiens
atcttaaaaggtcttaacttt

SEQ ID NO: 9043717 - DNA, 22 bp, Homo sapiens
atctgggtcagtatgttcttgg

SEQ ID NO: 9043718 - DNA, 17 bp, Homo sapiens
atctggctgcttctaga

SEQ ID NO: 9043719 - DNA, 22 bp, Homo sapiens
atgccagaagccaaaaaatatt

SEQ ID NO: 9043720 - DNA, 22 bp, Homo sapiens
atgcaacagttcatagttttat

SEQ ID NO: 9043721 - DNA, 22 bp, Homo sapiens
atgcaacaatgtatttatgtat

SEQ ID NO: 9043722 - DNA, 22 bp, Homo sapiens
atgcaacagctgggaatatgta

SEQ ID NO: 9043723 - DNA, 22 bp, Homo sapiens
agacataattaattagttctac

SEQ ID NO: 9043724 - DNA, 22 bp, Homo sapiens
atgcttaggttaaatttgtaat

SEQ ID NO: 9043725 - DNA, 22 bp, Homo sapiens
atgctgaaatttattggtaagg

SEQ ID NO: 9043726 - DNA, 22 bp, Homo sapiens
agagaacaaattaaaggtggtt

SEQ ID NO: 9043727 - DNA, 22 bp, Homo sapiens
atgcttcttgagatagaaacac

SEQ ID NO: 9043728 - DNA, 22 bp, Homo sapiens
agagaaaagagttcaggctttg

SEQ ID NO: 9043729 - DNA, 22 bp, Homo sapiens
atgcttccttaccagaagatga

SEQ ID NO: 9043730 - DNA, 22 bp, Homo sapiens
atgcttcctcccttccactcaa

SEQ ID NO: 9043731 - DNA, 22 bp, Homo sapiens
atgcttctcctgaacatccctg

SEQ ID NO: 9043732 - DNA, 22 bp, Homo sapiens
atgcttccctttgctccacatg

SEQ ID NO: 9043733 - DNA, 22 bp, Homo sapiens
agatacaagaggcctgacgtgt

SEQ ID NO: 9043734 - DNA, 22 bp, Homo sapiens
agatacaactgtttaaacatta

SEQ ID NO: 9043735 - DNA, 22 bp, Homo sapiens
agatacaactgtttaaacatta

SEQ ID NO: 9043736 - DNA, 22 bp, Homo sapiens
agatacaaggcagagatgtgca

SEQ ID NO: 9043737 - DNA, 22 bp, Homo sapiens
agatacaaggcagagatgtgca

SEQ ID NO: 9043738 - DNA, 22 bp, Homo sapiens
attgtattagcacaatacaatt

SEQ ID NO: 9043739 - DNA, 22 bp, Homo sapiens
attgtatttccagcttgaatgt

SEQ ID NO: 9043740 - DNA, 22 bp, Homo sapiens
attgaaaaatgactattgctta

SEQ ID NO: 9043741 - DNA, 22 bp, Homo sapiens
attgaaatacataaaattgcca

SEQ ID NO: 9043742 - DNA, 22 bp, Homo sapiens
attgagaatgcaatctactatg

SEQ ID NO: 9043743 - DNA, 22 bp, Homo sapiens
attgagcacaaacgttactaga

SEQ ID NO: 9043744 - DNA, 22 bp, Homo sapiens
attgagcaggcaaagtatcata

SEQ ID NO: 9043745 - DNA, 22 bp, Homo sapiens
attatttctcactcacataata

SEQ ID NO: 9043746 - DNA, 22 bp, Homo sapiens
agaggccggccgagcccatggg

SEQ ID NO: 9043747 - DNA, 22 bp, Homo sapiens
agaggccggccgagcccatggg

SEQ ID NO: 9043748 - DNA, 22 bp, Homo sapiens
agagcttttctgtaataacatc

SEQ ID NO: 9043749 - DNA, 22 bp, Homo sapiens
agagcttttacttacattctat

SEQ ID NO: 9043750 - DNA, 22 bp, Homo sapiens
attaataaaataccactttgtt

SEQ ID NO: 9043751 - DNA, 22 bp, Homo sapiens
agagcttcactggagagcacat

SEQ ID NO: 9043752 - DNA, 22 bp, Homo sapiens
attctctgggttccagtaaatg

SEQ ID NO: 9043753 - DNA, 22 bp, Homo sapiens
attctccttctattaagttatt

SEQ ID NO: 9043754 - DNA, 22 bp, Homo sapiens
attctccttattctgaaaaaag

SEQ ID NO: 9043755 - DNA, 22 bp, Homo sapiens
attcaaagaacctttagcattg

SEQ ID NO: 9043756 - DNA, 22 bp, Homo sapiens
attctacaaaagaactggatct

SEQ ID NO: 9043757 - DNA, 22 bp, Homo sapiens
attctacaaaagaactggatct

SEQ ID NO: 9043758 - DNA, 22 bp, Homo sapiens
attctaagtcttgttcacattc

SEQ ID NO: 9043759 - DNA, 22 bp, Homo sapiens
agatttcaatggatattgcaag

SEQ ID NO: 9043760 - DNA, 22 bp, Homo sapiens
attttctgtgtgcagataaata

SEQ ID NO: 9043761 - DNA, 22 bp, Homo sapiens
agatttaaagcagtattcgcaa

SEQ ID NO: 9043762 - DNA, 22 bp, Homo sapiens
agatttaaatttgctacaattc

SEQ ID NO: 9043763 - DNA, 22 bp, Homo sapiens
agatttaaatttgctacaattc

SEQ ID NO: 9043764 - DNA, 22 bp, Homo sapiens
agatttactgagaactgattac

SEQ ID NO: 9043765 - DNA, 22 bp, Homo sapiens
agattggggtccagactcctga

SEQ ID NO: 9043766 - DNA, 22 bp, Homo sapiens
agattcctcagtcatgaagcct

SEQ ID NO: 9043767 - DNA, 22 bp, Homo sapiens
agattcctaaagtaagatatca

SEQ ID NO: 9043768 - DNA, 22 bp, Homo sapiens
agattcctgttgtatggagggg

SEQ ID NO: 9043769 - DNA, 20 bp, Homo sapiens
agattccttggggatagtgc

SEQ ID NO: 9043770 - DNA, 22 bp, Homo sapiens
atttacagccttgaaaacagca

SEQ ID NO: 9043771 - DNA, 22 bp, Homo sapiens
atttctcttagcaagacattac

SEQ ID NO: 9043772 - DNA, 22 bp, Homo sapiens
agatgacaatgaaggaaaatgt

SEQ ID NO: 9043773 - DNA, 22 bp, Homo sapiens
atttgaatggcttaacacaacg

SEQ ID NO: 9043774 - DNA, 22 bp, Homo sapiens
agatgagaatttttagagtgct

SEQ ID NO: 9043775 - DNA, 22 bp, Homo sapiens
agatgacacacacgcacccgga

SEQ ID NO: 9043776 - DNA, 22 bp, Homo sapiens
agatgacagctacgggatgaaa

SEQ ID NO: 9043777 - DNA, 22 bp, Homo sapiens
agatgacagctacgggatgaaa

SEQ ID NO: 9043778 - DNA, 22 bp, Homo sapiens
agatgacagccaaggagatgaa

SEQ ID NO: 9043779 - DNA, 22 bp, Homo sapiens
agatgacagccaaggagatgaa

SEQ ID NO: 9043780 - DNA, 22 bp, Homo sapiens
agatgacatgggagcaagcact

SEQ ID NO: 9043781 - DNA, 22 bp, Homo sapiens
agatgacatggttcaagtttcc

SEQ ID NO: 9043782 - DNA, 22 bp, Homo sapiens
agcaaggtctccctgcacctgg

SEQ ID NO: 9043783 - DNA, 22 bp, Homo sapiens
agcaaggggcagtgaaagtgtg

SEQ ID NO: 9043784 - DNA, 22 bp, Homo sapiens
agcaagtagtaccaagtagctc

SEQ ID NO: 9043785 - DNA, 22 bp, Homo sapiens
agcaataacagaaaactttcct

SEQ ID NO: 9043786 - DNA, 22 bp, Homo sapiens
attttttagccaagactctgca

SEQ ID NO: 9043787 - DNA, 22 bp, Homo sapiens
attttgttgatggtggagtagc

SEQ ID NO: 9043788 - DNA, 22 bp, Homo sapiens
attttgtgaaccctcaagcaat

SEQ ID NO: 9043789 - DNA, 22 bp, Homo sapiens
caaagttttagtaaacatatat

SEQ ID NO: 9043790 - DNA, 22 bp, Homo sapiens
caaagttttagtaaacatatat

SEQ ID NO: 9043791 - DNA, 22 bp, Homo sapiens
caaagtttggctctcatgacat

SEQ ID NO: 9043792 - DNA, 22 bp, Homo sapiens
caaagtggagagcctgtggttg

SEQ ID NO: 9043793 - DNA, 22 bp, Homo sapiens
caaagtggaggctctggggcca

SEQ ID NO: 9043794 - DNA, 22 bp, Homo sapiens
caaagtggctggccgggagatc

SEQ ID NO: 9043795 - DNA, 22 bp, Homo sapiens
caaagtgggtgccctgatgctc

SEQ ID NO: 9043796 - DNA, 22 bp, Homo sapiens
agcaatgatgttttcaagtagg

SEQ ID NO: 9043797 - DNA, 22 bp, Homo sapiens
caaacattttgagtggtttctg

SEQ ID NO: 9043798 - DNA, 22 bp, Homo sapiens
caaacatttgttggaacccctg

SEQ ID NO: 9043799 - DNA, 22 bp, Homo sapiens
caaacattttaaataagggata

SEQ ID NO: 9043800 - DNA, 22 bp, Homo sapiens
caaacattgctaccagaggttt

SEQ ID NO: 9043801 - DNA, 22 bp, Homo sapiens
caaacatttaggaggagggagg

SEQ ID NO: 9043802 - DNA, 22 bp, Homo sapiens
caaacattgctaccagaggttt

SEQ ID NO: 9043803 - DNA, 22 bp, Homo sapiens
caaacattgggggcttcaacac

SEQ ID NO: 9043804 - DNA, 22 bp, Homo sapiens
caagtctgacctctgggtgaag

SEQ ID NO: 9043805 - DNA, 22 bp, Homo sapiens
caagtctgacctctgggtgaag

SEQ ID NO: 9043806 - DNA, 22 bp, Homo sapiens
caattatatttagaatgataca

SEQ ID NO: 9043807 - DNA, 22 bp, Homo sapiens
caaggaaaagaagtatttcaga

SEQ ID NO: 9043808 - DNA, 22 bp, Homo sapiens
caaggaaaacagatgatcaaca

SEQ ID NO: 9043809 - DNA, 22 bp, Homo sapiens
agcaattattgtataagaacaa

SEQ ID NO: 9043810 - DNA, 22 bp, Homo sapiens
agcaatttctcgcaccagacgc

SEQ ID NO: 9043811 - DNA, 22 bp, Homo sapiens
agcaattttctaagcaaaatac

SEQ ID NO: 9043812 - DNA, 22 bp, Homo sapiens
caagcagagaggttagaacaca

SEQ ID NO: 9043813 - DNA, 22 bp, Homo sapiens
caaggaaggagagatgatgggt

SEQ ID NO: 9043814 - DNA, 22 bp, Homo sapiens
caatttttaaactatgaagttg

SEQ ID NO: 9043815 - DNA, 22 bp, Homo sapiens
cacacatcttatcccagttatt

SEQ ID NO: 9043816 - DNA, 22 bp, Homo sapiens
cacacatcaacctagacattgt

SEQ ID NO: 9043817 - DNA, 22 bp, Homo sapiens
cacacagaaccgctcgccactt

SEQ ID NO: 9043818 - DNA, 22 bp, Homo sapiens
caatttctggaactaattctga

SEQ ID NO: 9043819 - DNA, 22 bp, Homo sapiens
caatttcttgttaattctcagg

SEQ ID NO: 9043820 - DNA, 22 bp, Homo sapiens
caatttgtctaatgaaactcag

SEQ ID NO: 9043821 - DNA, 22 bp, Homo sapiens
cacacatggctgccagggaggt

SEQ ID NO: 9043822 - DNA, 22 bp, Homo sapiens
cacacatggttccgcaggatgc

SEQ ID NO: 9043823 - DNA, 22 bp, Homo sapiens
cacacatgtgagcagagaggcg

SEQ ID NO: 9043824 - DNA, 22 bp, Homo sapiens
cacactttgttgaagttttcat

SEQ ID NO: 9043825 - DNA, 22 bp, Homo sapiens
cacactttcaggtcctctttgc

SEQ ID NO: 9043826 - DNA, 22 bp, Homo sapiens
cacactttgtgctaatctattt

SEQ ID NO: 9043827 - DNA, 22 bp, Homo sapiens
cacagaaaaaggcttgaaaatc

SEQ ID NO: 9043828 - DNA, 22 bp, Homo sapiens
cacagaaaaaggcttgaaaatc

SEQ ID NO: 9043829 - DNA, 22 bp, Homo sapiens
cacagaaaggctcaaatcccaa

SEQ ID NO: 9043830 - DNA, 22 bp, Homo sapiens
agcattttctgagagtatagat

SEQ ID NO: 9043831 - DNA, 20 bp, Homo sapiens
agcattttatggtaggaaac

SEQ ID NO: 9043832 - DNA, 22 bp, Homo sapiens
cactgggcgtgtcctgggtgag

SEQ ID NO: 9043833 - DNA, 22 bp, Homo sapiens
cactgggtaaatttgaggctga

SEQ ID NO: 9043834 - DNA, 22 bp, Homo sapiens
cactgggtcaggatagagccca

SEQ ID NO: 9043835 - DNA, 22 bp, Homo sapiens
agccaaagtccaaatgcagtgt

SEQ ID NO: 9043836 - DNA, 22 bp, Homo sapiens
cagaaagacctgattggcagtt

SEQ ID NO: 9043837 - DNA, 22 bp, Homo sapiens
cagaaagacctgggctcaagag

SEQ ID NO: 9043838 - DNA, 22 bp, Homo sapiens
cagaaactttctttactgagca

SEQ ID NO: 9043839 - DNA, 20 bp, Homo sapiens
cagaaagaaggtagattttt

SEQ ID NO: 9043840 - DNA, 22 bp, Homo sapiens
cagaaactgtttgttaatattt

SEQ ID NO: 9043841 - DNA, 22 bp, Homo sapiens
cagaaacttctggtgtcaaata

SEQ ID NO: 9043842 - DNA, 22 bp, Homo sapiens
cagaaactagatttagacacaa

SEQ ID NO: 9043843 - DNA, 22 bp, Homo sapiens
cagaaactatgtaagaaagtga

SEQ ID NO: 9043844 - DNA, 22 bp, Homo sapiens
cactgcaacctccacctcctgg

SEQ ID NO: 9043845 - DNA, 22 bp, Homo sapiens
cactgcactccagcccgggcaa

SEQ ID NO: 9043846 - DNA, 22 bp, Homo sapiens
agcatttaggagaatttgagaa

SEQ ID NO: 9043847 - DNA, 22 bp, Homo sapiens
agcatttatgactaatgtaaaa

SEQ ID NO: 9043848 - DNA, 22 bp, Homo sapiens
agcatttatagcccctatcatc

SEQ ID NO: 9043849 - DNA, 22 bp, Homo sapiens
agcatttagttagtaaatgttt

SEQ ID NO: 9043850 - DNA, 22 bp, Homo sapiens
agcatttatttcttagaaattg

SEQ ID NO: 9043851 - DNA, 22 bp, Homo sapiens
agcatttatgactaatgtaaaa

SEQ ID NO: 9043852 - DNA, 22 bp, Homo sapiens
cactgcactccatcctgggaaa

SEQ ID NO: 9043853 - DNA, 20 bp, Homo sapiens
agcatttagcctttatccac

SEQ ID NO: 9043854 - DNA, 20 bp, Homo sapiens
agcatttagcctttatccac

SEQ ID NO: 9043855 - DNA, 22 bp, Homo sapiens
cacatgaacatgctggaaaagc

SEQ ID NO: 9043856 - DNA, 22 bp, Homo sapiens
cacatgtcctgggaaaataact

SEQ ID NO: 9043857 - DNA, 22 bp, Homo sapiens
cacctgcaaggagctttcattt

SEQ ID NO: 9043858 - DNA, 22 bp, Homo sapiens
cacatttaaaaaatccacgatc

SEQ ID NO: 9043859 - DNA, 22 bp, Homo sapiens
cacatttaaaggttgaagctga

SEQ ID NO: 9043860 - DNA, 21 bp, Homo sapiens
cacattgaatacagagatgga

SEQ ID NO: 9043861 - DNA, 22 bp, Homo sapiens
cacattgtattgtggaaagtta

SEQ ID NO: 9043862 - DNA, 22 bp, Homo sapiens
cacattgtagagattagaaaga

SEQ ID NO: 9043863 - DNA, 22 bp, Homo sapiens
cactgaaatcgaaaaatgtagg

SEQ ID NO: 9043864 - DNA, 22 bp, Homo sapiens
cactgaaatcgaaaaatgtagg

SEQ ID NO: 9043865 - DNA, 22 bp, Homo sapiens
cactgaaatcgaaaaatgtagg

SEQ ID NO: 9043866 - DNA, 19 bp, Homo sapiens
cactaagaagcaggggagc

SEQ ID NO: 9043867 - DNA, 22 bp, Homo sapiens
cactaagaatacagacagggat

SEQ ID NO: 9043868 - DNA, 19 bp, Homo sapiens
cactaagatgagatatagc

SEQ ID NO: 9043869 - DNA, 22 bp, Homo sapiens
cactaagatttaaagtattagt

SEQ ID NO: 9043870 - DNA, 22 bp, Homo sapiens
cactagaaaggtacagattatg

SEQ ID NO: 9043871 - DNA, 20 bp, Homo sapiens
cagaggagtacatatgttca

SEQ ID NO: 9043872 - DNA, 22 bp, Homo sapiens
cagagcttaaaactccatggaa

SEQ ID NO: 9043873 - DNA, 22 bp, Homo sapiens
cagaggaggcggtatacactgc

SEQ ID NO: 9043874 - DNA, 22 bp, Homo sapiens
agccctgggctgtagataagca

SEQ ID NO: 9043875 - DNA, 22 bp, Homo sapiens
agccctgggctgtagataagca

SEQ ID NO: 9043876 - DNA, 22 bp, Homo sapiens
cagatgaactaggctgcacttg

SEQ ID NO: 9043877 - DNA, 19 bp, Homo sapiens
agcctggagggctggtcac

SEQ ID NO: 9043878 - DNA, 22 bp, Homo sapiens
agcctattccaggatgagctca

SEQ ID NO: 9043879 - DNA, 22 bp, Homo sapiens
agccagggaaggataacaagaa

SEQ ID NO: 9043880 - DNA, 22 bp, Homo sapiens
agccagggaagaggcctacctc

SEQ ID NO: 9043881 - DNA, 22 bp, Homo sapiens
agccagggatggcagtgcccag

SEQ ID NO: 9043882 - DNA, 22 bp, Homo sapiens
agccagggatgcagcacagtga

SEQ ID NO: 9043883 - DNA, 23 bp, Homo sapiens
agccagggcactggtggagattg

SEQ ID NO: 9043884 - DNA, 22 bp, Homo sapiens
agccagggctctccttcgcgtg

SEQ ID NO: 9043885 - DNA, 22 bp, Homo sapiens
agccagggacgctgcaggctac

SEQ ID NO: 9043886 - DNA, 22 bp, Homo sapiens
agccagggctgcgagcagacag

SEQ ID NO: 9043887 - DNA, 22 bp, Homo sapiens
agccagggctgcaggttccttg

SEQ ID NO: 9043888 - DNA, 22 bp, Homo sapiens
agccagggctgcgagcagacag

SEQ ID NO: 9043889 - DNA, 22 bp, Homo sapiens
agccaggggagtcagctgctgg

SEQ ID NO: 9043890 - DNA, 22 bp, Homo sapiens
agccaggggagtcagctgctgg

SEQ ID NO: 9043891 - DNA, 20 bp, Homo sapiens
cagagctgttatggatgatg

SEQ ID NO: 9043892 - DNA, 22 bp, Homo sapiens
cagagctgttgcggggcttggc

SEQ ID NO: 9043893 - DNA, 22 bp, Homo sapiens
cagagctgtccaaaccctgaca

SEQ ID NO: 9043894 - DNA, 22 bp, Homo sapiens
cagagctgttactattcatgaa

SEQ ID NO: 9043895 - DNA, 22 bp, Homo sapiens
cagagctgtgataaatagatat

SEQ ID NO: 9043896 - DNA, 23 bp, Homo sapiens
cagagctggctcagagctgcctg

SEQ ID NO: 9043897 - DNA, 21 bp, Homo sapiens
cagagctgtccaaaccctgac

SEQ ID NO: 9043898 - DNA, 22 bp, Homo sapiens
cagcactgcttcgcagccaggg

SEQ ID NO: 9043899 - DNA, 22 bp, Homo sapiens
cagccagctggcactgtgagta

SEQ ID NO: 9043900 - DNA, 22 bp, Homo sapiens
cagcccaaagccccaggctaga

SEQ ID NO: 9043901 - DNA, 22 bp, Homo sapiens
cagcccaggtctctcttccagt

SEQ ID NO: 9043902 - DNA, 20 bp, Homo sapiens
agctgaggcacctgaggtta

SEQ ID NO: 9043903 - DNA, 22 bp, Homo sapiens
agctgaagacctcaagtaagag

SEQ ID NO: 9043904 - DNA, 22 bp, Homo sapiens
agctgaagatccagggttgggg

SEQ ID NO: 9043905 - DNA, 22 bp, Homo sapiens
agctgaagcaacaacaggatgg

SEQ ID NO: 9043906 - DNA, 20 bp, Homo sapiens
agctgaagatctggatgggg

SEQ ID NO: 9043907 - DNA, 22 bp, Homo sapiens
agctgaggaggaatgatgggta

SEQ ID NO: 9043908 - DNA, 22 bp, Homo sapiens
agctgaggaggaatgatgggta

SEQ ID NO: 9043909 - DNA, 22 bp, Homo sapiens
agctgaggaataataacaaggt

SEQ ID NO: 9043910 - DNA, 22 bp, Homo sapiens
agctgaggacgtgaagggcggc

SEQ ID NO: 9043911 - DNA, 21 bp, Homo sapiens
agctctggagcagcaatcaag

SEQ ID NO: 9043912 - DNA, 22 bp, Homo sapiens
cagcctctgacaccacagtcgt

SEQ ID NO: 9043913 - DNA, 22 bp, Homo sapiens
cagcctctgagccttggcagat

SEQ ID NO: 9043914 - DNA, 22 bp, Homo sapiens
cagcggaggacagatgggagct

SEQ ID NO: 9043915 - DNA, 22 bp, Homo sapiens
cagcgctgtgggaacagggcta

SEQ ID NO: 9043916 - DNA, 22 bp, Homo sapiens
aagagtttcttactggcatcta

SEQ ID NO: 9043917 - DNA, 22 bp, Homo sapiens
aaatatagtgacacttatagtc

SEQ ID NO: 9043918 - DNA, 22 bp, Homo sapiens
aaatatagtaaatgcatagttc

SEQ ID NO: 9043919 - DNA, 22 bp, Homo sapiens
aagagttttagacaaactgatt

SEQ ID NO: 9043920 - DNA, 22 bp, Homo sapiens
aagagtttgtcagatctgcacg

SEQ ID NO: 9043921 - DNA, 22 bp, Homo sapiens
aagagtttctttattaaccttt

SEQ ID NO: 9043922 - DNA, 22 bp, Homo sapiens
aagagttttctctgatggcatt

SEQ ID NO: 9043923 - DNA, 22 bp, Homo sapiens
aaatatgagatgttctctttcg

SEQ ID NO: 9043924 - DNA, 22 bp, Homo sapiens
aagagagaccatgggggacagg

SEQ ID NO: 9043925 - DNA, 22 bp, Homo sapiens
aagagagagtgcgctcacagaa

SEQ ID NO: 9043926 - DNA, 22 bp, Homo sapiens
aagagagagtgcgctcacagaa

SEQ ID NO: 9043927 - DNA, 22 bp, Homo sapiens
aaatataatttctgcctcaata

SEQ ID NO: 9043928 - DNA, 22 bp, Homo sapiens
aaatatagcaattatgcctact

SEQ ID NO: 9043929 - DNA, 22 bp, Homo sapiens
aagagagaactcccttcgccag

SEQ ID NO: 9043930 - DNA, 22 bp, Homo sapiens
aaatacagtggcagcagataat

SEQ ID NO: 9043931 - DNA, 22 bp, Homo sapiens
aaatacaggagtttggacttct

SEQ ID NO: 9043932 - DNA, 22 bp, Homo sapiens
aaatacagtgtgtgttctttga

SEQ ID NO: 9043933 - DNA, 22 bp, Homo sapiens
aaatacaaaaattagccaggca

SEQ ID NO: 9043934 - DNA, 22 bp, Homo sapiens
aaatacagattcttgtgtctat

SEQ ID NO: 9043935 - DNA, 22 bp, Homo sapiens
aaatacagattctgactcagag

SEQ ID NO: 9043936 - DNA, 22 bp, Homo sapiens
aaatacaatttcaggctgtaat

SEQ ID NO: 9043937 - DNA, 19 bp, Homo sapiens
aaatacagcagctgtttcc

SEQ ID NO: 9043938 - DNA, 22 bp, Homo sapiens
aaatacagcagactcctgttgt

SEQ ID NO: 9043939 - DNA, 22 bp, Homo sapiens
aaatgatgattaaaatgaggta

SEQ ID NO: 9043940 - DNA, 22 bp, Homo sapiens
aaatgaaatgagtgcctggagg

SEQ ID NO: 9043941 - DNA, 22 bp, Homo sapiens
aaatcagagtctgattttaagg

SEQ ID NO: 9043942 - DNA, 22 bp, Homo sapiens
aaatcagagtctgattttaagg

SEQ ID NO: 9043943 - DNA, 22 bp, Homo sapiens
aaatcagagtctgattttaagg

SEQ ID NO: 9043944 - DNA, 22 bp, Homo sapiens
aaatcagagaatatatttagaa

SEQ ID NO: 9043945 - DNA, 22 bp, Homo sapiens
aaatcagacttgaattttcatc

SEQ ID NO: 9043946 - DNA, 19 bp, Homo sapiens
aaatcagaatctgcatttt

SEQ ID NO: 9043947 - DNA, 22 bp, Homo sapiens
aaatattggtaggatgcttgtt

SEQ ID NO: 9043948 - DNA, 22 bp, Homo sapiens
aaatcacagggtctctaagtat

SEQ ID NO: 9043949 - DNA, 22 bp, Homo sapiens
aaatcaaggagggattatattt

SEQ ID NO: 9043950 - DNA, 22 bp, Homo sapiens
aaatgcacaataaagtaaaggc

SEQ ID NO: 9043951 - DNA, 22 bp, Homo sapiens
aaatgcaattgtatgtactcca

SEQ ID NO: 9043952 - DNA, 22 bp, Homo sapiens
aaatgcaattcaggaagacaag

SEQ ID NO: 9043953 - DNA, 22 bp, Homo sapiens
aaatgcaaggccatgtgaagga

SEQ ID NO: 9043954 - DNA, 22 bp, Homo sapiens
aaatgattgtcaaagttctgtt

SEQ ID NO: 9043955 - DNA, 22 bp, Homo sapiens
aaatgcaaggattttgttaggc

SEQ ID NO: 9043956 - DNA, 22 bp, Homo sapiens
aaatgatgttataagaccagga

SEQ ID NO: 9043957 - DNA, 22 bp, Homo sapiens
aaatgcttattagtgtcacaaa

SEQ ID NO: 9043958 - DNA, 22 bp, Homo sapiens
aaatgcttagaggtgttcaaat

SEQ ID NO: 9043959 - DNA, 22 bp, Homo sapiens
aaatgcttgtaaattttccatg

SEQ ID NO: 9043960 - DNA, 19 bp, Homo sapiens
aaagttctgactgtagagc

SEQ ID NO: 9043961 - DNA, 22 bp, Homo sapiens
aacttgaatgagaacttttgcc

SEQ ID NO: 9043962 - DNA, 22 bp, Homo sapiens
aaagtcctgttaactgttaaca

SEQ ID NO: 9043963 - DNA, 22 bp, Homo sapiens
aaagtcacgctgatgggaaatg

SEQ ID NO: 9043964 - DNA, 22 bp, Homo sapiens
aaaggctttaaaatgtacatat

SEQ ID NO: 9043965 - DNA, 22 bp, Homo sapiens
aaaggctggggactgaggaagg

SEQ ID NO: 9043966 - DNA, 22 bp, Homo sapiens
aaagggaactctaattatcttc

SEQ ID NO: 9043967 - DNA, 22 bp, Homo sapiens
aaagggaggggcgataagccgg

SEQ ID NO: 9043968 - DNA, 22 bp, Homo sapiens
aaagtcacatataacaagggca

SEQ ID NO: 9043969 - DNA, 22 bp, Homo sapiens
aacatgatgtgaagcatgaact

SEQ ID NO: 9043970 - DNA, 22 bp, Homo sapiens
aacatgatttagtataatgcag

SEQ ID NO: 9043971 - DNA, 22 bp, Homo sapiens
aacatgattggaaaatgctgtc

SEQ ID NO: 9043972 - DNA, 22 bp, Homo sapiens
aacatgattggaaaatgctgtc

SEQ ID NO: 9043973 - DNA, 22 bp, Homo sapiens
aacatgatttagtataatgcag

SEQ ID NO: 9043974 - DNA, 22 bp, Homo sapiens
aaagcatttcatgtctagaaag

SEQ ID NO: 9043975 - DNA, 22 bp, Homo sapiens
aaaggaagtgccactcttcttc

SEQ ID NO: 9043976 - DNA, 22 bp, Homo sapiens
aaagcatttcatgtctagaaag

SEQ ID NO: 9043977 - DNA, 22 bp, Homo sapiens
aaagcatgactcaagaattact

SEQ ID NO: 9043978 - DNA, 21 bp, Homo sapiens
aaagcagttcttcctgcctct

SEQ ID NO: 9043979 - DNA, 22 bp, Homo sapiens
aaagcatgattagatagatgat

SEQ ID NO: 9043980 - DNA, 22 bp, Homo sapiens
aaagcatggcatgaagaacatg

SEQ ID NO: 9043981 - DNA, 22 bp, Homo sapiens
aaagcatggttaaagacagtgg

SEQ ID NO: 9043982 - DNA, 22 bp, Homo sapiens
aaagcatgtgaatagaatatgg

SEQ ID NO: 9043983 - DNA, 22 bp, Homo sapiens
aacatgaaggtaggatggtttt

SEQ ID NO: 9043984 - DNA, 22 bp, Homo sapiens
aaaggattagagataccatgcc

SEQ ID NO: 9043985 - DNA, 20 bp, Homo sapiens
aaaggaatatatgaagtata

SEQ ID NO: 9043986 - DNA, 22 bp, Homo sapiens
aaattgtaggatcacatgacct

SEQ ID NO: 9043987 - DNA, 22 bp, Homo sapiens
aaattggattttaaactgttgg

SEQ ID NO: 9043988 - DNA, 22 bp, Homo sapiens
aaattggattgggagaatgtga

SEQ ID NO: 9043989 - DNA, 22 bp, Homo sapiens
aaattgctgggtcccacccaag

SEQ ID NO: 9043990 - DNA, 22 bp, Homo sapiens
aaattgcttgagattagtctcc

SEQ ID NO: 9043991 - DNA, 22 bp, Homo sapiens
aaagcagtagttttcaaatagt

SEQ ID NO: 9043992 - DNA, 22 bp, Homo sapiens
aaagcaggttgcaattacagtg

SEQ ID NO: 9043993 - DNA, 22 bp, Homo sapiens
aaagcagtatgaaaggcaataa

SEQ ID NO: 9043994 - DNA, 22 bp, Homo sapiens
aaagcagtctcagacttaagca

SEQ ID NO: 9043995 - DNA, 22 bp, Homo sapiens
aaattcagttttaataatcact

SEQ ID NO: 9043996 - DNA, 22 bp, Homo sapiens
aaattcagttttaataatcact

SEQ ID NO: 9043997 - DNA, 22 bp, Homo sapiens
aaattgctatatgtgaatgtga

SEQ ID NO: 9043998 - DNA, 22 bp, Homo sapiens
aaattgctctttaaaagtactg

SEQ ID NO: 9043999 - DNA, 22 bp, Homo sapiens
aaattgctctttaaaagtactg

SEQ ID NO: 9044000 - DNA, 22 bp, Homo sapiens
aaattgctgaccaagtatattc

SEQ ID NO: 9044001 - DNA, 22 bp, Homo sapiens
aaattgcttataaagatgaatg

SEQ ID NO: 9044002 - DNA, 22 bp, Homo sapiens
aaattgctgttgggtgactctt

SEQ ID NO: 9044003 - DNA, 22 bp, Homo sapiens
aaattgctgtgaggtggtagta

SEQ ID NO: 9044004 - DNA, 22 bp, Homo sapiens
aaattgctggatcctactccca

SEQ ID NO: 9044005 - DNA, 22 bp, Homo sapiens
aaattgctgacacttgaccatt

SEQ ID NO: 9044006 - DNA, 22 bp, Homo sapiens
aaattgctggcagcctttattc

SEQ ID NO: 9044007 - DNA, 18 bp, Homo sapiens
aaaatgcaggcgacatgg

SEQ ID NO: 9044008 - DNA, 22 bp, Homo sapiens
aaaatggctgtggtctggcaag

SEQ ID NO: 9044009 - DNA, 22 bp, Homo sapiens
aaaatgggtttcttcaacctca

SEQ ID NO: 9044010 - DNA, 22 bp, Homo sapiens
aaaatgtaaagcttgagtgtag

SEQ ID NO: 9044011 - DNA, 22 bp, Homo sapiens
aaaatggtctcagctggcacca

SEQ ID NO: 9044012 - DNA, 22 bp, Homo sapiens
aaaatgagccatgaaccaacca

SEQ ID NO: 9044013 - DNA, 22 bp, Homo sapiens
aaaatgcaaacctacctacata

SEQ ID NO: 9044014 - DNA, 22 bp, Homo sapiens
aaagcaatggatgagaatctgt

SEQ ID NO: 9044015 - DNA, 22 bp, Homo sapiens
aaagcaatggatgagaatctgt

SEQ ID NO: 9044016 - DNA, 22 bp, Homo sapiens
aaagcagcctgctcatcctgga

SEQ ID NO: 9044017 - DNA, 22 bp, Homo sapiens
aaaatctgcttccttttacaga

SEQ ID NO: 9044018 - DNA, 22 bp, Homo sapiens
aaaatactgtggagtgttgaaa

SEQ ID NO: 9044019 - DNA, 22 bp, Homo sapiens
aaaatacacatactaggggaaa

SEQ ID NO: 9044020 - DNA, 22 bp, Homo sapiens
aaaagtttgtgcaaacactcag

SEQ ID NO: 9044021 - DNA, 22 bp, Homo sapiens
aaaagtttgtgcaaacactcag

SEQ ID NO: 9044022 - DNA, 22 bp, Homo sapiens
aaaagtttaagactcattctag

SEQ ID NO: 9044023 - DNA, 22 bp, Homo sapiens
aaaagtttaagactcattctag

SEQ ID NO: 9044024 - DNA, 22 bp, Homo sapiens
aaaagttacctctgtaatataa

SEQ ID NO: 9044025 - DNA, 22 bp, Homo sapiens
aaaaggacaagctttggagtta

SEQ ID NO: 9044026 - DNA, 22 bp, Homo sapiens
aaaagcaggtactcagcttggg

SEQ ID NO: 9044027 - DNA, 22 bp, Homo sapiens
aaaagcctggatactatcatta

SEQ ID NO: 9044028 - DNA, 22 bp, Homo sapiens
aaaagccaaggtcctcttcaga

SEQ ID NO: 9044029 - DNA, 22 bp, Homo sapiens
aaaagcagtttatagtcagttg

SEQ ID NO: 9044030 - DNA, 22 bp, Homo sapiens
aaaagcagatctccaaagtcta

SEQ ID NO: 9044031 - DNA, 22 bp, Homo sapiens
aaaagcagatctccaaagtcta

SEQ ID NO: 9044032 - DNA, 22 bp, Homo sapiens
aaaagcaattgcagttcttgcc

SEQ ID NO: 9044033 - DNA, 22 bp, Homo sapiens
aaaagcaagttgcctaggttga

SEQ ID NO: 9044034 - DNA, 22 bp, Homo sapiens
aaaacactgcaaagctgattgg

SEQ ID NO: 9044035 - DNA, 22 bp, Homo sapiens
aaaacactgcctgcttgactga

SEQ ID NO: 9044036 - DNA, 22 bp, Homo sapiens
aaaacaggtgtcagcaaactat

SEQ ID NO: 9044037 - DNA, 22 bp, Homo sapiens
aaaacaggagttttggtaggct

SEQ ID NO: 9044038 - DNA, 22 bp, Homo sapiens
aaaagatgaaatggtgtcttgg

SEQ ID NO: 9044039 - DNA, 22 bp, Homo sapiens
aaaagcaagaggctggattaaa

SEQ ID NO: 9044040 - DNA, 22 bp, Homo sapiens
aaaagatgaaatggtgtcttgg

SEQ ID NO: 9044041 - DNA, 22 bp, Homo sapiens
aaaaattgctgagaacggaatt

SEQ ID NO: 9044042 - DNA, 22 bp, Homo sapiens
aaaaatgttatctactgtccga

SEQ ID NO: 9044043 - DNA, 20 bp, Homo sapiens
aaaaattgatatcgcttcct

SEQ ID NO: 9044044 - DNA, 22 bp, Homo sapiens
aaaaatctatgactgcttctcc

SEQ ID NO: 9044045 - DNA, 22 bp, Homo sapiens
aaaaatctatgactgcttctcc

SEQ ID NO: 9044046 - DNA, 22 bp, Homo sapiens
aaaacattgaattgcacactat

SEQ ID NO: 9044047 - DNA, 22 bp, Homo sapiens
aaaacattttactgccatctca

SEQ ID NO: 9044048 - DNA, 22 bp, Homo sapiens
aaaacattttactgccatctca

SEQ ID NO: 9044049 - DNA, 22 bp, Homo sapiens
aaaaccagacactgtttctggg

SEQ ID NO: 9044050 - DNA, 22 bp, Homo sapiens
aaaaccaggcgtttcctattat

SEQ ID NO: 9044051 - DNA, 22 bp, Homo sapiens
aaacttcagtgaatgacttatg

SEQ ID NO: 9044052 - DNA, 22 bp, Homo sapiens
aaacttcatggataatataaag

SEQ ID NO: 9044053 - DNA, 22 bp, Homo sapiens
aaatgtctatctggcatattcc

SEQ ID NO: 9044054 - DNA, 22 bp, Homo sapiens
aaatgtctttgagtttttataa

SEQ ID NO: 9044055 - DNA, 23 bp, Homo sapiens
aaatgtgagggaaaatctttctg

SEQ ID NO: 9044056 - DNA, 22 bp, Homo sapiens
aaatacaatttcaggctgtaat

SEQ ID NO: 9044057 - DNA, 22 bp, Homo sapiens
aaatacacgtacatgtgtaaaa

SEQ ID NO: 9044058 - DNA, 22 bp, Homo sapiens
aaatacacgtacatgtgtaaaa

SEQ ID NO: 9044059 - DNA, 22 bp, Homo sapiens
aaatacaatttcaggctgtaat

SEQ ID NO: 9044060 - DNA, 22 bp, Homo sapiens
aaataaaggtccactttagggc

SEQ ID NO: 9044061 - DNA, 22 bp, Homo sapiens
aaataaactgaagcacagagag

SEQ ID NO: 9044062 - DNA, 22 bp, Homo sapiens
aaatacagatagatttaaccca

SEQ ID NO: 9044063 - DNA, 21 bp, Homo sapiens
aaatacagatgcaaatctgtt

SEQ ID NO: 9044064 - DNA, 21 bp, Homo sapiens
aaatacagatgcaaatctgtt

SEQ ID NO: 9044065 - DNA, 22 bp, Homo sapiens
aaatacagagttgcttaaaagc

SEQ ID NO: 9044066 - DNA, 22 bp, Homo sapiens
aaatacagagttgcttaaaagc

SEQ ID NO: 9044067 - DNA, 22 bp, Homo sapiens
aaatacagagttatggacctca

SEQ ID NO: 9044068 - DNA, 21 bp, Homo sapiens
aaatacagaaacttgttttca

SEQ ID NO: 9044069 - DNA, 20 bp, Homo sapiens
aaatccagtgtgtattttac

SEQ ID NO: 9044070 - DNA, 22 bp, Homo sapiens
aaatgacagagtaagctgttta

SEQ ID NO: 9044071 - DNA, 22 bp, Homo sapiens
aaactgttatagcagaaaggac

SEQ ID NO: 9044072 - DNA, 22 bp, Homo sapiens
aaactgttcctttttcagcaac

SEQ ID NO: 9044073 - DNA, 22 bp, Homo sapiens
aaactgttgtggtttatcatta

SEQ ID NO: 9044074 - DNA, 22 bp, Homo sapiens
aaactgttgtggtttatcatta

SEQ ID NO: 9044075 - DNA, 22 bp, Homo sapiens
aaagtcacttccttctgtcagc

SEQ ID NO: 9044076 - DNA, 22 bp, Homo sapiens
aaagtcacttacagctcttttg

SEQ ID NO: 9044077 - DNA, 22 bp, Homo sapiens
aaagtcagttggccagatcact

SEQ ID NO: 9044078 - DNA, 22 bp, Homo sapiens
aaaggttaatgttgtcatgtta

SEQ ID NO: 9044079 - DNA, 22 bp, Homo sapiens
aaagtacagccacatccaagta

SEQ ID NO: 9044080 - DNA, 22 bp, Homo sapiens
aaagtcatctaggagcagattt

SEQ ID NO: 9044081 - DNA, 22 bp, Homo sapiens
aaagtcattgctgttatcaatg

SEQ ID NO: 9044082 - DNA, 22 bp, Homo sapiens
aaagttttgttgattgtggaat

SEQ ID NO: 9044083 - DNA, 22 bp, Homo sapiens
aaagttttctgccttcattaga

SEQ ID NO: 9044084 - DNA, 22 bp, Homo sapiens
aaagttttattcaagcattagt

SEQ ID NO: 9044085 - DNA, 19 bp, Homo sapiens
aaagttttattctcatttg

SEQ ID NO: 9044086 - DNA, 22 bp, Homo sapiens
aaaggactaggtgttgccaaaa

SEQ ID NO: 9044087 - DNA, 22 bp, Homo sapiens
aaaggactcagactgaagggag

SEQ ID NO: 9044088 - DNA, 22 bp, Homo sapiens
aaaggactagtctttctaccat

SEQ ID NO: 9044089 - DNA, 22 bp, Homo sapiens
aaaggactggatattaaagagt

SEQ ID NO: 9044090 - DNA, 22 bp, Homo sapiens
aaaggactgatgctgagtacct

SEQ ID NO: 9044091 - DNA, 22 bp, Homo sapiens
aaaggagaaaacatacaggact

SEQ ID NO: 9044092 - DNA, 22 bp, Homo sapiens
aaaggagacagtcttacctgga

SEQ ID NO: 9044093 - DNA, 22 bp, Homo sapiens
aaaggaggaatggagagatgct

SEQ ID NO: 9044094 - DNA, 22 bp, Homo sapiens
aaaggagataaagggcccttca

SEQ ID NO: 9044095 - DNA, 22 bp, Homo sapiens
aaaggagagtgagtcagatgcc

SEQ ID NO: 9044096 - DNA, 22 bp, Homo sapiens
aaaggagagtaggttactccat

SEQ ID NO: 9044097 - DNA, 22 bp, Homo sapiens
aaaggagacttcagatctcctt

SEQ ID NO: 9044098 - DNA, 22 bp, Homo sapiens
aaagctctcccactgtatgaag

SEQ ID NO: 9044099 - DNA, 23 bp, Homo sapiens
aaagctctgctgcatgtagaata

SEQ ID NO: 9044100 - DNA, 22 bp, Homo sapiens
aaaggaatattcaaaacagtca

SEQ ID NO: 9044101 - DNA, 22 bp, Homo sapiens
aaagctcttaatgagattatcc

SEQ ID NO: 9044102 - DNA, 22 bp, Homo sapiens
aaaggaatgagcttctgttagg

SEQ ID NO: 9044103 - DNA, 22 bp, Homo sapiens
aaagctatttattacagagaat

SEQ ID NO: 9044104 - DNA, 22 bp, Homo sapiens
aaaattttactggtgtttcctt

SEQ ID NO: 9044105 - DNA, 22 bp, Homo sapiens
aagttacacattttcattgtaa

SEQ ID NO: 9044106 - DNA, 22 bp, Homo sapiens
aataatgtacatacatatttcg

SEQ ID NO: 9044107 - DNA, 22 bp, Homo sapiens
aataatgtaggatgataaatga

SEQ ID NO: 9044108 - DNA, 22 bp, Homo sapiens
aataatgtctgctattttaaaa

SEQ ID NO: 9044109 - DNA, 22 bp, Homo sapiens
aatacagatggcatgtgaagat

SEQ ID NO: 9044110 - DNA, 22 bp, Homo sapiens
aatacagatattcagtggtact

SEQ ID NO: 9044111 - DNA, 22 bp, Homo sapiens
aatacagaggcttccagtaaaa

SEQ ID NO: 9044112 - DNA, 22 bp, Homo sapiens
aatacagaggggtcacaattca

SEQ ID NO: 9044113 - DNA, 22 bp, Homo sapiens
aatacagtcttactagaaaatc

SEQ ID NO: 9044114 - DNA, 19 bp, Homo sapiens
aatacagtgttatagaatt

SEQ ID NO: 9044115 - DNA, 21 bp, Homo sapiens
aatacagtgaagaatttcttt

SEQ ID NO: 9044116 - DNA, 20 bp, Homo sapiens
aatataattctctgaattta

SEQ ID NO: 9044117 - DNA, 22 bp, Homo sapiens
aatattgagaaccagcatgttt

SEQ ID NO: 9044118 - DNA, 22 bp, Homo sapiens
aatattgagaaccagcatgttt

SEQ ID NO: 9044119 - DNA, 22 bp, Homo sapiens
aatattgtttcaagatcacaga

SEQ ID NO: 9044120 - DNA, 22 bp, Homo sapiens
aatatttctgtagctatgttct

SEQ ID NO: 9044121 - DNA, 22 bp, Homo sapiens
aatctcactcaaagaattctct

SEQ ID NO: 9044122 - DNA, 20 bp, Homo sapiens
aatctcagtatcctatgcaa

SEQ ID NO: 9044123 - DNA, 17 bp, Homo sapiens
aatctcagtggcttaag

SEQ ID NO: 9044124 - DNA, 22 bp, Homo sapiens
aatgaaatagttggctgtagag

SEQ ID NO: 9044125 - DNA, 22 bp, Homo sapiens
aatgaaagaatgaaacagccca

SEQ ID NO: 9044126 - DNA, 22 bp, Homo sapiens
aatgaaactgtatatagactgt

SEQ ID NO: 9044127 - DNA, 22 bp, Homo sapiens
aatctgcttttgtcatttatga

SEQ ID NO: 9044128 - DNA, 22 bp, Homo sapiens
aatgcagaccagtatgaaaaac

SEQ ID NO: 9044129 - DNA, 19 bp, Homo sapiens
aatgcagagtgtggtcttt

SEQ ID NO: 9044130 - DNA, 22 bp, Homo sapiens
aatgcacctaccttgattctgc

SEQ ID NO: 9044131 - DNA, 22 bp, Homo sapiens
aatgaaatgaagatatgatcag

SEQ ID NO: 9044132 - DNA, 22 bp, Homo sapiens
aactttacactgctttacatga

SEQ ID NO: 9044133 - DNA, 22 bp, Homo sapiens
aactttaaggctataaattatg

SEQ ID NO: 9044134 - DNA, 22 bp, Homo sapiens
aatgtaaacagcaagagaaggg

SEQ ID NO: 9044135 - DNA, 22 bp, Homo sapiens
aatgtaaagttgggcacaaatg

SEQ ID NO: 9044136 - DNA, 22 bp, Homo sapiens
aatgctttcaaaaatgtgcagt

SEQ ID NO: 9044137 - DNA, 22 bp, Homo sapiens
aatgcttatgggttccataata

SEQ ID NO: 9044138 - DNA, 22 bp, Homo sapiens
aatgcttcctcctcacctcagg

SEQ ID NO: 9044139 - DNA, 22 bp, Homo sapiens
aatgcttccaaaataccaagcc

SEQ ID NO: 9044140 - DNA, 22 bp, Homo sapiens
aatgcttcaacctcccacatgt

SEQ ID NO: 9044141 - DNA, 22 bp, Homo sapiens
aatgcttattattaatagaatg

SEQ ID NO: 9044142 - DNA, 22 bp, Homo sapiens
aatgctttaattgcatgtagtg

SEQ ID NO: 9044143 - DNA, 22 bp, Homo sapiens
aatgctttaattgcatgtagtg

SEQ ID NO: 9044144 - DNA, 22 bp, Homo sapiens
aatgctttagcagtgattagtg

SEQ ID NO: 9044145 - DNA, 22 bp, Homo sapiens
aatgcataatggtttgtgacaa

SEQ ID NO: 9044146 - DNA, 22 bp, Homo sapiens
aatgctgtatatcttagctaat

SEQ ID NO: 9044147 - DNA, 22 bp, Homo sapiens
aatgcttatgggttccataata

SEQ ID NO: 9044148 - DNA, 22 bp, Homo sapiens
aatgcttatacctaatgatctt

SEQ ID NO: 9044149 - DNA, 22 bp, Homo sapiens
aatgcttataacgttagaatgt

SEQ ID NO: 9044150 - DNA, 22 bp, Homo sapiens
aatgcttaattcaatactgtgt

SEQ ID NO: 9044151 - DNA, 22 bp, Homo sapiens
aatgctgtcttttctacttcat

SEQ ID NO: 9044152 - DNA, 22 bp, Homo sapiens
aacagtgtcaggattacagata

SEQ ID NO: 9044153 - DNA, 22 bp, Homo sapiens
aacagtgtttttcttcagcact

SEQ ID NO: 9044154 - DNA, 22 bp, Homo sapiens
aagtgctgtttctgatgaatgc

SEQ ID NO: 9044155 - DNA, 22 bp, Homo sapiens
aagtgaaacatgtatctcttta

SEQ ID NO: 9044156 - DNA, 22 bp, Homo sapiens
aagtctgtagaaaaacagttta

SEQ ID NO: 9044157 - DNA, 22 bp, Homo sapiens
aagtcttttgctaagagtaatg

SEQ ID NO: 9044158 - DNA, 22 bp, Homo sapiens
aaggtgtgaagagatgggaaga

SEQ ID NO: 9044159 - DNA, 22 bp, Homo sapiens
aagtaacatctgaacatgatgt

SEQ ID NO: 9044160 - DNA, 22 bp, Homo sapiens
aagtaacatgggaacatctgaa

SEQ ID NO: 9044161 - DNA, 22 bp, Homo sapiens
aagtaaggcagtgaatgagatt

SEQ ID NO: 9044162 - DNA, 22 bp, Homo sapiens
aagtaaggccttcttgagcatg

SEQ ID NO: 9044163 - DNA, 23 bp, Homo sapiens
aagtaacagggataatagcagtt

SEQ ID NO: 9044164 - DNA, 23 bp, Homo sapiens
aaggtgttctgtatttaactcag

SEQ ID NO: 9044165 - DNA, 22 bp, Homo sapiens
aagtacaatctttctgtaaagg

SEQ ID NO: 9044166 - DNA, 22 bp, Homo sapiens
aagtacaacgcatacagagaaa

SEQ ID NO: 9044167 - DNA, 22 bp, Homo sapiens
aagtacaaattttgaagagctt

SEQ ID NO: 9044168 - DNA, 22 bp, Homo sapiens
aagggaggccagaggttttgca

SEQ ID NO: 9044169 - DNA, 22 bp, Homo sapiens
aaggccatctacttacggaatt

SEQ ID NO: 9044170 - DNA, 22 bp, Homo sapiens
aaggccattgtaatgtaaatat

SEQ ID NO: 9044171 - DNA, 22 bp, Homo sapiens
aaggatatttggctacagaagc

SEQ ID NO: 9044172 - DNA, 22 bp, Homo sapiens
aaggatcaagtggattttctta

SEQ ID NO: 9044173 - DNA, 22 bp, Homo sapiens
aaggcactgaacttaaattctg

SEQ ID NO: 9044174 - DNA, 22 bp, Homo sapiens
aaggagtctgggccattcagag

SEQ ID NO: 9044175 - DNA, 22 bp, Homo sapiens
aaggagtctgggccattcagag

SEQ ID NO: 9044176 - DNA, 22 bp, Homo sapiens
aaatggagttctaagtatagta

SEQ ID NO: 9044177 - DNA, 22 bp, Homo sapiens
aaggagaagggtaatcaacaca

SEQ ID NO: 9044178 - DNA, 22 bp, Homo sapiens
aaggagaagtctgttgagattg

SEQ ID NO: 9044179 - DNA, 22 bp, Homo sapiens
acacataagcctaatcatctcc

SEQ ID NO: 9044180 - DNA, 22 bp, Homo sapiens
acacatacatggggaagatgag

SEQ ID NO: 9044181 - DNA, 22 bp, Homo sapiens
aagatacacgttgtattgaata

SEQ ID NO: 9044182 - DNA, 22 bp, Homo sapiens
acacataagaaactacaaagag

SEQ ID NO: 9044183 - DNA, 22 bp, Homo sapiens
aagatacatcaaagcaaattgg

SEQ ID NO: 9044184 - DNA, 22 bp, Homo sapiens
acacttctttgtcacctgcttc

SEQ ID NO: 9044185 - DNA, 22 bp, Homo sapiens
acagaaagatgatttgaaatgg

SEQ ID NO: 9044186 - DNA, 22 bp, Homo sapiens
acactttaagcatttcacactg

SEQ ID NO: 9044187 - DNA, 22 bp, Homo sapiens
acacttggagcaacacttatgg

SEQ ID NO: 9044188 - DNA, 22 bp, Homo sapiens
acagactggcctgtctcgcacc

SEQ ID NO: 9044189 - DNA, 23 bp, Homo sapiens
acagaaagttctgctggacagag

SEQ ID NO: 9044190 - DNA, 22 bp, Homo sapiens
acagaaatatagaaggtaggaa

SEQ ID NO: 9044191 - DNA, 23 bp, Homo sapiens
acagaaatcatttgtaaggtacc

SEQ ID NO: 9044192 - DNA, 23 bp, Homo sapiens
acagaaatcatttgtaaggtacc

SEQ ID NO: 9044193 - DNA, 22 bp, Homo sapiens
acagcaggttacagtggcacag

SEQ ID NO: 9044194 - DNA, 21 bp, Homo sapiens
aagcagggactgcccaggtcc

SEQ ID NO: 9044195 - DNA, 22 bp, Homo sapiens
aagcaggacgtatttctatcct

SEQ ID NO: 9044196 - DNA, 20 bp, Homo sapiens
aagcagtgaggtgaggagtg

SEQ ID NO: 9044197 - DNA, 22 bp, Homo sapiens
aagcagtgataagagctaccat

SEQ ID NO: 9044198 - DNA, 22 bp, Homo sapiens
aagcagtgatgcatacagctgt

SEQ ID NO: 9044199 - DNA, 22 bp, Homo sapiens
aagcagttactatttactatta

SEQ ID NO: 9044200 - DNA, 22 bp, Homo sapiens
aagcataaaacgttacaacatg

SEQ ID NO: 9044201 - DNA, 22 bp, Homo sapiens
acagcaggaagctggagggaaa

SEQ ID NO: 9044202 - DNA, 22 bp, Homo sapiens
aagcagtttttcaactgtttag

SEQ ID NO: 9044203 - DNA, 22 bp, Homo sapiens
acagcagggggagctgttggac

SEQ ID NO: 9044204 - DNA, 22 bp, Homo sapiens
aagaatcatctgaactttgagg

SEQ ID NO: 9044205 - DNA, 22 bp, Homo sapiens
aagaatatagattttttgaagt

SEQ ID NO: 9044206 - DNA, 22 bp, Homo sapiens
aagaatatctgttttatttagg

SEQ ID NO: 9044207 - DNA, 22 bp, Homo sapiens
aagaatatctgttttatttagg

SEQ ID NO: 9044208 - DNA, 22 bp, Homo sapiens
acaaaagcactgcagagtaagc

SEQ ID NO: 9044209 - DNA, 22 bp, Homo sapiens
acaaaagaataagatgagtcat

SEQ ID NO: 9044210 - DNA, 21 bp, Homo sapiens
acaaaagaagctgccttttaa

SEQ ID NO: 9044211 - DNA, 22 bp, Homo sapiens
aagaatctctgatcaggcttta

SEQ ID NO: 9044212 - DNA, 22 bp, Homo sapiens
aagaatctccattcctgtttta

SEQ ID NO: 9044213 - DNA, 22 bp, Homo sapiens
acaaatgaacctgaaatctcag

SEQ ID NO: 9044214 - DNA, 19 bp, Homo sapiens
acaaattgtcctcatcaag

SEQ ID NO: 9044215 - DNA, 22 bp, Homo sapiens
acaaatgactatttggtacagg

SEQ ID NO: 9044216 - DNA, 22 bp, Homo sapiens
acaaatgaatcatacataatgt

SEQ ID NO: 9044217 - DNA, 22 bp, Homo sapiens
acaaatgaacatataagcttga

SEQ ID NO: 9044218 - DNA, 22 bp, Homo sapiens
acaaatccagtgaactccagtg

SEQ ID NO: 9044219 - DNA, 19 bp, Homo sapiens
aagaagcaataagctgtga

SEQ ID NO: 9044220 - DNA, 22 bp, Homo sapiens
acaaaaagggagatgaggtaga

SEQ ID NO: 9044221 - DNA, 22 bp, Homo sapiens
aagaagaagtgttatttttaga

SEQ ID NO: 9044222 - DNA, 22 bp, Homo sapiens
aagaacattttgtagaatgaca

SEQ ID NO: 9044223 - DNA, 22 bp, Homo sapiens
aagaacattgatattgtctatg

SEQ ID NO: 9044224 - DNA, 22 bp, Homo sapiens
aagaactagtcttacagcctca

SEQ ID NO: 9044225 - DNA, 22 bp, Homo sapiens
acaatgttctctgagttgtgtg

SEQ ID NO: 9044226 - DNA, 22 bp, Homo sapiens
acaatgttctgtctgacttgtc

SEQ ID NO: 9044227 - DNA, 17 bp, Homo sapiens
acacagacaggcagaca

SEQ ID NO: 9044228 - DNA, 20 bp, Homo sapiens
acacagactcagcttggatg

SEQ ID NO: 9044229 - DNA, 22 bp, Homo sapiens
acacagaagctttttctattcc

SEQ ID NO: 9044230 - DNA, 17 bp, Homo sapiens
acacagagattaacaca

SEQ ID NO: 9044231 - DNA, 17 bp, Homo sapiens
acacagagattaacaca

SEQ ID NO: 9044232 - DNA, 22 bp, Homo sapiens
acacagagcaaatcatgacaga

SEQ ID NO: 9044233 - DNA, 22 bp, Homo sapiens
acacagagcaaatcatgacaga

SEQ ID NO: 9044234 - DNA, 22 bp, Homo sapiens
acacagagccaaaccatatcac

SEQ ID NO: 9044235 - DNA, 22 bp, Homo sapiens
aagagtttatgatataacatgt

SEQ ID NO: 9044236 - DNA, 22 bp, Homo sapiens
aagataagtaacgagcctcagt

SEQ ID NO: 9044237 - DNA, 22 bp, Homo sapiens
aagatacaaatgtcaatattgg

SEQ ID NO: 9044238 - DNA, 22 bp, Homo sapiens
acaacaaaatcactagtcttcc

SEQ ID NO: 9044239 - DNA, 22 bp, Homo sapiens
acaaattgttgcttcatgaatg

SEQ ID NO: 9044240 - DNA, 22 bp, Homo sapiens
acaaattgttgcttcatgaatg

SEQ ID NO: 9044241 - DNA, 22 bp, Homo sapiens
acaaatttcataggcaaatttt

SEQ ID NO: 9044242 - DNA, 22 bp, Homo sapiens
acaatgtaggctgaaaaagctt

SEQ ID NO: 9044243 - DNA, 22 bp, Homo sapiens
acaatattgtacccagaagttt

SEQ ID NO: 9044244 - DNA, 22 bp, Homo sapiens
acctctggacactgcatccttc

SEQ ID NO: 9044245 - DNA, 23 bp, Homo sapiens
aagtagataacactgttctgaga

SEQ ID NO: 9044246 - DNA, 22 bp, Homo sapiens
aaggtacagggtattagattat

SEQ ID NO: 9044247 - DNA, 22 bp, Homo sapiens
aaggtacaaagttatacagcgt

SEQ ID NO: 9044248 - DNA, 22 bp, Homo sapiens
aaggtacaaagtattatttaaa

SEQ ID NO: 9044249 - DNA, 22 bp, Homo sapiens
aagggtttgtctccctcaaggc

SEQ ID NO: 9044250 - DNA, 22 bp, Homo sapiens
aaggtaatatttttctctctaa

SEQ ID NO: 9044251 - DNA, 22 bp, Homo sapiens
aaggtaatcagcctttccacaa

SEQ ID NO: 9044252 - DNA, 22 bp, Homo sapiens
aaggtaatgaaacagcagctaa

SEQ ID NO: 9044253 - DNA, 22 bp, Homo sapiens
aaggggaagagaccgcagagtc

SEQ ID NO: 9044254 - DNA, 22 bp, Homo sapiens
aagggaggtaaagctatttaaa

SEQ ID NO: 9044255 - DNA, 22 bp, Homo sapiens
acatgcatgtgaatatggacac

SEQ ID NO: 9044256 - DNA, 22 bp, Homo sapiens
aagggaggggatgtaagcctgg

SEQ ID NO: 9044257 - DNA, 20 bp, Homo sapiens
aagggagaataatgattgta

SEQ ID NO: 9044258 - DNA, 22 bp, Homo sapiens
aagggatgcaggaaagaaggtt

SEQ ID NO: 9044259 - DNA, 22 bp, Homo sapiens
acatttcagtgagctattgaag

SEQ ID NO: 9044260 - DNA, 19 bp, Homo sapiens
aaggaatggctttaagtag

SEQ ID NO: 9044261 - DNA, 22 bp, Homo sapiens
aaggaattccctttctgacaga

SEQ ID NO: 9044262 - DNA, 22 bp, Homo sapiens
aaggacaaagcagagctggatg

SEQ ID NO: 9044263 - DNA, 22 bp, Homo sapiens
aaggaaggttcatagtcaaaga

SEQ ID NO: 9044264 - DNA, 22 bp, Homo sapiens
aaggaagctgttagacatgcat

SEQ ID NO: 9044265 - DNA, 22 bp, Homo sapiens
aaggaagcagcaatgcatgatt

SEQ ID NO: 9044266 - DNA, 22 bp, Homo sapiens
aaggaagccttgcctgaataca

SEQ ID NO: 9044267 - DNA, 22 bp, Homo sapiens
aaggaagcagccagagaccctc

SEQ ID NO: 9044268 - DNA, 22 bp, Homo sapiens
aaggacagaaacagattgctgg

SEQ ID NO: 9044269 - DNA, 22 bp, Homo sapiens
aaggacaatgaagacagccaca

SEQ ID NO: 9044270 - DNA, 22 bp, Homo sapiens
aaggatttgtccaaagtcacac

SEQ ID NO: 9044271 - DNA, 22 bp, Homo sapiens
aaggaggcctggcagatgaaga

SEQ ID NO: 9044272 - DNA, 22 bp, Homo sapiens
aaggatgattggtaatgacact

SEQ ID NO: 9044273 - DNA, 22 bp, Homo sapiens
aaggatgcagggacccaaggct

SEQ ID NO: 9044274 - DNA, 22 bp, Homo sapiens
aaggatgaacattaatacatca

SEQ ID NO: 9044275 - DNA, 22 bp, Homo sapiens
aagctgtgaaatctctagtgca

SEQ ID NO: 9044276 - DNA, 23 bp, Homo sapiens
aagcttctatctctgcagaagga

SEQ ID NO: 9044277 - DNA, 22 bp, Homo sapiens
aagcttcttagaatgcatgtgc

SEQ ID NO: 9044278 - DNA, 22 bp, Homo sapiens
aaggcaatgtaaattacagctt

SEQ ID NO: 9044279 - DNA, 22 bp, Homo sapiens
aaggcaatgactgatttagaat

SEQ ID NO: 9044280 - DNA, 22 bp, Homo sapiens
aaggcaatagtattaaactgga

SEQ ID NO: 9044281 - DNA, 22 bp, Homo sapiens
aaggcaactgtaaaacatgcac

SEQ ID NO: 9044282 - DNA, 22 bp, Homo sapiens
aaggcacagaggcagggcactt

SEQ ID NO: 9044283 - DNA, 22 bp, Homo sapiens
aaggcaattggcttgtataaga

SEQ ID NO: 9044284 - DNA, 22 bp, Homo sapiens
acatccattttgttcaaaagca

SEQ ID NO: 9044285 - DNA, 22 bp, Homo sapiens
acatcccacagaaacatacata

SEQ ID NO: 9044286 - DNA, 22 bp, Homo sapiens
acatgacagtgactttataaga

SEQ ID NO: 9044287 - DNA, 22 bp, Homo sapiens
aatagcttagtcctgattctgt

SEQ ID NO: 9044288 - DNA, 22 bp, Homo sapiens
aatagtaaaagatacagctaat

SEQ ID NO: 9044289 - DNA, 22 bp, Homo sapiens
aatagctttggtcaccatctgg

SEQ ID NO: 9044290 - DNA, 22 bp, Homo sapiens
aatagctttctcatgacttcac

SEQ ID NO: 9044291 - DNA, 22 bp, Homo sapiens
aatagcttggacccattgcttt

SEQ ID NO: 9044292 - DNA, 22 bp, Homo sapiens
acttttcaaatgggaaactcag

SEQ ID NO: 9044293 - DNA, 22 bp, Homo sapiens
aatcaagagttgtgtaatattt

SEQ ID NO: 9044294 - DNA, 22 bp, Homo sapiens
aatctacatagagatcaaatga

SEQ ID NO: 9044295 - DNA, 22 bp, Homo sapiens
aatctagattcggatcaaaggg

SEQ ID NO: 9044296 - DNA, 22 bp, Homo sapiens
aatctagagttcccagcataaa

SEQ ID NO: 9044297 - DNA, 22 bp, Homo sapiens
aatcgcttggtaattttaaaag

SEQ ID NO: 9044298 - DNA, 22 bp, Homo sapiens
agaaagggagcgtggatcaatt

SEQ ID NO: 9044299 - DNA, 22 bp, Homo sapiens
agaaagggaactggcaaagcca

SEQ ID NO: 9044300 - DNA, 22 bp, Homo sapiens
aatcacatagccatctctttga

SEQ ID NO: 9044301 - DNA, 22 bp, Homo sapiens
agaagccagaggcagtgggtac

SEQ ID NO: 9044302 - DNA, 22 bp, Homo sapiens
aatgaatgaaccacatataaca

SEQ ID NO: 9044303 - DNA, 22 bp, Homo sapiens
agaacaattgccccaaagcttg

SEQ ID NO: 9044304 - DNA, 22 bp, Homo sapiens
agaactgtcacgagtgacaaag

SEQ ID NO: 9044305 - DNA, 17 bp, Homo sapiens
agaactgtagtagctcc

SEQ ID NO: 9044306 - DNA, 20 bp, Homo sapiens
agaactgttgtttgggtcct

SEQ ID NO: 9044307 - DNA, 22 bp, Homo sapiens
agaactgtgccaaaaattttgt

SEQ ID NO: 9044308 - DNA, 22 bp, Homo sapiens
agaaggaagccaggagggtgca

SEQ ID NO: 9044309 - DNA, 22 bp, Homo sapiens
agaaggaaacagctgtgctttg

SEQ ID NO: 9044310 - DNA, 22 bp, Homo sapiens
agaaggaaggaagcattctgtt

SEQ ID NO: 9044311 - DNA, 22 bp, Homo sapiens
agaaggaaggaagcattctgtt

SEQ ID NO: 9044312 - DNA, 22 bp, Homo sapiens
agaaggaaggataactgcatta

SEQ ID NO: 9044313 - DNA, 22 bp, Homo sapiens
agaaggaaggctgagtgctgat

SEQ ID NO: 9044314 - DNA, 22 bp, Homo sapiens
agaaggaaaacctgtcttatgt

SEQ ID NO: 9044315 - DNA, 22 bp, Homo sapiens
agaagctgtggtatgaaatgtg

SEQ ID NO: 9044316 - DNA, 22 bp, Homo sapiens
agaagccagattgtagtgggac

SEQ ID NO: 9044317 - DNA, 21 bp, Homo sapiens
aatgcattaacataaagctga

SEQ ID NO: 9044318 - DNA, 23 bp, Homo sapiens
aatgcattaatttgggagagtac

SEQ ID NO: 9044319 - DNA, 22 bp, Homo sapiens
aatgcattgattgctggaaata

SEQ ID NO: 9044320 - DNA, 22 bp, Homo sapiens
aatgcattgattgctggaaata

SEQ ID NO: 9044321 - DNA, 22 bp, Homo sapiens
aatgcattaaagttagagactt

SEQ ID NO: 9044322 - DNA, 22 bp, Homo sapiens
aatgcatatgtaggcaagcagt

SEQ ID NO: 9044323 - DNA, 21 bp, Homo sapiens
aatgccagtcccagggaatgc

SEQ ID NO: 9044324 - DNA, 18 bp, Homo sapiens
aatgcatttatggagatg

SEQ ID NO: 9044325 - DNA, 22 bp, Homo sapiens
actctttattgtttgtggctag

SEQ ID NO: 9044326 - DNA, 18 bp, Homo sapiens
actgcaggagaggtgagg

SEQ ID NO: 9044327 - DNA, 22 bp, Homo sapiens
actgcaggagacacagctgctg

SEQ ID NO: 9044328 - DNA, 22 bp, Homo sapiens
actgcatgtaaggcaatatgtt

SEQ ID NO: 9044329 - DNA, 22 bp, Homo sapiens
aagttttattggctatagcact

SEQ ID NO: 9044330 - DNA, 22 bp, Homo sapiens
actgcatctgaaacatgggtca

SEQ ID NO: 9044331 - DNA, 22 bp, Homo sapiens
actgcatctgaactgtgaatgg

SEQ ID NO: 9044332 - DNA, 22 bp, Homo sapiens
actgcatgataataatagcaga

SEQ ID NO: 9044333 - DNA, 22 bp, Homo sapiens
actgcaggccttggtgccagca

SEQ ID NO: 9044334 - DNA, 19 bp, Homo sapiens
actgcagggaggaggtgtg

SEQ ID NO: 9044335 - DNA, 22 bp, Homo sapiens
actgcagggcatcctggccaag

SEQ ID NO: 9044336 - DNA, 22 bp, Homo sapiens
actcttgaactgattaagaatg

SEQ ID NO: 9044337 - DNA, 22 bp, Homo sapiens
aagtgtttacttaaagtcatgg

SEQ ID NO: 9044338 - DNA, 22 bp, Homo sapiens
aagtgtttacttaaagtcatgg

SEQ ID NO: 9044339 - DNA, 22 bp, Homo sapiens
aagtgtttcaataatttggacc

SEQ ID NO: 9044340 - DNA, 22 bp, Homo sapiens
aagtgtttaaattatttgcagg

SEQ ID NO: 9044341 - DNA, 22 bp, Homo sapiens
aagtgtgatttgtagaatgcct

SEQ ID NO: 9044342 - DNA, 22 bp, Homo sapiens
aagtgtgggaagtaggtggcga

SEQ ID NO: 9044343 - DNA, 22 bp, Homo sapiens
aagtgtgggactagggctccag

SEQ ID NO: 9044344 - DNA, 22 bp, Homo sapiens
aagtgtgggactagggctccag

SEQ ID NO: 9044345 - DNA, 22 bp, Homo sapiens
aataatacatgagattaatgtt

SEQ ID NO: 9044346 - DNA, 22 bp, Homo sapiens
actggctgatatggctaggaag

SEQ ID NO: 9044347 - DNA, 22 bp, Homo sapiens
actggctgagtttatgttcaca

SEQ ID NO: 9044348 - DNA, 22 bp, Homo sapiens
aagtttttggtagagaaaagta

SEQ ID NO: 9044349 - DNA, 20 bp, Homo sapiens
aagttttctccaaatacagt

SEQ ID NO: 9044350 - DNA, 22 bp, Homo sapiens
actgtacacagtggtgtactgt

SEQ ID NO: 9044351 - DNA, 22 bp, Homo sapiens
actgtcatgcattatggcatgt

SEQ ID NO: 9044352 - DNA, 21 bp, Homo sapiens
actgtcatttgcttagggagg

SEQ ID NO: 9044353 - DNA, 22 bp, Homo sapiens
actgtcatgcattatggcatgt

SEQ ID NO: 9044354 - DNA, 22 bp, Homo sapiens
actgtcatgtgctaactgtcca

SEQ ID NO: 9044355 - DNA, 22 bp, Homo sapiens
actgtcattaatgaatgtaata

SEQ ID NO: 9044356 - DNA, 22 bp, Homo sapiens
actgtacacgtgtcatttacag

SEQ ID NO: 9044357 - DNA, 22 bp, Homo sapiens
actgtacatatggattctaaga

SEQ ID NO: 9044358 - DNA, 22 bp, Homo sapiens
aatagcaaatgctcatttgaaa

SEQ ID NO: 9044359 - DNA, 22 bp, Homo sapiens
aatagcaaacagacatgcacaa

SEQ ID NO: 9044360 - DNA, 22 bp, Homo sapiens
aatagcagttaaaaatcagccc

SEQ ID NO: 9044361 - DNA, 22 bp, Homo sapiens
acaaagtcacaataattaacct

SEQ ID NO: 9044362 - DNA, 22 bp, Homo sapiens
acaaagtatttttaggtttgta

SEQ ID NO: 9044363 - DNA, 22 bp, Homo sapiens
acaaagttattctttcagagga

SEQ ID NO: 9044364 - DNA, 22 bp, Homo sapiens
acaaagttattctttcagagga

SEQ ID NO: 9044365 - DNA, 22 bp, Homo sapiens
acaaagtgctgacattacaggc

SEQ ID NO: 9044366 - DNA, 22 bp, Homo sapiens
acaacagagctggactgagagg

SEQ ID NO: 9044367 - DNA, 23 bp, Homo sapiens
acaacaggaaatcagacctgaac

SEQ ID NO: 9044368 - DNA, 22 bp, Homo sapiens
agatgctgattgaatagatttc

SEQ ID NO: 9044369 - DNA, 22 bp, Homo sapiens
agatgcagatttggattcagga

SEQ ID NO: 9044370 - DNA, 22 bp, Homo sapiens
agatgcagagtttgctgtggac

SEQ ID NO: 9044371 - DNA, 22 bp, Homo sapiens
agatgcagacttggttcaggca

SEQ ID NO: 9044372 - DNA, 21 bp, Homo sapiens
agatgcagtttgcaggtgggt

SEQ ID NO: 9044373 - DNA, 22 bp, Homo sapiens
aatttctcaattgttacaggtg

SEQ ID NO: 9044374 - DNA, 22 bp, Homo sapiens
aatttgattccctgcacctgtt

SEQ ID NO: 9044375 - DNA, 22 bp, Homo sapiens
agagttaagacgtacatgagtg

SEQ ID NO: 9044376 - DNA, 22 bp, Homo sapiens
agagttaatgcaggccaagcct

SEQ ID NO: 9044377 - DNA, 22 bp, Homo sapiens
agagttatggacttaatgcagg

SEQ ID NO: 9044378 - DNA, 22 bp, Homo sapiens
agagtgtaccaaatatcctaca

SEQ ID NO: 9044379 - DNA, 22 bp, Homo sapiens
agagtgtgtctatggaaggggt

SEQ ID NO: 9044380 - DNA, 20 bp, Homo sapiens
agagtgggtgtcacaggctg

SEQ ID NO: 9044381 - DNA, 22 bp, Homo sapiens
agagtgggttataggcagactt

SEQ ID NO: 9044382 - DNA, 22 bp, Homo sapiens
acaatagaaataattaagcaca

SEQ ID NO: 9044383 - DNA, 20 bp, Homo sapiens
acaatacaggttgtgtctga

SEQ ID NO: 9044384 - DNA, 22 bp, Homo sapiens
acaatacaggcttctggactta

SEQ ID NO: 9044385 - DNA, 22 bp, Homo sapiens
acaatacaggcttctggactta

SEQ ID NO: 9044386 - DNA, 20 bp, Homo sapiens
acaatacaggttgtgtctga

SEQ ID NO: 9044387 - DNA, 22 bp, Homo sapiens
acaagtttcattgtttagaacc

SEQ ID NO: 9044388 - DNA, 22 bp, Homo sapiens
agcaaatacttgaataaaaaga

SEQ ID NO: 9044389 - DNA, 22 bp, Homo sapiens
agcaaatacatttttagcataa

SEQ ID NO: 9044390 - DNA, 22 bp, Homo sapiens
agcaaatacttgaataaaaaga

SEQ ID NO: 9044391 - DNA, 22 bp, Homo sapiens
acaacagtccagtatagactgt

SEQ ID NO: 9044392 - DNA, 22 bp, Homo sapiens
acaacattatacatagaaagct

SEQ ID NO: 9044393 - DNA, 18 bp, Homo sapiens
agattttgagaaatacaa

SEQ ID NO: 9044394 - DNA, 22 bp, Homo sapiens
agattttggctggctggagaga

SEQ ID NO: 9044395 - DNA, 22 bp, Homo sapiens
acaacattcttaaatacactga

SEQ ID NO: 9044396 - DNA, 23 bp, Homo sapiens
agcaaataatctgcttgcttttt

SEQ ID NO: 9044397 - DNA, 19 bp, Homo sapiens
agcaaatacatcaaaattg

SEQ ID NO: 9044398 - DNA, 22 bp, Homo sapiens
agcaaataattgtctttgaggg

SEQ ID NO: 9044399 - DNA, 22 bp, Homo sapiens
agcacaaatataaaaatgtctg

SEQ ID NO: 9044400 - DNA, 22 bp, Homo sapiens
acaatttttcaaagaagcttat

SEQ ID NO: 9044401 - DNA, 22 bp, Homo sapiens
acacaaaatcaaagtcctaggc

SEQ ID NO: 9044402 - DNA, 22 bp, Homo sapiens
acacaagaagttaatgggcaaa

SEQ ID NO: 9044403 - DNA, 22 bp, Homo sapiens
agagcaacgaggtgatactaga

SEQ ID NO: 9044404 - DNA, 22 bp, Homo sapiens
agagaagggcctgtatgtaatc

SEQ ID NO: 9044405 - DNA, 22 bp, Homo sapiens
agagaaggggtaaagagtcctg

SEQ ID NO: 9044406 - DNA, 22 bp, Homo sapiens
agagaaatgattcctgggcaga

SEQ ID NO: 9044407 - DNA, 22 bp, Homo sapiens
agagaaggcatagaacttgagt

SEQ ID NO: 9044408 - DNA, 22 bp, Homo sapiens
aatgccttgcctgctacaactt

SEQ ID NO: 9044409 - DNA, 22 bp, Homo sapiens
agacatctcccatgcattttta

SEQ ID NO: 9044410 - DNA, 22 bp, Homo sapiens
aatgtataatatttaatgcttt

SEQ ID NO: 9044411 - DNA, 22 bp, Homo sapiens
aatgtataatatttaatgcttt

SEQ ID NO: 9044412 - DNA, 20 bp, Homo sapiens
aatgtatattttatgccagg

SEQ ID NO: 9044413 - DNA, 22 bp, Homo sapiens
aatgtatgagcgtgaaagcact

SEQ ID NO: 9044414 - DNA, 22 bp, Homo sapiens
agacattatgctgagtgaaaga

SEQ ID NO: 9044415 - DNA, 22 bp, Homo sapiens
agacatggagaaggagccagtg

SEQ ID NO: 9044416 - DNA, 22 bp, Homo sapiens
agagcacagaagttatatgtta

SEQ ID NO: 9044417 - DNA, 22 bp, Homo sapiens
aattaatggaaagtaaggaagg

SEQ ID NO: 9044418 - DNA, 22 bp, Homo sapiens
aattacaaatgtagactctcat

SEQ ID NO: 9044419 - DNA, 21 bp, Homo sapiens
aattacagatggaattacaga

SEQ ID NO: 9044420 - DNA, 22 bp, Homo sapiens
aattcatatggatatgctagta

SEQ ID NO: 9044421 - DNA, 22 bp, Homo sapiens
agagctgagcaccaagcatggt

SEQ ID NO: 9044422 - DNA, 22 bp, Homo sapiens
agagctgatttgattacagtgc

SEQ ID NO: 9044423 - DNA, 22 bp, Homo sapiens
agagctgagcaccaagcatggt

SEQ ID NO: 9044424 - DNA, 22 bp, Homo sapiens
agagctgcccacacagcagatt

SEQ ID NO: 9044425 - DNA, 22 bp, Homo sapiens
agagctgccgagctggggccat

SEQ ID NO: 9044426 - DNA, 22 bp, Homo sapiens
agagctgcagggtggacccagg

SEQ ID NO: 9044427 - DNA, 22 bp, Homo sapiens
aatttctaattgaatctctctt

SEQ ID NO: 9044428 - DNA, 22 bp, Homo sapiens
aatttcacagctggtctatggg

SEQ ID NO: 9044429 - DNA, 22 bp, Homo sapiens
aattccagctaggaaaagcttc

SEQ ID NO: 9044430 - DNA, 22 bp, Homo sapiens
aattccagctgattgactttcc

SEQ ID NO: 9044431 - DNA, 22 bp, Homo sapiens
aattccagaccacaagtgattt

SEQ ID NO: 9044432 - DNA, 22 bp, Homo sapiens
aattccagcctcagttctatta

SEQ ID NO: 9044433 - DNA, 22 bp, Homo sapiens
aattccagcctcagttctatta

SEQ ID NO: 9044434 - DNA, 22 bp, Homo sapiens
agcagggagaccatctcttcct

SEQ ID NO: 9044435 - DNA, 22 bp, Homo sapiens
agcagggactacgtgaaagtga

SEQ ID NO: 9044436 - DNA, 22 bp, Homo sapiens
agcagggactgagccagtggga

SEQ ID NO: 9044437 - DNA, 19 bp, Homo sapiens
agcagggacatggaacttt

SEQ ID NO: 9044438 - DNA, 22 bp, Homo sapiens
agcagggacatggcatctctcc

SEQ ID NO: 9044439 - DNA, 22 bp, Homo sapiens
agcagggactacgtgaaagtga

SEQ ID NO: 9044440 - DNA, 22 bp, Homo sapiens
agcagggaatagcggaaagaat

SEQ ID NO: 9044441 - DNA, 22 bp, Homo sapiens
acacatcagaaatatgaatgag

SEQ ID NO: 9044442 - DNA, 22 bp, Homo sapiens
acacatatgtcattgaaaaatc

SEQ ID NO: 9044443 - DNA, 22 bp, Homo sapiens
acacatctcaggggacactctc

SEQ ID NO: 9044444 - DNA, 22 bp, Homo sapiens
acacatcatgccaagtttcacc

SEQ ID NO: 9044445 - DNA, 22 bp, Homo sapiens
acacatcatgccaagtttcacc

SEQ ID NO: 9044446 - DNA, 22 bp, Homo sapiens
agcagggaagcctccagaacct

SEQ ID NO: 9044447 - DNA, 22 bp, Homo sapiens
acacataagaaactacaaagag

SEQ ID NO: 9044448 - DNA, 18 bp, Homo sapiens
acacacacacctgtgtat

SEQ ID NO: 9044449 - DNA, 22 bp, Homo sapiens
acacacacaagcaggttgtgga

SEQ ID NO: 9044450 - DNA, 22 bp, Homo sapiens
acacaagaataatgatgaaggt

SEQ ID NO: 9044451 - DNA, 22 bp, Homo sapiens
acacaagaataatgatgaaggt

SEQ ID NO: 9044452 - DNA, 22 bp, Homo sapiens
acacaagggcctatagtgtatt

SEQ ID NO: 9044453 - DNA, 22 bp, Homo sapiens
acacaagattgtgtattgaatt

SEQ ID NO: 9044454 - DNA, 22 bp, Homo sapiens
acacacaactcattgtgtaata

SEQ ID NO: 9044455 - DNA, 22 bp, Homo sapiens
acacaatttcctgtccatatgt

SEQ ID NO: 9044456 - DNA, 22 bp, Homo sapiens
acacaatttcataaacaccatg

SEQ ID NO: 9044457 - DNA, 21 bp, Homo sapiens
acacaattcttgcttggcctt

SEQ ID NO: 9044458 - DNA, 22 bp, Homo sapiens
acacaattgactgttgtccctt

SEQ ID NO: 9044459 - DNA, 22 bp, Homo sapiens
agcatttaattacagtttaatt

SEQ ID NO: 9044460 - DNA, 22 bp, Homo sapiens
agcatttacctcaatgcatctg

SEQ ID NO: 9044461 - DNA, 22 bp, Homo sapiens
agcaggtggtaggcagtcagca

SEQ ID NO: 9044462 - DNA, 22 bp, Homo sapiens
acacttaagcatgaagtataaa

SEQ ID NO: 9044463 - DNA, 22 bp, Homo sapiens
acacttaacttctgagaataaa

SEQ ID NO: 9044464 - DNA, 22 bp, Homo sapiens
acacttaacttctgagaataaa

SEQ ID NO: 9044465 - DNA, 22 bp, Homo sapiens
acactgttctttgcactgagaa

SEQ ID NO: 9044466 - DNA, 22 bp, Homo sapiens
acacttaatcttactgaggatc

SEQ ID NO: 9044467 - DNA, 22 bp, Homo sapiens
acacttaagcatgaagtataaa

SEQ ID NO: 9044468 - DNA, 22 bp, Homo sapiens
agccaggaagaaggtcacacca

SEQ ID NO: 9044469 - DNA, 22 bp, Homo sapiens
agccaggaagaaggtcacacca

SEQ ID NO: 9044470 - DNA, 22 bp, Homo sapiens
acagaagctcaagagagcagtg

SEQ ID NO: 9044471 - DNA, 22 bp, Homo sapiens
acagagctgtacatgtgccatg

SEQ ID NO: 9044472 - DNA, 22 bp, Homo sapiens
acagaggggtcacagcctgaag

SEQ ID NO: 9044473 - DNA, 22 bp, Homo sapiens
acagagggggccttggagtgca

SEQ ID NO: 9044474 - DNA, 22 bp, Homo sapiens
acagaggtaggacatgagatat

SEQ ID NO: 9044475 - DNA, 22 bp, Homo sapiens
agcgggtctgcaagccttccct

SEQ ID NO: 9044476 - DNA, 22 bp, Homo sapiens
agctaaatgtgaaatgtcaacc

SEQ ID NO: 9044477 - DNA, 22 bp, Homo sapiens
agctaaatcacttattctttca

SEQ ID NO: 9044478 - DNA, 22 bp, Homo sapiens
agcgtggatgtggggcgcggct

SEQ ID NO: 9044479 - DNA, 22 bp, Homo sapiens
agcgtgaattagttggtacaca

SEQ ID NO: 9044480 - DNA, 22 bp, Homo sapiens
acagcagaccactactagtagg

SEQ ID NO: 9044481 - DNA, 22 bp, Homo sapiens
acagatacagggacttggtatt

SEQ ID NO: 9044482 - DNA, 22 bp, Homo sapiens
agctgaggttgaagagtgaacg

SEQ ID NO: 9044483 - DNA, 22 bp, Homo sapiens
agctgatacatttcttgtagcc

SEQ ID NO: 9044484 - DNA, 22 bp, Homo sapiens
agctgaggttagtataaatgtg

SEQ ID NO: 9044485 - DNA, 23 bp, Homo sapiens
agctgaggtgcagatccaaagaa

SEQ ID NO: 9044486 - DNA, 21 bp, Homo sapiens
agctgaggtaaggcaagagag

SEQ ID NO: 9044487 - DNA, 22 bp, Homo sapiens
agctgagaggtggcaagctgta

SEQ ID NO: 9044488 - DNA, 22 bp, Homo sapiens
agctgagggttcggtgtccaca

SEQ ID NO: 9044489 - DNA, 22 bp, Homo sapiens
agctgagggcaggatggggtga

SEQ ID NO: 9044490 - DNA, 18 bp, Homo sapiens
agctgaggggactgaaga

SEQ ID NO: 9044491 - DNA, 17 bp, Homo sapiens
acagcaggcccggaggg

SEQ ID NO: 9044492 - DNA, 22 bp, Homo sapiens
tcagtgttacattatatagaac

SEQ ID NO: 9044493 - DNA, 22 bp, Homo sapiens
tcagtgttagacaagtttggaa

SEQ ID NO: 9044494 - DNA, 22 bp, Homo sapiens
tcagtgttaatcagtggtacct

SEQ ID NO: 9044495 - DNA, 19 bp, Homo sapiens
tcagtgtgtgggaggtggt

SEQ ID NO: 9044496 - DNA, 22 bp, Homo sapiens
tcagtgcagggtgggagagaga

SEQ ID NO: 9044497 - DNA, 22 bp, Homo sapiens
tcagtctttcgaattcagccag

SEQ ID NO: 9044498 - DNA, 22 bp, Homo sapiens
tcagtgaaatgcatattcttcg

SEQ ID NO: 9044499 - DNA, 22 bp, Homo sapiens
tcagggacgtgagctcagagtc

SEQ ID NO: 9044500 - DNA, 22 bp, Homo sapiens
tcagggacccctctgagtggag

SEQ ID NO: 9044501 - DNA, 22 bp, Homo sapiens
tcagggacaggatgggcatttc

SEQ ID NO: 9044502 - DNA, 22 bp, Homo sapiens
tcagggacagggtgctgctgcg

SEQ ID NO: 9044503 - DNA, 22 bp, Homo sapiens
tcagggacagttcttagggtgg

SEQ ID NO: 9044504 - DNA, 22 bp, Homo sapiens
tcagggacatttagacactgat

SEQ ID NO: 9044505 - DNA, 23 bp, Homo sapiens
tcagggacatgatgtgtcatatc

SEQ ID NO: 9044506 - DNA, 22 bp, Homo sapiens
tcagggaccaccactcacccag

SEQ ID NO: 9044507 - DNA, 22 bp, Homo sapiens
tcagggacaataagggaattga

SEQ ID NO: 9044508 - DNA, 22 bp, Homo sapiens
tcagggaataagtagatgagtg

SEQ ID NO: 9044509 - DNA, 22 bp, Homo sapiens
tcagggaagacttcttagagga

SEQ ID NO: 9044510 - DNA, 22 bp, Homo sapiens
tcagggaagaaatgggacttta

SEQ ID NO: 9044511 - DNA, 22 bp, Homo sapiens
tcattcactgcccagcagtgta

SEQ ID NO: 9044512 - DNA, 22 bp, Homo sapiens
tcattcataaaaattagttggc

SEQ ID NO: 9044513 - DNA, 22 bp, Homo sapiens
tcattcatactcttttctatta

SEQ ID NO: 9044514 - DNA, 22 bp, Homo sapiens
tcattcaatgtaagcatatata

SEQ ID NO: 9044515 - DNA, 22 bp, Homo sapiens
tcattcaagatttcaatagatt

SEQ ID NO: 9044516 - DNA, 22 bp, Homo sapiens
tcattatttgctttagttatgt

SEQ ID NO: 9044517 - DNA, 22 bp, Homo sapiens
tcattattttggactggagtgt

SEQ ID NO: 9044518 - DNA, 22 bp, Homo sapiens
tcattacacagttcagtggaaa

SEQ ID NO: 9044519 - DNA, 20 bp, Homo sapiens
tcattacagtgctaagatgt

SEQ ID NO: 9044520 - DNA, 22 bp, Homo sapiens
tcattacagagatataatctac

SEQ ID NO: 9044521 - DNA, 18 bp, Homo sapiens
tcattagggattgcaaag

SEQ ID NO: 9044522 - DNA, 18 bp, Homo sapiens
tcattattgtttctggag

SEQ ID NO: 9044523 - DNA, 22 bp, Homo sapiens
tcatggcattgttaagggtttt

SEQ ID NO: 9044524 - DNA, 22 bp, Homo sapiens
tcatggcacttagcacagtcct

SEQ ID NO: 9044525 - DNA, 23 bp, Homo sapiens
tcatggaactgggcaatcttgaa

SEQ ID NO: 9044526 - DNA, 23 bp, Homo sapiens
tcatggaactgggcaatcttgaa

SEQ ID NO: 9044527 - DNA, 22 bp, Homo sapiens
tcataggctaaggatttttccc

SEQ ID NO: 9044528 - DNA, 22 bp, Homo sapiens
tcataggctttgacttagttgt

SEQ ID NO: 9044529 - DNA, 22 bp, Homo sapiens
tcataggctcctctgcttctgc

SEQ ID NO: 9044530 - DNA, 22 bp, Homo sapiens
tcagtgttcgctcagggactcc

SEQ ID NO: 9044531 - DNA, 22 bp, Homo sapiens
tcagtgttcagcggtgtgtgca

SEQ ID NO: 9044532 - DNA, 16 bp, Homo sapiens
tcagtgttccagaata

SEQ ID NO: 9044533 - DNA, 22 bp, Homo sapiens
tcagtgttcagggaccaggtcc

SEQ ID NO: 9044534 - DNA, 22 bp, Homo sapiens
tcagtgttattagatgaggttt

SEQ ID NO: 9044535 - DNA, 22 bp, Homo sapiens
tcatgctcatcattagagtgac

SEQ ID NO: 9044536 - DNA, 22 bp, Homo sapiens
tcatgctctggtttagctgttt

SEQ ID NO: 9044537 - DNA, 19 bp, Homo sapiens
tcatgcatttctaagtgca

SEQ ID NO: 9044538 - DNA, 22 bp, Homo sapiens
tcatgccaaaatccagtggctt

SEQ ID NO: 9044539 - DNA, 22 bp, Homo sapiens
tcatgccaatttctgcatggct

SEQ ID NO: 9044540 - DNA, 21 bp, Homo sapiens
tcatatttctcttgctattgt

SEQ ID NO: 9044541 - DNA, 22 bp, Homo sapiens
tcatatttagttcacgctcaat

SEQ ID NO: 9044542 - DNA, 20 bp, Homo sapiens
tcatattgatgtagagcagc

SEQ ID NO: 9044543 - DNA, 22 bp, Homo sapiens
tcatatttaggcctttaattca

SEQ ID NO: 9044544 - DNA, 18 bp, Homo sapiens
tcaggctgggcctccttc

SEQ ID NO: 9044545 - DNA, 22 bp, Homo sapiens
tcagggaaacctaaggaagcca

SEQ ID NO: 9044546 - DNA, 22 bp, Homo sapiens
tcagggaaattcaagggagatt

SEQ ID NO: 9044547 - DNA, 22 bp, Homo sapiens
tcaggccttcagacctggcccg

SEQ ID NO: 9044548 - DNA, 22 bp, Homo sapiens
tcaggcctgcaggcttcctgga

SEQ ID NO: 9044549 - DNA, 19 bp, Homo sapiens
tcaggcagttattcacaaa

SEQ ID NO: 9044550 - DNA, 20 bp, Homo sapiens
tcaggcagtggggaaaggca

SEQ ID NO: 9044551 - DNA, 22 bp, Homo sapiens
tcaggatccatagactcccaaa

SEQ ID NO: 9044552 - DNA, 22 bp, Homo sapiens
tcagctctacctgggagctgtc

SEQ ID NO: 9044553 - DNA, 22 bp, Homo sapiens
tcagctctcacagatctcaacc

SEQ ID NO: 9044554 - DNA, 22 bp, Homo sapiens
tcagctctctgggctcgaacct

SEQ ID NO: 9044555 - DNA, 22 bp, Homo sapiens
tcagctctaagttttatgcaaa

SEQ ID NO: 9044556 - DNA, 23 bp, Homo sapiens
tcagcggattggctcagacaggc

SEQ ID NO: 9044557 - DNA, 22 bp, Homo sapiens
tcagcaggcacggacaggctgc

SEQ ID NO: 9044558 - DNA, 22 bp, Homo sapiens
tcagcaggcaccggaagtgttt

SEQ ID NO: 9044559 - DNA, 22 bp, Homo sapiens
tcagcaggcacaccaaaaactg

SEQ ID NO: 9044560 - DNA, 21 bp, Homo sapiens
tcagcaggcaccagaaggctg

SEQ ID NO: 9044561 - DNA, 22 bp, Homo sapiens
tcaatacagaaaggatattttg

SEQ ID NO: 9044562 - DNA, 22 bp, Homo sapiens
tcaatttctcagaaatggtctt

SEQ ID NO: 9044563 - DNA, 22 bp, Homo sapiens
tcaatttcccctattgatagac

SEQ ID NO: 9044564 - DNA, 20 bp, Homo sapiens
tcaatttcaggtagcatagt

SEQ ID NO: 9044565 - DNA, 22 bp, Homo sapiens
tcaatttcattctattagttaa

SEQ ID NO: 9044566 - DNA, 22 bp, Homo sapiens
tcaatttcaacagctgataaga

SEQ ID NO: 9044567 - DNA, 22 bp, Homo sapiens
tcaatttctagcttggtcggtt

SEQ ID NO: 9044568 - DNA, 22 bp, Homo sapiens
tcaatttcttggtttgataata

SEQ ID NO: 9044569 - DNA, 22 bp, Homo sapiens
tcaataaaattgttttcctatc

SEQ ID NO: 9044570 - DNA, 22 bp, Homo sapiens
tcaagtattattacagatgtag

SEQ ID NO: 9044571 - DNA, 22 bp, Homo sapiens
tcaagataagtcagtatatcaa

SEQ ID NO: 9044572 - DNA, 22 bp, Homo sapiens
tcaaggaaaagataacttgatg

SEQ ID NO: 9044573 - DNA, 22 bp, Homo sapiens
tcaaggaagggatattcttgaa

SEQ ID NO: 9044574 - DNA, 22 bp, Homo sapiens
tatttcttgagtggtcagtttc

SEQ ID NO: 9044575 - DNA, 22 bp, Homo sapiens
tatttcttgagactcgtcttcc

SEQ ID NO: 9044576 - DNA, 22 bp, Homo sapiens
tatttcttcgggattcaagcta

SEQ ID NO: 9044577 - DNA, 22 bp, Homo sapiens
tatttctgattgctcatgaggc

SEQ ID NO: 9044578 - DNA, 22 bp, Homo sapiens
tcacaagtttctcttgcatgcg

SEQ ID NO: 9044579 - DNA, 22 bp, Homo sapiens
tcacaagatggctgctgcagcc

SEQ ID NO: 9044580 - DNA, 22 bp, Homo sapiens
tcacaagatatttcagtccttt

SEQ ID NO: 9044581 - DNA, 22 bp, Homo sapiens
tcacaagatacagttagaagca

SEQ ID NO: 9044582 - DNA, 22 bp, Homo sapiens
tcacaagagtaagttcatgcct

SEQ ID NO: 9044583 - DNA, 22 bp, Homo sapiens
tcacaagataaacatagctcca

SEQ ID NO: 9044584 - DNA, 22 bp, Homo sapiens
tcacaagagtaagttcatgcct

SEQ ID NO: 9044585 - DNA, 22 bp, Homo sapiens
tcacaagagctggactgtcttt

SEQ ID NO: 9044586 - DNA, 22 bp, Homo sapiens
tcacaagagctggactgtcttt

SEQ ID NO: 9044587 - DNA, 22 bp, Homo sapiens
tcacaaagtgaagtgtgtcatg

SEQ ID NO: 9044588 - DNA, 22 bp, Homo sapiens
tcacaaagggagggatagctgg

SEQ ID NO: 9044589 - DNA, 22 bp, Homo sapiens
tcacaaaaggccatgtggcttc

SEQ ID NO: 9044590 - DNA, 22 bp, Homo sapiens
tcacaaagctttgataagcaga

SEQ ID NO: 9044591 - DNA, 22 bp, Homo sapiens
tcacaaagagaattgtgggtgt

SEQ ID NO: 9044592 - DNA, 22 bp, Homo sapiens
tcacaaagctttgataagcaga

SEQ ID NO: 9044593 - DNA, 22 bp, Homo sapiens
tcacaaaggatgatgaattctg

SEQ ID NO: 9044594 - DNA, 22 bp, Homo sapiens
tcacaaagctttgataagcaga

SEQ ID NO: 9044595 - DNA, 22 bp, Homo sapiens
tcacaatatgggtgtgggaact

SEQ ID NO: 9044596 - DNA, 22 bp, Homo sapiens
tcacacatgagtaaatacaggg

SEQ ID NO: 9044597 - DNA, 22 bp, Homo sapiens
tcacacatgagtaaatacaggg

SEQ ID NO: 9044598 - DNA, 22 bp, Homo sapiens
tcacaatggcatagtataaaat

SEQ ID NO: 9044599 - DNA, 22 bp, Homo sapiens
tcacaattcagaaaccaagtag

SEQ ID NO: 9044600 - DNA, 18 bp, Homo sapiens
tcacaattatggttcgtg

SEQ ID NO: 9044601 - DNA, 22 bp, Homo sapiens
tcacaatgaaaaacactacata

SEQ ID NO: 9044602 - DNA, 22 bp, Homo sapiens
tcacacatgctaagccagagat

SEQ ID NO: 9044603 - DNA, 22 bp, Homo sapiens
tcacacatgctaagccagagat

SEQ ID NO: 9044604 - DNA, 22 bp, Homo sapiens
tcacagggtgtacatcacctat

SEQ ID NO: 9044605 - DNA, 22 bp, Homo sapiens
tcacagtactgtgactattgac

SEQ ID NO: 9044606 - DNA, 22 bp, Homo sapiens
tcactgaatttcaagctagtgg

SEQ ID NO: 9044607 - DNA, 22 bp, Homo sapiens
tcactgaatgcagatacgtgac

SEQ ID NO: 9044608 - DNA, 22 bp, Homo sapiens
tcactgaaggaagacactgtca

SEQ ID NO: 9044609 - DNA, 22 bp, Homo sapiens
tcactgaagtcttcaagtagga

SEQ ID NO: 9044610 - DNA, 22 bp, Homo sapiens
tcactgaactctcatagagaaa

SEQ ID NO: 9044611 - DNA, 21 bp, Homo sapiens
tcactgaagcctaagatgttt

SEQ ID NO: 9044612 - DNA, 22 bp, Homo sapiens
tcactgaaaaccatacttcttt

SEQ ID NO: 9044613 - DNA, 22 bp, Homo sapiens
tcactgttaataaatagcaaag

SEQ ID NO: 9044614 - DNA, 22 bp, Homo sapiens
tcacttgagagatattagaagt

SEQ ID NO: 9044615 - DNA, 22 bp, Homo sapiens
tcactttaatgatttgtagaat

SEQ ID NO: 9044616 - DNA, 22 bp, Homo sapiens
tcactttactttgttaatctgg

SEQ ID NO: 9044617 - DNA, 22 bp, Homo sapiens
tcacattttccttggtatctgt

SEQ ID NO: 9044618 - DNA, 22 bp, Homo sapiens
tcacattttcatattctctgag

SEQ ID NO: 9044619 - DNA, 22 bp, Homo sapiens
tcacattttcttaggaaactta

SEQ ID NO: 9044620 - DNA, 22 bp, Homo sapiens
tcacattttctactactgtacg

SEQ ID NO: 9044621 - DNA, 22 bp, Homo sapiens
tcacattttttactggacttaa

SEQ ID NO: 9044622 - DNA, 22 bp, Homo sapiens
tcactctgcctccatattacta

SEQ ID NO: 9044623 - DNA, 23 bp, Homo sapiens
tcagagaactcgggcagatgacc

SEQ ID NO: 9044624 - DNA, 22 bp, Homo sapiens
tcagagaactggcatgtttaga

SEQ ID NO: 9044625 - DNA, 22 bp, Homo sapiens
tcagacagcttgggataactga

SEQ ID NO: 9044626 - DNA, 22 bp, Homo sapiens
tcagcaagtggaccatcctggg

SEQ ID NO: 9044627 - DNA, 22 bp, Homo sapiens
tcagagccctgctcctccccaa

SEQ ID NO: 9044628 - DNA, 22 bp, Homo sapiens
tcagagcccctccgctgtccca

SEQ ID NO: 9044629 - DNA, 20 bp, Homo sapiens
tccagggccctggctcctct

SEQ ID NO: 9044630 - DNA, 22 bp, Homo sapiens
tccagggccagtccttgtctgt

SEQ ID NO: 9044631 - DNA, 22 bp, Homo sapiens
tccagggccatctccatgaggc

SEQ ID NO: 9044632 - DNA, 22 bp, Homo sapiens
tccaggctgcagtcttgccctc

SEQ ID NO: 9044633 - DNA, 22 bp, Homo sapiens
tccatcacgtaggcatgattga

SEQ ID NO: 9044634 - DNA, 22 bp, Homo sapiens
tccatccacattaacagatacg

SEQ ID NO: 9044635 - DNA, 22 bp, Homo sapiens
tccagggctcattccctctgca

SEQ ID NO: 9044636 - DNA, 20 bp, Homo sapiens
tccagggctagggagctcat

SEQ ID NO: 9044637 - DNA, 22 bp, Homo sapiens
tcccacacttgaaacaaggctg

SEQ ID NO: 9044638 - DNA, 22 bp, Homo sapiens
tcccacacagcccgctcaccgg

SEQ ID NO: 9044639 - DNA, 22 bp, Homo sapiens
tcccacactacacggttgttgg

SEQ ID NO: 9044640 - DNA, 22 bp, Homo sapiens
tcccacacctgtctattcctag

SEQ ID NO: 9044641 - DNA, 22 bp, Homo sapiens
tcccaagcttagggctctcagt

SEQ ID NO: 9044642 - DNA, 22 bp, Homo sapiens
tccatgcagcagcctcccagcc

SEQ ID NO: 9044643 - DNA, 22 bp, Homo sapiens
tccatccatggatggaaatgtg

SEQ ID NO: 9044644 - DNA, 22 bp, Homo sapiens
tccatccatgtaggaagatggt

SEQ ID NO: 9044645 - DNA, 22 bp, Homo sapiens
tccatccatgtaggaagatggt

SEQ ID NO: 9044646 - DNA, 22 bp, Homo sapiens
tccatgcagagaactgaagtac

SEQ ID NO: 9044647 - DNA, 22 bp, Homo sapiens
tccaggagtctagcctcaggcc

SEQ ID NO: 9044648 - DNA, 22 bp, Homo sapiens
tccaggagtttgacctgtgggc

SEQ ID NO: 9044649 - DNA, 19 bp, Homo sapiens
tccaggcatccttcaggct

SEQ ID NO: 9044650 - DNA, 19 bp, Homo sapiens
tccaggctgagagtcagct

SEQ ID NO: 9044651 - DNA, 22 bp, Homo sapiens
tccaggctctaggctgctctcc

SEQ ID NO: 9044652 - DNA, 22 bp, Homo sapiens
tccaggctcagcacttgctact

SEQ ID NO: 9044653 - DNA, 22 bp, Homo sapiens
tccaggctctcaggtgtcagca

SEQ ID NO: 9044654 - DNA, 23 bp, Homo sapiens
tccagctcccttcaatggcactg

SEQ ID NO: 9044655 - DNA, 22 bp, Homo sapiens
tccagctcagatgcagggatca

SEQ ID NO: 9044656 - DNA, 22 bp, Homo sapiens
tccagcagtaaggaaagtacat

SEQ ID NO: 9044657 - DNA, 21 bp, Homo sapiens
tccaggaaagttttaagagtg

SEQ ID NO: 9044658 - DNA, 22 bp, Homo sapiens
tccagctctggcttggctagct

SEQ ID NO: 9044659 - DNA, 22 bp, Homo sapiens
tccagctgtagtggatttgaga

SEQ ID NO: 9044660 - DNA, 22 bp, Homo sapiens
tccagcaggtgtttgccaactt

SEQ ID NO: 9044661 - DNA, 22 bp, Homo sapiens
tccagcagaggttgataatacc

SEQ ID NO: 9044662 - DNA, 22 bp, Homo sapiens
tccagcagactcatcagcaagg

SEQ ID NO: 9044663 - DNA, 22 bp, Homo sapiens
tcattgcagactaacaatctca

SEQ ID NO: 9044664 - DNA, 22 bp, Homo sapiens
tcattgcagactaacaatctca

SEQ ID NO: 9044665 - DNA, 22 bp, Homo sapiens
tcattgcaagctcatttatctg

SEQ ID NO: 9044666 - DNA, 21 bp, Homo sapiens
tcccattgttcccctccagtg

SEQ ID NO: 9044667 - DNA, 22 bp, Homo sapiens
tcccatgttgtgcctggctgca

SEQ ID NO: 9044668 - DNA, 22 bp, Homo sapiens
tcccatgtgactcagctgcctg

SEQ ID NO: 9044669 - DNA, 20 bp, Homo sapiens
tcccatgtccatatcagccc

SEQ ID NO: 9044670 - DNA, 22 bp, Homo sapiens
tcccagtgaggtcctggctgtc

SEQ ID NO: 9044671 - DNA, 22 bp, Homo sapiens
tcccagtgtggcaggccatgga

SEQ ID NO: 9044672 - DNA, 22 bp, Homo sapiens
tcccacaggaaagtagacattg

SEQ ID NO: 9044673 - DNA, 22 bp, Homo sapiens
tccccaccccagaactactagg

SEQ ID NO: 9044674 - DNA, 22 bp, Homo sapiens
tccccactcaccactggccaaa

SEQ ID NO: 9044675 - DNA, 22 bp, Homo sapiens
tccccacacagatacagagtag

SEQ ID NO: 9044676 - DNA, 22 bp, Homo sapiens
tccccacagcagaagatctgag

SEQ ID NO: 9044677 - DNA, 22 bp, Homo sapiens
tccccacactttcactcctggc

SEQ ID NO: 9044678 - DNA, 22 bp, Homo sapiens
tccccacatctctgcatcaggc

SEQ ID NO: 9044679 - DNA, 21 bp, Homo sapiens
tccccacatttctaaacagac

SEQ ID NO: 9044680 - DNA, 22 bp, Homo sapiens
tattcatgagataggcagtttt

SEQ ID NO: 9044681 - DNA, 22 bp, Homo sapiens
tattattttagcactgaggatt

SEQ ID NO: 9044682 - DNA, 22 bp, Homo sapiens
tattcattatgaccaaatctag

SEQ ID NO: 9044683 - DNA, 22 bp, Homo sapiens
tattattatgcatagcatgaaa

SEQ ID NO: 9044684 - DNA, 22 bp, Homo sapiens
tattagcttgtttggcaggatg

SEQ ID NO: 9044685 - DNA, 21 bp, Homo sapiens
tattagcttctggtgctgttt

SEQ ID NO: 9044686 - DNA, 18 bp, Homo sapiens
tattctgtcctatgaagc

SEQ ID NO: 9044687 - DNA, 22 bp, Homo sapiens
tattctctgcagctgaatgttt

SEQ ID NO: 9044688 - DNA, 22 bp, Homo sapiens
tattctctccccaatcttgctt

SEQ ID NO: 9044689 - DNA, 22 bp, Homo sapiens
tattctcagtgctataagtaga

SEQ ID NO: 9044690 - DNA, 22 bp, Homo sapiens
tattgaaattcttcatgtcctc

SEQ ID NO: 9044691 - DNA, 22 bp, Homo sapiens
tattgaattagaccctaaaatg

SEQ ID NO: 9044692 - DNA, 22 bp, Homo sapiens
tatttattggacagtgttgctg

SEQ ID NO: 9044693 - DNA, 22 bp, Homo sapiens
tatttattcattcagcaagcat

SEQ ID NO: 9044694 - DNA, 22 bp, Homo sapiens
tatttattctttgtactgcctt

SEQ ID NO: 9044695 - DNA, 22 bp, Homo sapiens
tatttattggacagtgttgctg

SEQ ID NO: 9044696 - DNA, 22 bp, Homo sapiens
tatttattctttgtactgcctt

SEQ ID NO: 9044697 - DNA, 22 bp, Homo sapiens
tatttattcattcagcaagcat

SEQ ID NO: 9044698 - DNA, 22 bp, Homo sapiens
tatttctaagctgtaagtctga

SEQ ID NO: 9044699 - DNA, 22 bp, Homo sapiens
tatttctcttcaaaattgatgt

SEQ ID NO: 9044700 - DNA, 22 bp, Homo sapiens
tatttataacagtgagaacggg

SEQ ID NO: 9044701 - DNA, 22 bp, Homo sapiens
tatttaattagtgattgtagag

SEQ ID NO: 9044702 - DNA, 22 bp, Homo sapiens
tatttaattagtgattgtagag

SEQ ID NO: 9044703 - DNA, 22 bp, Homo sapiens
tatttataccaggtgatcggag

SEQ ID NO: 9044704 - DNA, 22 bp, Homo sapiens
tatttatattctgccttctgct

SEQ ID NO: 9044705 - DNA, 22 bp, Homo sapiens
tatttatcaaggtaggagaata

SEQ ID NO: 9044706 - DNA, 22 bp, Homo sapiens
tatttatgtctctgcagagaat

SEQ ID NO: 9044707 - DNA, 22 bp, Homo sapiens
tatttatgtggaccataagcct

SEQ ID NO: 9044708 - DNA, 21 bp, Homo sapiens
tatttatctcaggctatcttt

SEQ ID NO: 9044709 - DNA, 21 bp, Homo sapiens
tatttattaatttgtaaggct

SEQ ID NO: 9044710 - DNA, 22 bp, Homo sapiens
tatttatgtggaccataagcct

SEQ ID NO: 9044711 - DNA, 21 bp, Homo sapiens
tatttattaatttgtaaggct

SEQ ID NO: 9044712 - DNA, 22 bp, Homo sapiens
tattacatccacttttattgca

SEQ ID NO: 9044713 - DNA, 22 bp, Homo sapiens
tattacagaatcaggcataact

SEQ ID NO: 9044714 - DNA, 22 bp, Homo sapiens
tattagaaaggctattgcatag

SEQ ID NO: 9044715 - DNA, 22 bp, Homo sapiens
tattagaaaggctattgcatag

SEQ ID NO: 9044716 - DNA, 22 bp, Homo sapiens
tattagcacaaagcaaggtatt

SEQ ID NO: 9044717 - DNA, 22 bp, Homo sapiens
tattagcagttgtatgtgtctg

SEQ ID NO: 9044718 - DNA, 22 bp, Homo sapiens
tattagctcatgatttcggtgg

SEQ ID NO: 9044719 - DNA, 22 bp, Homo sapiens
tatgtctttagtatcttttgga

SEQ ID NO: 9044720 - DNA, 22 bp, Homo sapiens
tatgtcttaatccttccttagg

SEQ ID NO: 9044721 - DNA, 22 bp, Homo sapiens
tatgtcttgtgtttgctaatct

SEQ ID NO: 9044722 - DNA, 22 bp, Homo sapiens
tatgtcttcgtcacctatctca

SEQ ID NO: 9044723 - DNA, 22 bp, Homo sapiens
tatgtgcagtttgctcttaaca

SEQ ID NO: 9044724 - DNA, 22 bp, Homo sapiens
tatgagaatttgctaattggct

SEQ ID NO: 9044725 - DNA, 22 bp, Homo sapiens
tatgagaataatctggtaaata

SEQ ID NO: 9044726 - DNA, 23 bp, Homo sapiens
tatgagaattaagtgcgagtgcc

SEQ ID NO: 9044727 - DNA, 22 bp, Homo sapiens
tatgagaatctgcagtatgctt

SEQ ID NO: 9044728 - DNA, 22 bp, Homo sapiens
tatgtacaagcacacatgtgac

SEQ ID NO: 9044729 - DNA, 22 bp, Homo sapiens
tatgtacaatcagcagttcata

SEQ ID NO: 9044730 - DNA, 22 bp, Homo sapiens
tatgtacacacacatgcatgta

SEQ ID NO: 9044731 - DNA, 22 bp, Homo sapiens
tatgtacaatttgttgtatgtc

SEQ ID NO: 9044732 - DNA, 22 bp, Homo sapiens
tatgtacacggtggctctgaag

SEQ ID NO: 9044733 - DNA, 22 bp, Homo sapiens
tatgtacaccggggaaggtggg

SEQ ID NO: 9044734 - DNA, 22 bp, Homo sapiens
tatgtacagggatagaacttga

SEQ ID NO: 9044735 - DNA, 22 bp, Homo sapiens
tatgtacacttaagtttgagaa

SEQ ID NO: 9044736 - DNA, 22 bp, Homo sapiens
tatgtacacatacacttgtaat

SEQ ID NO: 9044737 - DNA, 22 bp, Homo sapiens
tatgtacaccaaggattgaaaa

SEQ ID NO: 9044738 - DNA, 22 bp, Homo sapiens
tatgtacacacacatgcatgta

SEQ ID NO: 9044739 - DNA, 22 bp, Homo sapiens
tatgtacacatacacttgtaat

SEQ ID NO: 9044740 - DNA, 22 bp, Homo sapiens
tatgtacataacatgaaatgca

SEQ ID NO: 9044741 - DNA, 22 bp, Homo sapiens
tatgtcctgctactctctcatg

SEQ ID NO: 9044742 - DNA, 22 bp, Homo sapiens
tatgtacagggatagaacttga

SEQ ID NO: 9044743 - DNA, 22 bp, Homo sapiens
tatgtacataacatgaaatgca

SEQ ID NO: 9044744 - DNA, 22 bp, Homo sapiens
tatgtacagtccttaacttaaa

SEQ ID NO: 9044745 - DNA, 22 bp, Homo sapiens
tataggctgtgcttgtgtcttt

SEQ ID NO: 9044746 - DNA, 22 bp, Homo sapiens
tatccaattcaccattgatggg

SEQ ID NO: 9044747 - DNA, 22 bp, Homo sapiens
tatctaaaggatttaatttagt

SEQ ID NO: 9044748 - DNA, 22 bp, Homo sapiens
tatctacagttaatatgtcatc

SEQ ID NO: 9044749 - DNA, 22 bp, Homo sapiens
tatgacattgctttttagaact

SEQ ID NO: 9044750 - DNA, 22 bp, Homo sapiens
tatgacattgctttttagaact

SEQ ID NO: 9044751 - DNA, 22 bp, Homo sapiens
tatgacatttctctgatttgtg

SEQ ID NO: 9044752 - DNA, 22 bp, Homo sapiens
tatgacattggccaagttctgt

SEQ ID NO: 9044753 - DNA, 22 bp, Homo sapiens
tatgagaaggtatggtgacttg

SEQ ID NO: 9044754 - DNA, 18 bp, Homo sapiens
tatgagaagattagcaat

SEQ ID NO: 9044755 - DNA, 22 bp, Homo sapiens
tatgagaactgacagagtgcca

SEQ ID NO: 9044756 - DNA, 22 bp, Homo sapiens
tatgagaagaacaggtgacttt

SEQ ID NO: 9044757 - DNA, 22 bp, Homo sapiens
tatgagaaattgctgatatttg

SEQ ID NO: 9044758 - DNA, 22 bp, Homo sapiens
tatgagaacgggggcgtgtggg

SEQ ID NO: 9044759 - DNA, 23 bp, Homo sapiens
tatgagaacccatacgctgtctt

SEQ ID NO: 9044760 - DNA, 22 bp, Homo sapiens
tatgagaacaagaacaatctcc

SEQ ID NO: 9044761 - DNA, 22 bp, Homo sapiens
tatgagaaaggagaatgacttt

SEQ ID NO: 9044762 - DNA, 22 bp, Homo sapiens
tatgagaaagtcgtatgtctcc

SEQ ID NO: 9044763 - DNA, 22 bp, Homo sapiens
tatgagaaattatacctaggtt

SEQ ID NO: 9044764 - DNA, 21 bp, Homo sapiens
tatgagaaaactgaggtgcat

SEQ ID NO: 9044765 - DNA, 22 bp, Homo sapiens
tatgagaaaataaatatctgtt

SEQ ID NO: 9044766 - DNA, 21 bp, Homo sapiens
tataacacacttcagcttctc

SEQ ID NO: 9044767 - DNA, 22 bp, Homo sapiens
tataattagtaaatggcagatt

SEQ ID NO: 9044768 - DNA, 22 bp, Homo sapiens
tataaatctttgttcctagaat

SEQ ID NO: 9044769 - DNA, 22 bp, Homo sapiens
tataaatgcacttttgaaatat

SEQ ID NO: 9044770 - DNA, 22 bp, Homo sapiens
tataaatgccaggactttagat

SEQ ID NO: 9044771 - DNA, 22 bp, Homo sapiens
tatacacacctccaaagcagga

SEQ ID NO: 9044772 - DNA, 17 bp, Homo sapiens
tatacacagacagactg

SEQ ID NO: 9044773 - DNA, 22 bp, Homo sapiens
tatacacaggaatctgtgaaaa

SEQ ID NO: 9044774 - DNA, 22 bp, Homo sapiens
tatacacatatacgtttgtgtg

SEQ ID NO: 9044775 - DNA, 22 bp, Homo sapiens
tatacacatcctccaaagatag

SEQ ID NO: 9044776 - DNA, 23 bp, Homo sapiens
tatacacatgtggcagtatagtg

SEQ ID NO: 9044777 - DNA, 22 bp, Homo sapiens
tatacacaaggtgtgcatttgt

SEQ ID NO: 9044778 - DNA, 22 bp, Homo sapiens
tatacacaaggtgtgcatttgt

SEQ ID NO: 9044779 - DNA, 22 bp, Homo sapiens
tatacacacctccaaagcagga

SEQ ID NO: 9044780 - DNA, 22 bp, Homo sapiens
tagacacatcttcatccacaat

SEQ ID NO: 9044781 - DNA, 22 bp, Homo sapiens
tagacacatcttcatccacaat

SEQ ID NO: 9044782 - DNA, 22 bp, Homo sapiens
tagacacatcaagtatagttaa

SEQ ID NO: 9044783 - DNA, 22 bp, Homo sapiens
tagacacatcaaggatcagttt

SEQ ID NO: 9044784 - DNA, 22 bp, Homo sapiens
tagacacatcaagtatagttaa

SEQ ID NO: 9044785 - DNA, 22 bp, Homo sapiens
tagacacatccgtggaagcttc

SEQ ID NO: 9044786 - DNA, 22 bp, Homo sapiens
tagacactgtatgagctgggtg

SEQ ID NO: 9044787 - DNA, 22 bp, Homo sapiens
tagacactttagaagtaagggt

SEQ ID NO: 9044788 - DNA, 22 bp, Homo sapiens
tagaattgggcctaacttccat

SEQ ID NO: 9044789 - DNA, 22 bp, Homo sapiens
tagacacatacccttgcccaaa

SEQ ID NO: 9044790 - DNA, 22 bp, Homo sapiens
tagacacaagagaagggtataa

SEQ ID NO: 9044791 - DNA, 22 bp, Homo sapiens
tagacacaaatctcagtgacac

SEQ ID NO: 9044792 - DNA, 22 bp, Homo sapiens
tagaaatgattttgatgcttca

SEQ ID NO: 9044793 - DNA, 22 bp, Homo sapiens
tagaaatggagaacagattaat

SEQ ID NO: 9044794 - DNA, 22 bp, Homo sapiens
tagaaatgcccagattctgcta

SEQ ID NO: 9044795 - DNA, 22 bp, Homo sapiens
tagaaatgattgagctgtaata

SEQ ID NO: 9044796 - DNA, 22 bp, Homo sapiens
tagaaatgaatgtttaaaagtc

SEQ ID NO: 9044797 - DNA, 22 bp, Homo sapiens
tagaaataaatctgcagctggg

SEQ ID NO: 9044798 - DNA, 22 bp, Homo sapiens
tagaaatcacagaaaatcaggg

SEQ ID NO: 9044799 - DNA, 22 bp, Homo sapiens
tagaaatcaggtttttagaaag

SEQ ID NO: 9044800 - DNA, 22 bp, Homo sapiens
tagaaatcatttagaagtattg

SEQ ID NO: 9044801 - DNA, 22 bp, Homo sapiens
tagaaatctacttagactttct

SEQ ID NO: 9044802 - DNA, 22 bp, Homo sapiens
tagaaatccccagtctcatagt

SEQ ID NO: 9044803 - DNA, 22 bp, Homo sapiens
tagaaatctacttagactttct

SEQ ID NO: 9044804 - DNA, 22 bp, Homo sapiens
tagaaagaacttcatgtaaaac

SEQ ID NO: 9044805 - DNA, 22 bp, Homo sapiens
tagaaagcgttaaatctacaga

SEQ ID NO: 9044806 - DNA, 22 bp, Homo sapiens
tagaaagctgagtaatacattt

SEQ ID NO: 9044807 - DNA, 22 bp, Homo sapiens
tagaaaggcaagcgtgaaatat

SEQ ID NO: 9044808 - DNA, 22 bp, Homo sapiens
tagaaaagataacattctgtgc

SEQ ID NO: 9044809 - DNA, 22 bp, Homo sapiens
tactttttatgataagaactga

SEQ ID NO: 9044810 - DNA, 22 bp, Homo sapiens
tagaaagaaattcagattggct

SEQ ID NO: 9044811 - DNA, 22 bp, Homo sapiens
tagaaactcacgttatcattgc

SEQ ID NO: 9044812 - DNA, 22 bp, Homo sapiens
tagaaacattcagttgcagtcc

SEQ ID NO: 9044813 - DNA, 22 bp, Homo sapiens
taggaaaaatacagaattatat

SEQ ID NO: 9044814 - DNA, 22 bp, Homo sapiens
tagctttagaaatattctcaga

SEQ ID NO: 9044815 - DNA, 22 bp, Homo sapiens
tagctttaccatagaagagtat

SEQ ID NO: 9044816 - DNA, 22 bp, Homo sapiens
tagctttaccatagaagagtat

SEQ ID NO: 9044817 - DNA, 22 bp, Homo sapiens
tagctttacaaagtgctgcacc

SEQ ID NO: 9044818 - DNA, 22 bp, Homo sapiens
tagctttacaaagtgctgcacc

SEQ ID NO: 9044819 - DNA, 22 bp, Homo sapiens
tagctttaatgagttggtaaga

SEQ ID NO: 9044820 - DNA, 22 bp, Homo sapiens
tagctttaggatggttctcttg

SEQ ID NO: 9044821 - DNA, 22 bp, Homo sapiens
tagctttaggatggttctcttg

SEQ ID NO: 9044822 - DNA, 22 bp, Homo sapiens
tagctttagaaatattctcaga

SEQ ID NO: 9044823 - DNA, 22 bp, Homo sapiens
tagctttaggcacgtttgaatt

SEQ ID NO: 9044824 - DNA, 22 bp, Homo sapiens
tagctttagtgaaaaatatcag

SEQ ID NO: 9044825 - DNA, 22 bp, Homo sapiens
tagggcacagcttagataaatg

SEQ ID NO: 9044826 - DNA, 22 bp, Homo sapiens
tagggaggagggttttcaaatc

SEQ ID NO: 9044827 - DNA, 22 bp, Homo sapiens
tagggaggctacttcttgtagg

SEQ ID NO: 9044828 - DNA, 22 bp, Homo sapiens
tagcagcatttttgtagagtat

SEQ ID NO: 9044829 - DNA, 22 bp, Homo sapiens
tagctctggcattctttccaaa

SEQ ID NO: 9044830 - DNA, 22 bp, Homo sapiens
tagctctggagtcttctcagaa

SEQ ID NO: 9044831 - DNA, 19 bp, Homo sapiens
tagctctgtcttattccaa

SEQ ID NO: 9044832 - DNA, 22 bp, Homo sapiens
tagctctgtgctctggatctgt

SEQ ID NO: 9044833 - DNA, 22 bp, Homo sapiens
tagctgaaggctacagcagaac

SEQ ID NO: 9044834 - DNA, 22 bp, Homo sapiens
tagctgttcccagctctgtgta

SEQ ID NO: 9044835 - DNA, 22 bp, Homo sapiens
tagctgttgcaataaacagttc

SEQ ID NO: 9044836 - DNA, 22 bp, Homo sapiens
tagctgttggcttacatctgtt

SEQ ID NO: 9044837 - DNA, 22 bp, Homo sapiens
tagctttaatgagttggtaaga

SEQ ID NO: 9044838 - DNA, 22 bp, Homo sapiens
tagctgttttttgtgaggaaat

SEQ ID NO: 9044839 - DNA, 21 bp, Homo sapiens
tagctttaatattcccacatt

SEQ ID NO: 9044840 - DNA, 22 bp, Homo sapiens
tagccctgtccttggcctgtgc

SEQ ID NO: 9044841 - DNA, 22 bp, Homo sapiens
tagcccctgcctttgaacctgg

SEQ ID NO: 9044842 - DNA, 22 bp, Homo sapiens
tacattctgaaataaatggttt

SEQ ID NO: 9044843 - DNA, 22 bp, Homo sapiens
tacattctggtggagaaagtaa

SEQ ID NO: 9044844 - DNA, 22 bp, Homo sapiens
tacattctcttcccattgtctc

SEQ ID NO: 9044845 - DNA, 22 bp, Homo sapiens
tacattctatatctgttacatc

SEQ ID NO: 9044846 - DNA, 22 bp, Homo sapiens
tacatttgctttgattttcagc

SEQ ID NO: 9044847 - DNA, 22 bp, Homo sapiens
tacattcctgttagcatctaag

SEQ ID NO: 9044848 - DNA, 22 bp, Homo sapiens
tacatctgatttacctactgaa

SEQ ID NO: 9044849 - DNA, 22 bp, Homo sapiens
tacatcattttggagatgagca

SEQ ID NO: 9044850 - DNA, 22 bp, Homo sapiens
tacatcatgtaagcagaatcat

SEQ ID NO: 9044851 - DNA, 19 bp, Homo sapiens
tacatcctcttcctctttg

SEQ ID NO: 9044852 - DNA, 22 bp, Homo sapiens
tacatcatggcttcatgctgca

SEQ ID NO: 9044853 - DNA, 22 bp, Homo sapiens
tacagtaactggaattcttctt

SEQ ID NO: 9044854 - DNA, 19 bp, Homo sapiens
tacaggcagtttctacaat

SEQ ID NO: 9044855 - DNA, 22 bp, Homo sapiens
tacatagattttgaaactggac

SEQ ID NO: 9044856 - DNA, 22 bp, Homo sapiens
tacatagagggtaatagcatca

SEQ ID NO: 9044857 - DNA, 22 bp, Homo sapiens
tacatacatgtatgtgtgtatt

SEQ ID NO: 9044858 - DNA, 22 bp, Homo sapiens
tacatacattacctcatttagt

SEQ ID NO: 9044859 - DNA, 22 bp, Homo sapiens
tacatacattacctcatttagt

SEQ ID NO: 9044860 - DNA, 22 bp, Homo sapiens
tacataccttgacggtagatgg

SEQ ID NO: 9044861 - DNA, 22 bp, Homo sapiens
tacagtaagatgaaatagcaat

SEQ ID NO: 9044862 - DNA, 22 bp, Homo sapiens
tacagtaataaaatgagctaca

SEQ ID NO: 9044863 - DNA, 22 bp, Homo sapiens
tacaacagacctagatgaatga

SEQ ID NO: 9044864 - DNA, 22 bp, Homo sapiens
tacaacagacaggaataagatt

SEQ ID NO: 9044865 - DNA, 22 bp, Homo sapiens
tacaacaatttccacattagaa

SEQ ID NO: 9044866 - DNA, 20 bp, Homo sapiens
tacaacaagtagagacatac

SEQ ID NO: 9044867 - DNA, 22 bp, Homo sapiens
tacaaagtgctttagaaatgaa

SEQ ID NO: 9044868 - DNA, 22 bp, Homo sapiens
tacaaagtgaaataattctgag

SEQ ID NO: 9044869 - DNA, 22 bp, Homo sapiens
tacactgagatgactttggttt

SEQ ID NO: 9044870 - DNA, 22 bp, Homo sapiens
tacactgaatactagttttcct

SEQ ID NO: 9044871 - DNA, 22 bp, Homo sapiens
tacacttttctggttactcttg

SEQ ID NO: 9044872 - DNA, 22 bp, Homo sapiens
tacactttttactacagattct

SEQ ID NO: 9044873 - DNA, 22 bp, Homo sapiens
tacactgaagtgtcttggtata

SEQ ID NO: 9044874 - DNA, 22 bp, Homo sapiens
tacaacagttcatgaaatgaaa

SEQ ID NO: 9044875 - DNA, 22 bp, Homo sapiens
tacaacaggaatttcaactttg

SEQ ID NO: 9044876 - DNA, 22 bp, Homo sapiens
tacaacagttcatgaaatgaaa

SEQ ID NO: 9044877 - DNA, 22 bp, Homo sapiens
tacagaaagggatgattgatct

SEQ ID NO: 9044878 - DNA, 20 bp, Homo sapiens
tacagaaacaggacttttgg

SEQ ID NO: 9044879 - DNA, 20 bp, Homo sapiens
tacagaaacaggacttttgg

SEQ ID NO: 9044880 - DNA, 22 bp, Homo sapiens
tacagcaagacagaccgctcaa

SEQ ID NO: 9044881 - DNA, 21 bp, Homo sapiens
tacagcaacggaggttttcta

SEQ ID NO: 9044882 - DNA, 23 bp, Homo sapiens
tacagcaaggacaacataggtgg

SEQ ID NO: 9044883 - DNA, 22 bp, Homo sapiens
tacagcaataatgacaccgctc

SEQ ID NO: 9044884 - DNA, 22 bp, Homo sapiens
tacagcaaagaaaccctcagtc

SEQ ID NO: 9044885 - DNA, 22 bp, Homo sapiens
tacagcaatgcctgaaatagta

SEQ ID NO: 9044886 - DNA, 22 bp, Homo sapiens
tacagcaatggttctaagagtc

SEQ ID NO: 9044887 - DNA, 22 bp, Homo sapiens
tacagcaatgctacaagatgac

SEQ ID NO: 9044888 - DNA, 22 bp, Homo sapiens
tacagcaatgctacaagatgac

SEQ ID NO: 9044889 - DNA, 22 bp, Homo sapiens
tacagaaattgccaccagctct

SEQ ID NO: 9044890 - DNA, 22 bp, Homo sapiens
tacagaagctgagacactgaga

SEQ ID NO: 9044891 - DNA, 22 bp, Homo sapiens
tacagaaatcacatcgctttga

SEQ ID NO: 9044892 - DNA, 22 bp, Homo sapiens
tacagataaaaatgctgttctt

SEQ ID NO: 9044893 - DNA, 22 bp, Homo sapiens
tacaaagtcacattgaaatgaa

SEQ ID NO: 9044894 - DNA, 22 bp, Homo sapiens
tacaaagtcaccagcttcttgc

SEQ ID NO: 9044895 - DNA, 22 bp, Homo sapiens
tacaaagatagtgttagagtaa

SEQ ID NO: 9044896 - DNA, 22 bp, Homo sapiens
tacaaagcagttccaacacgaa

SEQ ID NO: 9044897 - DNA, 22 bp, Homo sapiens
tacaaagcaaatcatctaagag

SEQ ID NO: 9044898 - DNA, 22 bp, Homo sapiens
tacaaagatggaaggttatgtt

SEQ ID NO: 9044899 - DNA, 22 bp, Homo sapiens
tacaaagatggaaggttatgtt

SEQ ID NO: 9044900 - DNA, 22 bp, Homo sapiens
tacaaagagtttggtctctaga

SEQ ID NO: 9044901 - DNA, 22 bp, Homo sapiens
tacaaagataaaatctcaccat

SEQ ID NO: 9044902 - DNA, 22 bp, Homo sapiens
tacaaaggagataaattggagg

SEQ ID NO: 9044903 - DNA, 22 bp, Homo sapiens
tacaaagcctggtagatatctg

SEQ ID NO: 9044904 - DNA, 22 bp, Homo sapiens
tacaaactctttatatttcata

SEQ ID NO: 9044905 - DNA, 22 bp, Homo sapiens
tacaaactccgaagtttgtacc

SEQ ID NO: 9044906 - DNA, 22 bp, Homo sapiens
tacaaaaaattgatactgacga

SEQ ID NO: 9044907 - DNA, 18 bp, Homo sapiens
tacaaactccttgaaggc

SEQ ID NO: 9044908 - DNA, 20 bp, Homo sapiens
tacaaagaatgaggttcagg

SEQ ID NO: 9044909 - DNA, 20 bp, Homo sapiens
tacaaagagcccctctcttc

SEQ ID NO: 9044910 - DNA, 20 bp, Homo sapiens
tacaaagagcccctctcttc

SEQ ID NO: 9044911 - DNA, 22 bp, Homo sapiens
tacaaagaggcagctccatttt

SEQ ID NO: 9044912 - DNA, 22 bp, Homo sapiens
tacaaacttgttttaagtaagt

SEQ ID NO: 9044913 - DNA, 22 bp, Homo sapiens
tacaaagaggtaattgcatata

SEQ ID NO: 9044914 - DNA, 22 bp, Homo sapiens
tacaaagaggcagctccatttt

SEQ ID NO: 9044915 - DNA, 22 bp, Homo sapiens
tacaaagaggtaattgcatata

SEQ ID NO: 9044916 - DNA, 22 bp, Homo sapiens
tacaaagagtttggtctctaga

SEQ ID NO: 9044917 - DNA, 22 bp, Homo sapiens
tacaaagaggtaattgcatata

SEQ ID NO: 9044918 - DNA, 22 bp, Homo sapiens
tacaaagaggtaattgcatata

SEQ ID NO: 9044919 - DNA, 22 bp, Homo sapiens
tacaaagagtttggtctctaga

SEQ ID NO: 9044920 - DNA, 22 bp, Homo sapiens
taattacaaagcaagcacaggg

SEQ ID NO: 9044921 - DNA, 22 bp, Homo sapiens
taatactgtaacttggtgggtc

SEQ ID NO: 9044922 - DNA, 22 bp, Homo sapiens
taatactgggaaatacttgggt

SEQ ID NO: 9044923 - DNA, 22 bp, Homo sapiens
taatactgctgtgcttgagttg

SEQ ID NO: 9044924 - DNA, 22 bp, Homo sapiens
taatagaaaggtattttttgca

SEQ ID NO: 9044925 - DNA, 22 bp, Homo sapiens
taatggctaaaattcagaagaa

SEQ ID NO: 9044926 - DNA, 22 bp, Homo sapiens
taatacatcattcatctaagga

SEQ ID NO: 9044927 - DNA, 22 bp, Homo sapiens
taatacagtttccaagccagct

SEQ ID NO: 9044928 - DNA, 22 bp, Homo sapiens
taatacagatacaaaggaggac

SEQ ID NO: 9044929 - DNA, 22 bp, Homo sapiens
taatacagatacaaaggaggac

SEQ ID NO: 9044930 - DNA, 22 bp, Homo sapiens
taagtggaaggttatatgctaa

SEQ ID NO: 9044931 - DNA, 22 bp, Homo sapiens
taatactgaaaggagtatcagc

SEQ ID NO: 9044932 - DNA, 22 bp, Homo sapiens
taatactgactaaagatatcaa

SEQ ID NO: 9044933 - DNA, 22 bp, Homo sapiens
taatactgaaggtaaaatttct

SEQ ID NO: 9044934 - DNA, 22 bp, Homo sapiens
taatacatgtattccagagagt

SEQ ID NO: 9044935 - DNA, 22 bp, Homo sapiens
taaggttttgagaccagaacgt

SEQ ID NO: 9044936 - DNA, 22 bp, Homo sapiens
taaggcttcttggaatactgca

SEQ ID NO: 9044937 - DNA, 22 bp, Homo sapiens
taagggttcagaatgcagtggt

SEQ ID NO: 9044938 - DNA, 22 bp, Homo sapiens
gttgctctatgtgtgttctatg

SEQ ID NO: 9044939 - DNA, 22 bp, Homo sapiens
gttgcaggaagcacacacatgt

SEQ ID NO: 9044940 - DNA, 22 bp, Homo sapiens
gttgcaggatgattttataagg

SEQ ID NO: 9044941 - DNA, 22 bp, Homo sapiens
gttgcaggcattaattaaaact

SEQ ID NO: 9044942 - DNA, 22 bp, Homo sapiens
gttgcaggaggatggctgcata

SEQ ID NO: 9044943 - DNA, 22 bp, Homo sapiens
gttgcagatgtggaactcgtgc

SEQ ID NO: 9044944 - DNA, 22 bp, Homo sapiens
gttgcacaacttgaatggctgg

SEQ ID NO: 9044945 - DNA, 22 bp, Homo sapiens
gttacaaaggactgggggccac

SEQ ID NO: 9044946 - DNA, 22 bp, Homo sapiens
gttcacaaaattctggccagtg

SEQ ID NO: 9044947 - DNA, 22 bp, Homo sapiens
gttcaatttcagcatccattga

SEQ ID NO: 9044948 - DNA, 22 bp, Homo sapiens
gttcaatttagaaagcacagtt

SEQ ID NO: 9044949 - DNA, 22 bp, Homo sapiens
gttcaattatacagtcagaggg

SEQ ID NO: 9044950 - DNA, 22 bp, Homo sapiens
gttcaattaagttacaaattta

SEQ ID NO: 9044951 - DNA, 22 bp, Homo sapiens
gttcacaaagtactgtatgcat

SEQ ID NO: 9044952 - DNA, 22 bp, Homo sapiens
gttcagagaaagagacacctta

SEQ ID NO: 9044953 - DNA, 22 bp, Homo sapiens
gttcagagtattaattgattta

SEQ ID NO: 9044954 - DNA, 22 bp, Homo sapiens
gttgaggtgatgccagccctgc

SEQ ID NO: 9044955 - DNA, 22 bp, Homo sapiens
gtgctctagaaattgtcagtgg

SEQ ID NO: 9044956 - DNA, 22 bp, Homo sapiens
gtgctctagaaatagtcagtgg

SEQ ID NO: 9044957 - DNA, 22 bp, Homo sapiens
gtgctctaggctacagggatgc

SEQ ID NO: 9044958 - DNA, 22 bp, Homo sapiens
gtgctctaggaccttagaagtg

SEQ ID NO: 9044959 - DNA, 22 bp, Homo sapiens
gtgctctagggtcattatggta

SEQ ID NO: 9044960 - DNA, 22 bp, Homo sapiens
gtgctctaggggtcagtggtta

SEQ ID NO: 9044961 - DNA, 22 bp, Homo sapiens
gtgctctatgttgattccttga

SEQ ID NO: 9044962 - DNA, 18 bp, Homo sapiens
gtgctctatgtctgttat

SEQ ID NO: 9044963 - DNA, 22 bp, Homo sapiens
gtgctctatagagatctaatcg

SEQ ID NO: 9044964 - DNA, 22 bp, Homo sapiens
gtgctctaggtgattccaaaat

SEQ ID NO: 9044965 - DNA, 22 bp, Homo sapiens
gtgctctatgaggatatagggt

SEQ ID NO: 9044966 - DNA, 22 bp, Homo sapiens
gtgctctacatgctccatgttt

SEQ ID NO: 9044967 - DNA, 22 bp, Homo sapiens
gtgctctaataaagcctgacat

SEQ ID NO: 9044968 - DNA, 22 bp, Homo sapiens
gtgctctaaggcaccactgagc

SEQ ID NO: 9044969 - DNA, 22 bp, Homo sapiens
gtgctccctccttcctcaagga

SEQ ID NO: 9044970 - DNA, 22 bp, Homo sapiens
gttaagaagctagagatgaaca

SEQ ID NO: 9044971 - DNA, 22 bp, Homo sapiens
gttaacattcaattaaacagtc

SEQ ID NO: 9044972 - DNA, 22 bp, Homo sapiens
gttaacatttctaggtgcaggg

SEQ ID NO: 9044973 - DNA, 22 bp, Homo sapiens
gttaagaacttgttgaaggtct

SEQ ID NO: 9044974 - DNA, 22 bp, Homo sapiens
gttaatgtgtctgacacaatgg

SEQ ID NO: 9044975 - DNA, 22 bp, Homo sapiens
gttaatgtcttcctattctaca

SEQ ID NO: 9044976 - DNA, 22 bp, Homo sapiens
gttaatgccattaggaaattta

SEQ ID NO: 9044977 - DNA, 22 bp, Homo sapiens
gttaatgcaaagcagagggcaa

SEQ ID NO: 9044978 - DNA, 22 bp, Homo sapiens
gttaatgcctacatattaagca

SEQ ID NO: 9044979 - DNA, 22 bp, Homo sapiens
gttaaggatcttgagatgagga

SEQ ID NO: 9044980 - DNA, 22 bp, Homo sapiens
gttacaaactcaggtgccaaaa

SEQ ID NO: 9044981 - DNA, 22 bp, Homo sapiens
gttacaaagcacttcaagtgaa

SEQ ID NO: 9044982 - DNA, 22 bp, Homo sapiens
gttacaaaggaagcttcactgc

SEQ ID NO: 9044983 - DNA, 22 bp, Homo sapiens
gttttcattactgctgtgattt

SEQ ID NO: 9044984 - DNA, 22 bp, Homo sapiens
gttttccactggattgtttgga

SEQ ID NO: 9044985 - DNA, 22 bp, Homo sapiens
taaaatgatctctcatgttctt

SEQ ID NO: 9044986 - DNA, 22 bp, Homo sapiens
taaaatgcacagcagttgaaag

SEQ ID NO: 9044987 - DNA, 22 bp, Homo sapiens
taaaatagaggatgtcatgcta

SEQ ID NO: 9044988 - DNA, 22 bp, Homo sapiens
taaaatgtagcttctaggctgg

SEQ ID NO: 9044989 - DNA, 22 bp, Homo sapiens
gtttttattgtgtaaatgtggg

SEQ ID NO: 9044990 - DNA, 22 bp, Homo sapiens
gtttttatctaatagcagttat

SEQ ID NO: 9044991 - DNA, 22 bp, Homo sapiens
gtttttatatcctgtggagtgt

SEQ ID NO: 9044992 - DNA, 19 bp, Homo sapiens
gttttgtttgcagaactta

SEQ ID NO: 9044993 - DNA, 22 bp, Homo sapiens
taaagggtaggttttactgtaa

SEQ ID NO: 9044994 - DNA, 22 bp, Homo sapiens
taaacaagggttactgagcatg

SEQ ID NO: 9044995 - DNA, 22 bp, Homo sapiens
taaacaagctgtctgatattct

SEQ ID NO: 9044996 - DNA, 22 bp, Homo sapiens
taaacaagctgtctgatattct

SEQ ID NO: 9044997 - DNA, 22 bp, Homo sapiens
taaacaagctggactgataagt

SEQ ID NO: 9044998 - DNA, 22 bp, Homo sapiens
taaaattgcggtgaatatttcc

SEQ ID NO: 9044999 - DNA, 22 bp, Homo sapiens
taaaatgtttgcaagagaccag

SEQ ID NO: 9045000 - DNA, 22 bp, Homo sapiens
taaaatttgtccctgagtgttg

SEQ ID NO: 9045001 - DNA, 22 bp, Homo sapiens
taaattatgttccatgtccttt

SEQ ID NO: 9045002 - DNA, 23 bp, Homo sapiens
taaattacctttccagtgcaggg

SEQ ID NO: 9045003 - DNA, 22 bp, Homo sapiens
taaagtggaaggatccactaag

SEQ ID NO: 9045004 - DNA, 23 bp, Homo sapiens
taaagtggcgctgttactgccag

SEQ ID NO: 9045005 - DNA, 22 bp, Homo sapiens
taaagtgggcaaactctcatgg

SEQ ID NO: 9045006 - DNA, 22 bp, Homo sapiens
taaagtaatccttcataaggag

SEQ ID NO: 9045007 - DNA, 22 bp, Homo sapiens
taaagtaatccttcataaggag

SEQ ID NO: 9045008 - DNA, 22 bp, Homo sapiens
taaaggtagtgtgacatattgt

SEQ ID NO: 9045009 - DNA, 22 bp, Homo sapiens
taaaggtagcatgaaactgcaa

SEQ ID NO: 9045010 - DNA, 22 bp, Homo sapiens
taaaggtaacatgaactgcttt

SEQ ID NO: 9045011 - DNA, 22 bp, Homo sapiens
taaccagacagaaacagctaga

SEQ ID NO: 9045012 - DNA, 22 bp, Homo sapiens
taaccaataaccaataagatac

SEQ ID NO: 9045013 - DNA, 18 bp, Homo sapiens
taacatgttttcattaag

SEQ ID NO: 9045014 - DNA, 22 bp, Homo sapiens
taaattgaaaatctacagaaca

SEQ ID NO: 9045015 - DNA, 22 bp, Homo sapiens
taacctgactgctctttagaat

SEQ ID NO: 9045016 - DNA, 22 bp, Homo sapiens
taactctgaatcctcacagcag

SEQ ID NO: 9045017 - DNA, 22 bp, Homo sapiens
gcctcctgaagtgctgggatta

SEQ ID NO: 9045018 - DNA, 22 bp, Homo sapiens
gcctcctgacttacactgagct

SEQ ID NO: 9045019 - DNA, 22 bp, Homo sapiens
gcctcctgagtagctgggattg

SEQ ID NO: 9045020 - DNA, 22 bp, Homo sapiens
gccctgggattgggtggaggct

SEQ ID NO: 9045021 - DNA, 22 bp, Homo sapiens
gccctggatgtacaggcatgtt

SEQ ID NO: 9045022 - DNA, 22 bp, Homo sapiens
gcccagctttttgaggcaggca

SEQ ID NO: 9045023 - DNA, 22 bp, Homo sapiens
gcccagctgtctggcagggatg

SEQ ID NO: 9045024 - DNA, 22 bp, Homo sapiens
gcccatggtccaggaagacaga

SEQ ID NO: 9045025 - DNA, 22 bp, Homo sapiens
gccccacagcctgcggtctcag

SEQ ID NO: 9045026 - DNA, 22 bp, Homo sapiens
gccaggggacgcggagcgacga

SEQ ID NO: 9045027 - DNA, 22 bp, Homo sapiens
gcccagcccctgggtggacgtg

SEQ ID NO: 9045028 - DNA, 22 bp, Homo sapiens
gcccagctgagaagcgcggggc

SEQ ID NO: 9045029 - DNA, 22 bp, Homo sapiens
gcccagctgcaccctggtgggt

SEQ ID NO: 9045030 - DNA, 22 bp, Homo sapiens
gcccagcctccaagctccaagg

SEQ ID NO: 9045031 - DNA, 22 bp, Homo sapiens
gcagtggcatgatgtgggctca

SEQ ID NO: 9045032 - DNA, 22 bp, Homo sapiens
gcaggggagtggatgatggatt

SEQ ID NO: 9045033 - DNA, 22 bp, Homo sapiens
gcagtgaatctggcaagaattt

SEQ ID NO: 9045034 - DNA, 22 bp, Homo sapiens
gcagtggaagcctctttaagca

SEQ ID NO: 9045035 - DNA, 22 bp, Homo sapiens
gcagtggccacatggaggagga

SEQ ID NO: 9045036 - DNA, 22 bp, Homo sapiens
gcagtggctaagctcgcatgca

SEQ ID NO: 9045037 - DNA, 22 bp, Homo sapiens
gccacatagaggaggatattaa

SEQ ID NO: 9045038 - DNA, 22 bp, Homo sapiens
gcatggccttgctgtagtggta

SEQ ID NO: 9045039 - DNA, 22 bp, Homo sapiens
gcatggccaggaaaggtagaaa

SEQ ID NO: 9045040 - DNA, 22 bp, Homo sapiens
gcatgctgcagggaatgcttgt

SEQ ID NO: 9045041 - DNA, 22 bp, Homo sapiens
gccagctcagtttcaaagtagg

SEQ ID NO: 9045042 - DNA, 22 bp, Homo sapiens
gccaccccaacctccctaagtt

SEQ ID NO: 9045043 - DNA, 22 bp, Homo sapiens
gccacccccaagtaggtggtct

SEQ ID NO: 9045044 - DNA, 22 bp, Homo sapiens
gccaccccataggtgttaggtg

SEQ ID NO: 9045045 - DNA, 20 bp, Homo sapiens
gccagccctgacacaggagc

SEQ ID NO: 9045046 - DNA, 22 bp, Homo sapiens
gccagccctgggagacttatgg

SEQ ID NO: 9045047 - DNA, 22 bp, Homo sapiens
gccagggaacccaagggcctca

SEQ ID NO: 9045048 - DNA, 22 bp, Homo sapiens
gccagggaacccaagggcctca

SEQ ID NO: 9045049 - DNA, 17 bp, Homo sapiens
gccagggagaggaagcc

SEQ ID NO: 9045050 - DNA, 17 bp, Homo sapiens
gccagggagaggaagcc

SEQ ID NO: 9045051 - DNA, 22 bp, Homo sapiens
gccagggagtctgggccacaga

SEQ ID NO: 9045052 - DNA, 22 bp, Homo sapiens
gcagggacctcactacccccag

SEQ ID NO: 9045053 - DNA, 22 bp, Homo sapiens
gcagggacctgccactgctgtc

SEQ ID NO: 9045054 - DNA, 22 bp, Homo sapiens
gcagggaccagggccagatcca

SEQ ID NO: 9045055 - DNA, 22 bp, Homo sapiens
gcagggacctatgacgatggaa

SEQ ID NO: 9045056 - DNA, 21 bp, Homo sapiens
gcagggaccgcgacttctggg

SEQ ID NO: 9045057 - DNA, 22 bp, Homo sapiens
gcagggaccaaaagaggcagta

SEQ ID NO: 9045058 - DNA, 22 bp, Homo sapiens
gcagggaccaaaagaggcagta

SEQ ID NO: 9045059 - DNA, 22 bp, Homo sapiens
gcagggacaaggcaggtgttct

SEQ ID NO: 9045060 - DNA, 22 bp, Homo sapiens
gcagggacaactgtgcacctga

SEQ ID NO: 9045061 - DNA, 22 bp, Homo sapiens
gcagggacacctttgtgaagct

SEQ ID NO: 9045062 - DNA, 18 bp, Homo sapiens
gcagggacacagggtcac

SEQ ID NO: 9045063 - DNA, 18 bp, Homo sapiens
gcagggacacagggtcac

SEQ ID NO: 9045064 - DNA, 22 bp, Homo sapiens
gcagggacatctttgtctagta

SEQ ID NO: 9045065 - DNA, 22 bp, Homo sapiens
gcagggacatcttcagatcact

SEQ ID NO: 9045066 - DNA, 22 bp, Homo sapiens
gcagggacagggcagggccttt

SEQ ID NO: 9045067 - DNA, 22 bp, Homo sapiens
gcagggcttgcagcagctagac

SEQ ID NO: 9045068 - DNA, 22 bp, Homo sapiens
gcagggctgggtcctgtctcat

SEQ ID NO: 9045069 - DNA, 22 bp, Homo sapiens
gcagggctggggctgctcctga

SEQ ID NO: 9045070 - DNA, 22 bp, Homo sapiens
gcaggcagaggtggaggagaca

SEQ ID NO: 9045071 - DNA, 16 bp, Homo sapiens
gcaggcagatcacatg

SEQ ID NO: 9045072 - DNA, 14 bp, Homo sapiens
gcaggcagatcacc

SEQ ID NO: 9045073 - DNA, 22 bp, Homo sapiens
gcaggcagagtcaatttgatcc

SEQ ID NO: 9045074 - DNA, 22 bp, Homo sapiens
gcaggcagatcacctgtcagga

SEQ ID NO: 9045075 - DNA, 15 bp, Homo sapiens
gcaggcagatcaccg

SEQ ID NO: 9045076 - DNA, 22 bp, Homo sapiens
gcaggcagccacgattcccttg

SEQ ID NO: 9045077 - DNA, 14 bp, Homo sapiens
gcaggcagatcatt

SEQ ID NO: 9045078 - DNA, 14 bp, Homo sapiens
gcaggcagatcact

SEQ ID NO: 9045079 - DNA, 22 bp, Homo sapiens
gcagggaagggaaacagagacc

SEQ ID NO: 9045080 - DNA, 21 bp, Homo sapiens
gcagggacaaagcttcaggag

SEQ ID NO: 9045081 - DNA, 22 bp, Homo sapiens
gcaggcagttatttagtagaat

SEQ ID NO: 9045082 - DNA, 22 bp, Homo sapiens
gcaggcagtcatctttcatatt

SEQ ID NO: 9045083 - DNA, 19 bp, Homo sapiens
gcaggcagtggcattcgga

SEQ ID NO: 9045084 - DNA, 22 bp, Homo sapiens
gcaggcaggtggcatcttgtga

SEQ ID NO: 9045085 - DNA, 18 bp, Homo sapiens
gcagcccctcttccttcc

SEQ ID NO: 9045086 - DNA, 18 bp, Homo sapiens
gcagcccctcttccttcc

SEQ ID NO: 9045087 - DNA, 22 bp, Homo sapiens
gcagatgtaatggctggaggtc

SEQ ID NO: 9045088 - DNA, 22 bp, Homo sapiens
gcagatgtaatggctggaggtc

SEQ ID NO: 9045089 - DNA, 22 bp, Homo sapiens
gcagatgtgtcctggagggagg

SEQ ID NO: 9045090 - DNA, 22 bp, Homo sapiens
gcagatgttctgtgtctcacaa

SEQ ID NO: 9045091 - DNA, 22 bp, Homo sapiens
gcagatgttcgcgttaatgcat

SEQ ID NO: 9045092 - DNA, 22 bp, Homo sapiens
gcacactggagcctggaagatt

SEQ ID NO: 9045093 - DNA, 22 bp, Homo sapiens
gcacacactgttttcctcacat

SEQ ID NO: 9045094 - DNA, 22 bp, Homo sapiens
gcacacagtagggattcaatga

SEQ ID NO: 9045095 - DNA, 22 bp, Homo sapiens
gcacacaggggagttctcagaa

SEQ ID NO: 9045096 - DNA, 22 bp, Homo sapiens
gcacacagtatatgctcattaa

SEQ ID NO: 9045097 - DNA, 22 bp, Homo sapiens
gcacacatgcatgcacaggagt

SEQ ID NO: 9045098 - DNA, 22 bp, Homo sapiens
gcacacattcggattcttaacc

SEQ ID NO: 9045099 - DNA, 22 bp, Homo sapiens
gcaaagtgaaatggggcagaga

SEQ ID NO: 9045100 - DNA, 22 bp, Homo sapiens
gcaaagtgaaatggggcagaga

SEQ ID NO: 9045101 - DNA, 22 bp, Homo sapiens
gcaaagtgcttcagtgggagct

SEQ ID NO: 9045102 - DNA, 22 bp, Homo sapiens
gcaaagtgcttcagtgggagct

SEQ ID NO: 9045103 - DNA, 22 bp, Homo sapiens
gcaaagcaagctgtcagcctca

SEQ ID NO: 9045104 - DNA, 22 bp, Homo sapiens
gcaaagaaagccaaggtctaac

SEQ ID NO: 9045105 - DNA, 22 bp, Homo sapiens
gcaaagaaagccaaggtctaac

SEQ ID NO: 9045106 - DNA, 22 bp, Homo sapiens
gcaaagaaagttttaatgaggt

SEQ ID NO: 9045107 - DNA, 22 bp, Homo sapiens
gcaaagaaagttttaatgaggt

SEQ ID NO: 9045108 - DNA, 22 bp, Homo sapiens
gcaaagaaatgtcagtgagagg

SEQ ID NO: 9045109 - DNA, 22 bp, Homo sapiens
gcaaagacaaattagaactcct

SEQ ID NO: 9045110 - DNA, 22 bp, Homo sapiens
gcaaagaatgcagatttgcctc

SEQ ID NO: 9045111 - DNA, 22 bp, Homo sapiens
gcagaggtgagaagggcctccc

SEQ ID NO: 9045112 - DNA, 22 bp, Homo sapiens
gcacataactgaccacatctaa

SEQ ID NO: 9045113 - DNA, 22 bp, Homo sapiens
gcacataaagggcatgggaggt

SEQ ID NO: 9045114 - DNA, 22 bp, Homo sapiens
gcacatacccactgtcaagcac

SEQ ID NO: 9045115 - DNA, 22 bp, Homo sapiens
gcacatactgcaaagattacta

SEQ ID NO: 9045116 - DNA, 22 bp, Homo sapiens
gctcctccaatatggactcctc

SEQ ID NO: 9045117 - DNA, 22 bp, Homo sapiens
gctctgggaactgactgccttc

SEQ ID NO: 9045118 - DNA, 22 bp, Homo sapiens
gctctgggaagtcctttaccat

SEQ ID NO: 9045119 - DNA, 22 bp, Homo sapiens
gctctgggattaccagccttag

SEQ ID NO: 9045120 - DNA, 22 bp, Homo sapiens
gctctgggccatcctggccggg

SEQ ID NO: 9045121 - DNA, 22 bp, Homo sapiens
gctctggggatgcttctgccgt

SEQ ID NO: 9045122 - DNA, 22 bp, Homo sapiens
gctgcctgtcctgaggagtccg

SEQ ID NO: 9045123 - DNA, 22 bp, Homo sapiens
gctgcctcaggcacctcctggc

SEQ ID NO: 9045124 - DNA, 22 bp, Homo sapiens
gctgccgacccacaggggttaa

SEQ ID NO: 9045125 - DNA, 22 bp, Homo sapiens
gctgcctgttgaagggtctgtg

SEQ ID NO: 9045126 - DNA, 22 bp, Homo sapiens
gctgcctgtggcccttctgggt

SEQ ID NO: 9045127 - DNA, 22 bp, Homo sapiens
gctgccttccaaagagttttat

SEQ ID NO: 9045128 - DNA, 20 bp, Homo sapiens
gctgcctgtttctgtaagta

SEQ ID NO: 9045129 - DNA, 22 bp, Homo sapiens
gctgctattagtcttctattca

SEQ ID NO: 9045130 - DNA, 22 bp, Homo sapiens
gctgctaagcgtttctgttcca

SEQ ID NO: 9045131 - DNA, 22 bp, Homo sapiens
gctcagagtggcctggctaggg

SEQ ID NO: 9045132 - DNA, 22 bp, Homo sapiens
gctcagaggttgttcttgggtt

SEQ ID NO: 9045133 - DNA, 23 bp, Homo sapiens
gctcagaggtttttctctggatg

SEQ ID NO: 9045134 - DNA, 22 bp, Homo sapiens
gctacctgagcaagagcttcaa

SEQ ID NO: 9045135 - DNA, 22 bp, Homo sapiens
gctccagggtcagctcagaact

SEQ ID NO: 9045136 - DNA, 22 bp, Homo sapiens
gctccagggagtacatttatca

SEQ ID NO: 9045137 - DNA, 22 bp, Homo sapiens
gctccagggtggatgacaattc

SEQ ID NO: 9045138 - DNA, 22 bp, Homo sapiens
gctccaggaggctcccgcgtct

SEQ ID NO: 9045139 - DNA, 22 bp, Homo sapiens
gctcagctgagcgaaggacatg

SEQ ID NO: 9045140 - DNA, 22 bp, Homo sapiens
gctccaggataataaagttgtt

SEQ ID NO: 9045141 - DNA, 22 bp, Homo sapiens
gctccaggcagagcctctttcg

SEQ ID NO: 9045142 - DNA, 22 bp, Homo sapiens
gctccaggtggcttatttgtat

SEQ ID NO: 9045143 - DNA, 22 bp, Homo sapiens
gctccaggtgtcccaggtaaaa

SEQ ID NO: 9045144 - DNA, 22 bp, Homo sapiens
gctccagtggactgggggaggc

SEQ ID NO: 9045145 - DNA, 22 bp, Homo sapiens
gctccaggtgaatcctctcacc

SEQ ID NO: 9045146 - DNA, 22 bp, Homo sapiens
gctccaggtgaatcctctcacc

SEQ ID NO: 9045147 - DNA, 20 bp, Homo sapiens
gctccaggtcagagaggacg

SEQ ID NO: 9045148 - DNA, 22 bp, Homo sapiens
gctccaggtatttgccctttta

SEQ ID NO: 9045149 - DNA, 22 bp, Homo sapiens
gctccaggtatttgccctttta

SEQ ID NO: 9045150 - DNA, 21 bp, Homo sapiens
gctccctgctcagctcctggg

SEQ ID NO: 9045151 - DNA, 22 bp, Homo sapiens
gcgtccagggaaggcccagctg

SEQ ID NO: 9045152 - DNA, 22 bp, Homo sapiens
gcggtccaggagcgcaggtcct

SEQ ID NO: 9045153 - DNA, 22 bp, Homo sapiens
gcggtggggaaaggaggtgctg

SEQ ID NO: 9045154 - DNA, 22 bp, Homo sapiens
gcggtgggggaaaggagcggtt

SEQ ID NO: 9045155 - DNA, 23 bp, Homo sapiens
gctacagctgactgtcattccct

SEQ ID NO: 9045156 - DNA, 22 bp, Homo sapiens
gcctttaaagctggcaggcttt

SEQ ID NO: 9045157 - DNA, 22 bp, Homo sapiens
gcctttaaagccccgagagccc

SEQ ID NO: 9045158 - DNA, 22 bp, Homo sapiens
gcctttcacagagatttaaaaa

SEQ ID NO: 9045159 - DNA, 22 bp, Homo sapiens
gcctctggtccctcatgctgtg

SEQ ID NO: 9045160 - DNA, 22 bp, Homo sapiens
gctggctggagtaaggagggag

SEQ ID NO: 9045161 - DNA, 23 bp, Homo sapiens
gctggctggcagtaaaggttgtt

SEQ ID NO: 9045162 - DNA, 19 bp, Homo sapiens
gctggctggaggagggaca

SEQ ID NO: 9045163 - DNA, 22 bp, Homo sapiens
gctggctggaggtgaggaagaa

SEQ ID NO: 9045164 - DNA, 22 bp, Homo sapiens
gctggctggaatgggagaagaa

SEQ ID NO: 9045165 - DNA, 22 bp, Homo sapiens
gctggctgcgtcatcacagggc

SEQ ID NO: 9045166 - DNA, 22 bp, Homo sapiens
gctggagaaactgcagctgagg

SEQ ID NO: 9045167 - DNA, 22 bp, Homo sapiens
gctggctgttgaataatggcat

SEQ ID NO: 9045168 - DNA, 22 bp, Homo sapiens
gctggctgtgggctccacgctc

SEQ ID NO: 9045169 - DNA, 21 bp, Homo sapiens
gctggctggctgaccggcctt

SEQ ID NO: 9045170 - DNA, 22 bp, Homo sapiens
gctgggcttctcaatgctgcct

SEQ ID NO: 9045171 - DNA, 22 bp, Homo sapiens
gctgggctgtagtttgctgacc

SEQ ID NO: 9045172 - DNA, 18 bp, Homo sapiens
gctttatttcttggggaa

SEQ ID NO: 9045173 - DNA, 18 bp, Homo sapiens
gctttatttcttggggaa

SEQ ID NO: 9045174 - DNA, 23 bp, Homo sapiens
gcttgctcattctatcacacagc

SEQ ID NO: 9045175 - DNA, 22 bp, Homo sapiens
gctgtgtatcagatgccacggg

SEQ ID NO: 9045176 - DNA, 22 bp, Homo sapiens
gctgtgtcagaaactctgggga

SEQ ID NO: 9045177 - DNA, 22 bp, Homo sapiens
gcttctgtcttagctacctccc

SEQ ID NO: 9045178 - DNA, 22 bp, Homo sapiens
gctgtgctgattcattccctgc

SEQ ID NO: 9045179 - DNA, 22 bp, Homo sapiens
ggaatgtagaatctctggtctc

SEQ ID NO: 9045180 - DNA, 22 bp, Homo sapiens
ggaatgttgtcatttacattat

SEQ ID NO: 9045181 - DNA, 22 bp, Homo sapiens
ggaatgcaattttacaattctg

SEQ ID NO: 9045182 - DNA, 22 bp, Homo sapiens
ggaagcagcctgaagccaaggg

SEQ ID NO: 9045183 - DNA, 22 bp, Homo sapiens
ggaagaggctgagccaggtccc

SEQ ID NO: 9045184 - DNA, 22 bp, Homo sapiens
ggaagaggaggagccaggcttt

SEQ ID NO: 9045185 - DNA, 22 bp, Homo sapiens
gctttctgcctgggctccattt

SEQ ID NO: 9045186 - DNA, 20 bp, Homo sapiens
gctttctatgagatggactg

SEQ ID NO: 9045187 - DNA, 20 bp, Homo sapiens
gctttctatgagatggactg

SEQ ID NO: 9045188 - DNA, 22 bp, Homo sapiens
gctttgcttcctgttctagcct

SEQ ID NO: 9045189 - DNA, 22 bp, Homo sapiens
gctttcctggccctgtccctgc

SEQ ID NO: 9045190 - DNA, 22 bp, Homo sapiens
gctttctaggcagagatgactg

SEQ ID NO: 9045191 - DNA, 22 bp, Homo sapiens
gctttctaatctatttccttac

SEQ ID NO: 9045192 - DNA, 22 bp, Homo sapiens
gctttctacaccaagtatgtgc

SEQ ID NO: 9045193 - DNA, 17 bp, Homo sapiens
gctttccttgcccctcc

SEQ ID NO: 9045194 - DNA, 22 bp, Homo sapiens
gctttattttgtgagggattac

SEQ ID NO: 9045195 - DNA, 22 bp, Homo sapiens
gctttattttgtgagggattac

SEQ ID NO: 9045196 - DNA, 22 bp, Homo sapiens
ggagagaaattgaggtagcaag

SEQ ID NO: 9045197 - DNA, 22 bp, Homo sapiens
ggagagaactgacctgaaagga

SEQ ID NO: 9045198 - DNA, 19 bp, Homo sapiens
ggagactcagcccatgcct

SEQ ID NO: 9045199 - DNA, 22 bp, Homo sapiens
ggagacatgcagactgagatac

SEQ ID NO: 9045200 - DNA, 22 bp, Homo sapiens
ggagagaattccatggacatgt

SEQ ID NO: 9045201 - DNA, 22 bp, Homo sapiens
ggacacaggcagctgggtgggt

SEQ ID NO: 9045202 - DNA, 22 bp, Homo sapiens
ggaccaggggcgcactccctgc

SEQ ID NO: 9045203 - DNA, 22 bp, Homo sapiens
ggaccaggcaagctgaggcggg

SEQ ID NO: 9045204 - DNA, 22 bp, Homo sapiens
ggaccaggccagcctccctgcg

SEQ ID NO: 9045205 - DNA, 22 bp, Homo sapiens
ggaccaggctgagcacctgcct

SEQ ID NO: 9045206 - DNA, 22 bp, Homo sapiens
ggcaaagagatgatctttgcaa

SEQ ID NO: 9045207 - DNA, 22 bp, Homo sapiens
ggcaaagagacatgcatcgggg

SEQ ID NO: 9045208 - DNA, 22 bp, Homo sapiens
ggcaaagaaccacaccacgtgt

SEQ ID NO: 9045209 - DNA, 23 bp, Homo sapiens
ggagtgcaatggcgccatctcgg

SEQ ID NO: 9045210 - DNA, 19 bp, Homo sapiens
ggagccagctgtggaaggc

SEQ ID NO: 9045211 - DNA, 22 bp, Homo sapiens
ggagccagcagggtgacactga

SEQ ID NO: 9045212 - DNA, 23 bp, Homo sapiens
ggagccagcctgtggggagcggg

SEQ ID NO: 9045213 - DNA, 22 bp, Homo sapiens
ggagccagaaatgctgtggttg

SEQ ID NO: 9045214 - DNA, 22 bp, Homo sapiens
ggagccagagcactggggagcc

SEQ ID NO: 9045215 - DNA, 22 bp, Homo sapiens
ggagccagagcactggggagcc

SEQ ID NO: 9045216 - DNA, 21 bp, Homo sapiens
ggagtcagggtctggctgggg

SEQ ID NO: 9045217 - DNA, 22 bp, Homo sapiens
ggagtcaggagcaggctgggct

SEQ ID NO: 9045218 - DNA, 22 bp, Homo sapiens
ggagtcaggatcctggggatgg

SEQ ID NO: 9045219 - DNA, 22 bp, Homo sapiens
ggcaggcagaaaaatagaatat

SEQ ID NO: 9045220 - DNA, 22 bp, Homo sapiens
ggcaggcactgtgttttgtgtt

SEQ ID NO: 9045221 - DNA, 22 bp, Homo sapiens
ggcaggcactgtgctaggcgct

SEQ ID NO: 9045222 - DNA, 22 bp, Homo sapiens
ggcaggcaccagctcagcaata

SEQ ID NO: 9045223 - DNA, 22 bp, Homo sapiens
ggcaggcactgtgatagattct

SEQ ID NO: 9045224 - DNA, 22 bp, Homo sapiens
ggcaggcacatttgggggccgt

SEQ ID NO: 9045225 - DNA, 22 bp, Homo sapiens
ggcaggcacagtaatacatgtt

SEQ ID NO: 9045226 - DNA, 22 bp, Homo sapiens
ggcaggcaatgaggatgggaag

SEQ ID NO: 9045227 - DNA, 22 bp, Homo sapiens
ggcaggcaacggaccactagtc

SEQ ID NO: 9045228 - DNA, 22 bp, Homo sapiens
ggcaggcaacggaccactagtc

SEQ ID NO: 9045229 - DNA, 22 bp, Homo sapiens
ggcaggcaagtctgctctgtga

SEQ ID NO: 9045230 - DNA, 22 bp, Homo sapiens
ggcaggcaaggcagcctggtga

SEQ ID NO: 9045231 - DNA, 22 bp, Homo sapiens
ggcagaggtagctggaaccagg

SEQ ID NO: 9045232 - DNA, 22 bp, Homo sapiens
ggcaggagggcggacaatgacc

SEQ ID NO: 9045233 - DNA, 22 bp, Homo sapiens
ggcaggaggtgagtggcgggtg

SEQ ID NO: 9045234 - DNA, 18 bp, Homo sapiens
ggcctcagcctggccgga

SEQ ID NO: 9045235 - DNA, 22 bp, Homo sapiens
ggcctcagtttctccatgggtt

SEQ ID NO: 9045236 - DNA, 22 bp, Homo sapiens
ggcctcagtttcttcaactgta

SEQ ID NO: 9045237 - DNA, 21 bp, Homo sapiens
ggcctgagtataggacaggcc

SEQ ID NO: 9045238 - DNA, 22 bp, Homo sapiens
ggcctttgcgtccacgccgctt

SEQ ID NO: 9045239 - DNA, 22 bp, Homo sapiens
ggccagggggcttcagactcca

SEQ ID NO: 9045240 - DNA, 22 bp, Homo sapiens
ggccaattccaggagccggcgg

SEQ ID NO: 9045241 - DNA, 22 bp, Homo sapiens
ggcaggcagaggctgagacagg

SEQ ID NO: 9045242 - DNA, 22 bp, Homo sapiens
ggcttgtccttctggttgtctt

SEQ ID NO: 9045243 - DNA, 22 bp, Homo sapiens
gggacaggcaaaggtatgcttc

SEQ ID NO: 9045244 - DNA, 22 bp, Homo sapiens
ggctttaaggagtaaaaatgcc

SEQ ID NO: 9045245 - DNA, 22 bp, Homo sapiens
gggaatgtgaaacagtaaggga

SEQ ID NO: 9045246 - DNA, 23 bp, Homo sapiens
gggagaatatgaggatgatggtg

SEQ ID NO: 9045247 - DNA, 22 bp, Homo sapiens
gggacaggcccctcgctagctt

SEQ ID NO: 9045248 - DNA, 22 bp, Homo sapiens
gggagaggttacccgagcaact

SEQ ID NO: 9045249 - DNA, 18 bp, Homo sapiens
gggagctgggaagctggt

SEQ ID NO: 9045250 - DNA, 22 bp, Homo sapiens
gggagctgtcatcagtgttgtc

SEQ ID NO: 9045251 - DNA, 22 bp, Homo sapiens
gggagagcgcgctagggccgag

SEQ ID NO: 9045252 - DNA, 22 bp, Homo sapiens
gggagacacgctgcaggcataa

SEQ ID NO: 9045253 - DNA, 22 bp, Homo sapiens
gggagacaaggagaaccaaaga

SEQ ID NO: 9045254 - DNA, 22 bp, Homo sapiens
gggagcttctggaaggcaggaa

SEQ ID NO: 9045255 - DNA, 22 bp, Homo sapiens
gggatggggagctggaaagggg

SEQ ID NO: 9045256 - DNA, 22 bp, Homo sapiens
gggatggggagctggaaagggg

SEQ ID NO: 9045257 - DNA, 20 bp, Homo sapiens
ggctgaaagtagaaagtatt

SEQ ID NO: 9045258 - DNA, 22 bp, Homo sapiens
ggctgaaggaactttttccatg

SEQ ID NO: 9045259 - DNA, 22 bp, Homo sapiens
ggctgaaaggtgggaggatggc

SEQ ID NO: 9045260 - DNA, 22 bp, Homo sapiens
ggctctttaacttgtctaaatt

SEQ ID NO: 9045261 - DNA, 22 bp, Homo sapiens
ggctctttggcgggccttgaac

SEQ ID NO: 9045262 - DNA, 22 bp, Homo sapiens
ggctccagaaacttcagtccat

SEQ ID NO: 9045263 - DNA, 22 bp, Homo sapiens
ggctccagaaacttcagtccat

SEQ ID NO: 9045264 - DNA, 22 bp, Homo sapiens
ggctccagaaacttcagtccat

SEQ ID NO: 9045265 - DNA, 16 bp, Homo sapiens
ggctccagaatagcga

SEQ ID NO: 9045266 - DNA, 22 bp, Homo sapiens
ggctccagaaatcatagagcag

SEQ ID NO: 9045267 - DNA, 22 bp, Homo sapiens
ggctccagaggccttacctgca

SEQ ID NO: 9045268 - DNA, 22 bp, Homo sapiens
ggctccagaggccttacctgca

SEQ ID NO: 9045269 - DNA, 22 bp, Homo sapiens
ggctccagatgtcccctggcaa

SEQ ID NO: 9045270 - DNA, 22 bp, Homo sapiens
ggctccagatgtcccctggcaa

SEQ ID NO: 9045271 - DNA, 22 bp, Homo sapiens
ggctccagatgtctcctggcaa

SEQ ID NO: 9045272 - DNA, 23 bp, Homo sapiens
ggctccaggcctgacgggcgcgg

SEQ ID NO: 9045273 - DNA, 22 bp, Homo sapiens
ggctccaggagggccttggcca

SEQ ID NO: 9045274 - DNA, 22 bp, Homo sapiens
ggctccaggagggccttggcca

SEQ ID NO: 9045275 - DNA, 22 bp, Homo sapiens
ggctccaggaacctcctctcct

SEQ ID NO: 9045276 - DNA, 22 bp, Homo sapiens
ggctccaggaacctcctctcct

SEQ ID NO: 9045277 - DNA, 18 bp, Homo sapiens
ggctccaggacctaccca

SEQ ID NO: 9045278 - DNA, 22 bp, Homo sapiens
ggctccaggagatgctgggcag

SEQ ID NO: 9045279 - DNA, 22 bp, Homo sapiens
ggctccagctaatggtttctat

SEQ ID NO: 9045280 - DNA, 22 bp, Homo sapiens
ggctccagccctggctcttcac

SEQ ID NO: 9045281 - DNA, 22 bp, Homo sapiens
ggctccagccctggctcttcac

SEQ ID NO: 9045282 - DNA, 22 bp, Homo sapiens
ggctccagatgtctcctggcaa

SEQ ID NO: 9045283 - DNA, 22 bp, Homo sapiens
ggctgctgctgtgtaggcctgt

SEQ ID NO: 9045284 - DNA, 22 bp, Homo sapiens
ggcttctgctcagcctgcacgc

SEQ ID NO: 9045285 - DNA, 22 bp, Homo sapiens
ggtcggggatggccaggctccc

SEQ ID NO: 9045286 - DNA, 22 bp, Homo sapiens
ggtgttggaacatggtgagatt

SEQ ID NO: 9045287 - DNA, 22 bp, Homo sapiens
ggtgttgggagagctggttttg

SEQ ID NO: 9045288 - DNA, 22 bp, Homo sapiens
ggtgttgggctcactggtcctt

SEQ ID NO: 9045289 - DNA, 22 bp, Homo sapiens
ggtgttggtctacaccagcact

SEQ ID NO: 9045290 - DNA, 22 bp, Homo sapiens
ggtgttcttagtggcactggca

SEQ ID NO: 9045291 - DNA, 22 bp, Homo sapiens
ggtctcttccagctttatcact

SEQ ID NO: 9045292 - DNA, 18 bp, Homo sapiens
ggtggcggggatggaggt

SEQ ID NO: 9045293 - DNA, 22 bp, Homo sapiens
gggtaggatggtagaagggacc

SEQ ID NO: 9045294 - DNA, 22 bp, Homo sapiens
gggtggagtgtgaaatctggct

SEQ ID NO: 9045295 - DNA, 22 bp, Homo sapiens
gggtggagtagaaagatgaatt

SEQ ID NO: 9045296 - DNA, 22 bp, Homo sapiens
ggggaagaatggcagaaaacat

SEQ ID NO: 9045297 - DNA, 22 bp, Homo sapiens
ggggaagaggcgtgatggatcc

SEQ ID NO: 9045298 - DNA, 22 bp, Homo sapiens
ggggaagaggcgtgatggatcc

SEQ ID NO: 9045299 - DNA, 22 bp, Homo sapiens
gggctgccaagcctgcctgcct

SEQ ID NO: 9045300 - DNA, 22 bp, Homo sapiens
gggctgcatcagcaggacccgg

SEQ ID NO: 9045301 - DNA, 22 bp, Homo sapiens
gggccacacagaacctcctggt

SEQ ID NO: 9045302 - DNA, 22 bp, Homo sapiens
gggccacacagggcagctccct

SEQ ID NO: 9045303 - DNA, 22 bp, Homo sapiens
gtgcaccagtcacatgggcaga

SEQ ID NO: 9045304 - DNA, 22 bp, Homo sapiens
gtgagaagataagtattgcaaa

SEQ ID NO: 9045305 - DNA, 22 bp, Homo sapiens
gtgcatttaggtcacatgatgt

SEQ ID NO: 9045306 - DNA, 22 bp, Homo sapiens
gtgcatactttattttaatact

SEQ ID NO: 9045307 - DNA, 22 bp, Homo sapiens
gtgcagggtcctaattgttaag

SEQ ID NO: 9045308 - DNA, 22 bp, Homo sapiens
gtctgccccacaggctcagttg

SEQ ID NO: 9045309 - DNA, 22 bp, Homo sapiens
gtctgccctcacgccagctggg

SEQ ID NO: 9045310 - DNA, 22 bp, Homo sapiens
gtctgcccttcctctccacgat

SEQ ID NO: 9045311 - DNA, 22 bp, Homo sapiens
gtgaagcagggaaggaaaggat

SEQ ID NO: 9045312 - DNA, 22 bp, Homo sapiens
gtgaaggaggggccacagatat

SEQ ID NO: 9045313 - DNA, 22 bp, Homo sapiens
gtgaaggactgaatgaaaatgt

SEQ ID NO: 9045314 - DNA, 18 bp, Homo sapiens
gtgaagctttattgaatg

SEQ ID NO: 9045315 - DNA, 22 bp, Homo sapiens
gtgaaggaccaatatgactcat

SEQ ID NO: 9045316 - DNA, 22 bp, Homo sapiens
gtgaaggataaggatctaaatt

SEQ ID NO: 9045317 - DNA, 22 bp, Homo sapiens
gtcctgggaactggacagctaa

SEQ ID NO: 9045318 - DNA, 17 bp, Homo sapiens
gtcctgggaggagagag

SEQ ID NO: 9045319 - DNA, 22 bp, Homo sapiens
gtccctctgctctagagagcca

SEQ ID NO: 9045320 - DNA, 22 bp, Homo sapiens
gtccacagggatggccacacat

SEQ ID NO: 9045321 - DNA, 22 bp, Homo sapiens
gtccacagggatggccacacat

SEQ ID NO: 9045322 - DNA, 18 bp, Homo sapiens
gtccacagccctcacagc

SEQ ID NO: 9045323 - DNA, 22 bp, Homo sapiens
gtccaagagtcaagaagggggc

SEQ ID NO: 9045324 - DNA, 22 bp, Homo sapiens
gtccaaggatggggtctcccag

SEQ ID NO: 9045325 - DNA, 22 bp, Homo sapiens
gtccaatggtaaatccaaataa

SEQ ID NO: 9045326 - DNA, 21 bp, Homo sapiens
gtattctttatgaagtgaaaa

SEQ ID NO: 9045327 - DNA, 17 bp, Homo sapiens
gtattctttgccttcca

SEQ ID NO: 9045328 - DNA, 22 bp, Homo sapiens
gtattcttgagtggcaactagg

SEQ ID NO: 9045329 - DNA, 22 bp, Homo sapiens
gtattcttggttatcaaaatac

SEQ ID NO: 9045330 - DNA, 22 bp, Homo sapiens
gtattcttatactcagtgagct

SEQ ID NO: 9045331 - DNA, 22 bp, Homo sapiens
gtattcttaaggattgagcaaa

SEQ ID NO: 9045332 - DNA, 22 bp, Homo sapiens
gtattccattagtgttaatatc

SEQ ID NO: 9045333 - DNA, 22 bp, Homo sapiens
gtattgcattttgaatgcatgg

SEQ ID NO: 9045334 - DNA, 22 bp, Homo sapiens
gtattgcaattactcttcttct

SEQ ID NO: 9045335 - DNA, 21 bp, Homo sapiens
gtattgcagagttatgtgctc

SEQ ID NO: 9045336 - DNA, 22 bp, Homo sapiens
gtattgcatagacctgggatga

SEQ ID NO: 9045337 - DNA, 22 bp, Homo sapiens
gtatttataggggaatgagagt

SEQ ID NO: 9045338 - DNA, 22 bp, Homo sapiens
gtattattgtcatgaaataata

SEQ ID NO: 9045339 - DNA, 22 bp, Homo sapiens
gtagacaagcacaggactcaga

SEQ ID NO: 9045340 - DNA, 22 bp, Homo sapiens
gtaaaactgcagaacttggagg

SEQ ID NO: 9045341 - DNA, 22 bp, Homo sapiens
gtaaaacctgcttttcaacacc

SEQ ID NO: 9045342 - DNA, 23 bp, Homo sapiens
gtaaaatacgcagtgcagtgtga

SEQ ID NO: 9045343 - DNA, 22 bp, Homo sapiens
ggtttctctagggctgaccagt

SEQ ID NO: 9045344 - DNA, 23 bp, Homo sapiens
ggttttcatggcattccttgcct

SEQ ID NO: 9045345 - DNA, 22 bp, Homo sapiens
ggttttcacctccagaatgtgc

SEQ ID NO: 9045346 - DNA, 22 bp, Homo sapiens
ggttttcagtttgtgagctctg

SEQ ID NO: 9045347 - DNA, 22 bp, Homo sapiens
ggttttcaaagaggcatttcat

SEQ ID NO: 9045348 - DNA, 22 bp, Homo sapiens
cttgacactgtcactcaggcca

SEQ ID NO: 9045349 - DNA, 22 bp, Homo sapiens
cttcctgggtcagcctggaggt

SEQ ID NO: 9045350 - DNA, 22 bp, Homo sapiens
cttgacaactggcagatatata

SEQ ID NO: 9045351 - DNA, 22 bp, Homo sapiens
cttcctggcatgggtctcatga

SEQ ID NO: 9045352 - DNA, 22 bp, Homo sapiens
cttcctggccattgccatggca

SEQ ID NO: 9045353 - DNA, 22 bp, Homo sapiens
cttcctggctcggtgcctcacc

SEQ ID NO: 9045354 - DNA, 22 bp, Homo sapiens
cttcctggatgaagcccagcat

SEQ ID NO: 9045355 - DNA, 22 bp, Homo sapiens
cttcctggatgagcaggctgat

SEQ ID NO: 9045356 - DNA, 22 bp, Homo sapiens
cttcctggatgagcaggctgat

SEQ ID NO: 9045357 - DNA, 22 bp, Homo sapiens
cttgcacatttcacacaatagg

SEQ ID NO: 9045358 - DNA, 22 bp, Homo sapiens
cttgcacatggctgctttctcg

SEQ ID NO: 9045359 - DNA, 22 bp, Homo sapiens
cttgcacatgttttactctcca

SEQ ID NO: 9045360 - DNA, 23 bp, Homo sapiens
cttgcaggaagcagatggcacac

SEQ ID NO: 9045361 - DNA, 20 bp, Homo sapiens
cttgcaggagtgggtagagt

SEQ ID NO: 9045362 - DNA, 22 bp, Homo sapiens
cttgcagggctgatgggaagtg

SEQ ID NO: 9045363 - DNA, 22 bp, Homo sapiens
cttgcaggcccagccttacaag

SEQ ID NO: 9045364 - DNA, 22 bp, Homo sapiens
cttgcaggctacatggaacctg

SEQ ID NO: 9045365 - DNA, 22 bp, Homo sapiens
cttgcaggcctttctagctcta

SEQ ID NO: 9045366 - DNA, 23 bp, Homo sapiens
cttgcagggctggaggcttagaa

SEQ ID NO: 9045367 - DNA, 22 bp, Homo sapiens
cttgcaggcagggcctcctgga

SEQ ID NO: 9045368 - DNA, 22 bp, Homo sapiens
cttgcaggcagggacactgtct

SEQ ID NO: 9045369 - DNA, 22 bp, Homo sapiens
cttgcaggattttgctgctgta

SEQ ID NO: 9045370 - DNA, 22 bp, Homo sapiens
cttgatttcagccttgtgatat

SEQ ID NO: 9045371 - DNA, 22 bp, Homo sapiens
cttgcacaggatctgaagtggg

SEQ ID NO: 9045372 - DNA, 22 bp, Homo sapiens
cttgcacagtgactaacacgta

SEQ ID NO: 9045373 - DNA, 22 bp, Homo sapiens
cttgcacagaactcttagaggt

SEQ ID NO: 9045374 - DNA, 22 bp, Homo sapiens
cttgcacacgtgtatgtacatg

SEQ ID NO: 9045375 - DNA, 22 bp, Homo sapiens
cttgcacaaagtcacctagtca

SEQ ID NO: 9045376 - DNA, 22 bp, Homo sapiens
cttgcacacatgtacatgtgta

SEQ ID NO: 9045377 - DNA, 22 bp, Homo sapiens
cttgtccagatgtttgttaggt

SEQ ID NO: 9045378 - DNA, 21 bp, Homo sapiens
cttgtcttgcttagaatagac

SEQ ID NO: 9045379 - DNA, 22 bp, Homo sapiens
cttgtattgctgttttgcatct

SEQ ID NO: 9045380 - DNA, 22 bp, Homo sapiens
cttgtattcttgtacctttcaa

SEQ ID NO: 9045381 - DNA, 22 bp, Homo sapiens
cttgtattcccctatctctaaa

SEQ ID NO: 9045382 - DNA, 22 bp, Homo sapiens
cttgtattatggttcgcttagt

SEQ ID NO: 9045383 - DNA, 22 bp, Homo sapiens
cttgtatacagtgtacacattg

SEQ ID NO: 9045384 - DNA, 22 bp, Homo sapiens
cttgtatacagtgtacacattg

SEQ ID NO: 9045385 - DNA, 22 bp, Homo sapiens
ctgtttaaccagatctcatatc

SEQ ID NO: 9045386 - DNA, 22 bp, Homo sapiens
cttatttaatgagggttagaat

SEQ ID NO: 9045387 - DNA, 22 bp, Homo sapiens
cttatttctccatccagagtca

SEQ ID NO: 9045388 - DNA, 22 bp, Homo sapiens
cttatttatgtctgtctctaat

SEQ ID NO: 9045389 - DNA, 22 bp, Homo sapiens
cttatttactgatccacagatg

SEQ ID NO: 9045390 - DNA, 22 bp, Homo sapiens
cttatttactgatccacagatg

SEQ ID NO: 9045391 - DNA, 22 bp, Homo sapiens
ctgtcctgtggacctgaggacg

SEQ ID NO: 9045392 - DNA, 22 bp, Homo sapiens
ctgggtctttttcttccattga

SEQ ID NO: 9045393 - DNA, 22 bp, Homo sapiens
ctgtccctgagcaactcctgtt

SEQ ID NO: 9045394 - DNA, 22 bp, Homo sapiens
ctgtcctgtactttgaggccct

SEQ ID NO: 9045395 - DNA, 22 bp, Homo sapiens
ctgtcctggtgctggggatccc

SEQ ID NO: 9045396 - DNA, 21 bp, Homo sapiens
ctgtcctggtctagaggcaca

SEQ ID NO: 9045397 - DNA, 22 bp, Homo sapiens
ctgtcctgcccaccctgcaggg

SEQ ID NO: 9045398 - DNA, 22 bp, Homo sapiens
ctgtcctgcagttgggggcagg

SEQ ID NO: 9045399 - DNA, 22 bp, Homo sapiens
ctgtcctgagttcttggaggtc

SEQ ID NO: 9045400 - DNA, 22 bp, Homo sapiens
ctgtcctgaggcaggtggcctg

SEQ ID NO: 9045401 - DNA, 22 bp, Homo sapiens
ctgtggctgtatttggccagag

SEQ ID NO: 9045402 - DNA, 22 bp, Homo sapiens
ctgtggctggcctgtctgacat

SEQ ID NO: 9045403 - DNA, 22 bp, Homo sapiens
ctgtgtagtcaggtggtcccac

SEQ ID NO: 9045404 - DNA, 22 bp, Homo sapiens
ctgttcttctgggaatggccct

SEQ ID NO: 9045405 - DNA, 22 bp, Homo sapiens
ctgttctgtaagctgctgttgt

SEQ ID NO: 9045406 - DNA, 22 bp, Homo sapiens
ctgttctgaactgcctgcatgc

SEQ ID NO: 9045407 - DNA, 22 bp, Homo sapiens
ctgttattttataattcaagaa

SEQ ID NO: 9045408 - DNA, 22 bp, Homo sapiens
ctgttattttcctctgaactct

SEQ ID NO: 9045409 - DNA, 22 bp, Homo sapiens
ctgttacaagagagagacatga

SEQ ID NO: 9045410 - DNA, 22 bp, Homo sapiens
ctgggctctgcagttgatgttt

SEQ ID NO: 9045411 - DNA, 22 bp, Homo sapiens
ctgggctgcagttcctggtcct

SEQ ID NO: 9045412 - DNA, 23 bp, Homo sapiens
ctgggctgcttgagtccctggct

SEQ ID NO: 9045413 - DNA, 23 bp, Homo sapiens
ctgggctgcttgagtccctggct

SEQ ID NO: 9045414 - DNA, 22 bp, Homo sapiens
ctggggtgtgctcagagcaggg

SEQ ID NO: 9045415 - DNA, 22 bp, Homo sapiens
ctgggtaaaggctgcttttcta

SEQ ID NO: 9045416 - DNA, 20 bp, Homo sapiens
ctgggtctccttctgcttaa

SEQ ID NO: 9045417 - DNA, 22 bp, Homo sapiens
ctgggtctggctactgcttcct

SEQ ID NO: 9045418 - DNA, 22 bp, Homo sapiens
ctgggccacatcagatgaagac

SEQ ID NO: 9045419 - DNA, 22 bp, Homo sapiens
ctgggccactccagatgcccac

SEQ ID NO: 9045420 - DNA, 22 bp, Homo sapiens
ctgggaaattgacactgataaa

SEQ ID NO: 9045421 - DNA, 22 bp, Homo sapiens
ctggctgcctggagtgagggag

SEQ ID NO: 9045422 - DNA, 22 bp, Homo sapiens
ctggctgcaggaaggagtgggc

SEQ ID NO: 9045423 - DNA, 22 bp, Homo sapiens
ctggctgcaggatgaggctgcc

SEQ ID NO: 9045424 - DNA, 23 bp, Homo sapiens
ctggctcatcctggttgcagtgg

SEQ ID NO: 9045425 - DNA, 22 bp, Homo sapiens
ctggctcattttagcatcaggt

SEQ ID NO: 9045426 - DNA, 22 bp, Homo sapiens
ctggctcatgtgatgagggcaa

SEQ ID NO: 9045427 - DNA, 22 bp, Homo sapiens
ctggctcagttcttggttttca

SEQ ID NO: 9045428 - DNA, 22 bp, Homo sapiens
ctggctcagttcttggttttca

SEQ ID NO: 9045429 - DNA, 22 bp, Homo sapiens
ctggctcagtgccttcagaagt

SEQ ID NO: 9045430 - DNA, 22 bp, Homo sapiens
ctggctcatagagcagctccaa

SEQ ID NO: 9045431 - DNA, 22 bp, Homo sapiens
ctggctcatccaggtgttgctc

SEQ ID NO: 9045432 - DNA, 22 bp, Homo sapiens
ctggctcaggaaagttgctgct

SEQ ID NO: 9045433 - DNA, 22 bp, Homo sapiens
ctggctcaggaaagttgctgct

SEQ ID NO: 9045434 - DNA, 22 bp, Homo sapiens
ctggctcagggtggtctgggtc

SEQ ID NO: 9045435 - DNA, 22 bp, Homo sapiens
ctggctcactagccctgccctg

SEQ ID NO: 9045436 - DNA, 22 bp, Homo sapiens
ctggctcagacagctgtgcagt

SEQ ID NO: 9045437 - DNA, 22 bp, Homo sapiens
ctggctcacctccgctccagca

SEQ ID NO: 9045438 - DNA, 22 bp, Homo sapiens
ctggccctggctggagcccagg

SEQ ID NO: 9045439 - DNA, 22 bp, Homo sapiens
ctggccctgtaggatgtgagtt

SEQ ID NO: 9045440 - DNA, 22 bp, Homo sapiens
ctggcccagtctcagagtgtca

SEQ ID NO: 9045441 - DNA, 22 bp, Homo sapiens
ctggccctattccaggccttcc

SEQ ID NO: 9045442 - DNA, 22 bp, Homo sapiens
ctggccctcgtcagtttcactg

SEQ ID NO: 9045443 - DNA, 22 bp, Homo sapiens
ctggcaggatctaaccagggaa

SEQ ID NO: 9045444 - DNA, 22 bp, Homo sapiens
ctggcaggcggaggttgcagtg

SEQ ID NO: 9045445 - DNA, 18 bp, Homo sapiens
ctgccacttaatgtggtg

SEQ ID NO: 9045446 - DNA, 22 bp, Homo sapiens
ctgccacttactaggcatggtg

SEQ ID NO: 9045447 - DNA, 22 bp, Homo sapiens
ctgccactctgggtgggcctgg

SEQ ID NO: 9045448 - DNA, 22 bp, Homo sapiens
ctgccactagctttcacatctt

SEQ ID NO: 9045449 - DNA, 21 bp, Homo sapiens
ctgccacctgctccatcagca

SEQ ID NO: 9045450 - DNA, 22 bp, Homo sapiens
ctgccactttggagtgctcaga

SEQ ID NO: 9045451 - DNA, 22 bp, Homo sapiens
ctgcatcagtggatatgatggt

SEQ ID NO: 9045452 - DNA, 22 bp, Homo sapiens
ctggcaggaagaggaaaggtca

SEQ ID NO: 9045453 - DNA, 22 bp, Homo sapiens
ctggcaggaagttagatggtaa

SEQ ID NO: 9045454 - DNA, 22 bp, Homo sapiens
gagaatgggaatgaaagtagca

SEQ ID NO: 9045455 - DNA, 21 bp, Homo sapiens
gagaatctgttttcttgtctt

SEQ ID NO: 9045456 - DNA, 22 bp, Homo sapiens
gagaagggatatggcttcttga

SEQ ID NO: 9045457 - DNA, 22 bp, Homo sapiens
gagaagggcttgggagtcaaca

SEQ ID NO: 9045458 - DNA, 22 bp, Homo sapiens
gacctgaaatgggggcctgtcc

SEQ ID NO: 9045459 - DNA, 22 bp, Homo sapiens
gacctgaaagtgtgggcgacct

SEQ ID NO: 9045460 - DNA, 22 bp, Homo sapiens
gacctgaaagagattaaatgac

SEQ ID NO: 9045461 - DNA, 22 bp, Homo sapiens
gagaggccctgtggtcccagct

SEQ ID NO: 9045462 - DNA, 22 bp, Homo sapiens
gagacacaaacacatttagagg

SEQ ID NO: 9045463 - DNA, 22 bp, Homo sapiens
gagatgaatgtaaacaaaggca

SEQ ID NO: 9045464 - DNA, 22 bp, Homo sapiens
gagatgaatgtaaacaaaggca

SEQ ID NO: 9045465 - DNA, 22 bp, Homo sapiens
gagatgagtgggggatctctca

SEQ ID NO: 9045466 - DNA, 22 bp, Homo sapiens
gagccagggctgtgagctgagc

SEQ ID NO: 9045467 - DNA, 22 bp, Homo sapiens
gagccagggctgtgagctgagc

SEQ ID NO: 9045468 - DNA, 22 bp, Homo sapiens
gagccagggtttgaaactagac

SEQ ID NO: 9045469 - DNA, 22 bp, Homo sapiens
gagccaggggtcagctccgagg

SEQ ID NO: 9045470 - DNA, 22 bp, Homo sapiens
gagccaggggtcagctccgagg

SEQ ID NO: 9045471 - DNA, 22 bp, Homo sapiens
gagccaggttggaggctgcagt

SEQ ID NO: 9045472 - DNA, 22 bp, Homo sapiens
gagccaggttggaggctgcagt

SEQ ID NO: 9045473 - DNA, 22 bp, Homo sapiens
gagccaggtcgggccgcggcga

SEQ ID NO: 9045474 - DNA, 16 bp, Homo sapiens
gagccaggtgccttga

SEQ ID NO: 9045475 - DNA, 22 bp, Homo sapiens
gagatttaattggattaactta

SEQ ID NO: 9045476 - DNA, 22 bp, Homo sapiens
gagattataagatagagtcatt

SEQ ID NO: 9045477 - DNA, 22 bp, Homo sapiens
gagcagcagattgtctccatgg

SEQ ID NO: 9045478 - DNA, 22 bp, Homo sapiens
gagcagcaggtggctgtgatgg

SEQ ID NO: 9045479 - DNA, 22 bp, Homo sapiens
gagcagcagttgttacaatgat

SEQ ID NO: 9045480 - DNA, 22 bp, Homo sapiens
gagctgaacatcatggaaaggc

SEQ ID NO: 9045481 - DNA, 22 bp, Homo sapiens
gagctcttcctttcaggaggcc

SEQ ID NO: 9045482 - DNA, 22 bp, Homo sapiens
gagctctttaccaggtcaggac

SEQ ID NO: 9045483 - DNA, 22 bp, Homo sapiens
gagctcttgcttctagtccagg

SEQ ID NO: 9045484 - DNA, 22 bp, Homo sapiens
gagctgaatcagagatattatt

SEQ ID NO: 9045485 - DNA, 22 bp, Homo sapiens
gagctgaatcagagatattatt

SEQ ID NO: 9045486 - DNA, 18 bp, Homo sapiens
gagctgagaagaggatgc

SEQ ID NO: 9045487 - DNA, 22 bp, Homo sapiens
gagctgaattgaagcaaggagc

SEQ ID NO: 9045488 - DNA, 22 bp, Homo sapiens
gagctgagacacactttggcaa

SEQ ID NO: 9045489 - DNA, 22 bp, Homo sapiens
gagctgagaagcagcgcttgat

SEQ ID NO: 9045490 - DNA, 19 bp, Homo sapiens
gagctgagagtagcactgg

SEQ ID NO: 9045491 - DNA, 22 bp, Homo sapiens
gagcttcagctgccatgactgt

SEQ ID NO: 9045492 - DNA, 22 bp, Homo sapiens
gagcttcatatgttgcagagaa

SEQ ID NO: 9045493 - DNA, 22 bp, Homo sapiens
gagcttcaaatggacgaccttt

SEQ ID NO: 9045494 - DNA, 22 bp, Homo sapiens
gagcttcagaatttaacagact

SEQ ID NO: 9045495 - DNA, 22 bp, Homo sapiens
gagcttcacgggggacagcatt

SEQ ID NO: 9045496 - DNA, 22 bp, Homo sapiens
gagcttaaatggctaaatataa

SEQ ID NO: 9045497 - DNA, 22 bp, Homo sapiens
gagcctggacatctcaggccca

SEQ ID NO: 9045498 - DNA, 22 bp, Homo sapiens
gagcctgcctctagtctctaga

SEQ ID NO: 9045499 - DNA, 22 bp, Homo sapiens
gagccctgttcaggcctcctca

SEQ ID NO: 9045500 - DNA, 22 bp, Homo sapiens
gagcctgcccagccctgtccac

SEQ ID NO: 9045501 - DNA, 22 bp, Homo sapiens
gagctcttatagttctagcagt

SEQ ID NO: 9045502 - DNA, 22 bp, Homo sapiens
gagctcttagatagggcaggaa

SEQ ID NO: 9045503 - DNA, 22 bp, Homo sapiens
gagctaagccctggagaggtcg

SEQ ID NO: 9045504 - DNA, 22 bp, Homo sapiens
gagctaagctatgttatgcagc

SEQ ID NO: 9045505 - DNA, 22 bp, Homo sapiens
gaggaaaagagacaggttattg

SEQ ID NO: 9045506 - DNA, 22 bp, Homo sapiens
gaggaaaataacaactaagggc

SEQ ID NO: 9045507 - DNA, 22 bp, Homo sapiens
gaggagcttgcatttaagtgcc

SEQ ID NO: 9045508 - DNA, 22 bp, Homo sapiens
gaggagcttgaggctaggagcc

SEQ ID NO: 9045509 - DNA, 22 bp, Homo sapiens
gaggagcttgtgagaagatgtc

SEQ ID NO: 9045510 - DNA, 22 bp, Homo sapiens
gaggcagaagttgcagtgagca

SEQ ID NO: 9045511 - DNA, 22 bp, Homo sapiens
gaggcactgctgggcccctgta

SEQ ID NO: 9045512 - DNA, 22 bp, Homo sapiens
gaggcactggaggaaaggagaa

SEQ ID NO: 9045513 - DNA, 22 bp, Homo sapiens
gaggcactgcagtacagtgact

SEQ ID NO: 9045514 - DNA, 22 bp, Homo sapiens
gaggcactctcgacaagggtgg

SEQ ID NO: 9045515 - DNA, 22 bp, Homo sapiens
gaggcaccagacatggcctcat

SEQ ID NO: 9045516 - DNA, 22 bp, Homo sapiens
gaggcaatgggctatagcattg

SEQ ID NO: 9045517 - DNA, 22 bp, Homo sapiens
gaataacattggaaccctgaag

SEQ ID NO: 9045518 - DNA, 22 bp, Homo sapiens
gaataacagcaagtttgcaggc

SEQ ID NO: 9045519 - DNA, 22 bp, Homo sapiens
gaaggaaaaatactctgtaagg

SEQ ID NO: 9045520 - DNA, 22 bp, Homo sapiens
gaaggaaaaatactctgtaagg

SEQ ID NO: 9045521 - DNA, 22 bp, Homo sapiens
gaaggaaaaatactctgtaagg

SEQ ID NO: 9045522 - DNA, 22 bp, Homo sapiens
gaaggaaaacagatctgcctga

SEQ ID NO: 9045523 - DNA, 22 bp, Homo sapiens
gaaggaaaacagatctgcctga

SEQ ID NO: 9045524 - DNA, 22 bp, Homo sapiens
gaagctgtgctgggggatctgt

SEQ ID NO: 9045525 - DNA, 22 bp, Homo sapiens
gaagctgtgttgatggcatgga

SEQ ID NO: 9045526 - DNA, 22 bp, Homo sapiens
gaagcttgaacagggccaggct

SEQ ID NO: 9045527 - DNA, 22 bp, Homo sapiens
gaaggaagactggtttaaatgt

SEQ ID NO: 9045528 - DNA, 22 bp, Homo sapiens
gaagttctcagctaggtgatgt

SEQ ID NO: 9045529 - DNA, 22 bp, Homo sapiens
gaagttctggtgtatgtgataa

SEQ ID NO: 9045530 - DNA, 22 bp, Homo sapiens
gaagttcttagtctcatttgca

SEQ ID NO: 9045531 - DNA, 22 bp, Homo sapiens
gaagttctttatagcagtgtga

SEQ ID NO: 9045532 - DNA, 23 bp, Homo sapiens
gaagttctttcttctcatgctgt

SEQ ID NO: 9045533 - DNA, 22 bp, Homo sapiens
gaagttctttgctccccagtac

SEQ ID NO: 9045534 - DNA, 22 bp, Homo sapiens
gaatatcccgctatgcaaagta

SEQ ID NO: 9045535 - DNA, 22 bp, Homo sapiens
gaatagcttagattccttagtg

SEQ ID NO: 9045536 - DNA, 22 bp, Homo sapiens
gaatagcttccttttttccaaa

SEQ ID NO: 9045537 - DNA, 22 bp, Homo sapiens
gaatacattggaaatcagaata

SEQ ID NO: 9045538 - DNA, 22 bp, Homo sapiens
gaatacattggaaatcagaata

SEQ ID NO: 9045539 - DNA, 18 bp, Homo sapiens
gaatactgagagcacaaa

SEQ ID NO: 9045540 - DNA, 22 bp, Homo sapiens
gacacagaaggtcacatgttca

SEQ ID NO: 9045541 - DNA, 22 bp, Homo sapiens
gacacagaaggtcacatgttca

SEQ ID NO: 9045542 - DNA, 22 bp, Homo sapiens
gacacagaatgggtgctcagta

SEQ ID NO: 9045543 - DNA, 22 bp, Homo sapiens
gacacagaccaccaggccctgg

SEQ ID NO: 9045544 - DNA, 22 bp, Homo sapiens
gacacagagacttgcagttgta

SEQ ID NO: 9045545 - DNA, 22 bp, Homo sapiens
gacacagacagttagaggtaat

SEQ ID NO: 9045546 - DNA, 22 bp, Homo sapiens
gacacagacagttagaggtaat

SEQ ID NO: 9045547 - DNA, 22 bp, Homo sapiens
gacacagaattcccctccaagt

SEQ ID NO: 9045548 - DNA, 22 bp, Homo sapiens
gacacagaatttactcccgata

SEQ ID NO: 9045549 - DNA, 22 bp, Homo sapiens
gacacagaatttactcccgata

SEQ ID NO: 9045550 - DNA, 22 bp, Homo sapiens
gacagggaaacattgaagtgtc

SEQ ID NO: 9045551 - DNA, 22 bp, Homo sapiens
gacagggacacagccagtgagg

SEQ ID NO: 9045552 - DNA, 22 bp, Homo sapiens
gacccatataggaccctccaaa

SEQ ID NO: 9045553 - DNA, 20 bp, Homo sapiens
gaagccagaggggaaaggag

SEQ ID NO: 9045554 - DNA, 22 bp, Homo sapiens
gaagccagattatcacaagcca

SEQ ID NO: 9045555 - DNA, 22 bp, Homo sapiens
gaagattttctcctttaaatga

SEQ ID NO: 9045556 - DNA, 20 bp, Homo sapiens
gaagatgggtagaggcacag

SEQ ID NO: 9045557 - DNA, 22 bp, Homo sapiens
gaagatttaagcacaatagtct

SEQ ID NO: 9045558 - DNA, 22 bp, Homo sapiens
gaagatttctgatgagttactt

SEQ ID NO: 9045559 - DNA, 22 bp, Homo sapiens
gaagaggactgtggcatcctag

SEQ ID NO: 9045560 - DNA, 22 bp, Homo sapiens
gaagagcttagttgtcctagaa

SEQ ID NO: 9045561 - DNA, 20 bp, Homo sapiens
gaacatttggccatactgag

SEQ ID NO: 9045562 - DNA, 21 bp, Homo sapiens
gaacatttgggttgtttctac

SEQ ID NO: 9045563 - DNA, 22 bp, Homo sapiens
gaagacaagctgagtgttgtcc

SEQ ID NO: 9045564 - DNA, 22 bp, Homo sapiens
gaagaccaccccctacagcaca

SEQ ID NO: 9045565 - DNA, 22 bp, Homo sapiens
gaaatgcataatcttagtagat

SEQ ID NO: 9045566 - DNA, 22 bp, Homo sapiens
gaaatcattagcaaagatatgt

SEQ ID NO: 9045567 - DNA, 22 bp, Homo sapiens
gaaatcagttctgaaatttaca

SEQ ID NO: 9045568 - DNA, 22 bp, Homo sapiens
gaaatcattagcaaagatatgt

SEQ ID NO: 9045569 - DNA, 22 bp, Homo sapiens
gaacaggctggagtagcacaga

SEQ ID NO: 9045570 - DNA, 22 bp, Homo sapiens
gaacaggcataagcatttgcat

SEQ ID NO: 9045571 - DNA, 22 bp, Homo sapiens
gaacagggttgggtgagagagg

SEQ ID NO: 9045572 - DNA, 22 bp, Homo sapiens
ctttcataaaggaaatgatgag

SEQ ID NO: 9045573 - DNA, 22 bp, Homo sapiens
ctttcacagtcatatgatgaat

SEQ ID NO: 9045574 - DNA, 22 bp, Homo sapiens
ctttcacagctgtgcttatgat

SEQ ID NO: 9045575 - DNA, 22 bp, Homo sapiens
ctttcacagtcctgactgagcg

SEQ ID NO: 9045576 - DNA, 22 bp, Homo sapiens
ctttcacagtcctgactgagcg

SEQ ID NO: 9045577 - DNA, 22 bp, Homo sapiens
ctttcacataattgaccttgaa

SEQ ID NO: 9045578 - DNA, 22 bp, Homo sapiens
ctttcacagctgtgcttatgat

SEQ ID NO: 9045579 - DNA, 22 bp, Homo sapiens
ctttcacagctactcacctctg

SEQ ID NO: 9045580 - DNA, 22 bp, Homo sapiens
ctttcacagcttgaaaagtatt

SEQ ID NO: 9045581 - DNA, 22 bp, Homo sapiens
ctttcacagccttcgttctgaa

SEQ ID NO: 9045582 - DNA, 22 bp, Homo sapiens
ctttcacagccttcgttctgaa

SEQ ID NO: 9045583 - DNA, 22 bp, Homo sapiens
ctttcacacacatacatttgga

SEQ ID NO: 9045584 - DNA, 22 bp, Homo sapiens
ctttcacagcacaagcctgcct

SEQ ID NO: 9045585 - DNA, 22 bp, Homo sapiens
ctttcaatgtcatctgtgaatg

SEQ ID NO: 9045586 - DNA, 22 bp, Homo sapiens
ctttcacaagatttgagatgct

SEQ ID NO: 9045587 - DNA, 22 bp, Homo sapiens
ctttcaatcaaagtttctagtg

SEQ ID NO: 9045588 - DNA, 18 bp, Homo sapiens
ctttatgtgcagagcttt

SEQ ID NO: 9045589 - DNA, 22 bp, Homo sapiens
gaaatcaaggctacattcaggt

SEQ ID NO: 9045590 - DNA, 22 bp, Homo sapiens
gaaatcaaggctacattcaggt

SEQ ID NO: 9045591 - DNA, 22 bp, Homo sapiens
ctttcattcttagatattagtg

SEQ ID NO: 9045592 - DNA, 22 bp, Homo sapiens
ctttcattcttagatattagtg

SEQ ID NO: 9045593 - DNA, 22 bp, Homo sapiens
ttcatctggaatttatgttata

SEQ ID NO: 9045594 - DNA, 22 bp, Homo sapiens
cgtatttcatctcctttctgct

SEQ ID NO: 9045595 - DNA, 22 bp, Homo sapiens
cgtatttagaaggctgctgaaa

SEQ ID NO: 9045596 - DNA, 22 bp, Homo sapiens
cggtccagagctagttcattgc

SEQ ID NO: 9045597 - DNA, 22 bp, Homo sapiens
cggtccaggatggctggcaagc

SEQ ID NO: 9045598 - DNA, 22 bp, Homo sapiens
cggtccagggaacgcccccgcc

SEQ ID NO: 9045599 - DNA, 22 bp, Homo sapiens
ctaaagaagctagcaatctata

SEQ ID NO: 9045600 - DNA, 22 bp, Homo sapiens
ttcatgaatgttccatgtgagt

SEQ ID NO: 9045601 - DNA, 22 bp, Homo sapiens
ttcatgaagggtgaatatagtc

SEQ ID NO: 9045602 - DNA, 22 bp, Homo sapiens
ttcaggcctaatttctagcccc

SEQ ID NO: 9045603 - DNA, 22 bp, Homo sapiens
ttcagatgtggctttgtcaggc

SEQ ID NO: 9045604 - DNA, 22 bp, Homo sapiens
ttcagataaactacaaataatt

SEQ ID NO: 9045605 - DNA, 22 bp, Homo sapiens
ttcagaaataaaatatcccaac

SEQ ID NO: 9045606 - DNA, 22 bp, Homo sapiens
ttcacaatttcccttcatcagg

SEQ ID NO: 9045607 - DNA, 22 bp, Homo sapiens
ttcacaatttcccttcatcagg

SEQ ID NO: 9045608 - DNA, 22 bp, Homo sapiens
ttcacaattaactttatactta

SEQ ID NO: 9045609 - DNA, 22 bp, Homo sapiens
ttcaagttgtgttttccgggct

SEQ ID NO: 9045610 - DNA, 20 bp, Homo sapiens
ttcaagttgggtctctggct

SEQ ID NO: 9045611 - DNA, 22 bp, Homo sapiens
ttcaagttttatatccatggct

SEQ ID NO: 9045612 - DNA, 22 bp, Homo sapiens
cgcatacatagaaacacacaga

SEQ ID NO: 9045613 - DNA, 22 bp, Homo sapiens
ttaggaatatgtattttaaagt

SEQ ID NO: 9045614 - DNA, 22 bp, Homo sapiens
ttaggaatttatcacagactgg

SEQ ID NO: 9045615 - DNA, 22 bp, Homo sapiens
ttaggaatttattccattgttg

SEQ ID NO: 9045616 - DNA, 16 bp, Homo sapiens
cctttctctgccttcc

SEQ ID NO: 9045617 - DNA, 22 bp, Homo sapiens
cctttctaagatactgcaactt

SEQ ID NO: 9045618 - DNA, 22 bp, Homo sapiens
cctttcctttttagtgtgggag

SEQ ID NO: 9045619 - DNA, 22 bp, Homo sapiens
cctttcctgtgtccttttaagg

SEQ ID NO: 9045620 - DNA, 22 bp, Homo sapiens
cctttcctgcctcaggaagtag

SEQ ID NO: 9045621 - DNA, 19 bp, Homo sapiens
cctttcagaacagaagcca

SEQ ID NO: 9045622 - DNA, 18 bp, Homo sapiens
cctttcctcccctcagct

SEQ ID NO: 9045623 - DNA, 22 bp, Homo sapiens
cctttcctgcctcaggaagtag

SEQ ID NO: 9045624 - DNA, 22 bp, Homo sapiens
ctcacaggcatctcatcaggct

SEQ ID NO: 9045625 - DNA, 22 bp, Homo sapiens
ctcaagaggatatgtccagaaa

SEQ ID NO: 9045626 - DNA, 22 bp, Homo sapiens
ctcaaaatccataaaatcaggt

SEQ ID NO: 9045627 - DNA, 22 bp, Homo sapiens
ctattattatcctaatttctgt

SEQ ID NO: 9045628 - DNA, 22 bp, Homo sapiens
ctattatttcctcatctataaa

SEQ ID NO: 9045629 - DNA, 22 bp, Homo sapiens
ctattattagataatctacttg

SEQ ID NO: 9045630 - DNA, 22 bp, Homo sapiens
ctagcaggctaatgtaagcttg

SEQ ID NO: 9045631 - DNA, 22 bp, Homo sapiens
ctagcaggtcaaaccagctgat

SEQ ID NO: 9045632 - DNA, 22 bp, Homo sapiens
ctagcagggtcgacgtctggcg

SEQ ID NO: 9045633 - DNA, 22 bp, Homo sapiens
ctatatacttttcacagatgtt

SEQ ID NO: 9045634 - DNA, 19 bp, Homo sapiens
ctagattatggaatgctgc

SEQ ID NO: 9045635 - DNA, 22 bp, Homo sapiens
ctattaaatactcttcaaattg

SEQ ID NO: 9045636 - DNA, 22 bp, Homo sapiens
ctattaaatactcttcaaattg

SEQ ID NO: 9045637 - DNA, 22 bp, Homo sapiens
ctattacaatctgctactatga

SEQ ID NO: 9045638 - DNA, 22 bp, Homo sapiens
ctattaaacactactgtgcact

SEQ ID NO: 9045639 - DNA, 22 bp, Homo sapiens
ctatgtatgcgattagaatttt

SEQ ID NO: 9045640 - DNA, 22 bp, Homo sapiens
ctatgtaccatgcctgatgtta

SEQ ID NO: 9045641 - DNA, 22 bp, Homo sapiens
ctatgtactggattagctccca

SEQ ID NO: 9045642 - DNA, 22 bp, Homo sapiens
ctatgagaagaaaacaagatta

SEQ ID NO: 9045643 - DNA, 22 bp, Homo sapiens
ctactgtcttccttggtaacaa

SEQ ID NO: 9045644 - DNA, 22 bp, Homo sapiens
ctactgtccataaagtataact

SEQ ID NO: 9045645 - DNA, 22 bp, Homo sapiens
ctactgtctcatcagtgttatt

SEQ ID NO: 9045646 - DNA, 22 bp, Homo sapiens
ctacttctgtggctctaagaga

SEQ ID NO: 9045647 - DNA, 20 bp, Homo sapiens
ttcctggctctaggaccttg

SEQ ID NO: 9045648 - DNA, 22 bp, Homo sapiens
ttagaaaaatgttcagtagttt

SEQ ID NO: 9045649 - DNA, 22 bp, Homo sapiens
ttagaatcagaagagaggtatt

SEQ ID NO: 9045650 - DNA, 22 bp, Homo sapiens
cctttacagtatggttgtatca

SEQ ID NO: 9045651 - DNA, 22 bp, Homo sapiens
cctttacatctgacttctttca

SEQ ID NO: 9045652 - DNA, 22 bp, Homo sapiens
ttagaattattgtttccttcta

SEQ ID NO: 9045653 - DNA, 22 bp, Homo sapiens
ccttcctttcagggctatgcct

SEQ ID NO: 9045654 - DNA, 22 bp, Homo sapiens
ccttccttgagaagcaattcct

SEQ ID NO: 9045655 - DNA, 21 bp, Homo sapiens
ttactaaacaaaacatgcagg

SEQ ID NO: 9045656 - DNA, 22 bp, Homo sapiens
tgtttagagtctctgtcaacat

SEQ ID NO: 9045657 - DNA, 22 bp, Homo sapiens
tgtttagactcaaaattgaaag

SEQ ID NO: 9045658 - DNA, 22 bp, Homo sapiens
tgtttagaggaacaacagactt

SEQ ID NO: 9045659 - DNA, 22 bp, Homo sapiens
cctgtcttagggaaagactgga

SEQ ID NO: 9045660 - DNA, 22 bp, Homo sapiens
ttaaagctgtagagttacttgc

SEQ ID NO: 9045661 - DNA, 22 bp, Homo sapiens
ttaaagctggcgttacagtttg

SEQ ID NO: 9045662 - DNA, 22 bp, Homo sapiens
cctgtgccctgccaggctggtg

SEQ ID NO: 9045663 - DNA, 22 bp, Homo sapiens
ttaaaggctgatcttaatatta

SEQ ID NO: 9045664 - DNA, 22 bp, Homo sapiens
cctgggctcaagtgatcctcct

SEQ ID NO: 9045665 - DNA, 22 bp, Homo sapiens
cctgggctgcatgatggcattt

SEQ ID NO: 9045666 - DNA, 22 bp, Homo sapiens
cctgggctgcatgatggcattt

SEQ ID NO: 9045667 - DNA, 17 bp, Homo sapiens
tgttaattccaatgata

SEQ ID NO: 9045668 - DNA, 22 bp, Homo sapiens
tgtgttctgaaggagaagagtg

SEQ ID NO: 9045669 - DNA, 22 bp, Homo sapiens
cctggtggagaggggcggagcg

SEQ ID NO: 9045670 - DNA, 22 bp, Homo sapiens
cctggtggaaggtgagtgaggc

SEQ ID NO: 9045671 - DNA, 22 bp, Homo sapiens
cctggtgggcaggagtgagacc

SEQ ID NO: 9045672 - DNA, 22 bp, Homo sapiens
tgttcagagacagaaattctaa

SEQ ID NO: 9045673 - DNA, 22 bp, Homo sapiens
tgttacaatattatcaactgag

SEQ ID NO: 9045674 - DNA, 22 bp, Homo sapiens
tgttacacccacaaaaaattcc

SEQ ID NO: 9045675 - DNA, 21 bp, Homo sapiens
tgggggagaattggttgcttt

SEQ ID NO: 9045676 - DNA, 22 bp, Homo sapiens
cctgggagtgtcagacttgctt

SEQ ID NO: 9045677 - DNA, 22 bp, Homo sapiens
tggggcagttaataaacattct

SEQ ID NO: 9045678 - DNA, 22 bp, Homo sapiens
tggggcagggatgggaaactat

SEQ ID NO: 9045679 - DNA, 22 bp, Homo sapiens
tggggcagggatgggaaactat

SEQ ID NO: 9045680 - DNA, 22 bp, Homo sapiens
tggggcagccacatagacaaca

SEQ ID NO: 9045681 - DNA, 22 bp, Homo sapiens
tgtgtataactcttaattcatt

SEQ ID NO: 9045682 - DNA, 22 bp, Homo sapiens
tgtgtatagatgcatgcatata

SEQ ID NO: 9045683 - DNA, 22 bp, Homo sapiens
cctgggcaacatagggagaccc

SEQ ID NO: 9045684 - DNA, 22 bp, Homo sapiens
tttcctttatgacatcaccact

SEQ ID NO: 9045685 - DNA, 20 bp, Homo sapiens
tttcctttcattttagtacc

SEQ ID NO: 9045686 - DNA, 22 bp, Homo sapiens
tttccttgttcatttgccctat

SEQ ID NO: 9045687 - DNA, 22 bp, Homo sapiens
tttcctttccaaaattctgcct

SEQ ID NO: 9045688 - DNA, 20 bp, Homo sapiens
ctctgcagcaaggcctgggt

SEQ ID NO: 9045689 - DNA, 20 bp, Homo sapiens
ctctgcagcaaggcctgggt

SEQ ID NO: 9045690 - DNA, 22 bp, Homo sapiens
tttgggattttacattgtatgg

SEQ ID NO: 9045691 - DNA, 22 bp, Homo sapiens
tttgggaaataaacctagagga

SEQ ID NO: 9045692 - DNA, 22 bp, Homo sapiens
ctctgctttcctcttacacact

SEQ ID NO: 9045693 - DNA, 22 bp, Homo sapiens
tttgctctgacagtgccagaga

SEQ ID NO: 9045694 - DNA, 22 bp, Homo sapiens
tttgctctgctgttgccaggtg

SEQ ID NO: 9045695 - DNA, 22 bp, Homo sapiens
tttgctcttgctgcttggggca

SEQ ID NO: 9045696 - DNA, 22 bp, Homo sapiens
tttgctcttatgaacaaggtgg

SEQ ID NO: 9045697 - DNA, 22 bp, Homo sapiens
tttgctcttgctggaaaagttg

SEQ ID NO: 9045698 - DNA, 22 bp, Homo sapiens
tttgctctctcaggctcctggg

SEQ ID NO: 9045699 - DNA, 20 bp, Homo sapiens
ttttagcacttgttatggtg

SEQ ID NO: 9045700 - DNA, 19 bp, Homo sapiens
ttttaagtcctctctattc

SEQ ID NO: 9045701 - DNA, 22 bp, Homo sapiens
ttttaagttaatataattgagg

SEQ ID NO: 9045702 - DNA, 22 bp, Homo sapiens
ttttaatactgctattgtagga

SEQ ID NO: 9045703 - DNA, 22 bp, Homo sapiens
ttttaagaactgttctgtgctt

SEQ ID NO: 9045704 - DNA, 22 bp, Homo sapiens
ttttaagaggaggctgtttgaa

SEQ ID NO: 9045705 - DNA, 22 bp, Homo sapiens
ttttaagatgctagtatttcag

SEQ ID NO: 9045706 - DNA, 22 bp, Homo sapiens
tttgttctattttagagatgaa

SEQ ID NO: 9045707 - DNA, 22 bp, Homo sapiens
ctctttagtcacagggcttcat

SEQ ID NO: 9045708 - DNA, 22 bp, Homo sapiens
ctctttagtctgtgtggagaag

SEQ ID NO: 9045709 - DNA, 22 bp, Homo sapiens
ttttcagttactgtttatgtga

SEQ ID NO: 9045710 - DNA, 22 bp, Homo sapiens
ttttcacattgtcccagcacta

SEQ ID NO: 9045711 - DNA, 22 bp, Homo sapiens
ttttcaggtgcagtaatcatat

SEQ ID NO: 9045712 - DNA, 22 bp, Homo sapiens
ctcttattcctacagtaacagg

SEQ ID NO: 9045713 - DNA, 20 bp, Homo sapiens
ctcttattgcattagtttct

SEQ ID NO: 9045714 - DNA, 22 bp, Homo sapiens
ctgcacagtggacagtgaagat

SEQ ID NO: 9045715 - DNA, 22 bp, Homo sapiens
ctgcaaaattgttctttgctcc

SEQ ID NO: 9045716 - DNA, 22 bp, Homo sapiens
ctgcaaaagtcattgtggtttt

SEQ ID NO: 9045717 - DNA, 20 bp, Homo sapiens
ctgcaaaatgacattaggaa

SEQ ID NO: 9045718 - DNA, 22 bp, Homo sapiens
ctgcagggagcagatggcgtgt

SEQ ID NO: 9045719 - DNA, 22 bp, Homo sapiens
ctgcaccacagcctgaggcagc

SEQ ID NO: 9045720 - DNA, 22 bp, Homo sapiens
ctgcaccacagcctgaggcagc

SEQ ID NO: 9045721 - DNA, 19 bp, Homo sapiens
ctgcagggatgtgcagagt

SEQ ID NO: 9045722 - DNA, 19 bp, Homo sapiens
ctgcagggatgtgcagagt

SEQ ID NO: 9045723 - DNA, 22 bp, Homo sapiens
ctgcagggatgtgaggcccgtt

SEQ ID NO: 9045724 - DNA, 22 bp, Homo sapiens
ctgcagggaggttccttgttct

SEQ ID NO: 9045725 - DNA, 22 bp, Homo sapiens
ctgcagggcagggcctcctggc

SEQ ID NO: 9045726 - DNA, 22 bp, Homo sapiens
ctgcagggcagggcctcctggc

SEQ ID NO: 9045727 - DNA, 22 bp, Homo sapiens
ctgcagggcattgtaactcttt

SEQ ID NO: 9045728 - DNA, 22 bp, Homo sapiens
ctgcagggattgcttctgtata

SEQ ID NO: 9045729 - DNA, 22 bp, Homo sapiens
ctgcagggcagaagggcataga

SEQ ID NO: 9045730 - DNA, 22 bp, Homo sapiens
ctgcaggggcagtccacttcct

SEQ ID NO: 9045731 - DNA, 22 bp, Homo sapiens
ctgcaggggaccaaagtctgac

SEQ ID NO: 9045732 - DNA, 22 bp, Homo sapiens
ctgcaggggaccaaagtctgac

SEQ ID NO: 9045733 - DNA, 22 bp, Homo sapiens
ctgcagggcttaccttgctctg

SEQ ID NO: 9045734 - DNA, 22 bp, Homo sapiens
ctgcagggcccgcctgagccct

SEQ ID NO: 9045735 - DNA, 22 bp, Homo sapiens
ctgcagggccatgggttctata

SEQ ID NO: 9045736 - DNA, 22 bp, Homo sapiens
ctgcagggcccaaggtcaacgg

SEQ ID NO: 9045737 - DNA, 22 bp, Homo sapiens
ctgacatgtataagctttaagt

SEQ ID NO: 9045738 - DNA, 19 bp, Homo sapiens
ctctttccattgtatttgc

SEQ ID NO: 9045739 - DNA, 22 bp, Homo sapiens
ctctttagtggtgatgatgcta

SEQ ID NO: 9045740 - DNA, 22 bp, Homo sapiens
ctctttagtttgaaatccacat

SEQ ID NO: 9045741 - DNA, 22 bp, Homo sapiens
ctctttggatagaattacaaag

SEQ ID NO: 9045742 - DNA, 22 bp, Homo sapiens
ttgtcttttgtgggaaatatgg

SEQ ID NO: 9045743 - DNA, 22 bp, Homo sapiens
ttgtggttaaccgcacattttt

SEQ ID NO: 9045744 - DNA, 22 bp, Homo sapiens
ctcccagacatgtgcctccttg

SEQ ID NO: 9045745 - DNA, 22 bp, Homo sapiens
tttaagttccttttcaacaact

SEQ ID NO: 9045746 - DNA, 22 bp, Homo sapiens
tttaacagatgctatgtctacc

SEQ ID NO: 9045747 - DNA, 22 bp, Homo sapiens
tttaatatccagtggatacaaa

SEQ ID NO: 9045748 - DNA, 22 bp, Homo sapiens
tttaatagggcccaatgagact

SEQ ID NO: 9045749 - DNA, 22 bp, Homo sapiens
tttaatatttctttcctgaagc

SEQ ID NO: 9045750 - DNA, 22 bp, Homo sapiens
tttaatatctcacacttccatg

SEQ ID NO: 9045751 - DNA, 22 bp, Homo sapiens
tttaatatctcacacttccatg

SEQ ID NO: 9045752 - DNA, 22 bp, Homo sapiens
ctcatttatgtaatgattaagg

SEQ ID NO: 9045753 - DNA, 22 bp, Homo sapiens
ctcatttacctttgcaatcaag

SEQ ID NO: 9045754 - DNA, 22 bp, Homo sapiens
ctcatttacactatgggaacta

SEQ ID NO: 9045755 - DNA, 22 bp, Homo sapiens
ctcatttaacagattaaaaagt

SEQ ID NO: 9045756 - DNA, 22 bp, Homo sapiens
ctcatttactcatctgcaaaac

SEQ ID NO: 9045757 - DNA, 22 bp, Homo sapiens
ctcatttactgtagaacagtta

SEQ ID NO: 9045758 - DNA, 22 bp, Homo sapiens
ctcatttactactcatgtgacc

SEQ ID NO: 9045759 - DNA, 22 bp, Homo sapiens
ttcttttaatttctgtctgcag

SEQ ID NO: 9045760 - DNA, 22 bp, Homo sapiens
ttcttttacattaagatttcag

SEQ ID NO: 9045761 - DNA, 22 bp, Homo sapiens
ctccaccacacatctgtccacc

SEQ ID NO: 9045762 - DNA, 22 bp, Homo sapiens
ttgtacaaagatttcacagctc

SEQ ID NO: 9045763 - DNA, 22 bp, Homo sapiens
ttgtacaaatgcatattcctgg

SEQ ID NO: 9045764 - DNA, 19 bp, Homo sapiens
ctccacagggattgtgatt

SEQ ID NO: 9045765 - DNA, 22 bp, Homo sapiens
ctctccagggaagcagtgtact

SEQ ID NO: 9045766 - DNA, 22 bp, Homo sapiens
tttccttgggtctcttagtggc

SEQ ID NO: 9045767 - DNA, 22 bp, Homo sapiens
tttccttgcctcctgtccttct

SEQ ID NO: 9045768 - DNA, 22 bp, Homo sapiens
tttccttgttattatttgtcct

SEQ ID NO: 9045769 - DNA, 18 bp, Homo sapiens
tttccttgtatgaacata

SEQ ID NO: 9045770 - DNA, 22 bp, Homo sapiens
tttcctaaggctcattttaaaa

SEQ ID NO: 9045771 - DNA, 20 bp, Homo sapiens
tttcctaagtggtttgctga

SEQ ID NO: 9045772 - DNA, 22 bp, Homo sapiens
tttcaattccaccaaagcgccc

SEQ ID NO: 9045773 - DNA, 22 bp, Homo sapiens
tttcaattaggatgtttccatg

SEQ ID NO: 9045774 - DNA, 22 bp, Homo sapiens
tttcaattgactttggaagaaa

SEQ ID NO: 9045775 - DNA, 22 bp, Homo sapiens
tttcaatttccaggctagaatt

SEQ ID NO: 9045776 - DNA, 21 bp, Homo sapiens
tttcaatttgccttgagtcat

SEQ ID NO: 9045777 - DNA, 22 bp, Homo sapiens
tttcaaatggagtcgtgaaatg

SEQ ID NO: 9045778 - DNA, 22 bp, Homo sapiens
ctcctggccctgagctcccagg

SEQ ID NO: 9045779 - DNA, 21 bp, Homo sapiens
tttcacaaaagtatgtgacaa

SEQ ID NO: 9045780 - DNA, 22 bp, Homo sapiens
tttcacaaactgaggagacaat

SEQ ID NO: 9045781 - DNA, 22 bp, Homo sapiens
tttcacaaactcagggtgtgtg

SEQ ID NO: 9045782 - DNA, 22 bp, Homo sapiens
tttcacaaactgaggagacaat

SEQ ID NO: 9045783 - DNA, 19 bp, Homo sapiens
tttcacaaagagagcgtga

SEQ ID NO: 9045784 - DNA, 19 bp, Homo sapiens
tttcacaaagagagcgtga

SEQ ID NO: 9045785 - DNA, 22 bp, Homo sapiens
tttcacaacacaatctcgttaa

SEQ ID NO: 9045786 - DNA, 22 bp, Homo sapiens
tttcacagtagaaatcattatg

SEQ ID NO: 9045787 - DNA, 22 bp, Homo sapiens
tttcacaaatgtctttaacttg

SEQ ID NO: 9045788 - DNA, 22 bp, Homo sapiens
tttcacaaatgtctttaacttg

SEQ ID NO: 9045789 - DNA, 22 bp, Homo sapiens
tttcacaaagcatagcacttta

SEQ ID NO: 9045790 - DNA, 22 bp, Homo sapiens
tttcacaaagcatagcacttta

SEQ ID NO: 9045791 - DNA, 22 bp, Homo sapiens
tttcacaaagcatagcacttta

SEQ ID NO: 9045792 - DNA, 22 bp, Homo sapiens
tttattccatgtgtctatgacc

SEQ ID NO: 9045793 - DNA, 22 bp, Homo sapiens
tttattccagtgtttctcaaat

SEQ ID NO: 9045794 - DNA, 18 bp, Homo sapiens
tttattcctgcccccagc

SEQ ID NO: 9045795 - DNA, 22 bp, Homo sapiens
ctcctcccaattgccaagtgct

SEQ ID NO: 9045796 - DNA, 22 bp, Homo sapiens
ctcctccacccgctggggccca

SEQ ID NO: 9045797 - DNA, 22 bp, Homo sapiens
ctcctccagcttccagtggctc

SEQ ID NO: 9045798 - DNA, 22 bp, Homo sapiens
tttatttaaagtcgtgtgttaa

SEQ ID NO: 9045799 - DNA, 22 bp, Homo sapiens
tttatttaccttatgtcctcca

SEQ ID NO: 9045800 - DNA, 22 bp, Homo sapiens
ctcctggcagttccccttgtca

SEQ ID NO: 9045801 - DNA, 17 bp, Homo sapiens
ctcctggcagcctcagg

SEQ ID NO: 9045802 - DNA, 21 bp, Homo sapiens
tttagagaatactcactattt

SEQ ID NO: 9045803 - DNA, 17 bp, Homo sapiens
ctcccccccacgtgtcc

SEQ ID NO: 9045804 - DNA, 22 bp, Homo sapiens
ctccccgagagaggttgtccgc

SEQ ID NO: 9045805 - DNA, 22 bp, Homo sapiens
tttaatcaggcaaagcataata

SEQ ID NO: 9045806 - DNA, 22 bp, Homo sapiens
tttaggttttttcacgtggcta

SEQ ID NO: 9045807 - DNA, 22 bp, Homo sapiens
tttagtcatttggatttgatct

SEQ ID NO: 9045808 - DNA, 22 bp, Homo sapiens
ctcctcagttgtcccatggaga

SEQ ID NO: 9045809 - DNA, 22 bp, Homo sapiens
ctcctccacagagtccttgcca

SEQ ID NO: 9045810 - DNA, 17 bp, Homo sapiens
ccaggtgggaggtgggg

SEQ ID NO: 9045811 - DNA, 17 bp, Homo sapiens
ccaggtgggaggtgggg

SEQ ID NO: 9045812 - DNA, 22 bp, Homo sapiens
tgagacgaagtcttgctctgtt

SEQ ID NO: 9045813 - DNA, 21 bp, Homo sapiens
tgagaagtatgtcttcagcca

SEQ ID NO: 9045814 - DNA, 22 bp, Homo sapiens
tgagaatagcagactggtaact

SEQ ID NO: 9045815 - DNA, 22 bp, Homo sapiens
tgagaatatttgaagatgttag

SEQ ID NO: 9045816 - DNA, 22 bp, Homo sapiens
tgagaatcatccagaggcttct

SEQ ID NO: 9045817 - DNA, 17 bp, Homo sapiens
ccaggtctccttgcttt

SEQ ID NO: 9045818 - DNA, 17 bp, Homo sapiens
ccaggtggaatcgtgga

SEQ ID NO: 9045819 - DNA, 22 bp, Homo sapiens
ccaggtggaaggtctgtgctct

SEQ ID NO: 9045820 - DNA, 22 bp, Homo sapiens
ccaggtggacaaggctttcaca

SEQ ID NO: 9045821 - DNA, 19 bp, Homo sapiens
ccaggtggaactgaggtag

SEQ ID NO: 9045822 - DNA, 22 bp, Homo sapiens
tgacaagaatttgggactgtta

SEQ ID NO: 9045823 - DNA, 22 bp, Homo sapiens
tgacaagagacccctccgcagg

SEQ ID NO: 9045824 - DNA, 22 bp, Homo sapiens
tgaatgcaagtcacacatttct

SEQ ID NO: 9045825 - DNA, 22 bp, Homo sapiens
tgaatgcacattagtaagtgca

SEQ ID NO: 9045826 - DNA, 22 bp, Homo sapiens
tgaatgcaaatcatgattgtaa

SEQ ID NO: 9045827 - DNA, 22 bp, Homo sapiens
tgacaaattcatatttcagagg

SEQ ID NO: 9045828 - DNA, 21 bp, Homo sapiens
tgaatgcttcgtcatcctggc

SEQ ID NO: 9045829 - DNA, 22 bp, Homo sapiens
tgaatgcatggcttagatctac

SEQ ID NO: 9045830 - DNA, 22 bp, Homo sapiens
tgaatgcagagactgtgggaaa

SEQ ID NO: 9045831 - DNA, 22 bp, Homo sapiens
tgaagttgttaaggttgccatt

SEQ ID NO: 9045832 - DNA, 22 bp, Homo sapiens
tgaatgatatgtgaaaaggaac

SEQ ID NO: 9045833 - DNA, 22 bp, Homo sapiens
ccaggctggattttgcagttca

SEQ ID NO: 9045834 - DNA, 22 bp, Homo sapiens
ccaggctggagtgcagtggcac

SEQ ID NO: 9045835 - DNA, 21 bp, Homo sapiens
ccaggggcaaattgtcgtttc

SEQ ID NO: 9045836 - DNA, 22 bp, Homo sapiens
ccaggggcctgtgaaggtgccc

SEQ ID NO: 9045837 - DNA, 22 bp, Homo sapiens
tgacaagatcacagtcaagtgt

SEQ ID NO: 9045838 - DNA, 22 bp, Homo sapiens
ccagtgttgcataggatgggga

SEQ ID NO: 9045839 - DNA, 22 bp, Homo sapiens
ccagtgtttacagttgaacaaa

SEQ ID NO: 9045840 - DNA, 22 bp, Homo sapiens
ccagtgttggaggatggcttgc

SEQ ID NO: 9045841 - DNA, 22 bp, Homo sapiens
ccagtgtttaggaataaaatgt

SEQ ID NO: 9045842 - DNA, 22 bp, Homo sapiens
ccagtgttccagagagctgatg

SEQ ID NO: 9045843 - DNA, 22 bp, Homo sapiens
ccagtgttccctcgggttcatg

SEQ ID NO: 9045844 - DNA, 22 bp, Homo sapiens
ccagtgttccatggagtgatta

SEQ ID NO: 9045845 - DNA, 22 bp, Homo sapiens
ccagtgttctggtgttcatttc

SEQ ID NO: 9045846 - DNA, 22 bp, Homo sapiens
ccagtgttgaacagtatttgga

SEQ ID NO: 9045847 - DNA, 22 bp, Homo sapiens
ccagtcctagaagaggagtcga

SEQ ID NO: 9045848 - DNA, 22 bp, Homo sapiens
ccagtcctgccaccctgtctat

SEQ ID NO: 9045849 - DNA, 22 bp, Homo sapiens
ccagtcctgccaccctgtctat

SEQ ID NO: 9045850 - DNA, 22 bp, Homo sapiens
ccagtcctcagatggtctgtgc

SEQ ID NO: 9045851 - DNA, 22 bp, Homo sapiens
ccagtcctttgagccagttctg

SEQ ID NO: 9045852 - DNA, 22 bp, Homo sapiens
ccagtcctgtgtgaccctgcac

SEQ ID NO: 9045853 - DNA, 22 bp, Homo sapiens
ccagtgtttccgtcagtacacg

SEQ ID NO: 9045854 - DNA, 22 bp, Homo sapiens
ccagtgtttccgtcagtacacg

SEQ ID NO: 9045855 - DNA, 22 bp, Homo sapiens
ccagtgtttccccagaagagag

SEQ ID NO: 9045856 - DNA, 22 bp, Homo sapiens
ccagtgttttcatcctcccttg

SEQ ID NO: 9045857 - DNA, 22 bp, Homo sapiens
ccagtgtttgatgggattttca

SEQ ID NO: 9045858 - DNA, 22 bp, Homo sapiens
ccatgcagtgctggagctgatt

SEQ ID NO: 9045859 - DNA, 22 bp, Homo sapiens
ccatgccctaaaggactggcag

SEQ ID NO: 9045860 - DNA, 22 bp, Homo sapiens
ccatgctgaccctgtgcaggca

SEQ ID NO: 9045861 - DNA, 22 bp, Homo sapiens
tgattttattgaaacttcactt

SEQ ID NO: 9045862 - DNA, 22 bp, Homo sapiens
tgatttcttctaatttccatca

SEQ ID NO: 9045863 - DNA, 20 bp, Homo sapiens
tgatttctcttctattcctt

SEQ ID NO: 9045864 - DNA, 22 bp, Homo sapiens
tgatttctcttggcaatatgtt

SEQ ID NO: 9045865 - DNA, 22 bp, Homo sapiens
tgatttctcatattgttcaaaa

SEQ ID NO: 9045866 - DNA, 21 bp, Homo sapiens
tgatttctagatattggccca

SEQ ID NO: 9045867 - DNA, 22 bp, Homo sapiens
ccattatccattttgagtctta

SEQ ID NO: 9045868 - DNA, 22 bp, Homo sapiens
ccattatccacgggcttcctga

SEQ ID NO: 9045869 - DNA, 22 bp, Homo sapiens
ccattatccattttgagtctta

SEQ ID NO: 9045870 - DNA, 22 bp, Homo sapiens
ccattattataggaggctcatt

SEQ ID NO: 9045871 - DNA, 22 bp, Homo sapiens
ccatgttgtatctcttatcggc

SEQ ID NO: 9045872 - DNA, 22 bp, Homo sapiens
ccatgttggaacttcacattct

SEQ ID NO: 9045873 - DNA, 22 bp, Homo sapiens
ccatgttgtcaaacttagagta

SEQ ID NO: 9045874 - DNA, 22 bp, Homo sapiens
tgcaaagggctttgcatacaga

SEQ ID NO: 9045875 - DNA, 22 bp, Homo sapiens
tgcaaatagcctatatttatag

SEQ ID NO: 9045876 - DNA, 22 bp, Homo sapiens
tgcaaataagctattatggaat

SEQ ID NO: 9045877 - DNA, 22 bp, Homo sapiens
tgcaaataaatttctgttcatt

SEQ ID NO: 9045878 - DNA, 22 bp, Homo sapiens
tgcaaatattagcattcgatat

SEQ ID NO: 9045879 - DNA, 22 bp, Homo sapiens
cccacccctggacaggtgagtg

SEQ ID NO: 9045880 - DNA, 22 bp, Homo sapiens
tgcacacatgtttacaagcatc

SEQ ID NO: 9045881 - DNA, 22 bp, Homo sapiens
tctcagaagggtggtgctggag

SEQ ID NO: 9045882 - DNA, 22 bp, Homo sapiens
tctcagaataaattcctaactt

SEQ ID NO: 9045883 - DNA, 22 bp, Homo sapiens
tctcagaagtgatcaggatgtt

SEQ ID NO: 9045884 - DNA, 22 bp, Homo sapiens
tctcagaattgtgtccactggg

SEQ ID NO: 9045885 - DNA, 19 bp, Homo sapiens
tctcagaattggcaatcat

SEQ ID NO: 9045886 - DNA, 19 bp, Homo sapiens
tctcagaattaagagtgct

SEQ ID NO: 9045887 - DNA, 22 bp, Homo sapiens
tctcagaatccttgcccaggtg

SEQ ID NO: 9045888 - DNA, 22 bp, Homo sapiens
tctcagaatcaggacctacttc

SEQ ID NO: 9045889 - DNA, 22 bp, Homo sapiens
tctgctattttctatctgtgtg

SEQ ID NO: 9045890 - DNA, 22 bp, Homo sapiens
ccagctctcagcgggagactca

SEQ ID NO: 9045891 - DNA, 22 bp, Homo sapiens
ccagctctctgcagaaaggact

SEQ ID NO: 9045892 - DNA, 22 bp, Homo sapiens
ccagctgattcggtggtggttg

SEQ ID NO: 9045893 - DNA, 22 bp, Homo sapiens
ccagctctgccaagcgtcagct

SEQ ID NO: 9045894 - DNA, 20 bp, Homo sapiens
ccagctgagccaaggggaga

SEQ ID NO: 9045895 - DNA, 22 bp, Homo sapiens
ccagctgaggcagccacacagg

SEQ ID NO: 9045896 - DNA, 22 bp, Homo sapiens
ccagctgaggttgaagaaagag

SEQ ID NO: 9045897 - DNA, 22 bp, Homo sapiens
ccagctctctttgaagcataaa

SEQ ID NO: 9045898 - DNA, 22 bp, Homo sapiens
ccagctctctgcagaaaggact

SEQ ID NO: 9045899 - DNA, 22 bp, Homo sapiens
ccagctctgcagggcctggggt

SEQ ID NO: 9045900 - DNA, 22 bp, Homo sapiens
ccagctctgcatgtttcccttg

SEQ ID NO: 9045901 - DNA, 22 bp, Homo sapiens
ccagctctgattttgacctcca

SEQ ID NO: 9045902 - DNA, 22 bp, Homo sapiens
tctggccctgctgctgtgagca

SEQ ID NO: 9045903 - DNA, 22 bp, Homo sapiens
tctggcctatttctgtcagatc

SEQ ID NO: 9045904 - DNA, 22 bp, Homo sapiens
tctgggagatccaagcagaact

SEQ ID NO: 9045905 - DNA, 22 bp, Homo sapiens
tctgggagagtctaacttgttt

SEQ ID NO: 9045906 - DNA, 22 bp, Homo sapiens
tctggtagaagaagtgaagctg

SEQ ID NO: 9045907 - DNA, 22 bp, Homo sapiens
tctgggagcagctcagcagatt

SEQ ID NO: 9045908 - DNA, 22 bp, Homo sapiens
tctggtcagtctccattctacc

SEQ ID NO: 9045909 - DNA, 20 bp, Homo sapiens
tctggtgccccttcctgaga

SEQ ID NO: 9045910 - DNA, 22 bp, Homo sapiens
tctggtgtcagtattctttgaa

SEQ ID NO: 9045911 - DNA, 22 bp, Homo sapiens
tctggtgtcagtattctttgaa

SEQ ID NO: 9045912 - DNA, 22 bp, Homo sapiens
tcttagaatgtcaactgatgtt

SEQ ID NO: 9045913 - DNA, 22 bp, Homo sapiens
tcttcacattcacgtaacatag

SEQ ID NO: 9045914 - DNA, 22 bp, Homo sapiens
tcttcacattcacgtaacatag

SEQ ID NO: 9045915 - DNA, 22 bp, Homo sapiens
tcttcacattttaagaagttct

SEQ ID NO: 9045916 - DNA, 22 bp, Homo sapiens
ccaggagttggaagctgccatg

SEQ ID NO: 9045917 - DNA, 22 bp, Homo sapiens
ccaggagttggaggctgcagtg

SEQ ID NO: 9045918 - DNA, 22 bp, Homo sapiens
ccaggagtttgaggctgcagtg

SEQ ID NO: 9045919 - DNA, 22 bp, Homo sapiens
ccaggaggttgaggctgcagtg

SEQ ID NO: 9045920 - DNA, 22 bp, Homo sapiens
ccaggagacccagggaaggagc

SEQ ID NO: 9045921 - DNA, 22 bp, Homo sapiens
tctttcaatccattcatatgtc

SEQ ID NO: 9045922 - DNA, 19 bp, Homo sapiens
ccaggccatcccagttccc

SEQ ID NO: 9045923 - DNA, 22 bp, Homo sapiens
tctttgaaaagggagatagaaa

SEQ ID NO: 9045924 - DNA, 22 bp, Homo sapiens
ccaggcctgcatctgctgcgca

SEQ ID NO: 9045925 - DNA, 22 bp, Homo sapiens
tctttcttggtataaagcaggg

SEQ ID NO: 9045926 - DNA, 22 bp, Homo sapiens
tctttcttattatgctcaatgt

SEQ ID NO: 9045927 - DNA, 22 bp, Homo sapiens
tctttcttattatgctcaatgt

SEQ ID NO: 9045928 - DNA, 22 bp, Homo sapiens
tctttcttcagccctgtaagat

SEQ ID NO: 9045929 - DNA, 22 bp, Homo sapiens
tctttcttcctggagcccaaca

SEQ ID NO: 9045930 - DNA, 22 bp, Homo sapiens
tctttcttctttcatagtgtga

SEQ ID NO: 9045931 - DNA, 22 bp, Homo sapiens
tctttgggagatgttatttata

SEQ ID NO: 9045932 - DNA, 22 bp, Homo sapiens
ccaggcctggacgggtggcctg

SEQ ID NO: 9045933 - DNA, 22 bp, Homo sapiens
ccaggcctggaccatgccaggg

SEQ ID NO: 9045934 - DNA, 22 bp, Homo sapiens
ccaggctgaatatgttccaggg

SEQ ID NO: 9045935 - DNA, 19 bp, Homo sapiens
ccctcttgcacaaagcaaa

SEQ ID NO: 9045936 - DNA, 22 bp, Homo sapiens
ccctctctcaggctgacagcct

SEQ ID NO: 9045937 - DNA, 22 bp, Homo sapiens
tggaatgtgctagggctgtggc

SEQ ID NO: 9045938 - DNA, 22 bp, Homo sapiens
tggaatgtgaacatacaaggta

SEQ ID NO: 9045939 - DNA, 22 bp, Homo sapiens
ccccacacctgccgggcagcag

SEQ ID NO: 9045940 - DNA, 20 bp, Homo sapiens
ccccacactattgagcactt

SEQ ID NO: 9045941 - DNA, 22 bp, Homo sapiens
ccccacactctttacattcata

SEQ ID NO: 9045942 - DNA, 22 bp, Homo sapiens
cccaggtccccacctgtctgct

SEQ ID NO: 9045943 - DNA, 22 bp, Homo sapiens
cccattccctttactgttgcat

SEQ ID NO: 9045944 - DNA, 22 bp, Homo sapiens
cccaggtctatgccagctctga

SEQ ID NO: 9045945 - DNA, 22 bp, Homo sapiens
cccctttctcccgcgtctggcc

SEQ ID NO: 9045946 - DNA, 22 bp, Homo sapiens
ccccttctgtgtcctgtcagcc

SEQ ID NO: 9045947 - DNA, 22 bp, Homo sapiens
ccccttctggtcttcaatggtg

SEQ ID NO: 9045948 - DNA, 22 bp, Homo sapiens
ccccttctctgcaagcctgctc

SEQ ID NO: 9045949 - DNA, 22 bp, Homo sapiens
cccgagtgtctactcactccca

SEQ ID NO: 9045950 - DNA, 22 bp, Homo sapiens
tgccatattgcaaagtgtctgc

SEQ ID NO: 9045951 - DNA, 22 bp, Homo sapiens
tgccagttgggaaaacagacat

SEQ ID NO: 9045952 - DNA, 22 bp, Homo sapiens
tgccctgggagttggagctgct

SEQ ID NO: 9045953 - DNA, 22 bp, Homo sapiens
tgccctgggagttggagctgct

SEQ ID NO: 9045954 - DNA, 22 bp, Homo sapiens
tgccctgggctttgctatgact

SEQ ID NO: 9045955 - DNA, 22 bp, Homo sapiens
tgccctggggtctggagcagca

SEQ ID NO: 9045956 - DNA, 22 bp, Homo sapiens
tgccagcttttgactatcttag

SEQ ID NO: 9045957 - DNA, 22 bp, Homo sapiens
tgccctggttacactggagtcc

SEQ ID NO: 9045958 - DNA, 22 bp, Homo sapiens
tgccctggtgaagtgctctcct

SEQ ID NO: 9045959 - DNA, 22 bp, Homo sapiens
cccaggctggggctcctccagc

SEQ ID NO: 9045960 - DNA, 22 bp, Homo sapiens
cccagggaaggcagatggagga

SEQ ID NO: 9045961 - DNA, 22 bp, Homo sapiens
cccagggacagctaggtggggc

SEQ ID NO: 9045962 - DNA, 22 bp, Homo sapiens
cccagggacagatgggcagcta

SEQ ID NO: 9045963 - DNA, 22 bp, Homo sapiens
tgccttcctggagctgaaggct

SEQ ID NO: 9045964 - DNA, 22 bp, Homo sapiens
cccagggattataaaggtgaaa

SEQ ID NO: 9045965 - DNA, 19 bp, Homo sapiens
cctagagcagtacctggta

SEQ ID NO: 9045966 - DNA, 22 bp, Homo sapiens
cctagagctctgctttatctaa

SEQ ID NO: 9045967 - DNA, 18 bp, Homo sapiens
cctagagcagatgggagt

SEQ ID NO: 9045968 - DNA, 18 bp, Homo sapiens
cctagagcagatggaagt

SEQ ID NO: 9045969 - DNA, 22 bp, Homo sapiens
cctagactagaggcagggagcc

SEQ ID NO: 9045970 - DNA, 22 bp, Homo sapiens
cctcagaatagtcctcagatca

SEQ ID NO: 9045971 - DNA, 22 bp, Homo sapiens
cctcagaaggacaagagacaaa

SEQ ID NO: 9045972 - DNA, 22 bp, Homo sapiens
tggcagggtggcaacttttggt

SEQ ID NO: 9045973 - DNA, 21 bp, Homo sapiens
cccttcttgggtcaaagtata

SEQ ID NO: 9045974 - DNA, 22 bp, Homo sapiens
ccctgcaggctcagactggagt

SEQ ID NO: 9045975 - DNA, 21 bp, Homo sapiens
ccctgcaggccagggctgagc

SEQ ID NO: 9045976 - DNA, 22 bp, Homo sapiens
ccctgcagggaggattctgaag

SEQ ID NO: 9045977 - DNA, 22 bp, Homo sapiens
ccctgcaggggacctgcagcct

SEQ ID NO: 9045978 - DNA, 22 bp, Homo sapiens
tggcccagagcactgctgggca

SEQ ID NO: 9045979 - DNA, 17 bp, Homo sapiens
cctcagcttctttcctc

SEQ ID NO: 9045980 - DNA, 22 bp, Homo sapiens
cctcaggcttacgggcaatgga

SEQ ID NO: 9045981 - DNA, 22 bp, Homo sapiens
cctccaagcttcatctcaacca

SEQ ID NO: 9045982 - DNA, 22 bp, Homo sapiens
cctcagtgagtgtttccttctt

SEQ ID NO: 9045983 - DNA, 22 bp, Homo sapiens
cctcagtgcgtactgaacagtg

SEQ ID NO: 9045984 - DNA, 22 bp, Homo sapiens
cctcagtgtgcagcagcatctg

SEQ ID NO: 9045985 - DNA, 20 bp, Homo sapiens
cctcagtgtcctggactggg

SEQ ID NO: 9045986 - DNA, 22 bp, Homo sapiens
cctcagtgtgtggatgttagag

SEQ ID NO: 9045987 - DNA, 22 bp, Homo sapiens
cctcagtgtgtttggggtgagg

SEQ ID NO: 9045988 - DNA, 22 bp, Homo sapiens
cctcagtgttaggataagagaa

SEQ ID NO: 9045989 - DNA, 22 bp, Homo sapiens
tggctctggtgcgggctcctgc

SEQ ID NO: 9045990 - DNA, 22 bp, Homo sapiens
tggcctgggccggcagatatac

SEQ ID NO: 9045991 - DNA, 22 bp, Homo sapiens
cctcttcctcaccatctacaac

SEQ ID NO: 9045992 - DNA, 22 bp, Homo sapiens
cctcttccttctcactgtggaa

SEQ ID NO: 9045993 - DNA, 22 bp, Homo sapiens
cctcttcctgcactgacatttt

SEQ ID NO: 9045994 - DNA, 19 bp, Homo sapiens
cctcttcctctgacactat

SEQ ID NO: 9045995 - DNA, 17 bp, Homo sapiens
cctcttcctctcagctg

SEQ ID NO: 9045996 - DNA, 22 bp, Homo sapiens
cctcttctaggtttcagcctgc

SEQ ID NO: 9045997 - DNA, 22 bp, Homo sapiens
cctcttctaggacgtccttgtg

SEQ ID NO: 9045998 - DNA, 23 bp, Homo sapiens
cctgagatctgtaagggaccttg

SEQ ID NO: 9045999 - DNA, 21 bp, Homo sapiens
cctgagatctggagtggcttt

SEQ ID NO: 9046000 - DNA, 22 bp, Homo sapiens
cctgagatggccagtgctggga

SEQ ID NO: 9046001 - DNA, 22 bp, Homo sapiens
cctgagatggggattattccaa

SEQ ID NO: 9046002 - DNA, 22 bp, Homo sapiens
cctgagatgtgtaacagatggt

SEQ ID NO: 9046003 - DNA, 22 bp, Homo sapiens
cctgagatgtgtaacagatggt

SEQ ID NO: 9046004 - DNA, 19 bp, Homo sapiens
cctgagattcctccttttc

SEQ ID NO: 9046005 - DNA, 22 bp, Homo sapiens
cctgagattggctagtatgagt

SEQ ID NO: 9046006 - DNA, 22 bp, Homo sapiens
cctgagatttgtaatttttgta

SEQ ID NO: 9046007 - DNA, 22 bp, Homo sapiens
cctgagatttcattgtctggcc

SEQ ID NO: 9046008 - DNA, 18 bp, Homo sapiens
tgggctgcctggcctctg

SEQ ID NO: 9046009 - DNA, 22 bp, Homo sapiens
tgggctgcggataggcctcgga

SEQ ID NO: 9046010 - DNA, 22 bp, Homo sapiens
cctgagctctgcactttttaga

SEQ ID NO: 9046011 - DNA, 22 bp, Homo sapiens
cctgagctagggaaggaagacc

SEQ ID NO: 9046012 - DNA, 22 bp, Homo sapiens
tggcttcatgtagtttgagttg

SEQ ID NO: 9046013 - DNA, 22 bp, Homo sapiens
tggcttcattctgtagttaaaa

SEQ ID NO: 9046014 - DNA, 22 bp, Homo sapiens
tggcttcatggcaagtcttagt

SEQ ID NO: 9046015 - DNA, 22 bp, Homo sapiens
cctctgcctttagtgaaagttg

SEQ ID NO: 9046016 - DNA, 18 bp, Homo sapiens
cctctgccatagccagca

SEQ ID NO: 9046017 - DNA, 22 bp, Homo sapiens
cctctgcctgcacatcatcctg

SEQ ID NO: 9046018 - DNA, 22 bp, Homo sapiens
cctcttccagctgttgcttcca

SEQ ID NO: 9046019 - DNA, 22 bp, Homo sapiens
caggcctgagacatctgagata

SEQ ID NO: 9046020 - DNA, 22 bp, Homo sapiens
tactttaaaaactgataattca

SEQ ID NO: 9046021 - DNA, 22 bp, Homo sapiens
caggctatatttaaagaagaac

SEQ ID NO: 9046022 - DNA, 22 bp, Homo sapiens
tactttatcagcgtcaaaggta

SEQ ID NO: 9046023 - DNA, 22 bp, Homo sapiens
caggcggccatgatctggcagg

SEQ ID NO: 9046024 - DNA, 22 bp, Homo sapiens
caggcgagggccctgaggagcc

SEQ ID NO: 9046025 - DNA, 22 bp, Homo sapiens
caggctgccgaggctgcagaat

SEQ ID NO: 9046026 - DNA, 22 bp, Homo sapiens
caggctgccctagcttggacat

SEQ ID NO: 9046027 - DNA, 22 bp, Homo sapiens
caggctgcatggaggggtacag

SEQ ID NO: 9046028 - DNA, 22 bp, Homo sapiens
caggctgcagtgcagtggctat

SEQ ID NO: 9046029 - DNA, 22 bp, Homo sapiens
caggctgccaaggctggggagg

SEQ ID NO: 9046030 - DNA, 22 bp, Homo sapiens
caggctgccgtggggtccaggc

SEQ ID NO: 9046031 - DNA, 22 bp, Homo sapiens
caggctgccgtgaagcaggcct

SEQ ID NO: 9046032 - DNA, 22 bp, Homo sapiens
tagaaaatgttccactgccatt

SEQ ID NO: 9046033 - DNA, 22 bp, Homo sapiens
cagggaaattaagtgacgatga

SEQ ID NO: 9046034 - DNA, 22 bp, Homo sapiens
cagggaacaagatgagaatgga

SEQ ID NO: 9046035 - DNA, 22 bp, Homo sapiens
tagattcatgcagtatgctagt

SEQ ID NO: 9046036 - DNA, 22 bp, Homo sapiens
tagatacaggctctctgagcct

SEQ ID NO: 9046037 - DNA, 22 bp, Homo sapiens
taatacaaggcaggaagcagta

SEQ ID NO: 9046038 - DNA, 22 bp, Homo sapiens
caggcagagttagtgatttagg

SEQ ID NO: 9046039 - DNA, 22 bp, Homo sapiens
caggcagagttagagcaactgg

SEQ ID NO: 9046040 - DNA, 22 bp, Homo sapiens
cagctcagacgcaggtcgagca

SEQ ID NO: 9046041 - DNA, 22 bp, Homo sapiens
gtgcttctccgttctgcagcac

SEQ ID NO: 9046042 - DNA, 22 bp, Homo sapiens
gtgcttcctctgccaacactct

SEQ ID NO: 9046043 - DNA, 22 bp, Homo sapiens
taagtcacttattccacaagat

SEQ ID NO: 9046044 - DNA, 22 bp, Homo sapiens
tacaaaaaattgatactgacga

SEQ ID NO: 9046045 - DNA, 22 bp, Homo sapiens
caggcatttcgcaaaggctgag

SEQ ID NO: 9046046 - DNA, 22 bp, Homo sapiens
tacaaaaaattgatactgacga

SEQ ID NO: 9046047 - DNA, 20 bp, Homo sapiens
tacaaacctccacactggtg

SEQ ID NO: 9046048 - DNA, 22 bp, Homo sapiens
caggccaggtgctctagaatca

SEQ ID NO: 9046049 - DNA, 22 bp, Homo sapiens
caggccagggttgagaagagaa

SEQ ID NO: 9046050 - DNA, 22 bp, Homo sapiens
caggcatgcttctgtctgggca

SEQ ID NO: 9046051 - DNA, 22 bp, Homo sapiens
taatgtctatgggccagataat

SEQ ID NO: 9046052 - DNA, 22 bp, Homo sapiens
taatgtcttagtaccttaattt

SEQ ID NO: 9046053 - DNA, 22 bp, Homo sapiens
taatcacaattcagatgtctta

SEQ ID NO: 9046054 - DNA, 22 bp, Homo sapiens
taatcacagaaacagactgttt

SEQ ID NO: 9046055 - DNA, 22 bp, Homo sapiens
taatcacagaaatgcccattca

SEQ ID NO: 9046056 - DNA, 22 bp, Homo sapiens
taatacagacaacttgccaaat

SEQ ID NO: 9046057 - DNA, 22 bp, Homo sapiens
taatatctggcattcaaacatg

SEQ ID NO: 9046058 - DNA, 22 bp, Homo sapiens
taatatgtgttactgacttttt

SEQ ID NO: 9046059 - DNA, 22 bp, Homo sapiens
taatcacatcagggtaaatggg

SEQ ID NO: 9046060 - DNA, 22 bp, Homo sapiens
tcaagcagagtcaaaagtacca

SEQ ID NO: 9046061 - DNA, 22 bp, Homo sapiens
tcaacaagaataccatcctcct

SEQ ID NO: 9046062 - DNA, 22 bp, Homo sapiens
tcaacaaatacttaaagcagag

SEQ ID NO: 9046063 - DNA, 22 bp, Homo sapiens
tattttatctgccagagtggag

SEQ ID NO: 9046064 - DNA, 22 bp, Homo sapiens
cagtcacttacaaaaatataat

SEQ ID NO: 9046065 - DNA, 22 bp, Homo sapiens
cagtcagtcaatactctttgag

SEQ ID NO: 9046066 - DNA, 22 bp, Homo sapiens
cagtcacataggtatacacata

SEQ ID NO: 9046067 - DNA, 19 bp, Homo sapiens
cagtatcattgcacatagt

SEQ ID NO: 9046068 - DNA, 22 bp, Homo sapiens
caggtgggtgtatgaatgcaaa

SEQ ID NO: 9046069 - DNA, 22 bp, Homo sapiens
caggtgacaagacaggtaatat

SEQ ID NO: 9046070 - DNA, 22 bp, Homo sapiens
caggtgctgtgaatcttcataa

SEQ ID NO: 9046071 - DNA, 22 bp, Homo sapiens
caggtcagagtccccctgtcct

SEQ ID NO: 9046072 - DNA, 22 bp, Homo sapiens
cagggtggggctggctatcaaa

SEQ ID NO: 9046073 - DNA, 22 bp, Homo sapiens
cagggtttctgttgagaagtcc

SEQ ID NO: 9046074 - DNA, 22 bp, Homo sapiens
tattatcatgttaattagtggg

SEQ ID NO: 9046075 - DNA, 22 bp, Homo sapiens
tattatcatgttaattagtggg

SEQ ID NO: 9046076 - DNA, 22 bp, Homo sapiens
tattataaaattactggcaggg

SEQ ID NO: 9046077 - DNA, 22 bp, Homo sapiens
tattagtctgtaaattgatgct

SEQ ID NO: 9046078 - DNA, 22 bp, Homo sapiens
tattatatttagtaatgtggag

SEQ ID NO: 9046079 - DNA, 22 bp, Homo sapiens
tattataatttagggcttggat

SEQ ID NO: 9046080 - DNA, 22 bp, Homo sapiens
tattatctagtaactgatagtg

SEQ ID NO: 9046081 - DNA, 22 bp, Homo sapiens
tattatgtaaaggttattgcag

SEQ ID NO: 9046082 - DNA, 22 bp, Homo sapiens
caggtggggggcttccgagcct

SEQ ID NO: 9046083 - DNA, 22 bp, Homo sapiens
caggtgggtacatcacagagac

SEQ ID NO: 9046084 - DNA, 18 bp, Homo sapiens
caggtgggtctcctgccc

SEQ ID NO: 9046085 - DNA, 18 bp, Homo sapiens
caggtgggtctcctgccc

SEQ ID NO: 9046086 - DNA, 22 bp, Homo sapiens
tattaaatgttatttgggttgt

SEQ ID NO: 9046087 - DNA, 22 bp, Homo sapiens
tattaaatatatctgttagttg

SEQ ID NO: 9046088 - DNA, 22 bp, Homo sapiens
caggtggcagaggtctctggaa

SEQ ID NO: 9046089 - DNA, 22 bp, Homo sapiens
tagatttaagaccctgaatttg

SEQ ID NO: 9046090 - DNA, 22 bp, Homo sapiens
cagggagcagcatgggcaaagg

SEQ ID NO: 9046091 - DNA, 22 bp, Homo sapiens
cagggagcactgcgagcggcag

SEQ ID NO: 9046092 - DNA, 22 bp, Homo sapiens
cagggagcactgcgagcggcag

SEQ ID NO: 9046093 - DNA, 22 bp, Homo sapiens
cagggagcaggctctgtccatc

SEQ ID NO: 9046094 - DNA, 22 bp, Homo sapiens
cagggagccccaattccatgcc

SEQ ID NO: 9046095 - DNA, 22 bp, Homo sapiens
tagcttctaatacttaccaatt

SEQ ID NO: 9046096 - DNA, 22 bp, Homo sapiens
tagcttctatacaacttcagca

SEQ ID NO: 9046097 - DNA, 22 bp, Homo sapiens
tagctttaaaaatcatcaaagc

SEQ ID NO: 9046098 - DNA, 22 bp, Homo sapiens
tagctttaaaaatcatcaaagc

SEQ ID NO: 9046099 - DNA, 22 bp, Homo sapiens
tagcttctcttttcaacatctt

SEQ ID NO: 9046100 - DNA, 22 bp, Homo sapiens
tagcttctggagtgtttgaaaa

SEQ ID NO: 9046101 - DNA, 22 bp, Homo sapiens
tagcttctgggagtgtttacta

SEQ ID NO: 9046102 - DNA, 22 bp, Homo sapiens
tagcttgactattctatgatgt

SEQ ID NO: 9046103 - DNA, 22 bp, Homo sapiens
taggccacgaaggagatgatag

SEQ ID NO: 9046104 - DNA, 22 bp, Homo sapiens
taggccacggaaagcaggttgc

SEQ ID NO: 9046105 - DNA, 22 bp, Homo sapiens
taggccactctcctttgtctca

SEQ ID NO: 9046106 - DNA, 22 bp, Homo sapiens
taggccacagatgagacataag

SEQ ID NO: 9046107 - DNA, 22 bp, Homo sapiens
taggccaccagggttccattta

SEQ ID NO: 9046108 - DNA, 21 bp, Homo sapiens
taggccacatgggttggagat

SEQ ID NO: 9046109 - DNA, 22 bp, Homo sapiens
taggccacaaataagatcctgt

SEQ ID NO: 9046110 - DNA, 22 bp, Homo sapiens
taggccacagagaggagatttc

SEQ ID NO: 9046111 - DNA, 22 bp, Homo sapiens
cagggctccatgcagggactcc

SEQ ID NO: 9046112 - DNA, 22 bp, Homo sapiens
cagggctcttccggagcaggga

SEQ ID NO: 9046113 - DNA, 22 bp, Homo sapiens
cagggctcttcatcacacagta

SEQ ID NO: 9046114 - DNA, 20 bp, Homo sapiens
cagggctctgggcctggcct

SEQ ID NO: 9046115 - DNA, 20 bp, Homo sapiens
cagggctctgggcctggcct

SEQ ID NO: 9046116 - DNA, 22 bp, Homo sapiens
cagggctgaactgagcttgtga

SEQ ID NO: 9046117 - DNA, 22 bp, Homo sapiens
cagggctgtaaattagtgctga

SEQ ID NO: 9046118 - DNA, 22 bp, Homo sapiens
cagggctggtttgtcgaagaaa

SEQ ID NO: 9046119 - DNA, 22 bp, Homo sapiens
cagggtccccgggtctcctgtg

SEQ ID NO: 9046120 - DNA, 22 bp, Homo sapiens
cagggtccggctgcctggctgt

SEQ ID NO: 9046121 - DNA, 22 bp, Homo sapiens
cagggtcaccagagatctgcat

SEQ ID NO: 9046122 - DNA, 22 bp, Homo sapiens
cagggtcccaggagctgctttc

SEQ ID NO: 9046123 - DNA, 17 bp, Homo sapiens
cagggctgtctgcctag

SEQ ID NO: 9046124 - DNA, 22 bp, Homo sapiens
tcaatgaaagagcatgcatttt

SEQ ID NO: 9046125 - DNA, 22 bp, Homo sapiens
tcaatgaaagagcatgcatttt

SEQ ID NO: 9046126 - DNA, 22 bp, Homo sapiens
cagttcttaataccatgtggtt

SEQ ID NO: 9046127 - DNA, 22 bp, Homo sapiens
cagttcttatttggccagtgtc

SEQ ID NO: 9046128 - DNA, 17 bp, Homo sapiens
cataaaacagttctatt

SEQ ID NO: 9046129 - DNA, 22 bp, Homo sapiens
cagttttggtgatatttgagaa

SEQ ID NO: 9046130 - DNA, 22 bp, Homo sapiens
tcagataccattgaatttgttg

SEQ ID NO: 9046131 - DNA, 23 bp, Homo sapiens
tcagagcaagatgatgtatgagc

SEQ ID NO: 9046132 - DNA, 22 bp, Homo sapiens
tcagggagaggtgagagcctgt

SEQ ID NO: 9046133 - DNA, 22 bp, Homo sapiens
tcagggagaggtgagagcctgt

SEQ ID NO: 9046134 - DNA, 22 bp, Homo sapiens
tcaggctgtgggcactggccat

SEQ ID NO: 9046135 - DNA, 17 bp, Homo sapiens
tcaggctgtgcctggta

SEQ ID NO: 9046136 - DNA, 21 bp, Homo sapiens
tcaggctgtctgctggttcca

SEQ ID NO: 9046137 - DNA, 22 bp, Homo sapiens
catagaaatcaggtgagaatct

SEQ ID NO: 9046138 - DNA, 22 bp, Homo sapiens
tcaggcctcaagctgctttaag

SEQ ID NO: 9046139 - DNA, 22 bp, Homo sapiens
tcaggcctccaggttaccattt

SEQ ID NO: 9046140 - DNA, 22 bp, Homo sapiens
catagaaacttgcagcaagcac

SEQ ID NO: 9046141 - DNA, 22 bp, Homo sapiens
cataacatccttgctactttga

SEQ ID NO: 9046142 - DNA, 22 bp, Homo sapiens
cataatccttgattcaaataat

SEQ ID NO: 9046143 - DNA, 22 bp, Homo sapiens
cataatcccaggcttgcattca

SEQ ID NO: 9046144 - DNA, 22 bp, Homo sapiens
cataatcctggtgtagccctct

SEQ ID NO: 9046145 - DNA, 22 bp, Homo sapiens
tcagcaggtgaacatcatgcca

SEQ ID NO: 9046146 - DNA, 22 bp, Homo sapiens
cataattaggcagttgatcatt

SEQ ID NO: 9046147 - DNA, 22 bp, Homo sapiens
cataattactgatatgctgatt

SEQ ID NO: 9046148 - DNA, 22 bp, Homo sapiens
cataatttgatatgcttgatgg

SEQ ID NO: 9046149 - DNA, 22 bp, Homo sapiens
catctgaatttgccttagtttc

SEQ ID NO: 9046150 - DNA, 22 bp, Homo sapiens
catgaaaataacattgttgtga

SEQ ID NO: 9046151 - DNA, 22 bp, Homo sapiens
tcagtgcattcatgggtggctg

SEQ ID NO: 9046152 - DNA, 22 bp, Homo sapiens
catctcaggtctgtggttcact

SEQ ID NO: 9046153 - DNA, 22 bp, Homo sapiens
tcagtgctaaaagagctggtgt

SEQ ID NO: 9046154 - DNA, 22 bp, Homo sapiens
tcagtgctcctaaagtgaatgc

SEQ ID NO: 9046155 - DNA, 22 bp, Homo sapiens
tcagtgctcaggggagccgagg

SEQ ID NO: 9046156 - DNA, 22 bp, Homo sapiens
tcagtcatctctgacagctagc

SEQ ID NO: 9046157 - DNA, 22 bp, Homo sapiens
tcagggagagtgacccatccac

SEQ ID NO: 9046158 - DNA, 22 bp, Homo sapiens
tcagggagatttggggactcaa

SEQ ID NO: 9046159 - DNA, 22 bp, Homo sapiens
tcagggagcctggacttcaagg

SEQ ID NO: 9046160 - DNA, 22 bp, Homo sapiens
tcagggagggacctgaggctgg

SEQ ID NO: 9046161 - DNA, 22 bp, Homo sapiens
tcagggagggacctgaggctgg

SEQ ID NO: 9046162 - DNA, 22 bp, Homo sapiens
tcagggaggtgtctgccagaga

SEQ ID NO: 9046163 - DNA, 22 bp, Homo sapiens
tcagggagtagtttgtgctatg

SEQ ID NO: 9046164 - DNA, 22 bp, Homo sapiens
tcagggagtagtttgtgctatg

SEQ ID NO: 9046165 - DNA, 19 bp, Homo sapiens
tcagggagtttacagcatg

SEQ ID NO: 9046166 - DNA, 22 bp, Homo sapiens
tcagggagtgttggcaggatca

SEQ ID NO: 9046167 - DNA, 22 bp, Homo sapiens
catgcattcagaatctctcaca

SEQ ID NO: 9046168 - DNA, 22 bp, Homo sapiens
catggcagagcctgcaggtggg

SEQ ID NO: 9046169 - DNA, 22 bp, Homo sapiens
catggcagcctgccctgcttgc

SEQ ID NO: 9046170 - DNA, 22 bp, Homo sapiens
catggcagcaattttcctgact

SEQ ID NO: 9046171 - DNA, 22 bp, Homo sapiens
catgcaggcctatggagcagtg

SEQ ID NO: 9046172 - DNA, 22 bp, Homo sapiens
catgagaaggggtggagttaga

SEQ ID NO: 9046173 - DNA, 20 bp, Homo sapiens
catgagaagggcagtgtgag

SEQ ID NO: 9046174 - DNA, 22 bp, Homo sapiens
catgagaaccaggtctgtgttt

SEQ ID NO: 9046175 - DNA, 22 bp, Homo sapiens
catgaccaaaatcattacactg

SEQ ID NO: 9046176 - DNA, 22 bp, Homo sapiens
catgaatgctgggttcatgtaa

SEQ ID NO: 9046177 - DNA, 22 bp, Homo sapiens
catgacacctaccatattaagt

SEQ ID NO: 9046178 - DNA, 22 bp, Homo sapiens
catgcaggtgaccaggtgtggg

SEQ ID NO: 9046179 - DNA, 22 bp, Homo sapiens
catgcagtcaataaacatgtgt

SEQ ID NO: 9046180 - DNA, 22 bp, Homo sapiens
catgcagtgactcagacacagg

SEQ ID NO: 9046181 - DNA, 22 bp, Homo sapiens
catgcagggagcagaggagaca

SEQ ID NO: 9046182 - DNA, 22 bp, Homo sapiens
tcctgggctttgtttctctcct

SEQ ID NO: 9046183 - DNA, 22 bp, Homo sapiens
tcctgggcttcacagactctgt

SEQ ID NO: 9046184 - DNA, 22 bp, Homo sapiens
tctaagaaatcagatgatgagg

SEQ ID NO: 9046185 - DNA, 21 bp, Homo sapiens
tctaagaacatgattctccct

SEQ ID NO: 9046186 - DNA, 22 bp, Homo sapiens
tctaagaatactcatatcttct

SEQ ID NO: 9046187 - DNA, 22 bp, Homo sapiens
ccactgggggctgctcccaggt

SEQ ID NO: 9046188 - DNA, 22 bp, Homo sapiens
tctaaggacagttattactggg

SEQ ID NO: 9046189 - DNA, 22 bp, Homo sapiens
tctaaggacaaggtcttggaga

SEQ ID NO: 9046190 - DNA, 22 bp, Homo sapiens
tctaaggaaggacaccctggct

SEQ ID NO: 9046191 - DNA, 22 bp, Homo sapiens
tctaagctagtggctcatgtga

SEQ ID NO: 9046192 - DNA, 22 bp, Homo sapiens
tctaaggacattggctttggag

SEQ ID NO: 9046193 - DNA, 22 bp, Homo sapiens
tctaaggagccaggactattag

SEQ ID NO: 9046194 - DNA, 22 bp, Homo sapiens
tctaaggagcgctccagaaaaa

SEQ ID NO: 9046195 - DNA, 22 bp, Homo sapiens
tctaaggagcgctccagaaaaa

SEQ ID NO: 9046196 - DNA, 22 bp, Homo sapiens
ccagagaaccttgagctgtgag

SEQ ID NO: 9046197 - DNA, 22 bp, Homo sapiens
ccagagaaagtgaagcaaatgt

SEQ ID NO: 9046198 - DNA, 22 bp, Homo sapiens
ccagagaaggtggagcttgtgt

SEQ ID NO: 9046199 - DNA, 22 bp, Homo sapiens
ccagagaagtcttgcctggatt

SEQ ID NO: 9046200 - DNA, 22 bp, Homo sapiens
ccagagaattttagacaaaaat

SEQ ID NO: 9046201 - DNA, 22 bp, Homo sapiens
ccaaggagaatgacaccatgga

SEQ ID NO: 9046202 - DNA, 22 bp, Homo sapiens
ccaaggagcaaggctcaacaag

SEQ ID NO: 9046203 - DNA, 22 bp, Homo sapiens
ccaaggagtagagcaggaagct

SEQ ID NO: 9046204 - DNA, 22 bp, Homo sapiens
ccacacagggggatgagttatt

SEQ ID NO: 9046205 - DNA, 22 bp, Homo sapiens
ccacacagtcagtttccaagaa

SEQ ID NO: 9046206 - DNA, 19 bp, Homo sapiens
ccacacagtgtgcaattta

SEQ ID NO: 9046207 - DNA, 22 bp, Homo sapiens
ccacactaaactgctcaaacca

SEQ ID NO: 9046208 - DNA, 22 bp, Homo sapiens
tcctggctccagcagctcttcc

SEQ ID NO: 9046209 - DNA, 22 bp, Homo sapiens
catttattcatgatctgtagct

SEQ ID NO: 9046210 - DNA, 22 bp, Homo sapiens
catttattctcagatccttgtc

SEQ ID NO: 9046211 - DNA, 22 bp, Homo sapiens
catttattcatttgctagggct

SEQ ID NO: 9046212 - DNA, 22 bp, Homo sapiens
catttattcagctcagtcggtt

SEQ ID NO: 9046213 - DNA, 22 bp, Homo sapiens
tccctggggtatcgctgaggca

SEQ ID NO: 9046214 - DNA, 22 bp, Homo sapiens
catttattgagtggccacagtg

SEQ ID NO: 9046215 - DNA, 20 bp, Homo sapiens
tccctcctgcagatagagaa

SEQ ID NO: 9046216 - DNA, 22 bp, Homo sapiens
catttacacttctaaccacaag

SEQ ID NO: 9046217 - DNA, 22 bp, Homo sapiens
tccctcctggtgagcaggggct

SEQ ID NO: 9046218 - DNA, 22 bp, Homo sapiens
catttaatgcctttgccatcca

SEQ ID NO: 9046219 - DNA, 22 bp, Homo sapiens
catttaaaggttgtgggtaaaa

SEQ ID NO: 9046220 - DNA, 22 bp, Homo sapiens
catttaatctggctcatgagca

SEQ ID NO: 9046221 - DNA, 22 bp, Homo sapiens
cattgtcacccaaagctcatag

SEQ ID NO: 9046222 - DNA, 22 bp, Homo sapiens
cattgttttgagaacaacctga

SEQ ID NO: 9046223 - DNA, 22 bp, Homo sapiens
cattgttttgagaacaacctga

SEQ ID NO: 9046224 - DNA, 22 bp, Homo sapiens
cattgtgcagggataatgcagc

SEQ ID NO: 9046225 - DNA, 22 bp, Homo sapiens
cattgttctggagaaggttcca

SEQ ID NO: 9046226 - DNA, 22 bp, Homo sapiens
cattctcaatagtagatgagta

SEQ ID NO: 9046227 - DNA, 22 bp, Homo sapiens
cattctcaatagtagatgagta

SEQ ID NO: 9046228 - DNA, 22 bp, Homo sapiens
cattcatttatgaaatatctat

SEQ ID NO: 9046229 - DNA, 22 bp, Homo sapiens
cattaggtatttaagcacacag

SEQ ID NO: 9046230 - DNA, 22 bp, Homo sapiens
cattagagcagataatatgtgt

SEQ ID NO: 9046231 - DNA, 22 bp, Homo sapiens
cattacatttcaaaatgtttcc

SEQ ID NO: 9046232 - DNA, 22 bp, Homo sapiens
tcccacattaccctgactgaca

SEQ ID NO: 9046233 - DNA, 22 bp, Homo sapiens
tcccacatgtgaatcctcaggt

SEQ ID NO: 9046234 - DNA, 22 bp, Homo sapiens
cattcttatatttactcattca

SEQ ID NO: 9046235 - DNA, 22 bp, Homo sapiens
cattcttacacaatattttaat

SEQ ID NO: 9046236 - DNA, 22 bp, Homo sapiens
cattctctgatcttcacatacc

SEQ ID NO: 9046237 - DNA, 17 bp, Homo sapiens
tttctgcatgattggac

SEQ ID NO: 9046238 - DNA, 22 bp, Homo sapiens
tttctcctgagttccacgctac

SEQ ID NO: 9046239 - DNA, 22 bp, Homo sapiens
tttctcctgtgaggtcagaagt

SEQ ID NO: 9046240 - DNA, 22 bp, Homo sapiens
tttctcctgctagaacaaggag

SEQ ID NO: 9046241 - DNA, 22 bp, Homo sapiens
tttctcctgcccagatgcctgg

SEQ ID NO: 9046242 - DNA, 22 bp, Homo sapiens
tttctccttgtgtctcctttga

SEQ ID NO: 9046243 - DNA, 22 bp, Homo sapiens
tttctcctgtgtaagccgccca

SEQ ID NO: 9046244 - DNA, 17 bp, Homo sapiens
tttctccttccatctca

SEQ ID NO: 9046245 - DNA, 22 bp, Homo sapiens
tttctctgggctgttggcagcc

SEQ ID NO: 9046246 - DNA, 22 bp, Homo sapiens
tttcttctctaatctcaatgat

SEQ ID NO: 9046247 - DNA, 22 bp, Homo sapiens
tttctttatcatagcatctttg

SEQ ID NO: 9046248 - DNA, 22 bp, Homo sapiens
tttcttctaggactaataagag

SEQ ID NO: 9046249 - DNA, 22 bp, Homo sapiens
tttcttctatgtgtgatatttt

SEQ ID NO: 9046250 - DNA, 22 bp, Homo sapiens
tttcttctatgtgtgatatttt

SEQ ID NO: 9046251 - DNA, 19 bp, Homo sapiens
tttctgttagaaggataca

SEQ ID NO: 9046252 - DNA, 23 bp, Homo sapiens
tttctgttgggtatatatccaag

SEQ ID NO: 9046253 - DNA, 22 bp, Homo sapiens
tttctgtatttaaaagatctgg

SEQ ID NO: 9046254 - DNA, 22 bp, Homo sapiens
tttcttatgtgcagagtgagta

SEQ ID NO: 9046255 - DNA, 22 bp, Homo sapiens
tttcctctgctgccattgcccc

SEQ ID NO: 9046256 - DNA, 22 bp, Homo sapiens
tttcattggcagagcctgtttt

SEQ ID NO: 9046257 - DNA, 22 bp, Homo sapiens
tttcattgtcaataaactgtat

SEQ ID NO: 9046258 - DNA, 22 bp, Homo sapiens
tttcattttggttatgccataa

SEQ ID NO: 9046259 - DNA, 22 bp, Homo sapiens
tttcaaaggaggctgagaggat

SEQ ID NO: 9046260 - DNA, 22 bp, Homo sapiens
tttcaaagcaactgaaaaggaa

SEQ ID NO: 9046261 - DNA, 22 bp, Homo sapiens
tttcaaagagaggcagaaggaa

SEQ ID NO: 9046262 - DNA, 22 bp, Homo sapiens
tttcaaagagttgtaaattact

SEQ ID NO: 9046263 - DNA, 23 bp, Homo sapiens
tttcaaagactttcccttagagt

SEQ ID NO: 9046264 - DNA, 20 bp, Homo sapiens
tttcaaaggcacctatgaag

SEQ ID NO: 9046265 - DNA, 22 bp, Homo sapiens
tttcaaagggaagttatgaagt

SEQ ID NO: 9046266 - DNA, 22 bp, Homo sapiens
tttcagagttagtagagcatgt

SEQ ID NO: 9046267 - DNA, 19 bp, Homo sapiens
tttcaggagctatgcaggg

SEQ ID NO: 9046268 - DNA, 22 bp, Homo sapiens
tttcaggattagtttaagcagg

SEQ ID NO: 9046269 - DNA, 22 bp, Homo sapiens
tttcagataaatatgggactaa

SEQ ID NO: 9046270 - DNA, 22 bp, Homo sapiens
tttcagatcttctttgggttaa

SEQ ID NO: 9046271 - DNA, 22 bp, Homo sapiens
tttcagatgcatccattagcag

SEQ ID NO: 9046272 - DNA, 17 bp, Homo sapiens
tttcagattcactttct

SEQ ID NO: 9046273 - DNA, 22 bp, Homo sapiens
tttcagatggaggtttaggaca

SEQ ID NO: 9046274 - DNA, 22 bp, Homo sapiens
tttcctctttgtaccttgacta

SEQ ID NO: 9046275 - DNA, 22 bp, Homo sapiens
tttcctgagtcagagacaccag

SEQ ID NO: 9046276 - DNA, 22 bp, Homo sapiens
tttcctgagccagagtttcatt

SEQ ID NO: 9046277 - DNA, 22 bp, Homo sapiens
tttctacattcaaaaactacca

SEQ ID NO: 9046278 - DNA, 22 bp, Homo sapiens
tttctacatttgtaaccagatt

SEQ ID NO: 9046279 - DNA, 22 bp, Homo sapiens
tttctactaagaaagttgatta

SEQ ID NO: 9046280 - DNA, 22 bp, Homo sapiens
tttctactttggaatgcactga

SEQ ID NO: 9046281 - DNA, 22 bp, Homo sapiens
tttctatttacagtgctaggta

SEQ ID NO: 9046282 - DNA, 22 bp, Homo sapiens
tttctcagttctctgcaaggag

SEQ ID NO: 9046283 - DNA, 21 bp, Homo sapiens
tttctcataaaatactcatta

SEQ ID NO: 9046284 - DNA, 22 bp, Homo sapiens
tttctcatagtcatgcctctta

SEQ ID NO: 9046285 - DNA, 21 bp, Homo sapiens
tttctcataaaatactcatta

SEQ ID NO: 9046286 - DNA, 22 bp, Homo sapiens
tttctcctcatgactggttgtg

SEQ ID NO: 9046287 - DNA, 22 bp, Homo sapiens
tttctcctaactcaaatttaag

SEQ ID NO: 9046288 - DNA, 22 bp, Homo sapiens
tttctcctctccagagtgcagt

SEQ ID NO: 9046289 - DNA, 22 bp, Homo sapiens
tttctcctccagagagacacag

SEQ ID NO: 9046290 - DNA, 22 bp, Homo sapiens
tttctcatggaacatagctcct

SEQ ID NO: 9046291 - DNA, 22 bp, Homo sapiens
tttctcatggaacatcgtttag

SEQ ID NO: 9046292 - DNA, 22 bp, Homo sapiens
tttctcatggaacatagctcct

SEQ ID NO: 9046293 - DNA, 22 bp, Homo sapiens
tttctcatggaacatagctcct

SEQ ID NO: 9046294 - DNA, 22 bp, Homo sapiens
tttctcatagtcatgcctctta

SEQ ID NO: 9046295 - DNA, 22 bp, Homo sapiens
tttctcatctggaaacagtgct

SEQ ID NO: 9046296 - DNA, 23 bp, Homo sapiens
tttctcatccagagagtcagtcc

SEQ ID NO: 9046297 - DNA, 16 bp, Homo sapiens
tttctcattgtcatca

SEQ ID NO: 9046298 - DNA, 22 bp, Homo sapiens
tttctcatttagagtggcaggg

SEQ ID NO: 9046299 - DNA, 22 bp, Homo sapiens
tttctcatggacccttcatgat

SEQ ID NO: 9046300 - DNA, 22 bp, Homo sapiens
tttctcatggacccttcatgat

SEQ ID NO: 9046301 - DNA, 22 bp, Homo sapiens
tttactttctcaagtatatagg

SEQ ID NO: 9046302 - DNA, 22 bp, Homo sapiens
tttaccatctgccacagatatg

SEQ ID NO: 9046303 - DNA, 22 bp, Homo sapiens
tttaatgttcatctcaaaggat

SEQ ID NO: 9046304 - DNA, 22 bp, Homo sapiens
tttaaaaaactagtctgagtct

SEQ ID NO: 9046305 - DNA, 22 bp, Homo sapiens
tttaaaaaactagtctgagtct

SEQ ID NO: 9046306 - DNA, 22 bp, Homo sapiens
tttaaaagttatcatctgtcca

SEQ ID NO: 9046307 - DNA, 22 bp, Homo sapiens
ttgtttttagagaagccctgaa

SEQ ID NO: 9046308 - DNA, 21 bp, Homo sapiens
tttaatttgcatgtatgacgc

SEQ ID NO: 9046309 - DNA, 22 bp, Homo sapiens
tttaatttgtatttctagaggg

SEQ ID NO: 9046310 - DNA, 22 bp, Homo sapiens
tttaatttgtatttctagaggg

SEQ ID NO: 9046311 - DNA, 22 bp, Homo sapiens
tttaattttcctggtaggcctg

SEQ ID NO: 9046312 - DNA, 22 bp, Homo sapiens
tttaattttctgggcccagcag

SEQ ID NO: 9046313 - DNA, 22 bp, Homo sapiens
tttaattttcctcttcctggag

SEQ ID NO: 9046314 - DNA, 22 bp, Homo sapiens
tttaattttcctcttcctggag

SEQ ID NO: 9046315 - DNA, 22 bp, Homo sapiens
tttaattgttgtgggtacatag

SEQ ID NO: 9046316 - DNA, 22 bp, Homo sapiens
tttaatttgaaatgagtaaccc

SEQ ID NO: 9046317 - DNA, 22 bp, Homo sapiens
tttaattctggcataatagctc

SEQ ID NO: 9046318 - DNA, 22 bp, Homo sapiens
tttaattatatctgggcagtta

SEQ ID NO: 9046319 - DNA, 22 bp, Homo sapiens
tttaattaggaaatgggcaggg

SEQ ID NO: 9046320 - DNA, 22 bp, Homo sapiens
tttatttgtcttgccatttagt

SEQ ID NO: 9046321 - DNA, 22 bp, Homo sapiens
tttattattctgttctctctac

SEQ ID NO: 9046322 - DNA, 22 bp, Homo sapiens
tttattattctgttctctctac

SEQ ID NO: 9046323 - DNA, 22 bp, Homo sapiens
tttattattctctggagaatgt

SEQ ID NO: 9046324 - DNA, 22 bp, Homo sapiens
tttattattctctggagaatgt

SEQ ID NO: 9046325 - DNA, 22 bp, Homo sapiens
tttattatgtacaggcactata

SEQ ID NO: 9046326 - DNA, 22 bp, Homo sapiens
tttattatgtacaggcactata

SEQ ID NO: 9046327 - DNA, 22 bp, Homo sapiens
tttattatgtacaggcactata

SEQ ID NO: 9046328 - DNA, 22 bp, Homo sapiens
tttattatgatggacaccttcg

SEQ ID NO: 9046329 - DNA, 22 bp, Homo sapiens
tttattatgatggacaccttcg

SEQ ID NO: 9046330 - DNA, 22 bp, Homo sapiens
tttattatgatggacaccttcg

SEQ ID NO: 9046331 - DNA, 22 bp, Homo sapiens
tttattatccagtgttgtcatg

SEQ ID NO: 9046332 - DNA, 22 bp, Homo sapiens
tttattatccagtgttgtcatg

SEQ ID NO: 9046333 - DNA, 22 bp, Homo sapiens
tttattatccagtgttgtcatg

SEQ ID NO: 9046334 - DNA, 22 bp, Homo sapiens
tttattatccagtgttgtcatg

SEQ ID NO: 9046335 - DNA, 22 bp, Homo sapiens
tttattatagtggtggggactg

SEQ ID NO: 9046336 - DNA, 22 bp, Homo sapiens
tttattatagtggtggggactg

SEQ ID NO: 9046337 - DNA, 22 bp, Homo sapiens
tttattatagtggtggggactg

SEQ ID NO: 9046338 - DNA, 22 bp, Homo sapiens
tttattaattagtgacccaatg

SEQ ID NO: 9046339 - DNA, 22 bp, Homo sapiens
tttattaatgtagcatccatgg

SEQ ID NO: 9046340 - DNA, 22 bp, Homo sapiens
tttatataacagagactgctat

SEQ ID NO: 9046341 - DNA, 22 bp, Homo sapiens
tttatataacagagactgctat

SEQ ID NO: 9046342 - DNA, 22 bp, Homo sapiens
tttatagctgtgagaccttggg

SEQ ID NO: 9046343 - DNA, 22 bp, Homo sapiens
tttattaagatgcgaatgctga

SEQ ID NO: 9046344 - DNA, 22 bp, Homo sapiens
tttattaaaactgttggctctg

SEQ ID NO: 9046345 - DNA, 21 bp, Homo sapiens
tttattaacaactgtggacgt

SEQ ID NO: 9046346 - DNA, 22 bp, Homo sapiens
ttggtcttttctattaaatata

SEQ ID NO: 9046347 - DNA, 22 bp, Homo sapiens
ttggtggacctcatcagaaccg

SEQ ID NO: 9046348 - DNA, 22 bp, Homo sapiens
ttggtggagtcattggcatatg

SEQ ID NO: 9046349 - DNA, 22 bp, Homo sapiens
ttgcaagatgttaccattgtta

SEQ ID NO: 9046350 - DNA, 20 bp, Homo sapiens
ttgcaagctttcaagatagc

SEQ ID NO: 9046351 - DNA, 22 bp, Homo sapiens
ttgtttgtaaggctcttagaat

SEQ ID NO: 9046352 - DNA, 22 bp, Homo sapiens
ttgtttgtatgctgagaagaat

SEQ ID NO: 9046353 - DNA, 22 bp, Homo sapiens
ttgtttgtaaggctcttagaat

SEQ ID NO: 9046354 - DNA, 22 bp, Homo sapiens
ttgtttgtcataatatcattac

SEQ ID NO: 9046355 - DNA, 22 bp, Homo sapiens
ttgtttgtgctatttaatgtag

SEQ ID NO: 9046356 - DNA, 17 bp, Homo sapiens
ttgtttgttcttgcccc

SEQ ID NO: 9046357 - DNA, 22 bp, Homo sapiens
ttgttttatctttctacagact

SEQ ID NO: 9046358 - DNA, 22 bp, Homo sapiens
ttgtttaagccacccaatctgt

SEQ ID NO: 9046359 - DNA, 22 bp, Homo sapiens
ttgtttaaagaacttctgactt

SEQ ID NO: 9046360 - DNA, 22 bp, Homo sapiens
ttgttacagcagcaatagaaaa

SEQ ID NO: 9046361 - DNA, 22 bp, Homo sapiens
ttgttaaaaatagatttccagg

SEQ ID NO: 9046362 - DNA, 22 bp, Homo sapiens
ttgtgtttcccttgcatattcc

SEQ ID NO: 9046363 - DNA, 20 bp, Homo sapiens
tttttccttctctacaggca

SEQ ID NO: 9046364 - DNA, 22 bp, Homo sapiens
tttttgcaccaacctaatagaa

SEQ ID NO: 9046365 - DNA, 22 bp, Homo sapiens
tttttgatactcaagaggggta

SEQ ID NO: 9046366 - DNA, 22 bp, Homo sapiens
tttttccaccgtacttcctgag

SEQ ID NO: 9046367 - DNA, 22 bp, Homo sapiens
tttttcattgcagcctctctcc

SEQ ID NO: 9046368 - DNA, 22 bp, Homo sapiens
tttttcctaagcagtggagctg

SEQ ID NO: 9046369 - DNA, 22 bp, Homo sapiens
ttttggcagattacttaatatg

SEQ ID NO: 9046370 - DNA, 22 bp, Homo sapiens
ttttgaaagccaggtttgtatg

SEQ ID NO: 9046371 - DNA, 19 bp, Homo sapiens
ttttgaagtatgagacagg

SEQ ID NO: 9046372 - DNA, 22 bp, Homo sapiens
ttttgcatctggtgaagaccag

SEQ ID NO: 9046373 - DNA, 23 bp, Homo sapiens
ttttcctttggacaggctgtatt

SEQ ID NO: 9046374 - DNA, 23 bp, Homo sapiens
ttttcctttggacaggctgtatt

SEQ ID NO: 9046375 - DNA, 22 bp, Homo sapiens
ttttcctttggaagatgcatat

SEQ ID NO: 9046376 - DNA, 22 bp, Homo sapiens
ttttcctttcatcaggacaaag

SEQ ID NO: 9046377 - DNA, 20 bp, Homo sapiens
ttttccttgttgccgctgct

SEQ ID NO: 9046378 - DNA, 22 bp, Homo sapiens
ttttcctttgattcccagatgt

SEQ ID NO: 9046379 - DNA, 22 bp, Homo sapiens
ttttcctttgaaaggtgagggc

SEQ ID NO: 9046380 - DNA, 22 bp, Homo sapiens
ttttccttctgatactccattt

SEQ ID NO: 9046381 - DNA, 20 bp, Homo sapiens
ttttccttctgagtatgttg

SEQ ID NO: 9046382 - DNA, 19 bp, Homo sapiens
ttttccttctcctcttaat

SEQ ID NO: 9046383 - DNA, 22 bp, Homo sapiens
tttgttcactgagcaatgatta

SEQ ID NO: 9046384 - DNA, 22 bp, Homo sapiens
tttgttctgcatcacagaaaaa

SEQ ID NO: 9046385 - DNA, 22 bp, Homo sapiens
tttgtttacaaaaataagcagt

SEQ ID NO: 9046386 - DNA, 22 bp, Homo sapiens
tttgtacatttcactccattgt

SEQ ID NO: 9046387 - DNA, 22 bp, Homo sapiens
tttgtagattcattgaactttt

SEQ ID NO: 9046388 - DNA, 22 bp, Homo sapiens
ttttagaagtgcctatcctatg

SEQ ID NO: 9046389 - DNA, 22 bp, Homo sapiens
tttgtttgaaagtctctacagc

SEQ ID NO: 9046390 - DNA, 22 bp, Homo sapiens
ttttatattgagtgagagttcc

SEQ ID NO: 9046391 - DNA, 22 bp, Homo sapiens
tttggcaaagatggctagctgt

SEQ ID NO: 9046392 - DNA, 22 bp, Homo sapiens
tttgtaatgataatgttaaatt

SEQ ID NO: 9046393 - DNA, 22 bp, Homo sapiens
tttggcaagcgagtactttctg

SEQ ID NO: 9046394 - DNA, 22 bp, Homo sapiens
tttctttatcctcctttgcaca

SEQ ID NO: 9046395 - DNA, 22 bp, Homo sapiens
tttctttccatacatattgcta

SEQ ID NO: 9046396 - DNA, 22 bp, Homo sapiens
tttgcacacacaataacaaatg

SEQ ID NO: 9046397 - DNA, 22 bp, Homo sapiens
tttgcacacattcttagaaatg

SEQ ID NO: 9046398 - DNA, 22 bp, Homo sapiens
tttgcacagatgggatacagca

SEQ ID NO: 9046399 - DNA, 22 bp, Homo sapiens
tttgcacagatgggatacagca

SEQ ID NO: 9046400 - DNA, 22 bp, Homo sapiens
tttgcaggcacggaggcagctg

SEQ ID NO: 9046401 - DNA, 22 bp, Homo sapiens
tttgcagggctggtaggaccac

SEQ ID NO: 9046402 - DNA, 20 bp, Homo sapiens
tttgcaggaaggaaataggt

SEQ ID NO: 9046403 - DNA, 22 bp, Homo sapiens
ttaacaaaaatatcaggcatca

SEQ ID NO: 9046404 - DNA, 22 bp, Homo sapiens
ttaacacagggggagacaaagt

SEQ ID NO: 9046405 - DNA, 22 bp, Homo sapiens
ttaacacatatttatcaattgc

SEQ ID NO: 9046406 - DNA, 22 bp, Homo sapiens
ttaaatgtgatttcatttatgt

SEQ ID NO: 9046407 - DNA, 22 bp, Homo sapiens
ttaaatgaacgagatatgcaac

SEQ ID NO: 9046408 - DNA, 22 bp, Homo sapiens
ttaaatcagtaggctactcctt

SEQ ID NO: 9046409 - DNA, 22 bp, Homo sapiens
ttaaatcaggcatcatttcagt

SEQ ID NO: 9046410 - DNA, 22 bp, Homo sapiens
ttaaatgaacgagatatgcaac

SEQ ID NO: 9046411 - DNA, 22 bp, Homo sapiens
ttaaatgacttttattattctc

SEQ ID NO: 9046412 - DNA, 22 bp, Homo sapiens
ttaaatgtcaatagattgcttg

SEQ ID NO: 9046413 - DNA, 22 bp, Homo sapiens
tgtttttatctctgtgtacaac

SEQ ID NO: 9046414 - DNA, 22 bp, Homo sapiens
ttaaagcatcacactattaatt

SEQ ID NO: 9046415 - DNA, 22 bp, Homo sapiens
ttaaagcagtttgtatacatgg

SEQ ID NO: 9046416 - DNA, 22 bp, Homo sapiens
tgtttttaaataatgatagaaa

SEQ ID NO: 9046417 - DNA, 22 bp, Homo sapiens
tgtttttaaaatgtcctggtta

SEQ ID NO: 9046418 - DNA, 22 bp, Homo sapiens
tgttttgtgcatttacaacatg

SEQ ID NO: 9046419 - DNA, 22 bp, Homo sapiens
tgttttgttagcactctgggaa

SEQ ID NO: 9046420 - DNA, 20 bp, Homo sapiens
ttaagaaaagcacatcctgc

SEQ ID NO: 9046421 - DNA, 20 bp, Homo sapiens
ttaagaaaagcacatcctgc

SEQ ID NO: 9046422 - DNA, 20 bp, Homo sapiens
ttaagaaaagcacatcctgc

SEQ ID NO: 9046423 - DNA, 22 bp, Homo sapiens
ttaagaatgtgccttttggttg

SEQ ID NO: 9046424 - DNA, 21 bp, Homo sapiens
ttaagacacacagattaagga

SEQ ID NO: 9046425 - DNA, 22 bp, Homo sapiens
ttaagacatgtgagcataactt

SEQ ID NO: 9046426 - DNA, 22 bp, Homo sapiens
ttaagagacaggagaatgatgt

SEQ ID NO: 9046427 - DNA, 22 bp, Homo sapiens
ttaacactatctgtcataatta

SEQ ID NO: 9046428 - DNA, 22 bp, Homo sapiens
ttaacacttgaactctacatgt

SEQ ID NO: 9046429 - DNA, 22 bp, Homo sapiens
ttaacactgattgtagagacac

SEQ ID NO: 9046430 - DNA, 19 bp, Homo sapiens
ttaacagtcaccaaggaga

SEQ ID NO: 9046431 - DNA, 22 bp, Homo sapiens
ttaacatcctgtttaaatttgg

SEQ ID NO: 9046432 - DNA, 22 bp, Homo sapiens
ttaacatgtcttgacttcatct

SEQ ID NO: 9046433 - DNA, 22 bp, Homo sapiens
ttaacattaaaagcagcatttt

SEQ ID NO: 9046434 - DNA, 22 bp, Homo sapiens
ttaacattgtccttagcagatt

SEQ ID NO: 9046435 - DNA, 22 bp, Homo sapiens
ttaacatttagtgtacccctgt

SEQ ID NO: 9046436 - DNA, 22 bp, Homo sapiens
ttaacatttgtgaagcatttag

SEQ ID NO: 9046437 - DNA, 22 bp, Homo sapiens
ttaacatttcttttccactcat

SEQ ID NO: 9046438 - DNA, 22 bp, Homo sapiens
ttaactctccctccttacatcc

SEQ ID NO: 9046439 - DNA, 22 bp, Homo sapiens
ttaattgagccagaaagtatct

SEQ ID NO: 9046440 - DNA, 22 bp, Homo sapiens
ttaattgttggaaatagattat

SEQ ID NO: 9046441 - DNA, 22 bp, Homo sapiens
ttaaggtagtcagcctctgtgt

SEQ ID NO: 9046442 - DNA, 22 bp, Homo sapiens
ttaaggctgtaagatacattca

SEQ ID NO: 9046443 - DNA, 22 bp, Homo sapiens
ttaagtcaatatcaatctcagc

SEQ ID NO: 9046444 - DNA, 22 bp, Homo sapiens
ttactacagagagagctccagt

SEQ ID NO: 9046445 - DNA, 22 bp, Homo sapiens
ttactgaaagtatacatttctg

SEQ ID NO: 9046446 - DNA, 22 bp, Homo sapiens
ttactgaaggtggatagtgagt

SEQ ID NO: 9046447 - DNA, 22 bp, Homo sapiens
ttacttcttacaaaagaaatat

SEQ ID NO: 9046448 - DNA, 22 bp, Homo sapiens
ttacttaaacagaaatgcagaa

SEQ ID NO: 9046449 - DNA, 22 bp, Homo sapiens
ttactttaagggtgtcttatta

SEQ ID NO: 9046450 - DNA, 22 bp, Homo sapiens
ttactttagatcatactgtgtg

SEQ ID NO: 9046451 - DNA, 22 bp, Homo sapiens
ttagaaagagtataccagaaac

SEQ ID NO: 9046452 - DNA, 20 bp, Homo sapiens
ttagaaagagcgtgataaga

SEQ ID NO: 9046453 - DNA, 22 bp, Homo sapiens
ttagaaagaatagcctggctgc

SEQ ID NO: 9046454 - DNA, 22 bp, Homo sapiens
ttactttcaagtggctgggggt

SEQ ID NO: 9046455 - DNA, 22 bp, Homo sapiens
ttagaggaaagtgactccgatg

SEQ ID NO: 9046456 - DNA, 22 bp, Homo sapiens
ttagagccagttacaaggtcaa

SEQ ID NO: 9046457 - DNA, 22 bp, Homo sapiens
ttagacatagaatattgtctag

SEQ ID NO: 9046458 - DNA, 22 bp, Homo sapiens
ttacacttgaaaacaggattta

SEQ ID NO: 9046459 - DNA, 22 bp, Homo sapiens
ttacagtacagaaaataacaga

SEQ ID NO: 9046460 - DNA, 23 bp, Homo sapiens
ttacagtaggagttggaaaacca

SEQ ID NO: 9046461 - DNA, 22 bp, Homo sapiens
ttacagtattgttaaactcttt

SEQ ID NO: 9046462 - DNA, 22 bp, Homo sapiens
ttacagtattgttaaactcttt

SEQ ID NO: 9046463 - DNA, 22 bp, Homo sapiens
ttacacaacatctgtattatta

SEQ ID NO: 9046464 - DNA, 22 bp, Homo sapiens
ttacacaagttctttaacctat

SEQ ID NO: 9046465 - DNA, 22 bp, Homo sapiens
ttacacaatatatggtacttgg

SEQ ID NO: 9046466 - DNA, 22 bp, Homo sapiens
ttacacaagttctttaacctat

SEQ ID NO: 9046467 - DNA, 22 bp, Homo sapiens
ttacacaacagtgcatcagcag

SEQ ID NO: 9046468 - DNA, 22 bp, Homo sapiens
ttacacaaagttagctcttgca

SEQ ID NO: 9046469 - DNA, 22 bp, Homo sapiens
ttacacaaagttagctcttgca

SEQ ID NO: 9046470 - DNA, 22 bp, Homo sapiens
ttacacaaagctccccaaatag

SEQ ID NO: 9046471 - DNA, 22 bp, Homo sapiens
ttacacaaagctccccaaatag

SEQ ID NO: 9046472 - DNA, 22 bp, Homo sapiens
ttacaaagaaaattaggcattt

SEQ ID NO: 9046473 - DNA, 22 bp, Homo sapiens
ttacaaacaacagacatttatt

SEQ ID NO: 9046474 - DNA, 22 bp, Homo sapiens
ttacaaacaagatcttattctt

SEQ ID NO: 9046475 - DNA, 22 bp, Homo sapiens
ttaattttgatgaggttcagtt

SEQ ID NO: 9046476 - DNA, 22 bp, Homo sapiens
ttacacacaattagcatagtaa

SEQ ID NO: 9046477 - DNA, 22 bp, Homo sapiens
ttacacacagagctgggcctgg

SEQ ID NO: 9046478 - DNA, 22 bp, Homo sapiens
ttacacaattactcactcctgg

SEQ ID NO: 9046479 - DNA, 22 bp, Homo sapiens
ttacacaattttattgacctaa

SEQ ID NO: 9046480 - DNA, 22 bp, Homo sapiens
ttacacaattttattgacctaa

SEQ ID NO: 9046481 - DNA, 22 bp, Homo sapiens
ttacacactctgccctgctgtt

SEQ ID NO: 9046482 - DNA, 22 bp, Homo sapiens
ttacacattaacaggcagctaa

SEQ ID NO: 9046483 - DNA, 22 bp, Homo sapiens
ttacactctggttgtgggcctt

SEQ ID NO: 9046484 - DNA, 19 bp, Homo sapiens
ttacactcctgggcagtgg

SEQ ID NO: 9046485 - DNA, 22 bp, Homo sapiens
ttacactgacagctgaaaagca

SEQ ID NO: 9046486 - DNA, 22 bp, Homo sapiens
ttacactcatattgcacttacc

SEQ ID NO: 9046487 - DNA, 22 bp, Homo sapiens
ttacacagtgcacaagcagagt

SEQ ID NO: 9046488 - DNA, 22 bp, Homo sapiens
ttacacatgaaggtccaatgtt

SEQ ID NO: 9046489 - DNA, 22 bp, Homo sapiens
tgtgttgtgacattcttggatg

SEQ ID NO: 9046490 - DNA, 21 bp, Homo sapiens
tgtgttcttctaggtcagcta

SEQ ID NO: 9046491 - DNA, 22 bp, Homo sapiens
tgtgttggctgccggcacagga

SEQ ID NO: 9046492 - DNA, 22 bp, Homo sapiens
tgtgttggaaatagggtctttg

SEQ ID NO: 9046493 - DNA, 22 bp, Homo sapiens
tgtgttggcttgcctgttaggc

SEQ ID NO: 9046494 - DNA, 22 bp, Homo sapiens
tgtgttggtagatctgaggtct

SEQ ID NO: 9046495 - DNA, 22 bp, Homo sapiens
tgtgttctggaaagctcactga

SEQ ID NO: 9046496 - DNA, 22 bp, Homo sapiens
tgttatgtgccacacttgaggg

SEQ ID NO: 9046497 - DNA, 21 bp, Homo sapiens
tgttatgtgcttcaagaagtg

SEQ ID NO: 9046498 - DNA, 22 bp, Homo sapiens
tgttattgatatctaatgctct

SEQ ID NO: 9046499 - DNA, 22 bp, Homo sapiens
tgttattatgtttccagagcct

SEQ ID NO: 9046500 - DNA, 22 bp, Homo sapiens
tgttattatctgttaggtgttc

SEQ ID NO: 9046501 - DNA, 22 bp, Homo sapiens
tgttatttctttgccatatctt

SEQ ID NO: 9046502 - DNA, 22 bp, Homo sapiens
tgttatttatttcacctccaga

SEQ ID NO: 9046503 - DNA, 21 bp, Homo sapiens
tgttcaaacgtacacatttct

SEQ ID NO: 9046504 - DNA, 18 bp, Homo sapiens
tgttcctgcctttctctg

SEQ ID NO: 9046505 - DNA, 22 bp, Homo sapiens
tgttcctggggacctgccttcc

SEQ ID NO: 9046506 - DNA, 22 bp, Homo sapiens
tgttcagaacaaaggtaaatga

SEQ ID NO: 9046507 - DNA, 22 bp, Homo sapiens
tgttcagaacaaaggtaaatga

SEQ ID NO: 9046508 - DNA, 20 bp, Homo sapiens
tgttcagaaatgcagagagg

SEQ ID NO: 9046509 - DNA, 22 bp, Homo sapiens
tgttcacttatgttctcccatt

SEQ ID NO: 9046510 - DNA, 22 bp, Homo sapiens
tgtttcatgaaacatgtttagg

SEQ ID NO: 9046511 - DNA, 22 bp, Homo sapiens
tgtttccaactgtgatcttact

SEQ ID NO: 9046512 - DNA, 22 bp, Homo sapiens
tgtttcaagcaatagcatttca

SEQ ID NO: 9046513 - DNA, 19 bp, Homo sapiens
tgttttcaagtgggattat

SEQ ID NO: 9046514 - DNA, 22 bp, Homo sapiens
tgttttcacaatgatgtcagat

SEQ ID NO: 9046515 - DNA, 22 bp, Homo sapiens
tgttttcagtcatatagcaggt

SEQ ID NO: 9046516 - DNA, 22 bp, Homo sapiens
tgttttcagatgcagggacaca

SEQ ID NO: 9046517 - DNA, 18 bp, Homo sapiens
tgtttcctcctggaggct

SEQ ID NO: 9046518 - DNA, 22 bp, Homo sapiens
tgtttcctaagtgtctctgaag

SEQ ID NO: 9046519 - DNA, 22 bp, Homo sapiens
tgtttcttgggtgctcacatca

SEQ ID NO: 9046520 - DNA, 22 bp, Homo sapiens
tgttctgccagcacttctcagc

SEQ ID NO: 9046521 - DNA, 22 bp, Homo sapiens
tgttctgtacctgtcctggggc

SEQ ID NO: 9046522 - DNA, 22 bp, Homo sapiens
tgttctcactggatgcttcaca

SEQ ID NO: 9046523 - DNA, 22 bp, Homo sapiens
tgttccttctggcttttacatc

SEQ ID NO: 9046524 - DNA, 22 bp, Homo sapiens
tgttccttttaaatgagtcagt

SEQ ID NO: 9046525 - DNA, 23 bp, Homo sapiens
tgttcctgtcaaattttcttccc

SEQ ID NO: 9046526 - DNA, 22 bp, Homo sapiens
tgttcctgtactgctgtggctt

SEQ ID NO: 9046527 - DNA, 21 bp, Homo sapiens
tgttcctgttctctaggatcc

SEQ ID NO: 9046528 - DNA, 22 bp, Homo sapiens
tgtggacatactaggcctaggc

SEQ ID NO: 9046529 - DNA, 22 bp, Homo sapiens
tccccccagcctttcacatgag

SEQ ID NO: 9046530 - DNA, 20 bp, Homo sapiens
tcccccactgtttctgctac

SEQ ID NO: 9046531 - DNA, 22 bp, Homo sapiens
tcccccactctaaaggagcctt

SEQ ID NO: 9046532 - DNA, 22 bp, Homo sapiens
tgtggcatggttgcaaggacaa

SEQ ID NO: 9046533 - DNA, 22 bp, Homo sapiens
tgtggcatggcagaagggcaca

SEQ ID NO: 9046534 - DNA, 22 bp, Homo sapiens
tgtggatgagggagtgaacaaa

SEQ ID NO: 9046535 - DNA, 22 bp, Homo sapiens
tgtggaggattctgatgccagc

SEQ ID NO: 9046536 - DNA, 22 bp, Homo sapiens
tgtggtagagggcagatgggca

SEQ ID NO: 9046537 - DNA, 22 bp, Homo sapiens
tgtggtctcctgtcttggcctt

SEQ ID NO: 9046538 - DNA, 19 bp, Homo sapiens
tgtggggagtcagggggct

SEQ ID NO: 9046539 - DNA, 22 bp, Homo sapiens
tgtggcctgattttgcatctct

SEQ ID NO: 9046540 - DNA, 22 bp, Homo sapiens
tgtgtcttacataattacatgt

SEQ ID NO: 9046541 - DNA, 22 bp, Homo sapiens
tgtgtcttaagttccaagacat

SEQ ID NO: 9046542 - DNA, 22 bp, Homo sapiens
ttgattaaacaggcatattcaa

SEQ ID NO: 9046543 - DNA, 22 bp, Homo sapiens
ttgagtctctgccaaaacacaa

SEQ ID NO: 9046544 - DNA, 22 bp, Homo sapiens
ttgatttcttactcttccaagg

SEQ ID NO: 9046545 - DNA, 22 bp, Homo sapiens
ttctttcccagtagatgtgaaa

SEQ ID NO: 9046546 - DNA, 22 bp, Homo sapiens
ttctttcccagaagatatgttt

SEQ ID NO: 9046547 - DNA, 20 bp, Homo sapiens
ttctttcatctacacgttgt

SEQ ID NO: 9046548 - DNA, 22 bp, Homo sapiens
ttctttccaaccagatattggt

SEQ ID NO: 9046549 - DNA, 22 bp, Homo sapiens
ttctttcaatagctggcatatg

SEQ ID NO: 9046550 - DNA, 22 bp, Homo sapiens
ttctttcactcaagaaggatct

SEQ ID NO: 9046551 - DNA, 22 bp, Homo sapiens
ttctttattgagacttcattgt

SEQ ID NO: 9046552 - DNA, 23 bp, Homo sapiens
ttctttcaagaagttcacagtgc

SEQ ID NO: 9046553 - DNA, 22 bp, Homo sapiens
ttctttattagtttagtgagct

SEQ ID NO: 9046554 - DNA, 22 bp, Homo sapiens
ttctttatgttaatgaatctat

SEQ ID NO: 9046555 - DNA, 22 bp, Homo sapiens
ttctttatgcttctgtttaggc

SEQ ID NO: 9046556 - DNA, 22 bp, Homo sapiens
ttctttatggaatggtgatagt

SEQ ID NO: 9046557 - DNA, 22 bp, Homo sapiens
ttctttatcctatttgtaggtg

SEQ ID NO: 9046558 - DNA, 22 bp, Homo sapiens
ttctttatcagttactcatagg

SEQ ID NO: 9046559 - DNA, 22 bp, Homo sapiens
ttctttctcaacatgaatgttt

SEQ ID NO: 9046560 - DNA, 22 bp, Homo sapiens
ttgagataggtggaatctcttt

SEQ ID NO: 9046561 - DNA, 22 bp, Homo sapiens
ttgagatgaggtagaagccaat

SEQ ID NO: 9046562 - DNA, 22 bp, Homo sapiens
ttgaagctaggctgtgcatatg

SEQ ID NO: 9046563 - DNA, 22 bp, Homo sapiens
ttgagcacaggtgaacagcatc

SEQ ID NO: 9046564 - DNA, 22 bp, Homo sapiens
ttcttaaaacttatggacaggt

SEQ ID NO: 9046565 - DNA, 22 bp, Homo sapiens
ttcttacaagtattccaggtcc

SEQ ID NO: 9046566 - DNA, 22 bp, Homo sapiens
ttctttaccactactcttccaa

SEQ ID NO: 9046567 - DNA, 20 bp, Homo sapiens
ttctttacgacctttctgca

SEQ ID NO: 9046568 - DNA, 22 bp, Homo sapiens
ttctttatatctgctagtgggt

SEQ ID NO: 9046569 - DNA, 22 bp, Homo sapiens
ttctttatagctattggatgag

SEQ ID NO: 9046570 - DNA, 23 bp, Homo sapiens
ttctttataaatcaatgggatgt

SEQ ID NO: 9046571 - DNA, 22 bp, Homo sapiens
ttcttgattagtctcatgccaa

SEQ ID NO: 9046572 - DNA, 20 bp, Homo sapiens
ttcttgaatacccaacccca

SEQ ID NO: 9046573 - DNA, 22 bp, Homo sapiens
ttcttctttccaattacatggt

SEQ ID NO: 9046574 - DNA, 22 bp, Homo sapiens
ttcttacagagtttacagagcc

SEQ ID NO: 9046575 - DNA, 21 bp, Homo sapiens
ttctgccttcccctagctggg

SEQ ID NO: 9046576 - DNA, 22 bp, Homo sapiens
ttctggaaagatttgcgtgtaa

SEQ ID NO: 9046577 - DNA, 22 bp, Homo sapiens
ttctcttttagaggctccatga

SEQ ID NO: 9046578 - DNA, 22 bp, Homo sapiens
ttctcttttcaccagttgctaa

SEQ ID NO: 9046579 - DNA, 22 bp, Homo sapiens
ttccttagatccttcaatcacg

SEQ ID NO: 9046580 - DNA, 22 bp, Homo sapiens
ttccttagagtttccagaaagc

SEQ ID NO: 9046581 - DNA, 22 bp, Homo sapiens
ttccttaatgaatcaggccatt

SEQ ID NO: 9046582 - DNA, 21 bp, Homo sapiens
ttcctcttgcttccgccttgc

SEQ ID NO: 9046583 - DNA, 22 bp, Homo sapiens
ttcctctttagggctggccagg

SEQ ID NO: 9046584 - DNA, 22 bp, Homo sapiens
ttcctgtgatattagccactgt

SEQ ID NO: 9046585 - DNA, 22 bp, Homo sapiens
ttcctgtggccttacatctgtg

SEQ ID NO: 9046586 - DNA, 20 bp, Homo sapiens
ttctaatttgatggagtagc

SEQ ID NO: 9046587 - DNA, 22 bp, Homo sapiens
ttctacacacctctgaggacat

SEQ ID NO: 9046588 - DNA, 22 bp, Homo sapiens
ttctacacagtgcgggttaaca

SEQ ID NO: 9046589 - DNA, 20 bp, Homo sapiens
ttccacatctttgcacatgc

SEQ ID NO: 9046590 - DNA, 22 bp, Homo sapiens
ttcctccagaagctgtagggga

SEQ ID NO: 9046591 - DNA, 22 bp, Homo sapiens
ttcctccacgtgacaggagcca

SEQ ID NO: 9046592 - DNA, 22 bp, Homo sapiens
ttcctctgtagttgctgatgaa

SEQ ID NO: 9046593 - DNA, 22 bp, Homo sapiens
ttcctctgtatgctttgctgct

SEQ ID NO: 9046594 - DNA, 22 bp, Homo sapiens
ttcctcagagggcgctggggaa

SEQ ID NO: 9046595 - DNA, 22 bp, Homo sapiens
ttcctcagccaaggctgggatc

SEQ ID NO: 9046596 - DNA, 22 bp, Homo sapiens
ttcctcagaccctcattgtgag

SEQ ID NO: 9046597 - DNA, 22 bp, Homo sapiens
ttcctaggatggtgaagcagga

SEQ ID NO: 9046598 - DNA, 18 bp, Homo sapiens
ttcctaggaactaagctt

SEQ ID NO: 9046599 - DNA, 22 bp, Homo sapiens
ttcctacatttgtacaataaga

SEQ ID NO: 9046600 - DNA, 22 bp, Homo sapiens
ttcctacatcaccagggggagt

SEQ ID NO: 9046601 - DNA, 22 bp, Homo sapiens
ttcctatggccagagtcaaaga

SEQ ID NO: 9046602 - DNA, 22 bp, Homo sapiens
ttcctatgtgggcagagacaca

SEQ ID NO: 9046603 - DNA, 22 bp, Homo sapiens
ttcctatggtgaacatgaatga

SEQ ID NO: 9046604 - DNA, 23 bp, Homo sapiens
ttcaacaaatatggccaccagaa

SEQ ID NO: 9046605 - DNA, 22 bp, Homo sapiens
ttcaacaaatatttattgagct

SEQ ID NO: 9046606 - DNA, 22 bp, Homo sapiens
ttcaacaagtatttattgagca

SEQ ID NO: 9046607 - DNA, 22 bp, Homo sapiens
ttcaaaggaaaggcagtgtcaa

SEQ ID NO: 9046608 - DNA, 22 bp, Homo sapiens
ttagagttaggatttgtcttta

SEQ ID NO: 9046609 - DNA, 20 bp, Homo sapiens
ttagagttagctgttatgca

SEQ ID NO: 9046610 - DNA, 22 bp, Homo sapiens
ttagataaaagtgttcaataaa

SEQ ID NO: 9046611 - DNA, 22 bp, Homo sapiens
ttcaacactgatcgtttacaca

SEQ ID NO: 9046612 - DNA, 22 bp, Homo sapiens
ttcaacacaggaacatgatata

SEQ ID NO: 9046613 - DNA, 22 bp, Homo sapiens
ttcaacaatgcacttgagtata

SEQ ID NO: 9046614 - DNA, 22 bp, Homo sapiens
ttcaacatcttggagctggaac

SEQ ID NO: 9046615 - DNA, 22 bp, Homo sapiens
ttcaactaatgtttattttatg

SEQ ID NO: 9046616 - DNA, 22 bp, Homo sapiens
ttcacaagtgtgaaggcagagc

SEQ ID NO: 9046617 - DNA, 19 bp, Homo sapiens
ttcacaagtgatgtctctc

SEQ ID NO: 9046618 - DNA, 22 bp, Homo sapiens
ttcacaataatgtccatcctct

SEQ ID NO: 9046619 - DNA, 22 bp, Homo sapiens
ttcacaatagctggcatcatct

SEQ ID NO: 9046620 - DNA, 22 bp, Homo sapiens
ttcacaagaggcccaggggagc

SEQ ID NO: 9046621 - DNA, 18 bp, Homo sapiens
ttcacaagggcttggttt

SEQ ID NO: 9046622 - DNA, 22 bp, Homo sapiens
ttcacaagtcattagctgcata

SEQ ID NO: 9046623 - DNA, 22 bp, Homo sapiens
ttcacaagtcattagctgcata

SEQ ID NO: 9046624 - DNA, 22 bp, Homo sapiens
ttcacaagtctggaatatgcta

SEQ ID NO: 9046625 - DNA, 20 bp, Homo sapiens
ttcacaactctaggggaggt

SEQ ID NO: 9046626 - DNA, 22 bp, Homo sapiens
ttcacaaagctggagcatttcc

SEQ ID NO: 9046627 - DNA, 22 bp, Homo sapiens
ttcacaaagctggagcatttcc

SEQ ID NO: 9046628 - DNA, 22 bp, Homo sapiens
ttcaattatccctgcaactgag

SEQ ID NO: 9046629 - DNA, 22 bp, Homo sapiens
ttcaatttcataatatctagct

SEQ ID NO: 9046630 - DNA, 22 bp, Homo sapiens
ttcaattttgcagaggaatgca

SEQ ID NO: 9046631 - DNA, 22 bp, Homo sapiens
ttcacaaaatggtttgttgatg

SEQ ID NO: 9046632 - DNA, 22 bp, Homo sapiens
ttcacaaaatggtttgttgatg

SEQ ID NO: 9046633 - DNA, 22 bp, Homo sapiens
ttcacaaaacactattttctgg

SEQ ID NO: 9046634 - DNA, 22 bp, Homo sapiens
ttcacaaaaatgctgaacagtt

SEQ ID NO: 9046635 - DNA, 20 bp, Homo sapiens
ttcatgggagcaaagaggcc

SEQ ID NO: 9046636 - DNA, 20 bp, Homo sapiens
ttcatgggagcaaagaggcc

SEQ ID NO: 9046637 - DNA, 20 bp, Homo sapiens
ttcatgggagcaaagaggcc

SEQ ID NO: 9046638 - DNA, 20 bp, Homo sapiens
ttcatgggagcaaagaggcc

SEQ ID NO: 9046639 - DNA, 22 bp, Homo sapiens
ttcatgtagcttagcagagagg

SEQ ID NO: 9046640 - DNA, 22 bp, Homo sapiens
ttccaattgttctttggaatct

SEQ ID NO: 9046641 - DNA, 22 bp, Homo sapiens
ttcatgtttgcctatttgactt

SEQ ID NO: 9046642 - DNA, 22 bp, Homo sapiens
ttcatgtttcctcttgtgctgc

SEQ ID NO: 9046643 - DNA, 22 bp, Homo sapiens
ttcatgtttcatttgttactat

SEQ ID NO: 9046644 - DNA, 22 bp, Homo sapiens
ttcatgttgtagtatgtatcag

SEQ ID NO: 9046645 - DNA, 22 bp, Homo sapiens
ttcatgtgccagagctgaaaat

SEQ ID NO: 9046646 - DNA, 23 bp, Homo sapiens
ttcatgttccctccttctggtga

SEQ ID NO: 9046647 - DNA, 22 bp, Homo sapiens
ttcatcatcagaactgttcact

SEQ ID NO: 9046648 - DNA, 22 bp, Homo sapiens
ttcatcattacagtcatgttat

SEQ ID NO: 9046649 - DNA, 22 bp, Homo sapiens
ttcatgattgactatcaagagc

SEQ ID NO: 9046650 - DNA, 22 bp, Homo sapiens
ttcatgcttgttcctccacctg

SEQ ID NO: 9046651 - DNA, 22 bp, Homo sapiens
ttcatgctgtgtctacaactta

SEQ ID NO: 9046652 - DNA, 22 bp, Homo sapiens
ttcatggatcatgccttttgtg

SEQ ID NO: 9046653 - DNA, 22 bp, Homo sapiens
agggccagaggcaccttgcagc

SEQ ID NO: 9046654 - DNA, 22 bp, Homo sapiens
ccctggaggcaaaggttgcagt

SEQ ID NO: 9046655 - DNA, 22 bp, Homo sapiens
ccctggaggcggatgttgcagt

SEQ ID NO: 9046656 - DNA, 22 bp, Homo sapiens
agggctccaggggaccatcagt

SEQ ID NO: 9046657 - DNA, 22 bp, Homo sapiens
agggctccaaggaagtgtagct

SEQ ID NO: 9046658 - DNA, 22 bp, Homo sapiens
agggctccaggggctgggtgac

SEQ ID NO: 9046659 - DNA, 22 bp, Homo sapiens
agggctcccgtgaggtgactgc

SEQ ID NO: 9046660 - DNA, 22 bp, Homo sapiens
agggctcccgcggtgtccggga

SEQ ID NO: 9046661 - DNA, 23 bp, Homo sapiens
agggcctcaggagggctgcatgg

SEQ ID NO: 9046662 - DNA, 22 bp, Homo sapiens
agggctcctgaggcccttctgg

SEQ ID NO: 9046663 - DNA, 23 bp, Homo sapiens
agggctccttgttgattagcatt

SEQ ID NO: 9046664 - DNA, 22 bp, Homo sapiens
agggctccgggcaggcgatgga

SEQ ID NO: 9046665 - DNA, 22 bp, Homo sapiens
agggctccgggccaccggcctg

SEQ ID NO: 9046666 - DNA, 22 bp, Homo sapiens
agggctcctatgatgctctgcc

SEQ ID NO: 9046667 - DNA, 22 bp, Homo sapiens
agggctcctatgccccatggac

SEQ ID NO: 9046668 - DNA, 22 bp, Homo sapiens
agggctcctccccggcctccac

SEQ ID NO: 9046669 - DNA, 22 bp, Homo sapiens
cctgaggaccagcacccatctg

SEQ ID NO: 9046670 - DNA, 22 bp, Homo sapiens
cctgaggaggtgaagtctccat

SEQ ID NO: 9046671 - DNA, 22 bp, Homo sapiens
cctgaggatgccagcatgggtg

SEQ ID NO: 9046672 - DNA, 22 bp, Homo sapiens
cctgaggatattcaccagcatg

SEQ ID NO: 9046673 - DNA, 22 bp, Homo sapiens
aggggctgggacagagccaagc

SEQ ID NO: 9046674 - DNA, 21 bp, Homo sapiens
aggggacagagtagctccagg

SEQ ID NO: 9046675 - DNA, 21 bp, Homo sapiens
aggggacagagtagctccagg

SEQ ID NO: 9046676 - DNA, 22 bp, Homo sapiens
aggggacatttagcaatgacta

SEQ ID NO: 9046677 - DNA, 22 bp, Homo sapiens
aggggagaaaaatgccttctgt

SEQ ID NO: 9046678 - DNA, 22 bp, Homo sapiens
aggggagaaaaatgccttctgt

SEQ ID NO: 9046679 - DNA, 22 bp, Homo sapiens
aggggagaatttcaactcaggt

SEQ ID NO: 9046680 - DNA, 22 bp, Homo sapiens
aggggagagaacataaggaagt

SEQ ID NO: 9046681 - DNA, 19 bp, Homo sapiens
cctgaggaaaagatgattg

SEQ ID NO: 9046682 - DNA, 22 bp, Homo sapiens
aggggagaggtgagcaacttct

SEQ ID NO: 9046683 - DNA, 22 bp, Homo sapiens
cctgagatcagtgcatttggtg

SEQ ID NO: 9046684 - DNA, 22 bp, Homo sapiens
agggctgagtggtgcagtcaaa

SEQ ID NO: 9046685 - DNA, 22 bp, Homo sapiens
cctcctgcggcgtccgcgctct

SEQ ID NO: 9046686 - DNA, 22 bp, Homo sapiens
cctcctgcacttgctttccttc

SEQ ID NO: 9046687 - DNA, 19 bp, Homo sapiens
cctctgccagcccgcctct

SEQ ID NO: 9046688 - DNA, 18 bp, Homo sapiens
agggatctagatggagtc

SEQ ID NO: 9046689 - DNA, 22 bp, Homo sapiens
agggatgatggaaagaagcagg

SEQ ID NO: 9046690 - DNA, 22 bp, Homo sapiens
agggatggagcccagctgttct

SEQ ID NO: 9046691 - DNA, 22 bp, Homo sapiens
agggagtggttaagaaggtgca

SEQ ID NO: 9046692 - DNA, 22 bp, Homo sapiens
agggagaagagaacaaagccct

SEQ ID NO: 9046693 - DNA, 22 bp, Homo sapiens
agggactccgtgcacagtggtt

SEQ ID NO: 9046694 - DNA, 22 bp, Homo sapiens
agggactgagctaggatctagt

SEQ ID NO: 9046695 - DNA, 22 bp, Homo sapiens
ccctggaggagcttagagcttg

SEQ ID NO: 9046696 - DNA, 18 bp, Homo sapiens
ccctcttgcacaaagcaa

SEQ ID NO: 9046697 - DNA, 22 bp, Homo sapiens
cccagggaagccatttctgact

SEQ ID NO: 9046698 - DNA, 20 bp, Homo sapiens
agggaacaatggacgctgtc

SEQ ID NO: 9046699 - DNA, 23 bp, Homo sapiens
agggaacaagcaagctgctagtc

SEQ ID NO: 9046700 - DNA, 22 bp, Homo sapiens
agggaacagtgaaaggcatcag

SEQ ID NO: 9046701 - DNA, 22 bp, Homo sapiens
agggaacaaaactctaaaattc

SEQ ID NO: 9046702 - DNA, 22 bp, Homo sapiens
aggcttctaggaaactttctgg

SEQ ID NO: 9046703 - DNA, 22 bp, Homo sapiens
aggcttcttctctatgtacaag

SEQ ID NO: 9046704 - DNA, 22 bp, Homo sapiens
aggcttctgtgagctcatacaa

SEQ ID NO: 9046705 - DNA, 22 bp, Homo sapiens
ccagccctgccagagagagctg

SEQ ID NO: 9046706 - DNA, 22 bp, Homo sapiens
aggcccagcccgtcctcgtgct

SEQ ID NO: 9046707 - DNA, 22 bp, Homo sapiens
aggcccagcccgtcctcgtgct

SEQ ID NO: 9046708 - DNA, 21 bp, Homo sapiens
aggcccagagtcttgggggga

SEQ ID NO: 9046709 - DNA, 19 bp, Homo sapiens
aggcccagcgctgggggct

SEQ ID NO: 9046710 - DNA, 22 bp, Homo sapiens
ccagctttatagcttcaaagga

SEQ ID NO: 9046711 - DNA, 22 bp, Homo sapiens
ccagcttctctctgatgcagct

SEQ ID NO: 9046712 - DNA, 22 bp, Homo sapiens
ccagcttttcttatcattataa

SEQ ID NO: 9046713 - DNA, 22 bp, Homo sapiens
aggcaggggagctggaagggta

SEQ ID NO: 9046714 - DNA, 22 bp, Homo sapiens
aggcaggggagctggaagggta

SEQ ID NO: 9046715 - DNA, 22 bp, Homo sapiens
aggcaggggagctggaagggta

SEQ ID NO: 9046716 - DNA, 22 bp, Homo sapiens
ccagagaaaggtttgattcatt

SEQ ID NO: 9046717 - DNA, 22 bp, Homo sapiens
aggctcctgcaggtgaggtgct

SEQ ID NO: 9046718 - DNA, 22 bp, Homo sapiens
aggctcctgagaggcagaggct

SEQ ID NO: 9046719 - DNA, 22 bp, Homo sapiens
aggctcctcggggctgacggcg

SEQ ID NO: 9046720 - DNA, 22 bp, Homo sapiens
aggctcctgagaggcagaggct

SEQ ID NO: 9046721 - DNA, 22 bp, Homo sapiens
aggctcctagcctgtggctggt

SEQ ID NO: 9046722 - DNA, 20 bp, Homo sapiens
aggctcctccaggatgtgtg

SEQ ID NO: 9046723 - DNA, 22 bp, Homo sapiens
ccagggaggagcatttcatggt

SEQ ID NO: 9046724 - DNA, 22 bp, Homo sapiens
ccagggaggagcatttcatggt

SEQ ID NO: 9046725 - DNA, 22 bp, Homo sapiens
ccagggaggagcatttcatggt

SEQ ID NO: 9046726 - DNA, 18 bp, Homo sapiens
ccagggagcttattagga

SEQ ID NO: 9046727 - DNA, 22 bp, Homo sapiens
ccagggagcggggctgggtctc

SEQ ID NO: 9046728 - DNA, 18 bp, Homo sapiens
ccagggagcttattagga

SEQ ID NO: 9046729 - DNA, 22 bp, Homo sapiens
ccagggactttgcattgtttat

SEQ ID NO: 9046730 - DNA, 22 bp, Homo sapiens
ccagggagcccacaggacaatg

SEQ ID NO: 9046731 - DNA, 22 bp, Homo sapiens
ccagggagcctggtgtgtcagc

SEQ ID NO: 9046732 - DNA, 22 bp, Homo sapiens
ccagggagcctggtgtgtcagc

SEQ ID NO: 9046733 - DNA, 22 bp, Homo sapiens
ccaggctgtaaacaccttcaaa

SEQ ID NO: 9046734 - DNA, 22 bp, Homo sapiens
aggctccaccccgccagacctt

SEQ ID NO: 9046735 - DNA, 22 bp, Homo sapiens
aggctcatctgagcagaaacct

SEQ ID NO: 9046736 - DNA, 23 bp, Homo sapiens
aggctccacatgggcactttgca

SEQ ID NO: 9046737 - DNA, 22 bp, Homo sapiens
aggctcagcctgggcctagagc

SEQ ID NO: 9046738 - DNA, 22 bp, Homo sapiens
aggctcagcctgggcctagagc

SEQ ID NO: 9046739 - DNA, 22 bp, Homo sapiens
cccagagccggtggtgctcaca

SEQ ID NO: 9046740 - DNA, 21 bp, Homo sapiens
ccatgtcagatgtgggctgtg

SEQ ID NO: 9046741 - DNA, 20 bp, Homo sapiens
aggctgcctaaggctctgca

SEQ ID NO: 9046742 - DNA, 22 bp, Homo sapiens
aggctgcctctgcaggatccct

SEQ ID NO: 9046743 - DNA, 22 bp, Homo sapiens
aggctgcctcgtgagctcgctg

SEQ ID NO: 9046744 - DNA, 22 bp, Homo sapiens
aggctctgtgactaaagaggat

SEQ ID NO: 9046745 - DNA, 22 bp, Homo sapiens
ccatggcttacagatggagcat

SEQ ID NO: 9046746 - DNA, 22 bp, Homo sapiens
catagacattgataggttatat

SEQ ID NO: 9046747 - DNA, 22 bp, Homo sapiens
catagttataaggcaacactgt

SEQ ID NO: 9046748 - DNA, 22 bp, Homo sapiens
catagttttaggtagaaactgg

SEQ ID NO: 9046749 - DNA, 22 bp, Homo sapiens
cataggaatgaggacaattagc

SEQ ID NO: 9046750 - DNA, 22 bp, Homo sapiens
cataggccacggtcagcccaca

SEQ ID NO: 9046751 - DNA, 22 bp, Homo sapiens
catagtaaataatgcagatgat

SEQ ID NO: 9046752 - DNA, 22 bp, Homo sapiens
catatttagtgtttggagatcg

SEQ ID NO: 9046753 - DNA, 22 bp, Homo sapiens
catatttatagatctggcattt

SEQ ID NO: 9046754 - DNA, 22 bp, Homo sapiens
catattctgttggtcacataga

SEQ ID NO: 9046755 - DNA, 19 bp, Homo sapiens
aggagaagtagcagaaatt

SEQ ID NO: 9046756 - DNA, 22 bp, Homo sapiens
aggagaagtaaggctagatgat

SEQ ID NO: 9046757 - DNA, 22 bp, Homo sapiens
caggtgggaccatgatagggca

SEQ ID NO: 9046758 - DNA, 22 bp, Homo sapiens
caggtgggagccacagcgtaca

SEQ ID NO: 9046759 - DNA, 22 bp, Homo sapiens
aggacaggattgagctgaactg

SEQ ID NO: 9046760 - DNA, 22 bp, Homo sapiens
aggacattatgctaagtaaatg

SEQ ID NO: 9046761 - DNA, 22 bp, Homo sapiens
caggtgggagcgaggagctact

SEQ ID NO: 9046762 - DNA, 22 bp, Homo sapiens
caggtgggagcggagactgatt

SEQ ID NO: 9046763 - DNA, 22 bp, Homo sapiens
aggaccttggaataacaaattc

SEQ ID NO: 9046764 - DNA, 22 bp, Homo sapiens
ccaagcatttctagccagtcac

SEQ ID NO: 9046765 - DNA, 22 bp, Homo sapiens
ccaagcatggggttcagtagga

SEQ ID NO: 9046766 - DNA, 22 bp, Homo sapiens
ccaagataagagacaagattta

SEQ ID NO: 9046767 - DNA, 23 bp, Homo sapiens
aggcagcaggttgtccagggtga

SEQ ID NO: 9046768 - DNA, 22 bp, Homo sapiens
ccaatcctcatgttcaacaacc

SEQ ID NO: 9046769 - DNA, 22 bp, Homo sapiens
ccaaggtcttggacagctaatg

SEQ ID NO: 9046770 - DNA, 21 bp, Homo sapiens
aggcagcaggatccagggaca

SEQ ID NO: 9046771 - DNA, 19 bp, Homo sapiens
aggcagcaggccagggatg

SEQ ID NO: 9046772 - DNA, 22 bp, Homo sapiens
catttgttctgatttcaaaagg

SEQ ID NO: 9046773 - DNA, 22 bp, Homo sapiens
catttgttctgatttcaaaagg

SEQ ID NO: 9046774 - DNA, 20 bp, Homo sapiens
catttgttagctttctactg

SEQ ID NO: 9046775 - DNA, 22 bp, Homo sapiens
cattaacaatgactgcttgact

SEQ ID NO: 9046776 - DNA, 22 bp, Homo sapiens
cattaacaattgtttatgctgt

SEQ ID NO: 9046777 - DNA, 22 bp, Homo sapiens
catttgaaatagttcattcttg

SEQ ID NO: 9046778 - DNA, 22 bp, Homo sapiens
cattaaaatatctcatggtgtt

SEQ ID NO: 9046779 - DNA, 22 bp, Homo sapiens
cattaaaatatctcatggtgtt

SEQ ID NO: 9046780 - DNA, 22 bp, Homo sapiens
cattaaacaaccttgaatcaat

SEQ ID NO: 9046781 - DNA, 22 bp, Homo sapiens
cattaaatatcaacctagacta

SEQ ID NO: 9046782 - DNA, 22 bp, Homo sapiens
cattaaatcttccagacctcac

SEQ ID NO: 9046783 - DNA, 22 bp, Homo sapiens
cattaaattccttgttctcaaa

SEQ ID NO: 9046784 - DNA, 22 bp, Homo sapiens
cattaacaaatggaagcatgaa

SEQ ID NO: 9046785 - DNA, 16 bp, Homo sapiens
aggaggggaattagga

SEQ ID NO: 9046786 - DNA, 20 bp, Homo sapiens
aggaggggatagaatcaaag

SEQ ID NO: 9046787 - DNA, 22 bp, Homo sapiens
aggagggatagaaaaatacttg

SEQ ID NO: 9046788 - DNA, 19 bp, Homo sapiens
aggattccagaacagtgtt

SEQ ID NO: 9046789 - DNA, 22 bp, Homo sapiens
aggattcatggtgcagacaaag

SEQ ID NO: 9046790 - DNA, 18 bp, Homo sapiens
catgtatgcaaataagca

SEQ ID NO: 9046791 - DNA, 22 bp, Homo sapiens
catgtatcttaattgctttgga

SEQ ID NO: 9046792 - DNA, 22 bp, Homo sapiens
catgtcacaattcttaatggga

SEQ ID NO: 9046793 - DNA, 22 bp, Homo sapiens
catgtccacagttctgagaggc

SEQ ID NO: 9046794 - DNA, 22 bp, Homo sapiens
catgtatagacactcatacagt

SEQ ID NO: 9046795 - DNA, 22 bp, Homo sapiens
catgggggtctggacaacaggc

SEQ ID NO: 9046796 - DNA, 22 bp, Homo sapiens
cagggagcggagtcccatgcct

SEQ ID NO: 9046797 - DNA, 22 bp, Homo sapiens
caggctgctgacaggcttggag

SEQ ID NO: 9046798 - DNA, 22 bp, Homo sapiens
cagggagctattagggttagtg

SEQ ID NO: 9046799 - DNA, 22 bp, Homo sapiens
cagggagctgacaaccaaggag

SEQ ID NO: 9046800 - DNA, 22 bp, Homo sapiens
caggctgcgtttgtgaaaggta

SEQ ID NO: 9046801 - DNA, 22 bp, Homo sapiens
caggctgctccagggtaggaaa

SEQ ID NO: 9046802 - DNA, 22 bp, Homo sapiens
caggctgcggtcggctctggtc

SEQ ID NO: 9046803 - DNA, 22 bp, Homo sapiens
caggctgcggccgtgtgagcat

SEQ ID NO: 9046804 - DNA, 22 bp, Homo sapiens
caggctcactgtaaggtcagct

SEQ ID NO: 9046805 - DNA, 22 bp, Homo sapiens
caggctcactttctcagtcaca

SEQ ID NO: 9046806 - DNA, 22 bp, Homo sapiens
caggcctggttgagccctgaga

SEQ ID NO: 9046807 - DNA, 20 bp, Homo sapiens
caggtgagcagatctgggtg

SEQ ID NO: 9046808 - DNA, 20 bp, Homo sapiens
caggtgagcagatctgggtg

SEQ ID NO: 9046809 - DNA, 22 bp, Homo sapiens
caggtgacttctgaggccttca

SEQ ID NO: 9046810 - DNA, 22 bp, Homo sapiens
caggtgacctatggtcactaca

SEQ ID NO: 9046811 - DNA, 22 bp, Homo sapiens
caggtgaccctctcacctgctt

SEQ ID NO: 9046812 - DNA, 22 bp, Homo sapiens
caggtgacctgggatccgctgc

SEQ ID NO: 9046813 - DNA, 22 bp, Homo sapiens
caggtgacctcagcgcctgcag

SEQ ID NO: 9046814 - DNA, 22 bp, Homo sapiens
caggtgacctttgtcctaagtt

SEQ ID NO: 9046815 - DNA, 17 bp, Homo sapiens
caggtgacctggtgatg

SEQ ID NO: 9046816 - DNA, 22 bp, Homo sapiens
caggtgacatcaacaggaccac

SEQ ID NO: 9046817 - DNA, 22 bp, Homo sapiens
caggtgaccctcagtgtggact

SEQ ID NO: 9046818 - DNA, 22 bp, Homo sapiens
cagggtgactgccctggccact

SEQ ID NO: 9046819 - DNA, 22 bp, Homo sapiens
cagggctcccaaatatctcttc

SEQ ID NO: 9046820 - DNA, 22 bp, Homo sapiens
cagggctccccagagagcctct

SEQ ID NO: 9046821 - DNA, 22 bp, Homo sapiens
cagggctcccttgcaaggaggg

SEQ ID NO: 9046822 - DNA, 22 bp, Homo sapiens
cagggctccctgcagcctctgt

SEQ ID NO: 9046823 - DNA, 22 bp, Homo sapiens
cagggctccctctggctcccag

SEQ ID NO: 9046824 - DNA, 22 bp, Homo sapiens
cagggctccccgcaccgcagcc

SEQ ID NO: 9046825 - DNA, 22 bp, Homo sapiens
cagggctctgccttgagggatg

SEQ ID NO: 9046826 - DNA, 22 bp, Homo sapiens
cagggctcgctcttgcccttcg

SEQ ID NO: 9046827 - DNA, 22 bp, Homo sapiens
cagggctcgctcgctcgctcgc

SEQ ID NO: 9046828 - DNA, 22 bp, Homo sapiens
cagggctcgctgccagcttcag

SEQ ID NO: 9046829 - DNA, 18 bp, Homo sapiens
agctggccctggctgccg

SEQ ID NO: 9046830 - DNA, 22 bp, Homo sapiens
agctgctgagccatgtcctgct

SEQ ID NO: 9046831 - DNA, 22 bp, Homo sapiens
caggcactgcactaccactttt

SEQ ID NO: 9046832 - DNA, 23 bp, Homo sapiens
agctgcagatgctcagcgggcag

SEQ ID NO: 9046833 - DNA, 22 bp, Homo sapiens
agctgcagagaaaagaggctgg

SEQ ID NO: 9046834 - DNA, 19 bp, Homo sapiens
agctgcagaccagaagtgc

SEQ ID NO: 9046835 - DNA, 22 bp, Homo sapiens
agctgcaatacccttcttcctt

SEQ ID NO: 9046836 - DNA, 22 bp, Homo sapiens
agctgcaagtgttgcctcctac

SEQ ID NO: 9046837 - DNA, 22 bp, Homo sapiens
agctgcaattaaagactgtgaa

SEQ ID NO: 9046838 - DNA, 22 bp, Homo sapiens
agctgcaattctggacatagtc

SEQ ID NO: 9046839 - DNA, 21 bp, Homo sapiens
agctgcaagagcaacatcttt

SEQ ID NO: 9046840 - DNA, 22 bp, Homo sapiens
agctgcaagataaaagtgatgt

SEQ ID NO: 9046841 - DNA, 22 bp, Homo sapiens
agctgcaagatttcttttgtat

SEQ ID NO: 9046842 - DNA, 22 bp, Homo sapiens
agctgcaagtctgtgtggggag

SEQ ID NO: 9046843 - DNA, 14 bp, Homo sapiens
agctgcaagcatcc

SEQ ID NO: 9046844 - DNA, 22 bp, Homo sapiens
agctgcaagtaagcttgctcct

SEQ ID NO: 9046845 - DNA, 22 bp, Homo sapiens
agctgcaagtccaaaggaatta

SEQ ID NO: 9046846 - DNA, 21 bp, Homo sapiens
agctgcaaaaacatacagttc

SEQ ID NO: 9046847 - DNA, 19 bp, Homo sapiens
agctgcaaaaggtggaact

SEQ ID NO: 9046848 - DNA, 22 bp, Homo sapiens
agctgcaaaccaggccggcgcg

SEQ ID NO: 9046849 - DNA, 20 bp, Homo sapiens
agctgcaacagactgtatgg

SEQ ID NO: 9046850 - DNA, 22 bp, Homo sapiens
agctgcaaaggcacacttgggc

SEQ ID NO: 9046851 - DNA, 22 bp, Homo sapiens
agctgcaaagatctgtcagtca

SEQ ID NO: 9046852 - DNA, 22 bp, Homo sapiens
agctgcaaagatgatttgttgt

SEQ ID NO: 9046853 - DNA, 23 bp, Homo sapiens
agctgcaagactccctgtctgag

SEQ ID NO: 9046854 - DNA, 22 bp, Homo sapiens
agctgcaactgtccttgccttg

SEQ ID NO: 9046855 - DNA, 22 bp, Homo sapiens
agctgcaagaagaggtccctga

SEQ ID NO: 9046856 - DNA, 22 bp, Homo sapiens
agctgcaacatctgcttgtccc

SEQ ID NO: 9046857 - DNA, 22 bp, Homo sapiens
agctgcaaccttagctataggc

SEQ ID NO: 9046858 - DNA, 22 bp, Homo sapiens
cagctctgggtgacaggagggc

SEQ ID NO: 9046859 - DNA, 22 bp, Homo sapiens
cagctctggtccagggagggca

SEQ ID NO: 9046860 - DNA, 22 bp, Homo sapiens
cagctctgggtaggaggaatct

SEQ ID NO: 9046861 - DNA, 22 bp, Homo sapiens
cagctctggggcagagtgacta

SEQ ID NO: 9046862 - DNA, 20 bp, Homo sapiens
cagctctgggcaggtcgagg

SEQ ID NO: 9046863 - DNA, 22 bp, Homo sapiens
cagctctgtaaattccttcatc

SEQ ID NO: 9046864 - DNA, 22 bp, Homo sapiens
cagctgaagctcttgtcaaagg

SEQ ID NO: 9046865 - DNA, 22 bp, Homo sapiens
cagctgaatcagtgagtggaaa

SEQ ID NO: 9046866 - DNA, 22 bp, Homo sapiens
cagctgaaggtaggaaccagga

SEQ ID NO: 9046867 - DNA, 22 bp, Homo sapiens
cagctgaagcccaggcagaacc

SEQ ID NO: 9046868 - DNA, 22 bp, Homo sapiens
cagctgaatggctccctgctaa

SEQ ID NO: 9046869 - DNA, 22 bp, Homo sapiens
cagctgaattcttcagactcca

SEQ ID NO: 9046870 - DNA, 20 bp, Homo sapiens
cctttattatttgtatgatg

SEQ ID NO: 9046871 - DNA, 20 bp, Homo sapiens
cctttattatttgtatgatg

SEQ ID NO: 9046872 - DNA, 22 bp, Homo sapiens
cgcctggaacctctaggaccag

SEQ ID NO: 9046873 - DNA, 22 bp, Homo sapiens
agtacaaatgcagccagagtag

SEQ ID NO: 9046874 - DNA, 22 bp, Homo sapiens
aggtggggttcagtctcagccg

SEQ ID NO: 9046875 - DNA, 19 bp, Homo sapiens
aggtgtgggggctgcagac

SEQ ID NO: 9046876 - DNA, 22 bp, Homo sapiens
aggtgtggctggggcagaggcc

SEQ ID NO: 9046877 - DNA, 21 bp, Homo sapiens
ctacacagctttctataggaa

SEQ ID NO: 9046878 - DNA, 22 bp, Homo sapiens
ctacacagttctgcctaatggc

SEQ ID NO: 9046879 - DNA, 22 bp, Homo sapiens
ctacagaaacctttttcataca

SEQ ID NO: 9046880 - DNA, 22 bp, Homo sapiens
agtcaccaacatggttcccagg

SEQ ID NO: 9046881 - DNA, 19 bp, Homo sapiens
cgcctggcaggccctgcgc

SEQ ID NO: 9046882 - DNA, 22 bp, Homo sapiens
ctaaaattatcaagataattcc

SEQ ID NO: 9046883 - DNA, 22 bp, Homo sapiens
cgtggcagtggaaggctgggtg

SEQ ID NO: 9046884 - DNA, 23 bp, Homo sapiens
cgtgcttccaggcccagctgagc

SEQ ID NO: 9046885 - DNA, 22 bp, Homo sapiens
cgtggcagtggtgtttcttagg

SEQ ID NO: 9046886 - DNA, 22 bp, Homo sapiens
aggtgaggtttgggaggtgtca

SEQ ID NO: 9046887 - DNA, 22 bp, Homo sapiens
aggtctggtgttgggcctgaaa

SEQ ID NO: 9046888 - DNA, 22 bp, Homo sapiens
aggtggagatcagggactaagg

SEQ ID NO: 9046889 - DNA, 22 bp, Homo sapiens
cctgcctgcggcccgcggggag

SEQ ID NO: 9046890 - DNA, 22 bp, Homo sapiens
cctggccttaagggcagggagc

SEQ ID NO: 9046891 - DNA, 22 bp, Homo sapiens
aggtagtgtagctgagtgggat

SEQ ID NO: 9046892 - DNA, 22 bp, Homo sapiens
ctgagaaaggacctcaaacagg

SEQ ID NO: 9046893 - DNA, 22 bp, Homo sapiens
ctgagaaaggacctcaaacagg

SEQ ID NO: 9046894 - DNA, 22 bp, Homo sapiens
ctgaagcttagtttacgctcca

SEQ ID NO: 9046895 - DNA, 22 bp, Homo sapiens
ctgaagcttgataaactataaa

SEQ ID NO: 9046896 - DNA, 22 bp, Homo sapiens
ctgaagctctccagtttgtttc

SEQ ID NO: 9046897 - DNA, 22 bp, Homo sapiens
ctgaagccatgtgctcactggt

SEQ ID NO: 9046898 - DNA, 22 bp, Homo sapiens
ctgaagcaggcctacttcattg

SEQ ID NO: 9046899 - DNA, 19 bp, Homo sapiens
ctgagagatgcttcacaca

SEQ ID NO: 9046900 - DNA, 23 bp, Homo sapiens
ctgaagcaatatcccctcacttc

SEQ ID NO: 9046901 - DNA, 21 bp, Homo sapiens
agtgtgttcttggcattacct

SEQ ID NO: 9046902 - DNA, 22 bp, Homo sapiens
ctcttagaaactatagagatta

SEQ ID NO: 9046903 - DNA, 20 bp, Homo sapiens
ctcttaaatgtaaagtaggc

SEQ ID NO: 9046904 - DNA, 22 bp, Homo sapiens
agtgtctgaacctgcagtggga

SEQ ID NO: 9046905 - DNA, 22 bp, Homo sapiens
agtggggaagagcatgggccct

SEQ ID NO: 9046906 - DNA, 22 bp, Homo sapiens
ctctgagacttttcacctccca

SEQ ID NO: 9046907 - DNA, 22 bp, Homo sapiens
ctctgagaggctgccctgccat

SEQ ID NO: 9046908 - DNA, 22 bp, Homo sapiens
agtgggagggccatatggtgaa

SEQ ID NO: 9046909 - DNA, 22 bp, Homo sapiens
agtggctggagccccaggctgg

SEQ ID NO: 9046910 - DNA, 18 bp, Homo sapiens
ctctctgggtgaggacaa

SEQ ID NO: 9046911 - DNA, 22 bp, Homo sapiens
ctctctgggggccatgccaaga

SEQ ID NO: 9046912 - DNA, 22 bp, Homo sapiens
agtgactggtgtgaagttaaat

SEQ ID NO: 9046913 - DNA, 22 bp, Homo sapiens
ctccatatgttcagttatgcag

SEQ ID NO: 9046914 - DNA, 22 bp, Homo sapiens
agtgacattattttgtgtacta

SEQ ID NO: 9046915 - DNA, 22 bp, Homo sapiens
ctccagtgcttctagaaaatac

SEQ ID NO: 9046916 - DNA, 22 bp, Homo sapiens
ctccagggagctgcgggagcca

SEQ ID NO: 9046917 - DNA, 22 bp, Homo sapiens
ctccagtgtctcagagcagatg

SEQ ID NO: 9046918 - DNA, 22 bp, Homo sapiens
ctcctcctggacacaggctgtg

SEQ ID NO: 9046919 - DNA, 18 bp, Homo sapiens
ctcctccctaagggctca

SEQ ID NO: 9046920 - DNA, 22 bp, Homo sapiens
ctcctccctctttgccacacat

SEQ ID NO: 9046921 - DNA, 19 bp, Homo sapiens
agtctgtggatttgtgggt

SEQ ID NO: 9046922 - DNA, 22 bp, Homo sapiens
agtctgtggatggactggcaga

SEQ ID NO: 9046923 - DNA, 22 bp, Homo sapiens
agtccaaagcagatgagggcca

SEQ ID NO: 9046924 - DNA, 22 bp, Homo sapiens
agtccaaagcagatgagggcca

SEQ ID NO: 9046925 - DNA, 19 bp, Homo sapiens
agtcatctcactgtgccca

SEQ ID NO: 9046926 - DNA, 22 bp, Homo sapiens
agtctgcaggaccgcgtcacat

SEQ ID NO: 9046927 - DNA, 22 bp, Homo sapiens
atatcacagatgcagaaagaga

SEQ ID NO: 9046928 - DNA, 22 bp, Homo sapiens
atatcaaaataaacagcatgca

SEQ ID NO: 9046929 - DNA, 22 bp, Homo sapiens
atatcacaaacaagtctgtact

SEQ ID NO: 9046930 - DNA, 22 bp, Homo sapiens
atagtctttactgctgaattga

SEQ ID NO: 9046931 - DNA, 22 bp, Homo sapiens
atagtcttcagcactttgatca

SEQ ID NO: 9046932 - DNA, 22 bp, Homo sapiens
atatatgtgcaggctcacacat

SEQ ID NO: 9046933 - DNA, 22 bp, Homo sapiens
atagtatttccagaaatagtct

SEQ ID NO: 9046934 - DNA, 22 bp, Homo sapiens
atagtcttagaatcttgagtgt

SEQ ID NO: 9046935 - DNA, 22 bp, Homo sapiens
atagtcttcagcactttgatca

SEQ ID NO: 9046936 - DNA, 22 bp, Homo sapiens
ctgggccatgggccagcgaggc

SEQ ID NO: 9046937 - DNA, 22 bp, Homo sapiens
ctgggccatctctctgcaagtg

SEQ ID NO: 9046938 - DNA, 22 bp, Homo sapiens
ctgggccatcagaggggctgga

SEQ ID NO: 9046939 - DNA, 22 bp, Homo sapiens
atattttcactgaaccaaagta

SEQ ID NO: 9046940 - DNA, 22 bp, Homo sapiens
atattttcacagaacttgcaaa

SEQ ID NO: 9046941 - DNA, 22 bp, Homo sapiens
atatttgttagagtctatgtgt

SEQ ID NO: 9046942 - DNA, 22 bp, Homo sapiens
ctgtatctgtcagctggtctcg

SEQ ID NO: 9046943 - DNA, 22 bp, Homo sapiens
atattttgaagttaataatgtg

SEQ ID NO: 9046944 - DNA, 22 bp, Homo sapiens
ctgtatttcccacattctctat

SEQ ID NO: 9046945 - DNA, 22 bp, Homo sapiens
ctgtcattgtacatgttataca

SEQ ID NO: 9046946 - DNA, 22 bp, Homo sapiens
ctgtcattggcagggagtgtgt

SEQ ID NO: 9046947 - DNA, 22 bp, Homo sapiens
ctgtcatttctattatagagga

SEQ ID NO: 9046948 - DNA, 22 bp, Homo sapiens
ctgtcatttctttagcaatggg

SEQ ID NO: 9046949 - DNA, 22 bp, Homo sapiens
ctgtcatttgtctgctccctct

SEQ ID NO: 9046950 - DNA, 22 bp, Homo sapiens
ctggtgctggagcctagtccct

SEQ ID NO: 9046951 - DNA, 22 bp, Homo sapiens
ctggtgggaagatggaaaacat

SEQ ID NO: 9046952 - DNA, 22 bp, Homo sapiens
ctggggaggcagggctgcccct

SEQ ID NO: 9046953 - DNA, 22 bp, Homo sapiens
ctgtttccaccttcatggctaa

SEQ ID NO: 9046954 - DNA, 23 bp, Homo sapiens
cttcacaatcaaaatcagttctg

SEQ ID NO: 9046955 - DNA, 22 bp, Homo sapiens
cttcacaacgacatctggttag

SEQ ID NO: 9046956 - DNA, 22 bp, Homo sapiens
cttcacaatcaccttttcggaa

SEQ ID NO: 9046957 - DNA, 22 bp, Homo sapiens
cttcacaattctaacagggcaa

SEQ ID NO: 9046958 - DNA, 22 bp, Homo sapiens
cttcacaattctaacagggcaa

SEQ ID NO: 9046959 - DNA, 22 bp, Homo sapiens
atccttaatttacttgcatctt

SEQ ID NO: 9046960 - DNA, 22 bp, Homo sapiens
atccttccagagttattctcaa

SEQ ID NO: 9046961 - DNA, 22 bp, Homo sapiens
atccttccttcatttgacaggt

SEQ ID NO: 9046962 - DNA, 22 bp, Homo sapiens
atctcataaacacacatatatg

SEQ ID NO: 9046963 - DNA, 22 bp, Homo sapiens
atctcccagccacagcattctt

SEQ ID NO: 9046964 - DNA, 22 bp, Homo sapiens
cttcatagtgagtttaatgatg

SEQ ID NO: 9046965 - DNA, 22 bp, Homo sapiens
cttcataggcttacttgagaaa

SEQ ID NO: 9046966 - DNA, 22 bp, Homo sapiens
cttcatagggttgtaaggatta

SEQ ID NO: 9046967 - DNA, 22 bp, Homo sapiens
cttcatagaacagaaatttaat

SEQ ID NO: 9046968 - DNA, 22 bp, Homo sapiens
cttcatgagactccactgccat

SEQ ID NO: 9046969 - DNA, 22 bp, Homo sapiens
cttcatgagtgtacaacctgtg

SEQ ID NO: 9046970 - DNA, 22 bp, Homo sapiens
atctgcatttacattgcttgta

SEQ ID NO: 9046971 - DNA, 17 bp, Homo sapiens
atctgcatttctaatga

SEQ ID NO: 9046972 - DNA, 22 bp, Homo sapiens
atctgcatgtatctctctgcat

SEQ ID NO: 9046973 - DNA, 22 bp, Homo sapiens
atctgcatgtccccatggatcc

SEQ ID NO: 9046974 - DNA, 22 bp, Homo sapiens
ctgttatttgagagtgttgaat

SEQ ID NO: 9046975 - DNA, 22 bp, Homo sapiens
ctgttatttgctggaagagttt

SEQ ID NO: 9046976 - DNA, 22 bp, Homo sapiens
ctgttatttggaggatgcttgg

SEQ ID NO: 9046977 - DNA, 22 bp, Homo sapiens
ctgttattttataattcaagaa

SEQ ID NO: 9046978 - DNA, 22 bp, Homo sapiens
ctgttatttctgccaggtgagt

SEQ ID NO: 9046979 - DNA, 22 bp, Homo sapiens
ctgttatttctgaatgccatcc

SEQ ID NO: 9046980 - DNA, 22 bp, Homo sapiens
ctgttatttagaacatggaatc

SEQ ID NO: 9046981 - DNA, 22 bp, Homo sapiens
ctgttatttatgctgctccatt

SEQ ID NO: 9046982 - DNA, 19 bp, Homo sapiens
ctgttattgtcagagctcc

SEQ ID NO: 9046983 - DNA, 22 bp, Homo sapiens
ctgttattccccttgctgtggt

SEQ ID NO: 9046984 - DNA, 23 bp, Homo sapiens
ctgttattccaggctgatgggtg

SEQ ID NO: 9046985 - DNA, 22 bp, Homo sapiens
ctgttattcaagacaaaggcag

SEQ ID NO: 9046986 - DNA, 22 bp, Homo sapiens
ctgttatattggtatatttaca

SEQ ID NO: 9046987 - DNA, 22 bp, Homo sapiens
ctgttattaaaaagctcaggct

SEQ ID NO: 9046988 - DNA, 22 bp, Homo sapiens
atcattcagcctaagcaagtac

SEQ ID NO: 9046989 - DNA, 22 bp, Homo sapiens
atcattataatggtatagttgt

SEQ ID NO: 9046990 - DNA, 22 bp, Homo sapiens
atcattaaatataagcttcaca

SEQ ID NO: 9046991 - DNA, 22 bp, Homo sapiens
atcattagaccaaactagagct

SEQ ID NO: 9046992 - DNA, 22 bp, Homo sapiens
ctgtgccttggcgctgtgccac

SEQ ID NO: 9046993 - DNA, 22 bp, Homo sapiens
ctgtgcctccagtctcgcttct

SEQ ID NO: 9046994 - DNA, 22 bp, Homo sapiens
ctgtgcctgccttgttcactga

SEQ ID NO: 9046995 - DNA, 19 bp, Homo sapiens
agtttattataggtgattc

SEQ ID NO: 9046996 - DNA, 19 bp, Homo sapiens
agtttattataggtgattc

SEQ ID NO: 9046997 - DNA, 22 bp, Homo sapiens
agtgttcatttattcattcact

SEQ ID NO: 9046998 - DNA, 22 bp, Homo sapiens
agtttcacagagggttagacgc

SEQ ID NO: 9046999 - DNA, 22 bp, Homo sapiens
agtttcacagtctgtcattgtt

SEQ ID NO: 9047000 - DNA, 22 bp, Homo sapiens
agtttcacacaacatttgcatg

SEQ ID NO: 9047001 - DNA, 22 bp, Homo sapiens
agtttatttttgataagtcttg

SEQ ID NO: 9047002 - DNA, 22 bp, Homo sapiens
agtttatttttgataagtcttg

SEQ ID NO: 9047003 - DNA, 22 bp, Homo sapiens
agtttatttttgataagtcttg

SEQ ID NO: 9047004 - DNA, 22 bp, Homo sapiens
agtttatttctccatttaccta

SEQ ID NO: 9047005 - DNA, 22 bp, Homo sapiens
agtttatttctccatttaccta

SEQ ID NO: 9047006 - DNA, 17 bp, Homo sapiens
agtttatttagccttct

SEQ ID NO: 9047007 - DNA, 17 bp, Homo sapiens
agtttatttagccttct

SEQ ID NO: 9047008 - DNA, 22 bp, Homo sapiens
agtttattctgcttggccctcc

SEQ ID NO: 9047009 - DNA, 22 bp, Homo sapiens
agtttattgtatatggtagttt

SEQ ID NO: 9047010 - DNA, 20 bp, Homo sapiens
agtttattccaggagaactg

SEQ ID NO: 9047011 - DNA, 20 bp, Homo sapiens
agtttattccaggagaactg

SEQ ID NO: 9047012 - DNA, 22 bp, Homo sapiens
agtttattctctggtcttagta

SEQ ID NO: 9047013 - DNA, 22 bp, Homo sapiens
agtttattctctggtcttagta

SEQ ID NO: 9047014 - DNA, 22 bp, Homo sapiens
agtttattctctggtcttagta

SEQ ID NO: 9047015 - DNA, 23 bp, Homo sapiens
agttttcaagttggtggctggca

SEQ ID NO: 9047016 - DNA, 22 bp, Homo sapiens
agttttcaatatatgatagtga

SEQ ID NO: 9047017 - DNA, 22 bp, Homo sapiens
ctgatacatagtagcatgtcat

SEQ ID NO: 9047018 - DNA, 22 bp, Homo sapiens
ctgatacaatgtctgctttata

SEQ ID NO: 9047019 - DNA, 23 bp, Homo sapiens
agtttcacattttacatgtggct

SEQ ID NO: 9047020 - DNA, 22 bp, Homo sapiens
agtttcacagtctgtcattgtt

SEQ ID NO: 9047021 - DNA, 22 bp, Homo sapiens
agtttcactaaggtctgtgtgt

SEQ ID NO: 9047022 - DNA, 22 bp, Homo sapiens
ctgccctcccagttggtccgtg

SEQ ID NO: 9047023 - DNA, 22 bp, Homo sapiens
ctgcccgctgctagagaggccg

SEQ ID NO: 9047024 - DNA, 22 bp, Homo sapiens
ctgccctgacctgcctcagagt

SEQ ID NO: 9047025 - DNA, 22 bp, Homo sapiens
ctgccctgtagctgttctagca

SEQ ID NO: 9047026 - DNA, 22 bp, Homo sapiens
ctgccctggtcccatggctgat

SEQ ID NO: 9047027 - DNA, 20 bp, Homo sapiens
agttttcagcagaacaccca

SEQ ID NO: 9047028 - DNA, 22 bp, Homo sapiens
agttttcaggaaagagttggtg

SEQ ID NO: 9047029 - DNA, 22 bp, Homo sapiens
agttttcacactcaccaaaagg

SEQ ID NO: 9047030 - DNA, 22 bp, Homo sapiens
agttttcacactcaccaaaagg

SEQ ID NO: 9047031 - DNA, 22 bp, Homo sapiens
agttttcagaaattgcgaccca

SEQ ID NO: 9047032 - DNA, 22 bp, Homo sapiens
agttttcagtaaatattagtga

SEQ ID NO: 9047033 - DNA, 22 bp, Homo sapiens
agttttcagggtttctgtcctc

SEQ ID NO: 9047034 - DNA, 22 bp, Homo sapiens
agttttcattaccatgctgcaa

SEQ ID NO: 9047035 - DNA, 22 bp, Homo sapiens
agttttcctggtcacagcttgg

SEQ ID NO: 9047036 - DNA, 22 bp, Homo sapiens
agttttcctctcatttatcaat

SEQ ID NO: 9047037 - DNA, 21 bp, Homo sapiens
agttttctgagttataaaata

SEQ ID NO: 9047038 - DNA, 22 bp, Homo sapiens
ctgcctgcttttctgggagccg

SEQ ID NO: 9047039 - DNA, 22 bp, Homo sapiens
ctgcctgctgcctgtggagggt

SEQ ID NO: 9047040 - DNA, 22 bp, Homo sapiens
ataagtgtgtaaggcattctgt

SEQ ID NO: 9047041 - DNA, 22 bp, Homo sapiens
ataagtgttaggtaaacatctt

SEQ ID NO: 9047042 - DNA, 22 bp, Homo sapiens
ctgccctgtctgcagcctggct

SEQ ID NO: 9047043 - DNA, 22 bp, Homo sapiens
ctgccctgtggctctgagtcat

SEQ ID NO: 9047044 - DNA, 22 bp, Homo sapiens
ctgccctgtggctctgagtcat

SEQ ID NO: 9047045 - DNA, 20 bp, Homo sapiens
atacacattcatagaaaaat

SEQ ID NO: 9047046 - DNA, 22 bp, Homo sapiens
atacagaactctcagttgtata

SEQ ID NO: 9047047 - DNA, 22 bp, Homo sapiens
ataatggccgggggctgaatgc

SEQ ID NO: 9047048 - DNA, 22 bp, Homo sapiens
ataattcatgggcctttcacct

SEQ ID NO: 9047049 - DNA, 22 bp, Homo sapiens
atacatgaggctcatttatgtc

SEQ ID NO: 9047050 - DNA, 22 bp, Homo sapiens
ctggagctgccagggctgccgc

SEQ ID NO: 9047051 - DNA, 22 bp, Homo sapiens
ctggagctgccagggctgccgc

SEQ ID NO: 9047052 - DNA, 22 bp, Homo sapiens
ctggagctgccagacgggcaca

SEQ ID NO: 9047053 - DNA, 22 bp, Homo sapiens
ctggagctggtatagggacaaa

SEQ ID NO: 9047054 - DNA, 22 bp, Homo sapiens
ctggagctgtcttcacaggcct

SEQ ID NO: 9047055 - DNA, 22 bp, Homo sapiens
ctggagctgtcttcacaggcct

SEQ ID NO: 9047056 - DNA, 22 bp, Homo sapiens
atacatgacagcatagcatcct

SEQ ID NO: 9047057 - DNA, 22 bp, Homo sapiens
atacatgacagcatagcatcct

SEQ ID NO: 9047058 - DNA, 22 bp, Homo sapiens
atacatgactcacacattctgc

SEQ ID NO: 9047059 - DNA, 22 bp, Homo sapiens
atacatgaggaggctggaaaca

SEQ ID NO: 9047060 - DNA, 22 bp, Homo sapiens
atacatgactcacacattctgc

SEQ ID NO: 9047061 - DNA, 21 bp, Homo sapiens
atacagaaggcagactctctc

SEQ ID NO: 9047062 - DNA, 22 bp, Homo sapiens
atacagaagaactatagccact

SEQ ID NO: 9047063 - DNA, 22 bp, Homo sapiens
atacagaagacccctccgtcat

SEQ ID NO: 9047064 - DNA, 21 bp, Homo sapiens
atacagaaggtggcaaagtac

SEQ ID NO: 9047065 - DNA, 22 bp, Homo sapiens
atagggcctaaaaagtattgct

SEQ ID NO: 9047066 - DNA, 22 bp, Homo sapiens
ataggtccaaggagaggtcttt

SEQ ID NO: 9047067 - DNA, 22 bp, Homo sapiens
ataggccatttgagggccaggt

SEQ ID NO: 9047068 - DNA, 22 bp, Homo sapiens
ataggccaatactgtagagttt

SEQ ID NO: 9047069 - DNA, 22 bp, Homo sapiens
ataggccagtgtcctttcttaa

SEQ ID NO: 9047070 - DNA, 22 bp, Homo sapiens
ataggccagatatgctcgcagt

SEQ ID NO: 9047071 - DNA, 22 bp, Homo sapiens
atagacacatgttattatactt

SEQ ID NO: 9047072 - DNA, 22 bp, Homo sapiens
atagacatggtcttttgtcatt

SEQ ID NO: 9047073 - DNA, 22 bp, Homo sapiens
atagacatatggctttgtttct

SEQ ID NO: 9047074 - DNA, 22 bp, Homo sapiens
atagaaacagggaagcaaagca

SEQ ID NO: 9047075 - DNA, 22 bp, Homo sapiens
atagaaacagaggtcaggcatt

SEQ ID NO: 9047076 - DNA, 22 bp, Homo sapiens
atactttgctagtatcagtgtg

SEQ ID NO: 9047077 - DNA, 22 bp, Homo sapiens
atagaaatggcagctggtgcta

SEQ ID NO: 9047078 - DNA, 22 bp, Homo sapiens
caatagaaaactcaatacttaa

SEQ ID NO: 9047079 - DNA, 22 bp, Homo sapiens
caatactgagtttacattcatc

SEQ ID NO: 9047080 - DNA, 22 bp, Homo sapiens
caattctttcagctgcatttgt

SEQ ID NO: 9047081 - DNA, 19 bp, Homo sapiens
caattctgcaacactgtcc

SEQ ID NO: 9047082 - DNA, 22 bp, Homo sapiens
caattgctttgtggaagccttt

SEQ ID NO: 9047083 - DNA, 22 bp, Homo sapiens
caattgcttttccaagggcaga

SEQ ID NO: 9047084 - DNA, 22 bp, Homo sapiens
caattgctgatatgcagaagac

SEQ ID NO: 9047085 - DNA, 22 bp, Homo sapiens
caattgctttcttaccaagaga

SEQ ID NO: 9047086 - DNA, 22 bp, Homo sapiens
caatttcaagattctgttcttt

SEQ ID NO: 9047087 - DNA, 22 bp, Homo sapiens
caatgttttgttgaatgaatag

SEQ ID NO: 9047088 - DNA, 22 bp, Homo sapiens
caatccatcaattacacaggct

SEQ ID NO: 9047089 - DNA, 22 bp, Homo sapiens
caatttcaatacaaaatacatt

SEQ ID NO: 9047090 - DNA, 22 bp, Homo sapiens
caatttcactaataatatttac

SEQ ID NO: 9047091 - DNA, 22 bp, Homo sapiens
caatttcaatgaggccacaggg

SEQ ID NO: 9047092 - DNA, 18 bp, Homo sapiens
caatttcaatggtctgaa

SEQ ID NO: 9047093 - DNA, 22 bp, Homo sapiens
caatttcagtctcagagagttc

SEQ ID NO: 9047094 - DNA, 22 bp, Homo sapiens
caatttcaggtggataggtttt

SEQ ID NO: 9047095 - DNA, 23 bp, Homo sapiens
caatttcatatgattctacctaa

SEQ ID NO: 9047096 - DNA, 23 bp, Homo sapiens
caatttcatatgattctacctaa

SEQ ID NO: 9047097 - DNA, 17 bp, Homo sapiens
caatttcataggttttg

SEQ ID NO: 9047098 - DNA, 17 bp, Homo sapiens
caatttcataggttttg

SEQ ID NO: 9047099 - DNA, 22 bp, Homo sapiens
caatttcagtgctgtggagagg

SEQ ID NO: 9047100 - DNA, 22 bp, Homo sapiens
caatttcactaatgatgtgggg

SEQ ID NO: 9047101 - DNA, 22 bp, Homo sapiens
caatttcactaatgatgtgggg

SEQ ID NO: 9047102 - DNA, 22 bp, Homo sapiens
caatttcactgacaccctggaa

SEQ ID NO: 9047103 - DNA, 22 bp, Homo sapiens
caatttcagacctttccttgga

SEQ ID NO: 9047104 - DNA, 22 bp, Homo sapiens
caatttcagacctttccttgga

SEQ ID NO: 9047105 - DNA, 22 bp, Homo sapiens
caatttcaggtggataggtttt

SEQ ID NO: 9047106 - DNA, 18 bp, Homo sapiens
caatttcatccttaagcc

SEQ ID NO: 9047107 - DNA, 18 bp, Homo sapiens
caatttcatccttaagcc

SEQ ID NO: 9047108 - DNA, 20 bp, Homo sapiens
caatttcatcatttcctgtg

SEQ ID NO: 9047109 - DNA, 20 bp, Homo sapiens
caatttcatcatttcctgtg

SEQ ID NO: 9047110 - DNA, 22 bp, Homo sapiens
caatttcatcttgtgcttcaat

SEQ ID NO: 9047111 - DNA, 22 bp, Homo sapiens
caatttcatgccatgtattgct

SEQ ID NO: 9047112 - DNA, 22 bp, Homo sapiens
caatttcattaatagatataga

SEQ ID NO: 9047113 - DNA, 22 bp, Homo sapiens
caatttcatgccatgtattgct

SEQ ID NO: 9047114 - DNA, 21 bp, Homo sapiens
caatttcatgggaagatggga

SEQ ID NO: 9047115 - DNA, 22 bp, Homo sapiens
caatttcatggataaaagatgt

SEQ ID NO: 9047116 - DNA, 21 bp, Homo sapiens
caatttcatgggaagatggga

SEQ ID NO: 9047117 - DNA, 22 bp, Homo sapiens
cacacagtaggcactcattaat

SEQ ID NO: 9047118 - DNA, 21 bp, Homo sapiens
cacacagtgatctatccacat

SEQ ID NO: 9047119 - DNA, 22 bp, Homo sapiens
ggagagcagggaggctgctctg

SEQ ID NO: 9047120 - DNA, 22 bp, Homo sapiens
cacaaatgactgaaacgactgt

SEQ ID NO: 9047121 - DNA, 23 bp, Homo sapiens
ggaagctcacgtagtcctgcact

SEQ ID NO: 9047122 - DNA, 22 bp, Homo sapiens
ggaagctctgtggcttggagtc

SEQ ID NO: 9047123 - DNA, 22 bp, Homo sapiens
ggacattatagcttccagattg

SEQ ID NO: 9047124 - DNA, 20 bp, Homo sapiens
ggacaggaagacaacctacc

SEQ ID NO: 9047125 - DNA, 20 bp, Homo sapiens
cacaactgtccacatgctcc

SEQ ID NO: 9047126 - DNA, 20 bp, Homo sapiens
cacaactgtccacatgctcc

SEQ ID NO: 9047127 - DNA, 23 bp, Homo sapiens
cacaactaatcagaatctctagg

SEQ ID NO: 9047128 - DNA, 22 bp, Homo sapiens
cacaaatggttgtagacattaa

SEQ ID NO: 9047129 - DNA, 22 bp, Homo sapiens
gctgcctgcagtgttttcccag

SEQ ID NO: 9047130 - DNA, 22 bp, Homo sapiens
gctgcctgccctgggtcatctg

SEQ ID NO: 9047131 - DNA, 22 bp, Homo sapiens
caagaatataaatactttcaaa

SEQ ID NO: 9047132 - DNA, 22 bp, Homo sapiens
caagacaagatctaagcatgct

SEQ ID NO: 9047133 - DNA, 22 bp, Homo sapiens
caagaagccgagctacaggctc

SEQ ID NO: 9047134 - DNA, 22 bp, Homo sapiens
gctggctcttcagtggagatag

SEQ ID NO: 9047135 - DNA, 22 bp, Homo sapiens
gctggctgaggtctagctcttt

SEQ ID NO: 9047136 - DNA, 22 bp, Homo sapiens
gctgggcttgtggccagctggg

SEQ ID NO: 9047137 - DNA, 20 bp, Homo sapiens
gctgggctttgactgacaca

SEQ ID NO: 9047138 - DNA, 22 bp, Homo sapiens
gctggggactccccaccatagc

SEQ ID NO: 9047139 - DNA, 22 bp, Homo sapiens
gctggggagaattgggttatct

SEQ ID NO: 9047140 - DNA, 22 bp, Homo sapiens
gctggggagcaagagtagtgag

SEQ ID NO: 9047141 - DNA, 22 bp, Homo sapiens
caagcgtggctgctctgatgga

SEQ ID NO: 9047142 - DNA, 22 bp, Homo sapiens
caaagtgagttataaacatctt

SEQ ID NO: 9047143 - DNA, 22 bp, Homo sapiens
caaagtcataaaacttgtaagt

SEQ ID NO: 9047144 - DNA, 22 bp, Homo sapiens
caaagtatgaaccagtttctct

SEQ ID NO: 9047145 - DNA, 22 bp, Homo sapiens
caactttagcaatgttagtata

SEQ ID NO: 9047146 - DNA, 22 bp, Homo sapiens
caaattttgtgtgttctctagt

SEQ ID NO: 9047147 - DNA, 22 bp, Homo sapiens
caaatttaggtaacagtctgta

SEQ ID NO: 9047148 - DNA, 22 bp, Homo sapiens
caaattttgtgtgttctctagt

SEQ ID NO: 9047149 - DNA, 22 bp, Homo sapiens
caagaaactttattctgccata

SEQ ID NO: 9047150 - DNA, 22 bp, Homo sapiens
caagaaacaccaatgactgctg

SEQ ID NO: 9047151 - DNA, 22 bp, Homo sapiens
caagaaatctagaagtcagtgg

SEQ ID NO: 9047152 - DNA, 22 bp, Homo sapiens
caagaaattctgttcagatagc

SEQ ID NO: 9047153 - DNA, 22 bp, Homo sapiens
caagaaatgtttactgagcatc

SEQ ID NO: 9047154 - DNA, 22 bp, Homo sapiens
caagaaatgtttactgagcatc

SEQ ID NO: 9047155 - DNA, 22 bp, Homo sapiens
caactttctgttaaatgttagt

SEQ ID NO: 9047156 - DNA, 22 bp, Homo sapiens
caagaaattctgttcagatagc

SEQ ID NO: 9047157 - DNA, 22 bp, Homo sapiens
caagaaattctgttcagatagc

SEQ ID NO: 9047158 - DNA, 22 bp, Homo sapiens
caagaaatttcttaagaactaa

SEQ ID NO: 9047159 - DNA, 22 bp, Homo sapiens
gctgcctgatgtccagcaggac

SEQ ID NO: 9047160 - DNA, 22 bp, Homo sapiens
cacagtcctgccagagggcctt

SEQ ID NO: 9047161 - DNA, 22 bp, Homo sapiens
cacagtgaatttcaagtgttgt

SEQ ID NO: 9047162 - DNA, 22 bp, Homo sapiens
cacagtgacctctttaaaaggg

SEQ ID NO: 9047163 - DNA, 22 bp, Homo sapiens
cacagtgactggcacatagtaa

SEQ ID NO: 9047164 - DNA, 22 bp, Homo sapiens
cacagtgattgatttttacttt

SEQ ID NO: 9047165 - DNA, 22 bp, Homo sapiens
cacagtgcatgatgggcagaag

SEQ ID NO: 9047166 - DNA, 22 bp, Homo sapiens
cacagtgcgaaagaaacccagc

SEQ ID NO: 9047167 - DNA, 22 bp, Homo sapiens
ggcaatcattggcattctctgg

SEQ ID NO: 9047168 - DNA, 22 bp, Homo sapiens
cacatgaccactctttacttct

SEQ ID NO: 9047169 - DNA, 22 bp, Homo sapiens
cacatgacactattttgttcta

SEQ ID NO: 9047170 - DNA, 22 bp, Homo sapiens
cacatgcaccagaaatcaacat

SEQ ID NO: 9047171 - DNA, 22 bp, Homo sapiens
ggcagatgctggcttctgctgt

SEQ ID NO: 9047172 - DNA, 22 bp, Homo sapiens
cacattattctaaagaggtact

SEQ ID NO: 9047173 - DNA, 22 bp, Homo sapiens
cacatgttaacttcctacagtg

SEQ ID NO: 9047174 - DNA, 22 bp, Homo sapiens
cacatgttcttaacttctgttt

SEQ ID NO: 9047175 - DNA, 22 bp, Homo sapiens
cacatgtttcaggccatatttg

SEQ ID NO: 9047176 - DNA, 22 bp, Homo sapiens
cacatgtttgctacatttttct

SEQ ID NO: 9047177 - DNA, 22 bp, Homo sapiens
caccagctttgcccactgccca

SEQ ID NO: 9047178 - DNA, 22 bp, Homo sapiens
caccagcttacagtctcacccc

SEQ ID NO: 9047179 - DNA, 22 bp, Homo sapiens
caccagctgcaacaccatctcc

SEQ ID NO: 9047180 - DNA, 22 bp, Homo sapiens
caccagctctccaccaggtttc

SEQ ID NO: 9047181 - DNA, 22 bp, Homo sapiens
caccagcttcccatcgcgggtc

SEQ ID NO: 9047182 - DNA, 22 bp, Homo sapiens
caccagcttctcattgcgggtc

SEQ ID NO: 9047183 - DNA, 22 bp, Homo sapiens
caccagcttgggctgtggaaat

SEQ ID NO: 9047184 - DNA, 22 bp, Homo sapiens
caccagcttgcagtcttaaccc

SEQ ID NO: 9047185 - DNA, 22 bp, Homo sapiens
caccagcttgcagtcttaaccc

SEQ ID NO: 9047186 - DNA, 22 bp, Homo sapiens
cacattcctggtgctcagcagc

SEQ ID NO: 9047187 - DNA, 22 bp, Homo sapiens
caccagctactcgggtttcctg

SEQ ID NO: 9047188 - DNA, 22 bp, Homo sapiens
caccagctccaccagggcaggt

SEQ ID NO: 9047189 - DNA, 22 bp, Homo sapiens
caccagctactccagggccgtg

SEQ ID NO: 9047190 - DNA, 21 bp, Homo sapiens
cacttgaatggtgttttacaa

SEQ ID NO: 9047191 - DNA, 22 bp, Homo sapiens
cacttctcacaaagtgacattc

SEQ ID NO: 9047192 - DNA, 22 bp, Homo sapiens
cacttctcacaaagtgacattc

SEQ ID NO: 9047193 - DNA, 22 bp, Homo sapiens
cacttgaaaatcagaggaaatt

SEQ ID NO: 9047194 - DNA, 22 bp, Homo sapiens
cacttcagctacaatcacatga

SEQ ID NO: 9047195 - DNA, 22 bp, Homo sapiens
cacttcaaggaatatctagaaa

SEQ ID NO: 9047196 - DNA, 22 bp, Homo sapiens
cacttcaattaacttcagcatt

SEQ ID NO: 9047197 - DNA, 22 bp, Homo sapiens
cacttaaatgttcctacagcag

SEQ ID NO: 9047198 - DNA, 22 bp, Homo sapiens
cacttacacttctgaaagccta

SEQ ID NO: 9047199 - DNA, 22 bp, Homo sapiens
cacttaaagtcttagcttacag

SEQ ID NO: 9047200 - DNA, 22 bp, Homo sapiens
cacttaaatctgttgagaaaaa

SEQ ID NO: 9047201 - DNA, 22 bp, Homo sapiens
cactgtaatggaattttcttta

SEQ ID NO: 9047202 - DNA, 22 bp, Homo sapiens
cactgtaatagcattataagtg

SEQ ID NO: 9047203 - DNA, 22 bp, Homo sapiens
cactgtaagatgagctttttta

SEQ ID NO: 9047204 - DNA, 21 bp, Homo sapiens
cactgtatagcaggagaaaac

SEQ ID NO: 9047205 - DNA, 22 bp, Homo sapiens
cactgtcacgttctgaaactgt

SEQ ID NO: 9047206 - DNA, 22 bp, Homo sapiens
cactgcactccagcctgggaga

SEQ ID NO: 9047207 - DNA, 22 bp, Homo sapiens
cactgcactccagcctgggtca

SEQ ID NO: 9047208 - DNA, 22 bp, Homo sapiens
cactgcactccagcctgggtga

SEQ ID NO: 9047209 - DNA, 22 bp, Homo sapiens
cacctggcccagctccagtgct

SEQ ID NO: 9047210 - DNA, 22 bp, Homo sapiens
caccaggcacatagtaggcact

SEQ ID NO: 9047211 - DNA, 22 bp, Homo sapiens
caccaggctgaaccagagggga

SEQ ID NO: 9047212 - DNA, 22 bp, Homo sapiens
cactgcaacctccacctcctgg

SEQ ID NO: 9047213 - DNA, 21 bp, Homo sapiens
cactccacttagaacagggtt

SEQ ID NO: 9047214 - DNA, 22 bp, Homo sapiens
cactcctataattaaagatgca

SEQ ID NO: 9047215 - DNA, 22 bp, Homo sapiens
cactccctctagttgcattctg

SEQ ID NO: 9047216 - DNA, 22 bp, Homo sapiens
cactctaagaacacaaaggccc

SEQ ID NO: 9047217 - DNA, 21 bp, Homo sapiens
cactccacttagaacagggtt

SEQ ID NO: 9047218 - DNA, 22 bp, Homo sapiens
cactattttctcttcagatggc

SEQ ID NO: 9047219 - DNA, 21 bp, Homo sapiens
cactcaataaatgtcatatgc

SEQ ID NO: 9047220 - DNA, 22 bp, Homo sapiens
ggccagggaggagaggcccctg

SEQ ID NO: 9047221 - DNA, 22 bp, Homo sapiens
ggccagggaggagaggcccctg

SEQ ID NO: 9047222 - DNA, 21 bp, Homo sapiens
cactatttatatatgccagct

SEQ ID NO: 9047223 - DNA, 22 bp, Homo sapiens
cagccctcctaccctgccaggc

SEQ ID NO: 9047224 - DNA, 22 bp, Homo sapiens
gtgagagctgctccagatctct

SEQ ID NO: 9047225 - DNA, 22 bp, Homo sapiens
cagccctgtccaatgtctgctc

SEQ ID NO: 9047226 - DNA, 22 bp, Homo sapiens
cagccctgtccagcagagggtg

SEQ ID NO: 9047227 - DNA, 22 bp, Homo sapiens
cagccctggcccaggtgcctta

SEQ ID NO: 9047228 - DNA, 22 bp, Homo sapiens
cagccctggtgaggttggctat

SEQ ID NO: 9047229 - DNA, 22 bp, Homo sapiens
cagccctgtccctgagggacct

SEQ ID NO: 9047230 - DNA, 22 bp, Homo sapiens
gtcagcagggtccccttgagtg

SEQ ID NO: 9047231 - DNA, 21 bp, Homo sapiens
gtcagcagatccagcacttgt

SEQ ID NO: 9047232 - DNA, 22 bp, Homo sapiens
cagcatctcatttgacttctgc

SEQ ID NO: 9047233 - DNA, 22 bp, Homo sapiens
gtcacagcctcaatcccatctg

SEQ ID NO: 9047234 - DNA, 22 bp, Homo sapiens
gtattttacttacgcatgactt

SEQ ID NO: 9047235 - DNA, 22 bp, Homo sapiens
gtcacaagggagcctgggcgca

SEQ ID NO: 9047236 - DNA, 22 bp, Homo sapiens
gtcacacagggcctccaaatca

SEQ ID NO: 9047237 - DNA, 22 bp, Homo sapiens
cagccaggagctccccctgctc

SEQ ID NO: 9047238 - DNA, 22 bp, Homo sapiens
cagccagctgtcccaagtgcct

SEQ ID NO: 9047239 - DNA, 22 bp, Homo sapiens
cagccagctggtgcggcagagc

SEQ ID NO: 9047240 - DNA, 22 bp, Homo sapiens
gtccagagctggcacactgtca

SEQ ID NO: 9047241 - DNA, 20 bp, Homo sapiens
gtccagagtaatgtgctgac

SEQ ID NO: 9047242 - DNA, 22 bp, Homo sapiens
cagatttaggtcactagaattt

SEQ ID NO: 9047243 - DNA, 22 bp, Homo sapiens
cagatttaggcttagtccaagc

SEQ ID NO: 9047244 - DNA, 22 bp, Homo sapiens
cagcaaaagccagcataagctc

SEQ ID NO: 9047245 - DNA, 20 bp, Homo sapiens
cagcaaaatgaaaatggatt

SEQ ID NO: 9047246 - DNA, 22 bp, Homo sapiens
cagatttaagagataaacagtg

SEQ ID NO: 9047247 - DNA, 20 bp, Homo sapiens
cagattctccactaacatat

SEQ ID NO: 9047248 - DNA, 22 bp, Homo sapiens
cagcaaagcaggctcctagaac

SEQ ID NO: 9047249 - DNA, 22 bp, Homo sapiens
cagcaaagcttaatttatatct

SEQ ID NO: 9047250 - DNA, 22 bp, Homo sapiens
cagcaaagcaggctcctagaac

SEQ ID NO: 9047251 - DNA, 22 bp, Homo sapiens
cagcaaaggtagaagcacagga

SEQ ID NO: 9047252 - DNA, 22 bp, Homo sapiens
gtaggccatggtggttgtctct

SEQ ID NO: 9047253 - DNA, 22 bp, Homo sapiens
gtacacactgtttgatcatttc

SEQ ID NO: 9047254 - DNA, 22 bp, Homo sapiens
gtacacactatgtattgtacac

SEQ ID NO: 9047255 - DNA, 22 bp, Homo sapiens
gtacacactatttaaagtgttt

SEQ ID NO: 9047256 - DNA, 22 bp, Homo sapiens
gtactaaaaaatgatcagtttg

SEQ ID NO: 9047257 - DNA, 22 bp, Homo sapiens
gggtaaatctcttttcatggct

SEQ ID NO: 9047258 - DNA, 22 bp, Homo sapiens
gggtaacgttggaatttttgtg

SEQ ID NO: 9047259 - DNA, 22 bp, Homo sapiens
ggggcagatggaacagagcaca

SEQ ID NO: 9047260 - DNA, 22 bp, Homo sapiens
gggctgtaggagctggaatggg

SEQ ID NO: 9047261 - DNA, 18 bp, Homo sapiens
gggctgtgagatgggaag

SEQ ID NO: 9047262 - DNA, 22 bp, Homo sapiens
gggctgtggagccgcgagggct

SEQ ID NO: 9047263 - DNA, 22 bp, Homo sapiens
gggttcagtccctcttgctact

SEQ ID NO: 9047264 - DNA, 22 bp, Homo sapiens
gggttccaatgatgagcaagag

SEQ ID NO: 9047265 - DNA, 20 bp, Homo sapiens
gggtgtgggcccggccaggc

SEQ ID NO: 9047266 - DNA, 22 bp, Homo sapiens
gggtccagtttcatctgaggtt

SEQ ID NO: 9047267 - DNA, 19 bp, Homo sapiens
gggtcccactgcccgtctg

SEQ ID NO: 9047268 - DNA, 22 bp, Homo sapiens
gggtccaggtcttcaggcagag

SEQ ID NO: 9047269 - DNA, 22 bp, Homo sapiens
gggtccaggtttagtcatttgt

SEQ ID NO: 9047270 - DNA, 22 bp, Homo sapiens
gggtccagtagttggtggccgt

SEQ ID NO: 9047271 - DNA, 22 bp, Homo sapiens
ggtatttccttgcctctgccta

SEQ ID NO: 9047272 - DNA, 22 bp, Homo sapiens
ggtatttcagtattatacaact

SEQ ID NO: 9047273 - DNA, 22 bp, Homo sapiens
ggtcacaaggcagataataagg

SEQ ID NO: 9047274 - DNA, 22 bp, Homo sapiens
cagatgaggcaacctcattgct

SEQ ID NO: 9047275 - DNA, 22 bp, Homo sapiens
cagatgagcatgggcacaagca

SEQ ID NO: 9047276 - DNA, 23 bp, Homo sapiens
cagatgaggttggcagcatggtc

SEQ ID NO: 9047277 - DNA, 18 bp, Homo sapiens
cagatgagatgcaatctc

SEQ ID NO: 9047278 - DNA, 22 bp, Homo sapiens
cagatgagagtggccagggttc

SEQ ID NO: 9047279 - DNA, 19 bp, Homo sapiens
cagatgagaaaagtgaggt

SEQ ID NO: 9047280 - DNA, 21 bp, Homo sapiens
cagatgacccacatggtgtct

SEQ ID NO: 9047281 - DNA, 22 bp, Homo sapiens
cagagcataattgacatgaggt

SEQ ID NO: 9047282 - DNA, 22 bp, Homo sapiens
gggcaggtactgggtggtgagc

SEQ ID NO: 9047283 - DNA, 22 bp, Homo sapiens
gggcaggggtcagtggccccaa

SEQ ID NO: 9047284 - DNA, 22 bp, Homo sapiens
cagagacaacctggtagagaaa

SEQ ID NO: 9047285 - DNA, 22 bp, Homo sapiens
cagagacaccccagaaaataag

SEQ ID NO: 9047286 - DNA, 22 bp, Homo sapiens
cagagacacttaacaggaatgg

SEQ ID NO: 9047287 - DNA, 22 bp, Homo sapiens
cagagacaccccagaaaataag

SEQ ID NO: 9047288 - DNA, 22 bp, Homo sapiens
cagagacaacaagtttaactat

SEQ ID NO: 9047289 - DNA, 22 bp, Homo sapiens
cagagacaacctggtagagaaa

SEQ ID NO: 9047290 - DNA, 22 bp, Homo sapiens
gggatgaattgagtcagaaggg

SEQ ID NO: 9047291 - DNA, 22 bp, Homo sapiens
gggatctgggacaacaggtggt

SEQ ID NO: 9047292 - DNA, 20 bp, Homo sapiens
gggatcttccaggctctcct

SEQ ID NO: 9047293 - DNA, 22 bp, Homo sapiens
gggatctttctgatgctgtggc

SEQ ID NO: 9047294 - DNA, 22 bp, Homo sapiens
cagaataagctgtgttgtcaag

SEQ ID NO: 9047295 - DNA, 22 bp, Homo sapiens
cagaaacagacatgacgcagta

SEQ ID NO: 9047296 - DNA, 22 bp, Homo sapiens
cagacacacaagcaatctaagt

SEQ ID NO: 9047297 - DNA, 22 bp, Homo sapiens
cagacacacaagcaatctaagt

SEQ ID NO: 9047298 - DNA, 22 bp, Homo sapiens
cagacacacaccctggcctagc

SEQ ID NO: 9047299 - DNA, 22 bp, Homo sapiens
cagacacaccaggcccattctg

SEQ ID NO: 9047300 - DNA, 22 bp, Homo sapiens
cagacacagatatgcatatggc

SEQ ID NO: 9047301 - DNA, 22 bp, Homo sapiens
cagacacagcaattctgtgttg

SEQ ID NO: 9047302 - DNA, 22 bp, Homo sapiens
cagacacagatatgcatatggc

SEQ ID NO: 9047303 - DNA, 22 bp, Homo sapiens
cagacacagcaattctgtgttg

SEQ ID NO: 9047304 - DNA, 22 bp, Homo sapiens
gggagccaaggagagaggcctt

SEQ ID NO: 9047305 - DNA, 22 bp, Homo sapiens
gggaggagtgaagattcacctg

SEQ ID NO: 9047306 - DNA, 22 bp, Homo sapiens
gggaggagggtgctggctaaac

SEQ ID NO: 9047307 - DNA, 21 bp, Homo sapiens
gggagctggaaactgggtgac

SEQ ID NO: 9047308 - DNA, 22 bp, Homo sapiens
atgacaaaagaagacatgaggt

SEQ ID NO: 9047309 - DNA, 22 bp, Homo sapiens
atgacactgagaataacaggta

SEQ ID NO: 9047310 - DNA, 23 bp, Homo sapiens
atgacactcctgtgcgcaccctg

SEQ ID NO: 9047311 - DNA, 22 bp, Homo sapiens
atgacactcgaaaaattgatgc

SEQ ID NO: 9047312 - DNA, 22 bp, Homo sapiens
atgacactctgcagggtgaatg

SEQ ID NO: 9047313 - DNA, 22 bp, Homo sapiens
ctttgggcaaagggccaattcg

SEQ ID NO: 9047314 - DNA, 22 bp, Homo sapiens
atgaattgaggaaaacagtcgt

SEQ ID NO: 9047315 - DNA, 22 bp, Homo sapiens
ctttgccatgttgcctgcagaa

SEQ ID NO: 9047316 - DNA, 22 bp, Homo sapiens
atgagagactgtgtgttgggag

SEQ ID NO: 9047317 - DNA, 22 bp, Homo sapiens
atgagacatgacttcaggcctt

SEQ ID NO: 9047318 - DNA, 22 bp, Homo sapiens
atgagaaagagttgtatctaga

SEQ ID NO: 9047319 - DNA, 22 bp, Homo sapiens
atgagcaagagctatgtacaga

SEQ ID NO: 9047320 - DNA, 22 bp, Homo sapiens
ctttttacaaagcctgtcttct

SEQ ID NO: 9047321 - DNA, 19 bp, Homo sapiens
ctttttcaccttctagaag

SEQ ID NO: 9047322 - DNA, 22 bp, Homo sapiens
ctttttatctcttaatgatgtt

SEQ ID NO: 9047323 - DNA, 22 bp, Homo sapiens
ctttttatagctatgtcctatg

SEQ ID NO: 9047324 - DNA, 22 bp, Homo sapiens
ctttacttcagcaagctttcct

SEQ ID NO: 9047325 - DNA, 22 bp, Homo sapiens
ctttatgtgtactttccatttt

SEQ ID NO: 9047326 - DNA, 22 bp, Homo sapiens
ctttattctgcaaattgccttg

SEQ ID NO: 9047327 - DNA, 22 bp, Homo sapiens
ctttattcctacaagattttct

SEQ ID NO: 9047328 - DNA, 22 bp, Homo sapiens
ctttattctgcaaattgccttg

SEQ ID NO: 9047329 - DNA, 22 bp, Homo sapiens
ctttattcctacaagattttct

SEQ ID NO: 9047330 - DNA, 22 bp, Homo sapiens
ctttattagatgtagactttct

SEQ ID NO: 9047331 - DNA, 22 bp, Homo sapiens
ctttacagatggataattgttt

SEQ ID NO: 9047332 - DNA, 22 bp, Homo sapiens
ctttacagataggaactactca

SEQ ID NO: 9047333 - DNA, 22 bp, Homo sapiens
ctttacaggaaaaggtggctgt

SEQ ID NO: 9047334 - DNA, 22 bp, Homo sapiens
ctttacagaaagagaactctgg

SEQ ID NO: 9047335 - DNA, 22 bp, Homo sapiens
cttctcctaaggtcagaattgc

SEQ ID NO: 9047336 - DNA, 22 bp, Homo sapiens
cttctcctctgagtcctgggag

SEQ ID NO: 9047337 - DNA, 22 bp, Homo sapiens
cttctcctgtaagaagatcaaa

SEQ ID NO: 9047338 - DNA, 21 bp, Homo sapiens
atctttattacgcagagaaga

SEQ ID NO: 9047339 - DNA, 21 bp, Homo sapiens
atctttattacgcagagaaga

SEQ ID NO: 9047340 - DNA, 22 bp, Homo sapiens
atgccactgcacttcagcttgg

SEQ ID NO: 9047341 - DNA, 22 bp, Homo sapiens
atgccactgcacttcagcctgg

SEQ ID NO: 9047342 - DNA, 22 bp, Homo sapiens
gaatttcaaaagccagaacggg

SEQ ID NO: 9047343 - DNA, 22 bp, Homo sapiens
gaatttcaacagtcctcaaatg

SEQ ID NO: 9047344 - DNA, 22 bp, Homo sapiens
gaatttcaaagaggttaagagg

SEQ ID NO: 9047345 - DNA, 22 bp, Homo sapiens
gaatttcacaaggtgaggataa

SEQ ID NO: 9047346 - DNA, 22 bp, Homo sapiens
gaatttcaagcagtgcaatgtt

SEQ ID NO: 9047347 - DNA, 22 bp, Homo sapiens
gaatttcagaggtaacatcatc

SEQ ID NO: 9047348 - DNA, 22 bp, Homo sapiens
atgccactgcactccagcctgg

SEQ ID NO: 9047349 - DNA, 22 bp, Homo sapiens
atgccactgcactccagcctgg

SEQ ID NO: 9047350 - DNA, 22 bp, Homo sapiens
atgccactgcactccagcctgg

SEQ ID NO: 9047351 - DNA, 22 bp, Homo sapiens
atgccactgcactccagcctag

SEQ ID NO: 9047352 - DNA, 22 bp, Homo sapiens
atgccactgcactccagcctag

SEQ ID NO: 9047353 - DNA, 22 bp, Homo sapiens
atgccactgcactccagcctag

SEQ ID NO: 9047354 - DNA, 22 bp, Homo sapiens
gaagtagaaagcctcgtaaata

SEQ ID NO: 9047355 - DNA, 22 bp, Homo sapiens
gaatttcatttgtttcctacca

SEQ ID NO: 9047356 - DNA, 22 bp, Homo sapiens
gaatttcaggacaactggaagg

SEQ ID NO: 9047357 - DNA, 22 bp, Homo sapiens
gaatttcagatcagagaccatt

SEQ ID NO: 9047358 - DNA, 22 bp, Homo sapiens
gaatttcagggtctggtaggaa

SEQ ID NO: 9047359 - DNA, 22 bp, Homo sapiens
gaatttcattgctctgctgtgt

SEQ ID NO: 9047360 - DNA, 22 bp, Homo sapiens
gaaggaggtctgatacaatatg

SEQ ID NO: 9047361 - DNA, 22 bp, Homo sapiens
gaaggaggctccccaaagtctg

SEQ ID NO: 9047362 - DNA, 22 bp, Homo sapiens
atgcagtacagataattctaca

SEQ ID NO: 9047363 - DNA, 22 bp, Homo sapiens
atgcagtaaatgttctagtttg

SEQ ID NO: 9047364 - DNA, 22 bp, Homo sapiens
atgcagtagataggcactttta

SEQ ID NO: 9047365 - DNA, 22 bp, Homo sapiens
atgcagtataaatcatttctgg

SEQ ID NO: 9047366 - DNA, 22 bp, Homo sapiens
gaagcctgtggataggggcatc

SEQ ID NO: 9047367 - DNA, 22 bp, Homo sapiens
gaagccttgaactgcaaacccc

SEQ ID NO: 9047368 - DNA, 22 bp, Homo sapiens
gaagccttgaactgcaaacccc

SEQ ID NO: 9047369 - DNA, 22 bp, Homo sapiens
gaagctaaaccacagctaagaa

SEQ ID NO: 9047370 - DNA, 22 bp, Homo sapiens
gaagctaatgagataaatgcca

SEQ ID NO: 9047371 - DNA, 22 bp, Homo sapiens
gaagccttgaactgcaaacccc

SEQ ID NO: 9047372 - DNA, 22 bp, Homo sapiens
atgagctgggccatccagtgat

SEQ ID NO: 9047373 - DNA, 22 bp, Homo sapiens
gaagagatgacaaaggagcatg

SEQ ID NO: 9047374 - DNA, 22 bp, Homo sapiens
gaagagatgacaaaggagcatg

SEQ ID NO: 9047375 - DNA, 21 bp, Homo sapiens
gagaatagaggggaagctgaa

SEQ ID NO: 9047376 - DNA, 22 bp, Homo sapiens
atggagggtgtcagagagcgaa

SEQ ID NO: 9047377 - DNA, 22 bp, Homo sapiens
atggcagacctcctggccacaa

SEQ ID NO: 9047378 - DNA, 22 bp, Homo sapiens
gagaataaatctaaagtttctt

SEQ ID NO: 9047379 - DNA, 22 bp, Homo sapiens
atgctggtttcatgataacata

SEQ ID NO: 9047380 - DNA, 22 bp, Homo sapiens
atggctcatttatcttgcagcc

SEQ ID NO: 9047381 - DNA, 21 bp, Homo sapiens
atggctcaggccatcaatgga

SEQ ID NO: 9047382 - DNA, 22 bp, Homo sapiens
atggcagacgaggcagcagggg

SEQ ID NO: 9047383 - DNA, 22 bp, Homo sapiens
atggctgcagtccgtgccctgg

SEQ ID NO: 9047384 - DNA, 22 bp, Homo sapiens
atggctgcagccggccctgcgc

SEQ ID NO: 9047385 - DNA, 22 bp, Homo sapiens
atggctgcagagacctgaagaa

SEQ ID NO: 9047386 - DNA, 20 bp, Homo sapiens
gagctgagtgtggtcatggg

SEQ ID NO: 9047387 - DNA, 22 bp, Homo sapiens
gagctgagtgtcctaggcatgg

SEQ ID NO: 9047388 - DNA, 22 bp, Homo sapiens
gagctgcactgggggtggaatg

SEQ ID NO: 9047389 - DNA, 22 bp, Homo sapiens
gagctgagttacctccagatca

SEQ ID NO: 9047390 - DNA, 22 bp, Homo sapiens
gagctgcagcggctgacgcaac

SEQ ID NO: 9047391 - DNA, 22 bp, Homo sapiens
gaggagctgggtcagggagaca

SEQ ID NO: 9047392 - DNA, 22 bp, Homo sapiens
gaggctccctcaactctgggtg

SEQ ID NO: 9047393 - DNA, 23 bp, Homo sapiens
atgtatttaaatttcagtgatga

SEQ ID NO: 9047394 - DNA, 23 bp, Homo sapiens
atgtatttaaatttcagtgatga

SEQ ID NO: 9047395 - DNA, 22 bp, Homo sapiens
atgtatttctatgtagtgaaga

SEQ ID NO: 9047396 - DNA, 22 bp, Homo sapiens
atgtatcagaaatagcattggc

SEQ ID NO: 9047397 - DNA, 22 bp, Homo sapiens
atgtatgagagattcttttatt

SEQ ID NO: 9047398 - DNA, 19 bp, Homo sapiens
atgtcactcatgttccctg

SEQ ID NO: 9047399 - DNA, 22 bp, Homo sapiens
atgtcactccagggacacaggt

SEQ ID NO: 9047400 - DNA, 22 bp, Homo sapiens
atgtcacttttctccctgctgg

SEQ ID NO: 9047401 - DNA, 22 bp, Homo sapiens
atgtcactgtgaggcagctgtc

SEQ ID NO: 9047402 - DNA, 22 bp, Homo sapiens
atgtcagattcctaaatatctt

SEQ ID NO: 9047403 - DNA, 22 bp, Homo sapiens
atgtcacttttgagactaggtt

SEQ ID NO: 9047404 - DNA, 22 bp, Homo sapiens
atgtcagagcttccacaatagt

SEQ ID NO: 9047405 - DNA, 22 bp, Homo sapiens
atgtgccacatgatattgtctc

SEQ ID NO: 9047406 - DNA, 22 bp, Homo sapiens
atgtgcgaggtgcttgtcagca

SEQ ID NO: 9047407 - DNA, 22 bp, Homo sapiens
atgtgctcaccctatttatgga

SEQ ID NO: 9047408 - DNA, 22 bp, Homo sapiens
atgttactgtgatcatgatact

SEQ ID NO: 9047409 - DNA, 22 bp, Homo sapiens
atgttaccatcttttatctaca

SEQ ID NO: 9047410 - DNA, 22 bp, Homo sapiens
atgttacctctattagaatatt

SEQ ID NO: 9047411 - DNA, 22 bp, Homo sapiens
atgttaccttgttctccaaaaa

SEQ ID NO: 9047412 - DNA, 22 bp, Homo sapiens
atgttacttagaataattctgg

SEQ ID NO: 9047413 - DNA, 22 bp, Homo sapiens
atgttagaaggaatgttaaaag

SEQ ID NO: 9047414 - DNA, 23 bp, Homo sapiens
atgttaccaatggaggaaattgg

SEQ ID NO: 9047415 - DNA, 22 bp, Homo sapiens
atgttacagggagagaaggcca

SEQ ID NO: 9047416 - DNA, 22 bp, Homo sapiens
gaggtgtgatgcagagtggtgg

SEQ ID NO: 9047417 - DNA, 22 bp, Homo sapiens
atgttatgacaagcatgacaga

SEQ ID NO: 9047418 - DNA, 22 bp, Homo sapiens
atgttatagttataaaatgagg

SEQ ID NO: 9047419 - DNA, 22 bp, Homo sapiens
atttattacctcggagtttctg

SEQ ID NO: 9047420 - DNA, 22 bp, Homo sapiens
gccatcatatcccctgtgacct

SEQ ID NO: 9047421 - DNA, 22 bp, Homo sapiens
gccatcatatcccctgtgacct

SEQ ID NO: 9047422 - DNA, 22 bp, Homo sapiens
gccaggtggctgagcagctgca

SEQ ID NO: 9047423 - DNA, 22 bp, Homo sapiens
atttatgattagcctattgttg

SEQ ID NO: 9047424 - DNA, 22 bp, Homo sapiens
atttatgagctgaaccatgaaa

SEQ ID NO: 9047425 - DNA, 22 bp, Homo sapiens
atttatgagctgaaccatgaaa

SEQ ID NO: 9047426 - DNA, 22 bp, Homo sapiens
atttatgatagctgcattaaag

SEQ ID NO: 9047427 - DNA, 22 bp, Homo sapiens
atttatgtatctgtgtagatca

SEQ ID NO: 9047428 - DNA, 22 bp, Homo sapiens
atttattaagcatctgctatgt

SEQ ID NO: 9047429 - DNA, 22 bp, Homo sapiens
atttagtttaggaaaagtaggt

SEQ ID NO: 9047430 - DNA, 22 bp, Homo sapiens
atttatgacagaagatatgctg

SEQ ID NO: 9047431 - DNA, 22 bp, Homo sapiens
attgtactacaccatagtactg

SEQ ID NO: 9047432 - DNA, 22 bp, Homo sapiens
atttcttatgaatattgactgt

SEQ ID NO: 9047433 - DNA, 22 bp, Homo sapiens
atttcttaaaacttcagggaga

SEQ ID NO: 9047434 - DNA, 22 bp, Homo sapiens
atttcttatctgaggtctacat

SEQ ID NO: 9047435 - DNA, 22 bp, Homo sapiens
atttcttacataacaaattgtt

SEQ ID NO: 9047436 - DNA, 18 bp, Homo sapiens
gccctggtggagctggtg

SEQ ID NO: 9047437 - DNA, 17 bp, Homo sapiens
atttcccagcagtgcta

SEQ ID NO: 9047438 - DNA, 22 bp, Homo sapiens
atttcaacagagtttgaaggca

SEQ ID NO: 9047439 - DNA, 22 bp, Homo sapiens
atttcaaggactacttttcaat

SEQ ID NO: 9047440 - DNA, 19 bp, Homo sapiens
gcccaggggcccgatgctg

SEQ ID NO: 9047441 - DNA, 22 bp, Homo sapiens
gcccagtctcttctggccctgt

SEQ ID NO: 9047442 - DNA, 22 bp, Homo sapiens
atttattatgggatttggcaca

SEQ ID NO: 9047443 - DNA, 22 bp, Homo sapiens
gccatgcagcttattaaagtgg

SEQ ID NO: 9047444 - DNA, 22 bp, Homo sapiens
caaagaaggaactataatccca

SEQ ID NO: 9047445 - DNA, 22 bp, Homo sapiens
caaagaatgagtgagtacataa

SEQ ID NO: 9047446 - DNA, 22 bp, Homo sapiens
caaagactgcataacacatgaa

SEQ ID NO: 9047447 - DNA, 20 bp, Homo sapiens
caaagacatgctaggggtgg

SEQ ID NO: 9047448 - DNA, 22 bp, Homo sapiens
gctccagggacccaagagaaaa

SEQ ID NO: 9047449 - DNA, 22 bp, Homo sapiens
gctcagagaaaactggggcttg

SEQ ID NO: 9047450 - DNA, 22 bp, Homo sapiens
attttgctggtctgaattactt

SEQ ID NO: 9047451 - DNA, 22 bp, Homo sapiens
attttgcacactatgcagcttt

SEQ ID NO: 9047452 - DNA, 22 bp, Homo sapiens
attttgctacagttggtggaaa

SEQ ID NO: 9047453 - DNA, 22 bp, Homo sapiens
attttgcacactatgcagcttt

SEQ ID NO: 9047454 - DNA, 22 bp, Homo sapiens
attttgataatcatgttagaga

SEQ ID NO: 9047455 - DNA, 22 bp, Homo sapiens
gctcagagagattaaataattt

SEQ ID NO: 9047456 - DNA, 19 bp, Homo sapiens
gctcagagacacctgttgc

SEQ ID NO: 9047457 - DNA, 19 bp, Homo sapiens
gctcagagacacctgttgc

SEQ ID NO: 9047458 - DNA, 20 bp, Homo sapiens
caaaagcaatgaagttatga

SEQ ID NO: 9047459 - DNA, 22 bp, Homo sapiens
caaaagatacttgcatctaact

SEQ ID NO: 9047460 - DNA, 22 bp, Homo sapiens
atttcttcctctgtcagtaact

SEQ ID NO: 9047461 - DNA, 22 bp, Homo sapiens
atttgggagttgctagtgagtt

SEQ ID NO: 9047462 - DNA, 22 bp, Homo sapiens
atttgggaattatttgcctaat

SEQ ID NO: 9047463 - DNA, 22 bp, Homo sapiens
atttgtcaataagatgaacata

SEQ ID NO: 9047464 - DNA, 22 bp, Homo sapiens
atttgtagtgaagtgaaaataa

SEQ ID NO: 9047465 - DNA, 22 bp, Homo sapiens
atttgtatcttctaatattatc

SEQ ID NO: 9047466 - DNA, 22 bp, Homo sapiens
attttcatggcttctgctcagt

SEQ ID NO: 9047467 - DNA, 22 bp, Homo sapiens
attttcatgactaccttaaata

SEQ ID NO: 9047468 - DNA, 22 bp, Homo sapiens
attttcagttgaaaaagttggt

SEQ ID NO: 9047469 - DNA, 22 bp, Homo sapiens
attttcatcatgggtttaacat

SEQ ID NO: 9047470 - DNA, 22 bp, Homo sapiens
attttcatcatgggtttaacat

SEQ ID NO: 9047471 - DNA, 22 bp, Homo sapiens
attccacagctacatcaatcta

SEQ ID NO: 9047472 - DNA, 22 bp, Homo sapiens
attccaattgtacttgctttta

SEQ ID NO: 9047473 - DNA, 22 bp, Homo sapiens
attccacaagaccataaattag

SEQ ID NO: 9047474 - DNA, 22 bp, Homo sapiens
attccacacagtaatactcaat

SEQ ID NO: 9047475 - DNA, 22 bp, Homo sapiens
attcacaaataacaggtgcaga

SEQ ID NO: 9047476 - DNA, 22 bp, Homo sapiens
attcacaagttctagggattag

SEQ ID NO: 9047477 - DNA, 22 bp, Homo sapiens
attcacaactgatccttgctca

SEQ ID NO: 9047478 - DNA, 16 bp, Homo sapiens
attcacaaggcatcgg

SEQ ID NO: 9047479 - DNA, 22 bp, Homo sapiens
attcacaaatgctgccccattc

SEQ ID NO: 9047480 - DNA, 22 bp, Homo sapiens
attcacaaatgctgccccattc

SEQ ID NO: 9047481 - DNA, 22 bp, Homo sapiens
attcacaaatgctgccccattc

SEQ ID NO: 9047482 - DNA, 22 bp, Homo sapiens
attcacaaagtcacccttacac

SEQ ID NO: 9047483 - DNA, 22 bp, Homo sapiens
attcacaaaatgatatagatac

SEQ ID NO: 9047484 - DNA, 20 bp, Homo sapiens
attcacaaagccagtgttgc

SEQ ID NO: 9047485 - DNA, 20 bp, Homo sapiens
attcacaaagccagtgttgc

SEQ ID NO: 9047486 - DNA, 22 bp, Homo sapiens
attcacaaagaagggaagtaca

SEQ ID NO: 9047487 - DNA, 22 bp, Homo sapiens
attcaatgggggtttctagttg

SEQ ID NO: 9047488 - DNA, 22 bp, Homo sapiens
attcacaaaatgatatagatac

SEQ ID NO: 9047489 - DNA, 22 bp, Homo sapiens
attcatttgctattgtgtatgg

SEQ ID NO: 9047490 - DNA, 22 bp, Homo sapiens
attcacaacaaaaggatatgag

SEQ ID NO: 9047491 - DNA, 22 bp, Homo sapiens
attcacaagttgatggatattt

SEQ ID NO: 9047492 - DNA, 22 bp, Homo sapiens
gcaggcaggagcccaactgcct

SEQ ID NO: 9047493 - DNA, 19 bp, Homo sapiens
gcaggcagctggggtatcc

SEQ ID NO: 9047494 - DNA, 22 bp, Homo sapiens
gcaggcaggaaggactaagtaa

SEQ ID NO: 9047495 - DNA, 22 bp, Homo sapiens
gcaggcaggcttccttgaactg

SEQ ID NO: 9047496 - DNA, 22 bp, Homo sapiens
gcaggcaaggaacagagactgt

SEQ ID NO: 9047497 - DNA, 22 bp, Homo sapiens
attctcataggagcgtgaacct

SEQ ID NO: 9047498 - DNA, 22 bp, Homo sapiens
attctcatttgctggctatatg

SEQ ID NO: 9047499 - DNA, 22 bp, Homo sapiens
attctttccagacactgattgc

SEQ ID NO: 9047500 - DNA, 22 bp, Homo sapiens
attcttttcccaactgctttaa

SEQ ID NO: 9047501 - DNA, 22 bp, Homo sapiens
attctgatgcttcacaaaggta

SEQ ID NO: 9047502 - DNA, 15 bp, Homo sapiens
gcaggcaggtcacct

SEQ ID NO: 9047503 - DNA, 20 bp, Homo sapiens
gcaggcagggaatgggggtg

SEQ ID NO: 9047504 - DNA, 22 bp, Homo sapiens
attgcactccagcctgggtgac

SEQ ID NO: 9047505 - DNA, 22 bp, Homo sapiens
attgcacagctgaatattttgg

SEQ ID NO: 9047506 - DNA, 22 bp, Homo sapiens
attgcacaaagagggaaactga

SEQ ID NO: 9047507 - DNA, 22 bp, Homo sapiens
attgcactccagcctgggggac

SEQ ID NO: 9047508 - DNA, 22 bp, Homo sapiens
attgcaccttgggttttgaaag

SEQ ID NO: 9047509 - DNA, 22 bp, Homo sapiens
gcagtaaagcctgagatatatg

SEQ ID NO: 9047510 - DNA, 22 bp, Homo sapiens
gcaggtgtgggtggctgccagg

SEQ ID NO: 9047511 - DNA, 22 bp, Homo sapiens
atgttatttcaaaattcccttg

SEQ ID NO: 9047512 - DNA, 22 bp, Homo sapiens
atgttattgatgcctgaggctt

SEQ ID NO: 9047513 - DNA, 22 bp, Homo sapiens
atgttatttattatcctcggtt

SEQ ID NO: 9047514 - DNA, 22 bp, Homo sapiens
atgttatttattgaaacacttt

SEQ ID NO: 9047515 - DNA, 22 bp, Homo sapiens
gatggcaggtagtggtctcatc

SEQ ID NO: 9047516 - DNA, 21 bp, Homo sapiens
atgttattctgttcctccagc

SEQ ID NO: 9047517 - DNA, 22 bp, Homo sapiens
atgttattcaatttgaatccaa

SEQ ID NO: 9047518 - DNA, 23 bp, Homo sapiens
atgttattattagcagtcttgcc

SEQ ID NO: 9047519 - DNA, 22 bp, Homo sapiens
atgttatgtgcaagatacataa

SEQ ID NO: 9047520 - DNA, 22 bp, Homo sapiens
atgttattaaagtacagattct

SEQ ID NO: 9047521 - DNA, 22 bp, Homo sapiens
atgttatgtctgggaaggggta

SEQ ID NO: 9047522 - DNA, 22 bp, Homo sapiens
gagtggggcgaagtcggcgagt

SEQ ID NO: 9047523 - DNA, 20 bp, Homo sapiens
gagtgggccatggagtgaga

SEQ ID NO: 9047524 - DNA, 22 bp, Homo sapiens
gagtggggcccactgctgggtg

SEQ ID NO: 9047525 - DNA, 23 bp, Homo sapiens
gagtggggagaaattggttaaac

SEQ ID NO: 9047526 - DNA, 22 bp, Homo sapiens
gagtgggcttggggagagtttg

SEQ ID NO: 9047527 - DNA, 22 bp, Homo sapiens
gatgtgagtggtagctgggatt

SEQ ID NO: 9047528 - DNA, 22 bp, Homo sapiens
gatgtgaggtggtaaacaggga

SEQ ID NO: 9047529 - DNA, 22 bp, Homo sapiens
gatgtctttgctgttatccact

SEQ ID NO: 9047530 - DNA, 22 bp, Homo sapiens
gatgtctttctgtgtgcctaga

SEQ ID NO: 9047531 - DNA, 22 bp, Homo sapiens
gatgtctttgaggctcactgct

SEQ ID NO: 9047532 - DNA, 22 bp, Homo sapiens
gatgtctttctaatactggctt

SEQ ID NO: 9047533 - DNA, 20 bp, Homo sapiens
gatgtcttggtcacagtggc

SEQ ID NO: 9047534 - DNA, 22 bp, Homo sapiens
attaacatgagttggagatagg

SEQ ID NO: 9047535 - DNA, 22 bp, Homo sapiens
attaacatgcagccagacacac

SEQ ID NO: 9047536 - DNA, 19 bp, Homo sapiens
attaacatcagtgttggcc

SEQ ID NO: 9047537 - DNA, 22 bp, Homo sapiens
attatccagcaccaatgtcaga

SEQ ID NO: 9047538 - DNA, 22 bp, Homo sapiens
attatcacatggactttgcttt

SEQ ID NO: 9047539 - DNA, 22 bp, Homo sapiens
attatatgtgggatagaattta

SEQ ID NO: 9047540 - DNA, 22 bp, Homo sapiens
attatataggacttgcccttcc

SEQ ID NO: 9047541 - DNA, 22 bp, Homo sapiens
attatataggacttgcccttcc

SEQ ID NO: 9047542 - DNA, 22 bp, Homo sapiens
gcacacagctagattaccattc

SEQ ID NO: 9047543 - DNA, 22 bp, Homo sapiens
gcacacaggcagtttccagcca

SEQ ID NO: 9047544 - DNA, 22 bp, Homo sapiens
gcagagacagactaatgaaaag

SEQ ID NO: 9047545 - DNA, 22 bp, Homo sapiens
attcaagtccagcttctctaca

SEQ ID NO: 9047546 - DNA, 22 bp, Homo sapiens
attcaagtacagttttcttctt

SEQ ID NO: 9047547 - DNA, 22 bp, Homo sapiens
attatctaggaattgacagaag

SEQ ID NO: 9047548 - DNA, 22 bp, Homo sapiens
gcaccatgacagtgaggagaac

SEQ ID NO: 9047549 - DNA, 22 bp, Homo sapiens
aaaaacctttcccatactaaga

SEQ ID NO: 9047550 - DNA, 22 bp, Homo sapiens
aaaatagttaacgttcagagta

SEQ ID NO: 9047551 - DNA, 22 bp, Homo sapiens
aaaaacagaatgtgtctaactc

SEQ ID NO: 9047552 - DNA, 22 bp, Homo sapiens
aaaaaatcagatctttggttaa

SEQ ID NO: 9047553 - DNA, 22 bp, Homo sapiens
aaaaaagattgatggtggatgc

SEQ ID NO: 9047554 - DNA, 22 bp, Homo sapiens
aaaaatctatgactgcttctcc

SEQ ID NO: 9047555 - DNA, 22 bp, Homo sapiens
aaaaatcacttttataggcagc

SEQ ID NO: 9047556 - DNA, 22 bp, Homo sapiens
aaaaatcacttttataggcagc

SEQ ID NO: 9047557 - DNA, 22 bp, Homo sapiens
aaaatgaataagttaacccagg

SEQ ID NO: 9047558 - DNA, 22 bp, Homo sapiens
aaaaatacttcacttctgggtg

SEQ ID NO: 9047559 - DNA, 22 bp, Homo sapiens
aaaagacatctatttcaggcag

SEQ ID NO: 9047560 - DNA, 22 bp, Homo sapiens
aaaagagaaagtggcaggcttt

SEQ ID NO: 9047561 - DNA, 22 bp, Homo sapiens
aaacagagggccactgaggctc

SEQ ID NO: 9047562 - DNA, 22 bp, Homo sapiens
aaacagactgaagagttgaagc

SEQ ID NO: 9047563 - DNA, 22 bp, Homo sapiens
aaacacttcctgtaacatgaca

SEQ ID NO: 9047564 - DNA, 22 bp, Homo sapiens
aaacagaaatttcctcatgctc

SEQ ID NO: 9047565 - DNA, 22 bp, Homo sapiens
aaaatctaagtagcgagtaagg

SEQ ID NO: 9047566 - DNA, 22 bp, Homo sapiens
aaaatctaagtagcgagtaagg

SEQ ID NO: 9047567 - DNA, 22 bp, Homo sapiens
aaaattttgccctatccttcat

SEQ ID NO: 9047568 - DNA, 22 bp, Homo sapiens
aaaatctgcacaggtcagtttt

SEQ ID NO: 9047569 - DNA, 22 bp, Homo sapiens
aaacaagcaagcacataatttt

SEQ ID NO: 9047570 - DNA, 22 bp, Homo sapiens
aaacaagcaagcacataatttt

SEQ ID NO: 9047571 - DNA, 22 bp, Homo sapiens
aaacaaggtacacagtaatggt

SEQ ID NO: 9047572 - DNA, 22 bp, Homo sapiens
aaacaaggtccttctgtgacat

SEQ ID NO: 9047573 - DNA, 22 bp, Homo sapiens
aaacaatgaaattcattcttca

SEQ ID NO: 9047574 - DNA, 22 bp, Homo sapiens
aaacaatgaaatatttttatgg

SEQ ID NO: 9047575 - DNA, 21 bp, Homo sapiens
aaaatcaccttaggtcactgg

SEQ ID NO: 9047576 - DNA, 22 bp, Homo sapiens
aaaatcagtacactttattttg

SEQ ID NO: 9047577 - DNA, 22 bp, Homo sapiens
aaaatccacaacgctcatttca

SEQ ID NO: 9047578 - DNA, 22 bp, Homo sapiens
aaagacattagcttagatgtca

SEQ ID NO: 9047579 - DNA, 23 bp, Homo sapiens
aaagacctaggatgagggagacg

SEQ ID NO: 9047580 - DNA, 22 bp, Homo sapiens
aaagacctgaaatataatctag

SEQ ID NO: 9047581 - DNA, 22 bp, Homo sapiens
aaagactaaacaaccaatatct

SEQ ID NO: 9047582 - DNA, 22 bp, Homo sapiens
aaagacctgtggtagctctaaa

SEQ ID NO: 9047583 - DNA, 22 bp, Homo sapiens
aaaagagagctgaggagctcca

SEQ ID NO: 9047584 - DNA, 22 bp, Homo sapiens
aaaagagaatcctgtacagaga

SEQ ID NO: 9047585 - DNA, 22 bp, Homo sapiens
aaaagagagttgccagtctgta

SEQ ID NO: 9047586 - DNA, 22 bp, Homo sapiens
aaactcaaggatttagacgaag

SEQ ID NO: 9047587 - DNA, 22 bp, Homo sapiens
aaagacatggaactagagatgg

SEQ ID NO: 9047588 - DNA, 22 bp, Homo sapiens
aaagaaggggtctacatccaat

SEQ ID NO: 9047589 - DNA, 22 bp, Homo sapiens
aaaagtactattttaacaaagt

SEQ ID NO: 9047590 - DNA, 22 bp, Homo sapiens
aaactctaatcaaatatagcat

SEQ ID NO: 9047591 - DNA, 22 bp, Homo sapiens
aaacagctgtcattgttttaaa

SEQ ID NO: 9047592 - DNA, 22 bp, Homo sapiens
aaacagctgtcattgttttaaa

SEQ ID NO: 9047593 - DNA, 22 bp, Homo sapiens
aaacaatgttcctatattagag

SEQ ID NO: 9047594 - DNA, 22 bp, Homo sapiens
aaacaatgtctaaggtgcacag

SEQ ID NO: 9047595 - DNA, 23 bp, Homo sapiens
aaacaatgtcatcaggacttggt

SEQ ID NO: 9047596 - DNA, 22 bp, Homo sapiens
aaacaatgttgctgggtgcggt

SEQ ID NO: 9047597 - DNA, 22 bp, Homo sapiens
aaacaatgttgtctccaagagg

SEQ ID NO: 9047598 - DNA, 22 bp, Homo sapiens
aaacaatgtagattaccattta

SEQ ID NO: 9047599 - DNA, 22 bp, Homo sapiens
aaacaatgtacatttataatgc

SEQ ID NO: 9047600 - DNA, 22 bp, Homo sapiens
aaacaatgtacacatgaatgtt

SEQ ID NO: 9047601 - DNA, 17 bp, Homo sapiens
aaacaatgcagacaagc

SEQ ID NO: 9047602 - DNA, 22 bp, Homo sapiens
aaacaatgagcttttacacact

SEQ ID NO: 9047603 - DNA, 22 bp, Homo sapiens
aaacaatgacaacacagctgcg

SEQ ID NO: 9047604 - DNA, 22 bp, Homo sapiens
aaaggtatgatactgtgacatg

SEQ ID NO: 9047605 - DNA, 22 bp, Homo sapiens
aaaggtagtacttctagaaggg

SEQ ID NO: 9047606 - DNA, 22 bp, Homo sapiens
aaaggtaaagtatctgcccaag

SEQ ID NO: 9047607 - DNA, 22 bp, Homo sapiens
aaaggtaactggggttttgcca

SEQ ID NO: 9047608 - DNA, 22 bp, Homo sapiens
aaagttcagtgccttctataca

SEQ ID NO: 9047609 - DNA, 22 bp, Homo sapiens
aaactctagggctccacattcc

SEQ ID NO: 9047610 - DNA, 22 bp, Homo sapiens
aaactctagtaaaatgtattca

SEQ ID NO: 9047611 - DNA, 22 bp, Homo sapiens
aaactctagttatgaagtttgt

SEQ ID NO: 9047612 - DNA, 22 bp, Homo sapiens
aaactctagttatgaagtttgt

SEQ ID NO: 9047613 - DNA, 22 bp, Homo sapiens
aaactctagtaaaatgtattca

SEQ ID NO: 9047614 - DNA, 22 bp, Homo sapiens
aaactctcttttcttcagtagg

SEQ ID NO: 9047615 - DNA, 22 bp, Homo sapiens
aaaccttaaaccaagctcttga

SEQ ID NO: 9047616 - DNA, 22 bp, Homo sapiens
aaacctttaccagactagcaag

SEQ ID NO: 9047617 - DNA, 22 bp, Homo sapiens
aaatgcagcctagctcagtttt

SEQ ID NO: 9047618 - DNA, 22 bp, Homo sapiens
aaatgcagcagctaattgaaaa

SEQ ID NO: 9047619 - DNA, 22 bp, Homo sapiens
aaatgcagacagcttcacacac

SEQ ID NO: 9047620 - DNA, 22 bp, Homo sapiens
aaatgcagatccctgaatctca

SEQ ID NO: 9047621 - DNA, 22 bp, Homo sapiens
aaatgcagattcctaggcccca

SEQ ID NO: 9047622 - DNA, 22 bp, Homo sapiens
aaatgcagattcatgagcccca

SEQ ID NO: 9047623 - DNA, 22 bp, Homo sapiens
aaatgcagattttgatgcagca

SEQ ID NO: 9047624 - DNA, 22 bp, Homo sapiens
aaatgcagattgtcattcagga

SEQ ID NO: 9047625 - DNA, 22 bp, Homo sapiens
aaatgcagattcttaggcccca

SEQ ID NO: 9047626 - DNA, 22 bp, Homo sapiens
aaatgcagaatctcagacccca

SEQ ID NO: 9047627 - DNA, 22 bp, Homo sapiens
aaatgcagaatgatttcatcta

SEQ ID NO: 9047628 - DNA, 22 bp, Homo sapiens
aaattacagatcaccaatgcat

SEQ ID NO: 9047629 - DNA, 20 bp, Homo sapiens
aaattactgccacacatttc

SEQ ID NO: 9047630 - DNA, 22 bp, Homo sapiens
aaattagaaatactttcaaagc

SEQ ID NO: 9047631 - DNA, 22 bp, Homo sapiens
aaagagttctgtttgagctgaa

SEQ ID NO: 9047632 - DNA, 22 bp, Homo sapiens
aaagagttgttgtataacagga

SEQ ID NO: 9047633 - DNA, 22 bp, Homo sapiens
aaagaagtgttgaatttgcaag

SEQ ID NO: 9047634 - DNA, 22 bp, Homo sapiens
aaagaataccctgggtcataaa

SEQ ID NO: 9047635 - DNA, 21 bp, Homo sapiens
aaactgaggcttcaagcagtg

SEQ ID NO: 9047636 - DNA, 22 bp, Homo sapiens
aaagaacatcggagtgggcggg

SEQ ID NO: 9047637 - DNA, 22 bp, Homo sapiens
aaagaatactccttttgccttg

SEQ ID NO: 9047638 - DNA, 22 bp, Homo sapiens
aaagaatcagaagtctcaaaca

SEQ ID NO: 9047639 - DNA, 21 bp, Homo sapiens
aaagaatcatgggtaatttca

SEQ ID NO: 9047640 - DNA, 22 bp, Homo sapiens
aaagaatcgtgtgtagtttgaa

SEQ ID NO: 9047641 - DNA, 22 bp, Homo sapiens
aaactctgtagctaaacataat

SEQ ID NO: 9047642 - DNA, 22 bp, Homo sapiens
aaactcttttgcatattagagg

SEQ ID NO: 9047643 - DNA, 22 bp, Homo sapiens
aaactctttccacgattacttt

SEQ ID NO: 9047644 - DNA, 22 bp, Homo sapiens
aaataagttaaactagaatgat

SEQ ID NO: 9047645 - DNA, 22 bp, Homo sapiens
aaataacttggtttcatcagag

SEQ ID NO: 9047646 - DNA, 22 bp, Homo sapiens
aaagtgttatgcaaaactctgt

SEQ ID NO: 9047647 - DNA, 22 bp, Homo sapiens
aaagtgttgaagaaaatgttca

SEQ ID NO: 9047648 - DNA, 22 bp, Homo sapiens
aaagtgttatgagaactaagtg

SEQ ID NO: 9047649 - DNA, 22 bp, Homo sapiens
aaataacagtcagggacaacat

SEQ ID NO: 9047650 - DNA, 23 bp, Homo sapiens
aaatagctccgtggcacactctc

SEQ ID NO: 9047651 - DNA, 22 bp, Homo sapiens
aaatagctacatgatctctagg

SEQ ID NO: 9047652 - DNA, 22 bp, Homo sapiens
aaatcagatcttacacaattgt

SEQ ID NO: 9047653 - DNA, 22 bp, Homo sapiens
aaatccatcaaatcttctagaa

SEQ ID NO: 9047654 - DNA, 22 bp, Homo sapiens
aaatccattctgttttaaaagt

SEQ ID NO: 9047655 - DNA, 22 bp, Homo sapiens
aaatagaattggaagcagagtt

SEQ ID NO: 9047656 - DNA, 22 bp, Homo sapiens
aagcatcaacactatattgatg

SEQ ID NO: 9047657 - DNA, 22 bp, Homo sapiens
aaatgcatcagctcataagaga

SEQ ID NO: 9047658 - DNA, 22 bp, Homo sapiens
aaatgcagtttcctgagaccca

SEQ ID NO: 9047659 - DNA, 20 bp, Homo sapiens
aaatgcagttctgccttggc

SEQ ID NO: 9047660 - DNA, 22 bp, Homo sapiens
aaatgcagttggtggggatatg

SEQ ID NO: 9047661 - DNA, 23 bp, Homo sapiens
aaatgcagggtcgcaggttacag

SEQ ID NO: 9047662 - DNA, 21 bp, Homo sapiens
aaatgcaggctctttgttttc

SEQ ID NO: 9047663 - DNA, 22 bp, Homo sapiens
aaatgcaggtagtatttatttt

SEQ ID NO: 9047664 - DNA, 22 bp, Homo sapiens
aaatgcagtggttctacttctc

SEQ ID NO: 9047665 - DNA, 20 bp, Homo sapiens
aaatgcagggctgctgcgga

SEQ ID NO: 9047666 - DNA, 22 bp, Homo sapiens
aaatgcaggttcttgagccaag

SEQ ID NO: 9047667 - DNA, 21 bp, Homo sapiens
aaatgcagtctctgagatctg

SEQ ID NO: 9047668 - DNA, 22 bp, Homo sapiens
aaatgcaggttcttgagccaag

SEQ ID NO: 9047669 - DNA, 22 bp, Homo sapiens
aaatgcaggattaacagctttg

SEQ ID NO: 9047670 - DNA, 22 bp, Homo sapiens
aaatgcagctgggcatgagagg

SEQ ID NO: 9047671 - DNA, 22 bp, Homo sapiens
aaatgcaggaaattatgctttt

SEQ ID NO: 9047672 - DNA, 22 bp, Homo sapiens
aaatcctaatgacaagtttagt

SEQ ID NO: 9047673 - DNA, 22 bp, Homo sapiens
aaatcctaataatgcactagtg

SEQ ID NO: 9047674 - DNA, 22 bp, Homo sapiens
aaatccttgatagtttgcccta

SEQ ID NO: 9047675 - DNA, 22 bp, Homo sapiens
aaatccttttctatacagcata

SEQ ID NO: 9047676 - DNA, 22 bp, Homo sapiens
aagctcttgagtaaactagttt

SEQ ID NO: 9047677 - DNA, 22 bp, Homo sapiens
aagcatgcaatctgtgataagg

SEQ ID NO: 9047678 - DNA, 19 bp, Homo sapiens
aagcatctttgaaactggg

SEQ ID NO: 9047679 - DNA, 22 bp, Homo sapiens
aagcatcttaaaaagtatcaga

SEQ ID NO: 9047680 - DNA, 22 bp, Homo sapiens
aaatgtacactttgcatcttga

SEQ ID NO: 9047681 - DNA, 22 bp, Homo sapiens
aaatgtacaacatccatatata

SEQ ID NO: 9047682 - DNA, 20 bp, Homo sapiens
aagcatggtcaaaacttatg

SEQ ID NO: 9047683 - DNA, 22 bp, Homo sapiens
aagcatgggaggcctggaggag

SEQ ID NO: 9047684 - DNA, 20 bp, Homo sapiens
aagcatggtcaaaacttatg

SEQ ID NO: 9047685 - DNA, 22 bp, Homo sapiens
aagcatggagcaatagaatgac

SEQ ID NO: 9047686 - DNA, 22 bp, Homo sapiens
aagcatggcctctccgctcccc

SEQ ID NO: 9047687 - DNA, 22 bp, Homo sapiens
aagcatggctgttctagctata

SEQ ID NO: 9047688 - DNA, 22 bp, Homo sapiens
aagcatgggaatcccacagggt

SEQ ID NO: 9047689 - DNA, 22 bp, Homo sapiens
aaagccttttctgtttaacaca

SEQ ID NO: 9047690 - DNA, 22 bp, Homo sapiens
aacagcaatagcactattcatt

SEQ ID NO: 9047691 - DNA, 22 bp, Homo sapiens
aacagcaatagcactattcatt

SEQ ID NO: 9047692 - DNA, 22 bp, Homo sapiens
aacagcaatagcactattcatt

SEQ ID NO: 9047693 - DNA, 19 bp, Homo sapiens
aacagcaacttcctagtca

SEQ ID NO: 9047694 - DNA, 22 bp, Homo sapiens
aacagcaagggcggggtcaaga

SEQ ID NO: 9047695 - DNA, 22 bp, Homo sapiens
aacagatttgtgaagctactca

SEQ ID NO: 9047696 - DNA, 22 bp, Homo sapiens
aaagctcttttccaagtattga

SEQ ID NO: 9047697 - DNA, 22 bp, Homo sapiens
aaagctgccctacacggaagca

SEQ ID NO: 9047698 - DNA, 22 bp, Homo sapiens
aaagctgcccagctgcctgttt

SEQ ID NO: 9047699 - DNA, 22 bp, Homo sapiens
aaagctgcaagctcctgaggaa

SEQ ID NO: 9047700 - DNA, 22 bp, Homo sapiens
aaagctgccaaggagaatacta

SEQ ID NO: 9047701 - DNA, 22 bp, Homo sapiens
aaagctgcccttgtgaaacaag

SEQ ID NO: 9047702 - DNA, 22 bp, Homo sapiens
aaagctgctatgaacattctat

SEQ ID NO: 9047703 - DNA, 22 bp, Homo sapiens
aaagctgctatgaacattctat

SEQ ID NO: 9047704 - DNA, 22 bp, Homo sapiens
aaagctgctgtgaatggtttgg

SEQ ID NO: 9047705 - DNA, 22 bp, Homo sapiens
aaagctgctgccaatcaggctt

SEQ ID NO: 9047706 - DNA, 22 bp, Homo sapiens
aaagctgctttggtttctggaa

SEQ ID NO: 9047707 - DNA, 22 bp, Homo sapiens
aaagctgctttaaacatctatg

SEQ ID NO: 9047708 - DNA, 22 bp, Homo sapiens
aaagctgctttaaacatctatg

SEQ ID NO: 9047709 - DNA, 22 bp, Homo sapiens
aaagctttgctggaaggaagag

SEQ ID NO: 9047710 - DNA, 22 bp, Homo sapiens
aaagcttctattcacttacttg

SEQ ID NO: 9047711 - DNA, 22 bp, Homo sapiens
aaagcttagcattttcaaaatg

SEQ ID NO: 9047712 - DNA, 22 bp, Homo sapiens
aaagctgtaatgcatgctttct

SEQ ID NO: 9047713 - DNA, 18 bp, Homo sapiens
aaagctgttattccagaa

SEQ ID NO: 9047714 - DNA, 22 bp, Homo sapiens
aaagctgtcaaggcaggaggct

SEQ ID NO: 9047715 - DNA, 22 bp, Homo sapiens
aaagctgtagaatcatcttaat

SEQ ID NO: 9047716 - DNA, 22 bp, Homo sapiens
aaagctgttaaatgcataatgc

SEQ ID NO: 9047717 - DNA, 22 bp, Homo sapiens
aaagctgttgtatggcccttgg

SEQ ID NO: 9047718 - DNA, 22 bp, Homo sapiens
aacaaacaaacattttgtcatc

SEQ ID NO: 9047719 - DNA, 22 bp, Homo sapiens
aaattttgtattctagttctag

SEQ ID NO: 9047720 - DNA, 22 bp, Homo sapiens
aacaaaacatttgtcttgtttc

SEQ ID NO: 9047721 - DNA, 22 bp, Homo sapiens
aaagagtttggagacaagatca

SEQ ID NO: 9047722 - DNA, 22 bp, Homo sapiens
aaagagtttggagacaagatca

SEQ ID NO: 9047723 - DNA, 22 bp, Homo sapiens
aaagataatgtttccttattct

SEQ ID NO: 9047724 - DNA, 22 bp, Homo sapiens
aacaaacaaacattttgtcatc

SEQ ID NO: 9047725 - DNA, 22 bp, Homo sapiens
aaagagtttccattgacatttc

SEQ ID NO: 9047726 - DNA, 22 bp, Homo sapiens
aaagatcaatagataaagctac

SEQ ID NO: 9047727 - DNA, 22 bp, Homo sapiens
aaagccacagttctatgtctgc

SEQ ID NO: 9047728 - DNA, 22 bp, Homo sapiens
aaagccatcagtaaaatgattt

SEQ ID NO: 9047729 - DNA, 22 bp, Homo sapiens
aaagcttttcagtatgttcatg

SEQ ID NO: 9047730 - DNA, 22 bp, Homo sapiens
aaagcttttgttttcgtaactg

SEQ ID NO: 9047731 - DNA, 22 bp, Homo sapiens
aaagcttttgttttcgtaactg

SEQ ID NO: 9047732 - DNA, 22 bp, Homo sapiens
aaagcttttcagtatgttcatg

SEQ ID NO: 9047733 - DNA, 22 bp, Homo sapiens
aaagctttgtaaataaacaggt

SEQ ID NO: 9047734 - DNA, 22 bp, Homo sapiens
aaaggtttgcatggaatttacc

SEQ ID NO: 9047735 - DNA, 22 bp, Homo sapiens
aactaaaactggtttgttctct

SEQ ID NO: 9047736 - DNA, 22 bp, Homo sapiens
aactaacagtcattaaaagaac

SEQ ID NO: 9047737 - DNA, 22 bp, Homo sapiens
aaagtacaaatgttctagccat

SEQ ID NO: 9047738 - DNA, 22 bp, Homo sapiens
aaagtacatgtttggccatttg

SEQ ID NO: 9047739 - DNA, 22 bp, Homo sapiens
aaagtgggaacaatggagagtg

SEQ ID NO: 9047740 - DNA, 21 bp, Homo sapiens
aaagtggtaaggattattttg

SEQ ID NO: 9047741 - DNA, 22 bp, Homo sapiens
aaagtggggtctagagggcctg

SEQ ID NO: 9047742 - DNA, 22 bp, Homo sapiens
aaagtggtcaccttctcatttc

SEQ ID NO: 9047743 - DNA, 22 bp, Homo sapiens
aaagtggtctgcatcccttctg

SEQ ID NO: 9047744 - DNA, 22 bp, Homo sapiens
aaagtggtgggcgaactcatca

SEQ ID NO: 9047745 - DNA, 22 bp, Homo sapiens
aaagtggttcttacatccgtgg

SEQ ID NO: 9047746 - DNA, 22 bp, Homo sapiens
aaagtggttgctgtcagcctct

SEQ ID NO: 9047747 - DNA, 22 bp, Homo sapiens
aaagtggtttatgatattccaa

SEQ ID NO: 9047748 - DNA, 22 bp, Homo sapiens
aaagtggtttcccagttcagta

SEQ ID NO: 9047749 - DNA, 22 bp, Homo sapiens
aaagtggtttttcagactttga

SEQ ID NO: 9047750 - DNA, 22 bp, Homo sapiens
aaagtggccatcctctgcatcg

SEQ ID NO: 9047751 - DNA, 22 bp, Homo sapiens
aaagtcacatagcatcacttct

SEQ ID NO: 9047752 - DNA, 22 bp, Homo sapiens
aaagtcacaatattggaaggtg

SEQ ID NO: 9047753 - DNA, 22 bp, Homo sapiens
aaagtcaatgatttctcctgga

SEQ ID NO: 9047754 - DNA, 22 bp, Homo sapiens
aaagtcacagtttaggggatat

SEQ ID NO: 9047755 - DNA, 22 bp, Homo sapiens
aaagtatatttacttactgtga

SEQ ID NO: 9047756 - DNA, 22 bp, Homo sapiens
aaagtcaaaatgctctcctgtc

SEQ ID NO: 9047757 - DNA, 22 bp, Homo sapiens
aacaaagatgggtgggaaagag

SEQ ID NO: 9047758 - DNA, 22 bp, Homo sapiens
aacaaagaagactggttatttt

SEQ ID NO: 9047759 - DNA, 22 bp, Homo sapiens
aacaaagatgggtgggaaagag

SEQ ID NO: 9047760 - DNA, 22 bp, Homo sapiens
aacaaagatgggtgggaaagag

SEQ ID NO: 9047761 - DNA, 22 bp, Homo sapiens
aacaaagtagctgctgttctta

SEQ ID NO: 9047762 - DNA, 22 bp, Homo sapiens
aacaaaggccgttaataaccac

SEQ ID NO: 9047763 - DNA, 22 bp, Homo sapiens
aaattgcattgagctgcttatt

SEQ ID NO: 9047764 - DNA, 22 bp, Homo sapiens
aaattgaatttgggaaacattg

SEQ ID NO: 9047765 - DNA, 22 bp, Homo sapiens
aaattgcagatgctaaatgact

SEQ ID NO: 9047766 - DNA, 22 bp, Homo sapiens
aaattgcacaatatagacatga

SEQ ID NO: 9047767 - DNA, 22 bp, Homo sapiens
aaattcctctgatcataagaat

SEQ ID NO: 9047768 - DNA, 22 bp, Homo sapiens
aaatgttttgctcccatgtggt

SEQ ID NO: 9047769 - DNA, 22 bp, Homo sapiens
aaatgtgcttgtgatcagctgt

SEQ ID NO: 9047770 - DNA, 22 bp, Homo sapiens
aaatgtgcttgtgatcagctgt

SEQ ID NO: 9047771 - DNA, 22 bp, Homo sapiens
aaatgtggggctggaggcagga

SEQ ID NO: 9047772 - DNA, 22 bp, Homo sapiens
aaatgtgatactgttcttttta

SEQ ID NO: 9047773 - DNA, 19 bp, Homo sapiens
aaatgtgcactgttttcca

SEQ ID NO: 9047774 - DNA, 22 bp, Homo sapiens
aaatgtgctcatttataaaagt

SEQ ID NO: 9047775 - DNA, 22 bp, Homo sapiens
aagctgaggcccatggcaaggt

SEQ ID NO: 9047776 - DNA, 22 bp, Homo sapiens
aacagcctcagtgagattagga

SEQ ID NO: 9047777 - DNA, 22 bp, Homo sapiens
aagtccaaggtcaccattcaca

SEQ ID NO: 9047778 - DNA, 22 bp, Homo sapiens
aacagcagctttcaggatcatc

SEQ ID NO: 9047779 - DNA, 22 bp, Homo sapiens
aacagcagttacttttgcatca

SEQ ID NO: 9047780 - DNA, 22 bp, Homo sapiens
aacagcataagtatttatttca

SEQ ID NO: 9047781 - DNA, 22 bp, Homo sapiens
aacactaatgggagaacaaccc

SEQ ID NO: 9047782 - DNA, 22 bp, Homo sapiens
aacactgaaacattgattgaca

SEQ ID NO: 9047783 - DNA, 22 bp, Homo sapiens
aacactctctgttggtaaggct

SEQ ID NO: 9047784 - DNA, 22 bp, Homo sapiens
aacaaatgataccagttctcaa

SEQ ID NO: 9047785 - DNA, 22 bp, Homo sapiens
aacaaagtttcaggaagataga

SEQ ID NO: 9047786 - DNA, 22 bp, Homo sapiens
aacaaagtttcaggaagataga

SEQ ID NO: 9047787 - DNA, 22 bp, Homo sapiens
aacaaagtgtacttccatactg

SEQ ID NO: 9047788 - DNA, 22 bp, Homo sapiens
aaggtattattgtctatgtact

SEQ ID NO: 9047789 - DNA, 22 bp, Homo sapiens
aaggtattatttgcaatcattt

SEQ ID NO: 9047790 - DNA, 22 bp, Homo sapiens
aaggtattttctaatgtatact

SEQ ID NO: 9047791 - DNA, 22 bp, Homo sapiens
aacactgaaatgtcttaagatt

SEQ ID NO: 9047792 - DNA, 22 bp, Homo sapiens
aacactgaaatgtcttaagatt

SEQ ID NO: 9047793 - DNA, 22 bp, Homo sapiens
aacactgaagaccaggtaattt

SEQ ID NO: 9047794 - DNA, 22 bp, Homo sapiens
aacactgaagaccaggtaattt

SEQ ID NO: 9047795 - DNA, 22 bp, Homo sapiens
aacactgacctctaccctcagt

SEQ ID NO: 9047796 - DNA, 22 bp, Homo sapiens
aacactgaagtagtgaatactg

SEQ ID NO: 9047797 - DNA, 22 bp, Homo sapiens
aacactgacgacgtgaactaaa

SEQ ID NO: 9047798 - DNA, 22 bp, Homo sapiens
aacactgacgacgtgaactaaa

SEQ ID NO: 9047799 - DNA, 22 bp, Homo sapiens
aacactgagaacaatacagagt

SEQ ID NO: 9047800 - DNA, 22 bp, Homo sapiens
aacactgagaacaatacagagt

SEQ ID NO: 9047801 - DNA, 22 bp, Homo sapiens
aacactgagaacaatacagagt

SEQ ID NO: 9047802 - DNA, 22 bp, Homo sapiens
aacactgagctattacggtgga

SEQ ID NO: 9047803 - DNA, 22 bp, Homo sapiens
aacactgagaggggagtggcac

SEQ ID NO: 9047804 - DNA, 22 bp, Homo sapiens
aacactgagaactgttggtggt

SEQ ID NO: 9047805 - DNA, 22 bp, Homo sapiens
aacttaggaaaataaggcatga

SEQ ID NO: 9047806 - DNA, 22 bp, Homo sapiens
aacttaaacaagctcccaagtt

SEQ ID NO: 9047807 - DNA, 22 bp, Homo sapiens
aacttaaacccactcatgtaga

SEQ ID NO: 9047808 - DNA, 22 bp, Homo sapiens
aacttaaacccactcatgtaga

SEQ ID NO: 9047809 - DNA, 22 bp, Homo sapiens
aacttaaacccactcatgtaga

SEQ ID NO: 9047810 - DNA, 22 bp, Homo sapiens
aactgttgcttgtaatatgtgc

SEQ ID NO: 9047811 - DNA, 22 bp, Homo sapiens
aactgttggaggattattttgc

SEQ ID NO: 9047812 - DNA, 22 bp, Homo sapiens
aactgttgtcatatggtcttaa

SEQ ID NO: 9047813 - DNA, 22 bp, Homo sapiens
aactgttacatagttatagatc

SEQ ID NO: 9047814 - DNA, 22 bp, Homo sapiens
aactgtgtgttttgctattagt

SEQ ID NO: 9047815 - DNA, 22 bp, Homo sapiens
aatgatcccatttagaaacaga

SEQ ID NO: 9047816 - DNA, 22 bp, Homo sapiens
aatataatgctgttttatgcca

SEQ ID NO: 9047817 - DNA, 22 bp, Homo sapiens
aactacagctcttgtctttctg

SEQ ID NO: 9047818 - DNA, 22 bp, Homo sapiens
aatcatcacgaacacaacagcg

SEQ ID NO: 9047819 - DNA, 22 bp, Homo sapiens
aatccaatcctactcagaaagt

SEQ ID NO: 9047820 - DNA, 22 bp, Homo sapiens
aactgcaataacttgtgcacca

SEQ ID NO: 9047821 - DNA, 18 bp, Homo sapiens
aacatgcattagaactgc

SEQ ID NO: 9047822 - DNA, 22 bp, Homo sapiens
aacatgcccgctgtatgccatt

SEQ ID NO: 9047823 - DNA, 22 bp, Homo sapiens
aacatgctctgtttcttggatg

SEQ ID NO: 9047824 - DNA, 22 bp, Homo sapiens
aacatgctcttcctggctagtc

SEQ ID NO: 9047825 - DNA, 22 bp, Homo sapiens
aacatgaaacccaaacagaata

SEQ ID NO: 9047826 - DNA, 15 bp, Homo sapiens
aacaggcatttatat

SEQ ID NO: 9047827 - DNA, 22 bp, Homo sapiens
aacaggcaggagaattctgcct

SEQ ID NO: 9047828 - DNA, 22 bp, Homo sapiens
aacaggcagcagactgaatctg

SEQ ID NO: 9047829 - DNA, 22 bp, Homo sapiens
aacaggcaaactgtgggatccc

SEQ ID NO: 9047830 - DNA, 22 bp, Homo sapiens
aacaggcaacagttgactctga

SEQ ID NO: 9047831 - DNA, 22 bp, Homo sapiens
aacaggcaatttaggactcttt

SEQ ID NO: 9047832 - DNA, 22 bp, Homo sapiens
aacaggcactaagcatgtgggg

SEQ ID NO: 9047833 - DNA, 22 bp, Homo sapiens
aaccaccattctctcctcttcc

SEQ ID NO: 9047834 - DNA, 22 bp, Homo sapiens
aaccaccattctctcctcttcc

SEQ ID NO: 9047835 - DNA, 22 bp, Homo sapiens
aaccacaacactaaatgctggt

SEQ ID NO: 9047836 - DNA, 22 bp, Homo sapiens
aaccaattaatagataggaaac

SEQ ID NO: 9047837 - DNA, 22 bp, Homo sapiens
aaccagagagtcttcttcattg

SEQ ID NO: 9047838 - DNA, 22 bp, Homo sapiens
aaccagagaaatggagtgataa

SEQ ID NO: 9047839 - DNA, 22 bp, Homo sapiens
aaccagaggcagcagtacctga

SEQ ID NO: 9047840 - DNA, 22 bp, Homo sapiens
aataagaaagagtcagcttcag

SEQ ID NO: 9047841 - DNA, 22 bp, Homo sapiens
aataagaactccatttactcgt

SEQ ID NO: 9047842 - DNA, 22 bp, Homo sapiens
aacatgctttgataaataaaag

SEQ ID NO: 9047843 - DNA, 22 bp, Homo sapiens
aataacttgtatggttattcca

SEQ ID NO: 9047844 - DNA, 23 bp, Homo sapiens
aagcatggttcacagttagtact

SEQ ID NO: 9047845 - DNA, 17 bp, Homo sapiens
aagcatttaatttgcta

SEQ ID NO: 9047846 - DNA, 22 bp, Homo sapiens
aagcatttatagataagaattt

SEQ ID NO: 9047847 - DNA, 22 bp, Homo sapiens
aagcatttcaatataatattca

SEQ ID NO: 9047848 - DNA, 22 bp, Homo sapiens
aagcatttatagataagaattt

SEQ ID NO: 9047849 - DNA, 22 bp, Homo sapiens
aagcatttcaggtagagatatt

SEQ ID NO: 9047850 - DNA, 22 bp, Homo sapiens
aagcatttcaatataatattca

SEQ ID NO: 9047851 - DNA, 22 bp, Homo sapiens
aagcatttcaggtagagatatt

SEQ ID NO: 9047852 - DNA, 22 bp, Homo sapiens
aagcatttctgtttatctatcg

SEQ ID NO: 9047853 - DNA, 22 bp, Homo sapiens
aagcatttggcatgaaactctt

SEQ ID NO: 9047854 - DNA, 22 bp, Homo sapiens
aagcatttggttctgaagactc

SEQ ID NO: 9047855 - DNA, 22 bp, Homo sapiens
aagcatttgtgaaattcagatg

SEQ ID NO: 9047856 - DNA, 22 bp, Homo sapiens
acacaggaaatggtttagtttt

SEQ ID NO: 9047857 - DNA, 22 bp, Homo sapiens
acacagtaccccaaggctgggc

SEQ ID NO: 9047858 - DNA, 22 bp, Homo sapiens
aagaggccttggtctgacctga

SEQ ID NO: 9047859 - DNA, 22 bp, Homo sapiens
aagaggcctcacctcactgccc

SEQ ID NO: 9047860 - DNA, 22 bp, Homo sapiens
aagatgttctattttcactttt

SEQ ID NO: 9047861 - DNA, 22 bp, Homo sapiens
aagattctgtatttctaacaat

SEQ ID NO: 9047862 - DNA, 22 bp, Homo sapiens
aagatttaccactttattcaag

SEQ ID NO: 9047863 - DNA, 22 bp, Homo sapiens
aagatttaccactttattcaag

SEQ ID NO: 9047864 - DNA, 22 bp, Homo sapiens
aagatttactagcataatagct

SEQ ID NO: 9047865 - DNA, 22 bp, Homo sapiens
aagatttactagcataatagct

SEQ ID NO: 9047866 - DNA, 22 bp, Homo sapiens
aagatttactttctttgtaata

SEQ ID NO: 9047867 - DNA, 22 bp, Homo sapiens
aagatttactttctttgtaata

SEQ ID NO: 9047868 - DNA, 22 bp, Homo sapiens
aagatttagggccagtttacat

SEQ ID NO: 9047869 - DNA, 22 bp, Homo sapiens
aagcacagggactcaggaccgg

SEQ ID NO: 9047870 - DNA, 22 bp, Homo sapiens
aagaaatcagaaaagcattcgt

SEQ ID NO: 9047871 - DNA, 22 bp, Homo sapiens
aagaaatcagaaaagcattcgt

SEQ ID NO: 9047872 - DNA, 22 bp, Homo sapiens
aagaaatacatggtttttgagt

SEQ ID NO: 9047873 - DNA, 22 bp, Homo sapiens
aagaaagcattagacaggcatt

SEQ ID NO: 9047874 - DNA, 22 bp, Homo sapiens
aagaaatcatatcatttcttgg

SEQ ID NO: 9047875 - DNA, 22 bp, Homo sapiens
aatgttttacagatcccattag

SEQ ID NO: 9047876 - DNA, 22 bp, Homo sapiens
aatgttttagattactgctggg

SEQ ID NO: 9047877 - DNA, 22 bp, Homo sapiens
aagaatacgtatcaacaatggt

SEQ ID NO: 9047878 - DNA, 22 bp, Homo sapiens
aagaataacacttaggttttgc

SEQ ID NO: 9047879 - DNA, 22 bp, Homo sapiens
aagaataagaggatttagaaca

SEQ ID NO: 9047880 - DNA, 23 bp, Homo sapiens
aagaataaatgacattaaaggtg

SEQ ID NO: 9047881 - DNA, 20 bp, Homo sapiens
aagacaccagtggcagcccc

SEQ ID NO: 9047882 - DNA, 22 bp, Homo sapiens
aatttaactgagagtactttta

SEQ ID NO: 9047883 - DNA, 22 bp, Homo sapiens
aagacatcagtgatgacatttg

SEQ ID NO: 9047884 - DNA, 20 bp, Homo sapiens
acaaagactggaaaagcaag

SEQ ID NO: 9047885 - DNA, 22 bp, Homo sapiens
acaaagattcatttgcattatt

SEQ ID NO: 9047886 - DNA, 22 bp, Homo sapiens
acaaagattcatttgcattatt

SEQ ID NO: 9047887 - DNA, 22 bp, Homo sapiens
acaaagatgtttaaagcattta

SEQ ID NO: 9047888 - DNA, 22 bp, Homo sapiens
acaaagatgtttaaagcattta

SEQ ID NO: 9047889 - DNA, 22 bp, Homo sapiens
acaaagataagtcagaaagtca

SEQ ID NO: 9047890 - DNA, 22 bp, Homo sapiens
acaaagataagtcagaaagtca

SEQ ID NO: 9047891 - DNA, 20 bp, Homo sapiens
aagagctgactcacagtggt

SEQ ID NO: 9047892 - DNA, 22 bp, Homo sapiens
aagagctggagctgctacagga

SEQ ID NO: 9047893 - DNA, 22 bp, Homo sapiens
aagagctggatggaatctggga

SEQ ID NO: 9047894 - DNA, 22 bp, Homo sapiens
aagagctggtcacaggtccatt

SEQ ID NO: 9047895 - DNA, 22 bp, Homo sapiens
aagagcttggactttcaagtca

SEQ ID NO: 9047896 - DNA, 22 bp, Homo sapiens
aagagcttccctgttgtagagg

SEQ ID NO: 9047897 - DNA, 22 bp, Homo sapiens
aagaggaaatgattgactatat

SEQ ID NO: 9047898 - DNA, 22 bp, Homo sapiens
aagaggaaatgattgactatat

SEQ ID NO: 9047899 - DNA, 19 bp, Homo sapiens
acaaatagttacatatcct

SEQ ID NO: 9047900 - DNA, 22 bp, Homo sapiens
acaaatgagaatgtagacagag

SEQ ID NO: 9047901 - DNA, 22 bp, Homo sapiens
acaaacttccatcatgaatttt

SEQ ID NO: 9047902 - DNA, 22 bp, Homo sapiens
acaaacttatgtttcatatgta

SEQ ID NO: 9047903 - DNA, 22 bp, Homo sapiens
acaaatgattttccaagccagt

SEQ ID NO: 9047904 - DNA, 22 bp, Homo sapiens
acaaatgccatatataaattct

SEQ ID NO: 9047905 - DNA, 22 bp, Homo sapiens
acaaatgccatatataaattct

SEQ ID NO: 9047906 - DNA, 23 bp, Homo sapiens
acaaatgcccatacatctagttc

SEQ ID NO: 9047907 - DNA, 19 bp, Homo sapiens
acaaatgatgttgcactga

SEQ ID NO: 9047908 - DNA, 22 bp, Homo sapiens
acaaaattatgaagaggccttg

SEQ ID NO: 9047909 - DNA, 22 bp, Homo sapiens
acaaaattacctagttattttc

SEQ ID NO: 9047910 - DNA, 22 bp, Homo sapiens
acaaaattgtgttaaactttat

SEQ ID NO: 9047911 - DNA, 22 bp, Homo sapiens
acaaaattgtgttaaactttat

SEQ ID NO: 9047912 - DNA, 22 bp, Homo sapiens
acaaacacgagacgccactgtg

SEQ ID NO: 9047913 - DNA, 22 bp, Homo sapiens
acaaaatttttagacaaggctt

SEQ ID NO: 9047914 - DNA, 22 bp, Homo sapiens
acaaaccagcttaagcaagatg

SEQ ID NO: 9047915 - DNA, 22 bp, Homo sapiens
acaaaccagcttaagcaagatg

SEQ ID NO: 9047916 - DNA, 22 bp, Homo sapiens
acaaacagagttgaaaaatagg

SEQ ID NO: 9047917 - DNA, 22 bp, Homo sapiens
acaaacagctaacatatgttaa

SEQ ID NO: 9047918 - DNA, 22 bp, Homo sapiens
acaaacagagttgaaaaatagg

SEQ ID NO: 9047919 - DNA, 22 bp, Homo sapiens
aattttatgccttgcacgttgg

SEQ ID NO: 9047920 - DNA, 22 bp, Homo sapiens
aattttcacagtgctgtgagat

SEQ ID NO: 9047921 - DNA, 22 bp, Homo sapiens
aattttcacagtgctgtgagat

SEQ ID NO: 9047922 - DNA, 22 bp, Homo sapiens
agagctggggccagagtcaagg

SEQ ID NO: 9047923 - DNA, 22 bp, Homo sapiens
aatttgttaaaagtgagtgaca

SEQ ID NO: 9047924 - DNA, 22 bp, Homo sapiens
acaaattctttctgcctattgg

SEQ ID NO: 9047925 - DNA, 22 bp, Homo sapiens
acaaattatagaaaattgagct

SEQ ID NO: 9047926 - DNA, 22 bp, Homo sapiens
acaagtttatttgattagaaca

SEQ ID NO: 9047927 - DNA, 22 bp, Homo sapiens
acaatgtttttgttcaaagagt

SEQ ID NO: 9047928 - DNA, 22 bp, Homo sapiens
acaatgtttttgttcaaagagt

SEQ ID NO: 9047929 - DNA, 22 bp, Homo sapiens
acaatgtagaggctgaaagcaa

SEQ ID NO: 9047930 - DNA, 22 bp, Homo sapiens
acaattccacatggcatgcagg

SEQ ID NO: 9047931 - DNA, 22 bp, Homo sapiens
acaattctgatggtttcccagt

SEQ ID NO: 9047932 - DNA, 22 bp, Homo sapiens
acaattcaagatgagattcagg

SEQ ID NO: 9047933 - DNA, 21 bp, Homo sapiens
agaagggattgtggtaaagat

SEQ ID NO: 9047934 - DNA, 22 bp, Homo sapiens
aatgtcactctgtttcctctgc

SEQ ID NO: 9047935 - DNA, 22 bp, Homo sapiens
aatgtcatagcatttcttcaat

SEQ ID NO: 9047936 - DNA, 22 bp, Homo sapiens
aatgtcatagcatttcttcaat

SEQ ID NO: 9047937 - DNA, 22 bp, Homo sapiens
aatgtcatgagcctgctcttgt

SEQ ID NO: 9047938 - DNA, 22 bp, Homo sapiens
aatgtcatattagtttgtgcct

SEQ ID NO: 9047939 - DNA, 21 bp, Homo sapiens
aatgtcattgaatggtgagac

SEQ ID NO: 9047940 - DNA, 22 bp, Homo sapiens
aatgtcatgggaatttattcat

SEQ ID NO: 9047941 - DNA, 22 bp, Homo sapiens
aatgtcattgagctccaatcct

SEQ ID NO: 9047942 - DNA, 22 bp, Homo sapiens
agacagggtcttgatcagagct

SEQ ID NO: 9047943 - DNA, 22 bp, Homo sapiens
aatgtcattgtgagttaggctt

SEQ ID NO: 9047944 - DNA, 22 bp, Homo sapiens
aatgtcattggtaaagattagg

SEQ ID NO: 9047945 - DNA, 22 bp, Homo sapiens
aatgtcatttaaaataattctg

SEQ ID NO: 9047946 - DNA, 22 bp, Homo sapiens
aatgtcatttttaaatgtgaga

SEQ ID NO: 9047947 - DNA, 22 bp, Homo sapiens
aatgtcatttaggattatgttt

SEQ ID NO: 9047948 - DNA, 22 bp, Homo sapiens
aatgtcttaaagtcgtgttaca

SEQ ID NO: 9047949 - DNA, 22 bp, Homo sapiens
aatgttctcaacaaaaggaagc

SEQ ID NO: 9047950 - DNA, 22 bp, Homo sapiens
aatgttcattgttttccatatg

SEQ ID NO: 9047951 - DNA, 22 bp, Homo sapiens
aatgttcagtgcctttaaacat

SEQ ID NO: 9047952 - DNA, 22 bp, Homo sapiens
aatgttatttctgcatagtagt

SEQ ID NO: 9047953 - DNA, 22 bp, Homo sapiens
aatgttatttctgcatagtagt

SEQ ID NO: 9047954 - DNA, 22 bp, Homo sapiens
aatgttatttctgcatagtagt

SEQ ID NO: 9047955 - DNA, 22 bp, Homo sapiens
aattagcttatgtgtacttttc

SEQ ID NO: 9047956 - DNA, 22 bp, Homo sapiens
aatgtttggctagatagatgga

SEQ ID NO: 9047957 - DNA, 22 bp, Homo sapiens
agagctgggacttggactcaat

SEQ ID NO: 9047958 - DNA, 22 bp, Homo sapiens
acagagttacataacttgtcca

SEQ ID NO: 9047959 - DNA, 22 bp, Homo sapiens
acagagttgtgtttgtacaacg

SEQ ID NO: 9047960 - DNA, 22 bp, Homo sapiens
acagagtttatgtgtgtacaaa

SEQ ID NO: 9047961 - DNA, 22 bp, Homo sapiens
acagagcagttctggagctggc

SEQ ID NO: 9047962 - DNA, 22 bp, Homo sapiens
acagagcataatgtctagcaca

SEQ ID NO: 9047963 - DNA, 22 bp, Homo sapiens
agccatggcgccactagaggga

SEQ ID NO: 9047964 - DNA, 22 bp, Homo sapiens
agccatgggctcccagtccttt

SEQ ID NO: 9047965 - DNA, 22 bp, Homo sapiens
agccagggtgggtgaatgctat

SEQ ID NO: 9047966 - DNA, 21 bp, Homo sapiens
acagcaagccttcacatgagt

SEQ ID NO: 9047967 - DNA, 17 bp, Homo sapiens
agcctgctgatctcaca

SEQ ID NO: 9047968 - DNA, 22 bp, Homo sapiens
acagcaaatggttttctgtctg

SEQ ID NO: 9047969 - DNA, 22 bp, Homo sapiens
acagcaaaggacgaacactctg

SEQ ID NO: 9047970 - DNA, 22 bp, Homo sapiens
acagcaaaagacaagaacttaa

SEQ ID NO: 9047971 - DNA, 22 bp, Homo sapiens
agctatttcaaagtttgagaca

SEQ ID NO: 9047972 - DNA, 21 bp, Homo sapiens
agctatttcagatttgagagc

SEQ ID NO: 9047973 - DNA, 22 bp, Homo sapiens
acagcaggcatgaagaaatgtt

SEQ ID NO: 9047974 - DNA, 22 bp, Homo sapiens
agctctgggctgacatgctccc

SEQ ID NO: 9047975 - DNA, 19 bp, Homo sapiens
agctcctgttcagcagctc

SEQ ID NO: 9047976 - DNA, 19 bp, Homo sapiens
agctcctgttcagcagctc

SEQ ID NO: 9047977 - DNA, 22 bp, Homo sapiens
agctcctgttctgagagcagga

SEQ ID NO: 9047978 - DNA, 22 bp, Homo sapiens
agctctatcacctgtcagttgc

SEQ ID NO: 9047979 - DNA, 21 bp, Homo sapiens
agctctatgacttggccaggt

SEQ ID NO: 9047980 - DNA, 21 bp, Homo sapiens
agctctatgacttggccaggt

SEQ ID NO: 9047981 - DNA, 22 bp, Homo sapiens
agctctatcacctgtcagttgc

SEQ ID NO: 9047982 - DNA, 22 bp, Homo sapiens
agctctatcacctgtcagttgc

SEQ ID NO: 9047983 - DNA, 22 bp, Homo sapiens
acagaaagataggcacaaggtc

SEQ ID NO: 9047984 - DNA, 22 bp, Homo sapiens
acagaaattgggcaaatggaag

SEQ ID NO: 9047985 - DNA, 22 bp, Homo sapiens
acagaaattgctaatagctcat

SEQ ID NO: 9047986 - DNA, 22 bp, Homo sapiens
acagaaattctgggacagaaaa

SEQ ID NO: 9047987 - DNA, 22 bp, Homo sapiens
acagaaattgctaatagctcat

SEQ ID NO: 9047988 - DNA, 19 bp, Homo sapiens
acagaaattagttattttc

SEQ ID NO: 9047989 - DNA, 22 bp, Homo sapiens
acactgcagatgtaatttgagt

SEQ ID NO: 9047990 - DNA, 22 bp, Homo sapiens
acactgtaaagtgatgcttaaa

SEQ ID NO: 9047991 - DNA, 23 bp, Homo sapiens
acactgtctcatggatagactgc

SEQ ID NO: 9047992 - DNA, 22 bp, Homo sapiens
acacattataggcaatcaaaag

SEQ ID NO: 9047993 - DNA, 22 bp, Homo sapiens
acacatttgcataatacctcat

SEQ ID NO: 9047994 - DNA, 19 bp, Homo sapiens
acacatttgcacaatccac

SEQ ID NO: 9047995 - DNA, 22 bp, Homo sapiens
agcagggcagtgcttcagctct

SEQ ID NO: 9047996 - DNA, 22 bp, Homo sapiens
acaccaaagtagaattaatgta

SEQ ID NO: 9047997 - DNA, 22 bp, Homo sapiens
agcaccatttatcatctaggta

SEQ ID NO: 9047998 - DNA, 22 bp, Homo sapiens
acaatttcaccttttggttcaa

SEQ ID NO: 9047999 - DNA, 20 bp, Homo sapiens
acaatttcctcactatatgc

SEQ ID NO: 9048000 - DNA, 22 bp, Homo sapiens
acaatttatccattgtatagtt

SEQ ID NO: 9048001 - DNA, 22 bp, Homo sapiens
acaattctgatggtttcccagt

SEQ ID NO: 9048002 - DNA, 22 bp, Homo sapiens
acaattttaagccagagtgggt

SEQ ID NO: 9048003 - DNA, 22 bp, Homo sapiens
acaatttcttatagttcaattc

SEQ ID NO: 9048004 - DNA, 22 bp, Homo sapiens
acaatttctaatatagatctta

SEQ ID NO: 9048005 - DNA, 22 bp, Homo sapiens
acaatttctgatcagtgaattt

SEQ ID NO: 9048006 - DNA, 22 bp, Homo sapiens
acacagcaacttgcagtatgga

SEQ ID NO: 9048007 - DNA, 22 bp, Homo sapiens
acacatatgtatgcatcatgtg

SEQ ID NO: 9048008 - DNA, 22 bp, Homo sapiens
acacatatctaagatagatgac

SEQ ID NO: 9048009 - DNA, 22 bp, Homo sapiens
aagttatttttcaagatccttt

SEQ ID NO: 9048010 - DNA, 22 bp, Homo sapiens
aagttattgcagcaatccaagt

SEQ ID NO: 9048011 - DNA, 22 bp, Homo sapiens
actccccagactgccatgctgg

SEQ ID NO: 9048012 - DNA, 22 bp, Homo sapiens
aagtgctttacaaatgtctgtt

SEQ ID NO: 9048013 - DNA, 21 bp, Homo sapiens
aagtggagaagaaaagctgga

SEQ ID NO: 9048014 - DNA, 22 bp, Homo sapiens
aagtggaagagaagttatctta

SEQ ID NO: 9048015 - DNA, 22 bp, Homo sapiens
actaaatgagatactgtcttca

SEQ ID NO: 9048016 - DNA, 22 bp, Homo sapiens
aagtcaccctagggcctggact

SEQ ID NO: 9048017 - DNA, 22 bp, Homo sapiens
aagtcaccccacactcttggga

SEQ ID NO: 9048018 - DNA, 18 bp, Homo sapiens
aagtcacccctgctccct

SEQ ID NO: 9048019 - DNA, 22 bp, Homo sapiens
aagtcacccacaggcagcagaa

SEQ ID NO: 9048020 - DNA, 22 bp, Homo sapiens
aagtttatgttggtaagatatc

SEQ ID NO: 9048021 - DNA, 22 bp, Homo sapiens
aagtttagtattagggaaaagt

SEQ ID NO: 9048022 - DNA, 22 bp, Homo sapiens
aagtttactgtccctggaaact

SEQ ID NO: 9048023 - DNA, 22 bp, Homo sapiens
aataatagttgcaaagtgttta

SEQ ID NO: 9048024 - DNA, 19 bp, Homo sapiens
aataatgttcatgagattg

SEQ ID NO: 9048025 - DNA, 22 bp, Homo sapiens
aataatgtgatagataagggaa

SEQ ID NO: 9048026 - DNA, 22 bp, Homo sapiens
aataatgttatgtcattcttct

SEQ ID NO: 9048027 - DNA, 22 bp, Homo sapiens
agaaatactaggaatattcata

SEQ ID NO: 9048028 - DNA, 18 bp, Homo sapiens
agaaataccagtattgga

SEQ ID NO: 9048029 - DNA, 20 bp, Homo sapiens
agaaatacatgcatgcatga

SEQ ID NO: 9048030 - DNA, 20 bp, Homo sapiens
agaaatacatgcatgcatga

SEQ ID NO: 9048031 - DNA, 22 bp, Homo sapiens
agaaataagagctttccttggg

SEQ ID NO: 9048032 - DNA, 22 bp, Homo sapiens
agaaataagagctttccttggg

SEQ ID NO: 9048033 - DNA, 22 bp, Homo sapiens
agaaatacaaagtactaagata

SEQ ID NO: 9048034 - DNA, 22 bp, Homo sapiens
aatgaaactatatttagagagg

SEQ ID NO: 9048035 - DNA, 22 bp, Homo sapiens
aatgaaactagtagaatctttg

SEQ ID NO: 9048036 - DNA, 22 bp, Homo sapiens
aatgagaactgggagttggtgg

SEQ ID NO: 9048037 - DNA, 22 bp, Homo sapiens
aatgagaagcctaggtgtactg

SEQ ID NO: 9048038 - DNA, 22 bp, Homo sapiens
aatgagaatgtaagtgaagaga

SEQ ID NO: 9048039 - DNA, 22 bp, Homo sapiens
aatgagaaccttgaaaggaact

SEQ ID NO: 9048040 - DNA, 22 bp, Homo sapiens
aatgagaaaacacagaggaggt

SEQ ID NO: 9048041 - DNA, 22 bp, Homo sapiens
aatgactctgctgcagagacac

SEQ ID NO: 9048042 - DNA, 19 bp, Homo sapiens
aatgactgagtacattgtc

SEQ ID NO: 9048043 - DNA, 22 bp, Homo sapiens
agaaatactgcctaagactgta

SEQ ID NO: 9048044 - DNA, 22 bp, Homo sapiens
agaaatactgcctaagactgta

SEQ ID NO: 9048045 - DNA, 22 bp, Homo sapiens
aatgaatgtttgttgagtgaag

SEQ ID NO: 9048046 - DNA, 20 bp, Homo sapiens
agaaatactttggtataatg

SEQ ID NO: 9048047 - DNA, 18 bp, Homo sapiens
agaaggagctatgggcag

SEQ ID NO: 9048048 - DNA, 22 bp, Homo sapiens
aatgagcaaatgaagacgctgt

SEQ ID NO: 9048049 - DNA, 22 bp, Homo sapiens
aatgagcaaatgaagacgctgt

SEQ ID NO: 9048050 - DNA, 22 bp, Homo sapiens
aatgagggagtggggcttgtcc

SEQ ID NO: 9048051 - DNA, 22 bp, Homo sapiens
aatgagcttctataatcttgtc

SEQ ID NO: 9048052 - DNA, 21 bp, Homo sapiens
aatacagaaatgagtagttgc

SEQ ID NO: 9048053 - DNA, 22 bp, Homo sapiens
acttcctggattcccaagggct

SEQ ID NO: 9048054 - DNA, 22 bp, Homo sapiens
acttgaaacatctttaaatgta

SEQ ID NO: 9048055 - DNA, 22 bp, Homo sapiens
acttgaaacatctttaaatgta

SEQ ID NO: 9048056 - DNA, 22 bp, Homo sapiens
acttgaaaggaagctctaaaac

SEQ ID NO: 9048057 - DNA, 22 bp, Homo sapiens
acttgattgtatgaagttattt

SEQ ID NO: 9048058 - DNA, 22 bp, Homo sapiens
aatatatttgaatcaggaacaa

SEQ ID NO: 9048059 - DNA, 18 bp, Homo sapiens
aatatcaataagggggag

SEQ ID NO: 9048060 - DNA, 22 bp, Homo sapiens
aatattcatttgcagaagaagt

SEQ ID NO: 9048061 - DNA, 22 bp, Homo sapiens
aatatcacaggaggagaccaag

SEQ ID NO: 9048062 - DNA, 22 bp, Homo sapiens
aatccagcacatggacacagtc

SEQ ID NO: 9048063 - DNA, 22 bp, Homo sapiens
aatcataattgtatacattcat

SEQ ID NO: 9048064 - DNA, 22 bp, Homo sapiens
aatccattgctgtgctgccagg

SEQ ID NO: 9048065 - DNA, 22 bp, Homo sapiens
aatccatgcatgcaaggaaagg

SEQ ID NO: 9048066 - DNA, 22 bp, Homo sapiens
aatcaagaataagttgtaaagc

SEQ ID NO: 9048067 - DNA, 22 bp, Homo sapiens
acttgttaactctcaaagaaca

SEQ ID NO: 9048068 - DNA, 22 bp, Homo sapiens
aatattttaggctttccaggct

SEQ ID NO: 9048069 - DNA, 22 bp, Homo sapiens
aatattttaggctttccaggct

SEQ ID NO: 9048070 - DNA, 19 bp, Homo sapiens
aatattttagcctcttcct

SEQ ID NO: 9048071 - DNA, 22 bp, Homo sapiens
aatatttttgaggccctgttat

SEQ ID NO: 9048072 - DNA, 22 bp, Homo sapiens
aatcaaaacctacagaggtaat

SEQ ID NO: 9048073 - DNA, 22 bp, Homo sapiens
acagtataactccatgccaccc

SEQ ID NO: 9048074 - DNA, 22 bp, Homo sapiens
aaggaaatctttgtaacatctt

SEQ ID NO: 9048075 - DNA, 22 bp, Homo sapiens
aaggaacactacaaggctggga

SEQ ID NO: 9048076 - DNA, 22 bp, Homo sapiens
aaggcaggatgggaaaagattt

SEQ ID NO: 9048077 - DNA, 22 bp, Homo sapiens
aaggcagggaaagtggattagg

SEQ ID NO: 9048078 - DNA, 22 bp, Homo sapiens
aaggcagtaggatcttccacag

SEQ ID NO: 9048079 - DNA, 22 bp, Homo sapiens
aaggcagtcaaagcagacttct

SEQ ID NO: 9048080 - DNA, 21 bp, Homo sapiens
acagttctgccggcatctttc

SEQ ID NO: 9048081 - DNA, 22 bp, Homo sapiens
acagttctttgtttatagcttg

SEQ ID NO: 9048082 - DNA, 19 bp, Homo sapiens
acagttctaatttctgtgg

SEQ ID NO: 9048083 - DNA, 22 bp, Homo sapiens
aagctttaaggaattttatgga

SEQ ID NO: 9048084 - DNA, 22 bp, Homo sapiens
aagctttaaggaattttatgga

SEQ ID NO: 9048085 - DNA, 22 bp, Homo sapiens
aagcttgtcagtgcaattttac

SEQ ID NO: 9048086 - DNA, 22 bp, Homo sapiens
aagctttaagtgtcagtcagcc

SEQ ID NO: 9048087 - DNA, 22 bp, Homo sapiens
aagctttaaggaattttatgga

SEQ ID NO: 9048088 - DNA, 22 bp, Homo sapiens
acaggcagttgaggtttgtgtg

SEQ ID NO: 9048089 - DNA, 22 bp, Homo sapiens
aaggaaagattctctctctaga

SEQ ID NO: 9048090 - DNA, 22 bp, Homo sapiens
aaggaaagctgtggttctgaga

SEQ ID NO: 9048091 - DNA, 22 bp, Homo sapiens
aaggaaaggatgagcatgcatt

SEQ ID NO: 9048092 - DNA, 22 bp, Homo sapiens
aaggaaatacaacatgtattca

SEQ ID NO: 9048093 - DNA, 22 bp, Homo sapiens
aaggaaatacttctgcagagca

SEQ ID NO: 9048094 - DNA, 22 bp, Homo sapiens
aaggaaatacttctgcagagca

SEQ ID NO: 9048095 - DNA, 22 bp, Homo sapiens
acagggctggggcacttggctg

SEQ ID NO: 9048096 - DNA, 23 bp, Homo sapiens
acagggctgtccagggctaggtc

SEQ ID NO: 9048097 - DNA, 22 bp, Homo sapiens
acagtacagctgaaactttagt

SEQ ID NO: 9048098 - DNA, 22 bp, Homo sapiens
aagctgcatgaagttgagtaga

SEQ ID NO: 9048099 - DNA, 22 bp, Homo sapiens
aagctgcaggttgaatccaggt

SEQ ID NO: 9048100 - DNA, 22 bp, Homo sapiens
aagctgcagcacagagaggtgg

SEQ ID NO: 9048101 - DNA, 22 bp, Homo sapiens
aagctgcactacttgagggacc

SEQ ID NO: 9048102 - DNA, 22 bp, Homo sapiens
aagctgcagatgtgcctgtgga

SEQ ID NO: 9048103 - DNA, 22 bp, Homo sapiens
aagctgcagaccccctgtctca

SEQ ID NO: 9048104 - DNA, 22 bp, Homo sapiens
aagctgcaaggaagtgtgccag

SEQ ID NO: 9048105 - DNA, 22 bp, Homo sapiens
aagctgcaaaaaatttctgtct

SEQ ID NO: 9048106 - DNA, 22 bp, Homo sapiens
aagggaaatggccaggcagaga

SEQ ID NO: 9048107 - DNA, 22 bp, Homo sapiens
aaggcttttgggaattttcaac

SEQ ID NO: 9048108 - DNA, 22 bp, Homo sapiens
aaggctttgattccattgccct

SEQ ID NO: 9048109 - DNA, 22 bp, Homo sapiens
aagggctccaagaggtagctgg

SEQ ID NO: 9048110 - DNA, 22 bp, Homo sapiens
aagggctctgtgtgcctcccca

SEQ ID NO: 9048111 - DNA, 22 bp, Homo sapiens
aagggctctgtgcttgtcccat

SEQ ID NO: 9048112 - DNA, 22 bp, Homo sapiens
aagggctctgggctacgcactg

SEQ ID NO: 9048113 - DNA, 22 bp, Homo sapiens
aaggcatggcagggtttacaca

SEQ ID NO: 9048114 - DNA, 22 bp, Homo sapiens
aaggctcttggagtgaatgcag

SEQ ID NO: 9048115 - DNA, 22 bp, Homo sapiens
aaggctgcctctgccagaggag

SEQ ID NO: 9048116 - DNA, 22 bp, Homo sapiens
acatgtgtggacatgaatctac

SEQ ID NO: 9048117 - DNA, 22 bp, Homo sapiens
acatgtgtctaagaatgaaaga

SEQ ID NO: 9048118 - DNA, 22 bp, Homo sapiens
aaggtgactcacaaagccagtt

SEQ ID NO: 9048119 - DNA, 22 bp, Homo sapiens
aaggtagattctggatcgaagg

SEQ ID NO: 9048120 - DNA, 22 bp, Homo sapiens
aaggtgggtggatcacgaggtc

SEQ ID NO: 9048121 - DNA, 22 bp, Homo sapiens
accatccaaactgctttctgtg

SEQ ID NO: 9048122 - DNA, 22 bp, Homo sapiens
accatgttggccaagctggtct

SEQ ID NO: 9048123 - DNA, 22 bp, Homo sapiens
aagtaacagcatcaagtctcaa

SEQ ID NO: 9048124 - DNA, 22 bp, Homo sapiens
accatgcatcaaagctaatata

SEQ ID NO: 9048125 - DNA, 23 bp, Homo sapiens
accatgatgggagtgcaaataag

SEQ ID NO: 9048126 - DNA, 21 bp, Homo sapiens
acccccacacctccttagttc

SEQ ID NO: 9048127 - DNA, 22 bp, Homo sapiens
acccccacggaaggccgtacgc

SEQ ID NO: 9048128 - DNA, 22 bp, Homo sapiens
accccccagataatcccttgag

SEQ ID NO: 9048129 - DNA, 22 bp, Homo sapiens
aagtacgtgcctccacttgtgt

SEQ ID NO: 9048130 - DNA, 22 bp, Homo sapiens
aagtacagccttcattctcatg

SEQ ID NO: 9048131 - DNA, 22 bp, Homo sapiens
aagtacatcctagtctctttca

SEQ ID NO: 9048132 - DNA, 22 bp, Homo sapiens
acatttcttttcatctctatat

SEQ ID NO: 9048133 - DNA, 22 bp, Homo sapiens
acatttcttgatgcctctgtga

SEQ ID NO: 9048134 - DNA, 18 bp, Homo sapiens
acatttctatgcttctgg

SEQ ID NO: 9048135 - DNA, 22 bp, Homo sapiens
acattgcaataataattctctt

SEQ ID NO: 9048136 - DNA, 22 bp, Homo sapiens
aggcctgaggaccttctggagg

SEQ ID NO: 9048137 - DNA, 22 bp, Homo sapiens
acatttctatagtgcatctgtt

SEQ ID NO: 9048138 - DNA, 22 bp, Homo sapiens
acatttcatttgcagtatggat

SEQ ID NO: 9048139 - DNA, 22 bp, Homo sapiens
acatgctttgcacttacatcat

SEQ ID NO: 9048140 - DNA, 22 bp, Homo sapiens
acatgcttgtttttcacaacct

SEQ ID NO: 9048141 - DNA, 22 bp, Homo sapiens
acatgcttccaaattatgttgg

SEQ ID NO: 9048142 - DNA, 22 bp, Homo sapiens
acatgccagcactgcttttcag

SEQ ID NO: 9048143 - DNA, 22 bp, Homo sapiens
acatgccatgaaggtatttttg

SEQ ID NO: 9048144 - DNA, 22 bp, Homo sapiens
acatgccatggttgtttgctgc

SEQ ID NO: 9048145 - DNA, 22 bp, Homo sapiens
acatcacacgccttccaggagg

SEQ ID NO: 9048146 - DNA, 22 bp, Homo sapiens
acatcacagtagttaagccaga

SEQ ID NO: 9048147 - DNA, 22 bp, Homo sapiens
acatcacagagcccagataaag

SEQ ID NO: 9048148 - DNA, 22 bp, Homo sapiens
acatcatgagagacttaaattg

SEQ ID NO: 9048149 - DNA, 22 bp, Homo sapiens
acatccatcttatgagataggt

SEQ ID NO: 9048150 - DNA, 22 bp, Homo sapiens
acatgtgtaaggtctctcagtc

SEQ ID NO: 9048151 - DNA, 22 bp, Homo sapiens
acatgtgttttcctacttatga

SEQ ID NO: 9048152 - DNA, 22 bp, Homo sapiens
acatgttaaacatcatggaatg

SEQ ID NO: 9048153 - DNA, 22 bp, Homo sapiens
acatgttgctaaatccaatggt

SEQ ID NO: 9048154 - DNA, 22 bp, Homo sapiens
acatgttgtttgccccagttgt

SEQ ID NO: 9048155 - DNA, 22 bp, Homo sapiens
acccagctggatgcatggaggc

SEQ ID NO: 9048156 - DNA, 22 bp, Homo sapiens
agggggagtttcagttagaaag

SEQ ID NO: 9048157 - DNA, 22 bp, Homo sapiens
agggggaggctgtgctgcgtct

SEQ ID NO: 9048158 - DNA, 22 bp, Homo sapiens
accctccacaccagtcttattt

SEQ ID NO: 9048159 - DNA, 22 bp, Homo sapiens
agggagagaagttatacaagat

SEQ ID NO: 9048160 - DNA, 22 bp, Homo sapiens
accagctctggacaggcatttc

SEQ ID NO: 9048161 - DNA, 19 bp, Homo sapiens
accagcccactcccagttt

SEQ ID NO: 9048162 - DNA, 22 bp, Homo sapiens
accagcattggacttagaatgc

SEQ ID NO: 9048163 - DNA, 19 bp, Homo sapiens
acagtcagggaataaagac

SEQ ID NO: 9048164 - DNA, 22 bp, Homo sapiens
acagtctacttgagcttgtata

SEQ ID NO: 9048165 - DNA, 22 bp, Homo sapiens
acagtctctgttgctgctgttt

SEQ ID NO: 9048166 - DNA, 23 bp, Homo sapiens
acagtgtctgctgcaagatatct

SEQ ID NO: 9048167 - DNA, 22 bp, Homo sapiens
acagtacaccactgtgtacagt

SEQ ID NO: 9048168 - DNA, 22 bp, Homo sapiens
aggacacaggcaggaggagatc

SEQ ID NO: 9048169 - DNA, 22 bp, Homo sapiens
acaggtttgtctgatgtaatga

SEQ ID NO: 9048170 - DNA, 22 bp, Homo sapiens
acagtaaataatgcatgttgat

SEQ ID NO: 9048171 - DNA, 22 bp, Homo sapiens
acagtaaacaatgcagcaaatt

SEQ ID NO: 9048172 - DNA, 22 bp, Homo sapiens
acagtttctccatttacacctt

SEQ ID NO: 9048173 - DNA, 22 bp, Homo sapiens
aggcactgggaatatgctgagg

SEQ ID NO: 9048174 - DNA, 22 bp, Homo sapiens
aggcactgggggatgagcaagg

SEQ ID NO: 9048175 - DNA, 22 bp, Homo sapiens
acagttcccgtcttgcacagct

SEQ ID NO: 9048176 - DNA, 22 bp, Homo sapiens
aggatgagagatacatggagca

SEQ ID NO: 9048177 - DNA, 22 bp, Homo sapiens
acatattggcaaactggaggca

SEQ ID NO: 9048178 - DNA, 22 bp, Homo sapiens
acatatattttcacacatggtt

SEQ ID NO: 9048179 - DNA, 20 bp, Homo sapiens
acatatcatggtagagtcct

SEQ ID NO: 9048180 - DNA, 21 bp, Homo sapiens
acatacattatctttttaaaa

SEQ ID NO: 9048181 - DNA, 21 bp, Homo sapiens
acataggcgaatgttcgggag

SEQ ID NO: 9048182 - DNA, 22 bp, Homo sapiens
acatagtgagagaaagatcagc

SEQ ID NO: 9048183 - DNA, 22 bp, Homo sapiens
acatagtgttttgagagacagc

SEQ ID NO: 9048184 - DNA, 22 bp, Homo sapiens
aggacacacagaatacaaatcc

SEQ ID NO: 9048185 - DNA, 19 bp, Homo sapiens
acaggggcctttccagggt

SEQ ID NO: 9048186 - DNA, 22 bp, Homo sapiens
aggacacaacatcatttctgtg

SEQ ID NO: 9048187 - DNA, 22 bp, Homo sapiens
aggacacacaaagagtgagaac

SEQ ID NO: 9048188 - DNA, 22 bp, Homo sapiens
acagggcttttaatcagtagtt

SEQ ID NO: 9048189 - DNA, 22 bp, Homo sapiens
aggaagaatgtttacatatcaa

SEQ ID NO: 9048190 - DNA, 19 bp, Homo sapiens
acagggcttggcctgacat

SEQ ID NO: 9048191 - DNA, 22 bp, Homo sapiens
acagggagccccagcatttcca

SEQ ID NO: 9048192 - DNA, 22 bp, Homo sapiens
acagggagatgggtgaaagcgg

SEQ ID NO: 9048193 - DNA, 22 bp, Homo sapiens
acaggcagcgtcattgctgctc

SEQ ID NO: 9048194 - DNA, 22 bp, Homo sapiens
acaggcagatgttttagttgta

SEQ ID NO: 9048195 - DNA, 22 bp, Homo sapiens
acagggaaggacatgacttggc

SEQ ID NO: 9048196 - DNA, 22 bp, Homo sapiens
acaggcaggcttcggccagagc

SEQ ID NO: 9048197 - DNA, 22 bp, Homo sapiens
acagggaccttggaagctggaa

SEQ ID NO: 9048198 - DNA, 22 bp, Homo sapiens
acagggagatatcttcaatatc

SEQ ID NO: 9048199 - DNA, 22 bp, Homo sapiens
acagggacctgtgagctccata

SEQ ID NO: 9048200 - DNA, 22 bp, Homo sapiens
acagctgtattcaagttgcaag

SEQ ID NO: 9048201 - DNA, 22 bp, Homo sapiens
agctgagagctgtgtcaagata

SEQ ID NO: 9048202 - DNA, 22 bp, Homo sapiens
agctgaagtttagaattgtgaa

SEQ ID NO: 9048203 - DNA, 22 bp, Homo sapiens
agctgaagtcctcgcggtgcta

SEQ ID NO: 9048204 - DNA, 22 bp, Homo sapiens
agctgaagggaggatatgtaca

SEQ ID NO: 9048205 - DNA, 22 bp, Homo sapiens
agctgaagtgttggtggtttca

SEQ ID NO: 9048206 - DNA, 22 bp, Homo sapiens
agctgaagttcagtccagagaa

SEQ ID NO: 9048207 - DNA, 22 bp, Homo sapiens
agctgactgatgaagaggcctt

SEQ ID NO: 9048208 - DNA, 22 bp, Homo sapiens
agctgacttcttgatccaatga

SEQ ID NO: 9048209 - DNA, 22 bp, Homo sapiens
agctgactctggcctctggtcc

SEQ ID NO: 9048210 - DNA, 22 bp, Homo sapiens
agctctggtatttctttaatcc

SEQ ID NO: 9048211 - DNA, 22 bp, Homo sapiens
agctctggttattgaagcaggg

SEQ ID NO: 9048212 - DNA, 22 bp, Homo sapiens
agctgaagcactgggatggaag

SEQ ID NO: 9048213 - DNA, 22 bp, Homo sapiens
agctgaagctcagcccagtagt

SEQ ID NO: 9048214 - DNA, 20 bp, Homo sapiens
agctgaagcccttggggaaa

SEQ ID NO: 9048215 - DNA, 22 bp, Homo sapiens
agctgaagcagtcagttcagct

SEQ ID NO: 9048216 - DNA, 22 bp, Homo sapiens
agctgaagggaggatatgtaca

SEQ ID NO: 9048217 - DNA, 22 bp, Homo sapiens
agctgaaggctagaacagctgg

SEQ ID NO: 9048218 - DNA, 22 bp, Homo sapiens
acaggagaaatctggtcaaaag

SEQ ID NO: 9048219 - DNA, 22 bp, Homo sapiens
atacattattgttaaagaacat

SEQ ID NO: 9048220 - DNA, 22 bp, Homo sapiens
atacattagctcatatgattaa

SEQ ID NO: 9048221 - DNA, 22 bp, Homo sapiens
atacatgttgtaccatatgttt

SEQ ID NO: 9048222 - DNA, 22 bp, Homo sapiens
atacatgttgtaccatatgttt

SEQ ID NO: 9048223 - DNA, 22 bp, Homo sapiens
atacattagaatctggtactca

SEQ ID NO: 9048224 - DNA, 22 bp, Homo sapiens
acttctgtatgtcctgcattca

SEQ ID NO: 9048225 - DNA, 22 bp, Homo sapiens
atacatgttcgtgtacatgttc

SEQ ID NO: 9048226 - DNA, 22 bp, Homo sapiens
atacatgttgagaaaatatctg

SEQ ID NO: 9048227 - DNA, 22 bp, Homo sapiens
atacatctagagtcataaaaac

SEQ ID NO: 9048228 - DNA, 22 bp, Homo sapiens
acttctttcacaatgtttctag

SEQ ID NO: 9048229 - DNA, 22 bp, Homo sapiens
atacattagtgaacaaaagaga

SEQ ID NO: 9048230 - DNA, 22 bp, Homo sapiens
atactgtaatacctaaatgaac

SEQ ID NO: 9048231 - DNA, 22 bp, Homo sapiens
atactgtaatacctaaatgaac

SEQ ID NO: 9048232 - DNA, 22 bp, Homo sapiens
actttatttcctattgcatcca

SEQ ID NO: 9048233 - DNA, 22 bp, Homo sapiens
actttatttcctattgcatcca

SEQ ID NO: 9048234 - DNA, 22 bp, Homo sapiens
actttatttcctattgcatcca

SEQ ID NO: 9048235 - DNA, 22 bp, Homo sapiens
actttatttcctattgcatcca

SEQ ID NO: 9048236 - DNA, 22 bp, Homo sapiens
actttcaaaagagaagtcatga

SEQ ID NO: 9048237 - DNA, 22 bp, Homo sapiens
actttagatattcctctgtaca

SEQ ID NO: 9048238 - DNA, 22 bp, Homo sapiens
atactgtagaggcatagctagt

SEQ ID NO: 9048239 - DNA, 22 bp, Homo sapiens
ataatgcagcttttcaatggcc

SEQ ID NO: 9048240 - DNA, 22 bp, Homo sapiens
ataatgcatttagaataattca

SEQ ID NO: 9048241 - DNA, 22 bp, Homo sapiens
acttacaatcaaccaccttgga

SEQ ID NO: 9048242 - DNA, 22 bp, Homo sapiens
acttagaaagggattctagatt

SEQ ID NO: 9048243 - DNA, 22 bp, Homo sapiens
acttacaagctagggaagcttg

SEQ ID NO: 9048244 - DNA, 22 bp, Homo sapiens
acttacaagttccctttctcag

SEQ ID NO: 9048245 - DNA, 22 bp, Homo sapiens
acttaacagacattatttacct

SEQ ID NO: 9048246 - DNA, 22 bp, Homo sapiens
acttagaagatgcagtaaagca

SEQ ID NO: 9048247 - DNA, 22 bp, Homo sapiens
atacaggttgaattttctttta

SEQ ID NO: 9048248 - DNA, 22 bp, Homo sapiens
atacagctttctttcacatgag

SEQ ID NO: 9048249 - DNA, 22 bp, Homo sapiens
atacagcagcccttgctttgca

SEQ ID NO: 9048250 - DNA, 22 bp, Homo sapiens
atacagcagtttgtgatcctag

SEQ ID NO: 9048251 - DNA, 22 bp, Homo sapiens
atacagccagcttcctgacctt

SEQ ID NO: 9048252 - DNA, 22 bp, Homo sapiens
atacagcctattcttaccattg

SEQ ID NO: 9048253 - DNA, 22 bp, Homo sapiens
ataaaatttgctactgttaaat

SEQ ID NO: 9048254 - DNA, 22 bp, Homo sapiens
ataaaatttgctactgttaaat

SEQ ID NO: 9048255 - DNA, 22 bp, Homo sapiens
ataaacaagactggccaacttt

SEQ ID NO: 9048256 - DNA, 22 bp, Homo sapiens
ataaacacttctagggcacaca

SEQ ID NO: 9048257 - DNA, 22 bp, Homo sapiens
ataatcctgctttttcactatt

SEQ ID NO: 9048258 - DNA, 22 bp, Homo sapiens
ataatgaatcagcatagggtga

SEQ ID NO: 9048259 - DNA, 22 bp, Homo sapiens
ataatgaatgcagagttatttt

SEQ ID NO: 9048260 - DNA, 22 bp, Homo sapiens
ataatgcacctttgagtatggc

SEQ ID NO: 9048261 - DNA, 23 bp, Homo sapiens
ataatgcaagtggtggtaatctg

SEQ ID NO: 9048262 - DNA, 22 bp, Homo sapiens
ataaggtatgagcaatgagttt

SEQ ID NO: 9048263 - DNA, 22 bp, Homo sapiens
ataaggttaacatcatcagtga

SEQ ID NO: 9048264 - DNA, 22 bp, Homo sapiens
actgtcactaactaagtctagt

SEQ ID NO: 9048265 - DNA, 22 bp, Homo sapiens
actgtcatctggtagatgatgg

SEQ ID NO: 9048266 - DNA, 22 bp, Homo sapiens
actgtattctagtcatgtttgt

SEQ ID NO: 9048267 - DNA, 22 bp, Homo sapiens
actgtattctagtcatgtttgt

SEQ ID NO: 9048268 - DNA, 22 bp, Homo sapiens
actgtatttttgaatcattgtg

SEQ ID NO: 9048269 - DNA, 22 bp, Homo sapiens
actgtattggttttctattgct

SEQ ID NO: 9048270 - DNA, 22 bp, Homo sapiens
actgtatttggatataagatct

SEQ ID NO: 9048271 - DNA, 23 bp, Homo sapiens
agaaaagttcatacctttttaac

SEQ ID NO: 9048272 - DNA, 22 bp, Homo sapiens
agaaaataaattgatggtggaa

SEQ ID NO: 9048273 - DNA, 22 bp, Homo sapiens
atattctctgctgcttttgtgt

SEQ ID NO: 9048274 - DNA, 22 bp, Homo sapiens
atattcatcgtgtagaaatact

SEQ ID NO: 9048275 - DNA, 22 bp, Homo sapiens
atattcatcgtgtagaaatact

SEQ ID NO: 9048276 - DNA, 17 bp, Homo sapiens
atattccaagggcttgg

SEQ ID NO: 9048277 - DNA, 22 bp, Homo sapiens
atatttcatggggttccatact

SEQ ID NO: 9048278 - DNA, 21 bp, Homo sapiens
atatttctcataaggttatgg

SEQ ID NO: 9048279 - DNA, 21 bp, Homo sapiens
atatttctcataaggttatgg

SEQ ID NO: 9048280 - DNA, 22 bp, Homo sapiens
atatttcagctttacttaggaa

SEQ ID NO: 9048281 - DNA, 20 bp, Homo sapiens
atatttcaggtagtgtgccc

SEQ ID NO: 9048282 - DNA, 22 bp, Homo sapiens
atatttataaggcaggcaagta

SEQ ID NO: 9048283 - DNA, 22 bp, Homo sapiens
atatttcacgtaggttgttttc

SEQ ID NO: 9048284 - DNA, 22 bp, Homo sapiens
atattcttatccttttctctgt

SEQ ID NO: 9048285 - DNA, 22 bp, Homo sapiens
atattcttccaaaacatcattt

SEQ ID NO: 9048286 - DNA, 22 bp, Homo sapiens
atattcttccaaaacatcattt

SEQ ID NO: 9048287 - DNA, 22 bp, Homo sapiens
atatttataagcaagcaggact

SEQ ID NO: 9048288 - DNA, 22 bp, Homo sapiens
atatttataaggcaggcaagta

SEQ ID NO: 9048289 - DNA, 22 bp, Homo sapiens
atatttataaggcaggcaagta

SEQ ID NO: 9048290 - DNA, 22 bp, Homo sapiens
atatttataagcaagcaggact

SEQ ID NO: 9048291 - DNA, 22 bp, Homo sapiens
atatttataagcaagcaggact

SEQ ID NO: 9048292 - DNA, 22 bp, Homo sapiens
actttcaattcactgagatata

SEQ ID NO: 9048293 - DNA, 22 bp, Homo sapiens
actttcaattcactgagatata

SEQ ID NO: 9048294 - DNA, 22 bp, Homo sapiens
actttcaagccctctagagaca

SEQ ID NO: 9048295 - DNA, 22 bp, Homo sapiens
actttcaaatatcatgattcta

SEQ ID NO: 9048296 - DNA, 22 bp, Homo sapiens
actttcatggatctctgttcag

SEQ ID NO: 9048297 - DNA, 22 bp, Homo sapiens
actttcatggtagttgtattct

SEQ ID NO: 9048298 - DNA, 22 bp, Homo sapiens
actttctattcccacagagata

SEQ ID NO: 9048299 - DNA, 22 bp, Homo sapiens
actttctaggtctcagtccttt

SEQ ID NO: 9048300 - DNA, 22 bp, Homo sapiens
actttctaggtgctattgtgat

SEQ ID NO: 9048301 - DNA, 22 bp, Homo sapiens
actttctatggcttattatgag

SEQ ID NO: 9048302 - DNA, 22 bp, Homo sapiens
actttccttatggatggggaaa

SEQ ID NO: 9048303 - DNA, 22 bp, Homo sapiens
actttctaaaattgctagcact

SEQ ID NO: 9048304 - DNA, 22 bp, Homo sapiens
actttcctgccaaggccagagt

SEQ ID NO: 9048305 - DNA, 22 bp, Homo sapiens
actttcctggccctgtcctctg

SEQ ID NO: 9048306 - DNA, 22 bp, Homo sapiens
actttcctagacttcagtgaca

SEQ ID NO: 9048307 - DNA, 22 bp, Homo sapiens
atatgaaagtaagcatgtgtgt

SEQ ID NO: 9048308 - DNA, 22 bp, Homo sapiens
atatgcttacagcttaaaatcc

SEQ ID NO: 9048309 - DNA, 22 bp, Homo sapiens
atatgcttgactctttcacatc

SEQ ID NO: 9048310 - DNA, 22 bp, Homo sapiens
agaaagggtcactgaaagagga

SEQ ID NO: 9048311 - DNA, 22 bp, Homo sapiens
agaaagggttctctgaggtgct

SEQ ID NO: 9048312 - DNA, 22 bp, Homo sapiens
agaacagcaggaaggccaggta

SEQ ID NO: 9048313 - DNA, 22 bp, Homo sapiens
agaacagcctatagtggccttt

SEQ ID NO: 9048314 - DNA, 22 bp, Homo sapiens
atcgtaaagccctatggcttca

SEQ ID NO: 9048315 - DNA, 22 bp, Homo sapiens
atctcaaacatctttgaccata

SEQ ID NO: 9048316 - DNA, 22 bp, Homo sapiens
atcctttcatctggtaatatat

SEQ ID NO: 9048317 - DNA, 22 bp, Homo sapiens
atcatcctagaaggaagctagg

SEQ ID NO: 9048318 - DNA, 22 bp, Homo sapiens
atcatctgcctcatcactgcat

SEQ ID NO: 9048319 - DNA, 22 bp, Homo sapiens
atcatctgtctccttgtatgtt

SEQ ID NO: 9048320 - DNA, 22 bp, Homo sapiens
agtaaaatttctgctgaggaga

SEQ ID NO: 9048321 - DNA, 22 bp, Homo sapiens
agtaaaacagagaaatcactca

SEQ ID NO: 9048322 - DNA, 22 bp, Homo sapiens
actagaatgcaggattggtctc

SEQ ID NO: 9048323 - DNA, 22 bp, Homo sapiens
actagacatcgagctacagagt

SEQ ID NO: 9048324 - DNA, 22 bp, Homo sapiens
actagcagtcagcggttggcaa

SEQ ID NO: 9048325 - DNA, 22 bp, Homo sapiens
actagcagaaactgatcatggc

SEQ ID NO: 9048326 - DNA, 22 bp, Homo sapiens
agtaaacagaaagcaagatgat

SEQ ID NO: 9048327 - DNA, 22 bp, Homo sapiens
agtcaacacattaaacctaggg

SEQ ID NO: 9048328 - DNA, 22 bp, Homo sapiens
agtccaggcgggtatagaggct

SEQ ID NO: 9048329 - DNA, 22 bp, Homo sapiens
agtattttcgccatcacaagaa

SEQ ID NO: 9048330 - DNA, 22 bp, Homo sapiens
agtcaaaacatgtactttcctt

SEQ ID NO: 9048331 - DNA, 22 bp, Homo sapiens
agtatttcttctgagcccaagg

SEQ ID NO: 9048332 - DNA, 21 bp, Homo sapiens
agtatttcttcatgtccttgc

SEQ ID NO: 9048333 - DNA, 22 bp, Homo sapiens
agtatttcttcatatgattact

SEQ ID NO: 9048334 - DNA, 22 bp, Homo sapiens
actaggaattcaagtagacaga

SEQ ID NO: 9048335 - DNA, 22 bp, Homo sapiens
acctgaatttgaaatgtttatt

SEQ ID NO: 9048336 - DNA, 22 bp, Homo sapiens
acctgaattgtcatatcttatt

SEQ ID NO: 9048337 - DNA, 22 bp, Homo sapiens
acctgaaaccaacttgtgtact

SEQ ID NO: 9048338 - DNA, 22 bp, Homo sapiens
acctgaaactcaactttatctc

SEQ ID NO: 9048339 - DNA, 22 bp, Homo sapiens
acctgaaaattattatttccgc

SEQ ID NO: 9048340 - DNA, 22 bp, Homo sapiens
acctcccttgctaaagactgtg

SEQ ID NO: 9048341 - DNA, 22 bp, Homo sapiens
accctccaggctgcagctcctg

SEQ ID NO: 9048342 - DNA, 22 bp, Homo sapiens
acctgagagctataaggtttta

SEQ ID NO: 9048343 - DNA, 22 bp, Homo sapiens
acctgcagtggccactcctaat

SEQ ID NO: 9048344 - DNA, 19 bp, Homo sapiens
acctgcagtaataattcct

SEQ ID NO: 9048345 - DNA, 22 bp, Homo sapiens
acctgcaggtgtttccacactt

SEQ ID NO: 9048346 - DNA, 22 bp, Homo sapiens
acctgcaggggtgctctctggg

SEQ ID NO: 9048347 - DNA, 22 bp, Homo sapiens
acctgcagctaaagatgtaggg

SEQ ID NO: 9048348 - DNA, 22 bp, Homo sapiens
acctgcagccacttctctcctt

SEQ ID NO: 9048349 - DNA, 22 bp, Homo sapiens
acctgcagctgagaaaatgact

SEQ ID NO: 9048350 - DNA, 22 bp, Homo sapiens
acctgcaggcacaggtgtgcgc

SEQ ID NO: 9048351 - DNA, 20 bp, Homo sapiens
acctgccacagagaaaggta

SEQ ID NO: 9048352 - DNA, 21 bp, Homo sapiens
acctgccacattgcagacttg

SEQ ID NO: 9048353 - DNA, 22 bp, Homo sapiens
acctgccagaatccaagccaca

SEQ ID NO: 9048354 - DNA, 22 bp, Homo sapiens
acctgccaagcatcagtggcag

SEQ ID NO: 9048355 - DNA, 22 bp, Homo sapiens
acctgccagaatgctagtcctg

SEQ ID NO: 9048356 - DNA, 22 bp, Homo sapiens
acctgccagctgagaagggtgt

SEQ ID NO: 9048357 - DNA, 22 bp, Homo sapiens
acctgccagtgaatactatctt

SEQ ID NO: 9048358 - DNA, 19 bp, Homo sapiens
acctgccatgacagcctga

SEQ ID NO: 9048359 - DNA, 22 bp, Homo sapiens
aggtccagttgccagaatggcc

SEQ ID NO: 9048360 - DNA, 20 bp, Homo sapiens
acctggctctcaggagcaac

SEQ ID NO: 9048361 - DNA, 22 bp, Homo sapiens
aggtccagttttcagttctcat

SEQ ID NO: 9048362 - DNA, 22 bp, Homo sapiens
agtgtttaatgccttttccagc

SEQ ID NO: 9048363 - DNA, 22 bp, Homo sapiens
agtgttggaccgaggtggagcc

SEQ ID NO: 9048364 - DNA, 23 bp, Homo sapiens
agtgttggttgggaagccaagca

SEQ ID NO: 9048365 - DNA, 22 bp, Homo sapiens
agtgttggagtcttggctgcag

SEQ ID NO: 9048366 - DNA, 22 bp, Homo sapiens
agtgttgggtctttagaattta

SEQ ID NO: 9048367 - DNA, 22 bp, Homo sapiens
agtgttcttcttcaaagctctg

SEQ ID NO: 9048368 - DNA, 22 bp, Homo sapiens
actggaaattgagaggtcactg

SEQ ID NO: 9048369 - DNA, 22 bp, Homo sapiens
agtggcagtagatgagctggtt

SEQ ID NO: 9048370 - DNA, 22 bp, Homo sapiens
actgcagaggtggggtgcagag

SEQ ID NO: 9048371 - DNA, 22 bp, Homo sapiens
actgcagaggtggggtgcagag

SEQ ID NO: 9048372 - DNA, 22 bp, Homo sapiens
agtctttacatgtgttatatat

SEQ ID NO: 9048373 - DNA, 22 bp, Homo sapiens
agtcttctgggtgtttccagag

SEQ ID NO: 9048374 - DNA, 22 bp, Homo sapiens
agtcttctttcatttactcagt

SEQ ID NO: 9048375 - DNA, 22 bp, Homo sapiens
agtcttcttgatcttttcagtg

SEQ ID NO: 9048376 - DNA, 22 bp, Homo sapiens
agtcttctttgtgttctctcat

SEQ ID NO: 9048377 - DNA, 22 bp, Homo sapiens
agtcttctttcatttactcagt

SEQ ID NO: 9048378 - DNA, 22 bp, Homo sapiens
actcctgggttgcagtcctcaa

SEQ ID NO: 9048379 - DNA, 22 bp, Homo sapiens
actctgtgaagatgcaggcttg

SEQ ID NO: 9048380 - DNA, 22 bp, Homo sapiens
actcttactccctcaggcactg

SEQ ID NO: 9048381 - DNA, 22 bp, Homo sapiens
actcttcagtacaataatatct

SEQ ID NO: 9048382 - DNA, 22 bp, Homo sapiens
actcttcaccgctactgaaata

SEQ ID NO: 9048383 - DNA, 22 bp, Homo sapiens
cagaggagttcagtacacagcc

SEQ ID NO: 9048384 - DNA, 22 bp, Homo sapiens
agccacccattcccgagcccta

SEQ ID NO: 9048385 - DNA, 22 bp, Homo sapiens
cagaaatatgtgccatgcctta

SEQ ID NO: 9048386 - DNA, 22 bp, Homo sapiens
cagaaatattccaagtactgca

SEQ ID NO: 9048387 - DNA, 22 bp, Homo sapiens
cagaaatattccaagtactgca

SEQ ID NO: 9048388 - DNA, 22 bp, Homo sapiens
cagaaatatcacctggactcta

SEQ ID NO: 9048389 - DNA, 22 bp, Homo sapiens
cagaaatatcagttgaaagtgc

SEQ ID NO: 9048390 - DNA, 22 bp, Homo sapiens
cagaaatatcagttgaaagtgc

SEQ ID NO: 9048391 - DNA, 22 bp, Homo sapiens
cagaaatatatatgggtcagag

SEQ ID NO: 9048392 - DNA, 22 bp, Homo sapiens
cagcagggcccccgggtgcgcc

SEQ ID NO: 9048393 - DNA, 22 bp, Homo sapiens
cagcagggcccccgggtgcgcc

SEQ ID NO: 9048394 - DNA, 22 bp, Homo sapiens
cagcaggatatggtggagagag

SEQ ID NO: 9048395 - DNA, 22 bp, Homo sapiens
agcctggcactgccccatccat

SEQ ID NO: 9048396 - DNA, 22 bp, Homo sapiens
agcctggcactgccccatccat

SEQ ID NO: 9048397 - DNA, 20 bp, Homo sapiens
agcctggcaaacacccccag

SEQ ID NO: 9048398 - DNA, 23 bp, Homo sapiens
agcctggcacctgcagatcggag

SEQ ID NO: 9048399 - DNA, 22 bp, Homo sapiens
agcctggcactgaggcagggcg

SEQ ID NO: 9048400 - DNA, 23 bp, Homo sapiens
agcctcttttctcctgccctgca

SEQ ID NO: 9048401 - DNA, 22 bp, Homo sapiens
cagcagcattgctctggattcc

SEQ ID NO: 9048402 - DNA, 22 bp, Homo sapiens
agcctctgtagaaagcagtgtg

SEQ ID NO: 9048403 - DNA, 22 bp, Homo sapiens
agcctctgtcaagcttttcaaa

SEQ ID NO: 9048404 - DNA, 22 bp, Homo sapiens
agcctctgcacgggcacgggtg

SEQ ID NO: 9048405 - DNA, 22 bp, Homo sapiens
agcctctgcttatgcaaaggta

SEQ ID NO: 9048406 - DNA, 22 bp, Homo sapiens
agctcagccctcctgtgcagct

SEQ ID NO: 9048407 - DNA, 22 bp, Homo sapiens
cagctcaggaaggaaggccggc

SEQ ID NO: 9048408 - DNA, 22 bp, Homo sapiens
agctcctgatacatgcaggaat

SEQ ID NO: 9048409 - DNA, 22 bp, Homo sapiens
cagctctgacacagtacaaaat

SEQ ID NO: 9048410 - DNA, 19 bp, Homo sapiens
cagctcagtttgattctct

SEQ ID NO: 9048411 - DNA, 22 bp, Homo sapiens
cagctcagtctggagagatgca

SEQ ID NO: 9048412 - DNA, 22 bp, Homo sapiens
cagcagggtatacagggaattt

SEQ ID NO: 9048413 - DNA, 22 bp, Homo sapiens
cagcatattactttaaaaaatc

SEQ ID NO: 9048414 - DNA, 23 bp, Homo sapiens
cagccctgaaatcgaggtgacac

SEQ ID NO: 9048415 - DNA, 22 bp, Homo sapiens
cagccctgagcaaggcttttaa

SEQ ID NO: 9048416 - DNA, 16 bp, Homo sapiens
cagccctgaggaagaa

SEQ ID NO: 9048417 - DNA, 22 bp, Homo sapiens
cagccctgcagagggcgctcct

SEQ ID NO: 9048418 - DNA, 22 bp, Homo sapiens
cagccctgcacgctgcctccgc

SEQ ID NO: 9048419 - DNA, 22 bp, Homo sapiens
cacacactggagcaaggagatg

SEQ ID NO: 9048420 - DNA, 22 bp, Homo sapiens
cacacactgttaatgtaggagt

SEQ ID NO: 9048421 - DNA, 22 bp, Homo sapiens
cacacacagttttgtattctgt

SEQ ID NO: 9048422 - DNA, 22 bp, Homo sapiens
cacacactcttcctggcaccta

SEQ ID NO: 9048423 - DNA, 22 bp, Homo sapiens
cacacactgacaccttatcttg

SEQ ID NO: 9048424 - DNA, 22 bp, Homo sapiens
agcaggagtttgatgcttttat

SEQ ID NO: 9048425 - DNA, 17 bp, Homo sapiens
agcaggcacgtcagcac

SEQ ID NO: 9048426 - DNA, 22 bp, Homo sapiens
agcagctgatcaaagcacttat

SEQ ID NO: 9048427 - DNA, 22 bp, Homo sapiens
cacacaattatgtgtgcacaat

SEQ ID NO: 9048428 - DNA, 22 bp, Homo sapiens
cacaattttcctttaagtgtat

SEQ ID NO: 9048429 - DNA, 22 bp, Homo sapiens
cacacaaatattctggaggcaa

SEQ ID NO: 9048430 - DNA, 22 bp, Homo sapiens
cacaatttttcttaggtcctgg

SEQ ID NO: 9048431 - DNA, 22 bp, Homo sapiens
cacaattttcctttaagtgtat

SEQ ID NO: 9048432 - DNA, 22 bp, Homo sapiens
cacagtgtttgatttaggggcc

SEQ ID NO: 9048433 - DNA, 22 bp, Homo sapiens
agcaggcaggaaggcagcactg

SEQ ID NO: 9048434 - DNA, 22 bp, Homo sapiens
cacagttcctgaatatatcaca

SEQ ID NO: 9048435 - DNA, 22 bp, Homo sapiens
cacagtttctgaacactttgca

SEQ ID NO: 9048436 - DNA, 22 bp, Homo sapiens
cacagtttggttttgctgtaat

SEQ ID NO: 9048437 - DNA, 22 bp, Homo sapiens
cacagtttggtatagaagtgat

SEQ ID NO: 9048438 - DNA, 22 bp, Homo sapiens
agcaggggcagggttttgtgct

SEQ ID NO: 9048439 - DNA, 22 bp, Homo sapiens
agcaggggctcctccacagcca

SEQ ID NO: 9048440 - DNA, 22 bp, Homo sapiens
agcaggggctcctccacagcca

SEQ ID NO: 9048441 - DNA, 22 bp, Homo sapiens
agcagggggagttagactagat

SEQ ID NO: 9048442 - DNA, 22 bp, Homo sapiens
agcagggggcatccttgccctt

SEQ ID NO: 9048443 - DNA, 22 bp, Homo sapiens
agcagggggcatccttgccctt

SEQ ID NO: 9048444 - DNA, 22 bp, Homo sapiens
agcagggggagttagactagat

SEQ ID NO: 9048445 - DNA, 22 bp, Homo sapiens
agcagggggccacagtcacagc

SEQ ID NO: 9048446 - DNA, 22 bp, Homo sapiens
agcaggggtaacagaaggaaag

SEQ ID NO: 9048447 - DNA, 22 bp, Homo sapiens
agcaggggtggaaggtagcttt

SEQ ID NO: 9048448 - DNA, 22 bp, Homo sapiens
agcaggggtctctgctaatgaa

SEQ ID NO: 9048449 - DNA, 22 bp, Homo sapiens
agcaggggtctctgctaatgaa

SEQ ID NO: 9048450 - DNA, 22 bp, Homo sapiens
cacctgaatggaactttgaacc

SEQ ID NO: 9048451 - DNA, 22 bp, Homo sapiens
cacctgaagatttagagattga

SEQ ID NO: 9048452 - DNA, 22 bp, Homo sapiens
cactgcacttcagcctgggtga

SEQ ID NO: 9048453 - DNA, 22 bp, Homo sapiens
cacctctttgatttgaggcaag

SEQ ID NO: 9048454 - DNA, 22 bp, Homo sapiens
agcatacaggtctgaaacagct

SEQ ID NO: 9048455 - DNA, 22 bp, Homo sapiens
agcatacaccctaaactgctta

SEQ ID NO: 9048456 - DNA, 22 bp, Homo sapiens
caagcagagactagatagctgt

SEQ ID NO: 9048457 - DNA, 22 bp, Homo sapiens
caagcactgtggcactcgcagg

SEQ ID NO: 9048458 - DNA, 22 bp, Homo sapiens
caagcactgtggcactcgcagg

SEQ ID NO: 9048459 - DNA, 22 bp, Homo sapiens
agcagccaaccttacattcatc

SEQ ID NO: 9048460 - DNA, 22 bp, Homo sapiens
cacaagagagtgcgcgttgcaa

SEQ ID NO: 9048461 - DNA, 20 bp, Homo sapiens
cacaagaggagttccctgag

SEQ ID NO: 9048462 - DNA, 20 bp, Homo sapiens
cacaagagaatacacactgg

SEQ ID NO: 9048463 - DNA, 22 bp, Homo sapiens
cacaagacttatttgtgtagaa

SEQ ID NO: 9048464 - DNA, 22 bp, Homo sapiens
cacaagaaataagctgcctttc

SEQ ID NO: 9048465 - DNA, 22 bp, Homo sapiens
cacaagaaataagctgcctttc

SEQ ID NO: 9048466 - DNA, 22 bp, Homo sapiens
caatttttgtacttatagtact

SEQ ID NO: 9048467 - DNA, 21 bp, Homo sapiens
agcagcagggaagcctcatcc

SEQ ID NO: 9048468 - DNA, 22 bp, Homo sapiens
agcaaagaaatggaggctcaga

SEQ ID NO: 9048469 - DNA, 22 bp, Homo sapiens
agcaaagaagggttcttcatta

SEQ ID NO: 9048470 - DNA, 22 bp, Homo sapiens
agcaaagaagacacaggcttca

SEQ ID NO: 9048471 - DNA, 22 bp, Homo sapiens
agcaaagatgtccggggcaagc

SEQ ID NO: 9048472 - DNA, 22 bp, Homo sapiens
agcaaagagtaattttgttttg

SEQ ID NO: 9048473 - DNA, 22 bp, Homo sapiens
agcaaagaagggttcttcatta

SEQ ID NO: 9048474 - DNA, 22 bp, Homo sapiens
agcaaagacagggacgaccaag

SEQ ID NO: 9048475 - DNA, 22 bp, Homo sapiens
caaaagtctgtcctttaacttc

SEQ ID NO: 9048476 - DNA, 22 bp, Homo sapiens
caaaagtcttcctattctctta

SEQ ID NO: 9048477 - DNA, 22 bp, Homo sapiens
caaaagtctgtcctttaacttc

SEQ ID NO: 9048478 - DNA, 22 bp, Homo sapiens
caaatagattgttcaatcctga

SEQ ID NO: 9048479 - DNA, 22 bp, Homo sapiens
agcacatgcacagtgctacact

SEQ ID NO: 9048480 - DNA, 22 bp, Homo sapiens
caaattaatgtgtctcaaaata

SEQ ID NO: 9048481 - DNA, 22 bp, Homo sapiens
caaattaccctcaacatctaga

SEQ ID NO: 9048482 - DNA, 22 bp, Homo sapiens
caacacttcttatacttactga

SEQ ID NO: 9048483 - DNA, 22 bp, Homo sapiens
caacagaaggtgtactactgaa

SEQ ID NO: 9048484 - DNA, 22 bp, Homo sapiens
caaatagtttttcatgtattat

SEQ ID NO: 9048485 - DNA, 22 bp, Homo sapiens
caaatattccaggtacatccct

SEQ ID NO: 9048486 - DNA, 22 bp, Homo sapiens
caagacaatgggtaagtgtaac

SEQ ID NO: 9048487 - DNA, 22 bp, Homo sapiens
caagacaatgggtaagtgtaac

SEQ ID NO: 9048488 - DNA, 22 bp, Homo sapiens
agagcctgggcagctcctctgg

SEQ ID NO: 9048489 - DNA, 22 bp, Homo sapiens
agagcctgggaatttgcatgtt

SEQ ID NO: 9048490 - DNA, 22 bp, Homo sapiens
atgtatttgcttgttatggatt

SEQ ID NO: 9048491 - DNA, 22 bp, Homo sapiens
agagcctgtgattgtcatcacc

SEQ ID NO: 9048492 - DNA, 22 bp, Homo sapiens
agagcctgtaacatctttctta

SEQ ID NO: 9048493 - DNA, 22 bp, Homo sapiens
agagcctgtcaattgtaaagag

SEQ ID NO: 9048494 - DNA, 22 bp, Homo sapiens
agagcctgtctgcctttctacc

SEQ ID NO: 9048495 - DNA, 22 bp, Homo sapiens
agagcctgtacttttctgtgaa

SEQ ID NO: 9048496 - DNA, 22 bp, Homo sapiens
atgggtgagtatgagttgactt

SEQ ID NO: 9048497 - DNA, 22 bp, Homo sapiens
agagatggccttaggtgggaat

SEQ ID NO: 9048498 - DNA, 22 bp, Homo sapiens
agagatggccttaggtgggaat

SEQ ID NO: 9048499 - DNA, 22 bp, Homo sapiens
agagatggagagcactggggct

SEQ ID NO: 9048500 - DNA, 22 bp, Homo sapiens
agaccaaagaaaacacatctgg

SEQ ID NO: 9048501 - DNA, 22 bp, Homo sapiens
agaccagaccagagtttactat

SEQ ID NO: 9048502 - DNA, 22 bp, Homo sapiens
agaccacttggataagaaacag

SEQ ID NO: 9048503 - DNA, 22 bp, Homo sapiens
agaccatggccatcctaggaaa

SEQ ID NO: 9048504 - DNA, 22 bp, Homo sapiens
agaccatgggctctgaagagca

SEQ ID NO: 9048505 - DNA, 22 bp, Homo sapiens
atggccagccactcctgatggc

SEQ ID NO: 9048506 - DNA, 22 bp, Homo sapiens
agagaagagcaatgataaattt

SEQ ID NO: 9048507 - DNA, 21 bp, Homo sapiens
agagaagaggactttctcaca

SEQ ID NO: 9048508 - DNA, 22 bp, Homo sapiens
agagaagacttacagccacagt

SEQ ID NO: 9048509 - DNA, 22 bp, Homo sapiens
agagaagacttacagccacagt

SEQ ID NO: 9048510 - DNA, 22 bp, Homo sapiens
atggccagggtggcactgtggt

SEQ ID NO: 9048511 - DNA, 22 bp, Homo sapiens
atggccagtcaagcctctggct

SEQ ID NO: 9048512 - DNA, 17 bp, Homo sapiens
atggctcacctgtgggc

SEQ ID NO: 9048513 - DNA, 22 bp, Homo sapiens
agagatgaagggcattccccag

SEQ ID NO: 9048514 - DNA, 22 bp, Homo sapiens
atggctcagcccatggaagaaa

SEQ ID NO: 9048515 - DNA, 22 bp, Homo sapiens
agagacctttgttattctagga

SEQ ID NO: 9048516 - DNA, 22 bp, Homo sapiens
agagaccttttgccttctagtt

SEQ ID NO: 9048517 - DNA, 23 bp, Homo sapiens
agagactataagttatgttctgt

SEQ ID NO: 9048518 - DNA, 21 bp, Homo sapiens
agagacagagaaagtaacatt

SEQ ID NO: 9048519 - DNA, 22 bp, Homo sapiens
agagaaggaaagctgacatggg

SEQ ID NO: 9048520 - DNA, 22 bp, Homo sapiens
agagaagagtcttgtcaaatta

SEQ ID NO: 9048521 - DNA, 22 bp, Homo sapiens
agagaagattcttatatgtctt

SEQ ID NO: 9048522 - DNA, 22 bp, Homo sapiens
agagaccaagggaatagtctca

SEQ ID NO: 9048523 - DNA, 22 bp, Homo sapiens
agagacatgcagttgttgtgaa

SEQ ID NO: 9048524 - DNA, 19 bp, Homo sapiens
agagaccacagagctgcct

SEQ ID NO: 9048525 - DNA, 22 bp, Homo sapiens
agaaggcttaaaacatggaata

SEQ ID NO: 9048526 - DNA, 22 bp, Homo sapiens
atctcagatctacagatctaca

SEQ ID NO: 9048527 - DNA, 22 bp, Homo sapiens
atctcagagaaatttgaatgca

SEQ ID NO: 9048528 - DNA, 22 bp, Homo sapiens
atctcagaaacatatctaatcc

SEQ ID NO: 9048529 - DNA, 23 bp, Homo sapiens
agaagtggaatggccgtggggtc

SEQ ID NO: 9048530 - DNA, 21 bp, Homo sapiens
agaagtcaattgaactgaaat

SEQ ID NO: 9048531 - DNA, 22 bp, Homo sapiens
agaagtttggtcctataaactc

SEQ ID NO: 9048532 - DNA, 22 bp, Homo sapiens
atgaaacatgctttgtggatga

SEQ ID NO: 9048533 - DNA, 22 bp, Homo sapiens
atgaaactaaactacataagtt

SEQ ID NO: 9048534 - DNA, 22 bp, Homo sapiens
atgaaacatgctttgtggatga

SEQ ID NO: 9048535 - DNA, 22 bp, Homo sapiens
agacaaaggattaatgatgatg

SEQ ID NO: 9048536 - DNA, 18 bp, Homo sapiens
agaattgctgcttcttct

SEQ ID NO: 9048537 - DNA, 22 bp, Homo sapiens
atgaaattgatcttgaactttt

SEQ ID NO: 9048538 - DNA, 22 bp, Homo sapiens
atgaaatttgctgctaagttcc

SEQ ID NO: 9048539 - DNA, 22 bp, Homo sapiens
atgaaagcaacttatttgagat

SEQ ID NO: 9048540 - DNA, 22 bp, Homo sapiens
atgaaagatgatttaaagtact

SEQ ID NO: 9048541 - DNA, 22 bp, Homo sapiens
atgaaagatgatttaaagtact

SEQ ID NO: 9048542 - DNA, 22 bp, Homo sapiens
atgaaagatgatttaaagtact

SEQ ID NO: 9048543 - DNA, 22 bp, Homo sapiens
atgacaagggttgacacatgtc

SEQ ID NO: 9048544 - DNA, 22 bp, Homo sapiens
atgacaagggttgacacatgtc

SEQ ID NO: 9048545 - DNA, 22 bp, Homo sapiens
atgcacataggccaaatcattt

SEQ ID NO: 9048546 - DNA, 20 bp, Homo sapiens
atgcacatacgcatgcacat

SEQ ID NO: 9048547 - DNA, 22 bp, Homo sapiens
atgacaaacccaggatgtaaca

SEQ ID NO: 9048548 - DNA, 22 bp, Homo sapiens
atgacaaattcagaccatagca

SEQ ID NO: 9048549 - DNA, 22 bp, Homo sapiens
atgacaaaggctgaaagggaaa

SEQ ID NO: 9048550 - DNA, 17 bp, Homo sapiens
agacagacctctgcatc

SEQ ID NO: 9048551 - DNA, 17 bp, Homo sapiens
atgcacatgtaagagga

SEQ ID NO: 9048552 - DNA, 22 bp, Homo sapiens
atgcacatgtatgtcaatattt

SEQ ID NO: 9048553 - DNA, 22 bp, Homo sapiens
atgcacattgtagccacacaat

SEQ ID NO: 9048554 - DNA, 22 bp, Homo sapiens
atgcactgggtgaggaaggaga

SEQ ID NO: 9048555 - DNA, 22 bp, Homo sapiens
agacagctctgggttccacact

SEQ ID NO: 9048556 - DNA, 22 bp, Homo sapiens
agacagctccaagtgtctctgt

SEQ ID NO: 9048557 - DNA, 22 bp, Homo sapiens
agacagctagggctgcagggac

SEQ ID NO: 9048558 - DNA, 22 bp, Homo sapiens
agacagcatgatacatgatgct

SEQ ID NO: 9048559 - DNA, 23 bp, Homo sapiens
agacagcttagagtttgcctctc

SEQ ID NO: 9048560 - DNA, 22 bp, Homo sapiens
agacagctgttccttcatgttt

SEQ ID NO: 9048561 - DNA, 22 bp, Homo sapiens
agacagctgctcgcagagctat

SEQ ID NO: 9048562 - DNA, 22 bp, Homo sapiens
agacagctgggagtgtccttct

SEQ ID NO: 9048563 - DNA, 22 bp, Homo sapiens
agacagctggtagcacttcctg

SEQ ID NO: 9048564 - DNA, 22 bp, Homo sapiens
agacatattggcttgctttaat

SEQ ID NO: 9048565 - DNA, 22 bp, Homo sapiens
attattatggttgctcttttcc

SEQ ID NO: 9048566 - DNA, 22 bp, Homo sapiens
attattattgttgatgttaggg

SEQ ID NO: 9048567 - DNA, 22 bp, Homo sapiens
attattattttagagagaggcc

SEQ ID NO: 9048568 - DNA, 21 bp, Homo sapiens
attattatttctgtgtccagc

SEQ ID NO: 9048569 - DNA, 22 bp, Homo sapiens
attattataaagtgcatgacct

SEQ ID NO: 9048570 - DNA, 22 bp, Homo sapiens
attattatatagggaaagtccc

SEQ ID NO: 9048571 - DNA, 21 bp, Homo sapiens
attattataaagaccacaggg

SEQ ID NO: 9048572 - DNA, 22 bp, Homo sapiens
attattaaagcttaggtcttat

SEQ ID NO: 9048573 - DNA, 23 bp, Homo sapiens
attattaaggacatggactttgt

SEQ ID NO: 9048574 - DNA, 22 bp, Homo sapiens
agaggagaatccgtttccttgc

SEQ ID NO: 9048575 - DNA, 22 bp, Homo sapiens
agaggagaatccgtttccttgc

SEQ ID NO: 9048576 - DNA, 22 bp, Homo sapiens
atgtttatggagcaggtattag

SEQ ID NO: 9048577 - DNA, 22 bp, Homo sapiens
atgtttatgcaaacatgtgagt

SEQ ID NO: 9048578 - DNA, 22 bp, Homo sapiens
atgtttatgacctccataagga

SEQ ID NO: 9048579 - DNA, 22 bp, Homo sapiens
agagctgtttattgatgtcaca

SEQ ID NO: 9048580 - DNA, 22 bp, Homo sapiens
attccagtccaaatgttttcct

SEQ ID NO: 9048581 - DNA, 22 bp, Homo sapiens
attccagttgggttctaataca

SEQ ID NO: 9048582 - DNA, 22 bp, Homo sapiens
attccagttctcctctctaaag

SEQ ID NO: 9048583 - DNA, 22 bp, Homo sapiens
attgcagggtccctgccatcgg

SEQ ID NO: 9048584 - DNA, 22 bp, Homo sapiens
attgcaggttgcatttgtttat

SEQ ID NO: 9048585 - DNA, 22 bp, Homo sapiens
attgcaggttgtagcccattag

SEQ ID NO: 9048586 - DNA, 22 bp, Homo sapiens
attgcaggccagtgtcctgggc

SEQ ID NO: 9048587 - DNA, 22 bp, Homo sapiens
attgcaggatacccaggtagag

SEQ ID NO: 9048588 - DNA, 22 bp, Homo sapiens
attgcaggctctgacaccaggc

SEQ ID NO: 9048589 - DNA, 22 bp, Homo sapiens
attgcagggactcaataagaat

SEQ ID NO: 9048590 - DNA, 22 bp, Homo sapiens
attgcagggaggcaggtagatg

SEQ ID NO: 9048591 - DNA, 22 bp, Homo sapiens
attgcaggcaaagtgctgtgtc

SEQ ID NO: 9048592 - DNA, 22 bp, Homo sapiens
attcatttgctattgtgtatgg

SEQ ID NO: 9048593 - DNA, 22 bp, Homo sapiens
attcatttagagggattaagca

SEQ ID NO: 9048594 - DNA, 22 bp, Homo sapiens
attcatttaggtattcacttac

SEQ ID NO: 9048595 - DNA, 22 bp, Homo sapiens
attcatttaggtattcacttac

SEQ ID NO: 9048596 - DNA, 22 bp, Homo sapiens
attcagtagaagttagctatta

SEQ ID NO: 9048597 - DNA, 22 bp, Homo sapiens
attcagtaggtctagaataaga

SEQ ID NO: 9048598 - DNA, 22 bp, Homo sapiens
attcatgtagtgattgagtcac

SEQ ID NO: 9048599 - DNA, 22 bp, Homo sapiens
attcatgtaaaattggatagac

SEQ ID NO: 9048600 - DNA, 22 bp, Homo sapiens
attcatgtaacattagagaaat

SEQ ID NO: 9048601 - DNA, 20 bp, Homo sapiens
attcatgtctttataaaagc

SEQ ID NO: 9048602 - DNA, 22 bp, Homo sapiens
attcatgttagcccacatgtag

SEQ ID NO: 9048603 - DNA, 22 bp, Homo sapiens
agaggcagcagtcatactacag

SEQ ID NO: 9048604 - DNA, 22 bp, Homo sapiens
agataaacccaacttaatgaag

SEQ ID NO: 9048605 - DNA, 22 bp, Homo sapiens
agataaaatggttcaaaggcta

SEQ ID NO: 9048606 - DNA, 22 bp, Homo sapiens
atttcacagcgtggttgactgc

SEQ ID NO: 9048607 - DNA, 21 bp, Homo sapiens
atttcacaccctcctttttct

SEQ ID NO: 9048608 - DNA, 22 bp, Homo sapiens
atttcacaaagaacagatgcag

SEQ ID NO: 9048609 - DNA, 22 bp, Homo sapiens
atttcacattaatttgatgctc

SEQ ID NO: 9048610 - DNA, 22 bp, Homo sapiens
atttcacatctatctcagattt

SEQ ID NO: 9048611 - DNA, 22 bp, Homo sapiens
atttcacatctatctcagattt

SEQ ID NO: 9048612 - DNA, 22 bp, Homo sapiens
atttcacattaatttgatgctc

SEQ ID NO: 9048613 - DNA, 22 bp, Homo sapiens
atttcacagctgctgttcaggt

SEQ ID NO: 9048614 - DNA, 22 bp, Homo sapiens
atttcacagctgctgttcaggt

SEQ ID NO: 9048615 - DNA, 22 bp, Homo sapiens
atttcacaggccagtggtgggg

SEQ ID NO: 9048616 - DNA, 22 bp, Homo sapiens
atttcacagctgtcagtgttac

SEQ ID NO: 9048617 - DNA, 22 bp, Homo sapiens
agagtgggtgatctctgttgtc

SEQ ID NO: 9048618 - DNA, 22 bp, Homo sapiens
agagtttcttgtgagcactgac

SEQ ID NO: 9048619 - DNA, 19 bp, Homo sapiens
agagtttaggtctatcagg

SEQ ID NO: 9048620 - DNA, 22 bp, Homo sapiens
agagtttacagaaataagctgt

SEQ ID NO: 9048621 - DNA, 22 bp, Homo sapiens
agagttggccaaaaggggcatt

SEQ ID NO: 9048622 - DNA, 22 bp, Homo sapiens
attgcattgtttgaggcagagg

SEQ ID NO: 9048623 - DNA, 22 bp, Homo sapiens
attgctctaatgtgggcagttt

SEQ ID NO: 9048624 - DNA, 22 bp, Homo sapiens
attgctctctatgtgtcggaca

SEQ ID NO: 9048625 - DNA, 22 bp, Homo sapiens
attgctctgcaatcctccccaa

SEQ ID NO: 9048626 - DNA, 17 bp, Homo sapiens
attgctctggggatttt

SEQ ID NO: 9048627 - DNA, 22 bp, Homo sapiens
attgctcttgcttagggaggca

SEQ ID NO: 9048628 - DNA, 21 bp, Homo sapiens
attgctctgttgtgtctagaa

SEQ ID NO: 9048629 - DNA, 22 bp, Homo sapiens
atttgttgttgctcccctaaga

SEQ ID NO: 9048630 - DNA, 22 bp, Homo sapiens
atttgttgaataaattagtatt

SEQ ID NO: 9048631 - DNA, 22 bp, Homo sapiens
caaaagtaatgtatgctcatcg

SEQ ID NO: 9048632 - DNA, 18 bp, Homo sapiens
atttggcagatgatgaac

SEQ ID NO: 9048633 - DNA, 22 bp, Homo sapiens
atttggcatagagtatcattct

SEQ ID NO: 9048634 - DNA, 20 bp, Homo sapiens
atttggcatagtttaagcaa

SEQ ID NO: 9048635 - DNA, 22 bp, Homo sapiens
atttggcaaaaattagcagtag

SEQ ID NO: 9048636 - DNA, 17 bp, Homo sapiens
atttgtgatgtaacgtc

SEQ ID NO: 9048637 - DNA, 21 bp, Homo sapiens
atttggatattgctggcaaat

SEQ ID NO: 9048638 - DNA, 22 bp, Homo sapiens
atttggatatcactgaatacat

SEQ ID NO: 9048639 - DNA, 22 bp, Homo sapiens
atttggatgcactaaataaaat

SEQ ID NO: 9048640 - DNA, 22 bp, Homo sapiens
atttggattcttatttagcact

SEQ ID NO: 9048641 - DNA, 22 bp, Homo sapiens
atttggatgaacaatggaaaaa

SEQ ID NO: 9048642 - DNA, 22 bp, Homo sapiens
atttggatgcactaaataaaat

SEQ ID NO: 9048643 - DNA, 22 bp, Homo sapiens
atttctcattttgcttcaaagg

SEQ ID NO: 9048644 - DNA, 22 bp, Homo sapiens
atttctctcattgttagctagg

SEQ ID NO: 9048645 - DNA, 22 bp, Homo sapiens
atttctcatctttgtgaatggt

SEQ ID NO: 9048646 - DNA, 22 bp, Homo sapiens
atttccttcagtgtttaatact

SEQ ID NO: 9048647 - DNA, 22 bp, Homo sapiens
gcattgcaggtgtacccagtta

SEQ ID NO: 9048648 - DNA, 22 bp, Homo sapiens
gcattgcaactgacagatcatt

SEQ ID NO: 9048649 - DNA, 22 bp, Homo sapiens
gcatttaaatttgaacttcaga

SEQ ID NO: 9048650 - DNA, 22 bp, Homo sapiens
gcatttaaatttgaacttcaga

SEQ ID NO: 9048651 - DNA, 22 bp, Homo sapiens
gcatttaaatttgaacttcaga

SEQ ID NO: 9048652 - DNA, 21 bp, Homo sapiens
gccacccctggcacaggtgct

SEQ ID NO: 9048653 - DNA, 22 bp, Homo sapiens
gcatttatttctttactgcatc

SEQ ID NO: 9048654 - DNA, 22 bp, Homo sapiens
gccacctctttgtctctgccgc

SEQ ID NO: 9048655 - DNA, 21 bp, Homo sapiens
gcagtttatgtaatatgcact

SEQ ID NO: 9048656 - DNA, 22 bp, Homo sapiens
gcattcttgtttttcctaccct

SEQ ID NO: 9048657 - DNA, 22 bp, Homo sapiens
gcattcttggtggagtgctaaa

SEQ ID NO: 9048658 - DNA, 22 bp, Homo sapiens
gcattctttagactgagagata

SEQ ID NO: 9048659 - DNA, 21 bp, Homo sapiens
gcattcttcatgtgattcaga

SEQ ID NO: 9048660 - DNA, 22 bp, Homo sapiens
gcattcttcgaagtaagtagtg

SEQ ID NO: 9048661 - DNA, 22 bp, Homo sapiens
gcattgaaatggcaaaaagaga

SEQ ID NO: 9048662 - DNA, 22 bp, Homo sapiens
gcagtgttttacagaccagcat

SEQ ID NO: 9048663 - DNA, 22 bp, Homo sapiens
gcagtgtttttcaatgcttcca

SEQ ID NO: 9048664 - DNA, 22 bp, Homo sapiens
gcagtgtttgtgttctcacatg

SEQ ID NO: 9048665 - DNA, 22 bp, Homo sapiens
gcagtgttgttaaaagattaga

SEQ ID NO: 9048666 - DNA, 22 bp, Homo sapiens
gcagtgttgtgatccaggtctt

SEQ ID NO: 9048667 - DNA, 22 bp, Homo sapiens
gcagtgtttacatattagaaac

SEQ ID NO: 9048668 - DNA, 22 bp, Homo sapiens
gcagtgtttcaaatcaaaggca

SEQ ID NO: 9048669 - DNA, 23 bp, Homo sapiens
gcagtgtttgcttcatcttatcc

SEQ ID NO: 9048670 - DNA, 22 bp, Homo sapiens
gcagtgtttggatccatagcga

SEQ ID NO: 9048671 - DNA, 22 bp, Homo sapiens
gcagtgtttcagtgctttttct

SEQ ID NO: 9048672 - DNA, 22 bp, Homo sapiens
gcagtgtttcccagagatggaa

SEQ ID NO: 9048673 - DNA, 22 bp, Homo sapiens
gcaggtgattcaccctgggcct

SEQ ID NO: 9048674 - DNA, 22 bp, Homo sapiens
gcagtgttggtttgctctgcag

SEQ ID NO: 9048675 - DNA, 22 bp, Homo sapiens
gcagtgttggcaggatggggct

SEQ ID NO: 9048676 - DNA, 22 bp, Homo sapiens
gcccaagccgccttccagagac

SEQ ID NO: 9048677 - DNA, 18 bp, Homo sapiens
gccaggaagaggaatgtg

SEQ ID NO: 9048678 - DNA, 22 bp, Homo sapiens
gccaggaacacaatgccaagct

SEQ ID NO: 9048679 - DNA, 22 bp, Homo sapiens
gccaggaatgcataaatgacct

SEQ ID NO: 9048680 - DNA, 22 bp, Homo sapiens
gccacttgtgtaagcgcctgtc

SEQ ID NO: 9048681 - DNA, 22 bp, Homo sapiens
gcctgcagtgagtgcagaaggt

SEQ ID NO: 9048682 - DNA, 20 bp, Homo sapiens
gcctgcaggttggatgggat

SEQ ID NO: 9048683 - DNA, 22 bp, Homo sapiens
gcctgcagggcctgggcctacc

SEQ ID NO: 9048684 - DNA, 22 bp, Homo sapiens
gcctgcagggtgatgggctgcc

SEQ ID NO: 9048685 - DNA, 22 bp, Homo sapiens
gcctgcagtgagtgcagaaggt

SEQ ID NO: 9048686 - DNA, 21 bp, Homo sapiens
gcctgcagttttgaagccctt

SEQ ID NO: 9048687 - DNA, 22 bp, Homo sapiens
gcctgcagttctgtgctaggca

SEQ ID NO: 9048688 - DNA, 22 bp, Homo sapiens
gcctggagaagatggaactagc

SEQ ID NO: 9048689 - DNA, 22 bp, Homo sapiens
gcctggagaggaagccggtgga

SEQ ID NO: 9048690 - DNA, 22 bp, Homo sapiens
gcctggagcagacgtgtcccgg

SEQ ID NO: 9048691 - DNA, 22 bp, Homo sapiens
gcctggagacctgctcctctac

SEQ ID NO: 9048692 - DNA, 22 bp, Homo sapiens
gcctggagagcactgtgcgctt

SEQ ID NO: 9048693 - DNA, 22 bp, Homo sapiens
gcctggagtggacttggcccct

SEQ ID NO: 9048694 - DNA, 16 bp, Homo sapiens
gcctggagtggcaggg

SEQ ID NO: 9048695 - DNA, 22 bp, Homo sapiens
gcctggagtagcatggcaagcc

SEQ ID NO: 9048696 - DNA, 22 bp, Homo sapiens
gcctggagcccagtgtggggct

SEQ ID NO: 9048697 - DNA, 22 bp, Homo sapiens
gcctgcagaggtgctgctagct

SEQ ID NO: 9048698 - DNA, 20 bp, Homo sapiens
gcctgcagagaaggtcagag

SEQ ID NO: 9048699 - DNA, 22 bp, Homo sapiens
gcctgcagaactgtgaggcaat

SEQ ID NO: 9048700 - DNA, 22 bp, Homo sapiens
gcctgcagcccctctgcagtag

SEQ ID NO: 9048701 - DNA, 22 bp, Homo sapiens
gcctgcagcctcaagggctgag

SEQ ID NO: 9048702 - DNA, 22 bp, Homo sapiens
gcctgcagatatataggatggt

SEQ ID NO: 9048703 - DNA, 22 bp, Homo sapiens
gcctgcagcatgctaggtcttg

SEQ ID NO: 9048704 - DNA, 22 bp, Homo sapiens
gcctgcagccagggagttctct

SEQ ID NO: 9048705 - DNA, 22 bp, Homo sapiens
gcctgcagatatataggatggt

SEQ ID NO: 9048706 - DNA, 17 bp, Homo sapiens
gcctgcaggcccgcaga

SEQ ID NO: 9048707 - DNA, 22 bp, Homo sapiens
gcctgcagggcccttgtgggtc

SEQ ID NO: 9048708 - DNA, 22 bp, Homo sapiens
gcctgcagctgcttccacacac

SEQ ID NO: 9048709 - DNA, 22 bp, Homo sapiens
gcctgcagctgcttccacacac

SEQ ID NO: 9048710 - DNA, 18 bp, Homo sapiens
gcctgcaggcacgggggt

SEQ ID NO: 9048711 - DNA, 22 bp, Homo sapiens
gcctccctggcccacagcagcg

SEQ ID NO: 9048712 - DNA, 22 bp, Homo sapiens
gcctccctgtagaggccagcct

SEQ ID NO: 9048713 - DNA, 22 bp, Homo sapiens
gcccacacaccagctcaggagg

SEQ ID NO: 9048714 - DNA, 22 bp, Homo sapiens
gcccacaccatttattctttgt

SEQ ID NO: 9048715 - DNA, 22 bp, Homo sapiens
gcccacacagcagatcctttgg

SEQ ID NO: 9048716 - DNA, 22 bp, Homo sapiens
gcccctctccttgtgcacctgc

SEQ ID NO: 9048717 - DNA, 22 bp, Homo sapiens
gcccctcccagtcaggagcact

SEQ ID NO: 9048718 - DNA, 22 bp, Homo sapiens
gcccctccatccatcaccgggg

SEQ ID NO: 9048719 - DNA, 22 bp, Homo sapiens
gccccttccatcatgtgaggac

SEQ ID NO: 9048720 - DNA, 22 bp, Homo sapiens
gccccttcgtggaagtgcattc

SEQ ID NO: 9048721 - DNA, 22 bp, Homo sapiens
gccccttgtctccaggccccaa

SEQ ID NO: 9048722 - DNA, 22 bp, Homo sapiens
gcccgcgccagcctctccatct

SEQ ID NO: 9048723 - DNA, 22 bp, Homo sapiens
gcctcagtgatatgtgggacaa

SEQ ID NO: 9048724 - DNA, 22 bp, Homo sapiens
gcctcagtctcccgagtagctg

SEQ ID NO: 9048725 - DNA, 20 bp, Homo sapiens
gcctcagtcacatggcctac

SEQ ID NO: 9048726 - DNA, 22 bp, Homo sapiens
gcctcagtaaccttaggggata

SEQ ID NO: 9048727 - DNA, 22 bp, Homo sapiens
gcctcagtggctttaggagttc

SEQ ID NO: 9048728 - DNA, 22 bp, Homo sapiens
gcctcagttgatctgtgtgagc

SEQ ID NO: 9048729 - DNA, 22 bp, Homo sapiens
gcctcagtgtcctcctccatgt

SEQ ID NO: 9048730 - DNA, 22 bp, Homo sapiens
gcctcagtttatacacctgtaa

SEQ ID NO: 9048731 - DNA, 18 bp, Homo sapiens
gcctcagtttcctcacct

SEQ ID NO: 9048732 - DNA, 23 bp, Homo sapiens
gccctgctactcacaagctgtgt

SEQ ID NO: 9048733 - DNA, 22 bp, Homo sapiens
gcaggtctcaatctgagcaggc

SEQ ID NO: 9048734 - DNA, 22 bp, Homo sapiens
gcaggtcccagaaagttaattc

SEQ ID NO: 9048735 - DNA, 22 bp, Homo sapiens
gcaggcagtttgcttttccctc

SEQ ID NO: 9048736 - DNA, 22 bp, Homo sapiens
gcaggcagttgcagttttctag

SEQ ID NO: 9048737 - DNA, 22 bp, Homo sapiens
gcagctgtaaagcagaaatagt

SEQ ID NO: 9048738 - DNA, 22 bp, Homo sapiens
gcagcacatataaacaaagaga

SEQ ID NO: 9048739 - DNA, 22 bp, Homo sapiens
gcagcaatcttcacagtgtcat

SEQ ID NO: 9048740 - DNA, 19 bp, Homo sapiens
gcagcaatagaagacaaat

SEQ ID NO: 9048741 - DNA, 22 bp, Homo sapiens
gcagccagaagactcagaacaa

SEQ ID NO: 9048742 - DNA, 22 bp, Homo sapiens
gcagacacttgaggtgggcttt

SEQ ID NO: 9048743 - DNA, 22 bp, Homo sapiens
gcagacacttttattctgcata

SEQ ID NO: 9048744 - DNA, 22 bp, Homo sapiens
gcagacacatccactcctacag

SEQ ID NO: 9048745 - DNA, 18 bp, Homo sapiens
gcagacactcgtggaggg

SEQ ID NO: 9048746 - DNA, 22 bp, Homo sapiens
gcagacacttcccactgcagcg

SEQ ID NO: 9048747 - DNA, 22 bp, Homo sapiens
gcagacagggctacagaggtac

SEQ ID NO: 9048748 - DNA, 22 bp, Homo sapiens
gcagagtcccagcaggtggtgg

SEQ ID NO: 9048749 - DNA, 22 bp, Homo sapiens
gcagagtgagccgaggctgctc

SEQ ID NO: 9048750 - DNA, 22 bp, Homo sapiens
gcagagtgaggaagagcttcca

SEQ ID NO: 9048751 - DNA, 22 bp, Homo sapiens
gcagagtgggagcccagggctg

SEQ ID NO: 9048752 - DNA, 22 bp, Homo sapiens
gagtagacattaaattacactg

SEQ ID NO: 9048753 - DNA, 22 bp, Homo sapiens
gcaaggagactgtagggccaag

SEQ ID NO: 9048754 - DNA, 22 bp, Homo sapiens
gcaaggagcacctttctggaac

SEQ ID NO: 9048755 - DNA, 22 bp, Homo sapiens
gcaaggagcctggaggtgagtg

SEQ ID NO: 9048756 - DNA, 22 bp, Homo sapiens
gcaaggaggctggtggaggaag

SEQ ID NO: 9048757 - DNA, 22 bp, Homo sapiens
gcaatacagtaagagtactgta

SEQ ID NO: 9048758 - DNA, 22 bp, Homo sapiens
gcaatacagaagagtggcaagg

SEQ ID NO: 9048759 - DNA, 22 bp, Homo sapiens
gcaatacagtaggtttattggt

SEQ ID NO: 9048760 - DNA, 22 bp, Homo sapiens
gcacatttaactgagctcagga

SEQ ID NO: 9048761 - DNA, 22 bp, Homo sapiens
gcacagactcaccttaatttga

SEQ ID NO: 9048762 - DNA, 22 bp, Homo sapiens
gcacagacccaccatctatagt

SEQ ID NO: 9048763 - DNA, 22 bp, Homo sapiens
gcacagactgtatcttaatcat

SEQ ID NO: 9048764 - DNA, 22 bp, Homo sapiens
gcaatacagttgaagagattga

SEQ ID NO: 9048765 - DNA, 22 bp, Homo sapiens
gctggaggtggtgagaaaaggt

SEQ ID NO: 9048766 - DNA, 22 bp, Homo sapiens
gctgctgcttgaaggctcggag

SEQ ID NO: 9048767 - DNA, 22 bp, Homo sapiens
gctgctgggatcctgggtctca

SEQ ID NO: 9048768 - DNA, 19 bp, Homo sapiens
gctgctggctctggctgga

SEQ ID NO: 9048769 - DNA, 22 bp, Homo sapiens
gctggaggggtaataggatggg

SEQ ID NO: 9048770 - DNA, 18 bp, Homo sapiens
gctgctggtggagggagc

SEQ ID NO: 9048771 - DNA, 22 bp, Homo sapiens
gctgcctctgcacagctcactc

SEQ ID NO: 9048772 - DNA, 22 bp, Homo sapiens
gctgcctcccccatggctggaa

SEQ ID NO: 9048773 - DNA, 22 bp, Homo sapiens
gctgcaggctgtggcaggggag

SEQ ID NO: 9048774 - DNA, 22 bp, Homo sapiens
gctgcagggaatgtatggattt

SEQ ID NO: 9048775 - DNA, 22 bp, Homo sapiens
gctgcaggctctgcaggaattg

SEQ ID NO: 9048776 - DNA, 22 bp, Homo sapiens
gctgcaggcggccgtggtggcg

SEQ ID NO: 9048777 - DNA, 22 bp, Homo sapiens
gctgcaggggggtctggacttg

SEQ ID NO: 9048778 - DNA, 21 bp, Homo sapiens
gctgcagggcccagggcaccc

SEQ ID NO: 9048779 - DNA, 22 bp, Homo sapiens
gctgcagggctctcacaggggg

SEQ ID NO: 9048780 - DNA, 22 bp, Homo sapiens
gctgcagggagctggaaggctc

SEQ ID NO: 9048781 - DNA, 22 bp, Homo sapiens
gctgcagggagctggaaggctc

SEQ ID NO: 9048782 - DNA, 21 bp, Homo sapiens
gctgcagggcccagggcaccc

SEQ ID NO: 9048783 - DNA, 22 bp, Homo sapiens
gctgcaggcgcctgcggtctct

SEQ ID NO: 9048784 - DNA, 18 bp, Homo sapiens
gctgcaggcgcctgcggt

SEQ ID NO: 9048785 - DNA, 22 bp, Homo sapiens
gctgcaggcattttcctgggca

SEQ ID NO: 9048786 - DNA, 18 bp, Homo sapiens
gctgcaggccctccgagg

SEQ ID NO: 9048787 - DNA, 22 bp, Homo sapiens
gctgagtcttgcctgtgctgtc

SEQ ID NO: 9048788 - DNA, 22 bp, Homo sapiens
gctgaggtttcaggagtggcag

SEQ ID NO: 9048789 - DNA, 22 bp, Homo sapiens
gctctgtccagcgtgcacagaa

SEQ ID NO: 9048790 - DNA, 20 bp, Homo sapiens
gctctgtctggcctactttt

SEQ ID NO: 9048791 - DNA, 22 bp, Homo sapiens
gctctgggtagccactgcctgg

SEQ ID NO: 9048792 - DNA, 22 bp, Homo sapiens
gctctcccgcagcctggtgggc

SEQ ID NO: 9048793 - DNA, 22 bp, Homo sapiens
gctcagtgtggtcctcagatgt

SEQ ID NO: 9048794 - DNA, 18 bp, Homo sapiens
gctcagtgtgttaacact

SEQ ID NO: 9048795 - DNA, 22 bp, Homo sapiens
gctcagtggtattcggaaactg

SEQ ID NO: 9048796 - DNA, 22 bp, Homo sapiens
gctcagtgtgcacgagtactct

SEQ ID NO: 9048797 - DNA, 22 bp, Homo sapiens
gctcagtgtgttcaagggctca

SEQ ID NO: 9048798 - DNA, 22 bp, Homo sapiens
gctcagtgttcatctgtatgca

SEQ ID NO: 9048799 - DNA, 22 bp, Homo sapiens
gctcagtgtttctggtagaaaa

SEQ ID NO: 9048800 - DNA, 19 bp, Homo sapiens
gctcagtgatgccagacca

SEQ ID NO: 9048801 - DNA, 22 bp, Homo sapiens
gctcagtgcagcctttctgtat

SEQ ID NO: 9048802 - DNA, 20 bp, Homo sapiens
gctcagtggagaaatgcacc

SEQ ID NO: 9048803 - DNA, 22 bp, Homo sapiens
gctcagtgcatcattccaggct

SEQ ID NO: 9048804 - DNA, 22 bp, Homo sapiens
gctcagtgagatattgactcca

SEQ ID NO: 9048805 - DNA, 22 bp, Homo sapiens
gctcagtgaatttttgcccatg

SEQ ID NO: 9048806 - DNA, 22 bp, Homo sapiens
gctcagtgaagggtgccaagta

SEQ ID NO: 9048807 - DNA, 22 bp, Homo sapiens
gctagaaatcgacttcagaatt

SEQ ID NO: 9048808 - DNA, 22 bp, Homo sapiens
gctagaaactgtttaatctctt

SEQ ID NO: 9048809 - DNA, 22 bp, Homo sapiens
gcctggagtggtcctgctgccc

SEQ ID NO: 9048810 - DNA, 22 bp, Homo sapiens
gcctggagttcagccaagtccc

SEQ ID NO: 9048811 - DNA, 22 bp, Homo sapiens
gcctggagttcagccaagtccc

SEQ ID NO: 9048812 - DNA, 18 bp, Homo sapiens
ggacaggagacatgggtg

SEQ ID NO: 9048813 - DNA, 22 bp, Homo sapiens
ggacaggataagagacactgcc

SEQ ID NO: 9048814 - DNA, 22 bp, Homo sapiens
ggacaggagtgaggcgggttcc

SEQ ID NO: 9048815 - DNA, 22 bp, Homo sapiens
ggacaggatgctgaagatgaag

SEQ ID NO: 9048816 - DNA, 22 bp, Homo sapiens
ggaaggaggggcaaagcagttc

SEQ ID NO: 9048817 - DNA, 22 bp, Homo sapiens
ggaaggagtctttaacacccat

SEQ ID NO: 9048818 - DNA, 18 bp, Homo sapiens
ggaaggagtggaccccag

SEQ ID NO: 9048819 - DNA, 22 bp, Homo sapiens
ggaaggatctggctgaaatcca

SEQ ID NO: 9048820 - DNA, 22 bp, Homo sapiens
ggaaggaggatgctctggcctt

SEQ ID NO: 9048821 - DNA, 22 bp, Homo sapiens
ggaaggagccatatcatatcca

SEQ ID NO: 9048822 - DNA, 22 bp, Homo sapiens
ggaaggagggcggcaatgatga

SEQ ID NO: 9048823 - DNA, 22 bp, Homo sapiens
ggaaaaacagtctttattattt

SEQ ID NO: 9048824 - DNA, 22 bp, Homo sapiens
ggaaaaatgacacatatctcaa

SEQ ID NO: 9048825 - DNA, 19 bp, Homo sapiens
ggaaggagagaaatgcatg

SEQ ID NO: 9048826 - DNA, 22 bp, Homo sapiens
ggaaggagcatttgccagttta

SEQ ID NO: 9048827 - DNA, 22 bp, Homo sapiens
ggacaggatgctgaagatgaag

SEQ ID NO: 9048828 - DNA, 22 bp, Homo sapiens
ggactttagctgtaatgtgtgt

SEQ ID NO: 9048829 - DNA, 22 bp, Homo sapiens
ggagaaaattgatgaagttggc

SEQ ID NO: 9048830 - DNA, 22 bp, Homo sapiens
ggagaaagctgtagtggaatgt

SEQ ID NO: 9048831 - DNA, 22 bp, Homo sapiens
ggactgggtcactaagatagta

SEQ ID NO: 9048832 - DNA, 20 bp, Homo sapiens
ggagctgccctgggctggag

SEQ ID NO: 9048833 - DNA, 22 bp, Homo sapiens
ggagctgttggcagctatcttg

SEQ ID NO: 9048834 - DNA, 19 bp, Homo sapiens
ggagcttggtggctgtggc

SEQ ID NO: 9048835 - DNA, 22 bp, Homo sapiens
ggagctgtgttatccattccca

SEQ ID NO: 9048836 - DNA, 22 bp, Homo sapiens
ggagaagaggagctggaagcct

SEQ ID NO: 9048837 - DNA, 22 bp, Homo sapiens
ggagccaggcaatctgtacttt

SEQ ID NO: 9048838 - DNA, 22 bp, Homo sapiens
ggagccaggggaccttcacaga

SEQ ID NO: 9048839 - DNA, 22 bp, Homo sapiens
ggagccaggcatatcggggcac

SEQ ID NO: 9048840 - DNA, 22 bp, Homo sapiens
ggagccagtgccctctggtgga

SEQ ID NO: 9048841 - DNA, 22 bp, Homo sapiens
ggagcctggcaatgctgcgtcc

SEQ ID NO: 9048842 - DNA, 22 bp, Homo sapiens
gctttaaacctctactctgtcc

SEQ ID NO: 9048843 - DNA, 22 bp, Homo sapiens
gctttaatgaagtcacgcaaag

SEQ ID NO: 9048844 - DNA, 22 bp, Homo sapiens
gcttttggacctctgatgtttc

SEQ ID NO: 9048845 - DNA, 22 bp, Homo sapiens
gcttttgtggctgtcttcattg

SEQ ID NO: 9048846 - DNA, 22 bp, Homo sapiens
gcttttgtgagctctcactttg

SEQ ID NO: 9048847 - DNA, 22 bp, Homo sapiens
gcttttatttcttcacaaaagt

SEQ ID NO: 9048848 - DNA, 22 bp, Homo sapiens
gctgtctggaggctctgaggga

SEQ ID NO: 9048849 - DNA, 22 bp, Homo sapiens
gctgtctgctgtgcactgagca

SEQ ID NO: 9048850 - DNA, 23 bp, Homo sapiens
gctgtctgtcatctctgcgggag

SEQ ID NO: 9048851 - DNA, 22 bp, Homo sapiens
gctgtctgtcttcacatctcgc

SEQ ID NO: 9048852 - DNA, 22 bp, Homo sapiens
gctgtcccgaacccctggtaat

SEQ ID NO: 9048853 - DNA, 22 bp, Homo sapiens
ggtccccgtggaggctggagcg

SEQ ID NO: 9048854 - DNA, 22 bp, Homo sapiens
ggtcccaggattggttgcgcag

SEQ ID NO: 9048855 - DNA, 22 bp, Homo sapiens
ggtcccaggctccctcttgtcc

SEQ ID NO: 9048856 - DNA, 18 bp, Homo sapiens
ggtgagggagctggaagc

SEQ ID NO: 9048857 - DNA, 22 bp, Homo sapiens
ggtgacagcgggtcaagaggag

SEQ ID NO: 9048858 - DNA, 19 bp, Homo sapiens
gtaatgcatctgtgtatga

SEQ ID NO: 9048859 - DNA, 22 bp, Homo sapiens
gtaatgcatttattttatgaaa

SEQ ID NO: 9048860 - DNA, 22 bp, Homo sapiens
ggtggggattcctgatcactgt

SEQ ID NO: 9048861 - DNA, 22 bp, Homo sapiens
ggtgggcgactgagaggggttt

SEQ ID NO: 9048862 - DNA, 22 bp, Homo sapiens
ggtggagagctggatgagaggt

SEQ ID NO: 9048863 - DNA, 22 bp, Homo sapiens
ggggtggatttcaggcggtgtc

SEQ ID NO: 9048864 - DNA, 22 bp, Homo sapiens
ggggtgagtgctcagccccgga

SEQ ID NO: 9048865 - DNA, 22 bp, Homo sapiens
ggggccaggtccagcttccaaa

SEQ ID NO: 9048866 - DNA, 22 bp, Homo sapiens
ggggccagcttcgcgtgctctt

SEQ ID NO: 9048867 - DNA, 22 bp, Homo sapiens
gggtgcagcagagctcctctgt

SEQ ID NO: 9048868 - DNA, 22 bp, Homo sapiens
gggtgaggcccatttgaggcca

SEQ ID NO: 9048869 - DNA, 22 bp, Homo sapiens
gggtggagccagttgactctgt

SEQ ID NO: 9048870 - DNA, 21 bp, Homo sapiens
gggtggggttccagccttttc

SEQ ID NO: 9048871 - DNA, 22 bp, Homo sapiens
gggctgtgtgcccacttcccat

SEQ ID NO: 9048872 - DNA, 22 bp, Homo sapiens
ggggaggaagctggaacacggg

SEQ ID NO: 9048873 - DNA, 22 bp, Homo sapiens
ggggagaattacatggcgtgga

SEQ ID NO: 9048874 - DNA, 19 bp, Homo sapiens
ggggagaactagagacagc

SEQ ID NO: 9048875 - DNA, 22 bp, Homo sapiens
ggggatctaggcttatgagggc

SEQ ID NO: 9048876 - DNA, 22 bp, Homo sapiens
ggggatctaggatatttcatga

SEQ ID NO: 9048877 - DNA, 22 bp, Homo sapiens
gtctttttctacgatagcgcct

SEQ ID NO: 9048878 - DNA, 22 bp, Homo sapiens
gtctttttattatagagtggag

SEQ ID NO: 9048879 - DNA, 22 bp, Homo sapiens
gtcttttttacaccttacatca

SEQ ID NO: 9048880 - DNA, 22 bp, Homo sapiens
gtctttttgtctggcagaggtc

SEQ ID NO: 9048881 - DNA, 22 bp, Homo sapiens
gtcttttttacaccttacatca

SEQ ID NO: 9048882 - DNA, 22 bp, Homo sapiens
gtgaaaaatgatttgttaactg

SEQ ID NO: 9048883 - DNA, 21 bp, Homo sapiens
gtcttttaagtgaagagaggc

SEQ ID NO: 9048884 - DNA, 21 bp, Homo sapiens
gtctttttaattgcgatttcc

SEQ ID NO: 9048885 - DNA, 22 bp, Homo sapiens
gtgagcatgtagtaatctggag

SEQ ID NO: 9048886 - DNA, 22 bp, Homo sapiens
gtgagcatatatgtaatcgttt

SEQ ID NO: 9048887 - DNA, 22 bp, Homo sapiens
gtgagccgagtatagttcatag

SEQ ID NO: 9048888 - DNA, 17 bp, Homo sapiens
gtgagctgagtcaggac

SEQ ID NO: 9048889 - DNA, 22 bp, Homo sapiens
gtgagctggaatagtggagaaa

SEQ ID NO: 9048890 - DNA, 22 bp, Homo sapiens
gtgagctgttggagtggcagag

SEQ ID NO: 9048891 - DNA, 20 bp, Homo sapiens
gtctacacgggcagtgtaga

SEQ ID NO: 9048892 - DNA, 22 bp, Homo sapiens
gtctacactgaatttccacaga

SEQ ID NO: 9048893 - DNA, 22 bp, Homo sapiens
gtctatatattgcttgaataat

SEQ ID NO: 9048894 - DNA, 22 bp, Homo sapiens
gtctatgatattttgttatagc

SEQ ID NO: 9048895 - DNA, 22 bp, Homo sapiens
gtctttattacaaatccttttc

SEQ ID NO: 9048896 - DNA, 22 bp, Homo sapiens
gtctttagagctcctggcatct

SEQ ID NO: 9048897 - DNA, 22 bp, Homo sapiens
gtctttagttgaaacatgtggt

SEQ ID NO: 9048898 - DNA, 22 bp, Homo sapiens
gtgcaggctagatccttcctac

SEQ ID NO: 9048899 - DNA, 22 bp, Homo sapiens
gtgcaggctctcgttcttgaca

SEQ ID NO: 9048900 - DNA, 22 bp, Homo sapiens
gtgcagggagcccagaaggtcc

SEQ ID NO: 9048901 - DNA, 22 bp, Homo sapiens
gtgcagggagcccagaaggtcc

SEQ ID NO: 9048902 - DNA, 22 bp, Homo sapiens
gtgcagggcagccgaatgggct

SEQ ID NO: 9048903 - DNA, 17 bp, Homo sapiens
gtgcagggatgaaggat

SEQ ID NO: 9048904 - DNA, 22 bp, Homo sapiens
gtgcagggccctcctaacatct

SEQ ID NO: 9048905 - DNA, 22 bp, Homo sapiens
gtgcagggcaggtgtccttcca

SEQ ID NO: 9048906 - DNA, 22 bp, Homo sapiens
gtgcagggctggcaccggaggc

SEQ ID NO: 9048907 - DNA, 22 bp, Homo sapiens
gtgcaggggatcaggttgcagc

SEQ ID NO: 9048908 - DNA, 22 bp, Homo sapiens
gtgcaggggcctccccttgctg

SEQ ID NO: 9048909 - DNA, 22 bp, Homo sapiens
gtgcagggtagcgacggcagga

SEQ ID NO: 9048910 - DNA, 22 bp, Homo sapiens
gtgccacttacctgggaggagt

SEQ ID NO: 9048911 - DNA, 22 bp, Homo sapiens
gtgcccagcagcagcgtccccg

SEQ ID NO: 9048912 - DNA, 22 bp, Homo sapiens
gtgcccagctccacctcacaga

SEQ ID NO: 9048913 - DNA, 22 bp, Homo sapiens
gtgctgattgggagctgggatt

SEQ ID NO: 9048914 - DNA, 22 bp, Homo sapiens
gtacaatagcagttttcccttt

SEQ ID NO: 9048915 - DNA, 22 bp, Homo sapiens
gtagtctgaacagtaattttgt

SEQ ID NO: 9048916 - DNA, 22 bp, Homo sapiens
gtacaaagtggacctgatagta

SEQ ID NO: 9048917 - DNA, 22 bp, Homo sapiens
gtacaaaggcagaattgggtag

SEQ ID NO: 9048918 - DNA, 22 bp, Homo sapiens
gtacaaattttgacatctagga

SEQ ID NO: 9048919 - DNA, 22 bp, Homo sapiens
gtacaacatgattttactctct

SEQ ID NO: 9048920 - DNA, 22 bp, Homo sapiens
gtacaagaggagaaaatggagt

SEQ ID NO: 9048921 - DNA, 23 bp, Homo sapiens
gtcaccataatccgttagaccag

SEQ ID NO: 9048922 - DNA, 16 bp, Homo sapiens
gtcaccatcatgtagt

SEQ ID NO: 9048923 - DNA, 22 bp, Homo sapiens
gtcaccatctacagctccaaac

SEQ ID NO: 9048924 - DNA, 22 bp, Homo sapiens
gtcaccatggataagaatcact

SEQ ID NO: 9048925 - DNA, 22 bp, Homo sapiens
gtcaccattgcccactccatgg

SEQ ID NO: 9048926 - DNA, 19 bp, Homo sapiens
gtcaccatttccaaatgcc

SEQ ID NO: 9048927 - DNA, 22 bp, Homo sapiens
gtatttttaggtaaggaaagta

SEQ ID NO: 9048928 - DNA, 22 bp, Homo sapiens
gtataaacatggagtgcattct

SEQ ID NO: 9048929 - DNA, 22 bp, Homo sapiens
gtataaagtataagcttgtttt

SEQ ID NO: 9048930 - DNA, 22 bp, Homo sapiens
gtattttatggcatgcagtggc

SEQ ID NO: 9048931 - DNA, 22 bp, Homo sapiens
gtattttatggcctggggccta

SEQ ID NO: 9048932 - DNA, 22 bp, Homo sapiens
gtcctctgggctttgagcagtc

SEQ ID NO: 9048933 - DNA, 22 bp, Homo sapiens
gtcctctggtgaaagcattccc

SEQ ID NO: 9048934 - DNA, 22 bp, Homo sapiens
gtcctctgtagggctgggccac

SEQ ID NO: 9048935 - DNA, 22 bp, Homo sapiens
gtcctctgtccctggggcacgg

SEQ ID NO: 9048936 - DNA, 22 bp, Homo sapiens
gtcctggaatcctagaacagtg

SEQ ID NO: 9048937 - DNA, 22 bp, Homo sapiens
gtccaggctaagtcccttctgc

SEQ ID NO: 9048938 - DNA, 22 bp, Homo sapiens
gtccaggccatggtggacacag

SEQ ID NO: 9048939 - DNA, 22 bp, Homo sapiens
gtccaggcctgcctctgaggag

SEQ ID NO: 9048940 - DNA, 22 bp, Homo sapiens
gtccaggccccagggattcttg

SEQ ID NO: 9048941 - DNA, 22 bp, Homo sapiens
gtccaggcacctcccttgtgct

SEQ ID NO: 9048942 - DNA, 22 bp, Homo sapiens
gtcctctgcttcatgccctgat

SEQ ID NO: 9048943 - DNA, 22 bp, Homo sapiens
gtcctctggaagatgagttctt

SEQ ID NO: 9048944 - DNA, 22 bp, Homo sapiens
gtcctctgggcagctgccccac

SEQ ID NO: 9048945 - DNA, 22 bp, Homo sapiens
gtcctctgggagccttgagcct

SEQ ID NO: 9048946 - DNA, 23 bp, Homo sapiens
gtcctctggagagaaaggcagta

SEQ ID NO: 9048947 - DNA, 22 bp, Homo sapiens
gtcctctggaggtttttaggtg

SEQ ID NO: 9048948 - DNA, 22 bp, Homo sapiens
gtcctctggcctttcccaggac

SEQ ID NO: 9048949 - DNA, 22 bp, Homo sapiens
gtccagctgcagctgggcagaa

SEQ ID NO: 9048950 - DNA, 22 bp, Homo sapiens
gtccagctccagggaggcaggc

SEQ ID NO: 9048951 - DNA, 22 bp, Homo sapiens
gtccagccctctgcctccaggt

SEQ ID NO: 9048952 - DNA, 22 bp, Homo sapiens
gtccagcccttgcagcttcttt

SEQ ID NO: 9048953 - DNA, 22 bp, Homo sapiens
gtccagcccctgactcccaggc

SEQ ID NO: 9048954 - DNA, 22 bp, Homo sapiens
gtccagccaggcctgtctctgg

SEQ ID NO: 9048955 - DNA, 21 bp, Homo sapiens
gtccagagagccggctcctga

SEQ ID NO: 9048956 - DNA, 22 bp, Homo sapiens
gtcactttaaagggttaacagg

SEQ ID NO: 9048957 - DNA, 22 bp, Homo sapiens
gtcactttggcctctacagcca

SEQ ID NO: 9048958 - DNA, 22 bp, Homo sapiens
ggcccagtgtgggtggatgttg

SEQ ID NO: 9048959 - DNA, 22 bp, Homo sapiens
ggcccagtgttgccagacctga

SEQ ID NO: 9048960 - DNA, 22 bp, Homo sapiens
ggcccagtgtaccccaggcagt

SEQ ID NO: 9048961 - DNA, 22 bp, Homo sapiens
ggcccagtctggggccctgtga

SEQ ID NO: 9048962 - DNA, 20 bp, Homo sapiens
ggcccagtgaaccaggacgg

SEQ ID NO: 9048963 - DNA, 22 bp, Homo sapiens
ggcccagcgaggccacctacag

SEQ ID NO: 9048964 - DNA, 22 bp, Homo sapiens
ggccacagtgggaaatcctggg

SEQ ID NO: 9048965 - DNA, 22 bp, Homo sapiens
ggccacagtctctggaaggatg

SEQ ID NO: 9048966 - DNA, 20 bp, Homo sapiens
ggccacagggtgctggtgga

SEQ ID NO: 9048967 - DNA, 22 bp, Homo sapiens
ggccacagagggcgggatgctg

SEQ ID NO: 9048968 - DNA, 22 bp, Homo sapiens
ggcagtgggaaataagtgagaa

SEQ ID NO: 9048969 - DNA, 22 bp, Homo sapiens
ggctcagaaacctctggtgtct

SEQ ID NO: 9048970 - DNA, 23 bp, Homo sapiens
ggctcagaaaaagtcctggcctc

SEQ ID NO: 9048971 - DNA, 22 bp, Homo sapiens
ggctctgcccgcggctgcccac

SEQ ID NO: 9048972 - DNA, 18 bp, Homo sapiens
ggcctctggactggcagc

SEQ ID NO: 9048973 - DNA, 22 bp, Homo sapiens
ggcctctctggcatggctgccc

SEQ ID NO: 9048974 - DNA, 22 bp, Homo sapiens
ggcctcatcacagtgcattagt

SEQ ID NO: 9048975 - DNA, 17 bp, Homo sapiens
ggcagtggaggaagaga

SEQ ID NO: 9048976 - DNA, 22 bp, Homo sapiens
ggcagtgagaggtctcctggtc

SEQ ID NO: 9048977 - DNA, 22 bp, Homo sapiens
ggcaggggtcctggtgttgact

SEQ ID NO: 9048978 - DNA, 22 bp, Homo sapiens
ggcaggggtcctggtgttgact

SEQ ID NO: 9048979 - DNA, 21 bp, Homo sapiens
ggcagcccgccctctcctggc

SEQ ID NO: 9048980 - DNA, 22 bp, Homo sapiens
ggcagctcactgattagcaatt

SEQ ID NO: 9048981 - DNA, 22 bp, Homo sapiens
ggcagctcacgggcatggggtg

SEQ ID NO: 9048982 - DNA, 22 bp, Homo sapiens
ggcagctcctctcagcaaaaga

SEQ ID NO: 9048983 - DNA, 22 bp, Homo sapiens
ggcagctcgatgacttctgcat

SEQ ID NO: 9048984 - DNA, 22 bp, Homo sapiens
ggcagctcctcaaaaaattaaa

SEQ ID NO: 9048985 - DNA, 22 bp, Homo sapiens
ggcaggcttgatatggggggac

SEQ ID NO: 9048986 - DNA, 22 bp, Homo sapiens
ggcaggcttggtggcaccggtt

SEQ ID NO: 9048987 - DNA, 22 bp, Homo sapiens
ggcaggctgttcacctgctttt

SEQ ID NO: 9048988 - DNA, 22 bp, Homo sapiens
ggcacctggatgtagcagtgaa

SEQ ID NO: 9048989 - DNA, 22 bp, Homo sapiens
ggcacctggtaagtgctcagta

SEQ ID NO: 9048990 - DNA, 22 bp, Homo sapiens
ggcagatggggtgacaagagag

SEQ ID NO: 9048991 - DNA, 23 bp, Homo sapiens
ggcactcggccgtgaactcgtgc

SEQ ID NO: 9048992 - DNA, 22 bp, Homo sapiens
gggataggtttggaagaggtgg

SEQ ID NO: 9048993 - DNA, 22 bp, Homo sapiens
gggagtgggtttggcctaggcc

SEQ ID NO: 9048994 - DNA, 22 bp, Homo sapiens
gggagtggttgatggtgaaaat

SEQ ID NO: 9048995 - DNA, 22 bp, Homo sapiens
gggagtaaactatggtgaggat

SEQ ID NO: 9048996 - DNA, 22 bp, Homo sapiens
gggagtggagagcaatggatga

SEQ ID NO: 9048997 - DNA, 21 bp, Homo sapiens
gggcagaggggcctcctgggt

SEQ ID NO: 9048998 - DNA, 17 bp, Homo sapiens
gggcagggactcctggg

SEQ ID NO: 9048999 - DNA, 22 bp, Homo sapiens
gggatccatccgtgcagcagag

SEQ ID NO: 9049000 - DNA, 22 bp, Homo sapiens
gggccctcagtcccaggccttc

SEQ ID NO: 9049001 - DNA, 22 bp, Homo sapiens
gggccctctgcagctgcccagg

SEQ ID NO: 9049002 - DNA, 22 bp, Homo sapiens
gggctcatggacagctctccag

SEQ ID NO: 9049003 - DNA, 22 bp, Homo sapiens
gggctcatgatgtaggctggta

SEQ ID NO: 9049004 - DNA, 22 bp, Homo sapiens
gggctccaacggtgagcatgga

SEQ ID NO: 9049005 - DNA, 22 bp, Homo sapiens
gggctccaaccccagtgaactc

SEQ ID NO: 9049006 - DNA, 22 bp, Homo sapiens
gggctccaacggtgagcatgga

SEQ ID NO: 9049007 - DNA, 22 bp, Homo sapiens
gggctccaaaatcctgtagcct

SEQ ID NO: 9049008 - DNA, 22 bp, Homo sapiens
gggctcattcatctgggcttgg

SEQ ID NO: 9049009 - DNA, 22 bp, Homo sapiens
gggctccaaagtaagctttagt

SEQ ID NO: 9049010 - DNA, 22 bp, Homo sapiens
gggctccaaaatctatgtcttc

SEQ ID NO: 9049011 - DNA, 22 bp, Homo sapiens
gggctccaaggaggccagcctg

SEQ ID NO: 9049012 - DNA, 22 bp, Homo sapiens
gggctccaaggaggccagcctg

SEQ ID NO: 9049013 - DNA, 22 bp, Homo sapiens
gggctccaactacatcagcctt

SEQ ID NO: 9049014 - DNA, 20 bp, Homo sapiens
ggctgcagtgcacctcatct

SEQ ID NO: 9049015 - DNA, 22 bp, Homo sapiens
ggctgcaggttggttggcagct

SEQ ID NO: 9049016 - DNA, 22 bp, Homo sapiens
ggctgcaggcttccctccagca

SEQ ID NO: 9049017 - DNA, 21 bp, Homo sapiens
ggctgcagggagccctggggt

SEQ ID NO: 9049018 - DNA, 19 bp, Homo sapiens
ggctgcctcctgggagatt

SEQ ID NO: 9049019 - DNA, 22 bp, Homo sapiens
ggctgcctcctcgagacaggat

SEQ ID NO: 9049020 - DNA, 22 bp, Homo sapiens
ggctgcagttgtgtgaaggccg

SEQ ID NO: 9049021 - DNA, 22 bp, Homo sapiens
ggctggcagaagtgtgctggct

SEQ ID NO: 9049022 - DNA, 22 bp, Homo sapiens
ggctgcctgctcaggtgcggcg

SEQ ID NO: 9049023 - DNA, 22 bp, Homo sapiens
ggctgcctctggaagctggaga

SEQ ID NO: 9049024 - DNA, 22 bp, Homo sapiens
ggctgtggcagctggaagtggt

SEQ ID NO: 9049025 - DNA, 22 bp, Homo sapiens
gggagccacagtgaggtgcatg

SEQ ID NO: 9049026 - DNA, 22 bp, Homo sapiens
gggagccacagtttatagtgat

SEQ ID NO: 9049027 - DNA, 22 bp, Homo sapiens
gggagccacagtagcagctact

SEQ ID NO: 9049028 - DNA, 22 bp, Homo sapiens
gggagccagccatccagaacct

SEQ ID NO: 9049029 - DNA, 22 bp, Homo sapiens
gggagccagcctttgcctataa

SEQ ID NO: 9049030 - DNA, 23 bp, Homo sapiens
gggagccaggacctcgcgcccca

SEQ ID NO: 9049031 - DNA, 23 bp, Homo sapiens
gggagccatgggtggtcatggag

SEQ ID NO: 9049032 - DNA, 23 bp, Homo sapiens
gggagccatgggtggtcatggag

SEQ ID NO: 9049033 - DNA, 22 bp, Homo sapiens
gggagccatgctggtcttcttt

SEQ ID NO: 9049034 - DNA, 22 bp, Homo sapiens
gggagccagcagggcatggagc

SEQ ID NO: 9049035 - DNA, 22 bp, Homo sapiens
gggagccagcagggcatggagc

SEQ ID NO: 9049036 - DNA, 22 bp, Homo sapiens
gggagccagagtcacctagaga

SEQ ID NO: 9049037 - DNA, 19 bp, Homo sapiens
gggagccagaccctttgct

SEQ ID NO: 9049038 - DNA, 22 bp, Homo sapiens
gggagccactcagctgagagtt

SEQ ID NO: 9049039 - DNA, 22 bp, Homo sapiens
gggagccactcagctgagagtt

SEQ ID NO: 9049040 - DNA, 22 bp, Homo sapiens
tatttcttgttattctcgttga

SEQ ID NO: 9049041 - DNA, 22 bp, Homo sapiens
tatttcttgttattctcgttga

SEQ ID NO: 9049042 - DNA, 22 bp, Homo sapiens
tatttgatagagataaatgata

SEQ ID NO: 9049043 - DNA, 22 bp, Homo sapiens
tatttgcaaagaactacactag

SEQ ID NO: 9049044 - DNA, 22 bp, Homo sapiens
tatttgatagagataaatgata

SEQ ID NO: 9049045 - DNA, 22 bp, Homo sapiens
tatttgatgaaggtaaagtctt

SEQ ID NO: 9049046 - DNA, 23 bp, Homo sapiens
tattacaattggtcttattaaga

SEQ ID NO: 9049047 - DNA, 22 bp, Homo sapiens
tattacaatttacattgcactt

SEQ ID NO: 9049048 - DNA, 22 bp, Homo sapiens
tattacaaattataatgggaga

SEQ ID NO: 9049049 - DNA, 22 bp, Homo sapiens
tattgtatcttaccacatgtat

SEQ ID NO: 9049050 - DNA, 22 bp, Homo sapiens
tattgtattaaggattcaagta

SEQ ID NO: 9049051 - DNA, 22 bp, Homo sapiens
tatttaactggaaacacaatga

SEQ ID NO: 9049052 - DNA, 22 bp, Homo sapiens
tatttaaaaagaggccagctgg

SEQ ID NO: 9049053 - DNA, 22 bp, Homo sapiens
tcaaagagctctatcttcaaaa

SEQ ID NO: 9049054 - DNA, 22 bp, Homo sapiens
tcaaagatagatgttgagaaat

SEQ ID NO: 9049055 - DNA, 22 bp, Homo sapiens
tcaaagacatggggaagctgag

SEQ ID NO: 9049056 - DNA, 22 bp, Homo sapiens
tcaaagactatatattttattt

SEQ ID NO: 9049057 - DNA, 21 bp, Homo sapiens
tcaaagactggggctgtgtgc

SEQ ID NO: 9049058 - DNA, 20 bp, Homo sapiens
tcaaagacaagctctcatcc

SEQ ID NO: 9049059 - DNA, 22 bp, Homo sapiens
tcaaagaatgttatgagggtag

SEQ ID NO: 9049060 - DNA, 22 bp, Homo sapiens
tcaaagaagtgcaaacctcatc

SEQ ID NO: 9049061 - DNA, 17 bp, Homo sapiens
tcaaagaatgcatgcag

SEQ ID NO: 9049062 - DNA, 22 bp, Homo sapiens
tcaaagaacatcatctgaaatg

SEQ ID NO: 9049063 - DNA, 22 bp, Homo sapiens
tcaaacttggtaagagaaatac

SEQ ID NO: 9049064 - DNA, 22 bp, Homo sapiens
tcaaaaagttgaagagttgggg

SEQ ID NO: 9049065 - DNA, 22 bp, Homo sapiens
tattttgcgttgagtcagattt

SEQ ID NO: 9049066 - DNA, 22 bp, Homo sapiens
tattttgctttagctgactgtt

SEQ ID NO: 9049067 - DNA, 22 bp, Homo sapiens
tattttgcaaacctgagtttga

SEQ ID NO: 9049068 - DNA, 20 bp, Homo sapiens
tattttgcaattatggttca

SEQ ID NO: 9049069 - DNA, 22 bp, Homo sapiens
tattttgacgattttatgcaaa

SEQ ID NO: 9049070 - DNA, 22 bp, Homo sapiens
tattttgacgattttatgcaaa

SEQ ID NO: 9049071 - DNA, 22 bp, Homo sapiens
tcaaagtaagattgttgaagct

SEQ ID NO: 9049072 - DNA, 22 bp, Homo sapiens
tcaaaggttaactctgttgttc

SEQ ID NO: 9049073 - DNA, 22 bp, Homo sapiens
tcaaatatgtgatagaagctaa

SEQ ID NO: 9049074 - DNA, 22 bp, Homo sapiens
tcaaatatgtgatagaagctaa

SEQ ID NO: 9049075 - DNA, 22 bp, Homo sapiens
tcaaataatgccattcatcatc

SEQ ID NO: 9049076 - DNA, 21 bp, Homo sapiens
tcaaatcatgtactgaccaca

SEQ ID NO: 9049077 - DNA, 22 bp, Homo sapiens
tcaaatgaagacagttgacttg

SEQ ID NO: 9049078 - DNA, 22 bp, Homo sapiens
tcaaatgacaagcacttttggg

SEQ ID NO: 9049079 - DNA, 22 bp, Homo sapiens
tatgtcatgggtcaaaatgaag

SEQ ID NO: 9049080 - DNA, 22 bp, Homo sapiens
tatgtcatgtcttagagaatga

SEQ ID NO: 9049081 - DNA, 23 bp, Homo sapiens
tatgtcatgagcatattgaatgt

SEQ ID NO: 9049082 - DNA, 22 bp, Homo sapiens
tattaaattatggatttaggag

SEQ ID NO: 9049083 - DNA, 21 bp, Homo sapiens
tatgtagactcgttagaatgc

SEQ ID NO: 9049084 - DNA, 22 bp, Homo sapiens
tatgtagacaggctgcttttcc

SEQ ID NO: 9049085 - DNA, 22 bp, Homo sapiens
tatgtagacttcattgtttact

SEQ ID NO: 9049086 - DNA, 22 bp, Homo sapiens
tatgtagagataaaatccaaat

SEQ ID NO: 9049087 - DNA, 22 bp, Homo sapiens
tatgtagatggaattaactgat

SEQ ID NO: 9049088 - DNA, 22 bp, Homo sapiens
tatgtagcaatagcatcatact

SEQ ID NO: 9049089 - DNA, 22 bp, Homo sapiens
tatgtagatgtcatataaattg

SEQ ID NO: 9049090 - DNA, 22 bp, Homo sapiens
tatgtagatttctctgtttttc

SEQ ID NO: 9049091 - DNA, 22 bp, Homo sapiens
tatgtataaatgcatgtgtgga

SEQ ID NO: 9049092 - DNA, 22 bp, Homo sapiens
tatgtatccgtgtgtgtacaga

SEQ ID NO: 9049093 - DNA, 20 bp, Homo sapiens
tatgtatgcctacatgctat

SEQ ID NO: 9049094 - DNA, 22 bp, Homo sapiens
tatgtaaagtagatggcaggta

SEQ ID NO: 9049095 - DNA, 22 bp, Homo sapiens
tatgtacatacatgtgcatacg

SEQ ID NO: 9049096 - DNA, 22 bp, Homo sapiens
tatgtactcatcaactattgaa

SEQ ID NO: 9049097 - DNA, 22 bp, Homo sapiens
tatgtactctaatttgtctcat

SEQ ID NO: 9049098 - DNA, 22 bp, Homo sapiens
tatgtagaaaacaaaagttgaa

SEQ ID NO: 9049099 - DNA, 22 bp, Homo sapiens
tatgtacatatacacgtgtgtg

SEQ ID NO: 9049100 - DNA, 22 bp, Homo sapiens
tatgtacatacatgtgcatacg

SEQ ID NO: 9049101 - DNA, 22 bp, Homo sapiens
tatgctttggtagagagttgtg

SEQ ID NO: 9049102 - DNA, 22 bp, Homo sapiens
tatgcttttaacctgtaactga

SEQ ID NO: 9049103 - DNA, 20 bp, Homo sapiens
tatgctttttataagattga

SEQ ID NO: 9049104 - DNA, 22 bp, Homo sapiens
tatgctttacttttcattgtga

SEQ ID NO: 9049105 - DNA, 22 bp, Homo sapiens
tatgctttcattcatatgtgag

SEQ ID NO: 9049106 - DNA, 22 bp, Homo sapiens
tatggacatctgaagttgcaga

SEQ ID NO: 9049107 - DNA, 21 bp, Homo sapiens
tatcacagtagaataggatct

SEQ ID NO: 9049108 - DNA, 22 bp, Homo sapiens
tatcacatacttctcatccagg

SEQ ID NO: 9049109 - DNA, 22 bp, Homo sapiens
tatcagaacacatgttttgcag

SEQ ID NO: 9049110 - DNA, 17 bp, Homo sapiens
tatcagaatgtgtttac

SEQ ID NO: 9049111 - DNA, 22 bp, Homo sapiens
tatcagaaggaagtgcctttaa

SEQ ID NO: 9049112 - DNA, 22 bp, Homo sapiens
tatcagaaggcacatggagtct

SEQ ID NO: 9049113 - DNA, 21 bp, Homo sapiens
tatcagaagagaaagaatgat

SEQ ID NO: 9049114 - DNA, 18 bp, Homo sapiens
tataaacacacttaggtt

SEQ ID NO: 9049115 - DNA, 22 bp, Homo sapiens
tataaagaaggcacagcaagac

SEQ ID NO: 9049116 - DNA, 22 bp, Homo sapiens
tagttttttcaacaaatggtgc

SEQ ID NO: 9049117 - DNA, 22 bp, Homo sapiens
tataaagtgtgaactgtgagta

SEQ ID NO: 9049118 - DNA, 22 bp, Homo sapiens
tataaagctgactcatgaaact

SEQ ID NO: 9049119 - DNA, 22 bp, Homo sapiens
tataaagttggggctgaagtaa

SEQ ID NO: 9049120 - DNA, 22 bp, Homo sapiens
tataaagaatccagaagagaca

SEQ ID NO: 9049121 - DNA, 22 bp, Homo sapiens
tataaagagtctcaaagaagtt

SEQ ID NO: 9049122 - DNA, 22 bp, Homo sapiens
tataaagaagtgtaaacaggaa

SEQ ID NO: 9049123 - DNA, 22 bp, Homo sapiens
tataaagaaggcacagcaagac

SEQ ID NO: 9049124 - DNA, 22 bp, Homo sapiens
tatgaaattgccatttttatgg

SEQ ID NO: 9049125 - DNA, 22 bp, Homo sapiens
tatgaaagcaatcattatgtac

SEQ ID NO: 9049126 - DNA, 22 bp, Homo sapiens
tatgaaatttaaacacagatca

SEQ ID NO: 9049127 - DNA, 22 bp, Homo sapiens
tatgaaatttctagttctgctt

SEQ ID NO: 9049128 - DNA, 22 bp, Homo sapiens
tatgacaaggtggagtatgagt

SEQ ID NO: 9049129 - DNA, 22 bp, Homo sapiens
tatgaaaatttagctgaagcat

SEQ ID NO: 9049130 - DNA, 22 bp, Homo sapiens
tatgaaaaggtggccaatgtag

SEQ ID NO: 9049131 - DNA, 22 bp, Homo sapiens
tagtttaatggtcaactaatga

SEQ ID NO: 9049132 - DNA, 22 bp, Homo sapiens
tagtttaaaagttagggatgat

SEQ ID NO: 9049133 - DNA, 22 bp, Homo sapiens
tagttctactcaaagtgtgatc

SEQ ID NO: 9049134 - DNA, 22 bp, Homo sapiens
tagtttatgattttttggaagg

SEQ ID NO: 9049135 - DNA, 22 bp, Homo sapiens
tagtttatagttagcgagcacg

SEQ ID NO: 9049136 - DNA, 22 bp, Homo sapiens
tagtttatgattttttggaagg

SEQ ID NO: 9049137 - DNA, 22 bp, Homo sapiens
tagtttatgctgctgcagtgag

SEQ ID NO: 9049138 - DNA, 22 bp, Homo sapiens
tagtttatgctgctgcagtgag

SEQ ID NO: 9049139 - DNA, 22 bp, Homo sapiens
tagtttcatctccaccctgccc

SEQ ID NO: 9049140 - DNA, 22 bp, Homo sapiens
tagtttttaagtgtacaatttc

SEQ ID NO: 9049141 - DNA, 22 bp, Homo sapiens
tagttttatgaattggtataat

SEQ ID NO: 9049142 - DNA, 22 bp, Homo sapiens
tagtggagaggatgtggagaaa

SEQ ID NO: 9049143 - DNA, 22 bp, Homo sapiens
taggggaagtctcagaatgcag

SEQ ID NO: 9049144 - DNA, 22 bp, Homo sapiens
taggggaaagcagaatcctgga

SEQ ID NO: 9049145 - DNA, 22 bp, Homo sapiens
taggggaattgcagtgtgtcca

SEQ ID NO: 9049146 - DNA, 23 bp, Homo sapiens
taggggaaaaatcttctgcaatt

SEQ ID NO: 9049147 - DNA, 22 bp, Homo sapiens
taggggaactggcacagggcag

SEQ ID NO: 9049148 - DNA, 22 bp, Homo sapiens
tagctgttaagttgtttggaaa

SEQ ID NO: 9049149 - DNA, 22 bp, Homo sapiens
tagctgttacccataaaagcca

SEQ ID NO: 9049150 - DNA, 22 bp, Homo sapiens
tagctgacgctaaataaatgtt

SEQ ID NO: 9049151 - DNA, 22 bp, Homo sapiens
tagcagggtctcaggagtcagg

SEQ ID NO: 9049152 - DNA, 22 bp, Homo sapiens
tagcagggtaaatgtagatgga

SEQ ID NO: 9049153 - DNA, 22 bp, Homo sapiens
tagcaggggtagatagagtgtg

SEQ ID NO: 9049154 - DNA, 22 bp, Homo sapiens
tagcagggtccaatgtgaggca

SEQ ID NO: 9049155 - DNA, 22 bp, Homo sapiens
tagcagggagggccagtgtcaa

SEQ ID NO: 9049156 - DNA, 22 bp, Homo sapiens
tagcagggaaggtgtgctgagc

SEQ ID NO: 9049157 - DNA, 22 bp, Homo sapiens
tagcagggaagatgatcagaat

SEQ ID NO: 9049158 - DNA, 22 bp, Homo sapiens
tagcagggatacaaggtcgcct

SEQ ID NO: 9049159 - DNA, 22 bp, Homo sapiens
tagatgaaatgtgtgttattat

SEQ ID NO: 9049160 - DNA, 21 bp, Homo sapiens
tagatgaaatcagagtatttc

SEQ ID NO: 9049161 - DNA, 22 bp, Homo sapiens
tagatgaatgacttatatgtca

SEQ ID NO: 9049162 - DNA, 22 bp, Homo sapiens
tagcaaagagaaaaattatgct

SEQ ID NO: 9049163 - DNA, 22 bp, Homo sapiens
tagcaaaagccacgattacttt

SEQ ID NO: 9049164 - DNA, 22 bp, Homo sapiens
tagcaaatacatgatgtaattt

SEQ ID NO: 9049165 - DNA, 22 bp, Homo sapiens
tagcaaataaaacagtattgaa

SEQ ID NO: 9049166 - DNA, 22 bp, Homo sapiens
tagcaaaggatgactatgtacc

SEQ ID NO: 9049167 - DNA, 22 bp, Homo sapiens
tagcaaatgtgttatgctatgc

SEQ ID NO: 9049168 - DNA, 22 bp, Homo sapiens
tagcaactgcctttactatatt

SEQ ID NO: 9049169 - DNA, 22 bp, Homo sapiens
tagcaactgctctattctagga

SEQ ID NO: 9049170 - DNA, 22 bp, Homo sapiens
tagagacaccagtaccattctg

SEQ ID NO: 9049171 - DNA, 22 bp, Homo sapiens
tagatagataaaatgttgcaga

SEQ ID NO: 9049172 - DNA, 22 bp, Homo sapiens
tagatcagagttcaggaagttt

SEQ ID NO: 9049173 - DNA, 22 bp, Homo sapiens
tagactctgcatttacctccca

SEQ ID NO: 9049174 - DNA, 22 bp, Homo sapiens
tagaagattctaaagtggagag

SEQ ID NO: 9049175 - DNA, 22 bp, Homo sapiens
tagaagattccagaggcaaagc

SEQ ID NO: 9049176 - DNA, 22 bp, Homo sapiens
tagaaatgggttacatttagag

SEQ ID NO: 9049177 - DNA, 22 bp, Homo sapiens
tacttacattagcaaacaaggt

SEQ ID NO: 9049178 - DNA, 22 bp, Homo sapiens
tagaactgctctcatacttgct

SEQ ID NO: 9049179 - DNA, 22 bp, Homo sapiens
tagaactggaattttgtggttt

SEQ ID NO: 9049180 - DNA, 22 bp, Homo sapiens
taatagttgtgactttgtaaag

SEQ ID NO: 9049181 - DNA, 22 bp, Homo sapiens
taatagtttcataatgtgcttc

SEQ ID NO: 9049182 - DNA, 22 bp, Homo sapiens
taatataccaaactgtaatttt

SEQ ID NO: 9049183 - DNA, 22 bp, Homo sapiens
taaggagagaatttagaggttt

SEQ ID NO: 9049184 - DNA, 22 bp, Homo sapiens
taaggaatgcttgaatgttcct

SEQ ID NO: 9049185 - DNA, 22 bp, Homo sapiens
taaggaatagtgctatgaaaaa

SEQ ID NO: 9049186 - DNA, 22 bp, Homo sapiens
taaggaatatcataagaagtag

SEQ ID NO: 9049187 - DNA, 22 bp, Homo sapiens
taatagttatggttggttctca

SEQ ID NO: 9049188 - DNA, 18 bp, Homo sapiens
taaggaagggggtgaaga

SEQ ID NO: 9049189 - DNA, 22 bp, Homo sapiens
taaggaagtacccattcttagg

SEQ ID NO: 9049190 - DNA, 22 bp, Homo sapiens
taaggaagtcacaagaatcgct

SEQ ID NO: 9049191 - DNA, 22 bp, Homo sapiens
taaggaagagcttggtaatagg

SEQ ID NO: 9049192 - DNA, 22 bp, Homo sapiens
taaggaaggggaaagacatgtc

SEQ ID NO: 9049193 - DNA, 21 bp, Homo sapiens
taaggaagagcattttaggtc

SEQ ID NO: 9049194 - DNA, 22 bp, Homo sapiens
taaggaaagtacatgttttgac

SEQ ID NO: 9049195 - DNA, 22 bp, Homo sapiens
taaggaaaatggacatcaaaca

SEQ ID NO: 9049196 - DNA, 22 bp, Homo sapiens
taaggaaacaacttgtattttt

SEQ ID NO: 9049197 - DNA, 22 bp, Homo sapiens
taaggaaacaacttgtattttt

SEQ ID NO: 9049198 - DNA, 22 bp, Homo sapiens
taagcattatggtaaagaagta

SEQ ID NO: 9049199 - DNA, 22 bp, Homo sapiens
taagcattaactctgctgcaag

SEQ ID NO: 9049200 - DNA, 22 bp, Homo sapiens
taagcctgcatgaaccatgaga

SEQ ID NO: 9049201 - DNA, 21 bp, Homo sapiens
taagctaaacattcagttaac

SEQ ID NO: 9049202 - DNA, 22 bp, Homo sapiens
taagctaacgtccatggaaatg

SEQ ID NO: 9049203 - DNA, 22 bp, Homo sapiens
taattcagtgttcacttggaca

SEQ ID NO: 9049204 - DNA, 21 bp, Homo sapiens
taattccagaggtcactgaag

SEQ ID NO: 9049205 - DNA, 22 bp, Homo sapiens
taattattgtctgaagagttat

SEQ ID NO: 9049206 - DNA, 22 bp, Homo sapiens
taattcagtgttcacttggaca

SEQ ID NO: 9049207 - DNA, 22 bp, Homo sapiens
taattcaggtagaacttaccag

SEQ ID NO: 9049208 - DNA, 22 bp, Homo sapiens
taattcagggccagaatcccca

SEQ ID NO: 9049209 - DNA, 22 bp, Homo sapiens
taattcagtcattaatcttagc

SEQ ID NO: 9049210 - DNA, 22 bp, Homo sapiens
taattgctgtatagattgtcat

SEQ ID NO: 9049211 - DNA, 22 bp, Homo sapiens
taattgcagctatcattttagt

SEQ ID NO: 9049212 - DNA, 22 bp, Homo sapiens
taattgctaaatgaaggagaag

SEQ ID NO: 9049213 - DNA, 22 bp, Homo sapiens
taattgctaatcctgccttcta

SEQ ID NO: 9049214 - DNA, 22 bp, Homo sapiens
taattgctattggaatgctttg

SEQ ID NO: 9049215 - DNA, 23 bp, Homo sapiens
taattgcttgagttagtaataca

SEQ ID NO: 9049216 - DNA, 22 bp, Homo sapiens
taattgctatttaatgtggtga

SEQ ID NO: 9049217 - DNA, 22 bp, Homo sapiens
taattgctccaaggagaactaa

SEQ ID NO: 9049218 - DNA, 22 bp, Homo sapiens
taattgctgaactactatccct

SEQ ID NO: 9049219 - DNA, 22 bp, Homo sapiens
taattgctcttggccgtgccag

SEQ ID NO: 9049220 - DNA, 22 bp, Homo sapiens
taattgctcgagaaataacctc

SEQ ID NO: 9049221 - DNA, 22 bp, Homo sapiens
taattattctagtcacatagca

SEQ ID NO: 9049222 - DNA, 22 bp, Homo sapiens
taatcttagcaacctccagtgt

SEQ ID NO: 9049223 - DNA, 22 bp, Homo sapiens
taatctagaacatatgagagca

SEQ ID NO: 9049224 - DNA, 22 bp, Homo sapiens
taatctatcaagcaacaaagtg

SEQ ID NO: 9049225 - DNA, 22 bp, Homo sapiens
taatctagtcccacatggaatt

SEQ ID NO: 9049226 - DNA, 22 bp, Homo sapiens
taatcctgatcaattttagctt

SEQ ID NO: 9049227 - DNA, 22 bp, Homo sapiens
tacacaatgacttaagatgtca

SEQ ID NO: 9049228 - DNA, 22 bp, Homo sapiens
tacacaatctgtttttccattt

SEQ ID NO: 9049229 - DNA, 22 bp, Homo sapiens
tacacaactgacaaccattctg

SEQ ID NO: 9049230 - DNA, 22 bp, Homo sapiens
tacaagagtgagattatcatgt

SEQ ID NO: 9049231 - DNA, 22 bp, Homo sapiens
tacaagaggtatatagaaacag

SEQ ID NO: 9049232 - DNA, 22 bp, Homo sapiens
tacaagaatgtcttaaaagctc

SEQ ID NO: 9049233 - DNA, 22 bp, Homo sapiens
tacaagagaactaatgtaagtc

SEQ ID NO: 9049234 - DNA, 22 bp, Homo sapiens
tacaagagacaccagggaggct

SEQ ID NO: 9049235 - DNA, 22 bp, Homo sapiens
tacaagaggatgtggacatgga

SEQ ID NO: 9049236 - DNA, 22 bp, Homo sapiens
tacaagagcagtaagcttgtcc

SEQ ID NO: 9049237 - DNA, 22 bp, Homo sapiens
tacaagaaggaaaactagcaat

SEQ ID NO: 9049238 - DNA, 22 bp, Homo sapiens
tacaagaaggatggagcccact

SEQ ID NO: 9049239 - DNA, 22 bp, Homo sapiens
tacaagaaggaaaactagcaat

SEQ ID NO: 9049240 - DNA, 22 bp, Homo sapiens
tacaagaaatttctgcatatat

SEQ ID NO: 9049241 - DNA, 22 bp, Homo sapiens
tacaagaagaggcagagctgga

SEQ ID NO: 9049242 - DNA, 22 bp, Homo sapiens
tacaagaaactacatgaatgca

SEQ ID NO: 9049243 - DNA, 22 bp, Homo sapiens
tacaaccatagacatatactag

SEQ ID NO: 9049244 - DNA, 22 bp, Homo sapiens
tacaaccagatcctctaagtca

SEQ ID NO: 9049245 - DNA, 22 bp, Homo sapiens
tacaacatttacgttaggctgt

SEQ ID NO: 9049246 - DNA, 22 bp, Homo sapiens
taatttatggtatgtgtgtaat

SEQ ID NO: 9049247 - DNA, 22 bp, Homo sapiens
taatttcaaatttcttagcgtg

SEQ ID NO: 9049248 - DNA, 22 bp, Homo sapiens
taatttcaagtttagggctcta

SEQ ID NO: 9049249 - DNA, 22 bp, Homo sapiens
tacacatacattgcttacaagg

SEQ ID NO: 9049250 - DNA, 22 bp, Homo sapiens
tacacacagaggccatgggatt

SEQ ID NO: 9049251 - DNA, 22 bp, Homo sapiens
tacacaattagttgcaaagtga

SEQ ID NO: 9049252 - DNA, 22 bp, Homo sapiens
tacacaattagttgcaaagtga

SEQ ID NO: 9049253 - DNA, 22 bp, Homo sapiens
tacacaattctggatgcatgtc

SEQ ID NO: 9049254 - DNA, 22 bp, Homo sapiens
tacacaatgacttaagatgtca

SEQ ID NO: 9049255 - DNA, 22 bp, Homo sapiens
tacacacagaggccatgggatt

SEQ ID NO: 9049256 - DNA, 22 bp, Homo sapiens
tacacacatgcatttgccttat

SEQ ID NO: 9049257 - DNA, 22 bp, Homo sapiens
tacacacttactggagatgaag

SEQ ID NO: 9049258 - DNA, 22 bp, Homo sapiens
tacacactgtgataatgaagca

SEQ ID NO: 9049259 - DNA, 22 bp, Homo sapiens
tacacatacattgcttacaagg

SEQ ID NO: 9049260 - DNA, 22 bp, Homo sapiens
tacacataggtctgaataaaaa

SEQ ID NO: 9049261 - DNA, 22 bp, Homo sapiens
tacagaatctatgcttcacagt

SEQ ID NO: 9049262 - DNA, 22 bp, Homo sapiens
tacagaatgttatgaagcatag

SEQ ID NO: 9049263 - DNA, 22 bp, Homo sapiens
tactataaagtcttaatgagtc

SEQ ID NO: 9049264 - DNA, 22 bp, Homo sapiens
tactaggaagcagctgcattgg

SEQ ID NO: 9049265 - DNA, 22 bp, Homo sapiens
tactagaacctcacaacaatcc

SEQ ID NO: 9049266 - DNA, 22 bp, Homo sapiens
tactacaagggccctaaaaggt

SEQ ID NO: 9049267 - DNA, 22 bp, Homo sapiens
tactacatacagaatttagaga

SEQ ID NO: 9049268 - DNA, 22 bp, Homo sapiens
tactacatacagaatttagaga

SEQ ID NO: 9049269 - DNA, 22 bp, Homo sapiens
taccatgtcaagcgagacatgt

SEQ ID NO: 9049270 - DNA, 22 bp, Homo sapiens
taccagctcacacaatctttgt

SEQ ID NO: 9049271 - DNA, 22 bp, Homo sapiens
taccactgctccctgcctgtga

SEQ ID NO: 9049272 - DNA, 22 bp, Homo sapiens
tacttacataaaaactgaatgt

SEQ ID NO: 9049273 - DNA, 22 bp, Homo sapiens
tacttacactgaagcaaagata

SEQ ID NO: 9049274 - DNA, 22 bp, Homo sapiens
tacttacacagctgtagaaggt

SEQ ID NO: 9049275 - DNA, 22 bp, Homo sapiens
tacttaaaaattatcaaagtgg

SEQ ID NO: 9049276 - DNA, 22 bp, Homo sapiens
tacttaaaaattatcaaagtgg

SEQ ID NO: 9049277 - DNA, 22 bp, Homo sapiens
tacttaaataattgctgctatt

SEQ ID NO: 9049278 - DNA, 22 bp, Homo sapiens
tacttaaaactgatagaatctc

SEQ ID NO: 9049279 - DNA, 22 bp, Homo sapiens
tacttaaaactgatagaatctc

SEQ ID NO: 9049280 - DNA, 22 bp, Homo sapiens
tactgtttcctgaagcagatgc

SEQ ID NO: 9049281 - DNA, 22 bp, Homo sapiens
tactgtttcaagccctcacaga

SEQ ID NO: 9049282 - DNA, 22 bp, Homo sapiens
tactgtttgcagtttgcagtat

SEQ ID NO: 9049283 - DNA, 22 bp, Homo sapiens
tacttaaaaattatcaaagtgg

SEQ ID NO: 9049284 - DNA, 22 bp, Homo sapiens
tactgaaactcttgtaaatatc

SEQ ID NO: 9049285 - DNA, 22 bp, Homo sapiens
tactgaaaactgagtcttccgt

SEQ ID NO: 9049286 - DNA, 22 bp, Homo sapiens
tactgaaaagccacaaggacca

SEQ ID NO: 9049287 - DNA, 22 bp, Homo sapiens
tactgaaacttttcttcaactg

SEQ ID NO: 9049288 - DNA, 22 bp, Homo sapiens
tactgtgtgcccagccgagctg

SEQ ID NO: 9049289 - DNA, 22 bp, Homo sapiens
tacagtgtccctttttcagaca

SEQ ID NO: 9049290 - DNA, 22 bp, Homo sapiens
tacagtgtctgcaactgcacac

SEQ ID NO: 9049291 - DNA, 22 bp, Homo sapiens
tacagtcaacattgatgatgat

SEQ ID NO: 9049292 - DNA, 22 bp, Homo sapiens
tacagtcacattctgaggtctt

SEQ ID NO: 9049293 - DNA, 22 bp, Homo sapiens
tacagtcaatactaggaccata

SEQ ID NO: 9049294 - DNA, 22 bp, Homo sapiens
tacagtatggaaaatgtatagt

SEQ ID NO: 9049295 - DNA, 22 bp, Homo sapiens
tacagagatactctagatcaaa

SEQ ID NO: 9049296 - DNA, 22 bp, Homo sapiens
tacagacagtttttcagatatt

SEQ ID NO: 9049297 - DNA, 20 bp, Homo sapiens
tacagacatgacaataatgg

SEQ ID NO: 9049298 - DNA, 22 bp, Homo sapiens
tacagtgtgacatttctacaaa

SEQ ID NO: 9049299 - DNA, 22 bp, Homo sapiens
tacagtgtctggatatcaaagg

SEQ ID NO: 9049300 - DNA, 22 bp, Homo sapiens
tacagtgtctggatatcaaagg

SEQ ID NO: 9049301 - DNA, 22 bp, Homo sapiens
tacagtgtgacatttctacaaa

SEQ ID NO: 9049302 - DNA, 22 bp, Homo sapiens
tacatgaacaaaatagcagaaa

SEQ ID NO: 9049303 - DNA, 22 bp, Homo sapiens
tacatgaagttgtctaaactgg

SEQ ID NO: 9049304 - DNA, 22 bp, Homo sapiens
tacatgaatgtttcaatattgt

SEQ ID NO: 9049305 - DNA, 22 bp, Homo sapiens
tacatgcaatgaggattctagt

SEQ ID NO: 9049306 - DNA, 22 bp, Homo sapiens
tacatgacctagacttgctaaa

SEQ ID NO: 9049307 - DNA, 22 bp, Homo sapiens
tacatgaatgtttcaatattgt

SEQ ID NO: 9049308 - DNA, 18 bp, Homo sapiens
tacatgcataaatgaagc

SEQ ID NO: 9049309 - DNA, 18 bp, Homo sapiens
tacatgccagagagttac

SEQ ID NO: 9049310 - DNA, 22 bp, Homo sapiens
tacatgcattggatggcaatag

SEQ ID NO: 9049311 - DNA, 22 bp, Homo sapiens
tacatgcatgtgtgtaaatata

SEQ ID NO: 9049312 - DNA, 22 bp, Homo sapiens
taccaaagattaaatagcaaca

SEQ ID NO: 9049313 - DNA, 22 bp, Homo sapiens
taccaagtgtattatgctttgt

SEQ ID NO: 9049314 - DNA, 22 bp, Homo sapiens
taccaaagattaaatagcaaca

SEQ ID NO: 9049315 - DNA, 22 bp, Homo sapiens
taagacttgatccaaagaacta

SEQ ID NO: 9049316 - DNA, 22 bp, Homo sapiens
taagagattctaaagctactgg

SEQ ID NO: 9049317 - DNA, 22 bp, Homo sapiens
taagagatggttatcaaaagca

SEQ ID NO: 9049318 - DNA, 22 bp, Homo sapiens
taagagatgcttttctaaataa

SEQ ID NO: 9049319 - DNA, 22 bp, Homo sapiens
taagagacttaagaataattga

SEQ ID NO: 9049320 - DNA, 22 bp, Homo sapiens
taagagctaggattttaaatca

SEQ ID NO: 9049321 - DNA, 22 bp, Homo sapiens
taagagctcccttctccttgca

SEQ ID NO: 9049322 - DNA, 22 bp, Homo sapiens
taagagctccaatatttgtggc

SEQ ID NO: 9049323 - DNA, 22 bp, Homo sapiens
taagaggatatttggccagaag

SEQ ID NO: 9049324 - DNA, 22 bp, Homo sapiens
taagcatggtggtaaaagaggt

SEQ ID NO: 9049325 - DNA, 22 bp, Homo sapiens
taacatgatttgctatttagat

SEQ ID NO: 9049326 - DNA, 22 bp, Homo sapiens
taacatgttcagactacctgtg

SEQ ID NO: 9049327 - DNA, 22 bp, Homo sapiens
taacatgtttgtacactgaaac

SEQ ID NO: 9049328 - DNA, 22 bp, Homo sapiens
taaatgttatgcccatcatcca

SEQ ID NO: 9049329 - DNA, 22 bp, Homo sapiens
taacaggctgatcatatatcct

SEQ ID NO: 9049330 - DNA, 22 bp, Homo sapiens
taaatgttggcattggaggccg

SEQ ID NO: 9049331 - DNA, 22 bp, Homo sapiens
taaatgttgtaagtacatctaa

SEQ ID NO: 9049332 - DNA, 22 bp, Homo sapiens
taaatgttgtaagtacatctaa

SEQ ID NO: 9049333 - DNA, 22 bp, Homo sapiens
taacatctccctgacttttgct

SEQ ID NO: 9049334 - DNA, 22 bp, Homo sapiens
taacatcaaactgcattttcta

SEQ ID NO: 9049335 - DNA, 22 bp, Homo sapiens
taacatcaaacatgttttaaag

SEQ ID NO: 9049336 - DNA, 22 bp, Homo sapiens
taaagatggagatgacctagga

SEQ ID NO: 9049337 - DNA, 22 bp, Homo sapiens
taaagatgctatagtgaaggag

SEQ ID NO: 9049338 - DNA, 22 bp, Homo sapiens
taaagatgcccacattgcaggt

SEQ ID NO: 9049339 - DNA, 22 bp, Homo sapiens
taaagcaatgaaagttttgcag

SEQ ID NO: 9049340 - DNA, 22 bp, Homo sapiens
taaagcaaggaatagagtagtc

SEQ ID NO: 9049341 - DNA, 22 bp, Homo sapiens
taaagcaagacacacccatagc

SEQ ID NO: 9049342 - DNA, 23 bp, Homo sapiens
taaagcaaagtcaagtgcactcc

SEQ ID NO: 9049343 - DNA, 20 bp, Homo sapiens
taaagcagccgtggagggta

SEQ ID NO: 9049344 - DNA, 20 bp, Homo sapiens
taaatgcatgaatgtaaggc

SEQ ID NO: 9049345 - DNA, 21 bp, Homo sapiens
taaaagatgacaagacagctc

SEQ ID NO: 9049346 - DNA, 22 bp, Homo sapiens
taaaagaccctctagagtccca

SEQ ID NO: 9049347 - DNA, 21 bp, Homo sapiens
gttttaagggagaaaacctag

SEQ ID NO: 9049348 - DNA, 22 bp, Homo sapiens
taaagacatgcaaagtctaatt

SEQ ID NO: 9049349 - DNA, 22 bp, Homo sapiens
taaaagttagctaggacaaagt

SEQ ID NO: 9049350 - DNA, 22 bp, Homo sapiens
taaaagctgagatatcctgtac

SEQ ID NO: 9049351 - DNA, 22 bp, Homo sapiens
taaaagctcttctgttgagtta

SEQ ID NO: 9049352 - DNA, 22 bp, Homo sapiens
taaaagattttataggaacaag

SEQ ID NO: 9049353 - DNA, 22 bp, Homo sapiens
gtttcaaagggaagacgctgga

SEQ ID NO: 9049354 - DNA, 22 bp, Homo sapiens
gtttcaaagcacagctcacatt

SEQ ID NO: 9049355 - DNA, 22 bp, Homo sapiens
gtttattatacaacaaaagcta

SEQ ID NO: 9049356 - DNA, 22 bp, Homo sapiens
gtttattatacaacaaaagcta

SEQ ID NO: 9049357 - DNA, 22 bp, Homo sapiens
gtttattatacaacaaaagcta

SEQ ID NO: 9049358 - DNA, 22 bp, Homo sapiens
gtttattagagttttctgtctg

SEQ ID NO: 9049359 - DNA, 22 bp, Homo sapiens
gtttattagagttttctgtctg

SEQ ID NO: 9049360 - DNA, 22 bp, Homo sapiens
gtttattagagttttctgtctg

SEQ ID NO: 9049361 - DNA, 22 bp, Homo sapiens
gtttattagagttttctgtctg

SEQ ID NO: 9049362 - DNA, 22 bp, Homo sapiens
gtttattaactgtcaagtgatt

SEQ ID NO: 9049363 - DNA, 22 bp, Homo sapiens
gtttattaactgtcaagtgatt

SEQ ID NO: 9049364 - DNA, 22 bp, Homo sapiens
gtttattaactgtcaagtgatt

SEQ ID NO: 9049365 - DNA, 22 bp, Homo sapiens
gttgagctctccagcttcattt

SEQ ID NO: 9049366 - DNA, 22 bp, Homo sapiens
gttctttaagtggagaaggaaa

SEQ ID NO: 9049367 - DNA, 22 bp, Homo sapiens
gttcttcctcattgctttgaag

SEQ ID NO: 9049368 - DNA, 22 bp, Homo sapiens
gtttcaaataggtttcagcaaa

SEQ ID NO: 9049369 - DNA, 22 bp, Homo sapiens
gtttcacacatcctgcacatag

SEQ ID NO: 9049370 - DNA, 22 bp, Homo sapiens
gtttcacaagcaacgggtaagg

SEQ ID NO: 9049371 - DNA, 22 bp, Homo sapiens
gtttcacagcaaagttccctgt

SEQ ID NO: 9049372 - DNA, 22 bp, Homo sapiens
gtttcacagggccatggaggaa

SEQ ID NO: 9049373 - DNA, 22 bp, Homo sapiens
gtttcacaggttggagccagca

SEQ ID NO: 9049374 - DNA, 22 bp, Homo sapiens
gtttcacagatggtgttcatat

SEQ ID NO: 9049375 - DNA, 22 bp, Homo sapiens
gtttcacagatggggagacacg

SEQ ID NO: 9049376 - DNA, 22 bp, Homo sapiens
gtttcacataattttaaattgt

SEQ ID NO: 9049377 - DNA, 22 bp, Homo sapiens
gtttcacatgaaacttggggaa

SEQ ID NO: 9049378 - DNA, 22 bp, Homo sapiens
gtttctttctattgactgaaca

SEQ ID NO: 9049379 - DNA, 22 bp, Homo sapiens
gtttcacagtctgcagaatttt

SEQ ID NO: 9049380 - DNA, 22 bp, Homo sapiens
gtttcttagacagacattatct

SEQ ID NO: 9049381 - DNA, 22 bp, Homo sapiens
gtttcttttgtgatcaccaacc

SEQ ID NO: 9049382 - DNA, 20 bp, Homo sapiens
gttttaaggcacaggccttt

SEQ ID NO: 9049383 - DNA, 22 bp, Homo sapiens
gtttgtcatttgtacttctagc

SEQ ID NO: 9049384 - DNA, 22 bp, Homo sapiens
gtttgtcaggaggttgaagtca

SEQ ID NO: 9049385 - DNA, 22 bp, Homo sapiens
gtttgcatgtgtacttaattgg

SEQ ID NO: 9049386 - DNA, 22 bp, Homo sapiens
gtttgattcaagaacaaagagt

SEQ ID NO: 9049387 - DNA, 22 bp, Homo sapiens
gttcttcatcttaaccatctgt

SEQ ID NO: 9049388 - DNA, 22 bp, Homo sapiens
gttcttcagtcacatcacagaa

SEQ ID NO: 9049389 - DNA, 22 bp, Homo sapiens
gttattgtttatcctgcacccc

SEQ ID NO: 9049390 - DNA, 22 bp, Homo sapiens
gttatttataaggtgtaactcc

SEQ ID NO: 9049391 - DNA, 22 bp, Homo sapiens
gttatttaactttgtagcatgg

SEQ ID NO: 9049392 - DNA, 22 bp, Homo sapiens
gttatttaactttgtagcatgg

SEQ ID NO: 9049393 - DNA, 22 bp, Homo sapiens
gttatattgccaagtatattgt

SEQ ID NO: 9049394 - DNA, 22 bp, Homo sapiens
gttatattggcagaagagaaga

SEQ ID NO: 9049395 - DNA, 22 bp, Homo sapiens
gttatataagacaaatcagagt

SEQ ID NO: 9049396 - DNA, 22 bp, Homo sapiens
gttatataattcctgtggtagt

SEQ ID NO: 9049397 - DNA, 22 bp, Homo sapiens
gttatatatagtatttctctga

SEQ ID NO: 9049398 - DNA, 22 bp, Homo sapiens
gtgttatttgagtgggagcgtg

SEQ ID NO: 9049399 - DNA, 22 bp, Homo sapiens
gtgttctgcagaccagcatcat

SEQ ID NO: 9049400 - DNA, 21 bp, Homo sapiens
gtgctgggacacagccaggct

SEQ ID NO: 9049401 - DNA, 22 bp, Homo sapiens
gtgttattagagcattaatttt

SEQ ID NO: 9049402 - DNA, 22 bp, Homo sapiens
gttaacataggagtttgttgta

SEQ ID NO: 9049403 - DNA, 22 bp, Homo sapiens
gttaacataggcttaggggttt

SEQ ID NO: 9049404 - DNA, 23 bp, Homo sapiens
gttaacatggtccatggaagagc

SEQ ID NO: 9049405 - DNA, 22 bp, Homo sapiens
tcaacactaaagaataatcttt

SEQ ID NO: 9049406 - DNA, 22 bp, Homo sapiens
tcaaatgagtgactcacacagg

SEQ ID NO: 9049407 - DNA, 22 bp, Homo sapiens
tcaaccaggaaactattttgct

SEQ ID NO: 9049408 - DNA, 22 bp, Homo sapiens
tcaacactctttggcacagtta

SEQ ID NO: 9049409 - DNA, 22 bp, Homo sapiens
tcaacactggctacagttatgc

SEQ ID NO: 9049410 - DNA, 22 bp, Homo sapiens
tcaagaaactgtgctacagagt

SEQ ID NO: 9049411 - DNA, 22 bp, Homo sapiens
tcacagtgagaaatttgttggc

SEQ ID NO: 9049412 - DNA, 22 bp, Homo sapiens
tcacatttctttatgtagtctt

SEQ ID NO: 9049413 - DNA, 21 bp, Homo sapiens
tcacatttctcatgggtaaat

SEQ ID NO: 9049414 - DNA, 22 bp, Homo sapiens
tcacatactgaaagtccagtga

SEQ ID NO: 9049415 - DNA, 22 bp, Homo sapiens
tcacattgttcttagtttacct

SEQ ID NO: 9049416 - DNA, 22 bp, Homo sapiens
tcacattgttatgtaaatgttt

SEQ ID NO: 9049417 - DNA, 22 bp, Homo sapiens
tcacattgtaggatagcagaga

SEQ ID NO: 9049418 - DNA, 22 bp, Homo sapiens
tcacataaatttaccagatgat

SEQ ID NO: 9049419 - DNA, 22 bp, Homo sapiens
tcacataaattatacaatttca

SEQ ID NO: 9049420 - DNA, 23 bp, Homo sapiens
tcacataatccttcatccacagg

SEQ ID NO: 9049421 - DNA, 23 bp, Homo sapiens
tcacataatccttcatccacagg

SEQ ID NO: 9049422 - DNA, 22 bp, Homo sapiens
tcacatacactaggatattttt

SEQ ID NO: 9049423 - DNA, 22 bp, Homo sapiens
tcagaataagttatgaaatgaa

SEQ ID NO: 9049424 - DNA, 22 bp, Homo sapiens
tcagaaacactcttcttctgtc

SEQ ID NO: 9049425 - DNA, 22 bp, Homo sapiens
tcagaaaccagctctctcaatt

SEQ ID NO: 9049426 - DNA, 22 bp, Homo sapiens
tcagaaacagaaactaagaacc

SEQ ID NO: 9049427 - DNA, 22 bp, Homo sapiens
tcagaaagaacacaggcagtag

SEQ ID NO: 9049428 - DNA, 22 bp, Homo sapiens
tcagaaagcttttacttaaaca

SEQ ID NO: 9049429 - DNA, 22 bp, Homo sapiens
tcagaacaattgggaaccatta

SEQ ID NO: 9049430 - DNA, 22 bp, Homo sapiens
tcactgcgcttcagcctgggtg

SEQ ID NO: 9049431 - DNA, 22 bp, Homo sapiens
tcacatttgttcttgaatctaa

SEQ ID NO: 9049432 - DNA, 22 bp, Homo sapiens
tcacatttgttcctctgcactt

SEQ ID NO: 9049433 - DNA, 22 bp, Homo sapiens
tcacatttgttcctctgcactt

SEQ ID NO: 9049434 - DNA, 22 bp, Homo sapiens
tcagcaggcagtgggtcacaat

SEQ ID NO: 9049435 - DNA, 22 bp, Homo sapiens
tcagcaggcaggaggcatgcca

SEQ ID NO: 9049436 - DNA, 22 bp, Homo sapiens
tcagcaggctctggttgaccat

SEQ ID NO: 9049437 - DNA, 22 bp, Homo sapiens
tcagcaggcggttccttgtggg

SEQ ID NO: 9049438 - DNA, 22 bp, Homo sapiens
tcagcaaatacttattgagcgc

SEQ ID NO: 9049439 - DNA, 22 bp, Homo sapiens
tcagcaaaggcaattcattatt

SEQ ID NO: 9049440 - DNA, 22 bp, Homo sapiens
tcagcaaacattgattggactt

SEQ ID NO: 9049441 - DNA, 22 bp, Homo sapiens
tcagcaaaggaccagcacaggc

SEQ ID NO: 9049442 - DNA, 22 bp, Homo sapiens
tcagcaaaggcaattcattatt

SEQ ID NO: 9049443 - DNA, 22 bp, Homo sapiens
tcagcagggccatgctctctct

SEQ ID NO: 9049444 - DNA, 22 bp, Homo sapiens
tcagcagggcatactgagccta

SEQ ID NO: 9049445 - DNA, 22 bp, Homo sapiens
tcagcagggaggctctgtgccc

SEQ ID NO: 9049446 - DNA, 22 bp, Homo sapiens
tcagcaggctgtcagcaggggc

SEQ ID NO: 9049447 - DNA, 22 bp, Homo sapiens
tcagcagggagaggagaatgca

SEQ ID NO: 9049448 - DNA, 22 bp, Homo sapiens
tcagcagggctgggagctgtga

SEQ ID NO: 9049449 - DNA, 22 bp, Homo sapiens
tcagcagggcctccttgtgcag

SEQ ID NO: 9049450 - DNA, 22 bp, Homo sapiens
tcagcaggggccgttgggtgga

SEQ ID NO: 9049451 - DNA, 17 bp, Homo sapiens
tcagcaggggccaagct

SEQ ID NO: 9049452 - DNA, 22 bp, Homo sapiens
tcagagttctctgtccagatga

SEQ ID NO: 9049453 - DNA, 22 bp, Homo sapiens
tcagacacagatgagacaagga

SEQ ID NO: 9049454 - DNA, 22 bp, Homo sapiens
tcaggacaacaagacttgttta

SEQ ID NO: 9049455 - DNA, 22 bp, Homo sapiens
tcaggacaacctgttttcagac

SEQ ID NO: 9049456 - DNA, 22 bp, Homo sapiens
tcagctctgcctgtggaggcac

SEQ ID NO: 9049457 - DNA, 22 bp, Homo sapiens
tcagtgtttgtggcaaatgtta

SEQ ID NO: 9049458 - DNA, 22 bp, Homo sapiens
tcagtgttttaactgtctttta

SEQ ID NO: 9049459 - DNA, 22 bp, Homo sapiens
tcagtgttttccagggtctact

SEQ ID NO: 9049460 - DNA, 22 bp, Homo sapiens
tcagtgtttcctagagcatata

SEQ ID NO: 9049461 - DNA, 22 bp, Homo sapiens
tcagtgtttcctgtggtacagc

SEQ ID NO: 9049462 - DNA, 22 bp, Homo sapiens
tcagtgtttggtttcagaattg

SEQ ID NO: 9049463 - DNA, 22 bp, Homo sapiens
tcagtgtttgaacccagggtta

SEQ ID NO: 9049464 - DNA, 22 bp, Homo sapiens
tcagtgtttttaaagcaatata

SEQ ID NO: 9049465 - DNA, 22 bp, Homo sapiens
tcataaagttatcaccaaatcc

SEQ ID NO: 9049466 - DNA, 22 bp, Homo sapiens
tcagtgtttattcaatgttatt

SEQ ID NO: 9049467 - DNA, 22 bp, Homo sapiens
tcagtgtttaccgtatgttgtt

SEQ ID NO: 9049468 - DNA, 22 bp, Homo sapiens
tcagtgtttattgcggtgtgta

SEQ ID NO: 9049469 - DNA, 22 bp, Homo sapiens
tcagtgtttcagtttggaaatg

SEQ ID NO: 9049470 - DNA, 22 bp, Homo sapiens
tcagtgttggtcaagaatcagt

SEQ ID NO: 9049471 - DNA, 22 bp, Homo sapiens
tcagtgttggctacatctgcct

SEQ ID NO: 9049472 - DNA, 22 bp, Homo sapiens
tcagtgtttacatgcatccttg

SEQ ID NO: 9049473 - DNA, 22 bp, Homo sapiens
tcagtgttgtgcacatacaaaa

SEQ ID NO: 9049474 - DNA, 22 bp, Homo sapiens
tcagtgttgaattttttgcaaa

SEQ ID NO: 9049475 - DNA, 22 bp, Homo sapiens
tcagtgttggcattcagaaatg

SEQ ID NO: 9049476 - DNA, 22 bp, Homo sapiens
tcagtgttggagataattgcac

SEQ ID NO: 9049477 - DNA, 22 bp, Homo sapiens
tcagtgttcttatttaattagg

SEQ ID NO: 9049478 - DNA, 22 bp, Homo sapiens
tcagtgttctggatttggggca

SEQ ID NO: 9049479 - DNA, 22 bp, Homo sapiens
tcagtcctccacacaggcaccc

SEQ ID NO: 9049480 - DNA, 22 bp, Homo sapiens
tcagtcctccacacaggcaccc

SEQ ID NO: 9049481 - DNA, 22 bp, Homo sapiens
tcagtcctcacttggttctaag

SEQ ID NO: 9049482 - DNA, 22 bp, Homo sapiens
tcagtcctcacttggttctaag

SEQ ID NO: 9049483 - DNA, 18 bp, Homo sapiens
tcagtcctccatagagct

SEQ ID NO: 9049484 - DNA, 22 bp, Homo sapiens
tcagtcctcctctcatagagag

SEQ ID NO: 9049485 - DNA, 22 bp, Homo sapiens
tcagtcctcctctcatagagag

SEQ ID NO: 9049486 - DNA, 18 bp, Homo sapiens
tcagtcctccatagagct

SEQ ID NO: 9049487 - DNA, 22 bp, Homo sapiens
tcagtcctacacgctcagggac

SEQ ID NO: 9049488 - DNA, 23 bp, Homo sapiens
tcagtcctgtaggggctccaggt

SEQ ID NO: 9049489 - DNA, 22 bp, Homo sapiens
tcagtccttatctggtgttcag

SEQ ID NO: 9049490 - DNA, 22 bp, Homo sapiens
tcagtccttggaggattctctt

SEQ ID NO: 9049491 - DNA, 21 bp, Homo sapiens
tcagtcctgttagcctttggg

SEQ ID NO: 9049492 - DNA, 22 bp, Homo sapiens
tcagtcctgatgacaggcccaa

SEQ ID NO: 9049493 - DNA, 22 bp, Homo sapiens
tcagtcctctctgggtttctta

SEQ ID NO: 9049494 - DNA, 22 bp, Homo sapiens
tcagtcctgggccggcatcctc

SEQ ID NO: 9049495 - DNA, 23 bp, Homo sapiens
tcagtcctgtaggggctccaggt

SEQ ID NO: 9049496 - DNA, 22 bp, Homo sapiens
tcagtcctgatgacaggcccaa

SEQ ID NO: 9049497 - DNA, 22 bp, Homo sapiens
tcagtcctctctgggtttctta

SEQ ID NO: 9049498 - DNA, 22 bp, Homo sapiens
tcatgaaaatagatcagaaatt

SEQ ID NO: 9049499 - DNA, 22 bp, Homo sapiens
tcatgaaaatagatcagaaatt

SEQ ID NO: 9049500 - DNA, 22 bp, Homo sapiens
tcatctgttcatacacatgcgt

SEQ ID NO: 9049501 - DNA, 22 bp, Homo sapiens
tcatctgttatttatgcctgag

SEQ ID NO: 9049502 - DNA, 22 bp, Homo sapiens
tcatctgtcaaattgcaataag

SEQ ID NO: 9049503 - DNA, 22 bp, Homo sapiens
tcatacattcagcagatatttg

SEQ ID NO: 9049504 - DNA, 22 bp, Homo sapiens
tcatacattcagcagatatttg

SEQ ID NO: 9049505 - DNA, 22 bp, Homo sapiens
tcatagaaatatcacgtctttt

SEQ ID NO: 9049506 - DNA, 22 bp, Homo sapiens
tcatagaagtagtatccacatt

SEQ ID NO: 9049507 - DNA, 22 bp, Homo sapiens
tcataaatgcagtgtcataaat

SEQ ID NO: 9049508 - DNA, 22 bp, Homo sapiens
tcatacatcttgtatatctatc

SEQ ID NO: 9049509 - DNA, 22 bp, Homo sapiens
tcatacattcagcagatatttg

SEQ ID NO: 9049510 - DNA, 22 bp, Homo sapiens
tcatacatcttgtatatctatc

SEQ ID NO: 9049511 - DNA, 22 bp, Homo sapiens
tcagggctgcagaagaggcagg

SEQ ID NO: 9049512 - DNA, 22 bp, Homo sapiens
tcagggctcaccagcctctgcc

SEQ ID NO: 9049513 - DNA, 22 bp, Homo sapiens
tcagtatcaatagcgtcacaat

SEQ ID NO: 9049514 - DNA, 22 bp, Homo sapiens
tcagtatcatgcggtagccatg

SEQ ID NO: 9049515 - DNA, 22 bp, Homo sapiens
tcagtatccacaaatgctcaaa

SEQ ID NO: 9049516 - DNA, 22 bp, Homo sapiens
tcagtaatattctttaaaatac

SEQ ID NO: 9049517 - DNA, 19 bp, Homo sapiens
tcagtaacttttaagagga

SEQ ID NO: 9049518 - DNA, 22 bp, Homo sapiens
tcagtaaatgagcaaaaatttc

SEQ ID NO: 9049519 - DNA, 22 bp, Homo sapiens
tcatttctattgctactgtctg

SEQ ID NO: 9049520 - DNA, 21 bp, Homo sapiens
tcatttctctatgtatttcac

SEQ ID NO: 9049521 - DNA, 22 bp, Homo sapiens
tcatttctctgagtctgataat

SEQ ID NO: 9049522 - DNA, 22 bp, Homo sapiens
tcatttcagatgcatttagaat

SEQ ID NO: 9049523 - DNA, 22 bp, Homo sapiens
tcatttcagccatttttaaatg

SEQ ID NO: 9049524 - DNA, 23 bp, Homo sapiens
tcatttcacagtgagcttcctag

SEQ ID NO: 9049525 - DNA, 22 bp, Homo sapiens
tcatttatagctaaccttgaat

SEQ ID NO: 9049526 - DNA, 22 bp, Homo sapiens
tcatttaaaatgtaccaggatt

SEQ ID NO: 9049527 - DNA, 22 bp, Homo sapiens
tcattgttttgattccttcatg

SEQ ID NO: 9049528 - DNA, 22 bp, Homo sapiens
tcatttaatagcttttgtcttt

SEQ ID NO: 9049529 - DNA, 22 bp, Homo sapiens
tcatttaattggttttgctcgt

SEQ ID NO: 9049530 - DNA, 22 bp, Homo sapiens
tcatttaataatttttgagtag

SEQ ID NO: 9049531 - DNA, 22 bp, Homo sapiens
tcatgcatatttgtagtagttc

SEQ ID NO: 9049532 - DNA, 22 bp, Homo sapiens
tcattgccatggcatttgcaga

SEQ ID NO: 9049533 - DNA, 22 bp, Homo sapiens
tccaacatttatcaaggttgtt

SEQ ID NO: 9049534 - DNA, 22 bp, Homo sapiens
tccaaatattatgattatagga

SEQ ID NO: 9049535 - DNA, 22 bp, Homo sapiens
tccaaacaccctccatgctgca

SEQ ID NO: 9049536 - DNA, 22 bp, Homo sapiens
tcatttttctcttacacgtaga

SEQ ID NO: 9049537 - DNA, 22 bp, Homo sapiens
tcccagcctggaccctgccagt

SEQ ID NO: 9049538 - DNA, 22 bp, Homo sapiens
tcccaagatgacacagtggacg

SEQ ID NO: 9049539 - DNA, 22 bp, Homo sapiens
tccattatacttctgattcaaa

SEQ ID NO: 9049540 - DNA, 22 bp, Homo sapiens
tccatgttgagaatgctataat

SEQ ID NO: 9049541 - DNA, 22 bp, Homo sapiens
tccatgttggtgattctaatgt

SEQ ID NO: 9049542 - DNA, 22 bp, Homo sapiens
tccattaatgattatttctgtg

SEQ ID NO: 9049543 - DNA, 22 bp, Homo sapiens
tccattatacttctgattcaaa

SEQ ID NO: 9049544 - DNA, 22 bp, Homo sapiens
tccaggctggctcttcaaaatt

SEQ ID NO: 9049545 - DNA, 22 bp, Homo sapiens
tccaggctggagtgcagtggca

SEQ ID NO: 9049546 - DNA, 22 bp, Homo sapiens
tccaggctggagtgcagtggcg

SEQ ID NO: 9049547 - DNA, 22 bp, Homo sapiens
tccaggctagcctggtagagaa

SEQ ID NO: 9049548 - DNA, 22 bp, Homo sapiens
tccaggctacttggattcctgg

SEQ ID NO: 9049549 - DNA, 22 bp, Homo sapiens
tccaggctagagtgcagtggcc

SEQ ID NO: 9049550 - DNA, 22 bp, Homo sapiens
tccaggctaattttgcattgtt

SEQ ID NO: 9049551 - DNA, 23 bp, Homo sapiens
tccaggctgggacttcaactggc

SEQ ID NO: 9049552 - DNA, 21 bp, Homo sapiens
tccagggaacttctcaggaat

SEQ ID NO: 9049553 - DNA, 22 bp, Homo sapiens
tccagggaaggtgtgaggctgg

SEQ ID NO: 9049554 - DNA, 22 bp, Homo sapiens
tccagggaaggtgtgaggctgg

SEQ ID NO: 9049555 - DNA, 21 bp, Homo sapiens
tccagggaatttcaactttta

SEQ ID NO: 9049556 - DNA, 22 bp, Homo sapiens
tccagggaagagcagaggctac

SEQ ID NO: 9049557 - DNA, 22 bp, Homo sapiens
tccagggaagagcagaggctac

SEQ ID NO: 9049558 - DNA, 22 bp, Homo sapiens
tccagggaagagcagaggctac

SEQ ID NO: 9049559 - DNA, 22 bp, Homo sapiens
tccagggacacagagtccttct

SEQ ID NO: 9049560 - DNA, 22 bp, Homo sapiens
tccagggctgggttggctcagc

SEQ ID NO: 9049561 - DNA, 22 bp, Homo sapiens
tccagtcacttcattttacaga

SEQ ID NO: 9049562 - DNA, 22 bp, Homo sapiens
tccagtcaacttaatctcttta

SEQ ID NO: 9049563 - DNA, 22 bp, Homo sapiens
tccagtagaattttattcaaca

SEQ ID NO: 9049564 - DNA, 21 bp, Homo sapiens
tccagggctttgattctctca

SEQ ID NO: 9049565 - DNA, 22 bp, Homo sapiens
tccaggtctggcctgctaggca

SEQ ID NO: 9049566 - DNA, 19 bp, Homo sapiens
tccagggctttatggcttt

SEQ ID NO: 9049567 - DNA, 18 bp, Homo sapiens
tccagggcttcctcctct

SEQ ID NO: 9049568 - DNA, 20 bp, Homo sapiens
tcccaggctgggctccagct

SEQ ID NO: 9049569 - DNA, 22 bp, Homo sapiens
tccctgcctcctggcagtgcca

SEQ ID NO: 9049570 - DNA, 22 bp, Homo sapiens
tccctgggaacaaaggatgaga

SEQ ID NO: 9049571 - DNA, 22 bp, Homo sapiens
tccctggcactgctgtgattag

SEQ ID NO: 9049572 - DNA, 22 bp, Homo sapiens
tcctagctggcctctcaccagc

SEQ ID NO: 9049573 - DNA, 20 bp, Homo sapiens
tcctagcttctctctgtaca

SEQ ID NO: 9049574 - DNA, 22 bp, Homo sapiens
tcctaggcagttggtgctccat

SEQ ID NO: 9049575 - DNA, 22 bp, Homo sapiens
tcctagcttgtcagttctctaa

SEQ ID NO: 9049576 - DNA, 22 bp, Homo sapiens
tcctaggcccagcctgagctgt

SEQ ID NO: 9049577 - DNA, 22 bp, Homo sapiens
tccgtgcccctggcactaggtc

SEQ ID NO: 9049578 - DNA, 22 bp, Homo sapiens
tcctcagcaaacacttcactct

SEQ ID NO: 9049579 - DNA, 22 bp, Homo sapiens
tcctcagagcagccctccgcat

SEQ ID NO: 9049580 - DNA, 19 bp, Homo sapiens
tcctgaagatttcctcagc

SEQ ID NO: 9049581 - DNA, 22 bp, Homo sapiens
tcctcttctgcctatatctgcc

SEQ ID NO: 9049582 - DNA, 22 bp, Homo sapiens
tcctctggttatacttgcaccc

SEQ ID NO: 9049583 - DNA, 22 bp, Homo sapiens
tcctctggttatacttgcaccc

SEQ ID NO: 9049584 - DNA, 19 bp, Homo sapiens
tcctctggtaccacccttg

SEQ ID NO: 9049585 - DNA, 19 bp, Homo sapiens
tcctctggtaccacccttg

SEQ ID NO: 9049586 - DNA, 22 bp, Homo sapiens
tcctctgggcctatttgttcac

SEQ ID NO: 9049587 - DNA, 22 bp, Homo sapiens
tcctcagtaaggcatggctttg

SEQ ID NO: 9049588 - DNA, 22 bp, Homo sapiens
tcctcagtaaggatcgtcagct

SEQ ID NO: 9049589 - DNA, 22 bp, Homo sapiens
tcctctgggctccctgcaacag

SEQ ID NO: 9049590 - DNA, 22 bp, Homo sapiens
tcctctggggcgtggtcctgga

SEQ ID NO: 9049591 - DNA, 22 bp, Homo sapiens
tcctctgggctccctgcaacag

SEQ ID NO: 9049592 - DNA, 19 bp, Homo sapiens
tcctgcagaccagacctgt

SEQ ID NO: 9049593 - DNA, 22 bp, Homo sapiens
tcctgcagagacagaggcctca

SEQ ID NO: 9049594 - DNA, 22 bp, Homo sapiens
tcctgcagacctcagtcaggtc

SEQ ID NO: 9049595 - DNA, 22 bp, Homo sapiens
tcctgcagacatttacaccttt

SEQ ID NO: 9049596 - DNA, 21 bp, Homo sapiens
tcctgcagaatgccttcctac

SEQ ID NO: 9049597 - DNA, 22 bp, Homo sapiens
tcctgcagagccgccctcaggt

SEQ ID NO: 9049598 - DNA, 22 bp, Homo sapiens
tcctgcagagccgccctcaggt

SEQ ID NO: 9049599 - DNA, 22 bp, Homo sapiens
tcctgcagagtcccactgattt

SEQ ID NO: 9049600 - DNA, 23 bp, Homo sapiens
tcctgcagataagctggttgaca

SEQ ID NO: 9049601 - DNA, 22 bp, Homo sapiens
tcctgcagatcaaagcctttga

SEQ ID NO: 9049602 - DNA, 22 bp, Homo sapiens
tcctgcagccattagaggtcaa

SEQ ID NO: 9049603 - DNA, 22 bp, Homo sapiens
tcctgcaggtggatgattctct

SEQ ID NO: 9049604 - DNA, 20 bp, Homo sapiens
tcctgcagtcgctagcgccc

SEQ ID NO: 9049605 - DNA, 20 bp, Homo sapiens
tcctgcagtcgctagcgccc

SEQ ID NO: 9049606 - DNA, 18 bp, Homo sapiens
tcctgcagcttctatgta

SEQ ID NO: 9049607 - DNA, 22 bp, Homo sapiens
tcctgcaggcttgagtcctcag

SEQ ID NO: 9049608 - DNA, 22 bp, Homo sapiens
tcctgcaggcctgttcccagta

SEQ ID NO: 9049609 - DNA, 22 bp, Homo sapiens
tcctgcaggccagaggggtgag

SEQ ID NO: 9049610 - DNA, 22 bp, Homo sapiens
tcctgcagctctgagaagcatc

SEQ ID NO: 9049611 - DNA, 22 bp, Homo sapiens
tcctgcagctgaagctcatgtg

SEQ ID NO: 9049612 - DNA, 22 bp, Homo sapiens
tcctgcagctgcagacctgggg

SEQ ID NO: 9049613 - DNA, 22 bp, Homo sapiens
tcctgcctaccttgcggaggtg

SEQ ID NO: 9049614 - DNA, 22 bp, Homo sapiens
tcctgcctgcaatcccagcact

SEQ ID NO: 9049615 - DNA, 22 bp, Homo sapiens
gagtaaaagatgaggcagtaga

SEQ ID NO: 9049616 - DNA, 22 bp, Homo sapiens
gaggttggtgaggggacacggt

SEQ ID NO: 9049617 - DNA, 22 bp, Homo sapiens
gagtaaaagttggattacaaag

SEQ ID NO: 9049618 - DNA, 22 bp, Homo sapiens
gagtaaggctgctgatggagtg

SEQ ID NO: 9049619 - DNA, 22 bp, Homo sapiens
gagtaaggctgctgatggagtg

SEQ ID NO: 9049620 - DNA, 22 bp, Homo sapiens
gaggtgagaagggggtcagatg

SEQ ID NO: 9049621 - DNA, 22 bp, Homo sapiens
gaggtggaaggcaggaacaaat

SEQ ID NO: 9049622 - DNA, 22 bp, Homo sapiens
gagggtgggctcctatctgggt

SEQ ID NO: 9049623 - DNA, 22 bp, Homo sapiens
gagggctgataacaggaataca

SEQ ID NO: 9049624 - DNA, 22 bp, Homo sapiens
gaggcctggtttgcatgagaat

SEQ ID NO: 9049625 - DNA, 22 bp, Homo sapiens
gaggctatgaggagtgaggttt

SEQ ID NO: 9049626 - DNA, 22 bp, Homo sapiens
gagggccacgttcagggctctc

SEQ ID NO: 9049627 - DNA, 22 bp, Homo sapiens
gagggaagaaagaattgatgcg

SEQ ID NO: 9049628 - DNA, 22 bp, Homo sapiens
gagctcattcattcattgcctg

SEQ ID NO: 9049629 - DNA, 22 bp, Homo sapiens
gagctcctatggtcggtggctc

SEQ ID NO: 9049630 - DNA, 22 bp, Homo sapiens
gagctcctgctgcatcctgcct

SEQ ID NO: 9049631 - DNA, 22 bp, Homo sapiens
gagctcctgaaacgttcctgcc

SEQ ID NO: 9049632 - DNA, 22 bp, Homo sapiens
gagctcctggattgctcctagg

SEQ ID NO: 9049633 - DNA, 22 bp, Homo sapiens
gagctgtggtcaacaggaaatt

SEQ ID NO: 9049634 - DNA, 22 bp, Homo sapiens
gaggagagaacattcctccata

SEQ ID NO: 9049635 - DNA, 22 bp, Homo sapiens
gaggagactgacagcagattct

SEQ ID NO: 9049636 - DNA, 22 bp, Homo sapiens
gaggagacggggtgcctggagc

SEQ ID NO: 9049637 - DNA, 22 bp, Homo sapiens
gaggagacatatttttgaagca

SEQ ID NO: 9049638 - DNA, 22 bp, Homo sapiens
gaggagacagtggagccgctac

SEQ ID NO: 9049639 - DNA, 18 bp, Homo sapiens
gaggatggaaggagatgc

SEQ ID NO: 9049640 - DNA, 22 bp, Homo sapiens
gaggatggaggcagttagggcc

SEQ ID NO: 9049641 - DNA, 22 bp, Homo sapiens
gaggcatggcctgaggctagga

SEQ ID NO: 9049642 - DNA, 22 bp, Homo sapiens
gaggccacggttttccttgggg

SEQ ID NO: 9049643 - DNA, 22 bp, Homo sapiens
gaggccacggaagggagctgtg

SEQ ID NO: 9049644 - DNA, 21 bp, Homo sapiens
gaggccactaataggggcaga

SEQ ID NO: 9049645 - DNA, 22 bp, Homo sapiens
gaggccacttcctactggagga

SEQ ID NO: 9049646 - DNA, 22 bp, Homo sapiens
gagaggaggtggctatgacagc

SEQ ID NO: 9049647 - DNA, 22 bp, Homo sapiens
gagaggaggtggctatgacagc

SEQ ID NO: 9049648 - DNA, 22 bp, Homo sapiens
gagagcaggaggcagcgggacg

SEQ ID NO: 9049649 - DNA, 22 bp, Homo sapiens
gagagcaggctctcgggggcca

SEQ ID NO: 9049650 - DNA, 22 bp, Homo sapiens
gagagaagaaagccatggtcct

SEQ ID NO: 9049651 - DNA, 22 bp, Homo sapiens
gagagaagggacttctacactt

SEQ ID NO: 9049652 - DNA, 22 bp, Homo sapiens
gagaagccgagtcagctgagcc

SEQ ID NO: 9049653 - DNA, 22 bp, Homo sapiens
gagaaagggaacttacagagtg

SEQ ID NO: 9049654 - DNA, 22 bp, Homo sapiens
gagaacaggctctggagtcaga

SEQ ID NO: 9049655 - DNA, 22 bp, Homo sapiens
gagaagaacttgggcaaagtca

SEQ ID NO: 9049656 - DNA, 22 bp, Homo sapiens
gagcaagactcactgcatcttg

SEQ ID NO: 9049657 - DNA, 22 bp, Homo sapiens
gagatttattgacttaacagta

SEQ ID NO: 9049658 - DNA, 22 bp, Homo sapiens
gagaggagtccctatcacagtt

SEQ ID NO: 9049659 - DNA, 22 bp, Homo sapiens
gagcaacttcaatagtactatt

SEQ ID NO: 9049660 - DNA, 22 bp, Homo sapiens
gagcacagtaaagcagtgtcac

SEQ ID NO: 9049661 - DNA, 22 bp, Homo sapiens
gaatttacaagttgaataacaa

SEQ ID NO: 9049662 - DNA, 22 bp, Homo sapiens
gaatttaaggaccaagcatttt

SEQ ID NO: 9049663 - DNA, 22 bp, Homo sapiens
gaattttgcttttatgtcaagt

SEQ ID NO: 9049664 - DNA, 22 bp, Homo sapiens
gaatttttctggaagcaattat

SEQ ID NO: 9049665 - DNA, 20 bp, Homo sapiens
gacaacagagtaccaggaag

SEQ ID NO: 9049666 - DNA, 22 bp, Homo sapiens
gacaaagagaagtaacagtacc

SEQ ID NO: 9049667 - DNA, 19 bp, Homo sapiens
gaatgcagaagagagtgga

SEQ ID NO: 9049668 - DNA, 19 bp, Homo sapiens
gaatgcagaagagagtgga

SEQ ID NO: 9049669 - DNA, 22 bp, Homo sapiens
gaatgcagctgacagtcgtttt

SEQ ID NO: 9049670 - DNA, 22 bp, Homo sapiens
gaatgcagtgacggaggcttac

SEQ ID NO: 9049671 - DNA, 22 bp, Homo sapiens
gaatgcagatggctggtgtatg

SEQ ID NO: 9049672 - DNA, 22 bp, Homo sapiens
gaatgcatgtgaagcaaagaat

SEQ ID NO: 9049673 - DNA, 22 bp, Homo sapiens
gaatgcagctgacagtcgtttt

SEQ ID NO: 9049674 - DNA, 22 bp, Homo sapiens
gaatgcagtggcaccatctcag

SEQ ID NO: 9049675 - DNA, 22 bp, Homo sapiens
gaatgcagttcatttctctatg

SEQ ID NO: 9049676 - DNA, 22 bp, Homo sapiens
gaatgcagtggtgagatcttgg

SEQ ID NO: 9049677 - DNA, 22 bp, Homo sapiens
gaatgcagtggtgagatcttgg

SEQ ID NO: 9049678 - DNA, 22 bp, Homo sapiens
gaatgcagtgacggaggcttac

SEQ ID NO: 9049679 - DNA, 22 bp, Homo sapiens
gaatgcagggctcctaagattc

SEQ ID NO: 9049680 - DNA, 22 bp, Homo sapiens
gaagaattgcccatttctgtct

SEQ ID NO: 9049681 - DNA, 22 bp, Homo sapiens
gaatggctgaatgtcttaaatt

SEQ ID NO: 9049682 - DNA, 23 bp, Homo sapiens
gaatggctaagcacatagacttg

SEQ ID NO: 9049683 - DNA, 22 bp, Homo sapiens
gaatggctatcggattattagg

SEQ ID NO: 9049684 - DNA, 22 bp, Homo sapiens
gaatgctgtagacagactctat

SEQ ID NO: 9049685 - DNA, 22 bp, Homo sapiens
gaatgctgagtcttatctctta

SEQ ID NO: 9049686 - DNA, 22 bp, Homo sapiens
gaattacataataaaatgagag

SEQ ID NO: 9049687 - DNA, 22 bp, Homo sapiens
gacctgaaatttgtggtagaac

SEQ ID NO: 9049688 - DNA, 22 bp, Homo sapiens
gacatgttatctctggcttcaa

SEQ ID NO: 9049689 - DNA, 22 bp, Homo sapiens
gacatgatggaaaaaaatgctc

SEQ ID NO: 9049690 - DNA, 22 bp, Homo sapiens
gactatgtgtgctttgtgaatg

SEQ ID NO: 9049691 - DNA, 22 bp, Homo sapiens
gactatgtgtattttactcacc

SEQ ID NO: 9049692 - DNA, 22 bp, Homo sapiens
gactatgtgcctgcgagtgtca

SEQ ID NO: 9049693 - DNA, 22 bp, Homo sapiens
gactatgtgggagggacaagga

SEQ ID NO: 9049694 - DNA, 22 bp, Homo sapiens
gactatgtaatggatggcatga

SEQ ID NO: 9049695 - DNA, 22 bp, Homo sapiens
gactatgtgaagtgtgaatagg

SEQ ID NO: 9049696 - DNA, 22 bp, Homo sapiens
gaccttcttgctgtgtcctaac

SEQ ID NO: 9049697 - DNA, 22 bp, Homo sapiens
gacagcatctgtgtggcaggag

SEQ ID NO: 9049698 - DNA, 22 bp, Homo sapiens
gacagcattccatctgcaggtt

SEQ ID NO: 9049699 - DNA, 22 bp, Homo sapiens
gacagctccagctcctccaggc

SEQ ID NO: 9049700 - DNA, 22 bp, Homo sapiens
gacagctccttttggtgcatat

SEQ ID NO: 9049701 - DNA, 22 bp, Homo sapiens
gacatctgaatttagcagtttt

SEQ ID NO: 9049702 - DNA, 22 bp, Homo sapiens
cttcttcaagaggaccatccag

SEQ ID NO: 9049703 - DNA, 20 bp, Homo sapiens
cttcttcagcctatgcttca

SEQ ID NO: 9049704 - DNA, 22 bp, Homo sapiens
cttcttcaatagcaagcgcata

SEQ ID NO: 9049705 - DNA, 22 bp, Homo sapiens
cttcttcagaggccagcctctg

SEQ ID NO: 9049706 - DNA, 22 bp, Homo sapiens
cttcttcataggcagtcctgtt

SEQ ID NO: 9049707 - DNA, 22 bp, Homo sapiens
cttccccaagtagagaggggag

SEQ ID NO: 9049708 - DNA, 22 bp, Homo sapiens
cttcactgggctcctgagaggg

SEQ ID NO: 9049709 - DNA, 22 bp, Homo sapiens
cttcactgtgcttcaagcagct

SEQ ID NO: 9049710 - DNA, 22 bp, Homo sapiens
cttcactgtttggttcacagca

SEQ ID NO: 9049711 - DNA, 22 bp, Homo sapiens
cttcacttcacagatgccaaga

SEQ ID NO: 9049712 - DNA, 22 bp, Homo sapiens
cttcacattgggcttgatatga

SEQ ID NO: 9049713 - DNA, 22 bp, Homo sapiens
cttcttccaagcttatgctcaa

SEQ ID NO: 9049714 - DNA, 22 bp, Homo sapiens
cttcttcctgctgcagcctcca

SEQ ID NO: 9049715 - DNA, 22 bp, Homo sapiens
cttggacccactcccagaattg

SEQ ID NO: 9049716 - DNA, 23 bp, Homo sapiens
ctttcctttctttgacacccagc

SEQ ID NO: 9049717 - DNA, 22 bp, Homo sapiens
ctttccttctcgtggttctcac

SEQ ID NO: 9049718 - DNA, 22 bp, Homo sapiens
ctttctcagtgttaattacttt

SEQ ID NO: 9049719 - DNA, 22 bp, Homo sapiens
ctttgcataatgaatgatcata

SEQ ID NO: 9049720 - DNA, 22 bp, Homo sapiens
ctttgcatacaatttttagaaa

SEQ ID NO: 9049721 - DNA, 22 bp, Homo sapiens
ctttggcacagtgtttactagc

SEQ ID NO: 9049722 - DNA, 22 bp, Homo sapiens
ctttggaaggtcgtccgtgtgg

SEQ ID NO: 9049723 - DNA, 22 bp, Homo sapiens
gaaactttcatgaatataagat

SEQ ID NO: 9049724 - DNA, 22 bp, Homo sapiens
gaaactttggctaaaagccaga

SEQ ID NO: 9049725 - DNA, 22 bp, Homo sapiens
gaaactgtgatcgtgttctggg

SEQ ID NO: 9049726 - DNA, 22 bp, Homo sapiens
gaaactgtgaggatcttaactt

SEQ ID NO: 9049727 - DNA, 22 bp, Homo sapiens
gaaactgtgaggatcttaactt

SEQ ID NO: 9049728 - DNA, 22 bp, Homo sapiens
gaaacttacttactcacatttc

SEQ ID NO: 9049729 - DNA, 22 bp, Homo sapiens
gaaacttcttgtctcacagttc

SEQ ID NO: 9049730 - DNA, 22 bp, Homo sapiens
gaaactgtttctggctttggtg

SEQ ID NO: 9049731 - DNA, 22 bp, Homo sapiens
gaaagaatgctgggagccatct

SEQ ID NO: 9049732 - DNA, 22 bp, Homo sapiens
gaaacttttaaacctcatgagt

SEQ ID NO: 9049733 - DNA, 22 bp, Homo sapiens
gaaagaagctttagatggctat

SEQ ID NO: 9049734 - DNA, 22 bp, Homo sapiens
gaaacgttggcataagtttatg

SEQ ID NO: 9049735 - DNA, 22 bp, Homo sapiens
gaaacgttaaaccatatgtaat

SEQ ID NO: 9049736 - DNA, 22 bp, Homo sapiens
gaaacctacctgaaatgaattg

SEQ ID NO: 9049737 - DNA, 21 bp, Homo sapiens
gaaaccaggttatcaatcaca

SEQ ID NO: 9049738 - DNA, 22 bp, Homo sapiens
gaaaccagtttgtaccaagatc

SEQ ID NO: 9049739 - DNA, 22 bp, Homo sapiens
gaaactgtatgtagtttttggg

SEQ ID NO: 9049740 - DNA, 22 bp, Homo sapiens
gaaacgttgtggaaaatcctct

SEQ ID NO: 9049741 - DNA, 22 bp, Homo sapiens
gaaaccagataagggaggctga

SEQ ID NO: 9049742 - DNA, 22 bp, Homo sapiens
gaaaccagctagaggcagaggg

SEQ ID NO: 9049743 - DNA, 22 bp, Homo sapiens
gaaaccagcatttaaaccagga

SEQ ID NO: 9049744 - DNA, 22 bp, Homo sapiens
gaaatattgggactcagagctt

SEQ ID NO: 9049745 - DNA, 22 bp, Homo sapiens
gaaatattgtactggagatgtt

SEQ ID NO: 9049746 - DNA, 22 bp, Homo sapiens
gaaatatttctcttgagcccct

SEQ ID NO: 9049747 - DNA, 22 bp, Homo sapiens
gaaatattacagtggaggggat

SEQ ID NO: 9049748 - DNA, 22 bp, Homo sapiens
gaaatattcttgtcttgttttc

SEQ ID NO: 9049749 - DNA, 22 bp, Homo sapiens
gaaatacagaaagggctgaatg

SEQ ID NO: 9049750 - DNA, 22 bp, Homo sapiens
gaaatacaggaatgccacacag

SEQ ID NO: 9049751 - DNA, 22 bp, Homo sapiens
gaaagacatagttgcaagatgg

SEQ ID NO: 9049752 - DNA, 22 bp, Homo sapiens
gaaatgttgtcctgtctcttga

SEQ ID NO: 9049753 - DNA, 22 bp, Homo sapiens
gaaattcaaaatgtcagtatag

SEQ ID NO: 9049754 - DNA, 22 bp, Homo sapiens
gaaattcaaataagatatgtag

SEQ ID NO: 9049755 - DNA, 22 bp, Homo sapiens
gaaattcaaataagatatgtag

SEQ ID NO: 9049756 - DNA, 22 bp, Homo sapiens
gaaattcaccttttacgtggcc

SEQ ID NO: 9049757 - DNA, 22 bp, Homo sapiens
gaaattcaccttttacgtggcc

SEQ ID NO: 9049758 - DNA, 22 bp, Homo sapiens
gaaattgaaaccgatctgtgtt

SEQ ID NO: 9049759 - DNA, 22 bp, Homo sapiens
gaaattgaataccctgcatgaa

SEQ ID NO: 9049760 - DNA, 22 bp, Homo sapiens
gaaattgaaagaccaactgcat

SEQ ID NO: 9049761 - DNA, 22 bp, Homo sapiens
gaaattcaggacaaagactctt

SEQ ID NO: 9049762 - DNA, 22 bp, Homo sapiens
gaaattcactgtatttcttggg

SEQ ID NO: 9049763 - DNA, 22 bp, Homo sapiens
gaacttcttctttaagagactc

SEQ ID NO: 9049764 - DNA, 22 bp, Homo sapiens
gaacttcttcaacataatggac

SEQ ID NO: 9049765 - DNA, 22 bp, Homo sapiens
gaagaactgtgacagaagcagt

SEQ ID NO: 9049766 - DNA, 22 bp, Homo sapiens
gaagaagacatggaacaatagt

SEQ ID NO: 9049767 - DNA, 22 bp, Homo sapiens
ctggagctccagggtctcctct

SEQ ID NO: 9049768 - DNA, 22 bp, Homo sapiens
ctgggctcagcaggccaaggcc

SEQ ID NO: 9049769 - DNA, 22 bp, Homo sapiens
ctgggctcagtggctcatggct

SEQ ID NO: 9049770 - DNA, 22 bp, Homo sapiens
ctgggctcagcccatgctgtcc

SEQ ID NO: 9049771 - DNA, 22 bp, Homo sapiens
ctgggctccactacttgctaac

SEQ ID NO: 9049772 - DNA, 22 bp, Homo sapiens
ctgggctccactcccacagtgt

SEQ ID NO: 9049773 - DNA, 22 bp, Homo sapiens
ctggggggctactgacagagga

SEQ ID NO: 9049774 - DNA, 22 bp, Homo sapiens
ctgggggtcttgaaagggagag

SEQ ID NO: 9049775 - DNA, 22 bp, Homo sapiens
ctgggggcagcaagaagccatg

SEQ ID NO: 9049776 - DNA, 20 bp, Homo sapiens
ctgggctcggtggccctggc

SEQ ID NO: 9049777 - DNA, 18 bp, Homo sapiens
ctgggctcgagagatcct

SEQ ID NO: 9049778 - DNA, 22 bp, Homo sapiens
ctgggctcctaaccatccaggt

SEQ ID NO: 9049779 - DNA, 22 bp, Homo sapiens
ctgggctccctcatgtgtctgc

SEQ ID NO: 9049780 - DNA, 22 bp, Homo sapiens
ctgggtgtagatggaagtttgg

SEQ ID NO: 9049781 - DNA, 22 bp, Homo sapiens
ctgggtgtcaggagacatgatg

SEQ ID NO: 9049782 - DNA, 22 bp, Homo sapiens
ctgggtgtagcccagtatgagg

SEQ ID NO: 9049783 - DNA, 22 bp, Homo sapiens
ctgggtgttgggtactgaccgt

SEQ ID NO: 9049784 - DNA, 22 bp, Homo sapiens
ctgggtgttgggtactgaccgt

SEQ ID NO: 9049785 - DNA, 22 bp, Homo sapiens
ctggtacatttgatgataatag

SEQ ID NO: 9049786 - DNA, 22 bp, Homo sapiens
ctggtacagtgttacaaaatgg

SEQ ID NO: 9049787 - DNA, 22 bp, Homo sapiens
ctgtccctctcacacctcacca

SEQ ID NO: 9049788 - DNA, 22 bp, Homo sapiens
ctgtccctcatcacctctgggt

SEQ ID NO: 9049789 - DNA, 22 bp, Homo sapiens
ctgtgaggcgggtggagtggag

SEQ ID NO: 9049790 - DNA, 22 bp, Homo sapiens
ctgtgaggccctgggtgctgga

SEQ ID NO: 9049791 - DNA, 22 bp, Homo sapiens
ctgtccatggtgctggacggtc

SEQ ID NO: 9049792 - DNA, 22 bp, Homo sapiens
ctgtcattgagcctgtcagggc

SEQ ID NO: 9049793 - DNA, 22 bp, Homo sapiens
ctgtcattcttacataatgtga

SEQ ID NO: 9049794 - DNA, 22 bp, Homo sapiens
ctggttctgatgttcttggctt

SEQ ID NO: 9049795 - DNA, 22 bp, Homo sapiens
ctgtggggaagatagaaccgac

SEQ ID NO: 9049796 - DNA, 22 bp, Homo sapiens
ctgtggcattgtgaggactgca

SEQ ID NO: 9049797 - DNA, 22 bp, Homo sapiens
ctgtggcaggaagggactagca

SEQ ID NO: 9049798 - DNA, 22 bp, Homo sapiens
ctctgaatactttaagaattgt

SEQ ID NO: 9049799 - DNA, 22 bp, Homo sapiens
tttcttggagctcttagggtcg

SEQ ID NO: 9049800 - DNA, 22 bp, Homo sapiens
tttgagaactttggtattttcc

SEQ ID NO: 9049801 - DNA, 22 bp, Homo sapiens
tttgagaaccctgtattttaag

SEQ ID NO: 9049802 - DNA, 22 bp, Homo sapiens
tttgagaagatgtaatgttaag

SEQ ID NO: 9049803 - DNA, 22 bp, Homo sapiens
tttgagaaactgattattatgg

SEQ ID NO: 9049804 - DNA, 22 bp, Homo sapiens
tttgagaaaggggatttaattc

SEQ ID NO: 9049805 - DNA, 22 bp, Homo sapiens
ctctggctatctgtttctatgt

SEQ ID NO: 9049806 - DNA, 22 bp, Homo sapiens
ctctggctatctgtttctatgt

SEQ ID NO: 9049807 - DNA, 22 bp, Homo sapiens
ctctggctccatttccctatgt

SEQ ID NO: 9049808 - DNA, 22 bp, Homo sapiens
tttggaatgacagatatcaata

SEQ ID NO: 9049809 - DNA, 21 bp, Homo sapiens
tttgttcaggcaagttacagt

SEQ ID NO: 9049810 - DNA, 22 bp, Homo sapiens
ctctgggtgttaatgtcagtgt

SEQ ID NO: 9049811 - DNA, 23 bp, Homo sapiens
ctctgggtccgatgtcctgacag

SEQ ID NO: 9049812 - DNA, 17 bp, Homo sapiens
ctctgggtctcctgctt

SEQ ID NO: 9049813 - DNA, 22 bp, Homo sapiens
tttcagaagtcacagttgactg

SEQ ID NO: 9049814 - DNA, 22 bp, Homo sapiens
ctccttcctgccccagtgataa

SEQ ID NO: 9049815 - DNA, 22 bp, Homo sapiens
ctccttcccctactcagcatcc

SEQ ID NO: 9049816 - DNA, 22 bp, Homo sapiens
ctccttcccttcaagtgttcct

SEQ ID NO: 9049817 - DNA, 22 bp, Homo sapiens
tttcagaacataatgtgagcat

SEQ ID NO: 9049818 - DNA, 22 bp, Homo sapiens
tttcagaaatggcactgaaatc

SEQ ID NO: 9049819 - DNA, 22 bp, Homo sapiens
tttcagaaattatattagatgc

SEQ ID NO: 9049820 - DNA, 22 bp, Homo sapiens
tttcagaaccgctaaaataaat

SEQ ID NO: 9049821 - DNA, 22 bp, Homo sapiens
tttcagaaccaagagagacatc

SEQ ID NO: 9049822 - DNA, 22 bp, Homo sapiens
tttattcatcatctgttcatat

SEQ ID NO: 9049823 - DNA, 22 bp, Homo sapiens
tttattcatcatctgttcatat

SEQ ID NO: 9049824 - DNA, 20 bp, Homo sapiens
tttattcagcctaccctctt

SEQ ID NO: 9049825 - DNA, 22 bp, Homo sapiens
tttattcattgtttcgtcgcag

SEQ ID NO: 9049826 - DNA, 22 bp, Homo sapiens
tttattccaaagcttgcacttt

SEQ ID NO: 9049827 - DNA, 22 bp, Homo sapiens
tttcacatataggggaagctac

SEQ ID NO: 9049828 - DNA, 22 bp, Homo sapiens
tttattcacttcagtgccaaag

SEQ ID NO: 9049829 - DNA, 22 bp, Homo sapiens
tttattcactggggtctgcccg

SEQ ID NO: 9049830 - DNA, 22 bp, Homo sapiens
tttattcacttcagtgccaaag

SEQ ID NO: 9049831 - DNA, 22 bp, Homo sapiens
tttattcagcagcagcagtggt

SEQ ID NO: 9049832 - DNA, 22 bp, Homo sapiens
tttattcacttcagtgccaaag

SEQ ID NO: 9049833 - DNA, 22 bp, Homo sapiens
tttattcactcattcagccagt

SEQ ID NO: 9049834 - DNA, 22 bp, Homo sapiens
tttatgtaagtggaatgatgcc

SEQ ID NO: 9049835 - DNA, 23 bp, Homo sapiens
tttatgcagcatgtagaacatgg

SEQ ID NO: 9049836 - DNA, 22 bp, Homo sapiens
tttatgcatctctaggaagggc

SEQ ID NO: 9049837 - DNA, 22 bp, Homo sapiens
tttatggcacacaaatatcaaa

SEQ ID NO: 9049838 - DNA, 22 bp, Homo sapiens
tttatgcacacttagacatggc

SEQ ID NO: 9049839 - DNA, 22 bp, Homo sapiens
tttatgcagatttgtacagtga

SEQ ID NO: 9049840 - DNA, 22 bp, Homo sapiens
tttctcaaggtgtcatgtattt

SEQ ID NO: 9049841 - DNA, 22 bp, Homo sapiens
tttctcaagttcagatatttga

SEQ ID NO: 9049842 - DNA, 22 bp, Homo sapiens
tttctcaacctcaacactattt

SEQ ID NO: 9049843 - DNA, 22 bp, Homo sapiens
tttctcaactgtattatgcaga

SEQ ID NO: 9049844 - DNA, 22 bp, Homo sapiens
tttctattttaaaggcatatgg

SEQ ID NO: 9049845 - DNA, 22 bp, Homo sapiens
tttctacatgtcagtaactgat

SEQ ID NO: 9049846 - DNA, 22 bp, Homo sapiens
tttctacatgtcaatccaaacc

SEQ ID NO: 9049847 - DNA, 22 bp, Homo sapiens
tttctacagtactgatttcata

SEQ ID NO: 9049848 - DNA, 22 bp, Homo sapiens
tttctcaacagagtatgccctt

SEQ ID NO: 9049849 - DNA, 18 bp, Homo sapiens
ctctctttccactctttg

SEQ ID NO: 9049850 - DNA, 22 bp, Homo sapiens
ctctctttttcgtgtgccgaag

SEQ ID NO: 9049851 - DNA, 22 bp, Homo sapiens
tttctacaacacttctgaatct

SEQ ID NO: 9049852 - DNA, 22 bp, Homo sapiens
tttctacaacacttctgaatct

SEQ ID NO: 9049853 - DNA, 22 bp, Homo sapiens
tttcctttctcaagagccggca

SEQ ID NO: 9049854 - DNA, 22 bp, Homo sapiens
tttcctttctagaagcctaaat

SEQ ID NO: 9049855 - DNA, 22 bp, Homo sapiens
tttctacagctggtgcaacttt

SEQ ID NO: 9049856 - DNA, 22 bp, Homo sapiens
tttctacagaagatacactgct

SEQ ID NO: 9049857 - DNA, 22 bp, Homo sapiens
tttctacagctggtgcaacttt

SEQ ID NO: 9049858 - DNA, 22 bp, Homo sapiens
tttccacactgcagccagcaaa

SEQ ID NO: 9049859 - DNA, 22 bp, Homo sapiens
tttccactcctattgcatctca

SEQ ID NO: 9049860 - DNA, 22 bp, Homo sapiens
tttccacaatttgagcagcaga

SEQ ID NO: 9049861 - DNA, 22 bp, Homo sapiens
tttccacaatgtttttgcagga

SEQ ID NO: 9049862 - DNA, 22 bp, Homo sapiens
tttccaagataatacacagaaa

SEQ ID NO: 9049863 - DNA, 22 bp, Homo sapiens
tttccaactgtaccccagtgtt

SEQ ID NO: 9049864 - DNA, 22 bp, Homo sapiens
tttcattaaagtcaaatctggt

SEQ ID NO: 9049865 - DNA, 22 bp, Homo sapiens
tttcatgttacatttaaaatgt

SEQ ID NO: 9049866 - DNA, 22 bp, Homo sapiens
tttcatgtttatggaaaatgag

SEQ ID NO: 9049867 - DNA, 22 bp, Homo sapiens
ctggagccggcgagccccagcc

SEQ ID NO: 9049868 - DNA, 22 bp, Homo sapiens
ctggaaggtctgtccccactgc

SEQ ID NO: 9049869 - DNA, 22 bp, Homo sapiens
ctggaagaggggaaatgccatg

SEQ ID NO: 9049870 - DNA, 22 bp, Homo sapiens
ctggaagaggacacacgaatca

SEQ ID NO: 9049871 - DNA, 22 bp, Homo sapiens
ctggaagagtcctaaacagata

SEQ ID NO: 9049872 - DNA, 22 bp, Homo sapiens
ctggaaagtgaggagagttcca

SEQ ID NO: 9049873 - DNA, 22 bp, Homo sapiens
ctgcctgtgggtacaagtggaa

SEQ ID NO: 9049874 - DNA, 22 bp, Homo sapiens
ctgctctgtatatgagcaggaa

SEQ ID NO: 9049875 - DNA, 22 bp, Homo sapiens
ctgctctgtggtccatgagaca

SEQ ID NO: 9049876 - DNA, 22 bp, Homo sapiens
ctgctctgaccctttcaccttc

SEQ ID NO: 9049877 - DNA, 21 bp, Homo sapiens
ctgctctgacagtgaggccag

SEQ ID NO: 9049878 - DNA, 22 bp, Homo sapiens
ctgctctgtttcttagctgggt

SEQ ID NO: 9049879 - DNA, 22 bp, Homo sapiens
ctgctctgttcccccatcatct

SEQ ID NO: 9049880 - DNA, 22 bp, Homo sapiens
ctgcggctctgcgggcagctgg

SEQ ID NO: 9049881 - DNA, 22 bp, Homo sapiens
ctgcctttgcccttgacactgt

SEQ ID NO: 9049882 - DNA, 22 bp, Homo sapiens
ctgctgtcgccgagctgcatgc

SEQ ID NO: 9049883 - DNA, 22 bp, Homo sapiens
ctgaggctcaagggcaggtggg

SEQ ID NO: 9049884 - DNA, 22 bp, Homo sapiens
ctgaggctcaagggcaggtggg

SEQ ID NO: 9049885 - DNA, 22 bp, Homo sapiens
ctgaggctccctcgggtctgct

SEQ ID NO: 9049886 - DNA, 22 bp, Homo sapiens
ctgaggctccctcgggtctgct

SEQ ID NO: 9049887 - DNA, 22 bp, Homo sapiens
ctgaggctctgggtgtcactgt

SEQ ID NO: 9049888 - DNA, 18 bp, Homo sapiens
ctgaggctggcaggagcc

SEQ ID NO: 9049889 - DNA, 22 bp, Homo sapiens
ctcttctgtacctcggcctcca

SEQ ID NO: 9049890 - DNA, 22 bp, Homo sapiens
ctcttcttatggccgtggctga

SEQ ID NO: 9049891 - DNA, 22 bp, Homo sapiens
ctcttcctagtgtgcagcgtgg

SEQ ID NO: 9049892 - DNA, 22 bp, Homo sapiens
ctcttcctagtgtgcagcgtgg

SEQ ID NO: 9049893 - DNA, 22 bp, Homo sapiens
ctcttcctctcatgcggtcata

SEQ ID NO: 9049894 - DNA, 22 bp, Homo sapiens
ctcttcctttcccttgagggtg

SEQ ID NO: 9049895 - DNA, 22 bp, Homo sapiens
ctcttccttaagactataaaga

SEQ ID NO: 9049896 - DNA, 22 bp, Homo sapiens
ctcttcctacagtctgctatgc

SEQ ID NO: 9049897 - DNA, 22 bp, Homo sapiens
ctcttcctacagtctgctatgc

SEQ ID NO: 9049898 - DNA, 22 bp, Homo sapiens
ctgcaggaattcaaagtgagct

SEQ ID NO: 9049899 - DNA, 22 bp, Homo sapiens
ctgcaggactgaaagatgaggt

SEQ ID NO: 9049900 - DNA, 22 bp, Homo sapiens
ctgcaggaatctgtgctaggtg

SEQ ID NO: 9049901 - DNA, 22 bp, Homo sapiens
ctgcagctttttgtgcttgtaa

SEQ ID NO: 9049902 - DNA, 22 bp, Homo sapiens
ctgcagcttatttgctgtgtga

SEQ ID NO: 9049903 - DNA, 22 bp, Homo sapiens
ctgcaggagtgaaagcaggcct

SEQ ID NO: 9049904 - DNA, 21 bp, Homo sapiens
ctgcaggatgctgaagccagg

SEQ ID NO: 9049905 - DNA, 21 bp, Homo sapiens
ctgcaggatgctgaagccagg

SEQ ID NO: 9049906 - DNA, 22 bp, Homo sapiens
ctgcaggatttcatgggctgac

SEQ ID NO: 9049907 - DNA, 22 bp, Homo sapiens
ctgcaggagcaaagcctctgct

SEQ ID NO: 9049908 - DNA, 22 bp, Homo sapiens
ctgcaggagcaagcctgggaga

SEQ ID NO: 9049909 - DNA, 20 bp, Homo sapiens
ctgcccagccactgagggat

SEQ ID NO: 9049910 - DNA, 22 bp, Homo sapiens
ctgcccaggaaggagaggatgg

SEQ ID NO: 9049911 - DNA, 22 bp, Homo sapiens
ctgcccccaggctgcatggctg

SEQ ID NO: 9049912 - DNA, 22 bp, Homo sapiens
ttggatccatctcaggcatagg

SEQ ID NO: 9049913 - DNA, 22 bp, Homo sapiens
ttggataaagaggaagattatc

SEQ ID NO: 9049914 - DNA, 22 bp, Homo sapiens
ttggaaggctgaatggcctctc

SEQ ID NO: 9049915 - DNA, 22 bp, Homo sapiens
ctcagtgcagctaggcatgaga

SEQ ID NO: 9049916 - DNA, 22 bp, Homo sapiens
ctcagtccgtcccgctaggtgc

SEQ ID NO: 9049917 - DNA, 22 bp, Homo sapiens
ctcagtctgtcttgtctgtgtt

SEQ ID NO: 9049918 - DNA, 22 bp, Homo sapiens
ctcagtctcttgggctgtgaag

SEQ ID NO: 9049919 - DNA, 22 bp, Homo sapiens
ctccagataggagggggtcccc

SEQ ID NO: 9049920 - DNA, 23 bp, Homo sapiens
ctcagggatagaaaggaagacag

SEQ ID NO: 9049921 - DNA, 22 bp, Homo sapiens
ctcagggaattatttctgtcct

SEQ ID NO: 9049922 - DNA, 22 bp, Homo sapiens
ctcagggaagctatggtgaggg

SEQ ID NO: 9049923 - DNA, 22 bp, Homo sapiens
ttgccctgcgttaccatctctt

SEQ ID NO: 9049924 - DNA, 22 bp, Homo sapiens
ttgccctgcgggtcctgcgcaa

SEQ ID NO: 9049925 - DNA, 22 bp, Homo sapiens
ttgccctggggctggcctggca

SEQ ID NO: 9049926 - DNA, 22 bp, Homo sapiens
ttgccctgtcagtagaagtgca

SEQ ID NO: 9049927 - DNA, 22 bp, Homo sapiens
ttgccctgtcttaagctggcaa

SEQ ID NO: 9049928 - DNA, 22 bp, Homo sapiens
ctcaggaaaatattgaagaagt

SEQ ID NO: 9049929 - DNA, 22 bp, Homo sapiens
ctcaggaaaggccatgcaaggg

SEQ ID NO: 9049930 - DNA, 22 bp, Homo sapiens
ttgcatactgacctctaagctt

SEQ ID NO: 9049931 - DNA, 22 bp, Homo sapiens
ctcactcagtttttagttcatc

SEQ ID NO: 9049932 - DNA, 22 bp, Homo sapiens
ctcacccctgtaattccagcac

SEQ ID NO: 9049933 - DNA, 22 bp, Homo sapiens
ctatacatcccaatttcagaga

SEQ ID NO: 9049934 - DNA, 22 bp, Homo sapiens
ctcacccatatctccatgactc

SEQ ID NO: 9049935 - DNA, 22 bp, Homo sapiens
ctatagaaaattgtatcacacg

SEQ ID NO: 9049936 - DNA, 22 bp, Homo sapiens
ctataaatctacccagcattgg

SEQ ID NO: 9049937 - DNA, 22 bp, Homo sapiens
ttctggctttaggcttttcaag

SEQ ID NO: 9049938 - DNA, 22 bp, Homo sapiens
ctcagaaagggttgctgagggc

SEQ ID NO: 9049939 - DNA, 22 bp, Homo sapiens
ctcagaaaggtgccatttatgt

SEQ ID NO: 9049940 - DNA, 22 bp, Homo sapiens
ttctttctgtcatggtgtactg

SEQ ID NO: 9049941 - DNA, 22 bp, Homo sapiens
ttctttctctgtaaaaggaaaa

SEQ ID NO: 9049942 - DNA, 22 bp, Homo sapiens
ttctttctgggaagagttcaga

SEQ ID NO: 9049943 - DNA, 21 bp, Homo sapiens
ttctttctgaatctgaagtat

SEQ ID NO: 9049944 - DNA, 22 bp, Homo sapiens
ttctatgtggatatagaactgc

SEQ ID NO: 9049945 - DNA, 22 bp, Homo sapiens
ttctatgtcagtgtgctctgtg

SEQ ID NO: 9049946 - DNA, 22 bp, Homo sapiens
ttctgcatcccagaagaggaca

SEQ ID NO: 9049947 - DNA, 22 bp, Homo sapiens
ttctgcataggctatatttgtt

SEQ ID NO: 9049948 - DNA, 22 bp, Homo sapiens
ttctgcatacactgaatgtagt

SEQ ID NO: 9049949 - DNA, 22 bp, Homo sapiens
ttctggaaggatgtttctatct

SEQ ID NO: 9049950 - DNA, 22 bp, Homo sapiens
ttctgcatgtgtttcaaatact

SEQ ID NO: 9049951 - DNA, 22 bp, Homo sapiens
ttctggaactatactgttggtg

SEQ ID NO: 9049952 - DNA, 22 bp, Homo sapiens
ttctgcatggttggggagaagc

SEQ ID NO: 9049953 - DNA, 17 bp, Homo sapiens
ttctgcatgtgaagatg

SEQ ID NO: 9049954 - DNA, 22 bp, Homo sapiens
ttctgcatggagaaactgagtc

SEQ ID NO: 9049955 - DNA, 22 bp, Homo sapiens
ttctgcatctcacagccagtgc

SEQ ID NO: 9049956 - DNA, 22 bp, Homo sapiens
ttctgcatgaaaagaactgaac

SEQ ID NO: 9049957 - DNA, 22 bp, Homo sapiens
ttctgcatgaacagtttattcc

SEQ ID NO: 9049958 - DNA, 22 bp, Homo sapiens
ttctgcatgatattaaatgtaa

SEQ ID NO: 9049959 - DNA, 22 bp, Homo sapiens
ctaaaaatccacactaggtgaa

SEQ ID NO: 9049960 - DNA, 22 bp, Homo sapiens
cgtttattttgaagattccact

SEQ ID NO: 9049961 - DNA, 22 bp, Homo sapiens
cgttttcatgggtagaggttct

SEQ ID NO: 9049962 - DNA, 22 bp, Homo sapiens
ctagaaagatacttaaatcaag

SEQ ID NO: 9049963 - DNA, 22 bp, Homo sapiens
ctagagctttctgctggtgttg

SEQ ID NO: 9049964 - DNA, 22 bp, Homo sapiens
ctagagctgttctgtgcactca

SEQ ID NO: 9049965 - DNA, 22 bp, Homo sapiens
ctagagcagattgcagagtagg

SEQ ID NO: 9049966 - DNA, 22 bp, Homo sapiens
ccttacaatgcagtttacttag

SEQ ID NO: 9049967 - DNA, 22 bp, Homo sapiens
ttaagcaacacacattaattat

SEQ ID NO: 9049968 - DNA, 22 bp, Homo sapiens
ttaagcaacacacattaattat

SEQ ID NO: 9049969 - DNA, 22 bp, Homo sapiens
ttaagcatggaagtgaaataat

SEQ ID NO: 9049970 - DNA, 22 bp, Homo sapiens
ccttacaatgcagtttacttag

SEQ ID NO: 9049971 - DNA, 22 bp, Homo sapiens
ttacaaagagtgccagagtgtg

SEQ ID NO: 9049972 - DNA, 22 bp, Homo sapiens
ttacaaagagtgttcttttcca

SEQ ID NO: 9049973 - DNA, 22 bp, Homo sapiens
ttacaaagagtgttcttttcca

SEQ ID NO: 9049974 - DNA, 22 bp, Homo sapiens
ttacaaagattatattcagtta

SEQ ID NO: 9049975 - DNA, 21 bp, Homo sapiens
ttacaaagcaagtgctgtgtc

SEQ ID NO: 9049976 - DNA, 21 bp, Homo sapiens
ttacaaagcaagtgctgtgtc

SEQ ID NO: 9049977 - DNA, 22 bp, Homo sapiens
ttacaaagattatattcagtta

SEQ ID NO: 9049978 - DNA, 22 bp, Homo sapiens
ttacaaagattatattcagtta

SEQ ID NO: 9049979 - DNA, 22 bp, Homo sapiens
ttacaaagcgctttacctctga

SEQ ID NO: 9049980 - DNA, 22 bp, Homo sapiens
ttacaaagcaggtcagctgaaa

SEQ ID NO: 9049981 - DNA, 22 bp, Homo sapiens
ttacaaagcgttgagacaagta

SEQ ID NO: 9049982 - DNA, 22 bp, Homo sapiens
ttacaaagcgttgagacaagta

SEQ ID NO: 9049983 - DNA, 22 bp, Homo sapiens
ttacaaagcgctttacctctga

SEQ ID NO: 9049984 - DNA, 22 bp, Homo sapiens
ttaaatttctacgtgatccagg

SEQ ID NO: 9049985 - DNA, 22 bp, Homo sapiens
ttaaatttctacgtgatccagg

SEQ ID NO: 9049986 - DNA, 22 bp, Homo sapiens
ttaaattccagcctcataatag

SEQ ID NO: 9049987 - DNA, 22 bp, Homo sapiens
ttaagatttgtagagaaaaagc

SEQ ID NO: 9049988 - DNA, 22 bp, Homo sapiens
ttaagaggtggtcgtgtctgtg

SEQ ID NO: 9049989 - DNA, 22 bp, Homo sapiens
ttaagaggagatcatactggag

SEQ ID NO: 9049990 - DNA, 22 bp, Homo sapiens
ttaagaggtgaggcctttaaga

SEQ ID NO: 9049991 - DNA, 22 bp, Homo sapiens
ttaagagggtgatgctagcatt

SEQ ID NO: 9049992 - DNA, 22 bp, Homo sapiens
ttaaattttagaaacagactct

SEQ ID NO: 9049993 - DNA, 22 bp, Homo sapiens
ttatcattgtcgcagtctaatt

SEQ ID NO: 9049994 - DNA, 22 bp, Homo sapiens
ttataacactgccttgtcacca

SEQ ID NO: 9049995 - DNA, 22 bp, Homo sapiens
ccttgactgtaatggagtaggg

SEQ ID NO: 9049996 - DNA, 22 bp, Homo sapiens
ttataaagattgttatgtatct

SEQ ID NO: 9049997 - DNA, 22 bp, Homo sapiens
ttataaacttgccaagaaggag

SEQ ID NO: 9049998 - DNA, 22 bp, Homo sapiens
ttataaacttgccaagaaggag

SEQ ID NO: 9049999 - DNA, 22 bp, Homo sapiens
ttagcaaagtttgccatctagt

SEQ ID NO: 9050000 - DNA, 22 bp, Homo sapiens
ttagcaagaaagattgcagcac

SEQ ID NO: 9050001 - DNA, 22 bp, Homo sapiens
ttagcaaatatcttgaaacagg

SEQ ID NO: 9050002 - DNA, 22 bp, Homo sapiens
ttagcaagataacagtaatttt

SEQ ID NO: 9050003 - DNA, 21 bp, Homo sapiens
ttcaaagtttgcctaaagatt

SEQ ID NO: 9050004 - DNA, 22 bp, Homo sapiens
ttcaaatcagaccgaaggcaac

SEQ ID NO: 9050005 - DNA, 22 bp, Homo sapiens
ttcaaatgatggcagtcctggc

SEQ ID NO: 9050006 - DNA, 22 bp, Homo sapiens
ttcaaattaccacatttgctta

SEQ ID NO: 9050007 - DNA, 22 bp, Homo sapiens
ttcaaatgcaagttactacttt

SEQ ID NO: 9050008 - DNA, 18 bp, Homo sapiens
cggatcatgcgctgaggc

SEQ ID NO: 9050009 - DNA, 22 bp, Homo sapiens
cggatcatgtgacctttgagtg

SEQ ID NO: 9050010 - DNA, 21 bp, Homo sapiens
cgtgactgggtccgtctggct

SEQ ID NO: 9050011 - DNA, 22 bp, Homo sapiens
cggggcagaaagttgtcttttg

SEQ ID NO: 9050012 - DNA, 22 bp, Homo sapiens
cggggcaggagtccctgtagag

SEQ ID NO: 9050013 - DNA, 22 bp, Homo sapiens
cggggccctggggctgaaggtc

SEQ ID NO: 9050014 - DNA, 22 bp, Homo sapiens
ttatttcatataatgttatcaa

SEQ ID NO: 9050015 - DNA, 22 bp, Homo sapiens
ttatttattgtgtacctactgt

SEQ ID NO: 9050016 - DNA, 20 bp, Homo sapiens
ttatttcagttgctagattg

SEQ ID NO: 9050017 - DNA, 22 bp, Homo sapiens
ttatttattcattctgtctgtc

SEQ ID NO: 9050018 - DNA, 22 bp, Homo sapiens
ttatttatgttaacagtcgaga

SEQ ID NO: 9050019 - DNA, 22 bp, Homo sapiens
ttattgcaactcctaaatagag

SEQ ID NO: 9050020 - DNA, 22 bp, Homo sapiens
ttattgcaactttagggataga

SEQ ID NO: 9050021 - DNA, 23 bp, Homo sapiens
ttattgcaaggtaaaattgctga

SEQ ID NO: 9050022 - DNA, 17 bp, Homo sapiens
ttattgcagtgctgaag

SEQ ID NO: 9050023 - DNA, 22 bp, Homo sapiens
cgctgcagctggctgcagggaa

SEQ ID NO: 9050024 - DNA, 22 bp, Homo sapiens
cgctgcagacgcgctggcgaaa

SEQ ID NO: 9050025 - DNA, 22 bp, Homo sapiens
ttcaaagtaccgtacttaatgg

SEQ ID NO: 9050026 - DNA, 22 bp, Homo sapiens
cgctgataaacgtcacgttccc

SEQ ID NO: 9050027 - DNA, 22 bp, Homo sapiens
cctttttctgagttgtagcttc

SEQ ID NO: 9050028 - DNA, 22 bp, Homo sapiens
cgaaacaggatcttagcccttg

SEQ ID NO: 9050029 - DNA, 22 bp, Homo sapiens
cgagagttagctaggagtcaca

SEQ ID NO: 9050030 - DNA, 22 bp, Homo sapiens
ttattcagcatttagaggaagg

SEQ ID NO: 9050031 - DNA, 22 bp, Homo sapiens
ttattcagctctctagaggcac

SEQ ID NO: 9050032 - DNA, 22 bp, Homo sapiens
ccagtgttcaatacatatttgt

SEQ ID NO: 9050033 - DNA, 22 bp, Homo sapiens
ccagtgttcagtatgcattaag

SEQ ID NO: 9050034 - DNA, 22 bp, Homo sapiens
ccagtgttcataattttacact

SEQ ID NO: 9050035 - DNA, 22 bp, Homo sapiens
ccagtgttcatcaagaaaatgt

SEQ ID NO: 9050036 - DNA, 22 bp, Homo sapiens
ccagtgttattttagagtgtga

SEQ ID NO: 9050037 - DNA, 22 bp, Homo sapiens
ccagtgttagagactgatacag

SEQ ID NO: 9050038 - DNA, 22 bp, Homo sapiens
ccagtgttacggcttgaactat

SEQ ID NO: 9050039 - DNA, 22 bp, Homo sapiens
tgatgacaatgttgctgcaata

SEQ ID NO: 9050040 - DNA, 22 bp, Homo sapiens
tgattagctgaagaatatgctg

SEQ ID NO: 9050041 - DNA, 22 bp, Homo sapiens
cccaagcagggtgcagaggcat

SEQ ID NO: 9050042 - DNA, 19 bp, Homo sapiens
cccaacttgactattttct

SEQ ID NO: 9050043 - DNA, 23 bp, Homo sapiens
ccattttgtgttttggagaaaca

SEQ ID NO: 9050044 - DNA, 22 bp, Homo sapiens
tgcagcagtcagtcaggcctgg

SEQ ID NO: 9050045 - DNA, 22 bp, Homo sapiens
tgattcaactttcttgaatgca

SEQ ID NO: 9050046 - DNA, 22 bp, Homo sapiens
cccacactctgagaaatgctga

SEQ ID NO: 9050047 - DNA, 21 bp, Homo sapiens
cccaccccataaggcagaacc

SEQ ID NO: 9050048 - DNA, 22 bp, Homo sapiens
tgcagaggtttccaggcaagtt

SEQ ID NO: 9050049 - DNA, 22 bp, Homo sapiens
tgcatattctcctttattttgt

SEQ ID NO: 9050050 - DNA, 22 bp, Homo sapiens
tgcatatatcttatttttctgt

SEQ ID NO: 9050051 - DNA, 22 bp, Homo sapiens
tgcatattttctgattcagaag

SEQ ID NO: 9050052 - DNA, 22 bp, Homo sapiens
tgccctggttctgtgggtgagc

SEQ ID NO: 9050053 - DNA, 23 bp, Homo sapiens
tgcctcagtggaatgtgagggtg

SEQ ID NO: 9050054 - DNA, 22 bp, Homo sapiens
tgccctcattataagaggctca

SEQ ID NO: 9050055 - DNA, 22 bp, Homo sapiens
tgcagcattttataccatcatt

SEQ ID NO: 9050056 - DNA, 22 bp, Homo sapiens
tgcagcattgcaaagcagtctt

SEQ ID NO: 9050057 - DNA, 22 bp, Homo sapiens
tgcagcatgcaggagaggctct

SEQ ID NO: 9050058 - DNA, 22 bp, Homo sapiens
tgcagcatgcaggagaggctct

SEQ ID NO: 9050059 - DNA, 22 bp, Homo sapiens
cccagcatgcacgctgacactc

SEQ ID NO: 9050060 - DNA, 22 bp, Homo sapiens
cccagcccccgagtgtctggaa

SEQ ID NO: 9050061 - DNA, 20 bp, Homo sapiens
cccagcccgggccgcgctcg

SEQ ID NO: 9050062 - DNA, 18 bp, Homo sapiens
cccagcccaccatttctc

SEQ ID NO: 9050063 - DNA, 22 bp, Homo sapiens
cccagcccagcgttcgaggggt

SEQ ID NO: 9050064 - DNA, 22 bp, Homo sapiens
tgagataacatggaagagtagc

SEQ ID NO: 9050065 - DNA, 22 bp, Homo sapiens
tgagataactattctgtcaact

SEQ ID NO: 9050066 - DNA, 22 bp, Homo sapiens
tgagataacaaaattatcttca

SEQ ID NO: 9050067 - DNA, 22 bp, Homo sapiens
tgagataagcaaggataaaggt

SEQ ID NO: 9050068 - DNA, 22 bp, Homo sapiens
tgagataataaacatctcctta

SEQ ID NO: 9050069 - DNA, 22 bp, Homo sapiens
tgagagtctgttcctcttgcag

SEQ ID NO: 9050070 - DNA, 22 bp, Homo sapiens
tgagagtctcagacctcctggt

SEQ ID NO: 9050071 - DNA, 22 bp, Homo sapiens
tgacagagacttcagagccaaa

SEQ ID NO: 9050072 - DNA, 22 bp, Homo sapiens
tgaaggagaattaataggcatt

SEQ ID NO: 9050073 - DNA, 22 bp, Homo sapiens
tgacagagcaagatctagataa

SEQ ID NO: 9050074 - DNA, 22 bp, Homo sapiens
ccagggcatgggaagaactgaa

SEQ ID NO: 9050075 - DNA, 22 bp, Homo sapiens
tgaccactgaatatgactgcct

SEQ ID NO: 9050076 - DNA, 22 bp, Homo sapiens
tgaccactgaatatgactgcct

SEQ ID NO: 9050077 - DNA, 22 bp, Homo sapiens
tgaccacagacccaatgactac

SEQ ID NO: 9050078 - DNA, 22 bp, Homo sapiens
tgacatttttgtacaaagtcag

SEQ ID NO: 9050079 - DNA, 22 bp, Homo sapiens
tgacatttttataagagtcaaa

SEQ ID NO: 9050080 - DNA, 22 bp, Homo sapiens
tgacatctgaccacacgtattc

SEQ ID NO: 9050081 - DNA, 22 bp, Homo sapiens
tgacttttggacctcactgtcc

SEQ ID NO: 9050082 - DNA, 22 bp, Homo sapiens
tgagaaaacagtttgtaataat

SEQ ID NO: 9050083 - DNA, 22 bp, Homo sapiens
tgaaagcttgttggaaatgtag

SEQ ID NO: 9050084 - DNA, 22 bp, Homo sapiens
tgaaagctttgggacagtgtga

SEQ ID NO: 9050085 - DNA, 22 bp, Homo sapiens
tgaaagctgtacatgtggtaca

SEQ ID NO: 9050086 - DNA, 22 bp, Homo sapiens
tgaaagcatatgctaaagacca

SEQ ID NO: 9050087 - DNA, 22 bp, Homo sapiens
tgaagattgagaaattatccaa

SEQ ID NO: 9050088 - DNA, 22 bp, Homo sapiens
tgaagatttaagcatctcaatt

SEQ ID NO: 9050089 - DNA, 22 bp, Homo sapiens
tgaagatttccaccaaatcaca

SEQ ID NO: 9050090 - DNA, 22 bp, Homo sapiens
tgaagctttcctgtggtcagga

SEQ ID NO: 9050091 - DNA, 22 bp, Homo sapiens
tgaaggagaaatggaaagtggg

SEQ ID NO: 9050092 - DNA, 22 bp, Homo sapiens
tgaaggaatgagtatactgttt

SEQ ID NO: 9050093 - DNA, 22 bp, Homo sapiens
ccaggcctggccaggggatgcc

SEQ ID NO: 9050094 - DNA, 22 bp, Homo sapiens
tctttcaaagctgtagtagatt

SEQ ID NO: 9050095 - DNA, 18 bp, Homo sapiens
ccaggctacttcttggcc

SEQ ID NO: 9050096 - DNA, 22 bp, Homo sapiens
tctttattttatgcttgtgcaa

SEQ ID NO: 9050097 - DNA, 22 bp, Homo sapiens
tctttattttatgcttgtgcaa

SEQ ID NO: 9050098 - DNA, 22 bp, Homo sapiens
tctttcaaagcaaaatgaggct

SEQ ID NO: 9050099 - DNA, 22 bp, Homo sapiens
tctttattttatgcttgtgcaa

SEQ ID NO: 9050100 - DNA, 22 bp, Homo sapiens
tctttatttctgaatcccccat

SEQ ID NO: 9050101 - DNA, 22 bp, Homo sapiens
tctttatttctgaatcccccat

SEQ ID NO: 9050102 - DNA, 22 bp, Homo sapiens
tctttatttctgaatcccccat

SEQ ID NO: 9050103 - DNA, 22 bp, Homo sapiens
tctttatttaagtctgttgtaa

SEQ ID NO: 9050104 - DNA, 22 bp, Homo sapiens
tctttatttaagtctgttgtaa

SEQ ID NO: 9050105 - DNA, 22 bp, Homo sapiens
tctttatttaagtctgttgtaa

SEQ ID NO: 9050106 - DNA, 18 bp, Homo sapiens
tctttaagttgtcagagt

SEQ ID NO: 9050107 - DNA, 22 bp, Homo sapiens
ccagcccttgctgaagggtggc

SEQ ID NO: 9050108 - DNA, 22 bp, Homo sapiens
ccagcccttgagatggaaggga

SEQ ID NO: 9050109 - DNA, 22 bp, Homo sapiens
tgtaatgaaaaggaggaaatag

SEQ ID NO: 9050110 - DNA, 22 bp, Homo sapiens
tgtacatacatagatatacaca

SEQ ID NO: 9050111 - DNA, 22 bp, Homo sapiens
tgtcaacaaaacggttcaaatg

SEQ ID NO: 9050112 - DNA, 22 bp, Homo sapiens
tgtattctctcaatatttcata

SEQ ID NO: 9050113 - DNA, 22 bp, Homo sapiens
cctggaggggaccaggaccagg

SEQ ID NO: 9050114 - DNA, 22 bp, Homo sapiens
cctggaggcggaggttgcagtg

SEQ ID NO: 9050115 - DNA, 22 bp, Homo sapiens
cctggaggctctgggagggcag

SEQ ID NO: 9050116 - DNA, 22 bp, Homo sapiens
cctggaggctctgggagggcag

SEQ ID NO: 9050117 - DNA, 22 bp, Homo sapiens
cctgctggacgtggaggagggg

SEQ ID NO: 9050118 - DNA, 22 bp, Homo sapiens
cctgctggcgcttgtctgggag

SEQ ID NO: 9050119 - DNA, 22 bp, Homo sapiens
tgggtcactatttgcagagacg

SEQ ID NO: 9050120 - DNA, 22 bp, Homo sapiens
tgggtcaccacttcagaggaga

SEQ ID NO: 9050121 - DNA, 22 bp, Homo sapiens
cctgcctggggacaaaggaggg

SEQ ID NO: 9050122 - DNA, 22 bp, Homo sapiens
cctgcctgcctgctggccggga

SEQ ID NO: 9050123 - DNA, 23 bp, Homo sapiens
cctgcctgttctaactccatttc

SEQ ID NO: 9050124 - DNA, 22 bp, Homo sapiens
cctgcctgtccctcagtccaca

SEQ ID NO: 9050125 - DNA, 21 bp, Homo sapiens
tgggagagcgttgctgtcctc

SEQ ID NO: 9050126 - DNA, 22 bp, Homo sapiens
tggctctctgggaggtcctggc

SEQ ID NO: 9050127 - DNA, 22 bp, Homo sapiens
tggctctcaggcctgctgcgtt

SEQ ID NO: 9050128 - DNA, 22 bp, Homo sapiens
tggctctccagagcctatggta

SEQ ID NO: 9050129 - DNA, 22 bp, Homo sapiens
cctctggcaacttcacagccca

SEQ ID NO: 9050130 - DNA, 22 bp, Homo sapiens
tgggagctcacaggcctggctc

SEQ ID NO: 9050131 - DNA, 22 bp, Homo sapiens
cctcttgattggttggaagcgg

SEQ ID NO: 9050132 - DNA, 18 bp, Homo sapiens
cctgaagcctgtgtcttt

SEQ ID NO: 9050133 - DNA, 22 bp, Homo sapiens
tgggccactaccttctctggat

SEQ ID NO: 9050134 - DNA, 22 bp, Homo sapiens
tgggccactcttccctgggtct

SEQ ID NO: 9050135 - DNA, 22 bp, Homo sapiens
cctgcaagagcggagaagccag

SEQ ID NO: 9050136 - DNA, 22 bp, Homo sapiens
cctgccagacgcaccagggggc

SEQ ID NO: 9050137 - DNA, 22 bp, Homo sapiens
tggggtacttgtatcaaagcac

SEQ ID NO: 9050138 - DNA, 22 bp, Homo sapiens
tggggtaggagtcagcgagaga

SEQ ID NO: 9050139 - DNA, 22 bp, Homo sapiens
tgggggtgtgccagggacctcc

SEQ ID NO: 9050140 - DNA, 22 bp, Homo sapiens
cctgacaggagaagcgcagcat

SEQ ID NO: 9050141 - DNA, 22 bp, Homo sapiens
cctgaccatttgccacatgggt

SEQ ID NO: 9050142 - DNA, 22 bp, Homo sapiens
cctgaccacccttggacaaggt

SEQ ID NO: 9050143 - DNA, 22 bp, Homo sapiens
cctgagctggcagtgacctgga

SEQ ID NO: 9050144 - DNA, 22 bp, Homo sapiens
cctgagcttgatccttctgtct

SEQ ID NO: 9050145 - DNA, 22 bp, Homo sapiens
cctccccatgacccggtgctgg

SEQ ID NO: 9050146 - DNA, 22 bp, Homo sapiens
cctccctcagaatgaagaaagg

SEQ ID NO: 9050147 - DNA, 22 bp, Homo sapiens
cctccctctttcagtcccacag

SEQ ID NO: 9050148 - DNA, 22 bp, Homo sapiens
tggctacagcaagaggaaagaa

SEQ ID NO: 9050149 - DNA, 22 bp, Homo sapiens
tggctaatcttaaggcttttgc

SEQ ID NO: 9050150 - DNA, 22 bp, Homo sapiens
cctcagctgcttccctggagcc

SEQ ID NO: 9050151 - DNA, 22 bp, Homo sapiens
tggcctcagatttcaggggtgg

SEQ ID NO: 9050152 - DNA, 22 bp, Homo sapiens
tggcctcaccactagctgggtg

SEQ ID NO: 9050153 - DNA, 22 bp, Homo sapiens
cctcagaagctcaaggacattg

SEQ ID NO: 9050154 - DNA, 22 bp, Homo sapiens
tggcctcaagtctgagggcctt

SEQ ID NO: 9050155 - DNA, 22 bp, Homo sapiens
cctcagaagactttagggaaga

SEQ ID NO: 9050156 - DNA, 22 bp, Homo sapiens
cctcagaagaagtggaattgat

SEQ ID NO: 9050157 - DNA, 22 bp, Homo sapiens
cctcagaacggaaatggttttg

SEQ ID NO: 9050158 - DNA, 22 bp, Homo sapiens
cctcactctgcaccctgcagca

SEQ ID NO: 9050159 - DNA, 22 bp, Homo sapiens
cctcactcttgtcctggcaggt

SEQ ID NO: 9050160 - DNA, 22 bp, Homo sapiens
ccgggttgaggttcccatagat

SEQ ID NO: 9050161 - DNA, 23 bp, Homo sapiens
ccgtgaagacagacagacagcag

SEQ ID NO: 9050162 - DNA, 22 bp, Homo sapiens
ccggctcggcgaccaggctgaa

SEQ ID NO: 9050163 - DNA, 22 bp, Homo sapiens
cctcacccagtcacctaggtgg

SEQ ID NO: 9050164 - DNA, 22 bp, Homo sapiens
ccctggttcaggtttctctgaa

SEQ ID NO: 9050165 - DNA, 22 bp, Homo sapiens
ccctggttgacaagccagctca

SEQ ID NO: 9050166 - DNA, 21 bp, Homo sapiens
ccctggttccactgtcaccgc

SEQ ID NO: 9050167 - DNA, 22 bp, Homo sapiens
ccctgtggaggaggagagcagt

SEQ ID NO: 9050168 - DNA, 20 bp, Homo sapiens
ccctgtgattggcaagtgtc

SEQ ID NO: 9050169 - DNA, 22 bp, Homo sapiens
ccctgctcttagtgcctgtgtg

SEQ ID NO: 9050170 - DNA, 23 bp, Homo sapiens
ccctgcagtcagggtgagatggt

SEQ ID NO: 9050171 - DNA, 22 bp, Homo sapiens
ccctgcagtgtgacctcaccta

SEQ ID NO: 9050172 - DNA, 22 bp, Homo sapiens
ccctgcagatcagtgagaactt

SEQ ID NO: 9050173 - DNA, 22 bp, Homo sapiens
ccctgcagagccagccctgacc

SEQ ID NO: 9050174 - DNA, 22 bp, Homo sapiens
ccctgcagatcagtgagaactt

SEQ ID NO: 9050175 - DNA, 22 bp, Homo sapiens
ccctgcagatctagggtccttc

SEQ ID NO: 9050176 - DNA, 22 bp, Homo sapiens
ccctgcagcattctctaactgg

SEQ ID NO: 9050177 - DNA, 22 bp, Homo sapiens
ccctgcagagagtgcttttgtg

SEQ ID NO: 9050178 - DNA, 22 bp, Homo sapiens
ccctgcagagaccactgacctt

SEQ ID NO: 9050179 - DNA, 17 bp, Homo sapiens
cccgttctcttcgctgg

SEQ ID NO: 9050180 - DNA, 22 bp, Homo sapiens
tgctttattggaacctcatcct

SEQ ID NO: 9050181 - DNA, 22 bp, Homo sapiens
tgctttattgcatcagtgtggg

SEQ ID NO: 9050182 - DNA, 22 bp, Homo sapiens
tgctttatttataaaatagcaa

SEQ ID NO: 9050183 - DNA, 22 bp, Homo sapiens
tgctttcagatatctgtttcaa

SEQ ID NO: 9050184 - DNA, 22 bp, Homo sapiens
tgctttattttaaatatgccat

SEQ ID NO: 9050185 - DNA, 22 bp, Homo sapiens
tcagcttttgtcagaaattgta

SEQ ID NO: 9050186 - DNA, 22 bp, Homo sapiens
cataaactcttgagattcttgt

SEQ ID NO: 9050187 - DNA, 22 bp, Homo sapiens
cagttaatcttgccattatatc

SEQ ID NO: 9050188 - DNA, 20 bp, Homo sapiens
cagttaatgactaggcatca

SEQ ID NO: 9050189 - DNA, 22 bp, Homo sapiens
cagttaaagtgcttatcacaga

SEQ ID NO: 9050190 - DNA, 22 bp, Homo sapiens
cagtttaacctatccattatgt

SEQ ID NO: 9050191 - DNA, 19 bp, Homo sapiens
cagtttaactaattttatc

SEQ ID NO: 9050192 - DNA, 22 bp, Homo sapiens
tcagcagatgatttccatacaa

SEQ ID NO: 9050193 - DNA, 22 bp, Homo sapiens
cagttaaaatgtgctataagaa

SEQ ID NO: 9050194 - DNA, 22 bp, Homo sapiens
cagtgtttgtatagaatatgca

SEQ ID NO: 9050195 - DNA, 22 bp, Homo sapiens
cagtgtttgtggaattcaggtg

SEQ ID NO: 9050196 - DNA, 22 bp, Homo sapiens
tcagagaaaggccaaaatatca

SEQ ID NO: 9050197 - DNA, 22 bp, Homo sapiens
cagtggggaggccaggatagaa

SEQ ID NO: 9050198 - DNA, 22 bp, Homo sapiens
cagtggggggactgaggcctga

SEQ ID NO: 9050199 - DNA, 22 bp, Homo sapiens
cagtgggggggccatgctgcag

SEQ ID NO: 9050200 - DNA, 22 bp, Homo sapiens
cagtgggggtgaggccgaggta

SEQ ID NO: 9050201 - DNA, 22 bp, Homo sapiens
cagtgggatatgggggcagcat

SEQ ID NO: 9050202 - DNA, 22 bp, Homo sapiens
cagtgggaagggcagaggcttt

SEQ ID NO: 9050203 - DNA, 22 bp, Homo sapiens
tatttcttttcgtgacttattg

SEQ ID NO: 9050204 - DNA, 22 bp, Homo sapiens
tatttcttttcgtgacttattg

SEQ ID NO: 9050205 - DNA, 22 bp, Homo sapiens
tatttcttttcgtgacttattg

SEQ ID NO: 9050206 - DNA, 22 bp, Homo sapiens
tcacaaatattttaacagtagg

SEQ ID NO: 9050207 - DNA, 22 bp, Homo sapiens
tcacaaatattttaacagtagg

SEQ ID NO: 9050208 - DNA, 22 bp, Homo sapiens
tcaatgaagagatttaaatcat

SEQ ID NO: 9050209 - DNA, 22 bp, Homo sapiens
tcacaagaatttgtagatgaaa

SEQ ID NO: 9050210 - DNA, 22 bp, Homo sapiens
tcacaagaactttggagggata

SEQ ID NO: 9050211 - DNA, 22 bp, Homo sapiens
tcacaaatcattttatctgtgt

SEQ ID NO: 9050212 - DNA, 22 bp, Homo sapiens
tcacaaatgtctcctgtcctgt

SEQ ID NO: 9050213 - DNA, 22 bp, Homo sapiens
tcacaagacaagacaaattgca

SEQ ID NO: 9050214 - DNA, 22 bp, Homo sapiens
tcacaagacagaaaacatttag

SEQ ID NO: 9050215 - DNA, 22 bp, Homo sapiens
tcacaagactgagcttgcttga

SEQ ID NO: 9050216 - DNA, 22 bp, Homo sapiens
tcacaagactgagcttgcttga

SEQ ID NO: 9050217 - DNA, 19 bp, Homo sapiens
tcacaagagagataaagtg

SEQ ID NO: 9050218 - DNA, 22 bp, Homo sapiens
cagtgaagtttaaagtgtagat

SEQ ID NO: 9050219 - DNA, 22 bp, Homo sapiens
cagtgaagttctactgaatggt

SEQ ID NO: 9050220 - DNA, 22 bp, Homo sapiens
cagtgaagttctactgaatggt

SEQ ID NO: 9050221 - DNA, 22 bp, Homo sapiens
cagtgaagttctactgaatggt

SEQ ID NO: 9050222 - DNA, 22 bp, Homo sapiens
cagtgaagtgtggacgtcacca

SEQ ID NO: 9050223 - DNA, 22 bp, Homo sapiens
cagtgagataccacagagcaaa

SEQ ID NO: 9050224 - DNA, 22 bp, Homo sapiens
tcacagactcttgattgtctaa

SEQ ID NO: 9050225 - DNA, 22 bp, Homo sapiens
tcacagactcttgattgtctaa

SEQ ID NO: 9050226 - DNA, 22 bp, Homo sapiens
cagggtggccctgtggtctcat

SEQ ID NO: 9050227 - DNA, 22 bp, Homo sapiens
tatttcattctttatcaggagc

SEQ ID NO: 9050228 - DNA, 22 bp, Homo sapiens
tatttcatctggaacaaggtaa

SEQ ID NO: 9050229 - DNA, 22 bp, Homo sapiens
tatttcatgtgcaccataattc

SEQ ID NO: 9050230 - DNA, 22 bp, Homo sapiens
tatttctttcaggtatgtgttg

SEQ ID NO: 9050231 - DNA, 22 bp, Homo sapiens
tatttctttcaggtatgtgttg

SEQ ID NO: 9050232 - DNA, 21 bp, Homo sapiens
tatttctttgactctctccct

SEQ ID NO: 9050233 - DNA, 22 bp, Homo sapiens
tatttcttgttccctccaagtt

SEQ ID NO: 9050234 - DNA, 22 bp, Homo sapiens
tatttcttgttccctccaagtt

SEQ ID NO: 9050235 - DNA, 22 bp, Homo sapiens
cagtagcttacttttcttgatc

SEQ ID NO: 9050236 - DNA, 22 bp, Homo sapiens
cagtagctgtctagccttatgg

SEQ ID NO: 9050237 - DNA, 22 bp, Homo sapiens
cagtagctaaattattttcatg

SEQ ID NO: 9050238 - DNA, 22 bp, Homo sapiens
tatttccagaggagtatagaag

SEQ ID NO: 9050239 - DNA, 22 bp, Homo sapiens
tagcattatttcctctttttgt

SEQ ID NO: 9050240 - DNA, 22 bp, Homo sapiens
tagcaatgtgtgtgtataaatt

SEQ ID NO: 9050241 - DNA, 22 bp, Homo sapiens
tagcaagtgttggtgaagatgt

SEQ ID NO: 9050242 - DNA, 22 bp, Homo sapiens
tagatacacacacagtcatgtg

SEQ ID NO: 9050243 - DNA, 19 bp, Homo sapiens
tagataaggcatttaatct

SEQ ID NO: 9050244 - DNA, 22 bp, Homo sapiens
tagagttatccttcacaggtat

SEQ ID NO: 9050245 - DNA, 18 bp, Homo sapiens
tagagttactacatgatt

SEQ ID NO: 9050246 - DNA, 17 bp, Homo sapiens
tagagctggttcaggag

SEQ ID NO: 9050247 - DNA, 22 bp, Homo sapiens
tagagctggaatttgcagcaag

SEQ ID NO: 9050248 - DNA, 22 bp, Homo sapiens
tagagctggccgggacagctgg

SEQ ID NO: 9050249 - DNA, 22 bp, Homo sapiens
tagagctgggcagtgctctgag

SEQ ID NO: 9050250 - DNA, 22 bp, Homo sapiens
tagagctggaaaactgcaggta

SEQ ID NO: 9050251 - DNA, 19 bp, Homo sapiens
tagagctgcttcctggcag

SEQ ID NO: 9050252 - DNA, 22 bp, Homo sapiens
tagagctggaaaactgcaggta

SEQ ID NO: 9050253 - DNA, 21 bp, Homo sapiens
tagaatcactaataagatgta

SEQ ID NO: 9050254 - DNA, 22 bp, Homo sapiens
tagaccaagacaggaagtaaca

SEQ ID NO: 9050255 - DNA, 22 bp, Homo sapiens
tactgtctgcttcttatagctt

SEQ ID NO: 9050256 - DNA, 22 bp, Homo sapiens
gtgaggggtggctgagcagttt

SEQ ID NO: 9050257 - DNA, 22 bp, Homo sapiens
tactatgttcttcctaaatagt

SEQ ID NO: 9050258 - DNA, 22 bp, Homo sapiens
tactatgtgaaaatactatagt

SEQ ID NO: 9050259 - DNA, 22 bp, Homo sapiens
tacctgaaccaagcccagctct

SEQ ID NO: 9050260 - DNA, 22 bp, Homo sapiens
gtgagggcaaattagaatcaaa

SEQ ID NO: 9050261 - DNA, 22 bp, Homo sapiens
tactgtctgcttcttatagctt

SEQ ID NO: 9050262 - DNA, 22 bp, Homo sapiens
tactgtctatacacttgattac

SEQ ID NO: 9050263 - DNA, 22 bp, Homo sapiens
tactgtctatacacttgattac

SEQ ID NO: 9050264 - DNA, 22 bp, Homo sapiens
tactgtctaataagattgatgg

SEQ ID NO: 9050265 - DNA, 22 bp, Homo sapiens
tactcaaactcactaagacaga

SEQ ID NO: 9050266 - DNA, 22 bp, Homo sapiens
tactcaaaaagttatgaatcat

SEQ ID NO: 9050267 - DNA, 22 bp, Homo sapiens
taggtagctttggcgtttcttg

SEQ ID NO: 9050268 - DNA, 22 bp, Homo sapiens
caggggaagatgccaagggaga

SEQ ID NO: 9050269 - DNA, 22 bp, Homo sapiens
caggggaagatgccaagggaga

SEQ ID NO: 9050270 - DNA, 22 bp, Homo sapiens
caggggaaggagccttgaaact

SEQ ID NO: 9050271 - DNA, 18 bp, Homo sapiens
tagggctctagggagtga

SEQ ID NO: 9050272 - DNA, 22 bp, Homo sapiens
cagggctcatctgtgtgaccag

SEQ ID NO: 9050273 - DNA, 19 bp, Homo sapiens
tagtctttattcttaattt

SEQ ID NO: 9050274 - DNA, 22 bp, Homo sapiens
cagggtggcactcagcgcatct

SEQ ID NO: 9050275 - DNA, 22 bp, Homo sapiens
cagggctcaggctctgggattc

SEQ ID NO: 9050276 - DNA, 22 bp, Homo sapiens
cagggctcagggactgcagaaa

SEQ ID NO: 9050277 - DNA, 22 bp, Homo sapiens
cagggctcaggaaatcagacgt

SEQ ID NO: 9050278 - DNA, 22 bp, Homo sapiens
cagggctcagaagacagacctc

SEQ ID NO: 9050279 - DNA, 22 bp, Homo sapiens
cagggctcactcggctggcgtc

SEQ ID NO: 9050280 - DNA, 22 bp, Homo sapiens
cagggctcaccactgggatcct

SEQ ID NO: 9050281 - DNA, 22 bp, Homo sapiens
cagggcctgcttccttcttgtt

SEQ ID NO: 9050282 - DNA, 22 bp, Homo sapiens
taggagacattgatcccaagaa

SEQ ID NO: 9050283 - DNA, 22 bp, Homo sapiens
tagctatttgagcatattccag

SEQ ID NO: 9050284 - DNA, 22 bp, Homo sapiens
tagctattttgcttggaaatac

SEQ ID NO: 9050285 - DNA, 22 bp, Homo sapiens
tagctatttggaaaattccaat

SEQ ID NO: 9050286 - DNA, 22 bp, Homo sapiens
taggacataagtattctaactt

SEQ ID NO: 9050287 - DNA, 22 bp, Homo sapiens
tagctttaataagctgctgaat

SEQ ID NO: 9050288 - DNA, 22 bp, Homo sapiens
tagctttaataagctgctgaat

SEQ ID NO: 9050289 - DNA, 22 bp, Homo sapiens
tagctttaagacatggtgaatg

SEQ ID NO: 9050290 - DNA, 22 bp, Homo sapiens
tagctttaagatgagatgtgga

SEQ ID NO: 9050291 - DNA, 22 bp, Homo sapiens
tagctttaagatgagatgtgga

SEQ ID NO: 9050292 - DNA, 20 bp, Homo sapiens
tctctgcagcagaggctggg

SEQ ID NO: 9050293 - DNA, 22 bp, Homo sapiens
tctctgcagtcttgggcaggca

SEQ ID NO: 9050294 - DNA, 22 bp, Homo sapiens
tctctgcatcccagggctcagc

SEQ ID NO: 9050295 - DNA, 22 bp, Homo sapiens
tctctcttgtcaccccatctgc

SEQ ID NO: 9050296 - DNA, 22 bp, Homo sapiens
tctcctggccgggctgtcccct

SEQ ID NO: 9050297 - DNA, 22 bp, Homo sapiens
ccagcagagtatcaatgtattt

SEQ ID NO: 9050298 - DNA, 22 bp, Homo sapiens
ccagcagggcagtgccctggac

SEQ ID NO: 9050299 - DNA, 22 bp, Homo sapiens
ccagcagggcagtgccctggac

SEQ ID NO: 9050300 - DNA, 22 bp, Homo sapiens
tctctgttcatggcactatgtc

SEQ ID NO: 9050301 - DNA, 22 bp, Homo sapiens
tctctgtgtgttggctgtatat

SEQ ID NO: 9050302 - DNA, 22 bp, Homo sapiens
ccagcaggtgtagggctcatgg

SEQ ID NO: 9050303 - DNA, 22 bp, Homo sapiens
tctgatattggacaattcaggg

SEQ ID NO: 9050304 - DNA, 22 bp, Homo sapiens
ccagccctgcctctcagggccc

SEQ ID NO: 9050305 - DNA, 22 bp, Homo sapiens
ccagcccttagataaacctggc

SEQ ID NO: 9050306 - DNA, 22 bp, Homo sapiens
tctatattccagatacagatta

SEQ ID NO: 9050307 - DNA, 22 bp, Homo sapiens
tctcaaatttgttagataaaat

SEQ ID NO: 9050308 - DNA, 22 bp, Homo sapiens
tctccacactttctctcccagg

SEQ ID NO: 9050309 - DNA, 20 bp, Homo sapiens
tctccagatgcagatgacat

SEQ ID NO: 9050310 - DNA, 22 bp, Homo sapiens
tctcctggccctgtcgccatct

SEQ ID NO: 9050311 - DNA, 22 bp, Homo sapiens
tctccctctttgtctgctttgg

SEQ ID NO: 9050312 - DNA, 22 bp, Homo sapiens
ccaccagctttgccaccctgct

SEQ ID NO: 9050313 - DNA, 22 bp, Homo sapiens
ccaccagctttggcggtgacag

SEQ ID NO: 9050314 - DNA, 22 bp, Homo sapiens
tcgcgggttgcacatggccatc

SEQ ID NO: 9050315 - DNA, 22 bp, Homo sapiens
ccacatttggagaagatacttt

SEQ ID NO: 9050316 - DNA, 22 bp, Homo sapiens
ccaccagcagtgtgcaaggatt

SEQ ID NO: 9050317 - DNA, 22 bp, Homo sapiens
ccaccagctgcatatgcacgta

SEQ ID NO: 9050318 - DNA, 22 bp, Homo sapiens
ccaccagcttcagcagccgcgg

SEQ ID NO: 9050319 - DNA, 22 bp, Homo sapiens
tcggggtctttgacacgctctg

SEQ ID NO: 9050320 - DNA, 22 bp, Homo sapiens
tcgggctcgctctcctagcgga

SEQ ID NO: 9050321 - DNA, 22 bp, Homo sapiens
tcgggctcgctctcctagcgga

SEQ ID NO: 9050322 - DNA, 22 bp, Homo sapiens
tcggaaggggccgcgctcggac

SEQ ID NO: 9050323 - DNA, 22 bp, Homo sapiens
ccacatggtcctcatttactct

SEQ ID NO: 9050324 - DNA, 22 bp, Homo sapiens
ccacatgtgcactgctgtatgg

SEQ ID NO: 9050325 - DNA, 22 bp, Homo sapiens
cattgcaccacattgcatccct

SEQ ID NO: 9050326 - DNA, 22 bp, Homo sapiens
cattgaaatatggaaactgatg

SEQ ID NO: 9050327 - DNA, 18 bp, Homo sapiens
cattcttggcagcttttg

SEQ ID NO: 9050328 - DNA, 22 bp, Homo sapiens
tcccggcgctgggaggtgggtc

SEQ ID NO: 9050329 - DNA, 22 bp, Homo sapiens
tcccggcgctgggaggtgggtc

SEQ ID NO: 9050330 - DNA, 22 bp, Homo sapiens
catttggaccaaaatagccaac

SEQ ID NO: 9050331 - DNA, 22 bp, Homo sapiens
tcctcagctttggtttactcat

SEQ ID NO: 9050332 - DNA, 22 bp, Homo sapiens
tcctcagcttttatttcacttg

SEQ ID NO: 9050333 - DNA, 22 bp, Homo sapiens
cattcattcacattttgtctat

SEQ ID NO: 9050334 - DNA, 22 bp, Homo sapiens
catgttgggaatcagctgagag

SEQ ID NO: 9050335 - DNA, 22 bp, Homo sapiens
catgttgggcatgcatatgtgt

SEQ ID NO: 9050336 - DNA, 22 bp, Homo sapiens
catgtttgtacaaaggtacaca

SEQ ID NO: 9050337 - DNA, 22 bp, Homo sapiens
catgttatttatccattaaaca

SEQ ID NO: 9050338 - DNA, 22 bp, Homo sapiens
catgttggcaaggatacagcag

SEQ ID NO: 9050339 - DNA, 22 bp, Homo sapiens
catgttggcttgtcacaatgaa

SEQ ID NO: 9050340 - DNA, 22 bp, Homo sapiens
catgttggctgaggctgtattt

SEQ ID NO: 9050341 - DNA, 22 bp, Homo sapiens
cattcaaattaagattttgtta

SEQ ID NO: 9050342 - DNA, 22 bp, Homo sapiens
cattcagtggagtattattcag

SEQ ID NO: 9050343 - DNA, 22 bp, Homo sapiens
cattcagtcatgctggttttga

SEQ ID NO: 9050344 - DNA, 22 bp, Homo sapiens
cattcatctatcaaatggtacc

SEQ ID NO: 9050345 - DNA, 22 bp, Homo sapiens
cattcattagaatagatatgta

SEQ ID NO: 9050346 - DNA, 17 bp, Homo sapiens
cattcagagtaattaca

SEQ ID NO: 9050347 - DNA, 22 bp, Homo sapiens
cattcacatcttgttccatcac

SEQ ID NO: 9050348 - DNA, 22 bp, Homo sapiens
tccagcccagctgtccccttca

SEQ ID NO: 9050349 - DNA, 22 bp, Homo sapiens
tccagccctgtggcttccaccc

SEQ ID NO: 9050350 - DNA, 19 bp, Homo sapiens
tccagccctgttccctttt

SEQ ID NO: 9050351 - DNA, 22 bp, Homo sapiens
tccagctgctagctagatgcaa

SEQ ID NO: 9050352 - DNA, 18 bp, Homo sapiens
tccaggctccaggctaac

SEQ ID NO: 9050353 - DNA, 22 bp, Homo sapiens
tccaggctcccctgcgtgctcc

SEQ ID NO: 9050354 - DNA, 22 bp, Homo sapiens
catgtgttttgtcatttcaata

SEQ ID NO: 9050355 - DNA, 22 bp, Homo sapiens
catgtgttaatctttctgcaaa

SEQ ID NO: 9050356 - DNA, 22 bp, Homo sapiens
catgtgtgtgagggaaacatgt

SEQ ID NO: 9050357 - DNA, 22 bp, Homo sapiens
tccaggcagcccttcctgactc

SEQ ID NO: 9050358 - DNA, 22 bp, Homo sapiens
tccacagtggtggaattgttca

SEQ ID NO: 9050359 - DNA, 22 bp, Homo sapiens
tccacatgacttctaataactg

SEQ ID NO: 9050360 - DNA, 19 bp, Homo sapiens
tcattgaacataattactt

SEQ ID NO: 9050361 - DNA, 22 bp, Homo sapiens
tcattctcagactcttggcctc

SEQ ID NO: 9050362 - DNA, 22 bp, Homo sapiens
tcattctctgggatgcagtttg

SEQ ID NO: 9050363 - DNA, 22 bp, Homo sapiens
tcattcttgcgtatgccatggt

SEQ ID NO: 9050364 - DNA, 22 bp, Homo sapiens
catgaaaaatttactgttaaca

SEQ ID NO: 9050365 - DNA, 22 bp, Homo sapiens
tttattcaagatgaggttcatg

SEQ ID NO: 9050366 - DNA, 22 bp, Homo sapiens
tttatctgaaaaaactcttgga

SEQ ID NO: 9050367 - DNA, 22 bp, Homo sapiens
tttatctgacctcacttcttaa

SEQ ID NO: 9050368 - DNA, 22 bp, Homo sapiens
tttatctgagctgatagatagt

SEQ ID NO: 9050369 - DNA, 22 bp, Homo sapiens
tttatccatcatctgctgaagg

SEQ ID NO: 9050370 - DNA, 22 bp, Homo sapiens
tttatcaaacaaattatccagc

SEQ ID NO: 9050371 - DNA, 22 bp, Homo sapiens
tttagcatatcctataaaacta

SEQ ID NO: 9050372 - DNA, 22 bp, Homo sapiens
tttagcatccaaggttatgact

SEQ ID NO: 9050373 - DNA, 22 bp, Homo sapiens
tttatattgtaaaaatggttct

SEQ ID NO: 9050374 - DNA, 22 bp, Homo sapiens
tttatattgggagtcgttttga

SEQ ID NO: 9050375 - DNA, 22 bp, Homo sapiens
tttatatagagatttgtgcatg

SEQ ID NO: 9050376 - DNA, 22 bp, Homo sapiens
tttagagaggctctgtaaaatg

SEQ ID NO: 9050377 - DNA, 22 bp, Homo sapiens
tttagagagaattttcaaagtg

SEQ ID NO: 9050378 - DNA, 19 bp, Homo sapiens
tttagaagttgaaactctg

SEQ ID NO: 9050379 - DNA, 22 bp, Homo sapiens
tttagaagttcacacatttaaa

SEQ ID NO: 9050380 - DNA, 22 bp, Homo sapiens
tttaaagaaattcctcatcttt

SEQ ID NO: 9050381 - DNA, 17 bp, Homo sapiens
tttaaactactacaagg

SEQ ID NO: 9050382 - DNA, 22 bp, Homo sapiens
tttaaagaaattcctcatcttt

SEQ ID NO: 9050383 - DNA, 22 bp, Homo sapiens
tttaagattcagtaaggcaaac

SEQ ID NO: 9050384 - DNA, 22 bp, Homo sapiens
tttaagcaagttgacatagcat

SEQ ID NO: 9050385 - DNA, 22 bp, Homo sapiens
tttaagcacagggataaagtta

SEQ ID NO: 9050386 - DNA, 22 bp, Homo sapiens
tttaagcacagggataaagtta

SEQ ID NO: 9050387 - DNA, 22 bp, Homo sapiens
tttaagctaatgtcataattag

SEQ ID NO: 9050388 - DNA, 22 bp, Homo sapiens
tttaagctgtggcattaattct

SEQ ID NO: 9050389 - DNA, 22 bp, Homo sapiens
tttaaggaaaaaatgtacttag

SEQ ID NO: 9050390 - DNA, 22 bp, Homo sapiens
tttaaggatgatgtgatatata

SEQ ID NO: 9050391 - DNA, 22 bp, Homo sapiens
tttaaggaggggctcacgtggg

SEQ ID NO: 9050392 - DNA, 22 bp, Homo sapiens
tttaaggagctactcaccgtca

SEQ ID NO: 9050393 - DNA, 22 bp, Homo sapiens
tttaaggcaatatagaattcat

SEQ ID NO: 9050394 - DNA, 22 bp, Homo sapiens
tttaaggatgtaaaggaagaag

SEQ ID NO: 9050395 - DNA, 22 bp, Homo sapiens
tttaagtcatggagaattgtgg

SEQ ID NO: 9050396 - DNA, 22 bp, Homo sapiens
tttaatgtagcgtgaaatgatt

SEQ ID NO: 9050397 - DNA, 22 bp, Homo sapiens
tttaatgcaatttctggtctgc

SEQ ID NO: 9050398 - DNA, 22 bp, Homo sapiens
tttaatgcccaaggctttgatg

SEQ ID NO: 9050399 - DNA, 22 bp, Homo sapiens
tttaatgatagtcttacgaaaa

SEQ ID NO: 9050400 - DNA, 22 bp, Homo sapiens
tttcatgcacaaatgagcaagg

SEQ ID NO: 9050401 - DNA, 22 bp, Homo sapiens
tttcatgttacagtgtaaaagt

SEQ ID NO: 9050402 - DNA, 21 bp, Homo sapiens
tttcattgaatgagataaggt

SEQ ID NO: 9050403 - DNA, 22 bp, Homo sapiens
tttcattgagaatataagattt

SEQ ID NO: 9050404 - DNA, 22 bp, Homo sapiens
tttcattgagactatagacatc

SEQ ID NO: 9050405 - DNA, 22 bp, Homo sapiens
tttcattatacagcttcataaa

SEQ ID NO: 9050406 - DNA, 22 bp, Homo sapiens
tttcattcagcaccctgaggtg

SEQ ID NO: 9050407 - DNA, 22 bp, Homo sapiens
tttcagactgctgtgtgaaact

SEQ ID NO: 9050408 - DNA, 21 bp, Homo sapiens
tttcagacctatctttgaagg

SEQ ID NO: 9050409 - DNA, 22 bp, Homo sapiens
tttcagaaagcatcatcaaagt

SEQ ID NO: 9050410 - DNA, 22 bp, Homo sapiens
tttcagaaagctgaacatatga

SEQ ID NO: 9050411 - DNA, 22 bp, Homo sapiens
tttcagaaatggcactgaaatc

SEQ ID NO: 9050412 - DNA, 22 bp, Homo sapiens
tttcacatttgttttaagaagt

SEQ ID NO: 9050413 - DNA, 22 bp, Homo sapiens
tttcacctcagtctttttatat

SEQ ID NO: 9050414 - DNA, 22 bp, Homo sapiens
tttcactgggcttgcagaaatc

SEQ ID NO: 9050415 - DNA, 20 bp, Homo sapiens
tttcactggcttgataaggt

SEQ ID NO: 9050416 - DNA, 20 bp, Homo sapiens
tttcactgtggtgctggaga

SEQ ID NO: 9050417 - DNA, 22 bp, Homo sapiens
tttcactgttaggagtatgcta

SEQ ID NO: 9050418 - DNA, 22 bp, Homo sapiens
tttcactgttaggagtatgcta

SEQ ID NO: 9050419 - DNA, 22 bp, Homo sapiens
tttcaaaggttttgtcatgtct

SEQ ID NO: 9050420 - DNA, 22 bp, Homo sapiens
tttcaaaggtggaagagtgaat

SEQ ID NO: 9050421 - DNA, 22 bp, Homo sapiens
tttcaacagaatatgatcagag

SEQ ID NO: 9050422 - DNA, 23 bp, Homo sapiens
tttcaacaatgcttagagaaaac

SEQ ID NO: 9050423 - DNA, 22 bp, Homo sapiens
tttcaaagggaagttatgaagt

SEQ ID NO: 9050424 - DNA, 20 bp, Homo sapiens
tttattcacagagaagagtt

SEQ ID NO: 9050425 - DNA, 19 bp, Homo sapiens
tttattcacctttaccttg

SEQ ID NO: 9050426 - DNA, 20 bp, Homo sapiens
tttattcacagagaagagtt

SEQ ID NO: 9050427 - DNA, 22 bp, Homo sapiens
tttattctataggcattaagca

SEQ ID NO: 9050428 - DNA, 22 bp, Homo sapiens
tttattctataggcattaagca

SEQ ID NO: 9050429 - DNA, 22 bp, Homo sapiens
tttattctagctcagaatagtt

SEQ ID NO: 9050430 - DNA, 22 bp, Homo sapiens
tttcaagaagcaaattaaagtc

SEQ ID NO: 9050431 - DNA, 22 bp, Homo sapiens
tttcaagaacagcagcattcca

SEQ ID NO: 9050432 - DNA, 23 bp, Homo sapiens
tttcaacaggcagagaagactta

SEQ ID NO: 9050433 - DNA, 22 bp, Homo sapiens
tttcaacagctctcaaatgatc

SEQ ID NO: 9050434 - DNA, 17 bp, Homo sapiens
tttcaacatcactcagc

SEQ ID NO: 9050435 - DNA, 23 bp, Homo sapiens
tttcacagaaggattgtagggcc

SEQ ID NO: 9050436 - DNA, 22 bp, Homo sapiens
tttcacacttgatttgcagtta

SEQ ID NO: 9050437 - DNA, 22 bp, Homo sapiens
tttcacaattttaaggagcaaa

SEQ ID NO: 9050438 - DNA, 22 bp, Homo sapiens
tttcacaatgcaatcctacttc

SEQ ID NO: 9050439 - DNA, 22 bp, Homo sapiens
tttcacaatgcaatcctacttc

SEQ ID NO: 9050440 - DNA, 23 bp, Homo sapiens
tttcacaatgagcattacagaat

SEQ ID NO: 9050441 - DNA, 23 bp, Homo sapiens
tttcacaatgagcattacagaat

SEQ ID NO: 9050442 - DNA, 23 bp, Homo sapiens
tttcacaatgagcattacagaat

SEQ ID NO: 9050443 - DNA, 20 bp, Homo sapiens
tttcacaatgaacatgtctc

SEQ ID NO: 9050444 - DNA, 23 bp, Homo sapiens
tttcacaatgagcattacagaat

SEQ ID NO: 9050445 - DNA, 20 bp, Homo sapiens
tttcacaatgaacatgtctc

SEQ ID NO: 9050446 - DNA, 20 bp, Homo sapiens
tttcacaatgaacatgtctc

SEQ ID NO: 9050447 - DNA, 22 bp, Homo sapiens
ttggaaaatgaggcacagagag

SEQ ID NO: 9050448 - DNA, 23 bp, Homo sapiens
ttgcattaatgtggaggcacagg

SEQ ID NO: 9050449 - DNA, 22 bp, Homo sapiens
ttgctctatgtttgtaaacaga

SEQ ID NO: 9050450 - DNA, 22 bp, Homo sapiens
ttgctctatcacagtgatggga

SEQ ID NO: 9050451 - DNA, 22 bp, Homo sapiens
ttgctctagtggcccctgaatg

SEQ ID NO: 9050452 - DNA, 22 bp, Homo sapiens
ttgctctaccctgatcagttaa

SEQ ID NO: 9050453 - DNA, 21 bp, Homo sapiens
ttgctctacagtgagggcagc

SEQ ID NO: 9050454 - DNA, 22 bp, Homo sapiens
ttgacaaggagccattgcatct

SEQ ID NO: 9050455 - DNA, 22 bp, Homo sapiens
ttgacaagcgaagtaccataat

SEQ ID NO: 9050456 - DNA, 22 bp, Homo sapiens
ttgacaaagtttagtaataatc

SEQ ID NO: 9050457 - DNA, 22 bp, Homo sapiens
ttgacaaatacccattagacca

SEQ ID NO: 9050458 - DNA, 22 bp, Homo sapiens
ttgacaaaggaattgaatctct

SEQ ID NO: 9050459 - DNA, 21 bp, Homo sapiens
ttgcacagaaaaccatagaga

SEQ ID NO: 9050460 - DNA, 22 bp, Homo sapiens
ttgacagctacggagcagctgt

SEQ ID NO: 9050461 - DNA, 21 bp, Homo sapiens
ttgcacagaaaaccatagaga

SEQ ID NO: 9050462 - DNA, 22 bp, Homo sapiens
ttgcagagcagtaggaatatag

SEQ ID NO: 9050463 - DNA, 22 bp, Homo sapiens
ttgcagggacctgcagaaagct

SEQ ID NO: 9050464 - DNA, 22 bp, Homo sapiens
ttgcagggacctgcagaaagct

SEQ ID NO: 9050465 - DNA, 22 bp, Homo sapiens
ttgcagggataaaacaagtgaa

SEQ ID NO: 9050466 - DNA, 22 bp, Homo sapiens
ttgcagggaaatagaaataaac

SEQ ID NO: 9050467 - DNA, 22 bp, Homo sapiens
ttgcagggaaatcagtgaggat

SEQ ID NO: 9050468 - DNA, 22 bp, Homo sapiens
ttgcagggaaatcagtgaggat

SEQ ID NO: 9050469 - DNA, 23 bp, Homo sapiens
ttgcagggatggagttcaaaatg

SEQ ID NO: 9050470 - DNA, 22 bp, Homo sapiens
ttgcagggataaaacaagtgaa

SEQ ID NO: 9050471 - DNA, 23 bp, Homo sapiens
ttgcagggatggagttcaaaatg

SEQ ID NO: 9050472 - DNA, 22 bp, Homo sapiens
ttgcagggattaccttattttt

SEQ ID NO: 9050473 - DNA, 22 bp, Homo sapiens
ttgcagggcaaatggtcagata

SEQ ID NO: 9050474 - DNA, 22 bp, Homo sapiens
ttgcagggcaaatggtcagata

SEQ ID NO: 9050475 - DNA, 22 bp, Homo sapiens
ttgcagggattaccttattttt

SEQ ID NO: 9050476 - DNA, 22 bp, Homo sapiens
ttgcagggaaacagtttaggaa

SEQ ID NO: 9050477 - DNA, 22 bp, Homo sapiens
ttgcagggaaatagaaataaac

SEQ ID NO: 9050478 - DNA, 22 bp, Homo sapiens
ttgcagggtcctgtggctctcc

SEQ ID NO: 9050479 - DNA, 22 bp, Homo sapiens
ttgcagggtacattcttagaat

SEQ ID NO: 9050480 - DNA, 22 bp, Homo sapiens
ttgcagggtcccagaggcctgg

SEQ ID NO: 9050481 - DNA, 22 bp, Homo sapiens
ttgcagggtcccagaggcctgg

SEQ ID NO: 9050482 - DNA, 22 bp, Homo sapiens
ttgcaggggaaggagcagagct

SEQ ID NO: 9050483 - DNA, 22 bp, Homo sapiens
ttgcaggggaaggagcagagct

SEQ ID NO: 9050484 - DNA, 22 bp, Homo sapiens
ttgcaggggagaggaacaaaca

SEQ ID NO: 9050485 - DNA, 22 bp, Homo sapiens
ttgcaggggagaggaacaaaca

SEQ ID NO: 9050486 - DNA, 22 bp, Homo sapiens
ttgcagggcaggaccatggaca

SEQ ID NO: 9050487 - DNA, 22 bp, Homo sapiens
ttgcagggcatcgcgtacttct

SEQ ID NO: 9050488 - DNA, 22 bp, Homo sapiens
ttgcagggcatctatgtctggt

SEQ ID NO: 9050489 - DNA, 22 bp, Homo sapiens
ttgcagggcttggggattacag

SEQ ID NO: 9050490 - DNA, 22 bp, Homo sapiens
ttgcagggctggaacatggaat

SEQ ID NO: 9050491 - DNA, 22 bp, Homo sapiens
ttgcagggccttggcttcttcc

SEQ ID NO: 9050492 - DNA, 22 bp, Homo sapiens
ttgcagggcatctatgtctggt

SEQ ID NO: 9050493 - DNA, 22 bp, Homo sapiens
ttgcagggttgaccaataggct

SEQ ID NO: 9050494 - DNA, 22 bp, Homo sapiens
ttgcagggttaaagtaaggtag

SEQ ID NO: 9050495 - DNA, 22 bp, Homo sapiens
ttgcagggttaaagtaaggtag

SEQ ID NO: 9050496 - DNA, 22 bp, Homo sapiens
ttgcagggttgacactgcctgc

SEQ ID NO: 9050497 - DNA, 22 bp, Homo sapiens
ttgcaggtgagggaaatgactg

SEQ ID NO: 9050498 - DNA, 22 bp, Homo sapiens
ttgcaggttcaagaaactgatt

SEQ ID NO: 9050499 - DNA, 23 bp, Homo sapiens
ttgcatgtagcccatgagtaact

SEQ ID NO: 9050500 - DNA, 22 bp, Homo sapiens
ttgggaagtaatatggtggtct

SEQ ID NO: 9050501 - DNA, 22 bp, Homo sapiens
ttgggaagaggcccctggattc

SEQ ID NO: 9050502 - DNA, 22 bp, Homo sapiens
ttgggagcttggacttagtgtg

SEQ ID NO: 9050503 - DNA, 22 bp, Homo sapiens
ttgggccaaagatgtccttgtt

SEQ ID NO: 9050504 - DNA, 22 bp, Homo sapiens
ttggaggactagttaagagacc

SEQ ID NO: 9050505 - DNA, 18 bp, Homo sapiens
ttggacctgtgtcagggc

SEQ ID NO: 9050506 - DNA, 22 bp, Homo sapiens
ttgtaaactgctgcaggagtgc

SEQ ID NO: 9050507 - DNA, 22 bp, Homo sapiens
ttgtaacaatctgtcataaatg

SEQ ID NO: 9050508 - DNA, 22 bp, Homo sapiens
ttgtaacaaagacactccaaaa

SEQ ID NO: 9050509 - DNA, 22 bp, Homo sapiens
ttgtaacacttttctattaata

SEQ ID NO: 9050510 - DNA, 22 bp, Homo sapiens
ttgtaacacttttctattaata

SEQ ID NO: 9050511 - DNA, 22 bp, Homo sapiens
ttgtaacatcaccatcaaaatc

SEQ ID NO: 9050512 - DNA, 22 bp, Homo sapiens
ttgtaacaggtactaaataact

SEQ ID NO: 9050513 - DNA, 22 bp, Homo sapiens
ttgtaacagctgtttatatagt

SEQ ID NO: 9050514 - DNA, 22 bp, Homo sapiens
ttgtcagggactggaaaagaaa

SEQ ID NO: 9050515 - DNA, 22 bp, Homo sapiens
ttgtcatcatgttttccaaagg

SEQ ID NO: 9050516 - DNA, 22 bp, Homo sapiens
ttcaaagataattaccaaacat

SEQ ID NO: 9050517 - DNA, 22 bp, Homo sapiens
ttcaaagatggagggatagatt

SEQ ID NO: 9050518 - DNA, 23 bp, Homo sapiens
ttcaaagatcttctgaaatctgt

SEQ ID NO: 9050519 - DNA, 22 bp, Homo sapiens
ttcaaagcagagggtcaataca

SEQ ID NO: 9050520 - DNA, 22 bp, Homo sapiens
ttcacaatggcaaaccattaaa

SEQ ID NO: 9050521 - DNA, 22 bp, Homo sapiens
ttcacaataggagcatgcaaat

SEQ ID NO: 9050522 - DNA, 21 bp, Homo sapiens
ttcaaagagtgggcattgtca

SEQ ID NO: 9050523 - DNA, 22 bp, Homo sapiens
ttcacagagagtatgcagagaa

SEQ ID NO: 9050524 - DNA, 22 bp, Homo sapiens
ttcagcaaggcatgtgcaggag

SEQ ID NO: 9050525 - DNA, 22 bp, Homo sapiens
ttcagagaagcaaaggcagatt

SEQ ID NO: 9050526 - DNA, 22 bp, Homo sapiens
ttcagagaaactgaggtttaga

SEQ ID NO: 9050527 - DNA, 22 bp, Homo sapiens
ttcacagggccactggcaggag

SEQ ID NO: 9050528 - DNA, 22 bp, Homo sapiens
ttcacaggatatatgtgcaggg

SEQ ID NO: 9050529 - DNA, 22 bp, Homo sapiens
ttcacaggatagctattgcacg

SEQ ID NO: 9050530 - DNA, 22 bp, Homo sapiens
ttcagagatggaaggcagaatg

SEQ ID NO: 9050531 - DNA, 22 bp, Homo sapiens
ttcagagagtccagtatgcagt

SEQ ID NO: 9050532 - DNA, 22 bp, Homo sapiens
ttcagagaattggataattcgt

SEQ ID NO: 9050533 - DNA, 22 bp, Homo sapiens
ttcagagaagtgcacaaaatca

SEQ ID NO: 9050534 - DNA, 22 bp, Homo sapiens
ttcatttttaccgcgtgtcaaa

SEQ ID NO: 9050535 - DNA, 22 bp, Homo sapiens
ttcatttgttgacagagacatg

SEQ ID NO: 9050536 - DNA, 18 bp, Homo sapiens
ttccagtagctgtatcac

SEQ ID NO: 9050537 - DNA, 22 bp, Homo sapiens
ttccagtaatgtgactttgagc

SEQ ID NO: 9050538 - DNA, 19 bp, Homo sapiens
ttccagtagattagatagc

SEQ ID NO: 9050539 - DNA, 22 bp, Homo sapiens
ttcattgtactttaagagatgc

SEQ ID NO: 9050540 - DNA, 22 bp, Homo sapiens
ttcatttaatttgtgtattaac

SEQ ID NO: 9050541 - DNA, 21 bp, Homo sapiens
ttcataaaccattctcatgca

SEQ ID NO: 9050542 - DNA, 19 bp, Homo sapiens
ttcataacttttatatcct

SEQ ID NO: 9050543 - DNA, 21 bp, Homo sapiens
ttcataaaccattctcatgca

SEQ ID NO: 9050544 - DNA, 22 bp, Homo sapiens
ttcaaacagttgcacaacttat

SEQ ID NO: 9050545 - DNA, 22 bp, Homo sapiens
ttcaaacagtgtagaatatatg

SEQ ID NO: 9050546 - DNA, 22 bp, Homo sapiens
ttcaaactagttaaaagtcaga

SEQ ID NO: 9050547 - DNA, 22 bp, Homo sapiens
ttcaaacaggggtcagggagat

SEQ ID NO: 9050548 - DNA, 22 bp, Homo sapiens
ttcaaacagatgactctgctct

SEQ ID NO: 9050549 - DNA, 22 bp, Homo sapiens
ttcaaacactgttggcactggg

SEQ ID NO: 9050550 - DNA, 22 bp, Homo sapiens
ttattcttttctccagaatccc

SEQ ID NO: 9050551 - DNA, 22 bp, Homo sapiens
ttattcttttctccagaatccc

SEQ ID NO: 9050552 - DNA, 22 bp, Homo sapiens
ttatatatcttgatttgttcca

SEQ ID NO: 9050553 - DNA, 22 bp, Homo sapiens
ttatatatatgtagaggtcacg

SEQ ID NO: 9050554 - DNA, 19 bp, Homo sapiens
ttatatacttggtttctct

SEQ ID NO: 9050555 - DNA, 22 bp, Homo sapiens
ttattaaaatgcggatttggct

SEQ ID NO: 9050556 - DNA, 22 bp, Homo sapiens
ttattataatgagggataaaaa

SEQ ID NO: 9050557 - DNA, 22 bp, Homo sapiens
ttattactgtattaatccagag

SEQ ID NO: 9050558 - DNA, 22 bp, Homo sapiens
ttattacactgaaagaattgcg

SEQ ID NO: 9050559 - DNA, 22 bp, Homo sapiens
ttattctttaaacatatatgtt

SEQ ID NO: 9050560 - DNA, 22 bp, Homo sapiens
ttattcttttctccagaatccc

SEQ ID NO: 9050561 - DNA, 22 bp, Homo sapiens
ttattatagattatgcaagatt

SEQ ID NO: 9050562 - DNA, 22 bp, Homo sapiens
ttattatagattatgcaagatt

SEQ ID NO: 9050563 - DNA, 22 bp, Homo sapiens
ttattatagattatgcaagatt

SEQ ID NO: 9050564 - DNA, 22 bp, Homo sapiens
ttatactaaaacgcattgaatt

SEQ ID NO: 9050565 - DNA, 22 bp, Homo sapiens
ttatatactgtggtagtactgt

SEQ ID NO: 9050566 - DNA, 22 bp, Homo sapiens
ttatataactcaggtgggctca

SEQ ID NO: 9050567 - DNA, 22 bp, Homo sapiens
ttataggaaaagttctagaaaa

SEQ ID NO: 9050568 - DNA, 22 bp, Homo sapiens
ttagctatggctattactagtt

SEQ ID NO: 9050569 - DNA, 22 bp, Homo sapiens
ttagctgaaaaaattcatgcaa

SEQ ID NO: 9050570 - DNA, 22 bp, Homo sapiens
ttagctctttgtagctatttct

SEQ ID NO: 9050571 - DNA, 22 bp, Homo sapiens
ttagctgagattaagtgaactt

SEQ ID NO: 9050572 - DNA, 23 bp, Homo sapiens
ttctctagatgaggtgaagatgg

SEQ ID NO: 9050573 - DNA, 21 bp, Homo sapiens
ttctctccatatgcccagccc

SEQ ID NO: 9050574 - DNA, 22 bp, Homo sapiens
ttctctgcctctagctatattc

SEQ ID NO: 9050575 - DNA, 22 bp, Homo sapiens
ttctctcttactgccatgctgt

SEQ ID NO: 9050576 - DNA, 22 bp, Homo sapiens
ttctcagattccccttttaata

SEQ ID NO: 9050577 - DNA, 22 bp, Homo sapiens
ttctcagatgattcagataaac

SEQ ID NO: 9050578 - DNA, 22 bp, Homo sapiens
ttctcagatccatcagaagtcc

SEQ ID NO: 9050579 - DNA, 21 bp, Homo sapiens
ttctcagatcgagtagtgaga

SEQ ID NO: 9050580 - DNA, 22 bp, Homo sapiens
ttcctgacttgccaggtgtgac

SEQ ID NO: 9050581 - DNA, 22 bp, Homo sapiens
ttcctgcagcaaggagaagctg

SEQ ID NO: 9050582 - DNA, 22 bp, Homo sapiens
ttcctggcactgcagtggttga

SEQ ID NO: 9050583 - DNA, 22 bp, Homo sapiens
ttcctgcctacatgccttatgc

SEQ ID NO: 9050584 - DNA, 22 bp, Homo sapiens
ttccttgaccactgcataatga

SEQ ID NO: 9050585 - DNA, 22 bp, Homo sapiens
ttccttgaaagtttgaactgac

SEQ ID NO: 9050586 - DNA, 22 bp, Homo sapiens
ttccttgaatgagtcatggaaa

SEQ ID NO: 9050587 - DNA, 22 bp, Homo sapiens
ttcctggggtactggagaaaat

SEQ ID NO: 9050588 - DNA, 22 bp, Homo sapiens
ttcctggtagtaagacatctgg

SEQ ID NO: 9050589 - DNA, 22 bp, Homo sapiens
ttctttttaaagtgtgtatgca

SEQ ID NO: 9050590 - DNA, 22 bp, Homo sapiens
ttcttttgggaattacgtatgc

SEQ ID NO: 9050591 - DNA, 22 bp, Homo sapiens
ttcttcaaccatctacataaac

SEQ ID NO: 9050592 - DNA, 22 bp, Homo sapiens
ttcttcaaatgctgaaagtcta

SEQ ID NO: 9050593 - DNA, 22 bp, Homo sapiens
ttcttcaaagtaatagagacta

SEQ ID NO: 9050594 - DNA, 22 bp, Homo sapiens
ttcttcaacaaggacactgtta

SEQ ID NO: 9050595 - DNA, 22 bp, Homo sapiens
ttcttcaattttccatatactg

SEQ ID NO: 9050596 - DNA, 22 bp, Homo sapiens
ttcttattttcctgaggaagaa

SEQ ID NO: 9050597 - DNA, 22 bp, Homo sapiens
ttcttattcttgaaatgtggga

SEQ ID NO: 9050598 - DNA, 22 bp, Homo sapiens
ttcttcaaagtaatagagacta

SEQ ID NO: 9050599 - DNA, 20 bp, Homo sapiens
ttctttgttccttacatttg

SEQ ID NO: 9050600 - DNA, 22 bp, Homo sapiens
ttctggaatgcctgttctaatt

SEQ ID NO: 9050601 - DNA, 22 bp, Homo sapiens
ttctggaaatgcacaactaatt

SEQ ID NO: 9050602 - DNA, 22 bp, Homo sapiens
ttctggaagtggaatttttgta

SEQ ID NO: 9050603 - DNA, 22 bp, Homo sapiens
ttctgtctggaaaaggacatag

SEQ ID NO: 9050604 - DNA, 22 bp, Homo sapiens
ttcttacattagtctgtgcttt

SEQ ID NO: 9050605 - DNA, 22 bp, Homo sapiens
ttcttactacatttgcaggcta

SEQ ID NO: 9050606 - DNA, 22 bp, Homo sapiens
tttgacaagagggcatcttcag

SEQ ID NO: 9050607 - DNA, 22 bp, Homo sapiens
tttgaagagccacagtgaaatt

SEQ ID NO: 9050608 - DNA, 22 bp, Homo sapiens
tttcttttccaatatccctact

SEQ ID NO: 9050609 - DNA, 19 bp, Homo sapiens
tttcttttcccctcagcac

SEQ ID NO: 9050610 - DNA, 22 bp, Homo sapiens
tttcctctgactgctcccctgc

SEQ ID NO: 9050611 - DNA, 22 bp, Homo sapiens
tttcctcctagcctccagccgc

SEQ ID NO: 9050612 - DNA, 22 bp, Homo sapiens
tttgatgatgatgataaagttt

SEQ ID NO: 9050613 - DNA, 19 bp, Homo sapiens
tttgatgagaatttaagca

SEQ ID NO: 9050614 - DNA, 22 bp, Homo sapiens
tttgatgaacctatataatttg

SEQ ID NO: 9050615 - DNA, 22 bp, Homo sapiens
tttgatgacttcagatctttgt

SEQ ID NO: 9050616 - DNA, 22 bp, Homo sapiens
tttgatgacctgtatctttttc

SEQ ID NO: 9050617 - DNA, 22 bp, Homo sapiens
tttgctttcccttgtagaaagt

SEQ ID NO: 9050618 - DNA, 22 bp, Homo sapiens
tttgatatcctatacaagtaaa

SEQ ID NO: 9050619 - DNA, 22 bp, Homo sapiens
tttgatagttgattaaattcca

SEQ ID NO: 9050620 - DNA, 22 bp, Homo sapiens
tttgtaaatagcagtactcatg

SEQ ID NO: 9050621 - DNA, 22 bp, Homo sapiens
tttgttaattcttatgttagag

SEQ ID NO: 9050622 - DNA, 22 bp, Homo sapiens
ttttaagaaatgtatgactgtc

SEQ ID NO: 9050623 - DNA, 22 bp, Homo sapiens
ttttaagaaatgtatgactgtc

SEQ ID NO: 9050624 - DNA, 21 bp, Homo sapiens
ttttaacaaggatttccctag

SEQ ID NO: 9050625 - DNA, 22 bp, Homo sapiens
ttttaacactcagcactatctc

SEQ ID NO: 9050626 - DNA, 22 bp, Homo sapiens
ttttaaatctccagttgacccc

SEQ ID NO: 9050627 - DNA, 22 bp, Homo sapiens
ttttaaaggatactcttgtcta

SEQ ID NO: 9050628 - DNA, 22 bp, Homo sapiens
ttttaaaggcagattatggctt

SEQ ID NO: 9050629 - DNA, 22 bp, Homo sapiens
tttgttcaatccagacaatagc

SEQ ID NO: 9050630 - DNA, 22 bp, Homo sapiens
ttttaaactgcagaatttagaa

SEQ ID NO: 9050631 - DNA, 22 bp, Homo sapiens
ttttaaactgcagaatttagaa

SEQ ID NO: 9050632 - DNA, 22 bp, Homo sapiens
ttttatgtcataaggacactca

SEQ ID NO: 9050633 - DNA, 22 bp, Homo sapiens
ttttaatactgctattgtagga

SEQ ID NO: 9050634 - DNA, 22 bp, Homo sapiens
ttttaattcaaagtgaatagtg

SEQ ID NO: 9050635 - DNA, 22 bp, Homo sapiens
ttttcatagtaatggtgcatgt

SEQ ID NO: 9050636 - DNA, 22 bp, Homo sapiens
ttttcatgtcatgtccttgagg

SEQ ID NO: 9050637 - DNA, 22 bp, Homo sapiens
ttttcacacaaggtgataagtt

SEQ ID NO: 9050638 - DNA, 22 bp, Homo sapiens
ttttcacacaaggtgataagtt

SEQ ID NO: 9050639 - DNA, 19 bp, Homo sapiens
ttttcacatactggatcct

SEQ ID NO: 9050640 - DNA, 22 bp, Homo sapiens
ttttcacatgcttggggactta

SEQ ID NO: 9050641 - DNA, 22 bp, Homo sapiens
ttttcacattgtcccagcacta

SEQ ID NO: 9050642 - DNA, 22 bp, Homo sapiens
ttttattagtggctagatgggg

SEQ ID NO: 9050643 - DNA, 22 bp, Homo sapiens
ttttattatctttgaatgggac

SEQ ID NO: 9050644 - DNA, 22 bp, Homo sapiens
ttttatgttgctataataggta

SEQ ID NO: 9050645 - DNA, 22 bp, Homo sapiens
ttttctcttgttaatgtactga

SEQ ID NO: 9050646 - DNA, 20 bp, Homo sapiens
ttttctgtgccaagaaaact

SEQ ID NO: 9050647 - DNA, 22 bp, Homo sapiens
ttttcttactgtctgtgatcct

SEQ ID NO: 9050648 - DNA, 22 bp, Homo sapiens
ttttcttatgtgcagctatatg

SEQ ID NO: 9050649 - DNA, 22 bp, Homo sapiens
tttttacagtcatggtcactca

SEQ ID NO: 9050650 - DNA, 22 bp, Homo sapiens
tttttataactcttttgtgaca

SEQ ID NO: 9050651 - DNA, 22 bp, Homo sapiens
tttttataccacctctcactta

SEQ ID NO: 9050652 - DNA, 22 bp, Homo sapiens
tttttacacttagcattgagcg

SEQ ID NO: 9050653 - DNA, 19 bp, Homo sapiens
tttttacaagtaggtgtga

SEQ ID NO: 9050654 - DNA, 22 bp, Homo sapiens
tttttatgcctacgctgaaaag

SEQ ID NO: 9050655 - DNA, 22 bp, Homo sapiens
tttttcaagacaacctgcatgt

SEQ ID NO: 9050656 - DNA, 22 bp, Homo sapiens
tttttcatattcccctctctgg

SEQ ID NO: 9050657 - DNA, 22 bp, Homo sapiens
cagaagcagattctaaagcaag

SEQ ID NO: 9050658 - DNA, 22 bp, Homo sapiens
cagaagcagattctaaagcaag

SEQ ID NO: 9050659 - DNA, 22 bp, Homo sapiens
cagaagcactaggaggaaacgt

SEQ ID NO: 9050660 - DNA, 22 bp, Homo sapiens
cagaagcacatgtttacatgta

SEQ ID NO: 9050661 - DNA, 22 bp, Homo sapiens
cagaagagtagctgaacaagtt

SEQ ID NO: 9050662 - DNA, 22 bp, Homo sapiens
cagaagcaagggccaaagtctt

SEQ ID NO: 9050663 - DNA, 22 bp, Homo sapiens
cagagcagcagagcttccatgg

SEQ ID NO: 9050664 - DNA, 22 bp, Homo sapiens
cagagctgtcatttgccagtga

SEQ ID NO: 9050665 - DNA, 22 bp, Homo sapiens
cagagcttgaatgtccatggtt

SEQ ID NO: 9050666 - DNA, 22 bp, Homo sapiens
gggggcagtaaggatatggaaa

SEQ ID NO: 9050667 - DNA, 22 bp, Homo sapiens
gggggcagtaacctcaaagtgt

SEQ ID NO: 9050668 - DNA, 22 bp, Homo sapiens
gggggaggtgaatgcaataagg

SEQ ID NO: 9050669 - DNA, 22 bp, Homo sapiens
gggggcagaatgtactcttgtc

SEQ ID NO: 9050670 - DNA, 22 bp, Homo sapiens
gggggcaggtctggaactttga

SEQ ID NO: 9050671 - DNA, 23 bp, Homo sapiens
gggggagctggactcctagatcc

SEQ ID NO: 9050672 - DNA, 22 bp, Homo sapiens
gggggagctagtccagctgagg

SEQ ID NO: 9050673 - DNA, 22 bp, Homo sapiens
gggggagctgttattggcaggg

SEQ ID NO: 9050674 - DNA, 22 bp, Homo sapiens
gggggagctagtccagctgagg

SEQ ID NO: 9050675 - DNA, 22 bp, Homo sapiens
ggggtgagatcaaggaagccct

SEQ ID NO: 9050676 - DNA, 22 bp, Homo sapiens
cagaggctgatggctgtagcca

SEQ ID NO: 9050677 - DNA, 22 bp, Homo sapiens
cagatacctgggtatcatttag

SEQ ID NO: 9050678 - DNA, 22 bp, Homo sapiens
cagatacattaaaatgatgatt

SEQ ID NO: 9050679 - DNA, 22 bp, Homo sapiens
cagatacaggtttttgttagat

SEQ ID NO: 9050680 - DNA, 22 bp, Homo sapiens
gtaagaaaaccttctttctaat

SEQ ID NO: 9050681 - DNA, 22 bp, Homo sapiens
gtaagaggagtgggaagcctca

SEQ ID NO: 9050682 - DNA, 22 bp, Homo sapiens
gtaacattattcatgagataca

SEQ ID NO: 9050683 - DNA, 16 bp, Homo sapiens
gtaacattctgtagcc

SEQ ID NO: 9050684 - DNA, 22 bp, Homo sapiens
gtaacattctagaaacttaaca

SEQ ID NO: 9050685 - DNA, 22 bp, Homo sapiens
gtaacctgtcggaaagccttgt

SEQ ID NO: 9050686 - DNA, 22 bp, Homo sapiens
gtaacctgggatgtagcacaga

SEQ ID NO: 9050687 - DNA, 22 bp, Homo sapiens
gtaacatttacagttcctagag

SEQ ID NO: 9050688 - DNA, 22 bp, Homo sapiens
gtaacattttgagcagtaggct

SEQ ID NO: 9050689 - DNA, 22 bp, Homo sapiens
ggtggcagtgcttgcgggtcta

SEQ ID NO: 9050690 - DNA, 22 bp, Homo sapiens
gtgcaaaagtcattgtggtttt

SEQ ID NO: 9050691 - DNA, 22 bp, Homo sapiens
gtgcaaaagtaattgtggtttt

SEQ ID NO: 9050692 - DNA, 22 bp, Homo sapiens
gtgaataattttttagtataag

SEQ ID NO: 9050693 - DNA, 20 bp, Homo sapiens
gtgcagccaagctgagccgc

SEQ ID NO: 9050694 - DNA, 22 bp, Homo sapiens
gtgaagtggttagggagttggc

SEQ ID NO: 9050695 - DNA, 22 bp, Homo sapiens
gtctttggagaggtgccatttc

SEQ ID NO: 9050696 - DNA, 22 bp, Homo sapiens
gtctcttagtcaatattttctg

SEQ ID NO: 9050697 - DNA, 22 bp, Homo sapiens
gtctcttagtctcattttctgc

SEQ ID NO: 9050698 - DNA, 22 bp, Homo sapiens
gtctcttatgggcaggagcaca

SEQ ID NO: 9050699 - DNA, 17 bp, Homo sapiens
gtctcttagcaccgtat

SEQ ID NO: 9050700 - DNA, 22 bp, Homo sapiens
gtctcttagaatcgcatattgt

SEQ ID NO: 9050701 - DNA, 22 bp, Homo sapiens
gtctgtttggggacctgtggcc

SEQ ID NO: 9050702 - DNA, 22 bp, Homo sapiens
gtctcagggactgcttctgggg

SEQ ID NO: 9050703 - DNA, 22 bp, Homo sapiens
gtctcagtgcccaatgccataa

SEQ ID NO: 9050704 - DNA, 22 bp, Homo sapiens
gtctcagtaagaaaggctcctg

SEQ ID NO: 9050705 - DNA, 22 bp, Homo sapiens
gtctcaggttcgagcctcctta

SEQ ID NO: 9050706 - DNA, 22 bp, Homo sapiens
gtctcagtttgaagtgatgcca

SEQ ID NO: 9050707 - DNA, 22 bp, Homo sapiens
gtctcattggttctgccagagt

SEQ ID NO: 9050708 - DNA, 22 bp, Homo sapiens
gtctcagttgtatcacctggtt

SEQ ID NO: 9050709 - DNA, 22 bp, Homo sapiens
gtctcagtgtcacctccagctg

SEQ ID NO: 9050710 - DNA, 22 bp, Homo sapiens
gtctcagttactctccctggta

SEQ ID NO: 9050711 - DNA, 21 bp, Homo sapiens
gtctcttaaggctttggctca

SEQ ID NO: 9050712 - DNA, 22 bp, Homo sapiens
gtctcttagaaccttgttttgg

SEQ ID NO: 9050713 - DNA, 22 bp, Homo sapiens
gtcctaatctcttcttataagg

SEQ ID NO: 9050714 - DNA, 22 bp, Homo sapiens
gtcctctgtgtaggctgcagac

SEQ ID NO: 9050715 - DNA, 22 bp, Homo sapiens
gtcctctgttagaaatgtgctt

SEQ ID NO: 9050716 - DNA, 22 bp, Homo sapiens
gtcctctgtttccatctgactt

SEQ ID NO: 9050717 - DNA, 22 bp, Homo sapiens
cagcagggaagctgtgctgttt

SEQ ID NO: 9050718 - DNA, 22 bp, Homo sapiens
cagcagagctgtgtgggaaggg

SEQ ID NO: 9050719 - DNA, 22 bp, Homo sapiens
cagcagtaactcccgtgcagca

SEQ ID NO: 9050720 - DNA, 22 bp, Homo sapiens
cagcagtacttctcagaggtat

SEQ ID NO: 9050721 - DNA, 22 bp, Homo sapiens
cagctccagccgactgtaagaa

SEQ ID NO: 9050722 - DNA, 22 bp, Homo sapiens
gtgctgaggtgggtgggcagcc

SEQ ID NO: 9050723 - DNA, 22 bp, Homo sapiens
cagctccagcccaggcagctcc

SEQ ID NO: 9050724 - DNA, 22 bp, Homo sapiens
gtgcctggtatgtaggtagcgg

SEQ ID NO: 9050725 - DNA, 21 bp, Homo sapiens
gtgctgaggatacagtagtaa

SEQ ID NO: 9050726 - DNA, 22 bp, Homo sapiens
gtgccctgacacacctggtgtg

SEQ ID NO: 9050727 - DNA, 22 bp, Homo sapiens
cagctctgagactgaggctatg

SEQ ID NO: 9050728 - DNA, 22 bp, Homo sapiens
cagctcctgaggactgctggga

SEQ ID NO: 9050729 - DNA, 22 bp, Homo sapiens
cagctctgaggaacactccttt

SEQ ID NO: 9050730 - DNA, 22 bp, Homo sapiens
cagctcctagatcggcgaagtg

SEQ ID NO: 9050731 - DNA, 22 bp, Homo sapiens
cagctcctatgagtatgattcc

SEQ ID NO: 9050732 - DNA, 22 bp, Homo sapiens
cagctcctcagccctgccttgg

SEQ ID NO: 9050733 - DNA, 22 bp, Homo sapiens
cagctcctattagacactgaat

SEQ ID NO: 9050734 - DNA, 22 bp, Homo sapiens
ggaacacagtgccttacaaact

SEQ ID NO: 9050735 - DNA, 22 bp, Homo sapiens
ggaacacaaatgggagagctgg

SEQ ID NO: 9050736 - DNA, 22 bp, Homo sapiens
caatggaagaatctgacctgca

SEQ ID NO: 9050737 - DNA, 22 bp, Homo sapiens
caatgcttttagcttcagcttg

SEQ ID NO: 9050738 - DNA, 22 bp, Homo sapiens
caatgctttatttcctcccctt

SEQ ID NO: 9050739 - DNA, 22 bp, Homo sapiens
caatgcttgctgactccctgtc

SEQ ID NO: 9050740 - DNA, 21 bp, Homo sapiens
caagttctgtgtcttactcct

SEQ ID NO: 9050741 - DNA, 22 bp, Homo sapiens
caagttaatatatagaattttg

SEQ ID NO: 9050742 - DNA, 22 bp, Homo sapiens
caagtcacatggccaactgatg

SEQ ID NO: 9050743 - DNA, 22 bp, Homo sapiens
caatgcagataccttccagaga

SEQ ID NO: 9050744 - DNA, 22 bp, Homo sapiens
caatcccatcaccatctgctct

SEQ ID NO: 9050745 - DNA, 22 bp, Homo sapiens
caagtttaaggcactgataagt

SEQ ID NO: 9050746 - DNA, 22 bp, Homo sapiens
caaatttaagttagaaagcaat

SEQ ID NO: 9050747 - DNA, 18 bp, Homo sapiens
caaattctcattgatttc

SEQ ID NO: 9050748 - DNA, 18 bp, Homo sapiens
caaattcagtgctggaag

SEQ ID NO: 9050749 - DNA, 20 bp, Homo sapiens
gctgaggtccctgtggtttt

SEQ ID NO: 9050750 - DNA, 16 bp, Homo sapiens
gctggagggaggggtt

SEQ ID NO: 9050751 - DNA, 20 bp, Homo sapiens
gctggcagatgtcttgagat

SEQ ID NO: 9050752 - DNA, 22 bp, Homo sapiens
gctgggagccccgagccagcgc

SEQ ID NO: 9050753 - DNA, 19 bp, Homo sapiens
gctgggagcagaccctccc

SEQ ID NO: 9050754 - DNA, 22 bp, Homo sapiens
ggagataatccagggagggact

SEQ ID NO: 9050755 - DNA, 22 bp, Homo sapiens
cacagagacagaagcacttatg

SEQ ID NO: 9050756 - DNA, 22 bp, Homo sapiens
cacagcaaagacactctcaact

SEQ ID NO: 9050757 - DNA, 21 bp, Homo sapiens
ggacagctgcgcgcagggctc

SEQ ID NO: 9050758 - DNA, 22 bp, Homo sapiens
ggaaggggccttgagcaaactg

SEQ ID NO: 9050759 - DNA, 22 bp, Homo sapiens
ggacacagacctttctgttcta

SEQ ID NO: 9050760 - DNA, 22 bp, Homo sapiens
ggacacaaaagtgaataaaata

SEQ ID NO: 9050761 - DNA, 22 bp, Homo sapiens
ggaacaggaaaggagggatgct

SEQ ID NO: 9050762 - DNA, 22 bp, Homo sapiens
cacagcattcacagaaagacat

SEQ ID NO: 9050763 - DNA, 22 bp, Homo sapiens
ggagcagccgcgtctcagggca

SEQ ID NO: 9050764 - DNA, 22 bp, Homo sapiens
ggagcagccacgtctcagggca

SEQ ID NO: 9050765 - DNA, 22 bp, Homo sapiens
ggaggagagaggttgcaaacac

SEQ ID NO: 9050766 - DNA, 22 bp, Homo sapiens
ggaggagacggagtgattagtg

SEQ ID NO: 9050767 - DNA, 22 bp, Homo sapiens
ggaggagacagtaaaaagcacg

SEQ ID NO: 9050768 - DNA, 22 bp, Homo sapiens
ggaggagattcccctctcactt

SEQ ID NO: 9050769 - DNA, 22 bp, Homo sapiens
ggaggagcacttctgagctcag

SEQ ID NO: 9050770 - DNA, 22 bp, Homo sapiens
ggaggagacagtaaaaagcacg

SEQ ID NO: 9050771 - DNA, 22 bp, Homo sapiens
ggagcagcttgcatgctcaggg

SEQ ID NO: 9050772 - DNA, 22 bp, Homo sapiens
ggaggggcatagttcaccatca

SEQ ID NO: 9050773 - DNA, 22 bp, Homo sapiens
ggaggggccggctgcctgccac

SEQ ID NO: 9050774 - DNA, 22 bp, Homo sapiens
ggaggggcagccatggaactcc

SEQ ID NO: 9050775 - DNA, 22 bp, Homo sapiens
ggaggggatttagtagatgcta

SEQ ID NO: 9050776 - DNA, 22 bp, Homo sapiens
ggcaggaagctcatgtggactg

SEQ ID NO: 9050777 - DNA, 22 bp, Homo sapiens
ggatccagtccagggctgtgtg

SEQ ID NO: 9050778 - DNA, 20 bp, Homo sapiens
ggcaggaccccagtggcatc

SEQ ID NO: 9050779 - DNA, 22 bp, Homo sapiens
cacatgcataaggataattact

SEQ ID NO: 9050780 - DNA, 22 bp, Homo sapiens
cacatgcatacctatgtgtata

SEQ ID NO: 9050781 - DNA, 22 bp, Homo sapiens
cacatgcatctgtcatgtttgg

SEQ ID NO: 9050782 - DNA, 22 bp, Homo sapiens
cacatgcattggcaaaagtgta

SEQ ID NO: 9050783 - DNA, 22 bp, Homo sapiens
ggcaggtgtggtgaccagagat

SEQ ID NO: 9050784 - DNA, 22 bp, Homo sapiens
ggcagtatgagttcaaataatt

SEQ ID NO: 9050785 - DNA, 22 bp, Homo sapiens
cacatgcccagaacttctcatt

SEQ ID NO: 9050786 - DNA, 22 bp, Homo sapiens
caccaaagtcgcttctgtcgtc

SEQ ID NO: 9050787 - DNA, 17 bp, Homo sapiens
caccaattaagaccctc

SEQ ID NO: 9050788 - DNA, 19 bp, Homo sapiens
cacattttgagtctgagat

SEQ ID NO: 9050789 - DNA, 19 bp, Homo sapiens
cacattttgagtctgagat

SEQ ID NO: 9050790 - DNA, 22 bp, Homo sapiens
ggccactttcatagcaagtgtg

SEQ ID NO: 9050791 - DNA, 22 bp, Homo sapiens
ggccagggccaaggctttccca

SEQ ID NO: 9050792 - DNA, 22 bp, Homo sapiens
ggccagctccttggcagtgcct

SEQ ID NO: 9050793 - DNA, 22 bp, Homo sapiens
ggccagctcagggtccttgggc

SEQ ID NO: 9050794 - DNA, 22 bp, Homo sapiens
ggcgcccccttcaaacagagca

SEQ ID NO: 9050795 - DNA, 20 bp, Homo sapiens
ggctgctggtttggctctgt

SEQ ID NO: 9050796 - DNA, 22 bp, Homo sapiens
cagaaatggtctgttcagctta

SEQ ID NO: 9050797 - DNA, 22 bp, Homo sapiens
cagaaatggtctgttcagctta

SEQ ID NO: 9050798 - DNA, 22 bp, Homo sapiens
cagaaatgcctgcttctctctc

SEQ ID NO: 9050799 - DNA, 19 bp, Homo sapiens
cagaaatagcgaagtgtaa

SEQ ID NO: 9050800 - DNA, 22 bp, Homo sapiens
cagaaatagacaatggcagtgg

SEQ ID NO: 9050801 - DNA, 22 bp, Homo sapiens
cagaaatgtttatgcttttgaa

SEQ ID NO: 9050802 - DNA, 22 bp, Homo sapiens
cagaaatgtactgacatgcagt

SEQ ID NO: 9050803 - DNA, 22 bp, Homo sapiens
cagaaatgttctaatgattcag

SEQ ID NO: 9050804 - DNA, 22 bp, Homo sapiens
ggcttcttcctggctcctatta

SEQ ID NO: 9050805 - DNA, 20 bp, Homo sapiens
cactgaggtgcagctcatgc

SEQ ID NO: 9050806 - DNA, 22 bp, Homo sapiens
ggctccagtttgtgccttcagc

SEQ ID NO: 9050807 - DNA, 22 bp, Homo sapiens
ggctgcagcggattggggattg

SEQ ID NO: 9050808 - DNA, 22 bp, Homo sapiens
cactgtccaatagatacataat

SEQ ID NO: 9050809 - DNA, 22 bp, Homo sapiens
cactgtccctgtttcctggaaa

SEQ ID NO: 9050810 - DNA, 22 bp, Homo sapiens
cactgtccatgcttgctaaccc

SEQ ID NO: 9050811 - DNA, 22 bp, Homo sapiens
ggctgcagccctcgcctagcca

SEQ ID NO: 9050812 - DNA, 22 bp, Homo sapiens
ggctgcagcagagggactcacg

SEQ ID NO: 9050813 - DNA, 22 bp, Homo sapiens
ggctgctcaaggactctgatcg

SEQ ID NO: 9050814 - DNA, 18 bp, Homo sapiens
ggctgctcctctccctac

SEQ ID NO: 9050815 - DNA, 18 bp, Homo sapiens
ggctgctcctctccctac

SEQ ID NO: 9050816 - DNA, 22 bp, Homo sapiens
ggctgctcctttaccctggcag

SEQ ID NO: 9050817 - DNA, 18 bp, Homo sapiens
ggctgctcgctctccccg

SEQ ID NO: 9050818 - DNA, 22 bp, Homo sapiens
gagttatagatggactattatt

SEQ ID NO: 9050819 - DNA, 18 bp, Homo sapiens
gatcgggggcgccccaag

SEQ ID NO: 9050820 - DNA, 22 bp, Homo sapiens
atgtttccattttcttgtatca

SEQ ID NO: 9050821 - DNA, 22 bp, Homo sapiens
gagtccagttctttccagcagt

SEQ ID NO: 9050822 - DNA, 22 bp, Homo sapiens
gagtccagtagttaggacagag

SEQ ID NO: 9050823 - DNA, 22 bp, Homo sapiens
gagtccaggctgttgctcatct

SEQ ID NO: 9050824 - DNA, 23 bp, Homo sapiens
gagtgcagaatagacatgcagtg

SEQ ID NO: 9050825 - DNA, 22 bp, Homo sapiens
atgtttcaggcgaactaacatg

SEQ ID NO: 9050826 - DNA, 22 bp, Homo sapiens
atgtttattgttttaagctgct

SEQ ID NO: 9050827 - DNA, 22 bp, Homo sapiens
atgtttcaccagttttataaga

SEQ ID NO: 9050828 - DNA, 22 bp, Homo sapiens
gagggcacgaaacaaccacttc

SEQ ID NO: 9050829 - DNA, 22 bp, Homo sapiens
gagtccaggatttgagctctgt

SEQ ID NO: 9050830 - DNA, 22 bp, Homo sapiens
gagtccaggatttgagctctgt

SEQ ID NO: 9050831 - DNA, 18 bp, Homo sapiens
gagtccaggctcttcacc

SEQ ID NO: 9050832 - DNA, 22 bp, Homo sapiens
gaggggtcacatgggctggctt

SEQ ID NO: 9050833 - DNA, 22 bp, Homo sapiens
gaggtagcgagtggacagtgca

SEQ ID NO: 9050834 - DNA, 22 bp, Homo sapiens
gaggtagccacagatagagact

SEQ ID NO: 9050835 - DNA, 22 bp, Homo sapiens
gagggatgtgcctgaaggcagg

SEQ ID NO: 9050836 - DNA, 22 bp, Homo sapiens
gaggctgtgtgtccctctggac

SEQ ID NO: 9050837 - DNA, 22 bp, Homo sapiens
gaggccacagctatcagggaca

SEQ ID NO: 9050838 - DNA, 22 bp, Homo sapiens
gaggccacagtgtctgggggcc

SEQ ID NO: 9050839 - DNA, 22 bp, Homo sapiens
atgtcacatggcctgtactttg

SEQ ID NO: 9050840 - DNA, 22 bp, Homo sapiens
atgtcacatggtcacctctagc

SEQ ID NO: 9050841 - DNA, 22 bp, Homo sapiens
atgtcacagttgcaacatgaat

SEQ ID NO: 9050842 - DNA, 22 bp, Homo sapiens
gaggcattaaagggaatcttct

SEQ ID NO: 9050843 - DNA, 22 bp, Homo sapiens
atgtcaccagtttccaaatttg

SEQ ID NO: 9050844 - DNA, 22 bp, Homo sapiens
atgtcacattggagctgctgga

SEQ ID NO: 9050845 - DNA, 22 bp, Homo sapiens
atgtaacaaatggtatacatgt

SEQ ID NO: 9050846 - DNA, 22 bp, Homo sapiens
atgtaacaggtgaagctctgag

SEQ ID NO: 9050847 - DNA, 22 bp, Homo sapiens
atgtaacaggcacgggtggata

SEQ ID NO: 9050848 - DNA, 22 bp, Homo sapiens
atgtaacattgaattatatagt

SEQ ID NO: 9050849 - DNA, 22 bp, Homo sapiens
atgtaaggagccacagtggggg

SEQ ID NO: 9050850 - DNA, 22 bp, Homo sapiens
atgtaactgaaggaaatgcatg

SEQ ID NO: 9050851 - DNA, 22 bp, Homo sapiens
atgtaatttatgttatccataa

SEQ ID NO: 9050852 - DNA, 22 bp, Homo sapiens
atgtacaatctatcacaagaag

SEQ ID NO: 9050853 - DNA, 22 bp, Homo sapiens
atgtcacagtctgactcagtga

SEQ ID NO: 9050854 - DNA, 22 bp, Homo sapiens
atgtcacagtgttgctggaagt

SEQ ID NO: 9050855 - DNA, 22 bp, Homo sapiens
atgtcacagttgcaacatgaat

SEQ ID NO: 9050856 - DNA, 22 bp, Homo sapiens
atgtcacaggcaacaagattgc

SEQ ID NO: 9050857 - DNA, 22 bp, Homo sapiens
atgtcaacaggcctttaaacat

SEQ ID NO: 9050858 - DNA, 22 bp, Homo sapiens
atgtcaatttgttctctcgaag

SEQ ID NO: 9050859 - DNA, 22 bp, Homo sapiens
gagctttacttctgactggtgc

SEQ ID NO: 9050860 - DNA, 22 bp, Homo sapiens
gagctttaccttaggttctgtt

SEQ ID NO: 9050861 - DNA, 22 bp, Homo sapiens
gagctttagctgagacctgctt

SEQ ID NO: 9050862 - DNA, 22 bp, Homo sapiens
gagctttaggagaaggaggtca

SEQ ID NO: 9050863 - DNA, 22 bp, Homo sapiens
gagctttaagggataaaatgat

SEQ ID NO: 9050864 - DNA, 22 bp, Homo sapiens
gagctttaagggcactggtctt

SEQ ID NO: 9050865 - DNA, 22 bp, Homo sapiens
gagcggaggcttggaggccagc

SEQ ID NO: 9050866 - DNA, 22 bp, Homo sapiens
gagcctttgcacttgctgtgtt

SEQ ID NO: 9050867 - DNA, 22 bp, Homo sapiens
gagcctttctagataatccagg

SEQ ID NO: 9050868 - DNA, 22 bp, Homo sapiens
atgcttttggtctttggtccgg

SEQ ID NO: 9050869 - DNA, 22 bp, Homo sapiens
gagaggtggaggttgcagtgag

SEQ ID NO: 9050870 - DNA, 22 bp, Homo sapiens
gagcagctaaaattctcatgca

SEQ ID NO: 9050871 - DNA, 22 bp, Homo sapiens
gagcagctagataaagcccttc

SEQ ID NO: 9050872 - DNA, 22 bp, Homo sapiens
atgaatgattaaagagtacagt

SEQ ID NO: 9050873 - DNA, 22 bp, Homo sapiens
atgaatgagattaccaatgtga

SEQ ID NO: 9050874 - DNA, 19 bp, Homo sapiens
gaaaacatgggtgagggtc

SEQ ID NO: 9050875 - DNA, 22 bp, Homo sapiens
gaaaagagaacatctgaggatc

SEQ ID NO: 9050876 - DNA, 22 bp, Homo sapiens
gaaaactaacggaaaagttagg

SEQ ID NO: 9050877 - DNA, 22 bp, Homo sapiens
atgaatgaaatacagagtactt

SEQ ID NO: 9050878 - DNA, 22 bp, Homo sapiens
atgaagcagcgttgtagagtga

SEQ ID NO: 9050879 - DNA, 22 bp, Homo sapiens
atgaagcaggcacagcttcagg

SEQ ID NO: 9050880 - DNA, 22 bp, Homo sapiens
cttgagctgaagccagttgaaa

SEQ ID NO: 9050881 - DNA, 22 bp, Homo sapiens
cttgagctgaagccagttgaaa

SEQ ID NO: 9050882 - DNA, 22 bp, Homo sapiens
cttgagcttaggttcaggattg

SEQ ID NO: 9050883 - DNA, 23 bp, Homo sapiens
cttgagctcaggaagagctgagt

SEQ ID NO: 9050884 - DNA, 23 bp, Homo sapiens
cttgagctcaggaagagctgagt

SEQ ID NO: 9050885 - DNA, 22 bp, Homo sapiens
cttgagctctcagccactagct

SEQ ID NO: 9050886 - DNA, 22 bp, Homo sapiens
cttgagctctcagccactagct

SEQ ID NO: 9050887 - DNA, 18 bp, Homo sapiens
cttgagctaagggacccc

SEQ ID NO: 9050888 - DNA, 22 bp, Homo sapiens
cttgagctaggaaggctgaggc

SEQ ID NO: 9050889 - DNA, 22 bp, Homo sapiens
atcttccttcactttctcccac

SEQ ID NO: 9050890 - DNA, 22 bp, Homo sapiens
cttgagaagagatttatatttg

SEQ ID NO: 9050891 - DNA, 22 bp, Homo sapiens
cttgagaacagggttaggtaac

SEQ ID NO: 9050892 - DNA, 22 bp, Homo sapiens
cttgagaatcttgatgtctacc

SEQ ID NO: 9050893 - DNA, 22 bp, Homo sapiens
gaaatgaactgattatcattgc

SEQ ID NO: 9050894 - DNA, 19 bp, Homo sapiens
gaacaatttgttagctctc

SEQ ID NO: 9050895 - DNA, 22 bp, Homo sapiens
gaaatcttgctcattgtgacaa

SEQ ID NO: 9050896 - DNA, 22 bp, Homo sapiens
gaaatcttttcatctcatttga

SEQ ID NO: 9050897 - DNA, 22 bp, Homo sapiens
gaaatcttttaaccattcattt

SEQ ID NO: 9050898 - DNA, 22 bp, Homo sapiens
gaaatctttatggaaataacaa

SEQ ID NO: 9050899 - DNA, 22 bp, Homo sapiens
gaaatgaaacaggcttttaagg

SEQ ID NO: 9050900 - DNA, 22 bp, Homo sapiens
gaaatgaactgattatcattgc

SEQ ID NO: 9050901 - DNA, 22 bp, Homo sapiens
gaacattcacagactcaccatt

SEQ ID NO: 9050902 - DNA, 23 bp, Homo sapiens
gaacattcattggttgctttaga

SEQ ID NO: 9050903 - DNA, 22 bp, Homo sapiens
atgcacaagaggctagaaaaga

SEQ ID NO: 9050904 - DNA, 22 bp, Homo sapiens
atgcacaacagtggctgccttg

SEQ ID NO: 9050905 - DNA, 22 bp, Homo sapiens
atgcaataccttctgaaaataa

SEQ ID NO: 9050906 - DNA, 22 bp, Homo sapiens
atgcaagggtaaccccagacat

SEQ ID NO: 9050907 - DNA, 22 bp, Homo sapiens
atgcaaatgcagccattgcaga

SEQ ID NO: 9050908 - DNA, 22 bp, Homo sapiens
atgcaagattcagcaggaagat

SEQ ID NO: 9050909 - DNA, 23 bp, Homo sapiens
atgcaagagtttctcaaactgga

SEQ ID NO: 9050910 - DNA, 22 bp, Homo sapiens
gaagaaactgaaaggggttggt

SEQ ID NO: 9050911 - DNA, 22 bp, Homo sapiens
gaagaaacaggggcttggggag

SEQ ID NO: 9050912 - DNA, 22 bp, Homo sapiens
gaagaaacaggggcttggggag

SEQ ID NO: 9050913 - DNA, 22 bp, Homo sapiens
atgcaaatgaacatgttgctag

SEQ ID NO: 9050914 - DNA, 22 bp, Homo sapiens
atgcataagtgcagcagatttg

SEQ ID NO: 9050915 - DNA, 22 bp, Homo sapiens
atgcacaagaggctagaaaaga

SEQ ID NO: 9050916 - DNA, 22 bp, Homo sapiens
atgccacttcattccagcctcg

SEQ ID NO: 9050917 - DNA, 22 bp, Homo sapiens
atgccacttcattccagcctcg

SEQ ID NO: 9050918 - DNA, 22 bp, Homo sapiens
atgccctgctgctggggcagtg

SEQ ID NO: 9050919 - DNA, 22 bp, Homo sapiens
atgccctgctctcgggaaggga

SEQ ID NO: 9050920 - DNA, 22 bp, Homo sapiens
atgccctgcatcaagtgacact

SEQ ID NO: 9050921 - DNA, 20 bp, Homo sapiens
atgccctgtcctcttctgtt

SEQ ID NO: 9050922 - DNA, 22 bp, Homo sapiens
atgccctgtgactctcctggac

SEQ ID NO: 9050923 - DNA, 22 bp, Homo sapiens
atgccctgggagtgctgtacca

SEQ ID NO: 9050924 - DNA, 22 bp, Homo sapiens
atgccctggggctacctctgag

SEQ ID NO: 9050925 - DNA, 23 bp, Homo sapiens
atgccctgtagaggctgctgacc

SEQ ID NO: 9050926 - DNA, 22 bp, Homo sapiens
atgccctgtggttcatgtgaga

SEQ ID NO: 9050927 - DNA, 20 bp, Homo sapiens
atgcctctaattttgcaaac

SEQ ID NO: 9050928 - DNA, 22 bp, Homo sapiens
atgctttagtgtcaagtttggg

SEQ ID NO: 9050929 - DNA, 22 bp, Homo sapiens
gacagggaggagcagagcttct

SEQ ID NO: 9050930 - DNA, 22 bp, Homo sapiens
atgcttttatgtcacatggtca

SEQ ID NO: 9050931 - DNA, 22 bp, Homo sapiens
atgcttttcctaaaatgatgcc

SEQ ID NO: 9050932 - DNA, 22 bp, Homo sapiens
gactttcttgcagaaatattcc

SEQ ID NO: 9050933 - DNA, 21 bp, Homo sapiens
gactttcttaccagatttttg

SEQ ID NO: 9050934 - DNA, 22 bp, Homo sapiens
gacccggctccaggcccagcag

SEQ ID NO: 9050935 - DNA, 22 bp, Homo sapiens
gcaaaaagtagtgctggttagg

SEQ ID NO: 9050936 - DNA, 22 bp, Homo sapiens
gcaaaatgatcttcttcaggct

SEQ ID NO: 9050937 - DNA, 22 bp, Homo sapiens
atgtttctacagcgtccactga

SEQ ID NO: 9050938 - DNA, 22 bp, Homo sapiens
gcaaaaaatgcttgttgcttag

SEQ ID NO: 9050939 - DNA, 22 bp, Homo sapiens
gcaacacagatcttctttgttg

SEQ ID NO: 9050940 - DNA, 22 bp, Homo sapiens
gcaacattcatgttctgtaacc

SEQ ID NO: 9050941 - DNA, 22 bp, Homo sapiens
gcaacattaaaccaataattgt

SEQ ID NO: 9050942 - DNA, 20 bp, Homo sapiens
gcaactcacccacagcagct

SEQ ID NO: 9050943 - DNA, 22 bp, Homo sapiens
gcaactgaacatgtgtgtggcc

SEQ ID NO: 9050944 - DNA, 22 bp, Homo sapiens
gcagaaggtcaaagcaagatgt

SEQ ID NO: 9050945 - DNA, 22 bp, Homo sapiens
gcagaagtggtgctgtgccact

SEQ ID NO: 9050946 - DNA, 22 bp, Homo sapiens
gcagatgaagtttacaggaaac

SEQ ID NO: 9050947 - DNA, 20 bp, Homo sapiens
gcagatgagactcacagagg

SEQ ID NO: 9050948 - DNA, 22 bp, Homo sapiens
gcagagtttgaagtcaagatgt

SEQ ID NO: 9050949 - DNA, 22 bp, Homo sapiens
gcagagtttctggcacattgga

SEQ ID NO: 9050950 - DNA, 22 bp, Homo sapiens
gcagccagggttaattatattt

SEQ ID NO: 9050951 - DNA, 22 bp, Homo sapiens
gcagcaggtccgcatcatcatc

SEQ ID NO: 9050952 - DNA, 22 bp, Homo sapiens
gcagatgatgtagacagacagt

SEQ ID NO: 9050953 - DNA, 19 bp, Homo sapiens
gcagatgatgaggctggtc

SEQ ID NO: 9050954 - DNA, 22 bp, Homo sapiens
gcagatgcagaactcagtgggt

SEQ ID NO: 9050955 - DNA, 22 bp, Homo sapiens
gccacagtcactgctgcagggg

SEQ ID NO: 9050956 - DNA, 22 bp, Homo sapiens
gccactgattccaagtcaattt

SEQ ID NO: 9050957 - DNA, 22 bp, Homo sapiens
gccactcaaatccagctttaga

SEQ ID NO: 9050958 - DNA, 22 bp, Homo sapiens
gccacagtgggctggggccaga

SEQ ID NO: 9050959 - DNA, 22 bp, Homo sapiens
gccacagtcaggacggggagag

SEQ ID NO: 9050960 - DNA, 22 bp, Homo sapiens
gccactcacatgtaccagatgc

SEQ ID NO: 9050961 - DNA, 22 bp, Homo sapiens
gccactcatgggaggtgtgcaa

SEQ ID NO: 9050962 - DNA, 22 bp, Homo sapiens
attgttttccaaagatgctgct

SEQ ID NO: 9050963 - DNA, 22 bp, Homo sapiens
attgtttacactaacttcataa

SEQ ID NO: 9050964 - DNA, 22 bp, Homo sapiens
attgttatgaaaataagatgtt

SEQ ID NO: 9050965 - DNA, 22 bp, Homo sapiens
attgttctaagggtttaattaa

SEQ ID NO: 9050966 - DNA, 22 bp, Homo sapiens
gcagggactttggcaacaggtg

SEQ ID NO: 9050967 - DNA, 22 bp, Homo sapiens
gcagggactgtgatctcacaga

SEQ ID NO: 9050968 - DNA, 22 bp, Homo sapiens
gcagggagggcctttcatgaca

SEQ ID NO: 9050969 - DNA, 22 bp, Homo sapiens
gcagggaggaagagatgcttcc

SEQ ID NO: 9050970 - DNA, 22 bp, Homo sapiens
gcaggatgggtgtagcccagca

SEQ ID NO: 9050971 - DNA, 22 bp, Homo sapiens
gcaggatggtggaaggcctgct

SEQ ID NO: 9050972 - DNA, 22 bp, Homo sapiens
gcaggatgaaggcagaggctga

SEQ ID NO: 9050973 - DNA, 22 bp, Homo sapiens
gcagggaggtttgctgacctgg

SEQ ID NO: 9050974 - DNA, 22 bp, Homo sapiens
gcaggggttttctgacttgagt

SEQ ID NO: 9050975 - DNA, 22 bp, Homo sapiens
gcaggtggatcaccacgtcagg

SEQ ID NO: 9050976 - DNA, 22 bp, Homo sapiens
attggttagaagtagtatgact

SEQ ID NO: 9050977 - DNA, 22 bp, Homo sapiens
attgtaaaagtattctaagatt

SEQ ID NO: 9050978 - DNA, 19 bp, Homo sapiens
gccctcctcactgagctct

SEQ ID NO: 9050979 - DNA, 22 bp, Homo sapiens
atttacagtgtgcctactatat

SEQ ID NO: 9050980 - DNA, 22 bp, Homo sapiens
gccagaggggctcgaaggcgcg

SEQ ID NO: 9050981 - DNA, 18 bp, Homo sapiens
gccagaggtactactgat

SEQ ID NO: 9050982 - DNA, 22 bp, Homo sapiens
gcccagccacagtcactttcat

SEQ ID NO: 9050983 - DNA, 22 bp, Homo sapiens
atttgcatgacctttgcaagtg

SEQ ID NO: 9050984 - DNA, 22 bp, Homo sapiens
gcctgccatgagctaatgacac

SEQ ID NO: 9050985 - DNA, 22 bp, Homo sapiens
gcctggctccctctgcagctcc

SEQ ID NO: 9050986 - DNA, 22 bp, Homo sapiens
attttgaaaagcatttgagtaa

SEQ ID NO: 9050987 - DNA, 22 bp, Homo sapiens
attttgaaatacttgaaggaaa

SEQ ID NO: 9050988 - DNA, 22 bp, Homo sapiens
attttgaaaagcatttgagtaa

SEQ ID NO: 9050989 - DNA, 22 bp, Homo sapiens
gcctggctcctaaggactggct

SEQ ID NO: 9050990 - DNA, 22 bp, Homo sapiens
gctaagaggctatatctttctc

SEQ ID NO: 9050991 - DNA, 22 bp, Homo sapiens
gctacacaatagcgttcactta

SEQ ID NO: 9050992 - DNA, 22 bp, Homo sapiens
gctatttattaaaatagtgaag

SEQ ID NO: 9050993 - DNA, 22 bp, Homo sapiens
gctattcatggagcatgtactg

SEQ ID NO: 9050994 - DNA, 22 bp, Homo sapiens
gctatttattaaaatggtgaag

SEQ ID NO: 9050995 - DNA, 22 bp, Homo sapiens
gctccaggcgagctggaccaga

SEQ ID NO: 9050996 - DNA, 17 bp, Homo sapiens
gctccaggcgtgagtga

SEQ ID NO: 9050997 - DNA, 22 bp, Homo sapiens
gctccaggccccagcgttccgc

SEQ ID NO: 9050998 - DNA, 22 bp, Homo sapiens
gctccaggccccagcgttccgc

SEQ ID NO: 9050999 - DNA, 22 bp, Homo sapiens
gctccaggccacggcttcttgg

SEQ ID NO: 9051000 - DNA, 22 bp, Homo sapiens
gctccaggcagcatagtggatg

SEQ ID NO: 9051001 - DNA, 22 bp, Homo sapiens
gctcagtgaaacatcaaatagt

SEQ ID NO: 9051002 - DNA, 22 bp, Homo sapiens
gctcagtctttgtggggtacgg

SEQ ID NO: 9051003 - DNA, 22 bp, Homo sapiens
gctccagggaacagaatgtact

SEQ ID NO: 9051004 - DNA, 22 bp, Homo sapiens
gctccaggctgctctgtcccat

SEQ ID NO: 9051005 - DNA, 22 bp, Homo sapiens
gctcgcagatcacctgggggcg

SEQ ID NO: 9051006 - DNA, 22 bp, Homo sapiens
gctctatgaacctgaatctcac

SEQ ID NO: 9051007 - DNA, 22 bp, Homo sapiens
gctctatgaatcacacgagggt

SEQ ID NO: 9051008 - DNA, 22 bp, Homo sapiens
caaatgaatttccctgcaaatg

SEQ ID NO: 9051009 - DNA, 22 bp, Homo sapiens
caaatgaatatttccatgggtt

SEQ ID NO: 9051010 - DNA, 22 bp, Homo sapiens
caaatgaagaaccttctcacct

SEQ ID NO: 9051011 - DNA, 22 bp, Homo sapiens
gctgaggaggtgtggttaggtg

SEQ ID NO: 9051012 - DNA, 22 bp, Homo sapiens
gctgaggagcgagaactctgct

SEQ ID NO: 9051013 - DNA, 22 bp, Homo sapiens
caaatgaagagggcaacttctg

SEQ ID NO: 9051014 - DNA, 22 bp, Homo sapiens
caaatgaagggagctgaagtct

SEQ ID NO: 9051015 - DNA, 22 bp, Homo sapiens
caaatgaagtccaaagggctta

SEQ ID NO: 9051016 - DNA, 22 bp, Homo sapiens
caaatgaatagggagtgtgatg

SEQ ID NO: 9051017 - DNA, 22 bp, Homo sapiens
caaatgaagtccaaagggctta

SEQ ID NO: 9051018 - DNA, 22 bp, Homo sapiens
gctgaggacatcatggaaggaa

SEQ ID NO: 9051019 - DNA, 20 bp, Homo sapiens
gctgaggagcagtgtggttg

SEQ ID NO: 9051020 - DNA, 22 bp, Homo sapiens
gctgaggacatacacattgtgc

SEQ ID NO: 9051021 - DNA, 22 bp, Homo sapiens
gctgaggaagtcaggtggccca

SEQ ID NO: 9051022 - DNA, 22 bp, Homo sapiens
gctgaggaaaggctggaaggga

SEQ ID NO: 9051023 - DNA, 22 bp, Homo sapiens
gctgaggaaggtttcttatcaa

SEQ ID NO: 9051024 - DNA, 22 bp, Homo sapiens
gctgaggaaaccaatgctcaga

SEQ ID NO: 9051025 - DNA, 22 bp, Homo sapiens
caaatagacttaagcatctgta

SEQ ID NO: 9051026 - DNA, 22 bp, Homo sapiens
caaatctccttaaaggtaaaat

SEQ ID NO: 9051027 - DNA, 22 bp, Homo sapiens
gctctgggtgaacttggagcaa

SEQ ID NO: 9051028 - DNA, 22 bp, Homo sapiens
agtgtgggcccccaggttagcc

SEQ ID NO: 9051029 - DNA, 17 bp, Homo sapiens
agtgtttccttatcatt

SEQ ID NO: 9051030 - DNA, 22 bp, Homo sapiens
agtgtttctaagtagatgtgaa

SEQ ID NO: 9051031 - DNA, 20 bp, Homo sapiens
agtgtttctcaacatggggc

SEQ ID NO: 9051032 - DNA, 22 bp, Homo sapiens
agtgtttcctgagtgttatcat

SEQ ID NO: 9051033 - DNA, 22 bp, Homo sapiens
agtgtttcaccgtatgttctca

SEQ ID NO: 9051034 - DNA, 22 bp, Homo sapiens
agtgtttctggaatcagtgttt

SEQ ID NO: 9051035 - DNA, 22 bp, Homo sapiens
agtgtttgggggccttgtaaca

SEQ ID NO: 9051036 - DNA, 22 bp, Homo sapiens
agtgtttggggtgattgtaacc

SEQ ID NO: 9051037 - DNA, 22 bp, Homo sapiens
agtgtttgggggccttgtaaca

SEQ ID NO: 9051038 - DNA, 22 bp, Homo sapiens
agtgtttgcatctcattgattt

SEQ ID NO: 9051039 - DNA, 22 bp, Homo sapiens
agttatttcagtaacataatag

SEQ ID NO: 9051040 - DNA, 22 bp, Homo sapiens
ctgagctgctcccgctgcagcg

SEQ ID NO: 9051041 - DNA, 20 bp, Homo sapiens
ctgagctgagctccatgggt

SEQ ID NO: 9051042 - DNA, 22 bp, Homo sapiens
agttcatgtggtttaacttaat

SEQ ID NO: 9051043 - DNA, 22 bp, Homo sapiens
ctgagctcagtcccagctctac

SEQ ID NO: 9051044 - DNA, 22 bp, Homo sapiens
agtgtctttgtctctcaagcac

SEQ ID NO: 9051045 - DNA, 22 bp, Homo sapiens
agtgtctttctctctccaagtg

SEQ ID NO: 9051046 - DNA, 22 bp, Homo sapiens
agtgtctttgacacattcaaag

SEQ ID NO: 9051047 - DNA, 22 bp, Homo sapiens
agtgtgagatgattgaggagca

SEQ ID NO: 9051048 - DNA, 22 bp, Homo sapiens
agtgtgagaacggactaataaa

SEQ ID NO: 9051049 - DNA, 22 bp, Homo sapiens
agtgtctttgtcaaattacagg

SEQ ID NO: 9051050 - DNA, 22 bp, Homo sapiens
agtgggtggcgcagaggaggaa

SEQ ID NO: 9051051 - DNA, 22 bp, Homo sapiens
agtgggtgtagtcttcctcctg

SEQ ID NO: 9051052 - DNA, 22 bp, Homo sapiens
ctctggagttctcatgaggaac

SEQ ID NO: 9051053 - DNA, 21 bp, Homo sapiens
ctctggagtttgaaggctggg

SEQ ID NO: 9051054 - DNA, 22 bp, Homo sapiens
ctctggagttagtgatctgggc

SEQ ID NO: 9051055 - DNA, 21 bp, Homo sapiens
agtggggtctctgtggaggcc

SEQ ID NO: 9051056 - DNA, 22 bp, Homo sapiens
agtgaggggattcaggcaaggt

SEQ ID NO: 9051057 - DNA, 22 bp, Homo sapiens
agtgagggactagtgctgggga

SEQ ID NO: 9051058 - DNA, 22 bp, Homo sapiens
agtgaggggcagctgagtgggc

SEQ ID NO: 9051059 - DNA, 22 bp, Homo sapiens
agtgaggtcaggatctcaggga

SEQ ID NO: 9051060 - DNA, 22 bp, Homo sapiens
agtgaggtcatactggagaggg

SEQ ID NO: 9051061 - DNA, 22 bp, Homo sapiens
agtgaaaacctaatcatgcagt

SEQ ID NO: 9051062 - DNA, 22 bp, Homo sapiens
agtgaaaacctaatcatgcagt

SEQ ID NO: 9051063 - DNA, 22 bp, Homo sapiens
agtgaaatagcatttatgaagc

SEQ ID NO: 9051064 - DNA, 22 bp, Homo sapiens
agtctttatctcgctcctggat

SEQ ID NO: 9051065 - DNA, 18 bp, Homo sapiens
agtcttctgatccatttt

SEQ ID NO: 9051066 - DNA, 23 bp, Homo sapiens
ctcaccaagcgccgccgctgtgt

SEQ ID NO: 9051067 - DNA, 22 bp, Homo sapiens
ctcacagttggctcattaatga

SEQ ID NO: 9051068 - DNA, 22 bp, Homo sapiens
ctcacatgagatctgtacatcc

SEQ ID NO: 9051069 - DNA, 22 bp, Homo sapiens
ctcacagtgatgtcttatgaca

SEQ ID NO: 9051070 - DNA, 22 bp, Homo sapiens
agtctcagaaaagaagcatgga

SEQ ID NO: 9051071 - DNA, 22 bp, Homo sapiens
agtctagtaggatctctgggct

SEQ ID NO: 9051072 - DNA, 22 bp, Homo sapiens
agtcctgggtctggagaatgga

SEQ ID NO: 9051073 - DNA, 22 bp, Homo sapiens
agtgcttttgtcattgaatctt

SEQ ID NO: 9051074 - DNA, 22 bp, Homo sapiens
agtggaggttacagctgtacat

SEQ ID NO: 9051075 - DNA, 22 bp, Homo sapiens
agtgccctcgtgcccagggcct

SEQ ID NO: 9051076 - DNA, 22 bp, Homo sapiens
agtgcctggcacatggaaggtg

SEQ ID NO: 9051077 - DNA, 22 bp, Homo sapiens
agtgcatttggggtagtggaag

SEQ ID NO: 9051078 - DNA, 22 bp, Homo sapiens
aggtaatgcaactactttgcta

SEQ ID NO: 9051079 - DNA, 18 bp, Homo sapiens
aggtcaggaaagcagagt

SEQ ID NO: 9051080 - DNA, 22 bp, Homo sapiens
aggtcagacagggtgtctttct

SEQ ID NO: 9051081 - DNA, 22 bp, Homo sapiens
aggtggcagagctggcccagcg

SEQ ID NO: 9051082 - DNA, 22 bp, Homo sapiens
aggtggcagcagaatcagggag

SEQ ID NO: 9051083 - DNA, 22 bp, Homo sapiens
cctgggggccaggaaggtgtga

SEQ ID NO: 9051084 - DNA, 22 bp, Homo sapiens
ctattctagtctgtcatgtcca

SEQ ID NO: 9051085 - DNA, 22 bp, Homo sapiens
ctatgaaatgtcagattctgca

SEQ ID NO: 9051086 - DNA, 22 bp, Homo sapiens
ctatgaccccagcatgaataag

SEQ ID NO: 9051087 - DNA, 22 bp, Homo sapiens
ctattccattccatagtagaaa

SEQ ID NO: 9051088 - DNA, 22 bp, Homo sapiens
ctatttacgctgctggggatca

SEQ ID NO: 9051089 - DNA, 22 bp, Homo sapiens
ctatattctggaatgtccattt

SEQ ID NO: 9051090 - DNA, 22 bp, Homo sapiens
ctaggaaagacacagagagttt

SEQ ID NO: 9051091 - DNA, 22 bp, Homo sapiens
ctaggaaatgaatacagtacac

SEQ ID NO: 9051092 - DNA, 21 bp, Homo sapiens
ccttctccattacagtaagct

SEQ ID NO: 9051093 - DNA, 22 bp, Homo sapiens
ccttccagtgactaaggaggaa

SEQ ID NO: 9051094 - DNA, 22 bp, Homo sapiens
ccttctccctctgagaggaacc

SEQ ID NO: 9051095 - DNA, 22 bp, Homo sapiens
ccttctcctgccttgggttcat

SEQ ID NO: 9051096 - DNA, 22 bp, Homo sapiens
agtaaacagtaggaactgagaa

SEQ ID NO: 9051097 - DNA, 22 bp, Homo sapiens
agtaaataacagagaaaatggg

SEQ ID NO: 9051098 - DNA, 22 bp, Homo sapiens
agtaaataacagagaaaatggg

SEQ ID NO: 9051099 - DNA, 22 bp, Homo sapiens
agtaaagcagagttgcagtaca

SEQ ID NO: 9051100 - DNA, 22 bp, Homo sapiens
agtagaaatgtagtgtagagaa

SEQ ID NO: 9051101 - DNA, 22 bp, Homo sapiens
agtagattttagattacatagt

SEQ ID NO: 9051102 - DNA, 22 bp, Homo sapiens
agtaacaaatagctgcctttaa

SEQ ID NO: 9051103 - DNA, 22 bp, Homo sapiens
agtaacaaatgcatctgggcat

SEQ ID NO: 9051104 - DNA, 22 bp, Homo sapiens
agtaacaagtgccaacgttaga

SEQ ID NO: 9051105 - DNA, 22 bp, Homo sapiens
agtagaaatgtaagaaggatta

SEQ ID NO: 9051106 - DNA, 22 bp, Homo sapiens
agtagaaagttgcaggaggaat

SEQ ID NO: 9051107 - DNA, 22 bp, Homo sapiens
agtagcttggccctttgttctt

SEQ ID NO: 9051108 - DNA, 22 bp, Homo sapiens
agtcaaggctattatgtgggaa

SEQ ID NO: 9051109 - DNA, 22 bp, Homo sapiens
agtatttctgctcatgaaagag

SEQ ID NO: 9051110 - DNA, 18 bp, Homo sapiens
agtatttctgcatgtctt

SEQ ID NO: 9051111 - DNA, 22 bp, Homo sapiens
agtatttctgaatattatcata

SEQ ID NO: 9051112 - DNA, 22 bp, Homo sapiens
agtatttctagttggttctact

SEQ ID NO: 9051113 - DNA, 22 bp, Homo sapiens
ataaacctatgctaagctgtgg

SEQ ID NO: 9051114 - DNA, 22 bp, Homo sapiens
ataaaccagaagtaaaagctac

SEQ ID NO: 9051115 - DNA, 22 bp, Homo sapiens
ataaactgaagggaacactgag

SEQ ID NO: 9051116 - DNA, 22 bp, Homo sapiens
ctgcagggagaggggacagcct

SEQ ID NO: 9051117 - DNA, 22 bp, Homo sapiens
ctgcagggaccacaagcaggtt

SEQ ID NO: 9051118 - DNA, 22 bp, Homo sapiens
ctgcagggaccacaagcaggtt

SEQ ID NO: 9051119 - DNA, 22 bp, Homo sapiens
ctgcagggacccaagtctttgg

SEQ ID NO: 9051120 - DNA, 22 bp, Homo sapiens
ctgcagggaactgaggcccaga

SEQ ID NO: 9051121 - DNA, 22 bp, Homo sapiens
ctgcaggctgagcgcctgccgg

SEQ ID NO: 9051122 - DNA, 22 bp, Homo sapiens
ataaagaggatgtatttacagc

SEQ ID NO: 9051123 - DNA, 22 bp, Homo sapiens
ataaagaggatgtatttacagc

SEQ ID NO: 9051124 - DNA, 22 bp, Homo sapiens
ataaactgggtatcaagaggcc

SEQ ID NO: 9051125 - DNA, 22 bp, Homo sapiens
ataaagcaaataggactattgc

SEQ ID NO: 9051126 - DNA, 22 bp, Homo sapiens
ataaagctaagacttacatgaa

SEQ ID NO: 9051127 - DNA, 22 bp, Homo sapiens
ataaagcatctagtctgtcact

SEQ ID NO: 9051128 - DNA, 22 bp, Homo sapiens
ataaagcatgcttgtttggaga

SEQ ID NO: 9051129 - DNA, 22 bp, Homo sapiens
ataaagcatactttgtatgact

SEQ ID NO: 9051130 - DNA, 22 bp, Homo sapiens
ataaaaatgagggcggtagcta

SEQ ID NO: 9051131 - DNA, 22 bp, Homo sapiens
ataaaaatgagggcggtagcta

SEQ ID NO: 9051132 - DNA, 22 bp, Homo sapiens
ataaaacttattagaattgtgt

SEQ ID NO: 9051133 - DNA, 22 bp, Homo sapiens
ataaaacttgggtatgatccct

SEQ ID NO: 9051134 - DNA, 22 bp, Homo sapiens
ataaaacttattagaattgtgt

SEQ ID NO: 9051135 - DNA, 22 bp, Homo sapiens
agttctggcggctgtcggcact

SEQ ID NO: 9051136 - DNA, 22 bp, Homo sapiens
agttctggtggtttggagatct

SEQ ID NO: 9051137 - DNA, 22 bp, Homo sapiens
agttctctggctcctttccaga

SEQ ID NO: 9051138 - DNA, 22 bp, Homo sapiens
agttctctttagctcatatggt

SEQ ID NO: 9051139 - DNA, 22 bp, Homo sapiens
agttctctttagctcatatggt

SEQ ID NO: 9051140 - DNA, 22 bp, Homo sapiens
ataaaggaaattccatgtctaa

SEQ ID NO: 9051141 - DNA, 22 bp, Homo sapiens
ataaagctatttttaattctgt

SEQ ID NO: 9051142 - DNA, 22 bp, Homo sapiens
ctgcctggtgcggtgcccaccc

SEQ ID NO: 9051143 - DNA, 22 bp, Homo sapiens
ctgctatgtatattttatgaga

SEQ ID NO: 9051144 - DNA, 22 bp, Homo sapiens
atacacatatgtgtgtatatgt

SEQ ID NO: 9051145 - DNA, 22 bp, Homo sapiens
atacacatgcacacatgtgtgt

SEQ ID NO: 9051146 - DNA, 22 bp, Homo sapiens
atacacatgcacacatgtgtgt

SEQ ID NO: 9051147 - DNA, 19 bp, Homo sapiens
atacacatacgtaaactga

SEQ ID NO: 9051148 - DNA, 19 bp, Homo sapiens
atacacatacgtaaactga

SEQ ID NO: 9051149 - DNA, 22 bp, Homo sapiens
atacacatatatacacgtttaa

SEQ ID NO: 9051150 - DNA, 22 bp, Homo sapiens
atacacatatcaggtgtataca

SEQ ID NO: 9051151 - DNA, 21 bp, Homo sapiens
atacacatacacataaatgtg

SEQ ID NO: 9051152 - DNA, 22 bp, Homo sapiens
ctggcctcacctcagacttact

SEQ ID NO: 9051153 - DNA, 22 bp, Homo sapiens
ctggcctcagagggtcatggtg

SEQ ID NO: 9051154 - DNA, 22 bp, Homo sapiens
ctggcaggtggatggggactcc

SEQ ID NO: 9051155 - DNA, 22 bp, Homo sapiens
ctggcaggtggaggttgcagtg

SEQ ID NO: 9051156 - DNA, 22 bp, Homo sapiens
ctggccactggaggtggcaccc

SEQ ID NO: 9051157 - DNA, 22 bp, Homo sapiens
atacacatgtgtatgtgcatgc

SEQ ID NO: 9051158 - DNA, 20 bp, Homo sapiens
atacacatgcagacagatgc

SEQ ID NO: 9051159 - DNA, 20 bp, Homo sapiens
atacacatgcagacagatgc

SEQ ID NO: 9051160 - DNA, 22 bp, Homo sapiens
atacacattactttctgtctga

SEQ ID NO: 9051161 - DNA, 22 bp, Homo sapiens
atacatgtcatcatatgtttgt

SEQ ID NO: 9051162 - DNA, 17 bp, Homo sapiens
atacatgtaaagtgctt

SEQ ID NO: 9051163 - DNA, 22 bp, Homo sapiens
atacatgatgggtgtatagttt

SEQ ID NO: 9051164 - DNA, 22 bp, Homo sapiens
atacatgatcactgtattataa

SEQ ID NO: 9051165 - DNA, 22 bp, Homo sapiens
atataccctgttcgagtcccag

SEQ ID NO: 9051166 - DNA, 22 bp, Homo sapiens
atatacaggtggtatgtgtaaa

SEQ ID NO: 9051167 - DNA, 22 bp, Homo sapiens
atatacagggagaaacagctta

SEQ ID NO: 9051168 - DNA, 22 bp, Homo sapiens
atatacactcaccatggtattt

SEQ ID NO: 9051169 - DNA, 19 bp, Homo sapiens
ctggctgcaatgccagggt

SEQ ID NO: 9051170 - DNA, 22 bp, Homo sapiens
ctggctgaggcagagcctgggg

SEQ ID NO: 9051171 - DNA, 19 bp, Homo sapiens
ctggcctgtgtcctgtgct

SEQ ID NO: 9051172 - DNA, 22 bp, Homo sapiens
ctggctcacaggtgagatgcat

SEQ ID NO: 9051173 - DNA, 22 bp, Homo sapiens
atagtttgaaggctgttctact

SEQ ID NO: 9051174 - DNA, 22 bp, Homo sapiens
ctggctcaatttgtactgctgt

SEQ ID NO: 9051175 - DNA, 22 bp, Homo sapiens
ctggctcaataaatattagctg

SEQ ID NO: 9051176 - DNA, 22 bp, Homo sapiens
atagttttctatgcactgttat

SEQ ID NO: 9051177 - DNA, 23 bp, Homo sapiens
atataaacaccagatagattgta

SEQ ID NO: 9051178 - DNA, 22 bp, Homo sapiens
atataaagagcttagtatagtg

SEQ ID NO: 9051179 - DNA, 22 bp, Homo sapiens
cttcaaatgtgattttaataac

SEQ ID NO: 9051180 - DNA, 22 bp, Homo sapiens
cttattcagaaggagaaatgga

SEQ ID NO: 9051181 - DNA, 22 bp, Homo sapiens
cttattaatggaatcctaatga

SEQ ID NO: 9051182 - DNA, 22 bp, Homo sapiens
cttattatggcatgtaagtggg

SEQ ID NO: 9051183 - DNA, 22 bp, Homo sapiens
cttattataaaatcctgtttga

SEQ ID NO: 9051184 - DNA, 22 bp, Homo sapiens
cttattcaatgctggaaatgtt

SEQ ID NO: 9051185 - DNA, 22 bp, Homo sapiens
cttcacaaaatatttcattata

SEQ ID NO: 9051186 - DNA, 22 bp, Homo sapiens
cttcacaaagctctctttatgt

SEQ ID NO: 9051187 - DNA, 22 bp, Homo sapiens
cttcacaaagctctctttatgt

SEQ ID NO: 9051188 - DNA, 22 bp, Homo sapiens
cttcacaaatggcctagagttc

SEQ ID NO: 9051189 - DNA, 22 bp, Homo sapiens
cttcacaaatggcctagagttc

SEQ ID NO: 9051190 - DNA, 22 bp, Homo sapiens
cttcacaaatggcctagagttc

SEQ ID NO: 9051191 - DNA, 21 bp, Homo sapiens
cttcaattcaacactgccatg

SEQ ID NO: 9051192 - DNA, 22 bp, Homo sapiens
cttcaattgccaccagctagca

SEQ ID NO: 9051193 - DNA, 22 bp, Homo sapiens
cttcaatttaaatggaagccac

SEQ ID NO: 9051194 - DNA, 22 bp, Homo sapiens
cttcacaaaatatttcattata

SEQ ID NO: 9051195 - DNA, 22 bp, Homo sapiens
cttcaatttttggtatgatgga

SEQ ID NO: 9051196 - DNA, 22 bp, Homo sapiens
cttccttgcggcccctgcctag

SEQ ID NO: 9051197 - DNA, 22 bp, Homo sapiens
cttccttgctgtctgctccagg

SEQ ID NO: 9051198 - DNA, 19 bp, Homo sapiens
cttccttgctccccatgtg

SEQ ID NO: 9051199 - DNA, 22 bp, Homo sapiens
cttccttctgaagcatagaagc

SEQ ID NO: 9051200 - DNA, 22 bp, Homo sapiens
cttcctctatgttcaggtagaa

SEQ ID NO: 9051201 - DNA, 22 bp, Homo sapiens
cttagcaagcattcaagtgcct

SEQ ID NO: 9051202 - DNA, 22 bp, Homo sapiens
cttagcaagaatcagctgctgg

SEQ ID NO: 9051203 - DNA, 22 bp, Homo sapiens
cttagatgaagtcacagaaccc

SEQ ID NO: 9051204 - DNA, 22 bp, Homo sapiens
cttagatgaagtcacagaaccc

SEQ ID NO: 9051205 - DNA, 22 bp, Homo sapiens
atccatgattagtaggataaag

SEQ ID NO: 9051206 - DNA, 23 bp, Homo sapiens
atccatgtgagaatagactagca

SEQ ID NO: 9051207 - DNA, 21 bp, Homo sapiens
atccattctccggttaatgag

SEQ ID NO: 9051208 - DNA, 22 bp, Homo sapiens
atccattctatgtgaaatgtcc

SEQ ID NO: 9051209 - DNA, 22 bp, Homo sapiens
cttaataataggtgaggctatg

SEQ ID NO: 9051210 - DNA, 20 bp, Homo sapiens
atccatgagagtctggattc

SEQ ID NO: 9051211 - DNA, 22 bp, Homo sapiens
atccatcttgatgtaatagcca

SEQ ID NO: 9051212 - DNA, 22 bp, Homo sapiens
atccatcccatcttcaccaggg

SEQ ID NO: 9051213 - DNA, 22 bp, Homo sapiens
cttaagagtctttctgtgttta

SEQ ID NO: 9051214 - DNA, 22 bp, Homo sapiens
cttaagaagcaagtctcagcaa

SEQ ID NO: 9051215 - DNA, 22 bp, Homo sapiens
cttaaggaaaagtctcttttaa

SEQ ID NO: 9051216 - DNA, 22 bp, Homo sapiens
cttaacatggggggtaagtctg

SEQ ID NO: 9051217 - DNA, 22 bp, Homo sapiens
cttaacatcctgcatttttctt

SEQ ID NO: 9051218 - DNA, 21 bp, Homo sapiens
cttaacattttaaatgaaagg

SEQ ID NO: 9051219 - DNA, 22 bp, Homo sapiens
cttaactctacactgcacttta

SEQ ID NO: 9051220 - DNA, 22 bp, Homo sapiens
atcatacagcctttgttagtgt

SEQ ID NO: 9051221 - DNA, 22 bp, Homo sapiens
atcatagaacacctacctacct

SEQ ID NO: 9051222 - DNA, 19 bp, Homo sapiens
atcatcactcatggtcctg

SEQ ID NO: 9051223 - DNA, 23 bp, Homo sapiens
atcataggccctagagagaaggc

SEQ ID NO: 9051224 - DNA, 22 bp, Homo sapiens
cttaacaagcccaactttcatt

SEQ ID NO: 9051225 - DNA, 22 bp, Homo sapiens
cttctccttatatgtcccgttc

SEQ ID NO: 9051226 - DNA, 21 bp, Homo sapiens
atctcgggcttctcgcccagc

SEQ ID NO: 9051227 - DNA, 22 bp, Homo sapiens
cttccttgtggtccttctcatt

SEQ ID NO: 9051228 - DNA, 22 bp, Homo sapiens
cttccttggcttctggggtgtg

SEQ ID NO: 9051229 - DNA, 19 bp, Homo sapiens
cttctgatggaaagccaac

SEQ ID NO: 9051230 - DNA, 22 bp, Homo sapiens
atcttatttaacacagcaaaac

SEQ ID NO: 9051231 - DNA, 22 bp, Homo sapiens
atctgttcccctatgctctcta

SEQ ID NO: 9051232 - DNA, 22 bp, Homo sapiens
atctgtcttgccttgcatattt

SEQ ID NO: 9051233 - DNA, 22 bp, Homo sapiens
atctgtcttgccttgcatattt

SEQ ID NO: 9051234 - DNA, 22 bp, Homo sapiens
atctgtcttccaccacacatcc

SEQ ID NO: 9051235 - DNA, 22 bp, Homo sapiens
atctgtcttttattcatgagct

SEQ ID NO: 9051236 - DNA, 22 bp, Homo sapiens
atctgtgagaaaggcttgtgct

SEQ ID NO: 9051237 - DNA, 22 bp, Homo sapiens
atctgtgagtatttttgtttat

SEQ ID NO: 9051238 - DNA, 22 bp, Homo sapiens
atctgtagaagatactctgaga

SEQ ID NO: 9051239 - DNA, 22 bp, Homo sapiens
atattcaagtgaggatggctaa

SEQ ID NO: 9051240 - DNA, 22 bp, Homo sapiens
ctgggggcaagcagacagctgt

SEQ ID NO: 9051241 - DNA, 19 bp, Homo sapiens
ctggggctttggtactgcc

SEQ ID NO: 9051242 - DNA, 22 bp, Homo sapiens
atcataaagtgctatctgattg

SEQ ID NO: 9051243 - DNA, 22 bp, Homo sapiens
atcataaaattgcaccatttct

SEQ ID NO: 9051244 - DNA, 22 bp, Homo sapiens
atcataaaccactttgtaatct

SEQ ID NO: 9051245 - DNA, 22 bp, Homo sapiens
ctgtctcctccactgcatggga

SEQ ID NO: 9051246 - DNA, 22 bp, Homo sapiens
ctgtctcagcaggaagtcatca

SEQ ID NO: 9051247 - DNA, 22 bp, Homo sapiens
atcagcttaattctcaacaggt

SEQ ID NO: 9051248 - DNA, 22 bp, Homo sapiens
ctgtaacagatatcatttagca

SEQ ID NO: 9051249 - DNA, 22 bp, Homo sapiens
atcacagagctcccttccactg

SEQ ID NO: 9051250 - DNA, 22 bp, Homo sapiens
atcacagagattgcttttaaaa

SEQ ID NO: 9051251 - DNA, 22 bp, Homo sapiens
atcacacttttgtaaccatcag

SEQ ID NO: 9051252 - DNA, 22 bp, Homo sapiens
atcacaatgtacgttaaaatgt

SEQ ID NO: 9051253 - DNA, 22 bp, Homo sapiens
atcacaaaggtctcagagcaca

SEQ ID NO: 9051254 - DNA, 22 bp, Homo sapiens
atcacaaaggtctcagagcaca

SEQ ID NO: 9051255 - DNA, 22 bp, Homo sapiens
atcaagaattgggagctattga

SEQ ID NO: 9051256 - DNA, 22 bp, Homo sapiens
atcacaaaggctgcttcatgat

SEQ ID NO: 9051257 - DNA, 22 bp, Homo sapiens
cagggactcccagggtagctcc

SEQ ID NO: 9051258 - DNA, 22 bp, Homo sapiens
agctttctccctgacgctttgg

SEQ ID NO: 9051259 - DNA, 22 bp, Homo sapiens
cagggacatgactggtctctgt

SEQ ID NO: 9051260 - DNA, 22 bp, Homo sapiens
cagggacagggatcatttgctt

SEQ ID NO: 9051261 - DNA, 20 bp, Homo sapiens
aggaaaaatggaaactggag

SEQ ID NO: 9051262 - DNA, 22 bp, Homo sapiens
aggaaaacacagtattgatgga

SEQ ID NO: 9051263 - DNA, 22 bp, Homo sapiens
aggaaaatggaccagagttgtt

SEQ ID NO: 9051264 - DNA, 22 bp, Homo sapiens
aggaaacaacttggcatgagcc

SEQ ID NO: 9051265 - DNA, 22 bp, Homo sapiens
aggaaacaacttggcatgagcc

SEQ ID NO: 9051266 - DNA, 22 bp, Homo sapiens
aggaaacagaggtgccacaata

SEQ ID NO: 9051267 - DNA, 22 bp, Homo sapiens
agctttcaggataatgaaaaag

SEQ ID NO: 9051268 - DNA, 22 bp, Homo sapiens
agctttcacgatttggaacagg

SEQ ID NO: 9051269 - DNA, 22 bp, Homo sapiens
agctttatttgtcattcacggc

SEQ ID NO: 9051270 - DNA, 22 bp, Homo sapiens
agctttatttgtcattcacggc

SEQ ID NO: 9051271 - DNA, 22 bp, Homo sapiens
agctttcagttactaatgaagg

SEQ ID NO: 9051272 - DNA, 22 bp, Homo sapiens
agctttcagtctctgaaggaac

SEQ ID NO: 9051273 - DNA, 22 bp, Homo sapiens
agctttattaactctccaggtg

SEQ ID NO: 9051274 - DNA, 22 bp, Homo sapiens
agctttattcatgatttcaggg

SEQ ID NO: 9051275 - DNA, 22 bp, Homo sapiens
agctttattcatgatttcaggg

SEQ ID NO: 9051276 - DNA, 22 bp, Homo sapiens
agcttctcctggtacagaactg

SEQ ID NO: 9051277 - DNA, 22 bp, Homo sapiens
aggaaacatccttatctattct

SEQ ID NO: 9051278 - DNA, 22 bp, Homo sapiens
aggaaacagttggtaatgcata

SEQ ID NO: 9051279 - DNA, 22 bp, Homo sapiens
aggaaacagttggtaatgcata

SEQ ID NO: 9051280 - DNA, 22 bp, Homo sapiens
aggaaacagagtgaagcttggg

SEQ ID NO: 9051281 - DNA, 22 bp, Homo sapiens
aggaaacaggcagcctttgaac

SEQ ID NO: 9051282 - DNA, 22 bp, Homo sapiens
aggaaacagagtgaagcttggg

SEQ ID NO: 9051283 - DNA, 22 bp, Homo sapiens
aggaaacagtgaacttggcagg

SEQ ID NO: 9051284 - DNA, 22 bp, Homo sapiens
aggaaacattgatattgggaaa

SEQ ID NO: 9051285 - DNA, 22 bp, Homo sapiens
aggaaacatgaatctgccttga

SEQ ID NO: 9051286 - DNA, 22 bp, Homo sapiens
aggaaacatgaatctgccttga

SEQ ID NO: 9051287 - DNA, 22 bp, Homo sapiens
aggaaacatccttatctattct

SEQ ID NO: 9051288 - DNA, 22 bp, Homo sapiens
aggaaacatccttatctattct

SEQ ID NO: 9051289 - DNA, 22 bp, Homo sapiens
cagggtttcaccatgttagcag

SEQ ID NO: 9051290 - DNA, 22 bp, Homo sapiens
aggaagcactggaaggggttgg

SEQ ID NO: 9051291 - DNA, 21 bp, Homo sapiens
aggaatgtgtatatatacaat

SEQ ID NO: 9051292 - DNA, 22 bp, Homo sapiens
aggaatgtgtttctaggctgtt

SEQ ID NO: 9051293 - DNA, 22 bp, Homo sapiens
aggaatgtggcaatcttcaagt

SEQ ID NO: 9051294 - DNA, 22 bp, Homo sapiens
aggaatgtcgtcataaacatga

SEQ ID NO: 9051295 - DNA, 22 bp, Homo sapiens
caggtcctggcatcaggcaggt

SEQ ID NO: 9051296 - DNA, 22 bp, Homo sapiens
aggaagggttctttgtgaaaga

SEQ ID NO: 9051297 - DNA, 22 bp, Homo sapiens
agctggagaatgtggatgatcc

SEQ ID NO: 9051298 - DNA, 20 bp, Homo sapiens
caggcagaggatgctgacca

SEQ ID NO: 9051299 - DNA, 22 bp, Homo sapiens
caggcagagtcagattagactt

SEQ ID NO: 9051300 - DNA, 22 bp, Homo sapiens
agctggtaacattagtcagtat

SEQ ID NO: 9051301 - DNA, 22 bp, Homo sapiens
agctggtaagtggcagagattc

SEQ ID NO: 9051302 - DNA, 22 bp, Homo sapiens
agctgaagaaatgggaagcatt

SEQ ID NO: 9051303 - DNA, 20 bp, Homo sapiens
agctctttttagctaaggta

SEQ ID NO: 9051304 - DNA, 22 bp, Homo sapiens
agctcttttatcatgaggagag

SEQ ID NO: 9051305 - DNA, 22 bp, Homo sapiens
caggaaatgctatcatagctga

SEQ ID NO: 9051306 - DNA, 22 bp, Homo sapiens
agctgccgatgcccagctgcat

SEQ ID NO: 9051307 - DNA, 22 bp, Homo sapiens
agctgcctcagcaacacagacc

SEQ ID NO: 9051308 - DNA, 21 bp, Homo sapiens
agctgcctccacttctgaggc

SEQ ID NO: 9051309 - DNA, 22 bp, Homo sapiens
agctgcctccatggtcaaagat

SEQ ID NO: 9051310 - DNA, 22 bp, Homo sapiens
agctgcctggagtcatttcctg

SEQ ID NO: 9051311 - DNA, 21 bp, Homo sapiens
agctgctttcagctcctagag

SEQ ID NO: 9051312 - DNA, 22 bp, Homo sapiens
catcacttttaaaggtgatcga

SEQ ID NO: 9051313 - DNA, 22 bp, Homo sapiens
cagttcagctagaagaaacaaa

SEQ ID NO: 9051314 - DNA, 22 bp, Homo sapiens
cagttcatccccatgttttcaa

SEQ ID NO: 9051315 - DNA, 22 bp, Homo sapiens
cagtgaggatgataattaaggt

SEQ ID NO: 9051316 - DNA, 22 bp, Homo sapiens
aggagcagattggtaagatcat

SEQ ID NO: 9051317 - DNA, 22 bp, Homo sapiens
aggagctgatagtctatggaga

SEQ ID NO: 9051318 - DNA, 22 bp, Homo sapiens
aggagctggccactaggatgca

SEQ ID NO: 9051319 - DNA, 22 bp, Homo sapiens
aggagctggcctagaaaggaga

SEQ ID NO: 9051320 - DNA, 22 bp, Homo sapiens
aggagctgggctgctgctggga

SEQ ID NO: 9051321 - DNA, 22 bp, Homo sapiens
aggagctgggagaaggactaaa

SEQ ID NO: 9051322 - DNA, 22 bp, Homo sapiens
aggagctgggcccaaggatgct

SEQ ID NO: 9051323 - DNA, 22 bp, Homo sapiens
aggcagagctaggaagaattgt

SEQ ID NO: 9051324 - DNA, 22 bp, Homo sapiens
ccaaacttaacgatgtttttgt

SEQ ID NO: 9051325 - DNA, 22 bp, Homo sapiens
ccaaaccatccatctccaggct

SEQ ID NO: 9051326 - DNA, 22 bp, Homo sapiens
ccaaaattattacatttgtagg

SEQ ID NO: 9051327 - DNA, 22 bp, Homo sapiens
ccaaaatgtttgaatgcatgtg

SEQ ID NO: 9051328 - DNA, 22 bp, Homo sapiens
ccaaaattaagcctcttatgtt

SEQ ID NO: 9051329 - DNA, 22 bp, Homo sapiens
aggcaggctcaggcccatgctt

SEQ ID NO: 9051330 - DNA, 22 bp, Homo sapiens
aggcaggccctgggccatcccg

SEQ ID NO: 9051331 - DNA, 22 bp, Homo sapiens
aggcaggccctctggaaaggta

SEQ ID NO: 9051332 - DNA, 22 bp, Homo sapiens
aggcaggcctacacaatgggag

SEQ ID NO: 9051333 - DNA, 22 bp, Homo sapiens
aggcaggccgtgtccctcctca

SEQ ID NO: 9051334 - DNA, 22 bp, Homo sapiens
aggatcatataagctccagcta

SEQ ID NO: 9051335 - DNA, 22 bp, Homo sapiens
aggatcatgtggtcattcctga

SEQ ID NO: 9051336 - DNA, 22 bp, Homo sapiens
aggatcctccttagaaaagacc

SEQ ID NO: 9051337 - DNA, 22 bp, Homo sapiens
aggatgactggaacccaagtga

SEQ ID NO: 9051338 - DNA, 22 bp, Homo sapiens
ccagaacacagtggaagaatat

SEQ ID NO: 9051339 - DNA, 22 bp, Homo sapiens
ccagaaagttcagctgtgaatg

SEQ ID NO: 9051340 - DNA, 22 bp, Homo sapiens
ccagaaagaatgaactgaaccc

SEQ ID NO: 9051341 - DNA, 22 bp, Homo sapiens
ccagaaacacctggattctgtt

SEQ ID NO: 9051342 - DNA, 21 bp, Homo sapiens
ccagacttgagtgtatgttgt

SEQ ID NO: 9051343 - DNA, 22 bp, Homo sapiens
aggccacaagaactaccccatc

SEQ ID NO: 9051344 - DNA, 22 bp, Homo sapiens
aggccacagtactttgcagacc

SEQ ID NO: 9051345 - DNA, 22 bp, Homo sapiens
aggccacagtcagtgggtgctg

SEQ ID NO: 9051346 - DNA, 22 bp, Homo sapiens
aggccagtgcagctggaacaga

SEQ ID NO: 9051347 - DNA, 22 bp, Homo sapiens
aggcccagactcagcggggcgg

SEQ ID NO: 9051348 - DNA, 22 bp, Homo sapiens
ccagagctaaacacacaggctg

SEQ ID NO: 9051349 - DNA, 22 bp, Homo sapiens
ccagagctccagggctacagaa

SEQ ID NO: 9051350 - DNA, 22 bp, Homo sapiens
ccagagctgaggagatgggctt

SEQ ID NO: 9051351 - DNA, 22 bp, Homo sapiens
aggccacattgtgattcccgca

SEQ ID NO: 9051352 - DNA, 22 bp, Homo sapiens
aggccacagttgaggccagcaa

SEQ ID NO: 9051353 - DNA, 22 bp, Homo sapiens
aggccacatagcttgcatgtag

SEQ ID NO: 9051354 - DNA, 22 bp, Homo sapiens
aggcggagctcagtgtgtccaa

SEQ ID NO: 9051355 - DNA, 22 bp, Homo sapiens
aggcggctggtgtcctgcaggt

SEQ ID NO: 9051356 - DNA, 22 bp, Homo sapiens
ccaggaagggctctttaaagac

SEQ ID NO: 9051357 - DNA, 22 bp, Homo sapiens
ccagctctgtaagctgtgaaat

SEQ ID NO: 9051358 - DNA, 22 bp, Homo sapiens
ccagcaggagatgcctgtgtct

SEQ ID NO: 9051359 - DNA, 22 bp, Homo sapiens
ccagctgacgatgcctggtctc

SEQ ID NO: 9051360 - DNA, 22 bp, Homo sapiens
ccagctgagaagtgtaaagtga

SEQ ID NO: 9051361 - DNA, 22 bp, Homo sapiens
ccagggctggaccagtgcttgg

SEQ ID NO: 9051362 - DNA, 22 bp, Homo sapiens
ccagggctcaggctcccagtgg

SEQ ID NO: 9051363 - DNA, 22 bp, Homo sapiens
ccaggtctgcgggcggcaggca

SEQ ID NO: 9051364 - DNA, 22 bp, Homo sapiens
ccagggctggtggctgcagagg

SEQ ID NO: 9051365 - DNA, 22 bp, Homo sapiens
ccaggctgctttattactctgt

SEQ ID NO: 9051366 - DNA, 22 bp, Homo sapiens
ccaggctgcttagccttatctt

SEQ ID NO: 9051367 - DNA, 22 bp, Homo sapiens
aggctaatatttatgaaaccaa

SEQ ID NO: 9051368 - DNA, 22 bp, Homo sapiens
aggctaatatggcacatgaaca

SEQ ID NO: 9051369 - DNA, 22 bp, Homo sapiens
aggctggcgacatctggcgggc

SEQ ID NO: 9051370 - DNA, 22 bp, Homo sapiens
aggctggcgacatctggcgggc

SEQ ID NO: 9051371 - DNA, 22 bp, Homo sapiens
aggctggcggtgactgctctga

SEQ ID NO: 9051372 - DNA, 22 bp, Homo sapiens
aggctggagtgctggagtgctg

SEQ ID NO: 9051373 - DNA, 22 bp, Homo sapiens
aggctgcttcttgtccttggca

SEQ ID NO: 9051374 - DNA, 22 bp, Homo sapiens
ccaggtgaaatcttcatggttc

SEQ ID NO: 9051375 - DNA, 22 bp, Homo sapiens
ccaggtctgtcttcttagctca

SEQ ID NO: 9051376 - DNA, 22 bp, Homo sapiens
agggctggcaagggattgaaat

SEQ ID NO: 9051377 - DNA, 22 bp, Homo sapiens
agggcgctgaaatactaacatg

SEQ ID NO: 9051378 - DNA, 22 bp, Homo sapiens
ccctgctttcaaccttctagct

SEQ ID NO: 9051379 - DNA, 20 bp, Homo sapiens
cctcagagcgcaggccccct

SEQ ID NO: 9051380 - DNA, 20 bp, Homo sapiens
agggcctggagtacagcagg

SEQ ID NO: 9051381 - DNA, 22 bp, Homo sapiens
agggcctgctctatcactctca

SEQ ID NO: 9051382 - DNA, 22 bp, Homo sapiens
cctgaaacatcttctgtaaata

SEQ ID NO: 9051383 - DNA, 22 bp, Homo sapiens
cctgaagacaacttttatcacc

SEQ ID NO: 9051384 - DNA, 22 bp, Homo sapiens
aggggatggagctggaaggcag

SEQ ID NO: 9051385 - DNA, 22 bp, Homo sapiens
cctcttccactgggccccatcc

SEQ ID NO: 9051386 - DNA, 22 bp, Homo sapiens
cctgaaacagtccttgccctca

SEQ ID NO: 9051387 - DNA, 18 bp, Homo sapiens
aggggcagcttgtgtgga

SEQ ID NO: 9051388 - DNA, 22 bp, Homo sapiens
aggggcagcctcacaatcctct

SEQ ID NO: 9051389 - DNA, 22 bp, Homo sapiens
aggggagagttaatgtgaatgt

SEQ ID NO: 9051390 - DNA, 22 bp, Homo sapiens
aggggagagttaatgtgaatgt

SEQ ID NO: 9051391 - DNA, 22 bp, Homo sapiens
aggggaggagcttttcttgcct

SEQ ID NO: 9051392 - DNA, 22 bp, Homo sapiens
aggggaggcagcgataaacctg

SEQ ID NO: 9051393 - DNA, 22 bp, Homo sapiens
aggggaggtgtccccaaatctc

SEQ ID NO: 9051394 - DNA, 22 bp, Homo sapiens
cccagtttcaactttccagtgg

SEQ ID NO: 9051395 - DNA, 22 bp, Homo sapiens
aggctgtctcagcctgcttgca

SEQ ID NO: 9051396 - DNA, 20 bp, Homo sapiens
aggctgtcatttctggcagg

SEQ ID NO: 9051397 - DNA, 18 bp, Homo sapiens
ccctgccagctcccagca

SEQ ID NO: 9051398 - DNA, 22 bp, Homo sapiens
ccctgccaatcccgtctctctg

SEQ ID NO: 9051399 - DNA, 22 bp, Homo sapiens
acattctaacattgtacagata

SEQ ID NO: 9051400 - DNA, 19 bp, Homo sapiens
acattcccatcagcaatgt

SEQ ID NO: 9051401 - DNA, 22 bp, Homo sapiens
acattcattgagcaacaacaat

SEQ ID NO: 9051402 - DNA, 22 bp, Homo sapiens
acattctttcgatgtctgattt

SEQ ID NO: 9051403 - DNA, 22 bp, Homo sapiens
acattctttgagttttgttaaa

SEQ ID NO: 9051404 - DNA, 22 bp, Homo sapiens
acattctttcaccttgtgtcca

SEQ ID NO: 9051405 - DNA, 22 bp, Homo sapiens
acattcttggactccactctag

SEQ ID NO: 9051406 - DNA, 22 bp, Homo sapiens
acattctagatatgttatattt

SEQ ID NO: 9051407 - DNA, 22 bp, Homo sapiens
acattctatgaagataatttta

SEQ ID NO: 9051408 - DNA, 22 bp, Homo sapiens
acattcatgtcccacttctagc

SEQ ID NO: 9051409 - DNA, 22 bp, Homo sapiens
acattcattccaggtcagtcag

SEQ ID NO: 9051410 - DNA, 22 bp, Homo sapiens
acattcacgctctcaaagctga

SEQ ID NO: 9051411 - DNA, 22 bp, Homo sapiens
acattcactatgtccaaactct

SEQ ID NO: 9051412 - DNA, 22 bp, Homo sapiens
acattcacaagcctacaaggtt

SEQ ID NO: 9051413 - DNA, 22 bp, Homo sapiens
aggctccaggcaatgtttctga

SEQ ID NO: 9051414 - DNA, 22 bp, Homo sapiens
aggctccagccaatgggtctgt

SEQ ID NO: 9051415 - DNA, 22 bp, Homo sapiens
aggctccacggtcactggctct

SEQ ID NO: 9051416 - DNA, 22 bp, Homo sapiens
acattgaaagcatattatctcc

SEQ ID NO: 9051417 - DNA, 22 bp, Homo sapiens
acattgaaccagtagacacaaa

SEQ ID NO: 9051418 - DNA, 22 bp, Homo sapiens
acattgaagggctatccaatag

SEQ ID NO: 9051419 - DNA, 22 bp, Homo sapiens
acattgaagctgtgaaatcaaa

SEQ ID NO: 9051420 - DNA, 22 bp, Homo sapiens
acattgaattcaaaattactga

SEQ ID NO: 9051421 - DNA, 22 bp, Homo sapiens
acattgaatttcacttttgtac

SEQ ID NO: 9051422 - DNA, 22 bp, Homo sapiens
aggccacacaactcttagagat

SEQ ID NO: 9051423 - DNA, 22 bp, Homo sapiens
aggccacaatttgatttggttt

SEQ ID NO: 9051424 - DNA, 18 bp, Homo sapiens
aggccacactccagaaca

SEQ ID NO: 9051425 - DNA, 22 bp, Homo sapiens
aggccacagagagtgcatgtgc

SEQ ID NO: 9051426 - DNA, 22 bp, Homo sapiens
aggccacagatactgtgaagta

SEQ ID NO: 9051427 - DNA, 22 bp, Homo sapiens
aggccacagcctgggaggtgac

SEQ ID NO: 9051428 - DNA, 22 bp, Homo sapiens
aggccacagcctgggaggtgac

SEQ ID NO: 9051429 - DNA, 22 bp, Homo sapiens
aggccacaggagtactgtcggt

SEQ ID NO: 9051430 - DNA, 22 bp, Homo sapiens
aggccacaggattgcacagcat

SEQ ID NO: 9051431 - DNA, 22 bp, Homo sapiens
aggccacaggtggaagccagag

SEQ ID NO: 9051432 - DNA, 22 bp, Homo sapiens
aggccacaggcaccctgtgttc

SEQ ID NO: 9051433 - DNA, 22 bp, Homo sapiens
aggccagcacgacagccgcagg

SEQ ID NO: 9051434 - DNA, 22 bp, Homo sapiens
acatacatgggattaaaaaatt

SEQ ID NO: 9051435 - DNA, 22 bp, Homo sapiens
aggcagtgttcttctaagggca

SEQ ID NO: 9051436 - DNA, 22 bp, Homo sapiens
aggcccagctgggccaggaaca

SEQ ID NO: 9051437 - DNA, 22 bp, Homo sapiens
aggcccagggctgctctctgaa

SEQ ID NO: 9051438 - DNA, 22 bp, Homo sapiens
aggcccagggctgctctctgaa

SEQ ID NO: 9051439 - DNA, 21 bp, Homo sapiens
aggcccagctttcctcttgct

SEQ ID NO: 9051440 - DNA, 22 bp, Homo sapiens
aggccagccctcacctgtgttc

SEQ ID NO: 9051441 - DNA, 22 bp, Homo sapiens
aggccagcagcatgacggcatc

SEQ ID NO: 9051442 - DNA, 22 bp, Homo sapiens
aggccagccctgggctgagaga

SEQ ID NO: 9051443 - DNA, 22 bp, Homo sapiens
acatgaaaagactatctgatta

SEQ ID NO: 9051444 - DNA, 20 bp, Homo sapiens
accaggagatggaggcaggg

SEQ ID NO: 9051445 - DNA, 22 bp, Homo sapiens
accaggaggcctggagcacaaa

SEQ ID NO: 9051446 - DNA, 22 bp, Homo sapiens
accaggagccatagagtcaggc

SEQ ID NO: 9051447 - DNA, 19 bp, Homo sapiens
accaggagacagtgagctt

SEQ ID NO: 9051448 - DNA, 22 bp, Homo sapiens
accaagcacaaagatgagtaaa

SEQ ID NO: 9051449 - DNA, 22 bp, Homo sapiens
accagctctttcttttcactat

SEQ ID NO: 9051450 - DNA, 22 bp, Homo sapiens
accagctgaactgcagcccagg

SEQ ID NO: 9051451 - DNA, 22 bp, Homo sapiens
accagctgagtaggggagggcc

SEQ ID NO: 9051452 - DNA, 22 bp, Homo sapiens
accaattttagagcaccaagaa

SEQ ID NO: 9051453 - DNA, 22 bp, Homo sapiens
accacactggctagtgaagaag

SEQ ID NO: 9051454 - DNA, 19 bp, Homo sapiens
accaggagtatcagagctg

SEQ ID NO: 9051455 - DNA, 22 bp, Homo sapiens
accccagaatctatgctttaca

SEQ ID NO: 9051456 - DNA, 20 bp, Homo sapiens
accccacagagtccattgca

SEQ ID NO: 9051457 - DNA, 22 bp, Homo sapiens
accctggactggggctgaggct

SEQ ID NO: 9051458 - DNA, 22 bp, Homo sapiens
accctggtgttgccccgctttt

SEQ ID NO: 9051459 - DNA, 22 bp, Homo sapiens
accctggtgatttgagagagta

SEQ ID NO: 9051460 - DNA, 21 bp, Homo sapiens
aggagaccggcttgtttgtgc

SEQ ID NO: 9051461 - DNA, 22 bp, Homo sapiens
aggagaccttcaccacttccac

SEQ ID NO: 9051462 - DNA, 22 bp, Homo sapiens
aggagacccaatgccagaaaga

SEQ ID NO: 9051463 - DNA, 22 bp, Homo sapiens
aggagacccagaatgttgctgt

SEQ ID NO: 9051464 - DNA, 22 bp, Homo sapiens
aggagaccttttgagtgtgaga

SEQ ID NO: 9051465 - DNA, 22 bp, Homo sapiens
aggagacataactatgatgaga

SEQ ID NO: 9051466 - DNA, 22 bp, Homo sapiens
aggagacataactatgatgaga

SEQ ID NO: 9051467 - DNA, 22 bp, Homo sapiens
aggagacatactataggaatat

SEQ ID NO: 9051468 - DNA, 20 bp, Homo sapiens
aggagaccaagccaagtgga

SEQ ID NO: 9051469 - DNA, 22 bp, Homo sapiens
aggagctgatgattctttgatc

SEQ ID NO: 9051470 - DNA, 22 bp, Homo sapiens
aggagctgcaaaaccggccgct

SEQ ID NO: 9051471 - DNA, 22 bp, Homo sapiens
aggagctgcactgggagttttt

SEQ ID NO: 9051472 - DNA, 22 bp, Homo sapiens
aggagctgcaaatattagtaat

SEQ ID NO: 9051473 - DNA, 22 bp, Homo sapiens
aggagctgcatggatacctggt

SEQ ID NO: 9051474 - DNA, 22 bp, Homo sapiens
aggagctgcagattctgccttg

SEQ ID NO: 9051475 - DNA, 22 bp, Homo sapiens
aggagctgcttaaatggttggt

SEQ ID NO: 9051476 - DNA, 22 bp, Homo sapiens
aggagctgctttggtgcggttt

SEQ ID NO: 9051477 - DNA, 22 bp, Homo sapiens
aggagctggaatggtccttttg

SEQ ID NO: 9051478 - DNA, 22 bp, Homo sapiens
aggaggggcatagaaatgtaat

SEQ ID NO: 9051479 - DNA, 21 bp, Homo sapiens
aggagctggagaaaactttcc

SEQ ID NO: 9051480 - DNA, 21 bp, Homo sapiens
aggaggggtctttcccactga

SEQ ID NO: 9051481 - DNA, 22 bp, Homo sapiens
aggaggggttctcgggtgctga

SEQ ID NO: 9051482 - DNA, 21 bp, Homo sapiens
acatacataccttaccacctt

SEQ ID NO: 9051483 - DNA, 23 bp, Homo sapiens
acatacataagcaccacattttg

SEQ ID NO: 9051484 - DNA, 23 bp, Homo sapiens
acatacatggagataaagtgatg

SEQ ID NO: 9051485 - DNA, 17 bp, Homo sapiens
acatacactggtgaaca

SEQ ID NO: 9051486 - DNA, 22 bp, Homo sapiens
acatacacatgaatatattttt

SEQ ID NO: 9051487 - DNA, 22 bp, Homo sapiens
acatacacaagcgtacatgaac

SEQ ID NO: 9051488 - DNA, 22 bp, Homo sapiens
acatacacaagcgtacatgaac

SEQ ID NO: 9051489 - DNA, 22 bp, Homo sapiens
agctggcctgttagagctgagt

SEQ ID NO: 9051490 - DNA, 22 bp, Homo sapiens
agctgctggggagggcagacac

SEQ ID NO: 9051491 - DNA, 22 bp, Homo sapiens
agctgctggtttaagggatggg

SEQ ID NO: 9051492 - DNA, 22 bp, Homo sapiens
agctgcttagagtctcttctta

SEQ ID NO: 9051493 - DNA, 22 bp, Homo sapiens
agctgcttgtacatgaccacat

SEQ ID NO: 9051494 - DNA, 22 bp, Homo sapiens
agctgcaggattatggaatgga

SEQ ID NO: 9051495 - DNA, 22 bp, Homo sapiens
agctgcaggattatggaatgga

SEQ ID NO: 9051496 - DNA, 22 bp, Homo sapiens
agctgcagctacagtgttggtt

SEQ ID NO: 9051497 - DNA, 22 bp, Homo sapiens
acagccagtgactgcagaccct

SEQ ID NO: 9051498 - DNA, 22 bp, Homo sapiens
agctgcagccgcagctgtggcc

SEQ ID NO: 9051499 - DNA, 22 bp, Homo sapiens
agctccaggtgcaagtcatggt

SEQ ID NO: 9051500 - DNA, 22 bp, Homo sapiens
aggaagcagtttataatgcatt

SEQ ID NO: 9051501 - DNA, 22 bp, Homo sapiens
agctttatggtgcctcacttga

SEQ ID NO: 9051502 - DNA, 20 bp, Homo sapiens
agcttcattatagcccacag

SEQ ID NO: 9051503 - DNA, 22 bp, Homo sapiens
agctttatggtgcctcacttga

SEQ ID NO: 9051504 - DNA, 22 bp, Homo sapiens
agcttttagtacgttaaaattg

SEQ ID NO: 9051505 - DNA, 21 bp, Homo sapiens
agcttttctgttttatatcta

SEQ ID NO: 9051506 - DNA, 22 bp, Homo sapiens
aggaaaaacctgttaatggtag

SEQ ID NO: 9051507 - DNA, 22 bp, Homo sapiens
agcttattaatttttctgcatg

SEQ ID NO: 9051508 - DNA, 22 bp, Homo sapiens
agtagaaagaaggcactgggcc

SEQ ID NO: 9051509 - DNA, 22 bp, Homo sapiens
agtactttttgttcaattgtgc

SEQ ID NO: 9051510 - DNA, 22 bp, Homo sapiens
agtactttacttcttacagttt

SEQ ID NO: 9051511 - DNA, 22 bp, Homo sapiens
agtactttgcactttgctcaga

SEQ ID NO: 9051512 - DNA, 20 bp, Homo sapiens
agtaccttttgtatgttacc

SEQ ID NO: 9051513 - DNA, 22 bp, Homo sapiens
agtatacagtaatgacatatct

SEQ ID NO: 9051514 - DNA, 21 bp, Homo sapiens
agtagtttagcacagggtttg

SEQ ID NO: 9051515 - DNA, 22 bp, Homo sapiens
aggtggggaaaccagcgatccc

SEQ ID NO: 9051516 - DNA, 22 bp, Homo sapiens
aggtggggaaaccagcgatccc

SEQ ID NO: 9051517 - DNA, 23 bp, Homo sapiens
agtacatttgacccaaataagct

SEQ ID NO: 9051518 - DNA, 22 bp, Homo sapiens
agtcaccaggttttagagacct

SEQ ID NO: 9051519 - DNA, 22 bp, Homo sapiens
agtcaccagggtttgctgggtt

SEQ ID NO: 9051520 - DNA, 22 bp, Homo sapiens
agtcaccattttcacctgcctc

SEQ ID NO: 9051521 - DNA, 22 bp, Homo sapiens
agtcaccatctgtggcagcctg

SEQ ID NO: 9051522 - DNA, 22 bp, Homo sapiens
actcctacatattagcattaac

SEQ ID NO: 9051523 - DNA, 22 bp, Homo sapiens
actctctgggcatgccccacca

SEQ ID NO: 9051524 - DNA, 22 bp, Homo sapiens
aggtgacaggacaggagctggt

SEQ ID NO: 9051525 - DNA, 19 bp, Homo sapiens
aggtgacaggtgcacttgc

SEQ ID NO: 9051526 - DNA, 22 bp, Homo sapiens
aggtgacatcccggcagcagag

SEQ ID NO: 9051527 - DNA, 19 bp, Homo sapiens
aggtgacatgtgacagcct

SEQ ID NO: 9051528 - DNA, 22 bp, Homo sapiens
accttttatgtaaatatatgtt

SEQ ID NO: 9051529 - DNA, 22 bp, Homo sapiens
acctttggtcatttacttttca

SEQ ID NO: 9051530 - DNA, 22 bp, Homo sapiens
accttttcatctgaaactttta

SEQ ID NO: 9051531 - DNA, 22 bp, Homo sapiens
actagaaagtttccagagttat

SEQ ID NO: 9051532 - DNA, 22 bp, Homo sapiens
actagaaaattcctagaaacta

SEQ ID NO: 9051533 - DNA, 22 bp, Homo sapiens
actagaaagcaaaagccatttc

SEQ ID NO: 9051534 - DNA, 22 bp, Homo sapiens
actagaaagcactaagctaggc

SEQ ID NO: 9051535 - DNA, 22 bp, Homo sapiens
acccttcatagaggagaagctg

SEQ ID NO: 9051536 - DNA, 19 bp, Homo sapiens
aggtagctcagactcaaag

SEQ ID NO: 9051537 - DNA, 22 bp, Homo sapiens
acctttatgtttgattacaatt

SEQ ID NO: 9051538 - DNA, 22 bp, Homo sapiens
aggtccagtgaaactttatttg

SEQ ID NO: 9051539 - DNA, 22 bp, Homo sapiens
aggtccagtgctcttggtggtt

SEQ ID NO: 9051540 - DNA, 21 bp, Homo sapiens
aggtccagttctgtcttggac

SEQ ID NO: 9051541 - DNA, 22 bp, Homo sapiens
aggtccagagttgagatacaga

SEQ ID NO: 9051542 - DNA, 22 bp, Homo sapiens
aggtccagaggttgaacggtgg

SEQ ID NO: 9051543 - DNA, 22 bp, Homo sapiens
aggtccagcctgccctctctcc

SEQ ID NO: 9051544 - DNA, 22 bp, Homo sapiens
aggtccagctctattgaaaaga

SEQ ID NO: 9051545 - DNA, 22 bp, Homo sapiens
aggtccagactgtgtaccctag

SEQ ID NO: 9051546 - DNA, 22 bp, Homo sapiens
aggtccagaggctccttattac

SEQ ID NO: 9051547 - DNA, 22 bp, Homo sapiens
aggtccagaacgtgcctactct

SEQ ID NO: 9051548 - DNA, 22 bp, Homo sapiens
aggtccaggcatttgggttggg

SEQ ID NO: 9051549 - DNA, 22 bp, Homo sapiens
aggtccaggttccgtttctgcg

SEQ ID NO: 9051550 - DNA, 22 bp, Homo sapiens
aggtccaggcctcatgatggcc

SEQ ID NO: 9051551 - DNA, 22 bp, Homo sapiens
aggtccagctgttgcagcctcc

SEQ ID NO: 9051552 - DNA, 22 bp, Homo sapiens
aggtccaggagatttggcaatt

SEQ ID NO: 9051553 - DNA, 22 bp, Homo sapiens
aggtccaggatttgtggggtct

SEQ ID NO: 9051554 - DNA, 22 bp, Homo sapiens
agtgctgaacatagaatggaca

SEQ ID NO: 9051555 - DNA, 22 bp, Homo sapiens
actgcacagatgaagctgtaaa

SEQ ID NO: 9051556 - DNA, 22 bp, Homo sapiens
actgcacagatgaagctgtaaa

SEQ ID NO: 9051557 - DNA, 22 bp, Homo sapiens
agtgaagcctgctgaaagtggc

SEQ ID NO: 9051558 - DNA, 22 bp, Homo sapiens
agtgaagccccgatgcgttttg

SEQ ID NO: 9051559 - DNA, 22 bp, Homo sapiens
agtgaagctaacctgctgattt

SEQ ID NO: 9051560 - DNA, 23 bp, Homo sapiens
agtgaagctggttagtgatgacc

SEQ ID NO: 9051561 - DNA, 22 bp, Homo sapiens
actctgaatgtgcatgtaaatc

SEQ ID NO: 9051562 - DNA, 22 bp, Homo sapiens
actctgacatttaaaaagcaat

SEQ ID NO: 9051563 - DNA, 22 bp, Homo sapiens
actgagagtcaagatagcatgg

SEQ ID NO: 9051564 - DNA, 22 bp, Homo sapiens
actgagatgctggatgaccctg

SEQ ID NO: 9051565 - DNA, 22 bp, Homo sapiens
actgagatttacatgttctagt

SEQ ID NO: 9051566 - DNA, 22 bp, Homo sapiens
actgagatgagttgcatagatt

SEQ ID NO: 9051567 - DNA, 22 bp, Homo sapiens
actgagatgaatagatggcaag

SEQ ID NO: 9051568 - DNA, 20 bp, Homo sapiens
actgggcatacctgtcctgt

SEQ ID NO: 9051569 - DNA, 22 bp, Homo sapiens
actggctgtgcccatagagctc

SEQ ID NO: 9051570 - DNA, 22 bp, Homo sapiens
actggctgtgcagagggcagta

SEQ ID NO: 9051571 - DNA, 21 bp, Homo sapiens
actggctgtcttcctactggt

SEQ ID NO: 9051572 - DNA, 21 bp, Homo sapiens
actggctggtggctaagaatc

SEQ ID NO: 9051573 - DNA, 21 bp, Homo sapiens
actggctggctgagtttcctg

SEQ ID NO: 9051574 - DNA, 22 bp, Homo sapiens
actggctggccacaccctggta

SEQ ID NO: 9051575 - DNA, 22 bp, Homo sapiens
actggctggccgcgctcttcgc

SEQ ID NO: 9051576 - DNA, 22 bp, Homo sapiens
actggctgtgcccatagagctc

SEQ ID NO: 9051577 - DNA, 22 bp, Homo sapiens
actggctgtggccacggctgct

SEQ ID NO: 9051578 - DNA, 22 bp, Homo sapiens
actggctgtgtaacctcaggca

SEQ ID NO: 9051579 - DNA, 21 bp, Homo sapiens
agtgtccttttactgtgaata

SEQ ID NO: 9051580 - DNA, 22 bp, Homo sapiens
actggctgcgatcttggcgctt

SEQ ID NO: 9051581 - DNA, 20 bp, Homo sapiens
actggctgcctggaatgcgc

SEQ ID NO: 9051582 - DNA, 22 bp, Homo sapiens
actggctgcggggtggaagaag

SEQ ID NO: 9051583 - DNA, 22 bp, Homo sapiens
actggctgcggggtggaagaag

SEQ ID NO: 9051584 - DNA, 22 bp, Homo sapiens
actggctgcgttcctgtgagac

SEQ ID NO: 9051585 - DNA, 22 bp, Homo sapiens
actggctggactctgacctctt

SEQ ID NO: 9051586 - DNA, 22 bp, Homo sapiens
actggctggagttgccaaggct

SEQ ID NO: 9051587 - DNA, 21 bp, Homo sapiens
actggctgccatgatccaggg

SEQ ID NO: 9051588 - DNA, 22 bp, Homo sapiens
actggctgcctccaaagtgtgc

SEQ ID NO: 9051589 - DNA, 21 bp, Homo sapiens
actggctgccatgatccaggg

SEQ ID NO: 9051590 - DNA, 22 bp, Homo sapiens
actggctgatcacctgcctcag

SEQ ID NO: 9051591 - DNA, 22 bp, Homo sapiens
actgcccattatggtagtcact

SEQ ID NO: 9051592 - DNA, 22 bp, Homo sapiens
actgcccagaagagatgaaagt

SEQ ID NO: 9051593 - DNA, 22 bp, Homo sapiens
actgccaatggtagtttgatgg

SEQ ID NO: 9051594 - DNA, 22 bp, Homo sapiens
actgccaatggtagtttgatgg

SEQ ID NO: 9051595 - DNA, 22 bp, Homo sapiens
actttaaaactgatcatcagag

SEQ ID NO: 9051596 - DNA, 22 bp, Homo sapiens
atacaaaatatatactggagac

SEQ ID NO: 9051597 - DNA, 21 bp, Homo sapiens
actttaatatacatgaggagg

SEQ ID NO: 9051598 - DNA, 22 bp, Homo sapiens
actttacaaactcctcactgtt

SEQ ID NO: 9051599 - DNA, 22 bp, Homo sapiens
actttacaagcttatagcctag

SEQ ID NO: 9051600 - DNA, 21 bp, Homo sapiens
actttacaatttacatagtga

SEQ ID NO: 9051601 - DNA, 21 bp, Homo sapiens
actttacaatttacatagtga

SEQ ID NO: 9051602 - DNA, 22 bp, Homo sapiens
atacatatccacaggagataaa

SEQ ID NO: 9051603 - DNA, 22 bp, Homo sapiens
atacatcacctatatattcaca

SEQ ID NO: 9051604 - DNA, 22 bp, Homo sapiens
atacatcaatttcttagttatc

SEQ ID NO: 9051605 - DNA, 22 bp, Homo sapiens
atacatcatgctccatatattt

SEQ ID NO: 9051606 - DNA, 22 bp, Homo sapiens
atacatcacctatatattcaca

SEQ ID NO: 9051607 - DNA, 22 bp, Homo sapiens
atacatcatgctccatatattt

SEQ ID NO: 9051608 - DNA, 22 bp, Homo sapiens
atacatcatttcccatcaatcg

SEQ ID NO: 9051609 - DNA, 18 bp, Homo sapiens
agtttttaggaagaaatg

SEQ ID NO: 9051610 - DNA, 21 bp, Homo sapiens
agtttttactcttaactgtgg

SEQ ID NO: 9051611 - DNA, 22 bp, Homo sapiens
agttttatgtagacaattcatt

SEQ ID NO: 9051612 - DNA, 22 bp, Homo sapiens
agttttatggctcaacctaata

SEQ ID NO: 9051613 - DNA, 23 bp, Homo sapiens
agtttttaatggtcatagctgag

SEQ ID NO: 9051614 - DNA, 21 bp, Homo sapiens
actgttattcccattttcacc

SEQ ID NO: 9051615 - DNA, 22 bp, Homo sapiens
actgtttagtaaattgaaatgg

SEQ ID NO: 9051616 - DNA, 22 bp, Homo sapiens
actgttatttgtaatccattat

SEQ ID NO: 9051617 - DNA, 22 bp, Homo sapiens
agtttttgacaaactgtagttg

SEQ ID NO: 9051618 - DNA, 17 bp, Homo sapiens
agtttttggacctgtgt

SEQ ID NO: 9051619 - DNA, 22 bp, Homo sapiens
agtttttgctgatagcatgctt

SEQ ID NO: 9051620 - DNA, 19 bp, Homo sapiens
agtttttggaaatcctgct

SEQ ID NO: 9051621 - DNA, 22 bp, Homo sapiens
agtttttgagaatttactatgt

SEQ ID NO: 9051622 - DNA, 22 bp, Homo sapiens
acttaaaaagaatcttttcacg

SEQ ID NO: 9051623 - DNA, 22 bp, Homo sapiens
acttaaaaacagatccagcagg

SEQ ID NO: 9051624 - DNA, 22 bp, Homo sapiens
acttccttttgggaaactgttt

SEQ ID NO: 9051625 - DNA, 22 bp, Homo sapiens
acttcctgggcatgcagagtcc

SEQ ID NO: 9051626 - DNA, 21 bp, Homo sapiens
ataaagttttacaggaatgca

SEQ ID NO: 9051627 - DNA, 21 bp, Homo sapiens
agaaaaacacgatataagccc

SEQ ID NO: 9051628 - DNA, 23 bp, Homo sapiens
agaaaaacaggattgtgttccta

SEQ ID NO: 9051629 - DNA, 22 bp, Homo sapiens
atattttgtaacttggaatagg

SEQ ID NO: 9051630 - DNA, 22 bp, Homo sapiens
atatttttccatgtgggactct

SEQ ID NO: 9051631 - DNA, 21 bp, Homo sapiens
agaaaaaccagcatgttttca

SEQ ID NO: 9051632 - DNA, 22 bp, Homo sapiens
agaaaaagtcaaggaattggac

SEQ ID NO: 9051633 - DNA, 22 bp, Homo sapiens
atatttctccaaatgttttcaa

SEQ ID NO: 9051634 - DNA, 22 bp, Homo sapiens
agaaagattttcaacaggaggt

SEQ ID NO: 9051635 - DNA, 22 bp, Homo sapiens
agaaagcaccctgcactttctg

SEQ ID NO: 9051636 - DNA, 22 bp, Homo sapiens
agaaagcacagcgggtccattt

SEQ ID NO: 9051637 - DNA, 22 bp, Homo sapiens
agaaagcatctccattgtaggt

SEQ ID NO: 9051638 - DNA, 22 bp, Homo sapiens
agaaagcactctgtcttttacc

SEQ ID NO: 9051639 - DNA, 22 bp, Homo sapiens
agaaagcagcatttatgatctc

SEQ ID NO: 9051640 - DNA, 22 bp, Homo sapiens
agaaatcattgaattatttgct

SEQ ID NO: 9051641 - DNA, 23 bp, Homo sapiens
agaaatcatctccaccccatgtc

SEQ ID NO: 9051642 - DNA, 22 bp, Homo sapiens
agaaatcatgactaagagcagt

SEQ ID NO: 9051643 - DNA, 22 bp, Homo sapiens
atcagtaaatattcattgtgca

SEQ ID NO: 9051644 - DNA, 22 bp, Homo sapiens
agaaatctatgttttggttaga

SEQ ID NO: 9051645 - DNA, 19 bp, Homo sapiens
agaaatctcgagatttgtt

SEQ ID NO: 9051646 - DNA, 19 bp, Homo sapiens
agaaatctcgagatttgtt

SEQ ID NO: 9051647 - DNA, 22 bp, Homo sapiens
atcccacacccctacaacatat

SEQ ID NO: 9051648 - DNA, 22 bp, Homo sapiens
atccccacgatatagccaaagc

SEQ ID NO: 9051649 - DNA, 22 bp, Homo sapiens
atcccatttcctgttttgtcaa

SEQ ID NO: 9051650 - DNA, 22 bp, Homo sapiens
atccccagactttagatttctc

SEQ ID NO: 9051651 - DNA, 22 bp, Homo sapiens
agaaccctaatacaatggacat

SEQ ID NO: 9051652 - DNA, 19 bp, Homo sapiens
agaagctgtgaaatgaagg

SEQ ID NO: 9051653 - DNA, 22 bp, Homo sapiens
agaaggagtgtacaggtcatgc

SEQ ID NO: 9051654 - DNA, 22 bp, Homo sapiens
atctctggccttccttttccaa

SEQ ID NO: 9051655 - DNA, 22 bp, Homo sapiens
atctcttagcagtctagtgacc

SEQ ID NO: 9051656 - DNA, 22 bp, Homo sapiens
atctcttatgtcacataaacca

SEQ ID NO: 9051657 - DNA, 22 bp, Homo sapiens
atctcttatgtcacataaacca

SEQ ID NO: 9051658 - DNA, 22 bp, Homo sapiens
agaagccaattctgtgtgagtc

SEQ ID NO: 9051659 - DNA, 22 bp, Homo sapiens
agaagccaacagggcaggagag

SEQ ID NO: 9051660 - DNA, 22 bp, Homo sapiens
atctctttgatggctcctgtga

SEQ ID NO: 9051661 - DNA, 20 bp, Homo sapiens
agaagccaagtgacatgttt

SEQ ID NO: 9051662 - DNA, 22 bp, Homo sapiens
atgaagcagttaaggtgcatga

SEQ ID NO: 9051663 - DNA, 19 bp, Homo sapiens
atgaagcattgtttttgta

SEQ ID NO: 9051664 - DNA, 22 bp, Homo sapiens
atgaagcattacaggatgacag

SEQ ID NO: 9051665 - DNA, 22 bp, Homo sapiens
agaatcaattagattctatgag

SEQ ID NO: 9051666 - DNA, 22 bp, Homo sapiens
agacacttatttagtgggagtt

SEQ ID NO: 9051667 - DNA, 22 bp, Homo sapiens
agacacttcatgtaagtggaat

SEQ ID NO: 9051668 - DNA, 22 bp, Homo sapiens
agacagaaataggagaaaccag

SEQ ID NO: 9051669 - DNA, 22 bp, Homo sapiens
agacacttggcagagagctgtt

SEQ ID NO: 9051670 - DNA, 22 bp, Homo sapiens
agacactttcagaagtgtttgc

SEQ ID NO: 9051671 - DNA, 22 bp, Homo sapiens
agacaagagctgaggacatatt

SEQ ID NO: 9051672 - DNA, 22 bp, Homo sapiens
agacaactgcagagcaaagaat

SEQ ID NO: 9051673 - DNA, 22 bp, Homo sapiens
agacaacatctagtttggtgga

SEQ ID NO: 9051674 - DNA, 22 bp, Homo sapiens
atgcagggttctgggctagaga

SEQ ID NO: 9051675 - DNA, 17 bp, Homo sapiens
atgcaggtgtgaggggc

SEQ ID NO: 9051676 - DNA, 22 bp, Homo sapiens
agacagaatttgtcagataaat

SEQ ID NO: 9051677 - DNA, 20 bp, Homo sapiens
agacagaatcagagataaag

SEQ ID NO: 9051678 - DNA, 22 bp, Homo sapiens
atgcatttttgagtatgaatga

SEQ ID NO: 9051679 - DNA, 22 bp, Homo sapiens
atgcctttctggtgttcttcct

SEQ ID NO: 9051680 - DNA, 22 bp, Homo sapiens
agacctggatgtgagggaagta

SEQ ID NO: 9051681 - DNA, 22 bp, Homo sapiens
atgccaattgcaggaagaaaac

SEQ ID NO: 9051682 - DNA, 22 bp, Homo sapiens
agactttatccctgtttttctc

SEQ ID NO: 9051683 - DNA, 22 bp, Homo sapiens
agactttataaatcttaatttc

SEQ ID NO: 9051684 - DNA, 21 bp, Homo sapiens
agagagggagatgaaacatcc

SEQ ID NO: 9051685 - DNA, 22 bp, Homo sapiens
agagagcctgagtggcagctat

SEQ ID NO: 9051686 - DNA, 22 bp, Homo sapiens
agagagcccgggccagggcaca

SEQ ID NO: 9051687 - DNA, 22 bp, Homo sapiens
agagaggcattcggtgatccca

SEQ ID NO: 9051688 - DNA, 22 bp, Homo sapiens
agagacaatgccaatgcacacg

SEQ ID NO: 9051689 - DNA, 22 bp, Homo sapiens
agagaatcctctacatgttttt

SEQ ID NO: 9051690 - DNA, 20 bp, Homo sapiens
agagaattccctttggagat

SEQ ID NO: 9051691 - DNA, 22 bp, Homo sapiens
agagacaccgcgcatcatggct

SEQ ID NO: 9051692 - DNA, 22 bp, Homo sapiens
agagagcattgaggaaatcttc

SEQ ID NO: 9051693 - DNA, 22 bp, Homo sapiens
agagattgtgctactcacccaa

SEQ ID NO: 9051694 - DNA, 22 bp, Homo sapiens
agagcacaggctctggagtcta

SEQ ID NO: 9051695 - DNA, 23 bp, Homo sapiens
agagcctgaaagacttctggcac

SEQ ID NO: 9051696 - DNA, 21 bp, Homo sapiens
agagcctgagatcttccagca

SEQ ID NO: 9051697 - DNA, 22 bp, Homo sapiens
agagcctgaggatgtcccagct

SEQ ID NO: 9051698 - DNA, 22 bp, Homo sapiens
agagctgaaaaagctgacccgg

SEQ ID NO: 9051699 - DNA, 22 bp, Homo sapiens
agatcagacacggcttgtgacg

SEQ ID NO: 9051700 - DNA, 21 bp, Homo sapiens
agatcattcttctgagcactt

SEQ ID NO: 9051701 - DNA, 22 bp, Homo sapiens
agatgattatgatagcactgtt

SEQ ID NO: 9051702 - DNA, 21 bp, Homo sapiens
agatgctgtgctccaggagca

SEQ ID NO: 9051703 - DNA, 22 bp, Homo sapiens
agatggagtggagatgagtaaa

SEQ ID NO: 9051704 - DNA, 22 bp, Homo sapiens
agatggagttagtaccagagtc

SEQ ID NO: 9051705 - DNA, 22 bp, Homo sapiens
agatggagaccttggatgaact

SEQ ID NO: 9051706 - DNA, 22 bp, Homo sapiens
caaagatgtcattggtaagaca

SEQ ID NO: 9051707 - DNA, 22 bp, Homo sapiens
caaagatgctgatgttggatca

SEQ ID NO: 9051708 - DNA, 22 bp, Homo sapiens
caaagataatcacagaataccc

SEQ ID NO: 9051709 - DNA, 17 bp, Homo sapiens
caaaccagtaagactgc

SEQ ID NO: 9051710 - DNA, 22 bp, Homo sapiens
caaaccagtaggaagtctatta

SEQ ID NO: 9051711 - DNA, 22 bp, Homo sapiens
caaagcaagggctgaagactcc

SEQ ID NO: 9051712 - DNA, 22 bp, Homo sapiens
caaagcaaggctcagtttgaac

SEQ ID NO: 9051713 - DNA, 22 bp, Homo sapiens
agcaagaagctttgctgtgata

SEQ ID NO: 9051714 - DNA, 22 bp, Homo sapiens
attttcaaaacatctgctgtgt

SEQ ID NO: 9051715 - DNA, 23 bp, Homo sapiens
attttagctgaatgacttcttta

SEQ ID NO: 9051716 - DNA, 22 bp, Homo sapiens
attttcagaacattcattcact

SEQ ID NO: 9051717 - DNA, 22 bp, Homo sapiens
attttcaagggagaggcctctg

SEQ ID NO: 9051718 - DNA, 22 bp, Homo sapiens
agcaaatattttgttgaagtgc

SEQ ID NO: 9051719 - DNA, 22 bp, Homo sapiens
agcaacacgcagtagtatacga

SEQ ID NO: 9051720 - DNA, 22 bp, Homo sapiens
agcaaatgggtttatatttgac

SEQ ID NO: 9051721 - DNA, 22 bp, Homo sapiens
attacaatcgagagaaacaaat

SEQ ID NO: 9051722 - DNA, 22 bp, Homo sapiens
attacactagctattcttatgg

SEQ ID NO: 9051723 - DNA, 22 bp, Homo sapiens
agaggggaggcgaaccagagtc

SEQ ID NO: 9051724 - DNA, 22 bp, Homo sapiens
agagtgagggggcactgagacg

SEQ ID NO: 9051725 - DNA, 22 bp, Homo sapiens
agagtcccagggacactccaga

SEQ ID NO: 9051726 - DNA, 22 bp, Homo sapiens
agcacctggagggctgggacct

SEQ ID NO: 9051727 - DNA, 22 bp, Homo sapiens
agcacctggtctcctggcgctg

SEQ ID NO: 9051728 - DNA, 22 bp, Homo sapiens
agcacctgtgtggtagggaggt

SEQ ID NO: 9051729 - DNA, 22 bp, Homo sapiens
agcacctgtgccctgatggaga

SEQ ID NO: 9051730 - DNA, 22 bp, Homo sapiens
caatacaattaccagttaatca

SEQ ID NO: 9051731 - DNA, 22 bp, Homo sapiens
agcagagcgcctgctcagaggg

SEQ ID NO: 9051732 - DNA, 22 bp, Homo sapiens
agcactgtgatttataacattt

SEQ ID NO: 9051733 - DNA, 22 bp, Homo sapiens
caatacatcaggtcaaaatgtg

SEQ ID NO: 9051734 - DNA, 22 bp, Homo sapiens
caatacatcaggtcaaaatgtg

SEQ ID NO: 9051735 - DNA, 22 bp, Homo sapiens
caatacaattaccagttaatca

SEQ ID NO: 9051736 - DNA, 22 bp, Homo sapiens
agcagctcaagacttaaatttg

SEQ ID NO: 9051737 - DNA, 22 bp, Homo sapiens
cacagagatggtctggcaggtg

SEQ ID NO: 9051738 - DNA, 19 bp, Homo sapiens
agcagctggaggtggagtg

SEQ ID NO: 9051739 - DNA, 22 bp, Homo sapiens
cacatttaatcctttataagta

SEQ ID NO: 9051740 - DNA, 19 bp, Homo sapiens
agcagggagtggttgtggg

SEQ ID NO: 9051741 - DNA, 17 bp, Homo sapiens
agcagggagtcaaggga

SEQ ID NO: 9051742 - DNA, 22 bp, Homo sapiens
caccagctacagactactgtgt

SEQ ID NO: 9051743 - DNA, 22 bp, Homo sapiens
caccagctaattaaaacagcag

SEQ ID NO: 9051744 - DNA, 22 bp, Homo sapiens
caccagctacagactactgtgt

SEQ ID NO: 9051745 - DNA, 22 bp, Homo sapiens
caccagatgaaaggacatatca

SEQ ID NO: 9051746 - DNA, 22 bp, Homo sapiens
caccagatgaatgtttgatgct

SEQ ID NO: 9051747 - DNA, 22 bp, Homo sapiens
cacagcaaaggcttcggctgat

SEQ ID NO: 9051748 - DNA, 22 bp, Homo sapiens
cacagcaagagctaaatgacca

SEQ ID NO: 9051749 - DNA, 22 bp, Homo sapiens
cacagcaagagctaaatgacca

SEQ ID NO: 9051750 - DNA, 22 bp, Homo sapiens
agcagggaggtctagcacgtgg

SEQ ID NO: 9051751 - DNA, 22 bp, Homo sapiens
agcagggaggcggtgtgctggc

SEQ ID NO: 9051752 - DNA, 22 bp, Homo sapiens
agcagggaggcggtgtgctggc

SEQ ID NO: 9051753 - DNA, 22 bp, Homo sapiens
agcagggaggtctagcacgtgg

SEQ ID NO: 9051754 - DNA, 22 bp, Homo sapiens
agcagggaggtctagcacgtgg

SEQ ID NO: 9051755 - DNA, 17 bp, Homo sapiens
agcagggagtcaaggga

SEQ ID NO: 9051756 - DNA, 22 bp, Homo sapiens
agcagggaggcccagggcactg

SEQ ID NO: 9051757 - DNA, 22 bp, Homo sapiens
agcagggaggcccagggcactg

SEQ ID NO: 9051758 - DNA, 22 bp, Homo sapiens
agcagggagaccatctcttcct

SEQ ID NO: 9051759 - DNA, 22 bp, Homo sapiens
cacagcaatagctaactgatac

SEQ ID NO: 9051760 - DNA, 22 bp, Homo sapiens
agcatggacagtggcagcagtg

SEQ ID NO: 9051761 - DNA, 22 bp, Homo sapiens
agcatgcatgaagattcagcaa

SEQ ID NO: 9051762 - DNA, 22 bp, Homo sapiens
cactgttttattccaacatagg

SEQ ID NO: 9051763 - DNA, 22 bp, Homo sapiens
cactgttattactactatacat

SEQ ID NO: 9051764 - DNA, 22 bp, Homo sapiens
cactgtggggtttggctggaac

SEQ ID NO: 9051765 - DNA, 22 bp, Homo sapiens
cactgtggtgtgagggctgatg

SEQ ID NO: 9051766 - DNA, 19 bp, Homo sapiens
cactgtggtccttcactgc

SEQ ID NO: 9051767 - DNA, 22 bp, Homo sapiens
cactgtgggtcccagactggag

SEQ ID NO: 9051768 - DNA, 22 bp, Homo sapiens
agcagggctggatttggcaaga

SEQ ID NO: 9051769 - DNA, 22 bp, Homo sapiens
agcagtgctatggccaggctaa

SEQ ID NO: 9051770 - DNA, 22 bp, Homo sapiens
agcagtgcccattctgccccct

SEQ ID NO: 9051771 - DNA, 22 bp, Homo sapiens
agcagtgccgcatcttgtgacc

SEQ ID NO: 9051772 - DNA, 21 bp, Homo sapiens
agcagtgctcctgggatgagg

SEQ ID NO: 9051773 - DNA, 22 bp, Homo sapiens
agcagtgcttgccttagtgtga

SEQ ID NO: 9051774 - DNA, 22 bp, Homo sapiens
agcagtgaaacagctgcatatg

SEQ ID NO: 9051775 - DNA, 22 bp, Homo sapiens
agcatattgtatgtctatatgt

SEQ ID NO: 9051776 - DNA, 22 bp, Homo sapiens
agcatattcatgccagactact

SEQ ID NO: 9051777 - DNA, 22 bp, Homo sapiens
agcatataggaaatgttgaatc

SEQ ID NO: 9051778 - DNA, 20 bp, Homo sapiens
agctcctggtataggtgcct

SEQ ID NO: 9051779 - DNA, 22 bp, Homo sapiens
agctcctgtctcaagggagcct

SEQ ID NO: 9051780 - DNA, 22 bp, Homo sapiens
agctcctgggagcaggtggtac

SEQ ID NO: 9051781 - DNA, 22 bp, Homo sapiens
agctcctggctttcctctcacc

SEQ ID NO: 9051782 - DNA, 22 bp, Homo sapiens
agctcctggctttcctctcacc

SEQ ID NO: 9051783 - DNA, 22 bp, Homo sapiens
agctcctggcaaggtcatggtg

SEQ ID NO: 9051784 - DNA, 22 bp, Homo sapiens
agctcttatctctaagcacagc

SEQ ID NO: 9051785 - DNA, 22 bp, Homo sapiens
agctctttatgggtaaatgcca

SEQ ID NO: 9051786 - DNA, 22 bp, Homo sapiens
agctctttgctggcagtaggct

SEQ ID NO: 9051787 - DNA, 22 bp, Homo sapiens
agctctttggcactgagcagca

SEQ ID NO: 9051788 - DNA, 22 bp, Homo sapiens
agctctttgagcaaggcagctc

SEQ ID NO: 9051789 - DNA, 22 bp, Homo sapiens
agctctttgagaaggcagtgtg

SEQ ID NO: 9051790 - DNA, 22 bp, Homo sapiens
agctctttctacaagcaggcag

SEQ ID NO: 9051791 - DNA, 22 bp, Homo sapiens
agctctgggattctcaggccac

SEQ ID NO: 9051792 - DNA, 22 bp, Homo sapiens
agctcctgtctcaagggagcct

SEQ ID NO: 9051793 - DNA, 22 bp, Homo sapiens
agctcctgtggcagctcttctg

SEQ ID NO: 9051794 - DNA, 22 bp, Homo sapiens
agctctgtgttcacagcactaa

SEQ ID NO: 9051795 - DNA, 22 bp, Homo sapiens
agctcctggacgaacagggagt

SEQ ID NO: 9051796 - DNA, 22 bp, Homo sapiens
agctcctggacgaacagggagt

SEQ ID NO: 9051797 - DNA, 22 bp, Homo sapiens
agctcctgcttgacagaagagg

SEQ ID NO: 9051798 - DNA, 19 bp, Homo sapiens
agcctggctttgctctgct

SEQ ID NO: 9051799 - DNA, 22 bp, Homo sapiens
agcctggccactcagggcctga

SEQ ID NO: 9051800 - DNA, 22 bp, Homo sapiens
agcctggcttagctctctcact

SEQ ID NO: 9051801 - DNA, 22 bp, Homo sapiens
cagatgtgagctggggagagtg

SEQ ID NO: 9051802 - DNA, 22 bp, Homo sapiens
cagatgtgcatgatgggaaggg

SEQ ID NO: 9051803 - DNA, 22 bp, Homo sapiens
cagcaaatactactagttttta

SEQ ID NO: 9051804 - DNA, 20 bp, Homo sapiens
cagcaactttggactgagtt

SEQ ID NO: 9051805 - DNA, 22 bp, Homo sapiens
cagcaactggtcattgctctcc

SEQ ID NO: 9051806 - DNA, 22 bp, Homo sapiens
agctaagacttagtgacttagt

SEQ ID NO: 9051807 - DNA, 22 bp, Homo sapiens
agctaaggaactctgtaacacc

SEQ ID NO: 9051808 - DNA, 22 bp, Homo sapiens
agctaagatttattaaaggccc

SEQ ID NO: 9051809 - DNA, 22 bp, Homo sapiens
agctaatgatacatgctccaca

SEQ ID NO: 9051810 - DNA, 22 bp, Homo sapiens
agctagaatattgatctgaaat

SEQ ID NO: 9051811 - DNA, 22 bp, Homo sapiens
agccctgggcagccaaggaagc

SEQ ID NO: 9051812 - DNA, 22 bp, Homo sapiens
agccctgggcagccaaggaagc

SEQ ID NO: 9051813 - DNA, 22 bp, Homo sapiens
agccctgggcgttactgggatg

SEQ ID NO: 9051814 - DNA, 22 bp, Homo sapiens
agccctgggatacagtaaaagc

SEQ ID NO: 9051815 - DNA, 22 bp, Homo sapiens
agccctggcccggctgtgcttt

SEQ ID NO: 9051816 - DNA, 22 bp, Homo sapiens
agccctggcccggctgtgcttt

SEQ ID NO: 9051817 - DNA, 22 bp, Homo sapiens
agccctggattctgaggtccaa

SEQ ID NO: 9051818 - DNA, 22 bp, Homo sapiens
agccctggcagagccaggtagt

SEQ ID NO: 9051819 - DNA, 22 bp, Homo sapiens
cactttcaagtttcagaggata

SEQ ID NO: 9051820 - DNA, 22 bp, Homo sapiens
cactttcaagtttcagaggata

SEQ ID NO: 9051821 - DNA, 22 bp, Homo sapiens
cactttatgggaagcaaaaatt

SEQ ID NO: 9051822 - DNA, 19 bp, Homo sapiens
cactttatttctgttttgt

SEQ ID NO: 9051823 - DNA, 22 bp, Homo sapiens
cactttcaagtttcagaggata

SEQ ID NO: 9051824 - DNA, 22 bp, Homo sapiens
cactttatattctaagacggcc

SEQ ID NO: 9051825 - DNA, 22 bp, Homo sapiens
cactttatgggaagcaaaaatt

SEQ ID NO: 9051826 - DNA, 22 bp, Homo sapiens
cactttatatgcattacctcat

SEQ ID NO: 9051827 - DNA, 22 bp, Homo sapiens
cagagctcagagctgccaggca

SEQ ID NO: 9051828 - DNA, 22 bp, Homo sapiens
cagagccttagttctcctagaa

SEQ ID NO: 9051829 - DNA, 22 bp, Homo sapiens
cagagacattaagtgccatgat

SEQ ID NO: 9051830 - DNA, 22 bp, Homo sapiens
cagagacattcagtaaattatc

SEQ ID NO: 9051831 - DNA, 22 bp, Homo sapiens
cagagacatccatgttagttgg

SEQ ID NO: 9051832 - DNA, 22 bp, Homo sapiens
aaatccaggtagtttggtttga

SEQ ID NO: 9051833 - DNA, 22 bp, Homo sapiens
aaatgcagctgggcatgagagg

SEQ ID NO: 9051834 - DNA, 22 bp, Homo sapiens
aaatgctagaacattttaaagg

SEQ ID NO: 9051835 - DNA, 22 bp, Homo sapiens
aaatgctacacaggaattctca

SEQ ID NO: 9051836 - DNA, 22 bp, Homo sapiens
aaatgctatttgggaacaacat

SEQ ID NO: 9051837 - DNA, 22 bp, Homo sapiens
aaatggcaggctctttgctagt

SEQ ID NO: 9051838 - DNA, 22 bp, Homo sapiens
aaatataatttctgcctcaata

SEQ ID NO: 9051839 - DNA, 22 bp, Homo sapiens
aaatatgtgatcagtgaataaa

SEQ ID NO: 9051840 - DNA, 22 bp, Homo sapiens
aaatactgttttattccatgat

SEQ ID NO: 9051841 - DNA, 22 bp, Homo sapiens
aaatactgtagataatagagtt

SEQ ID NO: 9051842 - DNA, 20 bp, Homo sapiens
aaacgagccatcattctggt

SEQ ID NO: 9051843 - DNA, 22 bp, Homo sapiens
aaacggttgctcatagttacat

SEQ ID NO: 9051844 - DNA, 22 bp, Homo sapiens
aaatagaaaccaacaaggtcag

SEQ ID NO: 9051845 - DNA, 22 bp, Homo sapiens
aaatagaattaactagctactg

SEQ ID NO: 9051846 - DNA, 22 bp, Homo sapiens
aaagcaatcagattcagatgtc

SEQ ID NO: 9051847 - DNA, 22 bp, Homo sapiens
aaagcaatagagggtaagactg

SEQ ID NO: 9051848 - DNA, 22 bp, Homo sapiens
aaaggccaataaagacaagctg

SEQ ID NO: 9051849 - DNA, 22 bp, Homo sapiens
aaagcaatggatgagaatctgt

SEQ ID NO: 9051850 - DNA, 22 bp, Homo sapiens
aaatacagattccagggtctta

SEQ ID NO: 9051851 - DNA, 22 bp, Homo sapiens
aaacatcataggcatgcatgat

SEQ ID NO: 9051852 - DNA, 22 bp, Homo sapiens
aaacatcaccattttacctaat

SEQ ID NO: 9051853 - DNA, 22 bp, Homo sapiens
aaaaactgtaattacttttgca

SEQ ID NO: 9051854 - DNA, 21 bp, Homo sapiens
aaaaatgaagttgttcaggaa

SEQ ID NO: 9051855 - DNA, 22 bp, Homo sapiens
aaaaagatagcattgtgctcct

SEQ ID NO: 9051856 - DNA, 22 bp, Homo sapiens
aaaaagatagcattgtgctcct

SEQ ID NO: 9051857 - DNA, 22 bp, Homo sapiens
aaaaatgaattcttcagtggca

SEQ ID NO: 9051858 - DNA, 22 bp, Homo sapiens
aaaagtctctctgagtaaaagt

SEQ ID NO: 9051859 - DNA, 22 bp, Homo sapiens
aaaagtctctctgagtaaaagt

SEQ ID NO: 9051860 - DNA, 22 bp, Homo sapiens
aaaagtctacaagcttcaacaa

SEQ ID NO: 9051861 - DNA, 22 bp, Homo sapiens
aaaagtcagtctctcctagctc

SEQ ID NO: 9051862 - DNA, 22 bp, Homo sapiens
aaaagggacgacaacaggccac

SEQ ID NO: 9051863 - DNA, 22 bp, Homo sapiens
aaaatagctatggaatgtcact

SEQ ID NO: 9051864 - DNA, 22 bp, Homo sapiens
aaaattcattcctcagactgcc

SEQ ID NO: 9051865 - DNA, 22 bp, Homo sapiens
aaaatagcatattgctttcttt

SEQ ID NO: 9051866 - DNA, 22 bp, Homo sapiens
aaaatagattctaggatgtctt

SEQ ID NO: 9051867 - DNA, 19 bp, Homo sapiens
aaacacagatttcttacca

SEQ ID NO: 9051868 - DNA, 22 bp, Homo sapiens
aaacacaatgtttctttgttct

SEQ ID NO: 9051869 - DNA, 22 bp, Homo sapiens
aaacaaagccagggaagttatg

SEQ ID NO: 9051870 - DNA, 22 bp, Homo sapiens
aaacaaacataggtttgaaagt

SEQ ID NO: 9051871 - DNA, 22 bp, Homo sapiens
aaacttgagcagtcagatgaag

SEQ ID NO: 9051872 - DNA, 22 bp, Homo sapiens
aaacttgaaaggtactgttggt

SEQ ID NO: 9051873 - DNA, 23 bp, Homo sapiens
aaacttgctatggctgaaatcat

SEQ ID NO: 9051874 - DNA, 22 bp, Homo sapiens
aaacttgatttagaactaaggc

SEQ ID NO: 9051875 - DNA, 20 bp, Homo sapiens
aaacttgatggcatagaata

SEQ ID NO: 9051876 - DNA, 21 bp, Homo sapiens
aaagatgagaactggatggct

SEQ ID NO: 9051877 - DNA, 22 bp, Homo sapiens
aaagatgatctacaagttcatt

SEQ ID NO: 9051878 - DNA, 22 bp, Homo sapiens
aaagatgtcacaagatgtgatg

SEQ ID NO: 9051879 - DNA, 22 bp, Homo sapiens
aaagatggcccatgatctcttg

SEQ ID NO: 9051880 - DNA, 22 bp, Homo sapiens
aaagatctccccttcaaagagt

SEQ ID NO: 9051881 - DNA, 22 bp, Homo sapiens
aaagaagcataggctagacttc

SEQ ID NO: 9051882 - DNA, 22 bp, Homo sapiens
aaagaaggacctggaggaggat

SEQ ID NO: 9051883 - DNA, 22 bp, Homo sapiens
aaacagtctgatgccatctgcc

SEQ ID NO: 9051884 - DNA, 22 bp, Homo sapiens
aaacagtcctctttatttagtc

SEQ ID NO: 9051885 - DNA, 22 bp, Homo sapiens
aaacacagggatatatattcca

SEQ ID NO: 9051886 - DNA, 22 bp, Homo sapiens
aaacatgaatagatattaaaca

SEQ ID NO: 9051887 - DNA, 22 bp, Homo sapiens
aaaccatggctcattggagatg

SEQ ID NO: 9051888 - DNA, 22 bp, Homo sapiens
aaaccacatgccttcaaatgct

SEQ ID NO: 9051889 - DNA, 22 bp, Homo sapiens
aaaccacagttcagtgcttttg

SEQ ID NO: 9051890 - DNA, 22 bp, Homo sapiens
aaaccacacttagcagtttcgt

SEQ ID NO: 9051891 - DNA, 22 bp, Homo sapiens
aagaaagtgctttgtaaattat

SEQ ID NO: 9051892 - DNA, 22 bp, Homo sapiens
aagaaagggctattgttctcca

SEQ ID NO: 9051893 - DNA, 22 bp, Homo sapiens
aagaaagggctattgttctcca

SEQ ID NO: 9051894 - DNA, 22 bp, Homo sapiens
aagaaaggtgtgtttgcagatg

SEQ ID NO: 9051895 - DNA, 22 bp, Homo sapiens
aagaatgagctcaaagatctta

SEQ ID NO: 9051896 - DNA, 22 bp, Homo sapiens
aagaatgattacaaagcaacga

SEQ ID NO: 9051897 - DNA, 22 bp, Homo sapiens
aagaatgattacaaagcaacga

SEQ ID NO: 9051898 - DNA, 22 bp, Homo sapiens
aagaaagggagaaggatggtgt

SEQ ID NO: 9051899 - DNA, 22 bp, Homo sapiens
aagaaaggatatatgggaggta

SEQ ID NO: 9051900 - DNA, 22 bp, Homo sapiens
aagaaagccaaagttcatacct

SEQ ID NO: 9051901 - DNA, 22 bp, Homo sapiens
aagacactttctaaatagaagt

SEQ ID NO: 9051902 - DNA, 22 bp, Homo sapiens
aagacactaagctttcaggata

SEQ ID NO: 9051903 - DNA, 22 bp, Homo sapiens
aagaggagaaaggctggctttg

SEQ ID NO: 9051904 - DNA, 22 bp, Homo sapiens
aagaggaatgggtgtgtttatg

SEQ ID NO: 9051905 - DNA, 22 bp, Homo sapiens
aagagcatggcaagaaaagggt

SEQ ID NO: 9051906 - DNA, 22 bp, Homo sapiens
aagccacttggggaaagatgga

SEQ ID NO: 9051907 - DNA, 22 bp, Homo sapiens
aagccactgagatttcactgca

SEQ ID NO: 9051908 - DNA, 22 bp, Homo sapiens
aagcagcagacctgattttgaa

SEQ ID NO: 9051909 - DNA, 22 bp, Homo sapiens
aagcatggtggatgatacagtg

SEQ ID NO: 9051910 - DNA, 23 bp, Homo sapiens
aagcatggttcacagttagtact

SEQ ID NO: 9051911 - DNA, 19 bp, Homo sapiens
aagcatggtgcctcacctc

SEQ ID NO: 9051912 - DNA, 22 bp, Homo sapiens
aagcagattggggatttccatg

SEQ ID NO: 9051913 - DNA, 22 bp, Homo sapiens
aagcagatgcgttggagcagtt

SEQ ID NO: 9051914 - DNA, 22 bp, Homo sapiens
aagcagatctgatagggccctg

SEQ ID NO: 9051915 - DNA, 22 bp, Homo sapiens
aagcagatgccaagatttacca

SEQ ID NO: 9051916 - DNA, 22 bp, Homo sapiens
aagcagatctgatagggccctg

SEQ ID NO: 9051917 - DNA, 22 bp, Homo sapiens
aagcagatattgtgggagtggg

SEQ ID NO: 9051918 - DNA, 22 bp, Homo sapiens
aaatatcctcagggcagaggtg

SEQ ID NO: 9051919 - DNA, 22 bp, Homo sapiens
aaatatgaatgataagagttat

SEQ ID NO: 9051920 - DNA, 19 bp, Homo sapiens
aaatatcagagagatgata

SEQ ID NO: 9051921 - DNA, 22 bp, Homo sapiens
aagcaactggctcattgtctca

SEQ ID NO: 9051922 - DNA, 22 bp, Homo sapiens
aagcaactgccttcaatattta

SEQ ID NO: 9051923 - DNA, 22 bp, Homo sapiens
aagcaactccctcctcattttt

SEQ ID NO: 9051924 - DNA, 22 bp, Homo sapiens
aagcaactcctaggaggaaagg

SEQ ID NO: 9051925 - DNA, 22 bp, Homo sapiens
aagcaactaaggcaaggaaatg

SEQ ID NO: 9051926 - DNA, 18 bp, Homo sapiens
aagaggaggagcaggttg

SEQ ID NO: 9051927 - DNA, 18 bp, Homo sapiens
aagaggaggaaacccagg

SEQ ID NO: 9051928 - DNA, 22 bp, Homo sapiens
aagaggaggacggttcccagaa

SEQ ID NO: 9051929 - DNA, 22 bp, Homo sapiens
aagaggagacttcagcaacttg

SEQ ID NO: 9051930 - DNA, 22 bp, Homo sapiens
aagcaaaggaaagctgactttt

SEQ ID NO: 9051931 - DNA, 22 bp, Homo sapiens
aagcaaatgaaccagaggtaat

SEQ ID NO: 9051932 - DNA, 22 bp, Homo sapiens
aagcaaatgtgggtgcagaatt

SEQ ID NO: 9051933 - DNA, 22 bp, Homo sapiens
aactatgttaataagtttcatt

SEQ ID NO: 9051934 - DNA, 22 bp, Homo sapiens
aactatgtgatatcatccttgc

SEQ ID NO: 9051935 - DNA, 22 bp, Homo sapiens
aactcactttgtggcttctgaa

SEQ ID NO: 9051936 - DNA, 22 bp, Homo sapiens
aactcaaagatgcatgacgctt

SEQ ID NO: 9051937 - DNA, 22 bp, Homo sapiens
aactatttttggagctaactct

SEQ ID NO: 9051938 - DNA, 22 bp, Homo sapiens
aacatttgtactaaagaagttc

SEQ ID NO: 9051939 - DNA, 20 bp, Homo sapiens
aacatttgtagtcaggcaca

SEQ ID NO: 9051940 - DNA, 22 bp, Homo sapiens
aacatttgaaaatcaagaatct

SEQ ID NO: 9051941 - DNA, 22 bp, Homo sapiens
aacatttgagaaaaatactctt

SEQ ID NO: 9051942 - DNA, 22 bp, Homo sapiens
aactcagacatgtataaagact

SEQ ID NO: 9051943 - DNA, 22 bp, Homo sapiens
aactgaaacttaggaagtaatc

SEQ ID NO: 9051944 - DNA, 22 bp, Homo sapiens
aactgaaatcaatcagtgattc

SEQ ID NO: 9051945 - DNA, 22 bp, Homo sapiens
aacattcaagttctggtttatg

SEQ ID NO: 9051946 - DNA, 22 bp, Homo sapiens
aacattcagctgggtggagcag

SEQ ID NO: 9051947 - DNA, 22 bp, Homo sapiens
aacattctactgtactgcattg

SEQ ID NO: 9051948 - DNA, 22 bp, Homo sapiens
aacattctatgtgcattcagaa

SEQ ID NO: 9051949 - DNA, 22 bp, Homo sapiens
aacaactgctaaggtgtgtcct

SEQ ID NO: 9051950 - DNA, 22 bp, Homo sapiens
aacaactgaaaagctttttctg

SEQ ID NO: 9051951 - DNA, 22 bp, Homo sapiens
aacaacagtgagtgctgggagg

SEQ ID NO: 9051952 - DNA, 22 bp, Homo sapiens
aacaacagctgctaaagagttg

SEQ ID NO: 9051953 - DNA, 22 bp, Homo sapiens
aacaaattagttgcaagactgg

SEQ ID NO: 9051954 - DNA, 22 bp, Homo sapiens
aaagcactcggcttcatccagg

SEQ ID NO: 9051955 - DNA, 22 bp, Homo sapiens
aaatggctacaagatgtgctct

SEQ ID NO: 9051956 - DNA, 22 bp, Homo sapiens
aaatggtataatgtcatgtatt

SEQ ID NO: 9051957 - DNA, 22 bp, Homo sapiens
aaagcaagtctctacaaagtac

SEQ ID NO: 9051958 - DNA, 22 bp, Homo sapiens
aacacatgggtgtttattgtac

SEQ ID NO: 9051959 - DNA, 22 bp, Homo sapiens
aacacataggcagagcatgaca

SEQ ID NO: 9051960 - DNA, 22 bp, Homo sapiens
aacacatatttatatatgcaca

SEQ ID NO: 9051961 - DNA, 21 bp, Homo sapiens
aacacatccagagtatttgac

SEQ ID NO: 9051962 - DNA, 22 bp, Homo sapiens
aacacatatttatatatgcaca

SEQ ID NO: 9051963 - DNA, 22 bp, Homo sapiens
aacagctttgagcagttctgta

SEQ ID NO: 9051964 - DNA, 22 bp, Homo sapiens
aacacaaagaagctgcaggatc

SEQ ID NO: 9051965 - DNA, 22 bp, Homo sapiens
aacacaaagaagctgcaggatc

SEQ ID NO: 9051966 - DNA, 23 bp, Homo sapiens
aacacaaagctgattccagtggc

SEQ ID NO: 9051967 - DNA, 22 bp, Homo sapiens
aacaatgtgaagtgctgttcag

SEQ ID NO: 9051968 - DNA, 22 bp, Homo sapiens
aacaatgtgattgaagctagaa

SEQ ID NO: 9051969 - DNA, 22 bp, Homo sapiens
aacaattactaccaaggcctgt

SEQ ID NO: 9051970 - DNA, 22 bp, Homo sapiens
aacaattagactgacggtatta

SEQ ID NO: 9051971 - DNA, 22 bp, Homo sapiens
aacaagaagagagggacgtaat

SEQ ID NO: 9051972 - DNA, 22 bp, Homo sapiens
aacaagaacacctacagttcta

SEQ ID NO: 9051973 - DNA, 22 bp, Homo sapiens
aacaagaagggaaggcatgatt

SEQ ID NO: 9051974 - DNA, 22 bp, Homo sapiens
aagttcttgataagtccactgt

SEQ ID NO: 9051975 - DNA, 22 bp, Homo sapiens
aagttcttgctgtgtgtcagat

SEQ ID NO: 9051976 - DNA, 22 bp, Homo sapiens
aagttcttggaggatgaagagt

SEQ ID NO: 9051977 - DNA, 22 bp, Homo sapiens
aagttctttctggaaggtctgc

SEQ ID NO: 9051978 - DNA, 23 bp, Homo sapiens
aagttcttttagatgtcttcgtg

SEQ ID NO: 9051979 - DNA, 22 bp, Homo sapiens
aagtatttcgttctgaaaaagt

SEQ ID NO: 9051980 - DNA, 22 bp, Homo sapiens
aagtcaaaccttgctcacagga

SEQ ID NO: 9051981 - DNA, 22 bp, Homo sapiens
aacactgatggaaagtatgttt

SEQ ID NO: 9051982 - DNA, 22 bp, Homo sapiens
aacactgagtatcagagttggg

SEQ ID NO: 9051983 - DNA, 22 bp, Homo sapiens
aacactgagggaaaagagatag

SEQ ID NO: 9051984 - DNA, 22 bp, Homo sapiens
aacactgagggaaaagagatag

SEQ ID NO: 9051985 - DNA, 20 bp, Homo sapiens
aacactgagggctactcttc

SEQ ID NO: 9051986 - DNA, 22 bp, Homo sapiens
aacactgagggaaaagagatag

SEQ ID NO: 9051987 - DNA, 20 bp, Homo sapiens
aacactgaggcctactcttc

SEQ ID NO: 9051988 - DNA, 22 bp, Homo sapiens
aagtcaagtgttattattgtag

SEQ ID NO: 9051989 - DNA, 22 bp, Homo sapiens
aataaaatggtcagttttctca

SEQ ID NO: 9051990 - DNA, 22 bp, Homo sapiens
aagtttgcggggaaagaacaca

SEQ ID NO: 9051991 - DNA, 22 bp, Homo sapiens
aagtttgatgagtttctggagg

SEQ ID NO: 9051992 - DNA, 20 bp, Homo sapiens
aagtttgccccaggaaattg

SEQ ID NO: 9051993 - DNA, 22 bp, Homo sapiens
aacagtttatgataaattctta

SEQ ID NO: 9051994 - DNA, 22 bp, Homo sapiens
aacagtttgagctttgaatttc

SEQ ID NO: 9051995 - DNA, 22 bp, Homo sapiens
aacagtttgcctgaaatgtatt

SEQ ID NO: 9051996 - DNA, 22 bp, Homo sapiens
aataaactgctcaattgcatca

SEQ ID NO: 9051997 - DNA, 22 bp, Homo sapiens
aataaacaaatctttcctgtgg

SEQ ID NO: 9051998 - DNA, 22 bp, Homo sapiens
aaccattagtcaatcagcaaga

SEQ ID NO: 9051999 - DNA, 22 bp, Homo sapiens
aaccatgaatgggttctggtgt

SEQ ID NO: 9052000 - DNA, 22 bp, Homo sapiens
aatcacttgtaaggaattcaat

SEQ ID NO: 9052001 - DNA, 22 bp, Homo sapiens
aatcacatttacattgctaatt

SEQ ID NO: 9052002 - DNA, 22 bp, Homo sapiens
aaccagagtgacactctacaga

SEQ ID NO: 9052003 - DNA, 22 bp, Homo sapiens
aaccagctccagcctccattca

SEQ ID NO: 9052004 - DNA, 22 bp, Homo sapiens
aaccaggaattgcagggctgca

SEQ ID NO: 9052005 - DNA, 22 bp, Homo sapiens
aaccagctctgcaaaatgtcat

SEQ ID NO: 9052006 - DNA, 22 bp, Homo sapiens
aaccagctttgatacgcattat

SEQ ID NO: 9052007 - DNA, 22 bp, Homo sapiens
aaccagctgagaatgcttctgc

SEQ ID NO: 9052008 - DNA, 22 bp, Homo sapiens
aacattgagttctacttccatt

SEQ ID NO: 9052009 - DNA, 20 bp, Homo sapiens
aacattgaaagtctagaaga

SEQ ID NO: 9052010 - DNA, 20 bp, Homo sapiens
aacattgaaagtctagaaga

SEQ ID NO: 9052011 - DNA, 22 bp, Homo sapiens
aacatgttgctttaataatatt

SEQ ID NO: 9052012 - DNA, 22 bp, Homo sapiens
aacattctttagctcttcctgc

SEQ ID NO: 9052013 - DNA, 22 bp, Homo sapiens
aacattcttcaaatatcactct

SEQ ID NO: 9052014 - DNA, 22 bp, Homo sapiens
aacatttatgattgaggtaaat

SEQ ID NO: 9052015 - DNA, 22 bp, Homo sapiens
aagccattcatctaatgtcctg

SEQ ID NO: 9052016 - DNA, 22 bp, Homo sapiens
aagccatatggtaggtatatgt

SEQ ID NO: 9052017 - DNA, 22 bp, Homo sapiens
aagccagttagcacatcattgc

SEQ ID NO: 9052018 - DNA, 22 bp, Homo sapiens
aagccagtaagtttttgtcatt

SEQ ID NO: 9052019 - DNA, 22 bp, Homo sapiens
aagcttttctctgtattacctg

SEQ ID NO: 9052020 - DNA, 22 bp, Homo sapiens
aagctttttggatttgcttcag

SEQ ID NO: 9052021 - DNA, 22 bp, Homo sapiens
aagctttatgacttggagacag

SEQ ID NO: 9052022 - DNA, 22 bp, Homo sapiens
aagctttatgatctctcagcta

SEQ ID NO: 9052023 - DNA, 22 bp, Homo sapiens
aagctttatgatctctcagcta

SEQ ID NO: 9052024 - DNA, 22 bp, Homo sapiens
aagctttatgatctctcagcta

SEQ ID NO: 9052025 - DNA, 19 bp, Homo sapiens
aagctttcccattaacccc

SEQ ID NO: 9052026 - DNA, 22 bp, Homo sapiens
aagctttagagatgagttcctt

SEQ ID NO: 9052027 - DNA, 22 bp, Homo sapiens
aagctttaagtgtcagtcagcc

SEQ ID NO: 9052028 - DNA, 22 bp, Homo sapiens
aagctttagagatgagttcctt

SEQ ID NO: 9052029 - DNA, 22 bp, Homo sapiens
aagctttatgacttggagacag

SEQ ID NO: 9052030 - DNA, 22 bp, Homo sapiens
aagctgtcaggaggttaccttt

SEQ ID NO: 9052031 - DNA, 22 bp, Homo sapiens
aaattattacaagctagttggc

SEQ ID NO: 9052032 - DNA, 22 bp, Homo sapiens
aaattattatgcccctctataa

SEQ ID NO: 9052033 - DNA, 22 bp, Homo sapiens
aaattattataggcagagctga

SEQ ID NO: 9052034 - DNA, 22 bp, Homo sapiens
aaggactaaaagaagggtttct

SEQ ID NO: 9052035 - DNA, 22 bp, Homo sapiens
aaggactagatattcatacatg

SEQ ID NO: 9052036 - DNA, 22 bp, Homo sapiens
aaggactaatgaatagatgaat

SEQ ID NO: 9052037 - DNA, 22 bp, Homo sapiens
aaggactagattatacaatagg

SEQ ID NO: 9052038 - DNA, 22 bp, Homo sapiens
aaggactagatattcatacatg

SEQ ID NO: 9052039 - DNA, 22 bp, Homo sapiens
aaggaccagattatccttaata

SEQ ID NO: 9052040 - DNA, 22 bp, Homo sapiens
aaggagaaatggtagatgtgca

SEQ ID NO: 9052041 - DNA, 22 bp, Homo sapiens
aaatttaaaaagcagcattgca

SEQ ID NO: 9052042 - DNA, 22 bp, Homo sapiens
aaatttaaaaagcagcattgca

SEQ ID NO: 9052043 - DNA, 22 bp, Homo sapiens
aaatttaaggaggtgctcactt

SEQ ID NO: 9052044 - DNA, 22 bp, Homo sapiens
aaattgctagttgcttttttca

SEQ ID NO: 9052045 - DNA, 22 bp, Homo sapiens
aaattgctaaggatctcatgtg

SEQ ID NO: 9052046 - DNA, 22 bp, Homo sapiens
aaattgctaaattgtaagaggg

SEQ ID NO: 9052047 - DNA, 22 bp, Homo sapiens
aaggggagatgtcatgggccct

SEQ ID NO: 9052048 - DNA, 22 bp, Homo sapiens
aaggggagttagtgataaaacc

SEQ ID NO: 9052049 - DNA, 22 bp, Homo sapiens
aaggggaagagaccgcagagtc

SEQ ID NO: 9052050 - DNA, 22 bp, Homo sapiens
aaggggaagtagcaccagaggt

SEQ ID NO: 9052051 - DNA, 22 bp, Homo sapiens
aaggggaatagagtgggttgtg

SEQ ID NO: 9052052 - DNA, 22 bp, Homo sapiens
aagggagcggggagaccctatg

SEQ ID NO: 9052053 - DNA, 22 bp, Homo sapiens
aagggagcttaggagatcaggc

SEQ ID NO: 9052054 - DNA, 22 bp, Homo sapiens
aagggaggaggatttattgtac

SEQ ID NO: 9052055 - DNA, 22 bp, Homo sapiens
aagggagcaaatggacagacgg

SEQ ID NO: 9052056 - DNA, 22 bp, Homo sapiens
aagggagcaaatggacagacgg

SEQ ID NO: 9052057 - DNA, 22 bp, Homo sapiens
aagggagccaagaaagcagggc

SEQ ID NO: 9052058 - DNA, 22 bp, Homo sapiens
aacaatcaagtttctaaatgac

SEQ ID NO: 9052059 - DNA, 20 bp, Homo sapiens
aacaatctagaagctattct

SEQ ID NO: 9052060 - DNA, 20 bp, Homo sapiens
aacaatctagaagctattct

SEQ ID NO: 9052061 - DNA, 22 bp, Homo sapiens
aacaatgaccacacaatgtact

SEQ ID NO: 9052062 - DNA, 22 bp, Homo sapiens
aacaatctgttcgatagaaaat

SEQ ID NO: 9052063 - DNA, 22 bp, Homo sapiens
aacaatgaccacacaatgtact

SEQ ID NO: 9052064 - DNA, 22 bp, Homo sapiens
aacaatgaggatctgttctgag

SEQ ID NO: 9052065 - DNA, 22 bp, Homo sapiens
aacaatgagtcctctgaggtta

SEQ ID NO: 9052066 - DNA, 22 bp, Homo sapiens
aacaatgatatagggattggca

SEQ ID NO: 9052067 - DNA, 22 bp, Homo sapiens
aaggccactttaccttaaatcc

SEQ ID NO: 9052068 - DNA, 22 bp, Homo sapiens
aaatttcaagcaaagtagctat

SEQ ID NO: 9052069 - DNA, 22 bp, Homo sapiens
aaatttcagttacctttacgtt

SEQ ID NO: 9052070 - DNA, 22 bp, Homo sapiens
aaatttcagttacctttacgtt

SEQ ID NO: 9052071 - DNA, 22 bp, Homo sapiens
aaatttcagttggaatgagctc

SEQ ID NO: 9052072 - DNA, 19 bp, Homo sapiens
aacaagtaggaatggaaga

SEQ ID NO: 9052073 - DNA, 22 bp, Homo sapiens
aagatagcttggaaaagtacag

SEQ ID NO: 9052074 - DNA, 22 bp, Homo sapiens
aagatacatcaaagcaaattgg

SEQ ID NO: 9052075 - DNA, 22 bp, Homo sapiens
aagatttttttccacagactca

SEQ ID NO: 9052076 - DNA, 22 bp, Homo sapiens
aagattttctcaactgtatttg

SEQ ID NO: 9052077 - DNA, 22 bp, Homo sapiens
acagaagaccaagaaagcttcc

SEQ ID NO: 9052078 - DNA, 22 bp, Homo sapiens
acagaagcagccgtcacagata

SEQ ID NO: 9052079 - DNA, 22 bp, Homo sapiens
acagaagcaaagactcaggcaa

SEQ ID NO: 9052080 - DNA, 22 bp, Homo sapiens
aagcacagttcttagagttaca

SEQ ID NO: 9052081 - DNA, 22 bp, Homo sapiens
acagagctgtactacttactga

SEQ ID NO: 9052082 - DNA, 22 bp, Homo sapiens
acagagcttaggatgactccca

SEQ ID NO: 9052083 - DNA, 22 bp, Homo sapiens
aagcaaaaggttacacttctgg

SEQ ID NO: 9052084 - DNA, 22 bp, Homo sapiens
aagcaaaaggttacacttctgg

SEQ ID NO: 9052085 - DNA, 22 bp, Homo sapiens
acagatgaattttaattgtgtt

SEQ ID NO: 9052086 - DNA, 22 bp, Homo sapiens
acagatgaatttatggatggaa

SEQ ID NO: 9052087 - DNA, 23 bp, Homo sapiens
acagatgaaagtgtggctcagag

SEQ ID NO: 9052088 - DNA, 22 bp, Homo sapiens
acagatgaaaaagcttgtggat

SEQ ID NO: 9052089 - DNA, 23 bp, Homo sapiens
acacctgtgctgtagtcactaca

SEQ ID NO: 9052090 - DNA, 22 bp, Homo sapiens
acacggcactttaggaaggggc

SEQ ID NO: 9052091 - DNA, 22 bp, Homo sapiens
acactaaatgagtctacagtac

SEQ ID NO: 9052092 - DNA, 22 bp, Homo sapiens
acactacagggagaagactcac

SEQ ID NO: 9052093 - DNA, 22 bp, Homo sapiens
aagagtttaattttgtctagac

SEQ ID NO: 9052094 - DNA, 21 bp, Homo sapiens
aagagtggctgaggaggtgat

SEQ ID NO: 9052095 - DNA, 22 bp, Homo sapiens
acacacaggtaaaggagcctgg

SEQ ID NO: 9052096 - DNA, 22 bp, Homo sapiens
acacacatgcatgcttgccatt

SEQ ID NO: 9052097 - DNA, 22 bp, Homo sapiens
acacacagaaggaagccccact

SEQ ID NO: 9052098 - DNA, 22 bp, Homo sapiens
acacacagagtttatacaggca

SEQ ID NO: 9052099 - DNA, 22 bp, Homo sapiens
acacacagcgcctaccatgtgc

SEQ ID NO: 9052100 - DNA, 22 bp, Homo sapiens
aagaggaggattgatgtgggag

SEQ ID NO: 9052101 - DNA, 23 bp, Homo sapiens
aagaggaggccctgctcccgtcc

SEQ ID NO: 9052102 - DNA, 22 bp, Homo sapiens
aagaggagggcagattcaaggc

SEQ ID NO: 9052103 - DNA, 22 bp, Homo sapiens
aagaggagtagatgtggttggt

SEQ ID NO: 9052104 - DNA, 22 bp, Homo sapiens
acaactgttggaggaacacagg

SEQ ID NO: 9052105 - DNA, 23 bp, Homo sapiens
acaactttacagatacattttgt

SEQ ID NO: 9052106 - DNA, 22 bp, Homo sapiens
acaagaagagcatttgcagggt

SEQ ID NO: 9052107 - DNA, 22 bp, Homo sapiens
acaagaataaggataagagatt

SEQ ID NO: 9052108 - DNA, 22 bp, Homo sapiens
aagacaatcctggacagtcagc

SEQ ID NO: 9052109 - DNA, 22 bp, Homo sapiens
aagacaatgtttctgatagata

SEQ ID NO: 9052110 - DNA, 22 bp, Homo sapiens
acaactctcagttaaataaaga

SEQ ID NO: 9052111 - DNA, 22 bp, Homo sapiens
acaactgttagacacttctaag

SEQ ID NO: 9052112 - DNA, 22 bp, Homo sapiens
acaactgtcttcttcatgctcc

SEQ ID NO: 9052113 - DNA, 22 bp, Homo sapiens
acaactgtcagtaaagaatatt

SEQ ID NO: 9052114 - DNA, 22 bp, Homo sapiens
acaacaaaatcactagtcttcc

SEQ ID NO: 9052115 - DNA, 22 bp, Homo sapiens
aattagcatttcccatataaat

SEQ ID NO: 9052116 - DNA, 22 bp, Homo sapiens
aattcaaggatctgttaaatct

SEQ ID NO: 9052117 - DNA, 23 bp, Homo sapiens
aattcaaattcagtgtgactagg

SEQ ID NO: 9052118 - DNA, 22 bp, Homo sapiens
aagacaacagagatgacagact

SEQ ID NO: 9052119 - DNA, 22 bp, Homo sapiens
aagacaacagagatgacagact

SEQ ID NO: 9052120 - DNA, 17 bp, Homo sapiens
aagacaagacaaatgca

SEQ ID NO: 9052121 - DNA, 22 bp, Homo sapiens
aagacaagccttgtttttctgc

SEQ ID NO: 9052122 - DNA, 22 bp, Homo sapiens
aagaattggtttcctctgtcat

SEQ ID NO: 9052123 - DNA, 22 bp, Homo sapiens
aagaattatctgaaagctgtgt

SEQ ID NO: 9052124 - DNA, 22 bp, Homo sapiens
aagaattattgcaatactagat

SEQ ID NO: 9052125 - DNA, 22 bp, Homo sapiens
aattcaatggtttttaggatat

SEQ ID NO: 9052126 - DNA, 22 bp, Homo sapiens
aattcacaaaaccagattgctt

SEQ ID NO: 9052127 - DNA, 22 bp, Homo sapiens
aattcacaaaagttagatccat

SEQ ID NO: 9052128 - DNA, 22 bp, Homo sapiens
aagaatctgacataatttcctg

SEQ ID NO: 9052129 - DNA, 22 bp, Homo sapiens
aagaatctttccagttttgatg

SEQ ID NO: 9052130 - DNA, 22 bp, Homo sapiens
aactcttaattttcatgaaatg

SEQ ID NO: 9052131 - DNA, 20 bp, Homo sapiens
aatgtcttgagacatttcag

SEQ ID NO: 9052132 - DNA, 22 bp, Homo sapiens
aatgtctttctcataacagata

SEQ ID NO: 9052133 - DNA, 22 bp, Homo sapiens
aatgtctttaaagtgcaataga

SEQ ID NO: 9052134 - DNA, 22 bp, Homo sapiens
aatgttacacaggtataatcag

SEQ ID NO: 9052135 - DNA, 22 bp, Homo sapiens
aatgttacagttttaattctga

SEQ ID NO: 9052136 - DNA, 22 bp, Homo sapiens
aatgttaattcacagccaaata

SEQ ID NO: 9052137 - DNA, 22 bp, Homo sapiens
aatgtcttttaacctctggact

SEQ ID NO: 9052138 - DNA, 22 bp, Homo sapiens
aatgtctttctgttctatgaga

SEQ ID NO: 9052139 - DNA, 21 bp, Homo sapiens
aatgtctttgtccatgctctg

SEQ ID NO: 9052140 - DNA, 22 bp, Homo sapiens
aatgttatgtggttcaacttaa

SEQ ID NO: 9052141 - DNA, 22 bp, Homo sapiens
aatgttattacacttgtgaaat

SEQ ID NO: 9052142 - DNA, 22 bp, Homo sapiens
aactttatcggaacaggtactc

SEQ ID NO: 9052143 - DNA, 22 bp, Homo sapiens
aactttcagaatcctatgcatt

SEQ ID NO: 9052144 - DNA, 22 bp, Homo sapiens
aactttctctggatggcttcct

SEQ ID NO: 9052145 - DNA, 22 bp, Homo sapiens
agcatcttgaaatataaagtca

SEQ ID NO: 9052146 - DNA, 22 bp, Homo sapiens
agcatctgcatattgggagacc

SEQ ID NO: 9052147 - DNA, 22 bp, Homo sapiens
agcatcctgcttgctgtctgtg

SEQ ID NO: 9052148 - DNA, 22 bp, Homo sapiens
agcatcctgcctctcctcccaa

SEQ ID NO: 9052149 - DNA, 22 bp, Homo sapiens
agcattgcatagaaccacacac

SEQ ID NO: 9052150 - DNA, 22 bp, Homo sapiens
agcattgctaaagctaattttt

SEQ ID NO: 9052151 - DNA, 22 bp, Homo sapiens
agcatttaatcctacatagatc

SEQ ID NO: 9052152 - DNA, 22 bp, Homo sapiens
agcatttaagcttctgcaaagc

SEQ ID NO: 9052153 - DNA, 22 bp, Homo sapiens
agcatttaagggtggatacagg

SEQ ID NO: 9052154 - DNA, 22 bp, Homo sapiens
agcatttaagggtggatacagg

SEQ ID NO: 9052155 - DNA, 22 bp, Homo sapiens
agcatttaatcctacatagatc

SEQ ID NO: 9052156 - DNA, 22 bp, Homo sapiens
agccaggacagggcagctcgct

SEQ ID NO: 9052157 - DNA, 22 bp, Homo sapiens
agcccaggtctggcccagcctg

SEQ ID NO: 9052158 - DNA, 22 bp, Homo sapiens
acagacagtatggtggggctga

SEQ ID NO: 9052159 - DNA, 22 bp, Homo sapiens
acagacagtaaatagtgtggct

SEQ ID NO: 9052160 - DNA, 22 bp, Homo sapiens
acagaacaggctgagaaaaaca

SEQ ID NO: 9052161 - DNA, 22 bp, Homo sapiens
acagaacaggctgagaaaaaca

SEQ ID NO: 9052162 - DNA, 22 bp, Homo sapiens
acagaacatattgcttctctca

SEQ ID NO: 9052163 - DNA, 22 bp, Homo sapiens
agcctggcttaatcctcctttt

SEQ ID NO: 9052164 - DNA, 22 bp, Homo sapiens
agcctggctgtaacctcatggt

SEQ ID NO: 9052165 - DNA, 22 bp, Homo sapiens
agcctggctaaattctcccatg

SEQ ID NO: 9052166 - DNA, 22 bp, Homo sapiens
agcctggctgggaagagcctct

SEQ ID NO: 9052167 - DNA, 22 bp, Homo sapiens
agcctgtgtgctttggacaggg

SEQ ID NO: 9052168 - DNA, 22 bp, Homo sapiens
agccttacataaacagccttat

SEQ ID NO: 9052169 - DNA, 22 bp, Homo sapiens
agccctggggctggtgcttacc

SEQ ID NO: 9052170 - DNA, 22 bp, Homo sapiens
agcctggcctgggcaggcacat

SEQ ID NO: 9052171 - DNA, 22 bp, Homo sapiens
agcctggcggtcgtcggtcagg

SEQ ID NO: 9052172 - DNA, 22 bp, Homo sapiens
agcctggccctgctgaactctg

SEQ ID NO: 9052173 - DNA, 21 bp, Homo sapiens
agcctggcccagggggaggct

SEQ ID NO: 9052174 - DNA, 22 bp, Homo sapiens
agcctgctggaccaagctcatg

SEQ ID NO: 9052175 - DNA, 22 bp, Homo sapiens
agcctgcttccctttgtgcccc

SEQ ID NO: 9052176 - DNA, 22 bp, Homo sapiens
agcctggccaggcctgcccagg

SEQ ID NO: 9052177 - DNA, 22 bp, Homo sapiens
agcctggccaggcctgcccagg

SEQ ID NO: 9052178 - DNA, 22 bp, Homo sapiens
acacactggaggtaaatggggt

SEQ ID NO: 9052179 - DNA, 21 bp, Homo sapiens
acacactgagttttccactgt

SEQ ID NO: 9052180 - DNA, 21 bp, Homo sapiens
acacactctgagtcttctatt

SEQ ID NO: 9052181 - DNA, 22 bp, Homo sapiens
acacactcaattgcataagcac

SEQ ID NO: 9052182 - DNA, 22 bp, Homo sapiens
acacacatggtattgttcagaa

SEQ ID NO: 9052183 - DNA, 22 bp, Homo sapiens
agcactttcctggcaaatgtgg

SEQ ID NO: 9052184 - DNA, 22 bp, Homo sapiens
agcactttgggagataaagctg

SEQ ID NO: 9052185 - DNA, 22 bp, Homo sapiens
agcactttgggagataaagctg

SEQ ID NO: 9052186 - DNA, 22 bp, Homo sapiens
agcagaaaattggaaatgacaa

SEQ ID NO: 9052187 - DNA, 22 bp, Homo sapiens
acacacatgcctttcctaagta

SEQ ID NO: 9052188 - DNA, 22 bp, Homo sapiens
agatttctgtcaccttctatgc

SEQ ID NO: 9052189 - DNA, 22 bp, Homo sapiens
acacactggcccccagtactga

SEQ ID NO: 9052190 - DNA, 22 bp, Homo sapiens
acacactgggcatggtttatgc

SEQ ID NO: 9052191 - DNA, 22 bp, Homo sapiens
acacactttaaattaaacctct

SEQ ID NO: 9052192 - DNA, 22 bp, Homo sapiens
acacactgttgctcatccaggc

SEQ ID NO: 9052193 - DNA, 22 bp, Homo sapiens
acacactgtaaggactatcact

SEQ ID NO: 9052194 - DNA, 22 bp, Homo sapiens
agcagcagctcagttctcagct

SEQ ID NO: 9052195 - DNA, 22 bp, Homo sapiens
agcaggagggttttgtagagtc

SEQ ID NO: 9052196 - DNA, 21 bp, Homo sapiens
agcagccatggatggtatgta

SEQ ID NO: 9052197 - DNA, 22 bp, Homo sapiens
agcagctcttaacaaagcatgg

SEQ ID NO: 9052198 - DNA, 22 bp, Homo sapiens
agcagggctttgcagacttggg

SEQ ID NO: 9052199 - DNA, 22 bp, Homo sapiens
agataatgttctgatccatttc

SEQ ID NO: 9052200 - DNA, 22 bp, Homo sapiens
agagtaaagtacttggaatacc

SEQ ID NO: 9052201 - DNA, 22 bp, Homo sapiens
aattttgttcttggaaatcagg

SEQ ID NO: 9052202 - DNA, 22 bp, Homo sapiens
aattttgtttaagtgatctgct

SEQ ID NO: 9052203 - DNA, 22 bp, Homo sapiens
aattttgttttagtggaggctg

SEQ ID NO: 9052204 - DNA, 22 bp, Homo sapiens
acaaaaagctccattactgtcc

SEQ ID NO: 9052205 - DNA, 22 bp, Homo sapiens
agattagcttgtgtacaaaggt

SEQ ID NO: 9052206 - DNA, 22 bp, Homo sapiens
agattagcctaaaaatgtatag

SEQ ID NO: 9052207 - DNA, 22 bp, Homo sapiens
agattacaacatgggacgcata

SEQ ID NO: 9052208 - DNA, 22 bp, Homo sapiens
agattacaacatgggacgcata

SEQ ID NO: 9052209 - DNA, 22 bp, Homo sapiens
agattatttccagactaatgaa

SEQ ID NO: 9052210 - DNA, 22 bp, Homo sapiens
agatctggttggagtcctgaca

SEQ ID NO: 9052211 - DNA, 22 bp, Homo sapiens
agatcgttggtccatgccagtg

SEQ ID NO: 9052212 - DNA, 22 bp, Homo sapiens
agagggcataaaatagagcacg

SEQ ID NO: 9052213 - DNA, 22 bp, Homo sapiens
agagggcccatgttgggctgct

SEQ ID NO: 9052214 - DNA, 22 bp, Homo sapiens
agagggctaaggtttgggagat

SEQ ID NO: 9052215 - DNA, 22 bp, Homo sapiens
agagggctgcctcagtcagcta

SEQ ID NO: 9052216 - DNA, 22 bp, Homo sapiens
aatttcaaactaataggaacca

SEQ ID NO: 9052217 - DNA, 22 bp, Homo sapiens
aatttcaaagctcactggcata

SEQ ID NO: 9052218 - DNA, 22 bp, Homo sapiens
aatttattcccgtctctgggct

SEQ ID NO: 9052219 - DNA, 22 bp, Homo sapiens
aatttattatatcctaggggaa

SEQ ID NO: 9052220 - DNA, 22 bp, Homo sapiens
aatttatttcctgccagtacac

SEQ ID NO: 9052221 - DNA, 22 bp, Homo sapiens
aatttatatgtaattaggcaca

SEQ ID NO: 9052222 - DNA, 22 bp, Homo sapiens
aattcagtggtttctgcaacaa

SEQ ID NO: 9052223 - DNA, 22 bp, Homo sapiens
aattcagttgtgtctgacctcg

SEQ ID NO: 9052224 - DNA, 23 bp, Homo sapiens
agagaaagggataacacgttgaa

SEQ ID NO: 9052225 - DNA, 19 bp, Homo sapiens
agagaaagaattgagtcta

SEQ ID NO: 9052226 - DNA, 22 bp, Homo sapiens
agacactgatgttcagctcaat

SEQ ID NO: 9052227 - DNA, 22 bp, Homo sapiens
agacactgccacttctgttccc

SEQ ID NO: 9052228 - DNA, 22 bp, Homo sapiens
agagatctgtctactatttaag

SEQ ID NO: 9052229 - DNA, 22 bp, Homo sapiens
aatgtacactgaaagcctatca

SEQ ID NO: 9052230 - DNA, 22 bp, Homo sapiens
agaatttctggaagattgcaag

SEQ ID NO: 9052231 - DNA, 22 bp, Homo sapiens
aatgtataaagtgttaataact

SEQ ID NO: 9052232 - DNA, 22 bp, Homo sapiens
aatgtataaagtgttaataact

SEQ ID NO: 9052233 - DNA, 22 bp, Homo sapiens
aatgtactaataagcaacattt

SEQ ID NO: 9052234 - DNA, 22 bp, Homo sapiens
aatggagaccctaaggaagagg

SEQ ID NO: 9052235 - DNA, 22 bp, Homo sapiens
agaagtttgttatgtaaacaaa

SEQ ID NO: 9052236 - DNA, 22 bp, Homo sapiens
agaataaatgctacctatcaca

SEQ ID NO: 9052237 - DNA, 22 bp, Homo sapiens
agaataaatgctacctatcaca

SEQ ID NO: 9052238 - DNA, 22 bp, Homo sapiens
agaataaccagtgtttcacagt

SEQ ID NO: 9052239 - DNA, 22 bp, Homo sapiens
agaatcattatatttattaagc

SEQ ID NO: 9052240 - DNA, 22 bp, Homo sapiens
agaataatcactgaagttcaaa

SEQ ID NO: 9052241 - DNA, 22 bp, Homo sapiens
aatgctttttgcgaaatgtgca

SEQ ID NO: 9052242 - DNA, 22 bp, Homo sapiens
aatgcttttacgacatgtacct

SEQ ID NO: 9052243 - DNA, 22 bp, Homo sapiens
aatgctttgagggaagatgaaa

SEQ ID NO: 9052244 - DNA, 22 bp, Homo sapiens
aatgctttgagggaagatgaaa

SEQ ID NO: 9052245 - DNA, 22 bp, Homo sapiens
aatgctttgattgattaaaaca

SEQ ID NO: 9052246 - DNA, 22 bp, Homo sapiens
aatgaaacatatttaggaataa

SEQ ID NO: 9052247 - DNA, 22 bp, Homo sapiens
aatgaaaattggaccctagaac

SEQ ID NO: 9052248 - DNA, 22 bp, Homo sapiens
acattctcaaatatttgtggaa

SEQ ID NO: 9052249 - DNA, 22 bp, Homo sapiens
acattagaacattaatattggg

SEQ ID NO: 9052250 - DNA, 23 bp, Homo sapiens
acattacttagccagagtctcag

SEQ ID NO: 9052251 - DNA, 22 bp, Homo sapiens
acattagatgactctttctttc

SEQ ID NO: 9052252 - DNA, 22 bp, Homo sapiens
acattagagaagcttggagatg

SEQ ID NO: 9052253 - DNA, 21 bp, Homo sapiens
acattataattcatattccac

SEQ ID NO: 9052254 - DNA, 22 bp, Homo sapiens
acattatccctggcacaactgc

SEQ ID NO: 9052255 - DNA, 22 bp, Homo sapiens
acattatagttgctacagagta

SEQ ID NO: 9052256 - DNA, 22 bp, Homo sapiens
aaggccagctggagggatgagg

SEQ ID NO: 9052257 - DNA, 22 bp, Homo sapiens
acataagtgcacaataaatatt

SEQ ID NO: 9052258 - DNA, 22 bp, Homo sapiens
acataagttatggataaaatgt

SEQ ID NO: 9052259 - DNA, 18 bp, Homo sapiens
acatacattctgtctgca

SEQ ID NO: 9052260 - DNA, 22 bp, Homo sapiens
acataatgaaatgcagaaatca

SEQ ID NO: 9052261 - DNA, 22 bp, Homo sapiens
acataatggacaataatgcatc

SEQ ID NO: 9052262 - DNA, 22 bp, Homo sapiens
acataatgagctctttataaat

SEQ ID NO: 9052263 - DNA, 22 bp, Homo sapiens
acattcttaacagttaaaaact

SEQ ID NO: 9052264 - DNA, 22 bp, Homo sapiens
acattttgcccttatttgctga

SEQ ID NO: 9052265 - DNA, 22 bp, Homo sapiens
accacccagccagcttctccct

SEQ ID NO: 9052266 - DNA, 22 bp, Homo sapiens
accaccccaaatgaacctctgt

SEQ ID NO: 9052267 - DNA, 22 bp, Homo sapiens
accaccccagaatttttcaagg

SEQ ID NO: 9052268 - DNA, 22 bp, Homo sapiens
accaccccagaatttttcaagg

SEQ ID NO: 9052269 - DNA, 22 bp, Homo sapiens
accacccccttgggtgtggaag

SEQ ID NO: 9052270 - DNA, 22 bp, Homo sapiens
accagctgccttttcttagtag

SEQ ID NO: 9052271 - DNA, 22 bp, Homo sapiens
accagctgctgattgctaaatg

SEQ ID NO: 9052272 - DNA, 23 bp, Homo sapiens
accagctgccctgaactttgtgc

SEQ ID NO: 9052273 - DNA, 22 bp, Homo sapiens
accagctgcctggtctatctgc

SEQ ID NO: 9052274 - DNA, 22 bp, Homo sapiens
accagctgccaagggctacact

SEQ ID NO: 9052275 - DNA, 22 bp, Homo sapiens
accagctgatttaagaataaag

SEQ ID NO: 9052276 - DNA, 22 bp, Homo sapiens
accagctgagttctcggatggt

SEQ ID NO: 9052277 - DNA, 22 bp, Homo sapiens
aaggttagtaagtatcttatgt

SEQ ID NO: 9052278 - DNA, 22 bp, Homo sapiens
aaggtttaaggtctataaatgt

SEQ ID NO: 9052279 - DNA, 22 bp, Homo sapiens
aaggtttccagtgatattgtgg

SEQ ID NO: 9052280 - DNA, 22 bp, Homo sapiens
aaggtttctccgaggctatttt

SEQ ID NO: 9052281 - DNA, 22 bp, Homo sapiens
accagctggtcacctgggcact

SEQ ID NO: 9052282 - DNA, 22 bp, Homo sapiens
accagctggcccatgagcacgt

SEQ ID NO: 9052283 - DNA, 22 bp, Homo sapiens
accagctgtgtcctggctgcag

SEQ ID NO: 9052284 - DNA, 22 bp, Homo sapiens
accagctggtcagttgaagatt

SEQ ID NO: 9052285 - DNA, 22 bp, Homo sapiens
accagctggtcagggcttttct

SEQ ID NO: 9052286 - DNA, 22 bp, Homo sapiens
accaggagttttgaccaggggc

SEQ ID NO: 9052287 - DNA, 22 bp, Homo sapiens
accagctgttatctgtagtatc

SEQ ID NO: 9052288 - DNA, 22 bp, Homo sapiens
accagctgtgtgacctgaggca

SEQ ID NO: 9052289 - DNA, 22 bp, Homo sapiens
accagctgttaggcttggtgct

SEQ ID NO: 9052290 - DNA, 22 bp, Homo sapiens
accagctgtgtgacttttaatg

SEQ ID NO: 9052291 - DNA, 22 bp, Homo sapiens
acagatttttggtaaataattt

SEQ ID NO: 9052292 - DNA, 22 bp, Homo sapiens
acagatgaggaaacagggtcag

SEQ ID NO: 9052293 - DNA, 20 bp, Homo sapiens
acagatgaggaaaatgaagt

SEQ ID NO: 9052294 - DNA, 22 bp, Homo sapiens
acagcttttgaaaaattactgg

SEQ ID NO: 9052295 - DNA, 20 bp, Homo sapiens
acaggagatctgaggaaagg

SEQ ID NO: 9052296 - DNA, 22 bp, Homo sapiens
acaggcagagaactcagccaga

SEQ ID NO: 9052297 - DNA, 23 bp, Homo sapiens
acagggcttatctgtcactcatc

SEQ ID NO: 9052298 - DNA, 22 bp, Homo sapiens
acaggtcctcaagtcagctggg

SEQ ID NO: 9052299 - DNA, 22 bp, Homo sapiens
acaggtgaggggttctaggctg

SEQ ID NO: 9052300 - DNA, 22 bp, Homo sapiens
acaggtgattcaggctctggga

SEQ ID NO: 9052301 - DNA, 22 bp, Homo sapiens
acagtgtcatcagtttctcaac

SEQ ID NO: 9052302 - DNA, 22 bp, Homo sapiens
actgagaactcaagagaaaagg

SEQ ID NO: 9052303 - DNA, 22 bp, Homo sapiens
actgagaacttgccaaggactg

SEQ ID NO: 9052304 - DNA, 22 bp, Homo sapiens
actgagaaatttccagacttgc

SEQ ID NO: 9052305 - DNA, 22 bp, Homo sapiens
aagttttattggaacatagcca

SEQ ID NO: 9052306 - DNA, 22 bp, Homo sapiens
aataaagcatgaggcatttatc

SEQ ID NO: 9052307 - DNA, 22 bp, Homo sapiens
aataaagcagggtccttgcact

SEQ ID NO: 9052308 - DNA, 18 bp, Homo sapiens
aataaagcaggatttctc

SEQ ID NO: 9052309 - DNA, 20 bp, Homo sapiens
aataaagcaacgagcgagct

SEQ ID NO: 9052310 - DNA, 22 bp, Homo sapiens
aataaagcacttgggttggtaa

SEQ ID NO: 9052311 - DNA, 22 bp, Homo sapiens
aataaagcctgtctctttagag

SEQ ID NO: 9052312 - DNA, 22 bp, Homo sapiens
aataaagtagcgtttaaggtgc

SEQ ID NO: 9052313 - DNA, 22 bp, Homo sapiens
aataacagaaacttgagcatca

SEQ ID NO: 9052314 - DNA, 22 bp, Homo sapiens
aataacagagtcttcaagatag

SEQ ID NO: 9052315 - DNA, 22 bp, Homo sapiens
actcagtgggcttgatgtcgaa

SEQ ID NO: 9052316 - DNA, 22 bp, Homo sapiens
actcagtggcactttggaattt

SEQ ID NO: 9052317 - DNA, 23 bp, Homo sapiens
actcagtgaagcaaacagatagt

SEQ ID NO: 9052318 - DNA, 23 bp, Homo sapiens
actcagtgagggccttgggctgc

SEQ ID NO: 9052319 - DNA, 22 bp, Homo sapiens
actcagtgaattttcatcaaat

SEQ ID NO: 9052320 - DNA, 22 bp, Homo sapiens
aagtttgttcattcattcatcc

SEQ ID NO: 9052321 - DNA, 22 bp, Homo sapiens
aagtggggcctggtggtacagt

SEQ ID NO: 9052322 - DNA, 22 bp, Homo sapiens
aagtaacacggaacttgaagca

SEQ ID NO: 9052323 - DNA, 18 bp, Homo sapiens
aagtaacagaagagcaca

SEQ ID NO: 9052324 - DNA, 22 bp, Homo sapiens
aagtaaaattcaatcttcactg

SEQ ID NO: 9052325 - DNA, 22 bp, Homo sapiens
aagtaaaccacagagaagccac

SEQ ID NO: 9052326 - DNA, 22 bp, Homo sapiens
aagtaaatatctgtttatagca

SEQ ID NO: 9052327 - DNA, 22 bp, Homo sapiens
aagtaaatgttggagctcaaat

SEQ ID NO: 9052328 - DNA, 20 bp, Homo sapiens
accttgatattatatgcagt

SEQ ID NO: 9052329 - DNA, 22 bp, Homo sapiens
acctttatagctgattatgaca

SEQ ID NO: 9052330 - DNA, 22 bp, Homo sapiens
aagtgaggtttctgctttcaga

SEQ ID NO: 9052331 - DNA, 22 bp, Homo sapiens
aagtgactatttgagtacatca

SEQ ID NO: 9052332 - DNA, 22 bp, Homo sapiens
aagtgatgctacgactttgaca

SEQ ID NO: 9052333 - DNA, 22 bp, Homo sapiens
aatcttgagtgttactctcatt

SEQ ID NO: 9052334 - DNA, 22 bp, Homo sapiens
aatcttgagggactcatgaggt

SEQ ID NO: 9052335 - DNA, 22 bp, Homo sapiens
aatctttttcacaagaaagcac

SEQ ID NO: 9052336 - DNA, 22 bp, Homo sapiens
aatctttcattcattcatacat

SEQ ID NO: 9052337 - DNA, 22 bp, Homo sapiens
aatcttaagctgaattctctcc

SEQ ID NO: 9052338 - DNA, 22 bp, Homo sapiens
aatcttacttatgatttttcgg

SEQ ID NO: 9052339 - DNA, 22 bp, Homo sapiens
agaaactatcctgagtagcaaa

SEQ ID NO: 9052340 - DNA, 22 bp, Homo sapiens
aatctatatgcttttcacatac

SEQ ID NO: 9052341 - DNA, 22 bp, Homo sapiens
aatcttaaagaatattctacca

SEQ ID NO: 9052342 - DNA, 20 bp, Homo sapiens
aatatgctgggagtttatat

SEQ ID NO: 9052343 - DNA, 22 bp, Homo sapiens
aatatgtttataagatatcttc

SEQ ID NO: 9052344 - DNA, 22 bp, Homo sapiens
aatatgttgagtctatctttat

SEQ ID NO: 9052345 - DNA, 22 bp, Homo sapiens
agaaaccatctttatatatctg

SEQ ID NO: 9052346 - DNA, 23 bp, Homo sapiens
agaaaccactgaagagatccagt

SEQ ID NO: 9052347 - DNA, 20 bp, Homo sapiens
agaaacatttcttgagaact

SEQ ID NO: 9052348 - DNA, 22 bp, Homo sapiens
agaaaataatttcttggctggt

SEQ ID NO: 9052349 - DNA, 22 bp, Homo sapiens
agaaaataatttcttggctggt

SEQ ID NO: 9052350 - DNA, 22 bp, Homo sapiens
aatactgtctttcacagatatt

SEQ ID NO: 9052351 - DNA, 17 bp, Homo sapiens
aatacttccaactagtg

SEQ ID NO: 9052352 - DNA, 22 bp, Homo sapiens
aataactggcacatatcacata

SEQ ID NO: 9052353 - DNA, 22 bp, Homo sapiens
aataacagggttgatttgcaat

SEQ ID NO: 9052354 - DNA, 22 bp, Homo sapiens
aataacagtgccatgaaattga

SEQ ID NO: 9052355 - DNA, 22 bp, Homo sapiens
aataacaggctcatcagatgct

SEQ ID NO: 9052356 - DNA, 22 bp, Homo sapiens
acttcctgcaatcgtccactcc

SEQ ID NO: 9052357 - DNA, 22 bp, Homo sapiens
acttatgtagtacctcttatgt

SEQ ID NO: 9052358 - DNA, 22 bp, Homo sapiens
acttatatttgctttatgcttc

SEQ ID NO: 9052359 - DNA, 22 bp, Homo sapiens
acttatttcatggatcataatg

SEQ ID NO: 9052360 - DNA, 22 bp, Homo sapiens
acttataggccaagtagactgt

SEQ ID NO: 9052361 - DNA, 22 bp, Homo sapiens
gcccatccatggggtcatggcc

SEQ ID NO: 9052362 - DNA, 22 bp, Homo sapiens
gcctagagagggagtgccacac

SEQ ID NO: 9052363 - DNA, 22 bp, Homo sapiens
gccctgagaatgtgtgtgtcta

SEQ ID NO: 9052364 - DNA, 22 bp, Homo sapiens
gccaggttgctgacgacgatct

SEQ ID NO: 9052365 - DNA, 22 bp, Homo sapiens
gccaggagaatgctagcagagg

SEQ ID NO: 9052366 - DNA, 22 bp, Homo sapiens
gccaggtggctgagtgactgag

SEQ ID NO: 9052367 - DNA, 22 bp, Homo sapiens
gccaggtgggagacagacagca

SEQ ID NO: 9052368 - DNA, 22 bp, Homo sapiens
gccaggtctaagcatcagccac

SEQ ID NO: 9052369 - DNA, 22 bp, Homo sapiens
gccaggtgtagtggccacacct

SEQ ID NO: 9052370 - DNA, 22 bp, Homo sapiens
gccaggtgtcctcacagtgagg

SEQ ID NO: 9052371 - DNA, 22 bp, Homo sapiens
gccaggtggtctggctccagag

SEQ ID NO: 9052372 - DNA, 22 bp, Homo sapiens
gcattttataaagagttatttg

SEQ ID NO: 9052373 - DNA, 22 bp, Homo sapiens
gcatttttctaatcattggcat

SEQ ID NO: 9052374 - DNA, 22 bp, Homo sapiens
gcattttaatgaggtttatgag

SEQ ID NO: 9052375 - DNA, 22 bp, Homo sapiens
gcattttaataagattcatagg

SEQ ID NO: 9052376 - DNA, 22 bp, Homo sapiens
gccagcagtcctgctgtgtgcc

SEQ ID NO: 9052377 - DNA, 22 bp, Homo sapiens
gccagcccattaacccctgtcc

SEQ ID NO: 9052378 - DNA, 22 bp, Homo sapiens
gccagcccagctccaggggaaa

SEQ ID NO: 9052379 - DNA, 22 bp, Homo sapiens
gccagcccagctccaggggaaa

SEQ ID NO: 9052380 - DNA, 22 bp, Homo sapiens
gccagcccctccatcctgttca

SEQ ID NO: 9052381 - DNA, 22 bp, Homo sapiens
gccagaggcccaaggacagctg

SEQ ID NO: 9052382 - DNA, 22 bp, Homo sapiens
gcatttctgtgcatacacatga

SEQ ID NO: 9052383 - DNA, 22 bp, Homo sapiens
gcatttctgtgcatacacatga

SEQ ID NO: 9052384 - DNA, 22 bp, Homo sapiens
gcagggctcattgccaggcatt

SEQ ID NO: 9052385 - DNA, 22 bp, Homo sapiens
gcagggctccactgtggccaag

SEQ ID NO: 9052386 - DNA, 22 bp, Homo sapiens
gcagggctcagccgctcccacc

SEQ ID NO: 9052387 - DNA, 22 bp, Homo sapiens
gcagggctattggaaggagatg

SEQ ID NO: 9052388 - DNA, 17 bp, Homo sapiens
gcagtatgatcctctgg

SEQ ID NO: 9052389 - DNA, 19 bp, Homo sapiens
gcagggctctcccagatgc

SEQ ID NO: 9052390 - DNA, 22 bp, Homo sapiens
gcagggctccccaggcccgagg

SEQ ID NO: 9052391 - DNA, 22 bp, Homo sapiens
gcagtcctagggtgctctgcag

SEQ ID NO: 9052392 - DNA, 22 bp, Homo sapiens
gcagtcctcctgcctcagcctc

SEQ ID NO: 9052393 - DNA, 22 bp, Homo sapiens
gcagtcctagggtgctctgcag

SEQ ID NO: 9052394 - DNA, 22 bp, Homo sapiens
gcagtcctctcattggcctcct

SEQ ID NO: 9052395 - DNA, 22 bp, Homo sapiens
gcaggctgatgactggagttgg

SEQ ID NO: 9052396 - DNA, 22 bp, Homo sapiens
gcaggctcaaaagctggtagga

SEQ ID NO: 9052397 - DNA, 22 bp, Homo sapiens
gcaggctccaactggaggagtt

SEQ ID NO: 9052398 - DNA, 22 bp, Homo sapiens
gcaggagtggagaccatgggga

SEQ ID NO: 9052399 - DNA, 22 bp, Homo sapiens
gcagcaggaatttaaatttata

SEQ ID NO: 9052400 - DNA, 22 bp, Homo sapiens
gcagcaggatggccaattgcca

SEQ ID NO: 9052401 - DNA, 22 bp, Homo sapiens
gcagctgccccgactgtgagtc

SEQ ID NO: 9052402 - DNA, 22 bp, Homo sapiens
gcagctgcagaccctcagtgct

SEQ ID NO: 9052403 - DNA, 22 bp, Homo sapiens
gcagcatgttgaaagggccaca

SEQ ID NO: 9052404 - DNA, 22 bp, Homo sapiens
gcacttaactggaaaagaattt

SEQ ID NO: 9052405 - DNA, 22 bp, Homo sapiens
gcagagctgcagcgaggcctgg

SEQ ID NO: 9052406 - DNA, 22 bp, Homo sapiens
gcactgctatttagctccatca

SEQ ID NO: 9052407 - DNA, 22 bp, Homo sapiens
gaggggtcctgccttggctgga

SEQ ID NO: 9052408 - DNA, 22 bp, Homo sapiens
gaggggtccaggaggcacttac

SEQ ID NO: 9052409 - DNA, 22 bp, Homo sapiens
gagggtccctgctcagggccag

SEQ ID NO: 9052410 - DNA, 22 bp, Homo sapiens
gagggtccccatgcagagctca

SEQ ID NO: 9052411 - DNA, 22 bp, Homo sapiens
gcaagaaaagagccttcagtgg

SEQ ID NO: 9052412 - DNA, 20 bp, Homo sapiens
gcaagcatgaagagtagaga

SEQ ID NO: 9052413 - DNA, 22 bp, Homo sapiens
gcttcctcaccttctcttgcat

SEQ ID NO: 9052414 - DNA, 22 bp, Homo sapiens
gcttcctagcattagccattgc

SEQ ID NO: 9052415 - DNA, 22 bp, Homo sapiens
gcttcctccctgctgctcacta

SEQ ID NO: 9052416 - DNA, 22 bp, Homo sapiens
gcttcctccctgctgctcacta

SEQ ID NO: 9052417 - DNA, 22 bp, Homo sapiens
gcttcctgagaaacaatctgat

SEQ ID NO: 9052418 - DNA, 23 bp, Homo sapiens
ggacacatttatttcagaattca

SEQ ID NO: 9052419 - DNA, 22 bp, Homo sapiens
ggacacttagcctcagtttgct

SEQ ID NO: 9052420 - DNA, 22 bp, Homo sapiens
ggacacttggtggcccattgtg

SEQ ID NO: 9052421 - DNA, 22 bp, Homo sapiens
ggacactttgagttgaaggggt

SEQ ID NO: 9052422 - DNA, 22 bp, Homo sapiens
ggacacttgtttggttaggcct

SEQ ID NO: 9052423 - DNA, 22 bp, Homo sapiens
ggacggggagctggaaagggga

SEQ ID NO: 9052424 - DNA, 22 bp, Homo sapiens
ggactatgcagaatatgacagt

SEQ ID NO: 9052425 - DNA, 22 bp, Homo sapiens
ggactgagctgacatctgttgg

SEQ ID NO: 9052426 - DNA, 22 bp, Homo sapiens
gctggctgcacaggggctcact

SEQ ID NO: 9052427 - DNA, 22 bp, Homo sapiens
gctggattggagcaatagagtc

SEQ ID NO: 9052428 - DNA, 22 bp, Homo sapiens
gctggcagacttcctctggaac

SEQ ID NO: 9052429 - DNA, 22 bp, Homo sapiens
gctgtgaacatgcacatggagt

SEQ ID NO: 9052430 - DNA, 22 bp, Homo sapiens
gctgtgaagaacctagtgaacc

SEQ ID NO: 9052431 - DNA, 22 bp, Homo sapiens
gctgtgaaacctcagtgatagt

SEQ ID NO: 9052432 - DNA, 22 bp, Homo sapiens
gctgtctttcccctgctccaga

SEQ ID NO: 9052433 - DNA, 22 bp, Homo sapiens
gctgtcttgctcactcttgcag

SEQ ID NO: 9052434 - DNA, 22 bp, Homo sapiens
gctgtgaagaggccactgcatg

SEQ ID NO: 9052435 - DNA, 22 bp, Homo sapiens
gctgtgaatctgaagactaaaa

SEQ ID NO: 9052436 - DNA, 22 bp, Homo sapiens
gctgtgaattattcttaactgg

SEQ ID NO: 9052437 - DNA, 20 bp, Homo sapiens
gctgggggtgtgctgagtga

SEQ ID NO: 9052438 - DNA, 22 bp, Homo sapiens
gctcctggtgcaaagtttcttc

SEQ ID NO: 9052439 - DNA, 22 bp, Homo sapiens
gctctatggctgctgggagtcc

SEQ ID NO: 9052440 - DNA, 22 bp, Homo sapiens
gctctatgtcgaaagccagtta

SEQ ID NO: 9052441 - DNA, 22 bp, Homo sapiens
gctctatgggcacagccagtgt

SEQ ID NO: 9052442 - DNA, 22 bp, Homo sapiens
gctctatggtgagtgtctgtga

SEQ ID NO: 9052443 - DNA, 22 bp, Homo sapiens
gctctatgcatgggagcaggag

SEQ ID NO: 9052444 - DNA, 23 bp, Homo sapiens
gctctatgtgttatagctgtttt

SEQ ID NO: 9052445 - DNA, 22 bp, Homo sapiens
gctctatgttgaccttcagtgg

SEQ ID NO: 9052446 - DNA, 22 bp, Homo sapiens
gctctatgagtttctcagttta

SEQ ID NO: 9052447 - DNA, 22 bp, Homo sapiens
gctctcagatgctccagcagcc

SEQ ID NO: 9052448 - DNA, 18 bp, Homo sapiens
gctcctggttggaaagaa

SEQ ID NO: 9052449 - DNA, 22 bp, Homo sapiens
gctgaagacctccctctccatg

SEQ ID NO: 9052450 - DNA, 22 bp, Homo sapiens
gctgaagagacttctgttcgaa

SEQ ID NO: 9052451 - DNA, 22 bp, Homo sapiens
gctgaagagcaaggctgggtct

SEQ ID NO: 9052452 - DNA, 22 bp, Homo sapiens
gctgaagataagtgaagaggct

SEQ ID NO: 9052453 - DNA, 23 bp, Homo sapiens
gctgaagagcaaaccaggcaaaa

SEQ ID NO: 9052454 - DNA, 22 bp, Homo sapiens
gctgaagagaggccttgagcac

SEQ ID NO: 9052455 - DNA, 22 bp, Homo sapiens
gctgaagagagatgcgtccagc

SEQ ID NO: 9052456 - DNA, 21 bp, Homo sapiens
gctgcaaattctaacaattat

SEQ ID NO: 9052457 - DNA, 22 bp, Homo sapiens
gctgcaaacctgccacctggtg

SEQ ID NO: 9052458 - DNA, 22 bp, Homo sapiens
gctgaagctgacacatagtgct

SEQ ID NO: 9052459 - DNA, 22 bp, Homo sapiens
gctgaagatttttgctagcccc

SEQ ID NO: 9052460 - DNA, 22 bp, Homo sapiens
gctgaagataggcatttcagca

SEQ ID NO: 9052461 - DNA, 20 bp, Homo sapiens
gctgaagattcccatgcaag

SEQ ID NO: 9052462 - DNA, 22 bp, Homo sapiens
gctgaagatgcatcccttctct

SEQ ID NO: 9052463 - DNA, 22 bp, Homo sapiens
gctgccagcccagcaaggtgtg

SEQ ID NO: 9052464 - DNA, 22 bp, Homo sapiens
gctgccagctttccttggctga

SEQ ID NO: 9052465 - DNA, 22 bp, Homo sapiens
gctgcagacctcatgcaggtgg

SEQ ID NO: 9052466 - DNA, 22 bp, Homo sapiens
gctgcaggagctggagctgtgg

SEQ ID NO: 9052467 - DNA, 22 bp, Homo sapiens
gctgcaggagattttgagagtc

SEQ ID NO: 9052468 - DNA, 22 bp, Homo sapiens
gctgcagggggtgggcgtctcc

SEQ ID NO: 9052469 - DNA, 22 bp, Homo sapiens
gctgcaggatgaggctctgctc

SEQ ID NO: 9052470 - DNA, 22 bp, Homo sapiens
gctgcaggttgggcaacagagt

SEQ ID NO: 9052471 - DNA, 22 bp, Homo sapiens
gcctggggtctctgactcacag

SEQ ID NO: 9052472 - DNA, 22 bp, Homo sapiens
gcctggctggtcactgcctggc

SEQ ID NO: 9052473 - DNA, 19 bp, Homo sapiens
gcctggctgggatgagccc

SEQ ID NO: 9052474 - DNA, 22 bp, Homo sapiens
gcctggctgggctgaatgctta

SEQ ID NO: 9052475 - DNA, 22 bp, Homo sapiens
gcctggctagttagtgtcaggt

SEQ ID NO: 9052476 - DNA, 22 bp, Homo sapiens
gcctggctgctggttctgagga

SEQ ID NO: 9052477 - DNA, 22 bp, Homo sapiens
gcctggctaagcagaaggaccc

SEQ ID NO: 9052478 - DNA, 22 bp, Homo sapiens
gcggctccgaagccaggccgcg

SEQ ID NO: 9052479 - DNA, 22 bp, Homo sapiens
gcggaaggctgcctggcttgag

SEQ ID NO: 9052480 - DNA, 22 bp, Homo sapiens
gcggcaggagtaaaggaggaag

SEQ ID NO: 9052481 - DNA, 22 bp, Homo sapiens
gcgagaaactaagtgccctttg

SEQ ID NO: 9052482 - DNA, 22 bp, Homo sapiens
gcggggcacagtgatggagcac

SEQ ID NO: 9052483 - DNA, 22 bp, Homo sapiens
gctcaagccttctgcccacctc

SEQ ID NO: 9052484 - DNA, 22 bp, Homo sapiens
gctcaccactgctagagtctat

SEQ ID NO: 9052485 - DNA, 22 bp, Homo sapiens
gggagggaggtgatgcttggct

SEQ ID NO: 9052486 - DNA, 22 bp, Homo sapiens
gggagggaggtgctggttcacg

SEQ ID NO: 9052487 - DNA, 22 bp, Homo sapiens
gggagctggagctggaagactc

SEQ ID NO: 9052488 - DNA, 22 bp, Homo sapiens
gggagctggatgattgaggcaa

SEQ ID NO: 9052489 - DNA, 22 bp, Homo sapiens
gggagggacacaaagagttccc

SEQ ID NO: 9052490 - DNA, 22 bp, Homo sapiens
gggaggtgttccagtgttggta

SEQ ID NO: 9052491 - DNA, 22 bp, Homo sapiens
ggctttattttgcatgaatgct

SEQ ID NO: 9052492 - DNA, 22 bp, Homo sapiens
ggctttatttcactgtaccata

SEQ ID NO: 9052493 - DNA, 22 bp, Homo sapiens
ggctttatttgcagccattgtt

SEQ ID NO: 9052494 - DNA, 22 bp, Homo sapiens
ggctttattatgtggccatgtg

SEQ ID NO: 9052495 - DNA, 22 bp, Homo sapiens
ggctttattaactcatccgtaa

SEQ ID NO: 9052496 - DNA, 22 bp, Homo sapiens
ggctttattaagcagggtaagt

SEQ ID NO: 9052497 - DNA, 22 bp, Homo sapiens
ggctttatgtttttcatgtggt

SEQ ID NO: 9052498 - DNA, 21 bp, Homo sapiens
ggctttatgctcacccagcct

SEQ ID NO: 9052499 - DNA, 22 bp, Homo sapiens
ggctttatagggtagaggatca

SEQ ID NO: 9052500 - DNA, 22 bp, Homo sapiens
ggctttatcaaatgagaccctg

SEQ ID NO: 9052501 - DNA, 22 bp, Homo sapiens
ggctttatattgtttgagcaga

SEQ ID NO: 9052502 - DNA, 22 bp, Homo sapiens
ggctttatgcacagcagatggt

SEQ ID NO: 9052503 - DNA, 22 bp, Homo sapiens
ggctttatgcagggatagaaat

SEQ ID NO: 9052504 - DNA, 22 bp, Homo sapiens
gggaagtttgtttggactggga

SEQ ID NO: 9052505 - DNA, 22 bp, Homo sapiens
gggaatatggaagtggacactt

SEQ ID NO: 9052506 - DNA, 17 bp, Homo sapiens
gggaagtggagaaagct

SEQ ID NO: 9052507 - DNA, 22 bp, Homo sapiens
gggaagtgtgcagagttctctt

SEQ ID NO: 9052508 - DNA, 22 bp, Homo sapiens
gggagctgagctggaagagaat

SEQ ID NO: 9052509 - DNA, 22 bp, Homo sapiens
ggctagaataattgacttcatt

SEQ ID NO: 9052510 - DNA, 22 bp, Homo sapiens
ggctagaagtcagaggtcaaga

SEQ ID NO: 9052511 - DNA, 19 bp, Homo sapiens
ggctaatgtctttgaaata

SEQ ID NO: 9052512 - DNA, 22 bp, Homo sapiens
ggctccagggagtggagagaag

SEQ ID NO: 9052513 - DNA, 22 bp, Homo sapiens
ggctccaggctcctatttcact

SEQ ID NO: 9052514 - DNA, 22 bp, Homo sapiens
ggctctgtttactttcagaggc

SEQ ID NO: 9052515 - DNA, 22 bp, Homo sapiens
ggctccctgggtgctcctgctc

SEQ ID NO: 9052516 - DNA, 22 bp, Homo sapiens
ggctggaagtccaagatcaagg

SEQ ID NO: 9052517 - DNA, 22 bp, Homo sapiens
ggctggaagtccaagatcaaga

SEQ ID NO: 9052518 - DNA, 22 bp, Homo sapiens
ggctggaaggtagaagatgagg

SEQ ID NO: 9052519 - DNA, 22 bp, Homo sapiens
ggctggaaaagacaaagctatt

SEQ ID NO: 9052520 - DNA, 23 bp, Homo sapiens
ggctggaagaaaacagaattgtt

SEQ ID NO: 9052521 - DNA, 21 bp, Homo sapiens
ggccctggttacgcctcctct

SEQ ID NO: 9052522 - DNA, 22 bp, Homo sapiens
ggcctagttttttctggtaggt

SEQ ID NO: 9052523 - DNA, 22 bp, Homo sapiens
ggccctgggatgctcagcagtg

SEQ ID NO: 9052524 - DNA, 22 bp, Homo sapiens
ggccctgggccctctagcttgt

SEQ ID NO: 9052525 - DNA, 22 bp, Homo sapiens
ggccctgggcagaggagtgggc

SEQ ID NO: 9052526 - DNA, 22 bp, Homo sapiens
ggccctggtcctaggggtggaa

SEQ ID NO: 9052527 - DNA, 19 bp, Homo sapiens
ggcctggctatccctgctg

SEQ ID NO: 9052528 - DNA, 19 bp, Homo sapiens
ggcctggatttagggctcc

SEQ ID NO: 9052529 - DNA, 22 bp, Homo sapiens
ggcctggcctccagatgtgggc

SEQ ID NO: 9052530 - DNA, 22 bp, Homo sapiens
ggccagcttctctgctgcctgt

SEQ ID NO: 9052531 - DNA, 22 bp, Homo sapiens
ggccagctttgagctgcaggaa

SEQ ID NO: 9052532 - DNA, 22 bp, Homo sapiens
ggccagctgtaagctgctgaat

SEQ ID NO: 9052533 - DNA, 22 bp, Homo sapiens
ggcagtgggttccccaaggcac

SEQ ID NO: 9052534 - DNA, 22 bp, Homo sapiens
ggcaggggttcattttgtctta

SEQ ID NO: 9052535 - DNA, 22 bp, Homo sapiens
ggcaggggtggccttcctttgg

SEQ ID NO: 9052536 - DNA, 22 bp, Homo sapiens
ggcaggggtgaggccactctga

SEQ ID NO: 9052537 - DNA, 18 bp, Homo sapiens
ggcaggagcaagaatagg

SEQ ID NO: 9052538 - DNA, 18 bp, Homo sapiens
ggcaggggtgaaccacag

SEQ ID NO: 9052539 - DNA, 22 bp, Homo sapiens
ggcacttttctccccggtcatg

SEQ ID NO: 9052540 - DNA, 22 bp, Homo sapiens
ggcagcagcaaggttggagctg

SEQ ID NO: 9052541 - DNA, 22 bp, Homo sapiens
ggcactgccccctgcccaggac

SEQ ID NO: 9052542 - DNA, 22 bp, Homo sapiens
ggcactttgattttgagatgca

SEQ ID NO: 9052543 - DNA, 22 bp, Homo sapiens
ggcactttgcctttatgcactg

SEQ ID NO: 9052544 - DNA, 22 bp, Homo sapiens
ggcagctgttggctctctagga

SEQ ID NO: 9052545 - DNA, 23 bp, Homo sapiens
ggatggagccactttgaaaccac

SEQ ID NO: 9052546 - DNA, 22 bp, Homo sapiens
ggatggaggttctcagatgctc

SEQ ID NO: 9052547 - DNA, 22 bp, Homo sapiens
ggatgaggtagatgaacaaggg

SEQ ID NO: 9052548 - DNA, 22 bp, Homo sapiens
ggatctggggtagagcagtggg

SEQ ID NO: 9052549 - DNA, 22 bp, Homo sapiens
ggagcaagaggtggtgaaaaat

SEQ ID NO: 9052550 - DNA, 22 bp, Homo sapiens
ggagcaaatgccaagtgggagg

SEQ ID NO: 9052551 - DNA, 22 bp, Homo sapiens
ggagcaccctgctcagccaagc

SEQ ID NO: 9052552 - DNA, 22 bp, Homo sapiens
gggctccagccagctccttgtg

SEQ ID NO: 9052553 - DNA, 22 bp, Homo sapiens
gggctccagcagaggcagccgg

SEQ ID NO: 9052554 - DNA, 22 bp, Homo sapiens
gggctccagcagaggcagccgg

SEQ ID NO: 9052555 - DNA, 22 bp, Homo sapiens
gggctccagccactggctgagg

SEQ ID NO: 9052556 - DNA, 22 bp, Homo sapiens
gggctccagccaggtgtcccca

SEQ ID NO: 9052557 - DNA, 22 bp, Homo sapiens
gggctccagcccgggaccaggt

SEQ ID NO: 9052558 - DNA, 22 bp, Homo sapiens
gggctccagcccgggaccaggt

SEQ ID NO: 9052559 - DNA, 22 bp, Homo sapiens
gggctccacagcagtgagtgga

SEQ ID NO: 9052560 - DNA, 22 bp, Homo sapiens
gggctccacgcacgcgagaggt

SEQ ID NO: 9052561 - DNA, 22 bp, Homo sapiens
gggctccacctagggacactgg

SEQ ID NO: 9052562 - DNA, 22 bp, Homo sapiens
gggctccacctagggacactgg

SEQ ID NO: 9052563 - DNA, 22 bp, Homo sapiens
gggctccagagtccatgttctt

SEQ ID NO: 9052564 - DNA, 22 bp, Homo sapiens
gggctccagattgcagcgatca

SEQ ID NO: 9052565 - DNA, 21 bp, Homo sapiens
gggctccagagatgtagcttc

SEQ ID NO: 9052566 - DNA, 22 bp, Homo sapiens
gggctccagaggctcaccctgg

SEQ ID NO: 9052567 - DNA, 22 bp, Homo sapiens
gggctccagaggctcaccctgg

SEQ ID NO: 9052568 - DNA, 23 bp, Homo sapiens
gggctccagtctctgctcagttg

SEQ ID NO: 9052569 - DNA, 22 bp, Homo sapiens
gggctccagggcccgagtcgtc

SEQ ID NO: 9052570 - DNA, 22 bp, Homo sapiens
gggctccagtttggccaggaag

SEQ ID NO: 9052571 - DNA, 22 bp, Homo sapiens
gggctccagttgtccccaggat

SEQ ID NO: 9052572 - DNA, 22 bp, Homo sapiens
gggctccaggcaggcaggaaat

SEQ ID NO: 9052573 - DNA, 22 bp, Homo sapiens
gggctccaggagccctaagaga

SEQ ID NO: 9052574 - DNA, 20 bp, Homo sapiens
gggctccagctgtgattctt

SEQ ID NO: 9052575 - DNA, 22 bp, Homo sapiens
gggctccagctgtttgccatga

SEQ ID NO: 9052576 - DNA, 22 bp, Homo sapiens
gggctccatcacaggctccatc

SEQ ID NO: 9052577 - DNA, 22 bp, Homo sapiens
gggctccatcacaggctccatc

SEQ ID NO: 9052578 - DNA, 22 bp, Homo sapiens
gggctccatcggacttgggttt

SEQ ID NO: 9052579 - DNA, 22 bp, Homo sapiens
gggctctctttttggcctgccc

SEQ ID NO: 9052580 - DNA, 22 bp, Homo sapiens
gggctctagaggacagcctgct

SEQ ID NO: 9052581 - DNA, 22 bp, Homo sapiens
gggctctcgattagaccctggg

SEQ ID NO: 9052582 - DNA, 22 bp, Homo sapiens
gggcctccgtgtgctggtgctc

SEQ ID NO: 9052583 - DNA, 22 bp, Homo sapiens
ggggcaatgtccaagtcagttg

SEQ ID NO: 9052584 - DNA, 22 bp, Homo sapiens
ggggcagaaagcccacagagtg

SEQ ID NO: 9052585 - DNA, 22 bp, Homo sapiens
gggggacaggatgaatatctgt

SEQ ID NO: 9052586 - DNA, 23 bp, Homo sapiens
gggggccgtcctggggattatag

SEQ ID NO: 9052587 - DNA, 22 bp, Homo sapiens
gggggagctacaggtcccttgg

SEQ ID NO: 9052588 - DNA, 22 bp, Homo sapiens
ggtgaattctaggagatctgac

SEQ ID NO: 9052589 - DNA, 22 bp, Homo sapiens
ggtgcagggagaggcaggcccc

SEQ ID NO: 9052590 - DNA, 22 bp, Homo sapiens
ggtccatgataggaagttccga

SEQ ID NO: 9052591 - DNA, 22 bp, Homo sapiens
ggtccagtctttcccttctaga

SEQ ID NO: 9052592 - DNA, 22 bp, Homo sapiens
ggtgaacagttgtttcaaatat

SEQ ID NO: 9052593 - DNA, 22 bp, Homo sapiens
ggtgggagtggaacgtggaaga

SEQ ID NO: 9052594 - DNA, 22 bp, Homo sapiens
ggtgggaggcaggctgctccca

SEQ ID NO: 9052595 - DNA, 22 bp, Homo sapiens
ggtgggagccaacacccttctg

SEQ ID NO: 9052596 - DNA, 22 bp, Homo sapiens
gggtcagggctggctgtcgtca

SEQ ID NO: 9052597 - DNA, 22 bp, Homo sapiens
gggtccagaatgagaatgggct

SEQ ID NO: 9052598 - DNA, 22 bp, Homo sapiens
gggtccacctgagcagcagcct

SEQ ID NO: 9052599 - DNA, 22 bp, Homo sapiens
gggtccagactatgaagaactt

SEQ ID NO: 9052600 - DNA, 23 bp, Homo sapiens
gggtccagagaagccattagggc

SEQ ID NO: 9052601 - DNA, 22 bp, Homo sapiens
gggtccagacactccagaggaa

SEQ ID NO: 9052602 - DNA, 23 bp, Homo sapiens
gggtccagagacaggcatgggtg

SEQ ID NO: 9052603 - DNA, 22 bp, Homo sapiens
gggtccagagcctcagcccaga

SEQ ID NO: 9052604 - DNA, 22 bp, Homo sapiens
gggtccagagttgaagaggtta

SEQ ID NO: 9052605 - DNA, 16 bp, Homo sapiens
gggtccagatctgctc

SEQ ID NO: 9052606 - DNA, 22 bp, Homo sapiens
gggtccagagttttcccgccct

SEQ ID NO: 9052607 - DNA, 22 bp, Homo sapiens
ggtaacaaccctacaaatccac

SEQ ID NO: 9052608 - DNA, 22 bp, Homo sapiens
ggtaacaaggccgatagaaaca

SEQ ID NO: 9052609 - DNA, 22 bp, Homo sapiens
gggtccagcgacagcaggctca

SEQ ID NO: 9052610 - DNA, 23 bp, Homo sapiens
gggtccagccaattccaaggaaa

SEQ ID NO: 9052611 - DNA, 22 bp, Homo sapiens
gggtccagatggtgagagttaa

SEQ ID NO: 9052612 - DNA, 22 bp, Homo sapiens
gggtccagatggtgagagttaa

SEQ ID NO: 9052613 - DNA, 22 bp, Homo sapiens
gggtccagcgacagcaggctca

SEQ ID NO: 9052614 - DNA, 22 bp, Homo sapiens
ggtacagggcttcctggacaag

SEQ ID NO: 9052615 - DNA, 22 bp, Homo sapiens
ggtaataaaattgtgtcaaaca

SEQ ID NO: 9052616 - DNA, 22 bp, Homo sapiens
ggtagactgagctccttgagga

SEQ ID NO: 9052617 - DNA, 20 bp, Homo sapiens
ggtagctgctgcagttggta

SEQ ID NO: 9052618 - DNA, 22 bp, Homo sapiens
ggtccagcacaacactggcatg

SEQ ID NO: 9052619 - DNA, 22 bp, Homo sapiens
ggtccagccaggtgctcatgcc

SEQ ID NO: 9052620 - DNA, 23 bp, Homo sapiens
ggtccaggaaaggcagcagcacc

SEQ ID NO: 9052621 - DNA, 22 bp, Homo sapiens
ggtccaggtcctgtgacagcag

SEQ ID NO: 9052622 - DNA, 22 bp, Homo sapiens
ggtccaggtatgtggtgtgaat

SEQ ID NO: 9052623 - DNA, 22 bp, Homo sapiens
ggtccaggtttgctctacttgt

SEQ ID NO: 9052624 - DNA, 22 bp, Homo sapiens
ggtccagtcagatattcatgca

SEQ ID NO: 9052625 - DNA, 22 bp, Homo sapiens
ggtccagggaactttgaaggat

SEQ ID NO: 9052626 - DNA, 22 bp, Homo sapiens
ggtccaggatcaaggcatcacc

SEQ ID NO: 9052627 - DNA, 22 bp, Homo sapiens
ggtccagggggtagatatgtga

SEQ ID NO: 9052628 - DNA, 22 bp, Homo sapiens
ggtcagggctcttccagtggct

SEQ ID NO: 9052629 - DNA, 22 bp, Homo sapiens
gtgaggtgactagcaggtgggg

SEQ ID NO: 9052630 - DNA, 22 bp, Homo sapiens
gtcttctgtctgtctggcatgt

SEQ ID NO: 9052631 - DNA, 22 bp, Homo sapiens
gtcttcttttcagtctgcttgt

SEQ ID NO: 9052632 - DNA, 22 bp, Homo sapiens
gtgagtgtcagtcaaaggtttt

SEQ ID NO: 9052633 - DNA, 22 bp, Homo sapiens
gtgataaagacgtgtcataatt

SEQ ID NO: 9052634 - DNA, 22 bp, Homo sapiens
gtcttcctaatttgctattagg

SEQ ID NO: 9052635 - DNA, 22 bp, Homo sapiens
gtcttctaagtatcaaagcaga

SEQ ID NO: 9052636 - DNA, 22 bp, Homo sapiens
gtcttcctaatttgctattagg

SEQ ID NO: 9052637 - DNA, 20 bp, Homo sapiens
gtcttatttaacacatgact

SEQ ID NO: 9052638 - DNA, 22 bp, Homo sapiens
gtgctggggagataggaagaga

SEQ ID NO: 9052639 - DNA, 22 bp, Homo sapiens
gtgctgggattacaggtgtgag

SEQ ID NO: 9052640 - DNA, 22 bp, Homo sapiens
gtgctgggccctgagaccaggg

SEQ ID NO: 9052641 - DNA, 22 bp, Homo sapiens
gtgctgggtgctgcagacaggt

SEQ ID NO: 9052642 - DNA, 22 bp, Homo sapiens
gtgccctggatgactttggtct

SEQ ID NO: 9052643 - DNA, 22 bp, Homo sapiens
gtgccctgggccttcagggcca

SEQ ID NO: 9052644 - DNA, 22 bp, Homo sapiens
gtgccctggggtgaacccctgg

SEQ ID NO: 9052645 - DNA, 22 bp, Homo sapiens
gtgccctgtgaactgtaaggaa

SEQ ID NO: 9052646 - DNA, 22 bp, Homo sapiens
gtgcaaaaataattgtggtttt

SEQ ID NO: 9052647 - DNA, 22 bp, Homo sapiens
gtgcaaaaggcattgtggtttt

SEQ ID NO: 9052648 - DNA, 22 bp, Homo sapiens
gtgcaaaagcagttgtggtttt

SEQ ID NO: 9052649 - DNA, 22 bp, Homo sapiens
gtgcaaaagtaactgtggtttt

SEQ ID NO: 9052650 - DNA, 22 bp, Homo sapiens
gtgcaaaagtaaatgtggtttt

SEQ ID NO: 9052651 - DNA, 22 bp, Homo sapiens
gtgccctgagtgggtaggagag

SEQ ID NO: 9052652 - DNA, 22 bp, Homo sapiens
gtgccctgatcgctaggctccc

SEQ ID NO: 9052653 - DNA, 22 bp, Homo sapiens
gtgccctggaggggttgaaggg

SEQ ID NO: 9052654 - DNA, 22 bp, Homo sapiens
gtgccctgcatgccccgggtat

SEQ ID NO: 9052655 - DNA, 22 bp, Homo sapiens
gtcctcagtcagtttggtgggg

SEQ ID NO: 9052656 - DNA, 22 bp, Homo sapiens
gtcctctgaaagatgaaccatg

SEQ ID NO: 9052657 - DNA, 22 bp, Homo sapiens
gtcctctgaagttgtgcaatgc

SEQ ID NO: 9052658 - DNA, 22 bp, Homo sapiens
gtcctctgactcagccttggga

SEQ ID NO: 9052659 - DNA, 22 bp, Homo sapiens
gtcctctgagggggctgcacgc

SEQ ID NO: 9052660 - DNA, 22 bp, Homo sapiens
gtcctctgatttctaggtatat

SEQ ID NO: 9052661 - DNA, 22 bp, Homo sapiens
gtcctctgcccaggtcaaggtt

SEQ ID NO: 9052662 - DNA, 22 bp, Homo sapiens
gtcctattagcatattgaatac

SEQ ID NO: 9052663 - DNA, 22 bp, Homo sapiens
gtcatttattctggtcaattca

SEQ ID NO: 9052664 - DNA, 22 bp, Homo sapiens
gtcatttatcatcagaagtcat

SEQ ID NO: 9052665 - DNA, 22 bp, Homo sapiens
gtcatttaggtctgtcagaaat

SEQ ID NO: 9052666 - DNA, 22 bp, Homo sapiens
gtcatttaaaagggaacacatg

SEQ ID NO: 9052667 - DNA, 22 bp, Homo sapiens
gtcattgagtcgtcagagtctt

SEQ ID NO: 9052668 - DNA, 21 bp, Homo sapiens
gtcctcagctgatgggagctg

SEQ ID NO: 9052669 - DNA, 22 bp, Homo sapiens
gtcctcagggaatgtggcgggt

SEQ ID NO: 9052670 - DNA, 22 bp, Homo sapiens
gtcctcagggagtcccagtcat

SEQ ID NO: 9052671 - DNA, 23 bp, Homo sapiens
gtcctattttttgaaatactgag

SEQ ID NO: 9052672 - DNA, 22 bp, Homo sapiens
gtcctcagagtgggcaggtcct

SEQ ID NO: 9052673 - DNA, 22 bp, Homo sapiens
gtcacaaaggtgagggacatga

SEQ ID NO: 9052674 - DNA, 22 bp, Homo sapiens
gtcacaaaggtgagggacatga

SEQ ID NO: 9052675 - DNA, 22 bp, Homo sapiens
gtcagtaggaacctagggtcaa

SEQ ID NO: 9052676 - DNA, 22 bp, Homo sapiens
gtagagttgagtagtggtaaca

SEQ ID NO: 9052677 - DNA, 22 bp, Homo sapiens
gtagagtttaatgaaaaatctg

SEQ ID NO: 9052678 - DNA, 22 bp, Homo sapiens
gtagctctgtttaaagttcttt

SEQ ID NO: 9052679 - DNA, 22 bp, Homo sapiens
gtagctgatattagcaatgagt

SEQ ID NO: 9052680 - DNA, 22 bp, Homo sapiens
gtagctgatcctgaggacaggg

SEQ ID NO: 9052681 - DNA, 22 bp, Homo sapiens
gtagctctgtttaaagttcttt

SEQ ID NO: 9052682 - DNA, 22 bp, Homo sapiens
gtcaacaaggtttgcttatctt

SEQ ID NO: 9052683 - DNA, 22 bp, Homo sapiens
gtcaacaattccagtttttact

SEQ ID NO: 9052684 - DNA, 22 bp, Homo sapiens
gtcaacaagtagttttcttcca

SEQ ID NO: 9052685 - DNA, 22 bp, Homo sapiens
gtagctttaaagactggctgat

SEQ ID NO: 9052686 - DNA, 17 bp, Homo sapiens
gtaaggcttgcagatgc

SEQ ID NO: 9052687 - DNA, 20 bp, Homo sapiens
gtaatgaatgtaaacagtaa

SEQ ID NO: 9052688 - DNA, 22 bp, Homo sapiens
gtaaatttcccgggccatttaa

SEQ ID NO: 9052689 - DNA, 22 bp, Homo sapiens
gtaaatgtgaatgtcatttagc

SEQ ID NO: 9052690 - DNA, 22 bp, Homo sapiens
gtaaatgtgcttcttttaactt

SEQ ID NO: 9052691 - DNA, 22 bp, Homo sapiens
tcagtgcttgacagctctggga

SEQ ID NO: 9052692 - DNA, 22 bp, Homo sapiens
tcagtgcttatattctgagcct

SEQ ID NO: 9052693 - DNA, 22 bp, Homo sapiens
tcagtgcttttgagaagctcct

SEQ ID NO: 9052694 - DNA, 22 bp, Homo sapiens
tcagtgcttgcctctggaggag

SEQ ID NO: 9052695 - DNA, 22 bp, Homo sapiens
tcataaaagtactcatgttcat

SEQ ID NO: 9052696 - DNA, 20 bp, Homo sapiens
tcataaagaggaaataaata

SEQ ID NO: 9052697 - DNA, 22 bp, Homo sapiens
tcataaagagtgctgttgtttt

SEQ ID NO: 9052698 - DNA, 22 bp, Homo sapiens
tcatcaaaggattgcatgattt

SEQ ID NO: 9052699 - DNA, 22 bp, Homo sapiens
tcatcctgtctcactttttgct

SEQ ID NO: 9052700 - DNA, 20 bp, Homo sapiens
tcatggctgctgagaggttc

SEQ ID NO: 9052701 - DNA, 22 bp, Homo sapiens
tcaggcctttcttcagagcttc

SEQ ID NO: 9052702 - DNA, 22 bp, Homo sapiens
tcaggctctgagctgatgctaa

SEQ ID NO: 9052703 - DNA, 21 bp, Homo sapiens
tcagggactaggtactgggga

SEQ ID NO: 9052704 - DNA, 22 bp, Homo sapiens
tcagggactaggtgctgcctga

SEQ ID NO: 9052705 - DNA, 22 bp, Homo sapiens
tcagggagagcctgtctgacgt

SEQ ID NO: 9052706 - DNA, 22 bp, Homo sapiens
tcagggactgcagagggaagct

SEQ ID NO: 9052707 - DNA, 22 bp, Homo sapiens
tcagggactgttactgcctttg

SEQ ID NO: 9052708 - DNA, 22 bp, Homo sapiens
tcagggacttacaaaccagaag

SEQ ID NO: 9052709 - DNA, 22 bp, Homo sapiens
tcaggtcttttgtctcctagaa

SEQ ID NO: 9052710 - DNA, 22 bp, Homo sapiens
tcagggctgccgggcagaccgt

SEQ ID NO: 9052711 - DNA, 22 bp, Homo sapiens
tcaggggacttaggagagaagt

SEQ ID NO: 9052712 - DNA, 22 bp, Homo sapiens
tcaggcactggctgagtgatgg

SEQ ID NO: 9052713 - DNA, 22 bp, Homo sapiens
tcaggcaggatcccagggaagg

SEQ ID NO: 9052714 - DNA, 22 bp, Homo sapiens
tcaggccttgtcctgacctcct

SEQ ID NO: 9052715 - DNA, 22 bp, Homo sapiens
tcaggcaggttggctgcaggtc

SEQ ID NO: 9052716 - DNA, 22 bp, Homo sapiens
tcaggcaggctcagaggaaaac

SEQ ID NO: 9052717 - DNA, 22 bp, Homo sapiens
tcaggagctgtgaatacaaagg

SEQ ID NO: 9052718 - DNA, 22 bp, Homo sapiens
tcagaggcttgaagcccaagcc

SEQ ID NO: 9052719 - DNA, 22 bp, Homo sapiens
tcagagtcttggcaataggtta

SEQ ID NO: 9052720 - DNA, 22 bp, Homo sapiens
tcagagtctaaatagaagaata

SEQ ID NO: 9052721 - DNA, 22 bp, Homo sapiens
tcagagtctatgcaacagaatt

SEQ ID NO: 9052722 - DNA, 20 bp, Homo sapiens
tcagagtcatcaaagatggt

SEQ ID NO: 9052723 - DNA, 21 bp, Homo sapiens
tcactggaatacaattgattt

SEQ ID NO: 9052724 - DNA, 22 bp, Homo sapiens
tcactgtaaagtaatactgtca

SEQ ID NO: 9052725 - DNA, 18 bp, Homo sapiens
tcacatgacagctgttgc

SEQ ID NO: 9052726 - DNA, 19 bp, Homo sapiens
tcacatgaagcctagagaa

SEQ ID NO: 9052727 - DNA, 22 bp, Homo sapiens
tcacatgaagatccctcaattt

SEQ ID NO: 9052728 - DNA, 22 bp, Homo sapiens
tcacatgaaatgctgtaaagaa

SEQ ID NO: 9052729 - DNA, 22 bp, Homo sapiens
tcacatgaggcatccccgggca

SEQ ID NO: 9052730 - DNA, 22 bp, Homo sapiens
tcacatgaggttatgacaaagc

SEQ ID NO: 9052731 - DNA, 20 bp, Homo sapiens
tcacatgagctggggcaggc

SEQ ID NO: 9052732 - DNA, 22 bp, Homo sapiens
tcacatgactttttggtggcct

SEQ ID NO: 9052733 - DNA, 22 bp, Homo sapiens
tcacatgaggttatgacaaagc

SEQ ID NO: 9052734 - DNA, 22 bp, Homo sapiens
tcacatgagtattattttccaa

SEQ ID NO: 9052735 - DNA, 20 bp, Homo sapiens
tcacatgcatattcgtttct

SEQ ID NO: 9052736 - DNA, 22 bp, Homo sapiens
tcacatgagtcactatcttaat

SEQ ID NO: 9052737 - DNA, 22 bp, Homo sapiens
tcacatgagtcactatcttaat

SEQ ID NO: 9052738 - DNA, 18 bp, Homo sapiens
tcacatgattaccctggg

SEQ ID NO: 9052739 - DNA, 22 bp, Homo sapiens
tcacatgatgtttcctctgtgc

SEQ ID NO: 9052740 - DNA, 22 bp, Homo sapiens
tcagagacagtattggctattg

SEQ ID NO: 9052741 - DNA, 22 bp, Homo sapiens
tcagagacctagcaagaaattg

SEQ ID NO: 9052742 - DNA, 22 bp, Homo sapiens
tcagagactggtctgcagatgc

SEQ ID NO: 9052743 - DNA, 22 bp, Homo sapiens
tcagaggcagctgatgttctgt

SEQ ID NO: 9052744 - DNA, 21 bp, Homo sapiens
tcagaactggtgcagatgaat

SEQ ID NO: 9052745 - DNA, 22 bp, Homo sapiens
tcagaagagtaatagggtgaga

SEQ ID NO: 9052746 - DNA, 22 bp, Homo sapiens
tcagagaaggtaagtgacctgc

SEQ ID NO: 9052747 - DNA, 22 bp, Homo sapiens
tcagagaattctcagatgactc

SEQ ID NO: 9052748 - DNA, 22 bp, Homo sapiens
tcacatagtggggcattggaat

SEQ ID NO: 9052749 - DNA, 22 bp, Homo sapiens
tcacatagtggggcattggaat

SEQ ID NO: 9052750 - DNA, 16 bp, Homo sapiens
tcacatacttccttgc

SEQ ID NO: 9052751 - DNA, 22 bp, Homo sapiens
tcacagcatttttagaaagatt

SEQ ID NO: 9052752 - DNA, 22 bp, Homo sapiens
tcacagacactgggttattgca

SEQ ID NO: 9052753 - DNA, 18 bp, Homo sapiens
tcacagacagctgtcttt

SEQ ID NO: 9052754 - DNA, 22 bp, Homo sapiens
tcacagacacattaaacatgtg

SEQ ID NO: 9052755 - DNA, 22 bp, Homo sapiens
tcacagacactgggttattgca

SEQ ID NO: 9052756 - DNA, 22 bp, Homo sapiens
tcacacataaaaagaagactag

SEQ ID NO: 9052757 - DNA, 22 bp, Homo sapiens
tcacacataaaaagaagactag

SEQ ID NO: 9052758 - DNA, 22 bp, Homo sapiens
tcaaaagtttcacatagagata

SEQ ID NO: 9052759 - DNA, 22 bp, Homo sapiens
tcaaaagtctgcattcttcaca

SEQ ID NO: 9052760 - DNA, 22 bp, Homo sapiens
tcaaaagtggcctgtaaaatct

SEQ ID NO: 9052761 - DNA, 22 bp, Homo sapiens
tcaaaatcaaagatacttgaaa

SEQ ID NO: 9052762 - DNA, 22 bp, Homo sapiens
tcaaaattctagggagaatggt

SEQ ID NO: 9052763 - DNA, 22 bp, Homo sapiens
tcaaaattttatttctcaagga

SEQ ID NO: 9052764 - DNA, 22 bp, Homo sapiens
tcaaacaccatctgaccttatg

SEQ ID NO: 9052765 - DNA, 22 bp, Homo sapiens
tcaaacactgtaacatggaaaa

SEQ ID NO: 9052766 - DNA, 22 bp, Homo sapiens
tcacaatttggatacagctatg

SEQ ID NO: 9052767 - DNA, 22 bp, Homo sapiens
tcacaattgtttttaggatcaa

SEQ ID NO: 9052768 - DNA, 22 bp, Homo sapiens
tcacaatttttaagtagcgcaa

SEQ ID NO: 9052769 - DNA, 22 bp, Homo sapiens
tcacacacatggatagtatttt

SEQ ID NO: 9052770 - DNA, 22 bp, Homo sapiens
tcacacacataatctaagatta

SEQ ID NO: 9052771 - DNA, 22 bp, Homo sapiens
tcacacacatggatagtatttt

SEQ ID NO: 9052772 - DNA, 22 bp, Homo sapiens
tcacaattgagatcctcccacc

SEQ ID NO: 9052773 - DNA, 22 bp, Homo sapiens
tcacacacatttgctgtctgat

SEQ ID NO: 9052774 - DNA, 21 bp, Homo sapiens
tcacacacgtttccaagggca

SEQ ID NO: 9052775 - DNA, 22 bp, Homo sapiens
tcacacagctgacagagccttt

SEQ ID NO: 9052776 - DNA, 22 bp, Homo sapiens
tcacacagctcctttccttagt

SEQ ID NO: 9052777 - DNA, 22 bp, Homo sapiens
tcaattctagagccttacattg

SEQ ID NO: 9052778 - DNA, 22 bp, Homo sapiens
tcaattctgcctctaaatattt

SEQ ID NO: 9052779 - DNA, 22 bp, Homo sapiens
tcaattctgcatacatttcact

SEQ ID NO: 9052780 - DNA, 22 bp, Homo sapiens
tcaattaagaggctaagttact

SEQ ID NO: 9052781 - DNA, 22 bp, Homo sapiens
tcaatgtttggaaatcctttgt

SEQ ID NO: 9052782 - DNA, 22 bp, Homo sapiens
tcccagagtgtgggcatcaagg

SEQ ID NO: 9052783 - DNA, 22 bp, Homo sapiens
tcccacatatgcaatcctgaat

SEQ ID NO: 9052784 - DNA, 22 bp, Homo sapiens
tccagtgtgtgtccagctgctg

SEQ ID NO: 9052785 - DNA, 21 bp, Homo sapiens
tcccactgccacagcttcagg

SEQ ID NO: 9052786 - DNA, 18 bp, Homo sapiens
tccagtcccaaggccagc

SEQ ID NO: 9052787 - DNA, 22 bp, Homo sapiens
tccagtcatttccattgttccc

SEQ ID NO: 9052788 - DNA, 22 bp, Homo sapiens
tccagtccagggaatggctgat

SEQ ID NO: 9052789 - DNA, 22 bp, Homo sapiens
tccagtccagggaatggctgat

SEQ ID NO: 9052790 - DNA, 22 bp, Homo sapiens
tccagtcatctcccttcacatt

SEQ ID NO: 9052791 - DNA, 22 bp, Homo sapiens
tccagggatgccagccatgttg

SEQ ID NO: 9052792 - DNA, 23 bp, Homo sapiens
tccagggattaatgaagtcagtc

SEQ ID NO: 9052793 - DNA, 22 bp, Homo sapiens
tccagggatgtcctgtagcact

SEQ ID NO: 9052794 - DNA, 22 bp, Homo sapiens
tccagggatggtaatgagcagt

SEQ ID NO: 9052795 - DNA, 22 bp, Homo sapiens
tccagggatgccagccatgttg

SEQ ID NO: 9052796 - DNA, 22 bp, Homo sapiens
tccagggatgccagccatgttg

SEQ ID NO: 9052797 - DNA, 22 bp, Homo sapiens
tccagggagtcaaatgaactac

SEQ ID NO: 9052798 - DNA, 22 bp, Homo sapiens
tccagggagcaagtcaggccgg

SEQ ID NO: 9052799 - DNA, 22 bp, Homo sapiens
tccagggagttggctggatagt

SEQ ID NO: 9052800 - DNA, 22 bp, Homo sapiens
tccagggatctttagagtcttt

SEQ ID NO: 9052801 - DNA, 22 bp, Homo sapiens
tccagggatctttagagtcttt

SEQ ID NO: 9052802 - DNA, 22 bp, Homo sapiens
tccagtgcaatggctcattcat

SEQ ID NO: 9052803 - DNA, 22 bp, Homo sapiens
tccagtcctagaaactggagag

SEQ ID NO: 9052804 - DNA, 18 bp, Homo sapiens
tccagtcccagctctgcc

SEQ ID NO: 9052805 - DNA, 22 bp, Homo sapiens
tccagtcctatctgcccttgga

SEQ ID NO: 9052806 - DNA, 22 bp, Homo sapiens
tccagtgctgtttccaatgtaa

SEQ ID NO: 9052807 - DNA, 22 bp, Homo sapiens
tccaggccattgactgcatcct

SEQ ID NO: 9052808 - DNA, 22 bp, Homo sapiens
tccagggagatggcagaggctg

SEQ ID NO: 9052809 - DNA, 22 bp, Homo sapiens
tccagggagatactggctgcca

SEQ ID NO: 9052810 - DNA, 22 bp, Homo sapiens
tccagggagagccgctgctcca

SEQ ID NO: 9052811 - DNA, 22 bp, Homo sapiens
tccagggacagcgctggagcta

SEQ ID NO: 9052812 - DNA, 22 bp, Homo sapiens
tccagggacagtatagaggatc

SEQ ID NO: 9052813 - DNA, 22 bp, Homo sapiens
tccagggacagcgctggagcta

SEQ ID NO: 9052814 - DNA, 22 bp, Homo sapiens
tccagggacctccctgagagct

SEQ ID NO: 9052815 - DNA, 22 bp, Homo sapiens
tccagccctgcttcctgcctca

SEQ ID NO: 9052816 - DNA, 22 bp, Homo sapiens
tccagcccgactgggcctgccg

SEQ ID NO: 9052817 - DNA, 22 bp, Homo sapiens
tccagccccggcttccttacag

SEQ ID NO: 9052818 - DNA, 20 bp, Homo sapiens
tccagcccaggtcctgcctg

SEQ ID NO: 9052819 - DNA, 22 bp, Homo sapiens
tccagcccatccctagcctggg

SEQ ID NO: 9052820 - DNA, 22 bp, Homo sapiens
tccagaaaattttacagtgcct

SEQ ID NO: 9052821 - DNA, 22 bp, Homo sapiens
tcatgttattgactcataatat

SEQ ID NO: 9052822 - DNA, 20 bp, Homo sapiens
tcatgttgggccatcagaat

SEQ ID NO: 9052823 - DNA, 22 bp, Homo sapiens
tccacacacatttctatgtgca

SEQ ID NO: 9052824 - DNA, 22 bp, Homo sapiens
tcattaatttgcttagacttat

SEQ ID NO: 9052825 - DNA, 22 bp, Homo sapiens
tccacagcacaaagccagtgtg

SEQ ID NO: 9052826 - DNA, 22 bp, Homo sapiens
tccacccctgggaatgtcaata

SEQ ID NO: 9052827 - DNA, 22 bp, Homo sapiens
tccacccccagacagctggtga

SEQ ID NO: 9052828 - DNA, 23 bp, Homo sapiens
tccaccccagctgaggcttagcc

SEQ ID NO: 9052829 - DNA, 22 bp, Homo sapiens
tccacccctgggaatgtcaata

SEQ ID NO: 9052830 - DNA, 22 bp, Homo sapiens
tccacccccagacagctggtga

SEQ ID NO: 9052831 - DNA, 19 bp, Homo sapiens
tccaccccagccagctctg

SEQ ID NO: 9052832 - DNA, 19 bp, Homo sapiens
tccaccccagccagctctg

SEQ ID NO: 9052833 - DNA, 22 bp, Homo sapiens
tccaccagttcaccttgtagca

SEQ ID NO: 9052834 - DNA, 18 bp, Homo sapiens
tccaccagtcaatctgtc

SEQ ID NO: 9052835 - DNA, 22 bp, Homo sapiens
tccaccatgtaacaagctctgt

SEQ ID NO: 9052836 - DNA, 22 bp, Homo sapiens
tccaccagcagcctgtcagcct

SEQ ID NO: 9052837 - DNA, 22 bp, Homo sapiens
tccaccagagccctctttgcgg

SEQ ID NO: 9052838 - DNA, 22 bp, Homo sapiens
tccaccagagccttcccatgct

SEQ ID NO: 9052839 - DNA, 20 bp, Homo sapiens
tccaccaggaagggtaggga

SEQ ID NO: 9052840 - DNA, 22 bp, Homo sapiens
tccaccagggtttcatctccct

SEQ ID NO: 9052841 - DNA, 22 bp, Homo sapiens
tccaccaggctccatgttcagt

SEQ ID NO: 9052842 - DNA, 22 bp, Homo sapiens
tccaccagccaggcccaggctg

SEQ ID NO: 9052843 - DNA, 21 bp, Homo sapiens
tccaccagctcttcctcttca

SEQ ID NO: 9052844 - DNA, 22 bp, Homo sapiens
tccaccagcttcttcaccagct

SEQ ID NO: 9052845 - DNA, 22 bp, Homo sapiens
tcccttgtcctcttcgtcactg

SEQ ID NO: 9052846 - DNA, 22 bp, Homo sapiens
tccctgtgtcttcctcttgccc

SEQ ID NO: 9052847 - DNA, 22 bp, Homo sapiens
tcccttcacagatgcgatgttt

SEQ ID NO: 9052848 - DNA, 23 bp, Homo sapiens
tccctgtgtacagcctgcatgag

SEQ ID NO: 9052849 - DNA, 22 bp, Homo sapiens
tccctgtgtccatgccaggagg

SEQ ID NO: 9052850 - DNA, 22 bp, Homo sapiens
tccctgtggatatctgcagctg

SEQ ID NO: 9052851 - DNA, 22 bp, Homo sapiens
tccctgtgcctatatgtgctga

SEQ ID NO: 9052852 - DNA, 22 bp, Homo sapiens
tccctgggcctatcttagctcc

SEQ ID NO: 9052853 - DNA, 22 bp, Homo sapiens
tccctgcatttgggagagtgtc

SEQ ID NO: 9052854 - DNA, 22 bp, Homo sapiens
tcctccctaaatcctagactgt

SEQ ID NO: 9052855 - DNA, 23 bp, Homo sapiens
tcctccctgacttctacagcaca

SEQ ID NO: 9052856 - DNA, 23 bp, Homo sapiens
tcctccctgacttctacagcaca

SEQ ID NO: 9052857 - DNA, 22 bp, Homo sapiens
tcctccctgcactcagtgaagt

SEQ ID NO: 9052858 - DNA, 22 bp, Homo sapiens
tcctccagtggtactggccaat

SEQ ID NO: 9052859 - DNA, 21 bp, Homo sapiens
tcctcctccactaggctagcc

SEQ ID NO: 9052860 - DNA, 22 bp, Homo sapiens
tcctcctcacgctgttgcttgt

SEQ ID NO: 9052861 - DNA, 22 bp, Homo sapiens
tcctcctctatcagacagtgcc

SEQ ID NO: 9052862 - DNA, 22 bp, Homo sapiens
tccgcccgcacgtatggagtgg

SEQ ID NO: 9052863 - DNA, 22 bp, Homo sapiens
tcctcagttttctagtatggca

SEQ ID NO: 9052864 - DNA, 22 bp, Homo sapiens
tcctcagttataaataggaaac

SEQ ID NO: 9052865 - DNA, 22 bp, Homo sapiens
tcctcatagactgactgcttgc

SEQ ID NO: 9052866 - DNA, 22 bp, Homo sapiens
tcctcagtggggcattcattat

SEQ ID NO: 9052867 - DNA, 22 bp, Homo sapiens
tcctcagtgctagccaactgcc

SEQ ID NO: 9052868 - DNA, 22 bp, Homo sapiens
tcctcagtctctcaaatgaggc

SEQ ID NO: 9052869 - DNA, 19 bp, Homo sapiens
tcctcagtgacaacctcag

SEQ ID NO: 9052870 - DNA, 22 bp, Homo sapiens
tcctcagtcagctccgttcttg

SEQ ID NO: 9052871 - DNA, 22 bp, Homo sapiens
tcctcagtcacggtagcacatt

SEQ ID NO: 9052872 - DNA, 22 bp, Homo sapiens
tcctcagtattgtggagcagat

SEQ ID NO: 9052873 - DNA, 22 bp, Homo sapiens
tcctcagtcgtttgagccaaaa

SEQ ID NO: 9052874 - DNA, 22 bp, Homo sapiens
tcctcagtctctaaggcctcag

SEQ ID NO: 9052875 - DNA, 23 bp, Homo sapiens
tcctcagtatataaaggcagatg

SEQ ID NO: 9052876 - DNA, 22 bp, Homo sapiens
tcctccaggataaaatgtgttg

SEQ ID NO: 9052877 - DNA, 22 bp, Homo sapiens
tcctccagctgtatcctgcctg

SEQ ID NO: 9052878 - DNA, 22 bp, Homo sapiens
tcctccagccctctaggaaaat

SEQ ID NO: 9052879 - DNA, 22 bp, Homo sapiens
tcctccagctactaggcaaata

SEQ ID NO: 9052880 - DNA, 23 bp, Homo sapiens
tcctccagaggccctccttggcc

SEQ ID NO: 9052881 - DNA, 20 bp, Homo sapiens
tcctccagaagggcagggtg

SEQ ID NO: 9052882 - DNA, 22 bp, Homo sapiens
tcctccagaaactgaggcagaa

SEQ ID NO: 9052883 - DNA, 22 bp, Homo sapiens
tacttcaaccttctctattaga

SEQ ID NO: 9052884 - DNA, 22 bp, Homo sapiens
tacttcaacaccatatggtcct

SEQ ID NO: 9052885 - DNA, 22 bp, Homo sapiens
tacttcaatttgtatatgtgaa

SEQ ID NO: 9052886 - DNA, 22 bp, Homo sapiens
tactgtaatcagggcttaggta

SEQ ID NO: 9052887 - DNA, 20 bp, Homo sapiens
tacttctgaggcactctgaa

SEQ ID NO: 9052888 - DNA, 22 bp, Homo sapiens
tactgcatcgaaatgcttttat

SEQ ID NO: 9052889 - DNA, 22 bp, Homo sapiens
tactgcatgaaggcacctattt

SEQ ID NO: 9052890 - DNA, 22 bp, Homo sapiens
tactgcatagacactgggatat

SEQ ID NO: 9052891 - DNA, 22 bp, Homo sapiens
tactgcataactggcatgtggg

SEQ ID NO: 9052892 - DNA, 22 bp, Homo sapiens
tactggaaggctggaagtcagg

SEQ ID NO: 9052893 - DNA, 22 bp, Homo sapiens
tactgcatgggtgcatgctgct

SEQ ID NO: 9052894 - DNA, 22 bp, Homo sapiens
tactgcatgtgtttgatgatgg

SEQ ID NO: 9052895 - DNA, 22 bp, Homo sapiens
tacctttaaggagatttgacaa

SEQ ID NO: 9052896 - DNA, 22 bp, Homo sapiens
tactgaaatggcagatatataa

SEQ ID NO: 9052897 - DNA, 22 bp, Homo sapiens
tactgacacaaagccaatccct

SEQ ID NO: 9052898 - DNA, 22 bp, Homo sapiens
tacccaaggccctttcaatttc

SEQ ID NO: 9052899 - DNA, 22 bp, Homo sapiens
tacctgcagcgggaatccatta

SEQ ID NO: 9052900 - DNA, 22 bp, Homo sapiens
tacctgcacagccagccatgtg

SEQ ID NO: 9052901 - DNA, 22 bp, Homo sapiens
tacctgaattaccaaaagcttt

SEQ ID NO: 9052902 - DNA, 22 bp, Homo sapiens
tacctgaagtaacaatgaatat

SEQ ID NO: 9052903 - DNA, 23 bp, Homo sapiens
tacctgaagtaagcattcatcca

SEQ ID NO: 9052904 - DNA, 22 bp, Homo sapiens
tacctggctggggaatagccag

SEQ ID NO: 9052905 - DNA, 22 bp, Homo sapiens
tacctgttgatttatactgaaa

SEQ ID NO: 9052906 - DNA, 20 bp, Homo sapiens
tacattcaaaacaaactctg

SEQ ID NO: 9052907 - DNA, 22 bp, Homo sapiens
tacattcaacatgtcactatgt

SEQ ID NO: 9052908 - DNA, 22 bp, Homo sapiens
tacattcaacatgtcactatgt

SEQ ID NO: 9052909 - DNA, 22 bp, Homo sapiens
tacattcaaacgatttattgat

SEQ ID NO: 9052910 - DNA, 22 bp, Homo sapiens
tacattatttcatcagtcatct

SEQ ID NO: 9052911 - DNA, 22 bp, Homo sapiens
tacattcatggtgacttgtatg

SEQ ID NO: 9052912 - DNA, 22 bp, Homo sapiens
tacattcatggtgacttgtatg

SEQ ID NO: 9052913 - DNA, 22 bp, Homo sapiens
tacatacacaaatatactgttt

SEQ ID NO: 9052914 - DNA, 22 bp, Homo sapiens
tacatacaagcattcaatttta

SEQ ID NO: 9052915 - DNA, 22 bp, Homo sapiens
tacatacacaaatatactgttt

SEQ ID NO: 9052916 - DNA, 22 bp, Homo sapiens
tacatacaagcattcaatttta

SEQ ID NO: 9052917 - DNA, 22 bp, Homo sapiens
tacatacagagatgctagttaa

SEQ ID NO: 9052918 - DNA, 22 bp, Homo sapiens
tacatacagagatgctagttaa

SEQ ID NO: 9052919 - DNA, 22 bp, Homo sapiens
tacatgtctacatgcatttttg

SEQ ID NO: 9052920 - DNA, 22 bp, Homo sapiens
tacatacagtggatgctttagg

SEQ ID NO: 9052921 - DNA, 22 bp, Homo sapiens
tacatacagtggatgctttagg

SEQ ID NO: 9052922 - DNA, 22 bp, Homo sapiens
tacatacaagatgtgtttaaaa

SEQ ID NO: 9052923 - DNA, 22 bp, Homo sapiens
tacagcagcatcgcagtgacct

SEQ ID NO: 9052924 - DNA, 22 bp, Homo sapiens
tacagcagcccaccttcttctg

SEQ ID NO: 9052925 - DNA, 20 bp, Homo sapiens
tacagcagaaatgttttgct

SEQ ID NO: 9052926 - DNA, 22 bp, Homo sapiens
taattttatgacagtgtatttt

SEQ ID NO: 9052927 - DNA, 22 bp, Homo sapiens
tacacatgctcagattcctgtg

SEQ ID NO: 9052928 - DNA, 22 bp, Homo sapiens
tacacatgctcagattcctgtg

SEQ ID NO: 9052929 - DNA, 22 bp, Homo sapiens
tacacatgtttggcaagtatgt

SEQ ID NO: 9052930 - DNA, 22 bp, Homo sapiens
tacacccacattgagcatggga

SEQ ID NO: 9052931 - DNA, 22 bp, Homo sapiens
tacaccattcccaggtggattt

SEQ ID NO: 9052932 - DNA, 22 bp, Homo sapiens
tacacctgctgagcctgtcctc

SEQ ID NO: 9052933 - DNA, 22 bp, Homo sapiens
tacacatcactgtatctttcag

SEQ ID NO: 9052934 - DNA, 22 bp, Homo sapiens
tacacatctctgtcagtagtga

SEQ ID NO: 9052935 - DNA, 22 bp, Homo sapiens
tacacatgacagtggactgaga

SEQ ID NO: 9052936 - DNA, 22 bp, Homo sapiens
tacacatcccagactcccagga

SEQ ID NO: 9052937 - DNA, 22 bp, Homo sapiens
tacacatccatgttttgacttt

SEQ ID NO: 9052938 - DNA, 21 bp, Homo sapiens
tacacaaagcgtggtccagag

SEQ ID NO: 9052939 - DNA, 22 bp, Homo sapiens
tacaatttagtggtgtgtggtt

SEQ ID NO: 9052940 - DNA, 22 bp, Homo sapiens
tacacaaaggcactctgttgtt

SEQ ID NO: 9052941 - DNA, 22 bp, Homo sapiens
taagtgttggtaattacaatga

SEQ ID NO: 9052942 - DNA, 22 bp, Homo sapiens
taagcagtttttcttgtattaa

SEQ ID NO: 9052943 - DNA, 22 bp, Homo sapiens
taagcaagtggtagaaggacaa

SEQ ID NO: 9052944 - DNA, 22 bp, Homo sapiens
taagcaagggtctctgtatcag

SEQ ID NO: 9052945 - DNA, 22 bp, Homo sapiens
taagttctcaatacattgtagc

SEQ ID NO: 9052946 - DNA, 22 bp, Homo sapiens
taatttcactgatatgaagtca

SEQ ID NO: 9052947 - DNA, 22 bp, Homo sapiens
taatttcaccgttgctagaaat

SEQ ID NO: 9052948 - DNA, 22 bp, Homo sapiens
taatttcactgatatgaagtca

SEQ ID NO: 9052949 - DNA, 22 bp, Homo sapiens
taatttcagtgcaagctcacgg

SEQ ID NO: 9052950 - DNA, 22 bp, Homo sapiens
taatttcagtgggctctgggct

SEQ ID NO: 9052951 - DNA, 22 bp, Homo sapiens
taatttcaatagcttgcataat

SEQ ID NO: 9052952 - DNA, 22 bp, Homo sapiens
taatttcaatagcttgcataat

SEQ ID NO: 9052953 - DNA, 22 bp, Homo sapiens
taatttcacagttcaacgcaca

SEQ ID NO: 9052954 - DNA, 22 bp, Homo sapiens
taatttcacagttcaacgcaca

SEQ ID NO: 9052955 - DNA, 22 bp, Homo sapiens
taatgcttaattttcacaagcc

SEQ ID NO: 9052956 - DNA, 22 bp, Homo sapiens
taatgcttaattttcacaagcc

SEQ ID NO: 9052957 - DNA, 20 bp, Homo sapiens
taatgcttaacacatcccct

SEQ ID NO: 9052958 - DNA, 22 bp, Homo sapiens
taatgctttgttttgatctaac

SEQ ID NO: 9052959 - DNA, 22 bp, Homo sapiens
taatgcttgcaaattatgggac

SEQ ID NO: 9052960 - DNA, 22 bp, Homo sapiens
taatgcttttccttcaaataag

SEQ ID NO: 9052961 - DNA, 22 bp, Homo sapiens
taatgcttcaatttccttgatt

SEQ ID NO: 9052962 - DNA, 22 bp, Homo sapiens
taatgcttatgttatgcaattt

SEQ ID NO: 9052963 - DNA, 22 bp, Homo sapiens
taatgcttcctatatagcactc

SEQ ID NO: 9052964 - DNA, 22 bp, Homo sapiens
taatgagatcatatcttctgag

SEQ ID NO: 9052965 - DNA, 22 bp, Homo sapiens
taatgaggaaggagactttcac

SEQ ID NO: 9052966 - DNA, 22 bp, Homo sapiens
taatgactgccgtctctcttca

SEQ ID NO: 9052967 - DNA, 22 bp, Homo sapiens
taatgagactcaattgtgtgtg

SEQ ID NO: 9052968 - DNA, 22 bp, Homo sapiens
taatgagaattctttttgggta

SEQ ID NO: 9052969 - DNA, 23 bp, Homo sapiens
taatgagaagctttgtttcctga

SEQ ID NO: 9052970 - DNA, 22 bp, Homo sapiens
taatgaggcatttgagtcacct

SEQ ID NO: 9052971 - DNA, 22 bp, Homo sapiens
taatgcagagtgcactcacctg

SEQ ID NO: 9052972 - DNA, 22 bp, Homo sapiens
taatgcaggtgcccttgggttt

SEQ ID NO: 9052973 - DNA, 22 bp, Homo sapiens
taatgcagtactgatataaaca

SEQ ID NO: 9052974 - DNA, 22 bp, Homo sapiens
taatgcagtaagcaatggtgaa

SEQ ID NO: 9052975 - DNA, 22 bp, Homo sapiens
taatgcagtaggtattaaagaa

SEQ ID NO: 9052976 - DNA, 22 bp, Homo sapiens
taatgccacggcagggaacagc

SEQ ID NO: 9052977 - DNA, 22 bp, Homo sapiens
taatgcacatagaagtacttag

SEQ ID NO: 9052978 - DNA, 22 bp, Homo sapiens
taatgcacgttaacatttgaga

SEQ ID NO: 9052979 - DNA, 22 bp, Homo sapiens
gttttatttccatgagagaccg

SEQ ID NO: 9052980 - DNA, 22 bp, Homo sapiens
gttttattggaacacagccatg

SEQ ID NO: 9052981 - DNA, 21 bp, Homo sapiens
gttttcatgatagagtctgta

SEQ ID NO: 9052982 - DNA, 22 bp, Homo sapiens
taaacagcctcccctttcactc

SEQ ID NO: 9052983 - DNA, 22 bp, Homo sapiens
taaacagcctaaaactttcttt

SEQ ID NO: 9052984 - DNA, 22 bp, Homo sapiens
taaacatctgaatcctgcttcc

SEQ ID NO: 9052985 - DNA, 22 bp, Homo sapiens
taaacaggagttgaagcagtaa

SEQ ID NO: 9052986 - DNA, 22 bp, Homo sapiens
taaacaggccccagggaggttg

SEQ ID NO: 9052987 - DNA, 22 bp, Homo sapiens
taaacatctgtagccttcagtc

SEQ ID NO: 9052988 - DNA, 22 bp, Homo sapiens
taaactgtagctctcgtaattc

SEQ ID NO: 9052989 - DNA, 22 bp, Homo sapiens
taaactgtgaaaggcttaacat

SEQ ID NO: 9052990 - DNA, 22 bp, Homo sapiens
taaactgtggaatgttctcttt

SEQ ID NO: 9052991 - DNA, 21 bp, Homo sapiens
taaagaagatgaatgtgatca

SEQ ID NO: 9052992 - DNA, 22 bp, Homo sapiens
taaagacaataggaaagttgtt

SEQ ID NO: 9052993 - DNA, 22 bp, Homo sapiens
taaagtttgtagcaattgatat

SEQ ID NO: 9052994 - DNA, 22 bp, Homo sapiens
taaagtttgtagcaattgatat

SEQ ID NO: 9052995 - DNA, 22 bp, Homo sapiens
taaagtttatttgaacatctct

SEQ ID NO: 9052996 - DNA, 17 bp, Homo sapiens
taaatacacaagggtat

SEQ ID NO: 9052997 - DNA, 22 bp, Homo sapiens
taaatacagtcatttgagccat

SEQ ID NO: 9052998 - DNA, 22 bp, Homo sapiens
taacttcagcgagttctcttaa

SEQ ID NO: 9052999 - DNA, 22 bp, Homo sapiens
taacttctgaatagcaatagta

SEQ ID NO: 9053000 - DNA, 22 bp, Homo sapiens
taacttctgcacagaaaatttg

SEQ ID NO: 9053001 - DNA, 23 bp, Homo sapiens
taacttacatcattctgcacaag

SEQ ID NO: 9053002 - DNA, 22 bp, Homo sapiens
taagaaacccaggaatttctta

SEQ ID NO: 9053003 - DNA, 22 bp, Homo sapiens
taagaaactaatgcaataagag

SEQ ID NO: 9053004 - DNA, 22 bp, Homo sapiens
taagaaactatggagaagaact

SEQ ID NO: 9053005 - DNA, 22 bp, Homo sapiens
taacttctttggtttaaagaga

SEQ ID NO: 9053006 - DNA, 16 bp, Homo sapiens
taacttcttccttcaa

SEQ ID NO: 9053007 - DNA, 22 bp, Homo sapiens
taacttctggaaatgcatctgc

SEQ ID NO: 9053008 - DNA, 22 bp, Homo sapiens
taagaaacttaactgggaacta

SEQ ID NO: 9053009 - DNA, 22 bp, Homo sapiens
taagaaatttagttatagaatg

SEQ ID NO: 9053010 - DNA, 22 bp, Homo sapiens
taagaaacttaactgggaacta

SEQ ID NO: 9053011 - DNA, 22 bp, Homo sapiens
taagaaactattgtctctgaac

SEQ ID NO: 9053012 - DNA, 22 bp, Homo sapiens
taagaaactgtcacagtactat

SEQ ID NO: 9053013 - DNA, 22 bp, Homo sapiens
taagaaactgtcacagtactat

SEQ ID NO: 9053014 - DNA, 22 bp, Homo sapiens
taagagtaagtgattaagaaga

SEQ ID NO: 9053015 - DNA, 22 bp, Homo sapiens
taagataaggaacattctgtga

SEQ ID NO: 9053016 - DNA, 22 bp, Homo sapiens
taagataagtgggttgagatgg

SEQ ID NO: 9053017 - DNA, 22 bp, Homo sapiens
taagataataagtatgtctatg

SEQ ID NO: 9053018 - DNA, 22 bp, Homo sapiens
taagataataagtatgtctatg

SEQ ID NO: 9053019 - DNA, 22 bp, Homo sapiens
taagataataccatgggccagg

SEQ ID NO: 9053020 - DNA, 22 bp, Homo sapiens
taagataatccattataatgtt

SEQ ID NO: 9053021 - DNA, 22 bp, Homo sapiens
taagatgaccttataaagagca

SEQ ID NO: 9053022 - DNA, 21 bp, Homo sapiens
taagcaaggaaagggcagccc

SEQ ID NO: 9053023 - DNA, 22 bp, Homo sapiens
taagcaagatttattgaatttt

SEQ ID NO: 9053024 - DNA, 22 bp, Homo sapiens
taagatgaggtaggtaagactt

SEQ ID NO: 9053025 - DNA, 22 bp, Homo sapiens
taacacaaaagaatatgtgtgt

SEQ ID NO: 9053026 - DNA, 22 bp, Homo sapiens
taacaattctcaaaagagggga

SEQ ID NO: 9053027 - DNA, 22 bp, Homo sapiens
taaatacagtcatttgagccat

SEQ ID NO: 9053028 - DNA, 22 bp, Homo sapiens
taacaatacccattctaattac

SEQ ID NO: 9053029 - DNA, 21 bp, Homo sapiens
taacaaagacttctggtcagg

SEQ ID NO: 9053030 - DNA, 22 bp, Homo sapiens
taaatttttgttaacagcctct

SEQ ID NO: 9053031 - DNA, 22 bp, Homo sapiens
taacacatggttagtacacaat

SEQ ID NO: 9053032 - DNA, 22 bp, Homo sapiens
taacacatgtctgggatgtgaa

SEQ ID NO: 9053033 - DNA, 22 bp, Homo sapiens
taacacatggttctgtcaggaa

SEQ ID NO: 9053034 - DNA, 22 bp, Homo sapiens
taacacattttaagccatttta

SEQ ID NO: 9053035 - DNA, 21 bp, Homo sapiens
taacacattttggtactttgg

SEQ ID NO: 9053036 - DNA, 22 bp, Homo sapiens
gtttctcatcagtttctgatat

SEQ ID NO: 9053037 - DNA, 22 bp, Homo sapiens
gtttcttaaatgtagcaggacc

SEQ ID NO: 9053038 - DNA, 22 bp, Homo sapiens
gttttacacacctatgaaagac

SEQ ID NO: 9053039 - DNA, 22 bp, Homo sapiens
gtttatatgaacttcataccca

SEQ ID NO: 9053040 - DNA, 22 bp, Homo sapiens
gttccttgggaacaacgctgaa

SEQ ID NO: 9053041 - DNA, 22 bp, Homo sapiens
gttccttggaagaacttgaggt

SEQ ID NO: 9053042 - DNA, 22 bp, Homo sapiens
gttccttgtaatttgttaagga

SEQ ID NO: 9053043 - DNA, 22 bp, Homo sapiens
gttccttgtatttcagacatga

SEQ ID NO: 9053044 - DNA, 22 bp, Homo sapiens
gttataaaggtgataatggtca

SEQ ID NO: 9053045 - DNA, 20 bp, Homo sapiens
gttaggaggttggacatgga

SEQ ID NO: 9053046 - DNA, 22 bp, Homo sapiens
gttacaaaggtcataaaagtgt

SEQ ID NO: 9053047 - DNA, 22 bp, Homo sapiens
gttacaaaggtcataaaagtgt

SEQ ID NO: 9053048 - DNA, 22 bp, Homo sapiens
tagaatcatacctctaggaaca

SEQ ID NO: 9053049 - DNA, 22 bp, Homo sapiens
tactttctgtccttctgttaaa

SEQ ID NO: 9053050 - DNA, 22 bp, Homo sapiens
tactttcatgtctatacatatt

SEQ ID NO: 9053051 - DNA, 22 bp, Homo sapiens
tactttattgtaaatgctgatg

SEQ ID NO: 9053052 - DNA, 22 bp, Homo sapiens
tacttgtagcaggtggcattta

SEQ ID NO: 9053053 - DNA, 22 bp, Homo sapiens
tagagctgagttgactccattt

SEQ ID NO: 9053054 - DNA, 22 bp, Homo sapiens
tagagctgctggactgtaacag

SEQ ID NO: 9053055 - DNA, 22 bp, Homo sapiens
tagagctgataatgaggccaag

SEQ ID NO: 9053056 - DNA, 22 bp, Homo sapiens
tagaggagggctgttcttcagt

SEQ ID NO: 9053057 - DNA, 22 bp, Homo sapiens
tagaggaggtgattcttgagct

SEQ ID NO: 9053058 - DNA, 22 bp, Homo sapiens
tagcaaaaaaactggcatctcc

SEQ ID NO: 9053059 - DNA, 22 bp, Homo sapiens
tagcaaaaactgcagttacttt

SEQ ID NO: 9053060 - DNA, 22 bp, Homo sapiens
tagcacaagaagtacacataga

SEQ ID NO: 9053061 - DNA, 22 bp, Homo sapiens
tagattttaggagattttactg

SEQ ID NO: 9053062 - DNA, 22 bp, Homo sapiens
tagattttgcatttctaacaag

SEQ ID NO: 9053063 - DNA, 20 bp, Homo sapiens
tagatgtttcctgtcataaa

SEQ ID NO: 9053064 - DNA, 22 bp, Homo sapiens
tagtaaaaggtcttcctttgtt

SEQ ID NO: 9053065 - DNA, 22 bp, Homo sapiens
tagtaaaaagcaatggtgagta

SEQ ID NO: 9053066 - DNA, 22 bp, Homo sapiens
tagtcacctttggcacctgcaa

SEQ ID NO: 9053067 - DNA, 22 bp, Homo sapiens
tagtggggcctgggagggttcc

SEQ ID NO: 9053068 - DNA, 22 bp, Homo sapiens
tagtggggaaggaggacaagaa

SEQ ID NO: 9053069 - DNA, 22 bp, Homo sapiens
taggctcacatagcactaagtg

SEQ ID NO: 9053070 - DNA, 22 bp, Homo sapiens
taggaatgataatagtaaagag

SEQ ID NO: 9053071 - DNA, 22 bp, Homo sapiens
tatactctgagaaacgtgtcac

SEQ ID NO: 9053072 - DNA, 22 bp, Homo sapiens
tatactacgcaccaaacaaagg

SEQ ID NO: 9053073 - DNA, 20 bp, Homo sapiens
tatactaacatatatctgtt

SEQ ID NO: 9053074 - DNA, 22 bp, Homo sapiens
tatacatgttttacataagtga

SEQ ID NO: 9053075 - DNA, 22 bp, Homo sapiens
tagttaaagccctaaattgata

SEQ ID NO: 9053076 - DNA, 22 bp, Homo sapiens
tagttaatggaaatgatggaaa

SEQ ID NO: 9053077 - DNA, 22 bp, Homo sapiens
tagtgtttagtacatatgcata

SEQ ID NO: 9053078 - DNA, 22 bp, Homo sapiens
tatattaacttgtgatcctgga

SEQ ID NO: 9053079 - DNA, 22 bp, Homo sapiens
tatattacctgcctgatctata

SEQ ID NO: 9053080 - DNA, 22 bp, Homo sapiens
tatagacaagcgtaacaagaag

SEQ ID NO: 9053081 - DNA, 22 bp, Homo sapiens
tatatgcagtgtgtcattcaag

SEQ ID NO: 9053082 - DNA, 22 bp, Homo sapiens
tatatgtaaataagtctaatgt

SEQ ID NO: 9053083 - DNA, 22 bp, Homo sapiens
tatatgtaagctatgtaagagt

SEQ ID NO: 9053084 - DNA, 22 bp, Homo sapiens
tatcaaagttgtcctgtgaagt

SEQ ID NO: 9053085 - DNA, 22 bp, Homo sapiens
tatcaaaggctatgtgattttt

SEQ ID NO: 9053086 - DNA, 22 bp, Homo sapiens
tatattttagacaccctcacgc

SEQ ID NO: 9053087 - DNA, 22 bp, Homo sapiens
tatctagatggattttagtgaa

SEQ ID NO: 9053088 - DNA, 22 bp, Homo sapiens
tatctataatgttttacttcct

SEQ ID NO: 9053089 - DNA, 22 bp, Homo sapiens
tatgcagtgtatgcactgagat

SEQ ID NO: 9053090 - DNA, 21 bp, Homo sapiens
tatgcagtttacttaggtatt

SEQ ID NO: 9053091 - DNA, 22 bp, Homo sapiens
tatgcagtgagcactatttata

SEQ ID NO: 9053092 - DNA, 22 bp, Homo sapiens
tatgcactggtactattcgtgt

SEQ ID NO: 9053093 - DNA, 22 bp, Homo sapiens
tatgcacattcacacaaaaatg

SEQ ID NO: 9053094 - DNA, 22 bp, Homo sapiens
tatctttattatgtctatctgc

SEQ ID NO: 9053095 - DNA, 22 bp, Homo sapiens
tatctttaacttgcagtattta

SEQ ID NO: 9053096 - DNA, 22 bp, Homo sapiens
tatttccagcagtaagaagaca

SEQ ID NO: 9053097 - DNA, 22 bp, Homo sapiens
tatttctaagagatatctgtac

SEQ ID NO: 9053098 - DNA, 22 bp, Homo sapiens
tatttgtagaatggattaaggg

SEQ ID NO: 9053099 - DNA, 22 bp, Homo sapiens
tatttgtatgtgtgtacatata

SEQ ID NO: 9053100 - DNA, 22 bp, Homo sapiens
tattttcaccttctctggatat

SEQ ID NO: 9053101 - DNA, 22 bp, Homo sapiens
tattttcaccttctctggatat

SEQ ID NO: 9053102 - DNA, 22 bp, Homo sapiens
tattttcaccttctctggatat

SEQ ID NO: 9053103 - DNA, 22 bp, Homo sapiens
tattttcatcttgtccttggat

SEQ ID NO: 9053104 - DNA, 22 bp, Homo sapiens
tattttcattctgtgtgactgt

SEQ ID NO: 9053105 - DNA, 22 bp, Homo sapiens
tatttgtgagactgactgaagt

SEQ ID NO: 9053106 - DNA, 22 bp, Homo sapiens
tatttgttgagttgttatgtct

SEQ ID NO: 9053107 - DNA, 22 bp, Homo sapiens
tatttcacaaagtttggggaca

SEQ ID NO: 9053108 - DNA, 22 bp, Homo sapiens
tatttcaagaacttctatccat

SEQ ID NO: 9053109 - DNA, 22 bp, Homo sapiens
tatttcaacgtatgaaaagctg

SEQ ID NO: 9053110 - DNA, 22 bp, Homo sapiens
tatttcacataccacagagtgt

SEQ ID NO: 9053111 - DNA, 22 bp, Homo sapiens
tatttcacaagatgctgatgct

SEQ ID NO: 9053112 - DNA, 22 bp, Homo sapiens
tatttcacagcagctcatttaa

SEQ ID NO: 9053113 - DNA, 22 bp, Homo sapiens
tatttcacattagataggtctg

SEQ ID NO: 9053114 - DNA, 22 bp, Homo sapiens
tatttcaccaccgctgatgaag

SEQ ID NO: 9053115 - DNA, 22 bp, Homo sapiens
tatttcaccagtaggaggctgt

SEQ ID NO: 9053116 - DNA, 22 bp, Homo sapiens
tatttcacatctatgaagtgag

SEQ ID NO: 9053117 - DNA, 22 bp, Homo sapiens
tatttcacatgtgggaaacata

SEQ ID NO: 9053118 - DNA, 22 bp, Homo sapiens
tatttcacctcacccaggagaa

SEQ ID NO: 9053119 - DNA, 22 bp, Homo sapiens
tatttcacctaaaagtgtcaaa

SEQ ID NO: 9053120 - DNA, 22 bp, Homo sapiens
tatttcaccatgttttccccat

SEQ ID NO: 9053121 - DNA, 22 bp, Homo sapiens
tatttcactattctctgtaact

SEQ ID NO: 9053122 - DNA, 22 bp, Homo sapiens
tatttcaccttactaagctgtg

SEQ ID NO: 9053123 - DNA, 22 bp, Homo sapiens
tatttcactcagtataccatag

SEQ ID NO: 9053124 - DNA, 22 bp, Homo sapiens
tatttcactccgagactctatg

SEQ ID NO: 9053125 - DNA, 20 bp, Homo sapiens
tatttcactctccagatggc

SEQ ID NO: 9053126 - DNA, 17 bp, Homo sapiens
tatttcactggctcccc

SEQ ID NO: 9053127 - DNA, 18 bp, Homo sapiens
tatttcacttttgggcat

SEQ ID NO: 9053128 - DNA, 23 bp, Homo sapiens
tattgcacacatagaaacataga

SEQ ID NO: 9053129 - DNA, 22 bp, Homo sapiens
tattgcatctcttcatatctgt

SEQ ID NO: 9053130 - DNA, 22 bp, Homo sapiens
tattgcatccccattgtgcccc

SEQ ID NO: 9053131 - DNA, 22 bp, Homo sapiens
tattgcatcatcctgcaggggt

SEQ ID NO: 9053132 - DNA, 22 bp, Homo sapiens
tattgcatcagtaatttagtgt

SEQ ID NO: 9053133 - DNA, 22 bp, Homo sapiens
tattgcatattgtacttgaatg

SEQ ID NO: 9053134 - DNA, 22 bp, Homo sapiens
tattgcatattattctagtggc

SEQ ID NO: 9053135 - DNA, 22 bp, Homo sapiens
tattgcatagaaggaaggagtt

SEQ ID NO: 9053136 - DNA, 22 bp, Homo sapiens
tattgcatacttaaatttccgg

SEQ ID NO: 9053137 - DNA, 21 bp, Homo sapiens
tattgcataccatgaatctga

SEQ ID NO: 9053138 - DNA, 21 bp, Homo sapiens
tattgcataacaaattaccct

SEQ ID NO: 9053139 - DNA, 23 bp, Homo sapiens
tattgcagacatgaagggaatgc

SEQ ID NO: 9053140 - DNA, 22 bp, Homo sapiens
tattgcataaaatcaggttaga

SEQ ID NO: 9053141 - DNA, 22 bp, Homo sapiens
tattgcaggttccaaccgggaa

SEQ ID NO: 9053142 - DNA, 19 bp, Homo sapiens
tattgcagtgttaggagga

SEQ ID NO: 9053143 - DNA, 22 bp, Homo sapiens
tattgcagaatgtgagttggca

SEQ ID NO: 9053144 - DNA, 22 bp, Homo sapiens
tattgcagacaaaatgagctac

SEQ ID NO: 9053145 - DNA, 22 bp, Homo sapiens
tattggtttattgtgtatgaga

SEQ ID NO: 9053146 - DNA, 22 bp, Homo sapiens
tattgcattatggtaggaaagg

SEQ ID NO: 9053147 - DNA, 22 bp, Homo sapiens
tattgcatcttagtgtaagtca

SEQ ID NO: 9053148 - DNA, 22 bp, Homo sapiens
tattgcatgtgatagaggcagg

SEQ ID NO: 9053149 - DNA, 22 bp, Homo sapiens
tatgttctctgctctaggatgt

SEQ ID NO: 9053150 - DNA, 22 bp, Homo sapiens
tatgttctgactctacatggga

SEQ ID NO: 9053151 - DNA, 22 bp, Homo sapiens
tatgttattttcatacaacaga

SEQ ID NO: 9053152 - DNA, 22 bp, Homo sapiens
tatgttattttcatacaacaga

SEQ ID NO: 9053153 - DNA, 23 bp, Homo sapiens
tatgttaggtttgcaagccagat

SEQ ID NO: 9053154 - DNA, 22 bp, Homo sapiens
tattcacaaaatgaggtcctca

SEQ ID NO: 9053155 - DNA, 22 bp, Homo sapiens
tattcacaggcacgaaatattg

SEQ ID NO: 9053156 - DNA, 22 bp, Homo sapiens
tattcacaggcacgaaatattg

SEQ ID NO: 9053157 - DNA, 22 bp, Homo sapiens
tattcacatgaaaacaaatttt

SEQ ID NO: 9053158 - DNA, 22 bp, Homo sapiens
tattcacatgtacatatgctca

SEQ ID NO: 9053159 - DNA, 22 bp, Homo sapiens
tattcacaggctggagtgatgt

SEQ ID NO: 9053160 - DNA, 22 bp, Homo sapiens
tattcacattaataagtcttca

SEQ ID NO: 9053161 - DNA, 22 bp, Homo sapiens
tattcacattctcaggcctggt

SEQ ID NO: 9053162 - DNA, 22 bp, Homo sapiens
tattcagaggtgaagtagggag

SEQ ID NO: 9053163 - DNA, 22 bp, Homo sapiens
tattcatagtaaacaaaagtgg

SEQ ID NO: 9053164 - DNA, 22 bp, Homo sapiens
tattcatattgtaaaagaagtg

SEQ ID NO: 9053165 - DNA, 22 bp, Homo sapiens
tattgagttacagaaaatactt

SEQ ID NO: 9053166 - DNA, 20 bp, Homo sapiens
ctcagaaaagctaaggagaa

SEQ ID NO: 9053167 - DNA, 22 bp, Homo sapiens
ctcagaaaacctctttcttgat

SEQ ID NO: 9053168 - DNA, 22 bp, Homo sapiens
ttgaataatatgcttcgttctc

SEQ ID NO: 9053169 - DNA, 22 bp, Homo sapiens
ttgaataatgtgtatgttgtta

SEQ ID NO: 9053170 - DNA, 21 bp, Homo sapiens
ttcttcatgatgattaatggc

SEQ ID NO: 9053171 - DNA, 22 bp, Homo sapiens
ttgaaggaggctcctttttaaa

SEQ ID NO: 9053172 - DNA, 22 bp, Homo sapiens
ttgaaggtgacatatctggagc

SEQ ID NO: 9053173 - DNA, 22 bp, Homo sapiens
ttgaaggtaaattatattgatc

SEQ ID NO: 9053174 - DNA, 22 bp, Homo sapiens
ttgaaggtttaactgagaggca

SEQ ID NO: 9053175 - DNA, 22 bp, Homo sapiens
ttcttaaagaggcaaaacacag

SEQ ID NO: 9053176 - DNA, 22 bp, Homo sapiens
ttcttaactcaaatatatatcc

SEQ ID NO: 9053177 - DNA, 20 bp, Homo sapiens
ttcttaaagacctcactttg

SEQ ID NO: 9053178 - DNA, 22 bp, Homo sapiens
ttcttaactggaaaatgtcaga

SEQ ID NO: 9053179 - DNA, 22 bp, Homo sapiens
ttcttaagaggaacatttttgt

SEQ ID NO: 9053180 - DNA, 23 bp, Homo sapiens
ttcttacaaggctggcccacttg

SEQ ID NO: 9053181 - DNA, 19 bp, Homo sapiens
ttcttacaacaccctggga

SEQ ID NO: 9053182 - DNA, 22 bp, Homo sapiens
ttcttacaaacaagatcattga

SEQ ID NO: 9053183 - DNA, 22 bp, Homo sapiens
ttctgtctctgtgtttacatta

SEQ ID NO: 9053184 - DNA, 22 bp, Homo sapiens
ttctctttttgcatctcaacct

SEQ ID NO: 9053185 - DNA, 22 bp, Homo sapiens
ttctctttttgcatctcaacct

SEQ ID NO: 9053186 - DNA, 22 bp, Homo sapiens
ttctcttttgtgatgtgagatg

SEQ ID NO: 9053187 - DNA, 22 bp, Homo sapiens
ttctcttttgtgatgtgagatg

SEQ ID NO: 9053188 - DNA, 22 bp, Homo sapiens
ttgatcaaatcagctactgagg

SEQ ID NO: 9053189 - DNA, 22 bp, Homo sapiens
ctcagaaacggagctgccattt

SEQ ID NO: 9053190 - DNA, 22 bp, Homo sapiens
ctcagaaagcaatctggtgagg

SEQ ID NO: 9053191 - DNA, 22 bp, Homo sapiens
ctcagccccaattctccccatt

SEQ ID NO: 9053192 - DNA, 22 bp, Homo sapiens
ctcaggccaggtttctcccaca

SEQ ID NO: 9053193 - DNA, 22 bp, Homo sapiens
ctcaggccattcttccagctgc

SEQ ID NO: 9053194 - DNA, 22 bp, Homo sapiens
ttgctgtagctactatgtattc

SEQ ID NO: 9053195 - DNA, 23 bp, Homo sapiens
ttgcacagtgtatacacatattt

SEQ ID NO: 9053196 - DNA, 22 bp, Homo sapiens
ttgcacagggctggaatgtcct

SEQ ID NO: 9053197 - DNA, 22 bp, Homo sapiens
ctcaggcctgagtggcagtccc

SEQ ID NO: 9053198 - DNA, 22 bp, Homo sapiens
ctcaggccttgaagtcttttct

SEQ ID NO: 9053199 - DNA, 18 bp, Homo sapiens
ctcaggcctttccctgtg

SEQ ID NO: 9053200 - DNA, 22 bp, Homo sapiens
ttgcacagaatgacaatatgta

SEQ ID NO: 9053201 - DNA, 22 bp, Homo sapiens
ttgcacagagtggatattcagt

SEQ ID NO: 9053202 - DNA, 21 bp, Homo sapiens
ttgcaccatgataaattcaga

SEQ ID NO: 9053203 - DNA, 22 bp, Homo sapiens
ttgcaccaaatgagttaaaatt

SEQ ID NO: 9053204 - DNA, 22 bp, Homo sapiens
ttgcaccatttcacttccatta

SEQ ID NO: 9053205 - DNA, 22 bp, Homo sapiens
ttgcctatgtaactttatattt

SEQ ID NO: 9053206 - DNA, 22 bp, Homo sapiens
ttctcaaaactcagggtatctg

SEQ ID NO: 9053207 - DNA, 23 bp, Homo sapiens
ttctcagtcctgcccagggaggc

SEQ ID NO: 9053208 - DNA, 22 bp, Homo sapiens
ttctcagtatgtgacgaggacc

SEQ ID NO: 9053209 - DNA, 22 bp, Homo sapiens
ttctcagtttcatagctgagca

SEQ ID NO: 9053210 - DNA, 19 bp, Homo sapiens
ttctcagttcaggagaaga

SEQ ID NO: 9053211 - DNA, 22 bp, Homo sapiens
ttctcataaatcctgagaccta

SEQ ID NO: 9053212 - DNA, 22 bp, Homo sapiens
ttctcatacaggatctcttatt

SEQ ID NO: 9053213 - DNA, 22 bp, Homo sapiens
ttctcatagagacatgattata

SEQ ID NO: 9053214 - DNA, 22 bp, Homo sapiens
ttctcatacaggatctcttatt

SEQ ID NO: 9053215 - DNA, 22 bp, Homo sapiens
ttctcatgtaaatgccatcatc

SEQ ID NO: 9053216 - DNA, 22 bp, Homo sapiens
ttctcatgatgcaattcatccc

SEQ ID NO: 9053217 - DNA, 22 bp, Homo sapiens
ttctcatagagacatgattata

SEQ ID NO: 9053218 - DNA, 22 bp, Homo sapiens
ttctcatgaaactcgcttcctc

SEQ ID NO: 9053219 - DNA, 22 bp, Homo sapiens
ttctcatatgcactctatttga

SEQ ID NO: 9053220 - DNA, 22 bp, Homo sapiens
ttctcatagatgctatagacag

SEQ ID NO: 9053221 - DNA, 22 bp, Homo sapiens
ttctcatatgcactctatttga

SEQ ID NO: 9053222 - DNA, 22 bp, Homo sapiens
ttctcatatgcactctatttga

SEQ ID NO: 9053223 - DNA, 22 bp, Homo sapiens
ttctccttgaaaagctgcatct

SEQ ID NO: 9053224 - DNA, 21 bp, Homo sapiens
ttctccttcttgatccaagca

SEQ ID NO: 9053225 - DNA, 22 bp, Homo sapiens
ctagttctgccattcagtgtca

SEQ ID NO: 9053226 - DNA, 22 bp, Homo sapiens
ctagttctagatccctgaggaa

SEQ ID NO: 9053227 - DNA, 22 bp, Homo sapiens
ttctacatgagaaaatgtattt

SEQ ID NO: 9053228 - DNA, 22 bp, Homo sapiens
ctacagtgaagactagctatag

SEQ ID NO: 9053229 - DNA, 22 bp, Homo sapiens
ttctaccagaccccagacttgt

SEQ ID NO: 9053230 - DNA, 22 bp, Homo sapiens
ctacattaaattggcttactta

SEQ ID NO: 9053231 - DNA, 22 bp, Homo sapiens
ctacatacatatacatgcagtt

SEQ ID NO: 9053232 - DNA, 22 bp, Homo sapiens
ctaacatttggaaggcttatga

SEQ ID NO: 9053233 - DNA, 22 bp, Homo sapiens
ctaacatttattgagcacttag

SEQ ID NO: 9053234 - DNA, 22 bp, Homo sapiens
ttctacaggtactgaagtacat

SEQ ID NO: 9053235 - DNA, 22 bp, Homo sapiens
ttctacagtgactgcagccata

SEQ ID NO: 9053236 - DNA, 22 bp, Homo sapiens
ttctacagaataaatgtttaca

SEQ ID NO: 9053237 - DNA, 22 bp, Homo sapiens
ttccttttgcaaggtcctctag

SEQ ID NO: 9053238 - DNA, 22 bp, Homo sapiens
ttcctttttacataatcacatt

SEQ ID NO: 9053239 - DNA, 22 bp, Homo sapiens
ttctacactcacccagctgtaa

SEQ ID NO: 9053240 - DNA, 22 bp, Homo sapiens
ttctacacttttcattagctag

SEQ ID NO: 9053241 - DNA, 22 bp, Homo sapiens
ttctacactgagttttttccct

SEQ ID NO: 9053242 - DNA, 22 bp, Homo sapiens
cgtccaggaagatcggccgatg

SEQ ID NO: 9053243 - DNA, 22 bp, Homo sapiens
cgtccagggcgggctcccctca

SEQ ID NO: 9053244 - DNA, 19 bp, Homo sapiens
cgtccaggtgctggaagat

SEQ ID NO: 9053245 - DNA, 22 bp, Homo sapiens
cgtcccgggttcacgccattct

SEQ ID NO: 9053246 - DNA, 22 bp, Homo sapiens
cgtccgcaatgcaagcctttta

SEQ ID NO: 9053247 - DNA, 22 bp, Homo sapiens
ttcctccagcctggagcacttc

SEQ ID NO: 9053248 - DNA, 22 bp, Homo sapiens
cgtctggcttctccacggtaaa

SEQ ID NO: 9053249 - DNA, 22 bp, Homo sapiens
ttcctctcctcccaccaggtga

SEQ ID NO: 9053250 - DNA, 22 bp, Homo sapiens
ctaaatgatggatttaaacttt

SEQ ID NO: 9053251 - DNA, 22 bp, Homo sapiens
ttcctctgaaatggcttggaaa

SEQ ID NO: 9053252 - DNA, 22 bp, Homo sapiens
ttccaccattcatgctaatatt

SEQ ID NO: 9053253 - DNA, 22 bp, Homo sapiens
ttccacattccttacattcata

SEQ ID NO: 9053254 - DNA, 22 bp, Homo sapiens
ttaagctatacattgttagagt

SEQ ID NO: 9053255 - DNA, 22 bp, Homo sapiens
ttaaaagagcagcccagcatat

SEQ ID NO: 9053256 - DNA, 22 bp, Homo sapiens
ttaaaagggatgttatctgtaa

SEQ ID NO: 9053257 - DNA, 22 bp, Homo sapiens
ttaaaatcacagtcacccagta

SEQ ID NO: 9053258 - DNA, 22 bp, Homo sapiens
ttacaatcatctaggataaaga

SEQ ID NO: 9053259 - DNA, 22 bp, Homo sapiens
ttacaatctgattgtctcatct

SEQ ID NO: 9053260 - DNA, 20 bp, Homo sapiens
ttacaagtttctaataacca

SEQ ID NO: 9053261 - DNA, 22 bp, Homo sapiens
ttacaaagcgttgagacaagta

SEQ ID NO: 9053262 - DNA, 21 bp, Homo sapiens
ttacaaagctacagatgttgc

SEQ ID NO: 9053263 - DNA, 22 bp, Homo sapiens
ttaatgacttatatttaaagca

SEQ ID NO: 9053264 - DNA, 22 bp, Homo sapiens
ttaatgacatcataggtgaagt

SEQ ID NO: 9053265 - DNA, 22 bp, Homo sapiens
ttaatgaatgtgtgctaacgtt

SEQ ID NO: 9053266 - DNA, 22 bp, Homo sapiens
ttaatgacctggaagaagtgat

SEQ ID NO: 9053267 - DNA, 22 bp, Homo sapiens
ttaatgcagaaatcaaactgac

SEQ ID NO: 9053268 - DNA, 22 bp, Homo sapiens
ttaatgcagctctaccacacag

SEQ ID NO: 9053269 - DNA, 22 bp, Homo sapiens
tgttttcatttgatgtaacaaa

SEQ ID NO: 9053270 - DNA, 22 bp, Homo sapiens
tgttttcatggagatggtggcg

SEQ ID NO: 9053271 - DNA, 22 bp, Homo sapiens
tgttttcatcacagaatgtaac

SEQ ID NO: 9053272 - DNA, 17 bp, Homo sapiens
tgttttcattcattgct

SEQ ID NO: 9053273 - DNA, 22 bp, Homo sapiens
tgttttcatggttatgtgtcta

SEQ ID NO: 9053274 - DNA, 22 bp, Homo sapiens
tgtttcttctcacacaaactca

SEQ ID NO: 9053275 - DNA, 19 bp, Homo sapiens
tgtttcttcctccatctga

SEQ ID NO: 9053276 - DNA, 22 bp, Homo sapiens
cctggggagaagagcttccccc

SEQ ID NO: 9053277 - DNA, 22 bp, Homo sapiens
tggttattaaggcctctttcag

SEQ ID NO: 9053278 - DNA, 22 bp, Homo sapiens
tggttcctcaagcgctggcggc

SEQ ID NO: 9053279 - DNA, 22 bp, Homo sapiens
tggttcctacgcacattgaatt

SEQ ID NO: 9053280 - DNA, 22 bp, Homo sapiens
tggttcctcaagcgctggcggc

SEQ ID NO: 9053281 - DNA, 22 bp, Homo sapiens
tggttcctacgcacattgaatt

SEQ ID NO: 9053282 - DNA, 22 bp, Homo sapiens
cctgcgtcgtgtgggcagtgac

SEQ ID NO: 9053283 - DNA, 22 bp, Homo sapiens
ttattattggtgagttaaggaa

SEQ ID NO: 9053284 - DNA, 22 bp, Homo sapiens
cgcaccactgaattccagcctg

SEQ ID NO: 9053285 - DNA, 23 bp, Homo sapiens
ttattttgtcagaagggactttt

SEQ ID NO: 9053286 - DNA, 22 bp, Homo sapiens
ttatgtaagtggagtcatatag

SEQ ID NO: 9053287 - DNA, 22 bp, Homo sapiens
ttatgtatgaatatagtagaag

SEQ ID NO: 9053288 - DNA, 22 bp, Homo sapiens
ttatgtatgaatatagtagaag

SEQ ID NO: 9053289 - DNA, 22 bp, Homo sapiens
cctttcttgctaagagtttatg

SEQ ID NO: 9053290 - DNA, 22 bp, Homo sapiens
cctttgggtgaattcctctctt

SEQ ID NO: 9053291 - DNA, 17 bp, Homo sapiens
cgagggcttgctggctc

SEQ ID NO: 9053292 - DNA, 22 bp, Homo sapiens
cgattttgtggcaaattcttct

SEQ ID NO: 9053293 - DNA, 22 bp, Homo sapiens
cgcaaagagctctaaatcagac

SEQ ID NO: 9053294 - DNA, 22 bp, Homo sapiens
ccttgtgcaggttcatgatggg

SEQ ID NO: 9053295 - DNA, 22 bp, Homo sapiens
cctttaaatggatgttcaactg

SEQ ID NO: 9053296 - DNA, 22 bp, Homo sapiens
ttacgaatgttagattgcatct

SEQ ID NO: 9053297 - DNA, 22 bp, Homo sapiens
ccttggctgtgttgcctgccct

SEQ ID NO: 9053298 - DNA, 19 bp, Homo sapiens
ccttgcctgtccctgcagc

SEQ ID NO: 9053299 - DNA, 22 bp, Homo sapiens
ccttggcttgtgggctgcagcc

SEQ ID NO: 9053300 - DNA, 21 bp, Homo sapiens
ccttctccacagggtctccgg

SEQ ID NO: 9053301 - DNA, 22 bp, Homo sapiens
ttacagaaggaacactactcag

SEQ ID NO: 9053302 - DNA, 22 bp, Homo sapiens
ttacagaactgtcttgaaattt

SEQ ID NO: 9053303 - DNA, 22 bp, Homo sapiens
ttacagaactgtcttgaaattt

SEQ ID NO: 9053304 - DNA, 23 bp, Homo sapiens
ttacagaaagtatgcttttgttt

SEQ ID NO: 9053305 - DNA, 22 bp, Homo sapiens
ttacagaaaatgtgttttaact

SEQ ID NO: 9053306 - DNA, 22 bp, Homo sapiens
ttacctaaaatagctcaattta

SEQ ID NO: 9053307 - DNA, 22 bp, Homo sapiens
ttacctaaaatagctcaattta

SEQ ID NO: 9053308 - DNA, 22 bp, Homo sapiens
ttaccaaatgaaatagagattt

SEQ ID NO: 9053309 - DNA, 22 bp, Homo sapiens
ttaccaattcagacatctcttc

SEQ ID NO: 9053310 - DNA, 22 bp, Homo sapiens
ccttctgctccctggccagggc

SEQ ID NO: 9053311 - DNA, 22 bp, Homo sapiens
ccttcttctgtgtggcccaaga

SEQ ID NO: 9053312 - DNA, 22 bp, Homo sapiens
ctctgaggtcctacagtgaccc

SEQ ID NO: 9053313 - DNA, 22 bp, Homo sapiens
ctctctggcacttcattgctgt

SEQ ID NO: 9053314 - DNA, 22 bp, Homo sapiens
ctctgagggctcgagggacgcg

SEQ ID NO: 9053315 - DNA, 22 bp, Homo sapiens
ctctgagggtctaaggagtcac

SEQ ID NO: 9053316 - DNA, 22 bp, Homo sapiens
ctctgaggctccatgcaggctt

SEQ ID NO: 9053317 - DNA, 22 bp, Homo sapiens
tttctctagctattcattaaat

SEQ ID NO: 9053318 - DNA, 22 bp, Homo sapiens
tttctcacccaagagttatttt

SEQ ID NO: 9053319 - DNA, 22 bp, Homo sapiens
ctctatttatggcatctttatg

SEQ ID NO: 9053320 - DNA, 22 bp, Homo sapiens
ctctagctgaggtcactgctat

SEQ ID NO: 9053321 - DNA, 22 bp, Homo sapiens
ctctagcttttgataccagtgt

SEQ ID NO: 9053322 - DNA, 22 bp, Homo sapiens
ctctctggaattaaagcccaat

SEQ ID NO: 9053323 - DNA, 22 bp, Homo sapiens
tttctctgctgtgttggcagct

SEQ ID NO: 9053324 - DNA, 19 bp, Homo sapiens
ctctggagcagacactgga

SEQ ID NO: 9053325 - DNA, 22 bp, Homo sapiens
ctctggagtcaggcagccctgg

SEQ ID NO: 9053326 - DNA, 21 bp, Homo sapiens
ctctggagtcaagagcttcca

SEQ ID NO: 9053327 - DNA, 22 bp, Homo sapiens
tttcttagtcctagagtgattt

SEQ ID NO: 9053328 - DNA, 22 bp, Homo sapiens
tttcttcttgatttaaacaggg

SEQ ID NO: 9053329 - DNA, 21 bp, Homo sapiens
ctctacattcccagcaactct

SEQ ID NO: 9053330 - DNA, 22 bp, Homo sapiens
ctcgggtaccatgctaggcact

SEQ ID NO: 9053331 - DNA, 22 bp, Homo sapiens
tttcaaagtcaatatcattacc

SEQ ID NO: 9053332 - DNA, 22 bp, Homo sapiens
tttcaaataccataaacctaat

SEQ ID NO: 9053333 - DNA, 22 bp, Homo sapiens
tttcaaagtcaagaaggatact

SEQ ID NO: 9053334 - DNA, 22 bp, Homo sapiens
tttcaaagtcaagaaggatact

SEQ ID NO: 9053335 - DNA, 22 bp, Homo sapiens
tttcaaagtaaggattttcatc

SEQ ID NO: 9053336 - DNA, 22 bp, Homo sapiens
tttatatgtttgtacaattaag

SEQ ID NO: 9053337 - DNA, 22 bp, Homo sapiens
tttatattacctggaatagctt

SEQ ID NO: 9053338 - DNA, 22 bp, Homo sapiens
ctcctgctgaatggccaggagc

SEQ ID NO: 9053339 - DNA, 22 bp, Homo sapiens
tttacacaaaagatagcacacc

SEQ ID NO: 9053340 - DNA, 22 bp, Homo sapiens
tttacaattggttttctctaat

SEQ ID NO: 9053341 - DNA, 22 bp, Homo sapiens
tttacaattggttttctctaat

SEQ ID NO: 9053342 - DNA, 20 bp, Homo sapiens
ctcctcagttccatgggagg

SEQ ID NO: 9053343 - DNA, 22 bp, Homo sapiens
tttacaagtttacagaatgatg

SEQ ID NO: 9053344 - DNA, 22 bp, Homo sapiens
tttatatggttgactatgagtt

SEQ ID NO: 9053345 - DNA, 18 bp, Homo sapiens
tttatatggatagagacc

SEQ ID NO: 9053346 - DNA, 21 bp, Homo sapiens
ctcaggctggcagcaggctag

SEQ ID NO: 9053347 - DNA, 22 bp, Homo sapiens
ctcaggctgtgatgtgatggca

SEQ ID NO: 9053348 - DNA, 22 bp, Homo sapiens
ctccccaaagataacggcttct

SEQ ID NO: 9053349 - DNA, 22 bp, Homo sapiens
ctccccaactcagccgaggctt

SEQ ID NO: 9053350 - DNA, 22 bp, Homo sapiens
ctccccaccttcgcggtccctg

SEQ ID NO: 9053351 - DNA, 22 bp, Homo sapiens
ttgtttcaaatatttcagaata

SEQ ID NO: 9053352 - DNA, 22 bp, Homo sapiens
ttgtttaatatcgtgaagtact

SEQ ID NO: 9053353 - DNA, 22 bp, Homo sapiens
ttgtttaatgcctcatacatct

SEQ ID NO: 9053354 - DNA, 22 bp, Homo sapiens
ctcctcagctgggaggagtccc

SEQ ID NO: 9053355 - DNA, 22 bp, Homo sapiens
ctcccttccaatgactatgctt

SEQ ID NO: 9053356 - DNA, 22 bp, Homo sapiens
ctccctggtgtcccctccagga

SEQ ID NO: 9053357 - DNA, 23 bp, Homo sapiens
ctccctggcccttgggagacctg

SEQ ID NO: 9053358 - DNA, 22 bp, Homo sapiens
ctccctggctttgtcctgaggc

SEQ ID NO: 9053359 - DNA, 22 bp, Homo sapiens
ctccctgggcagatgtggctct

SEQ ID NO: 9053360 - DNA, 23 bp, Homo sapiens
ctccctggagtttctggaagatg

SEQ ID NO: 9053361 - DNA, 22 bp, Homo sapiens
ctccctggcagccgcactcctg

SEQ ID NO: 9053362 - DNA, 22 bp, Homo sapiens
ctccctggcacagcgagaggtt

SEQ ID NO: 9053363 - DNA, 22 bp, Homo sapiens
ctccctggaggcccagacctgg

SEQ ID NO: 9053364 - DNA, 22 bp, Homo sapiens
ctccctggaggtgagctggcac

SEQ ID NO: 9053365 - DNA, 22 bp, Homo sapiens
ctccctgcttgtttcccttcag

SEQ ID NO: 9053366 - DNA, 22 bp, Homo sapiens
ctgcctgcatcccacagtgggg

SEQ ID NO: 9053367 - DNA, 22 bp, Homo sapiens
ctgctcctggtcatcctccact

SEQ ID NO: 9053368 - DNA, 22 bp, Homo sapiens
ctgctctatgtcctcacccagg

SEQ ID NO: 9053369 - DNA, 22 bp, Homo sapiens
ctgctctaggttcctgcatatg

SEQ ID NO: 9053370 - DNA, 22 bp, Homo sapiens
ctgctctaggtccattgcggga

SEQ ID NO: 9053371 - DNA, 22 bp, Homo sapiens
ctgctctaggtcatgggtactt

SEQ ID NO: 9053372 - DNA, 22 bp, Homo sapiens
ctgctctagagagcattagtca

SEQ ID NO: 9053373 - DNA, 22 bp, Homo sapiens
ctgctctaatatcagatagact

SEQ ID NO: 9053374 - DNA, 22 bp, Homo sapiens
ctgctctaggggcagggccctt

SEQ ID NO: 9053375 - DNA, 22 bp, Homo sapiens
ctgctctaggtattgaggctaa

SEQ ID NO: 9053376 - DNA, 22 bp, Homo sapiens
ctgctctaagctggtggagagt

SEQ ID NO: 9053377 - DNA, 22 bp, Homo sapiens
ctgctctaactgcattagtttt

SEQ ID NO: 9053378 - DNA, 22 bp, Homo sapiens
ctgcatatcaaattactcctgg

SEQ ID NO: 9053379 - DNA, 22 bp, Homo sapiens
ctgcatatgatagatgccttgc

SEQ ID NO: 9053380 - DNA, 22 bp, Homo sapiens
ctgcatcactcttactggcttt

SEQ ID NO: 9053381 - DNA, 22 bp, Homo sapiens
ctgcagtaacgatcatggtgcc

SEQ ID NO: 9053382 - DNA, 22 bp, Homo sapiens
ctgcaggttgagcagccaggtt

SEQ ID NO: 9053383 - DNA, 22 bp, Homo sapiens
ctgcaggttaggagcactcctt

SEQ ID NO: 9053384 - DNA, 22 bp, Homo sapiens
ctgcagggtttttcaaggacaa

SEQ ID NO: 9053385 - DNA, 22 bp, Homo sapiens
ctgcaggggctggagttggctt

SEQ ID NO: 9053386 - DNA, 22 bp, Homo sapiens
ctgcaggggcctcgagcacagg

SEQ ID NO: 9053387 - DNA, 22 bp, Homo sapiens
ctgcccctggctggtgaagcag

SEQ ID NO: 9053388 - DNA, 22 bp, Homo sapiens
ctgcccctggtgatggacgcca

SEQ ID NO: 9053389 - DNA, 22 bp, Homo sapiens
ctgcccctggtgatggacgcca

SEQ ID NO: 9053390 - DNA, 22 bp, Homo sapiens
ctgccctgcttctgagggaagc

SEQ ID NO: 9053391 - DNA, 22 bp, Homo sapiens
ctgccctgctggagatcacagt

SEQ ID NO: 9053392 - DNA, 22 bp, Homo sapiens
ctgccctgcttgatgacagcga

SEQ ID NO: 9053393 - DNA, 22 bp, Homo sapiens
ctgccctgctaatgagttccaa

SEQ ID NO: 9053394 - DNA, 22 bp, Homo sapiens
ctgccctgggccaggaagcggc

SEQ ID NO: 9053395 - DNA, 22 bp, Homo sapiens
ctgccctgcttgatgacagcga

SEQ ID NO: 9053396 - DNA, 22 bp, Homo sapiens
ctgccctgggatggtctgtgcg

SEQ ID NO: 9053397 - DNA, 22 bp, Homo sapiens
ctgccctggccactgtgcccag

SEQ ID NO: 9053398 - DNA, 22 bp, Homo sapiens
ctgaaactttagttctgcaaca

SEQ ID NO: 9053399 - DNA, 22 bp, Homo sapiens
ctgaaactccatgagaaattgc

SEQ ID NO: 9053400 - DNA, 22 bp, Homo sapiens
ctgaagatgttctttttggttc

SEQ ID NO: 9053401 - DNA, 22 bp, Homo sapiens
ctgaagattataaacagacata

SEQ ID NO: 9053402 - DNA, 22 bp, Homo sapiens
ctgaagattcgcctttgtttat

SEQ ID NO: 9053403 - DNA, 22 bp, Homo sapiens
ctgaagatttttggtaatcatg

SEQ ID NO: 9053404 - DNA, 22 bp, Homo sapiens
ctgaagattcgcctttgtttat

SEQ ID NO: 9053405 - DNA, 22 bp, Homo sapiens
ctgaaggctaaaatggactgaa

SEQ ID NO: 9053406 - DNA, 18 bp, Homo sapiens
ctgaaggcaccagggcag

SEQ ID NO: 9053407 - DNA, 22 bp, Homo sapiens
ctgaaggcatttttgctgattt

SEQ ID NO: 9053408 - DNA, 22 bp, Homo sapiens
ctgaaggcaccaggggtgccag

SEQ ID NO: 9053409 - DNA, 22 bp, Homo sapiens
ttttctcaggtgcttatctaag

SEQ ID NO: 9053410 - DNA, 20 bp, Homo sapiens
ttttcctgtggtttgatatg

SEQ ID NO: 9053411 - DNA, 22 bp, Homo sapiens
ttttcagtttgcactgcagtgc

SEQ ID NO: 9053412 - DNA, 22 bp, Homo sapiens
tttttctgagcggtaatcatca

SEQ ID NO: 9053413 - DNA, 22 bp, Homo sapiens
tttttctagctcaaagattcta

SEQ ID NO: 9053414 - DNA, 22 bp, Homo sapiens
tttttctagaccttaaaggcca

SEQ ID NO: 9053415 - DNA, 22 bp, Homo sapiens
ttttctctatattgtctgtgaa

SEQ ID NO: 9053416 - DNA, 18 bp, Homo sapiens
ctgagggcaacagaggct

SEQ ID NO: 9053417 - DNA, 22 bp, Homo sapiens
ctgaggctgggcatggggtcca

SEQ ID NO: 9053418 - DNA, 22 bp, Homo sapiens
ctgagcttggcttatctccagc

SEQ ID NO: 9053419 - DNA, 22 bp, Homo sapiens
ctgagcttccagttcctccagg

SEQ ID NO: 9053420 - DNA, 22 bp, Homo sapiens
ctgagctggtgtttcagggtca

SEQ ID NO: 9053421 - DNA, 21 bp, Homo sapiens
ctgagctggggtgaaggttgc

SEQ ID NO: 9053422 - DNA, 22 bp, Homo sapiens
ctgagctgtgctaagtgaaatg

SEQ ID NO: 9053423 - DNA, 22 bp, Homo sapiens
ctgagctggttctcttgtgaaa

SEQ ID NO: 9053424 - DNA, 22 bp, Homo sapiens
ctgagctgggagtggatagtgg

SEQ ID NO: 9053425 - DNA, 22 bp, Homo sapiens
ctgagctgggcaactcttagat

SEQ ID NO: 9053426 - DNA, 22 bp, Homo sapiens
ctgagagatcaagccacaggat

SEQ ID NO: 9053427 - DNA, 22 bp, Homo sapiens
gaatgaaaaccttggctcaaat

SEQ ID NO: 9053428 - DNA, 22 bp, Homo sapiens
gacactttaggatttaaaagtc

SEQ ID NO: 9053429 - DNA, 22 bp, Homo sapiens
gacacttgacatccagcagcaa

SEQ ID NO: 9053430 - DNA, 22 bp, Homo sapiens
gacactgttatggtgaggtaag

SEQ ID NO: 9053431 - DNA, 22 bp, Homo sapiens
gacacttcacctttcccagcct

SEQ ID NO: 9053432 - DNA, 22 bp, Homo sapiens
gacactgtcccacagaattcga

SEQ ID NO: 9053433 - DNA, 22 bp, Homo sapiens
gacacagtaatgtgtttcatct

SEQ ID NO: 9053434 - DNA, 22 bp, Homo sapiens
gacagacactgtgtcctcactt

SEQ ID NO: 9053435 - DNA, 22 bp, Homo sapiens
gacagaaggcatctagggcacg

SEQ ID NO: 9053436 - DNA, 22 bp, Homo sapiens
gacactttctcaggtaaagcat

SEQ ID NO: 9053437 - DNA, 22 bp, Homo sapiens
gaaggggaaagttgagcaaata

SEQ ID NO: 9053438 - DNA, 19 bp, Homo sapiens
gaaggggaaggtgggtacc

SEQ ID NO: 9053439 - DNA, 22 bp, Homo sapiens
gaaggggactggcagctgcaga

SEQ ID NO: 9053440 - DNA, 18 bp, Homo sapiens
gaagggagctggaatgca

SEQ ID NO: 9053441 - DNA, 22 bp, Homo sapiens
gaaggtgcagtggctggaggct

SEQ ID NO: 9053442 - DNA, 22 bp, Homo sapiens
gaaggtagctgctgagatgaca

SEQ ID NO: 9053443 - DNA, 17 bp, Homo sapiens
gaatccttctctgttct

SEQ ID NO: 9053444 - DNA, 22 bp, Homo sapiens
gaatccttggttttaagcaata

SEQ ID NO: 9053445 - DNA, 22 bp, Homo sapiens
gaatctcaaattaagaatttta

SEQ ID NO: 9053446 - DNA, 22 bp, Homo sapiens
gaatctcaggaagatctctgca

SEQ ID NO: 9053447 - DNA, 22 bp, Homo sapiens
gaatcttaaatcggaatcttaa

SEQ ID NO: 9053448 - DNA, 20 bp, Homo sapiens
gaatcttactacattctctc

SEQ ID NO: 9053449 - DNA, 22 bp, Homo sapiens
gaatcttacctctctattgttg

SEQ ID NO: 9053450 - DNA, 22 bp, Homo sapiens
gaatcttatttttaaatcttcc

SEQ ID NO: 9053451 - DNA, 22 bp, Homo sapiens
gaatctcagtggaagcaggaag

SEQ ID NO: 9053452 - DNA, 22 bp, Homo sapiens
gaatctcattctaactagtagg

SEQ ID NO: 9053453 - DNA, 22 bp, Homo sapiens
gaatattttcagtacagatggt

SEQ ID NO: 9053454 - DNA, 22 bp, Homo sapiens
gaagggagaaggttgggtgacg

SEQ ID NO: 9053455 - DNA, 22 bp, Homo sapiens
gaaggcattttatgccttatag

SEQ ID NO: 9053456 - DNA, 22 bp, Homo sapiens
gaaggcatttcagagatctctg

SEQ ID NO: 9053457 - DNA, 22 bp, Homo sapiens
gaaggcattctattctacatat

SEQ ID NO: 9053458 - DNA, 22 bp, Homo sapiens
gaaggcaggtttttcaaaactg

SEQ ID NO: 9053459 - DNA, 22 bp, Homo sapiens
gaaggcaggtttttcaaaactg

SEQ ID NO: 9053460 - DNA, 22 bp, Homo sapiens
gaaggcataaaaccaattttgt

SEQ ID NO: 9053461 - DNA, 22 bp, Homo sapiens
gaaggcatctctggacttattt

SEQ ID NO: 9053462 - DNA, 22 bp, Homo sapiens
gaaggagctaccaagactgaat

SEQ ID NO: 9053463 - DNA, 22 bp, Homo sapiens
gaaggcaggcttctgattaggt

SEQ ID NO: 9053464 - DNA, 22 bp, Homo sapiens
gaaggagagggtcaaggataat

SEQ ID NO: 9053465 - DNA, 16 bp, Homo sapiens
gaaggagattcagaaa

SEQ ID NO: 9053466 - DNA, 22 bp, Homo sapiens
gaaaggagggaaacagagcggt

SEQ ID NO: 9053467 - DNA, 22 bp, Homo sapiens
gaaagcttccattttgtacatt

SEQ ID NO: 9053468 - DNA, 22 bp, Homo sapiens
gaaaggaaatattctaagcact

SEQ ID NO: 9053469 - DNA, 22 bp, Homo sapiens
gaagccaacattccaagtagaa

SEQ ID NO: 9053470 - DNA, 22 bp, Homo sapiens
gaagcatgctaaggattctcag

SEQ ID NO: 9053471 - DNA, 22 bp, Homo sapiens
gaagcagtttctgtaatgaaat

SEQ ID NO: 9053472 - DNA, 22 bp, Homo sapiens
gaagcagtatcctgacagcacc

SEQ ID NO: 9053473 - DNA, 22 bp, Homo sapiens
gaagcaagtggcctgattcaga

SEQ ID NO: 9053474 - DNA, 22 bp, Homo sapiens
gaagcaagtgcaaggaagaggc

SEQ ID NO: 9053475 - DNA, 22 bp, Homo sapiens
gagaaagatggaatcttacagg

SEQ ID NO: 9053476 - DNA, 22 bp, Homo sapiens
gagaaagatgtaggctgggagg

SEQ ID NO: 9053477 - DNA, 22 bp, Homo sapiens
gagaaagattgtccttcagggg

SEQ ID NO: 9053478 - DNA, 22 bp, Homo sapiens
gagaaagaaagggaagtttgtt

SEQ ID NO: 9053479 - DNA, 22 bp, Homo sapiens
gagaaagaaagggaagtttgtt

SEQ ID NO: 9053480 - DNA, 22 bp, Homo sapiens
gagaaagacgtaggctgggagg

SEQ ID NO: 9053481 - DNA, 22 bp, Homo sapiens
gagaaagatggaatcttacagg

SEQ ID NO: 9053482 - DNA, 22 bp, Homo sapiens
gagaaagatgaagagtggcgtt

SEQ ID NO: 9053483 - DNA, 22 bp, Homo sapiens
gagaaacactgttagtttatta

SEQ ID NO: 9053484 - DNA, 22 bp, Homo sapiens
gagagaaatgtgcagtttgggc

SEQ ID NO: 9053485 - DNA, 22 bp, Homo sapiens
gagagaaatgtgcagtttgggc

SEQ ID NO: 9053486 - DNA, 22 bp, Homo sapiens
gagacctcttggtatcgctagg

SEQ ID NO: 9053487 - DNA, 22 bp, Homo sapiens
gactccagggattggaagatgt

SEQ ID NO: 9053488 - DNA, 22 bp, Homo sapiens
gacatttagaagttagattcaa

SEQ ID NO: 9053489 - DNA, 22 bp, Homo sapiens
gactctagattcatggtggagt

SEQ ID NO: 9053490 - DNA, 22 bp, Homo sapiens
gactctcaagcacaagtccacc

SEQ ID NO: 9053491 - DNA, 22 bp, Homo sapiens
gacagaggagaagatgctgtgg

SEQ ID NO: 9053492 - DNA, 22 bp, Homo sapiens
gacagcagacaaaccatgtttt

SEQ ID NO: 9053493 - DNA, 22 bp, Homo sapiens
gacagcaatgacggggcagctg

SEQ ID NO: 9053494 - DNA, 22 bp, Homo sapiens
gacagcaagagacagagcatcc

SEQ ID NO: 9053495 - DNA, 21 bp, Homo sapiens
gacagcaactgtagtcctctt

SEQ ID NO: 9053496 - DNA, 22 bp, Homo sapiens
gacattctaaaaaatatggaag

SEQ ID NO: 9053497 - DNA, 22 bp, Homo sapiens
gacatttaaggcagtcacttaa

SEQ ID NO: 9053498 - DNA, 22 bp, Homo sapiens
gacatttactgaatactgatta

SEQ ID NO: 9053499 - DNA, 22 bp, Homo sapiens
gacatttaatagtattgtggga

SEQ ID NO: 9053500 - DNA, 22 bp, Homo sapiens
gacattctgtgactctgaacag

SEQ ID NO: 9053501 - DNA, 22 bp, Homo sapiens
gacattctgtcaatgttgactc

SEQ ID NO: 9053502 - DNA, 22 bp, Homo sapiens
gaggagagatggtagattgggt

SEQ ID NO: 9053503 - DNA, 22 bp, Homo sapiens
gaggagaggccatcgttgttat

SEQ ID NO: 9053504 - DNA, 22 bp, Homo sapiens
gaggagaggggctcccaagagc

SEQ ID NO: 9053505 - DNA, 22 bp, Homo sapiens
gaggagaggggctcccaagagc

SEQ ID NO: 9053506 - DNA, 22 bp, Homo sapiens
gaggcagcttagggtactgact

SEQ ID NO: 9053507 - DNA, 22 bp, Homo sapiens
gaggcagcttggggctgtgggt

SEQ ID NO: 9053508 - DNA, 22 bp, Homo sapiens
gaggcagggtgttgattacaga

SEQ ID NO: 9053509 - DNA, 22 bp, Homo sapiens
gaggcagggtgttgattacaga

SEQ ID NO: 9053510 - DNA, 22 bp, Homo sapiens
gaggcaggccctgaatgagtca

SEQ ID NO: 9053511 - DNA, 22 bp, Homo sapiens
gagggagccgccacagactggg

SEQ ID NO: 9053512 - DNA, 22 bp, Homo sapiens
gagggagctatgaatagaagaa

SEQ ID NO: 9053513 - DNA, 22 bp, Homo sapiens
gagggaggcatcatgaatccag

SEQ ID NO: 9053514 - DNA, 22 bp, Homo sapiens
gagggagctggagcagacgccg

SEQ ID NO: 9053515 - DNA, 22 bp, Homo sapiens
gagggagcttgatggatgtttg

SEQ ID NO: 9053516 - DNA, 22 bp, Homo sapiens
gagggagggaaagtttaacact

SEQ ID NO: 9053517 - DNA, 22 bp, Homo sapiens
gagggagggactagcattctct

SEQ ID NO: 9053518 - DNA, 22 bp, Homo sapiens
gagggagggccaggtcccaacc

SEQ ID NO: 9053519 - DNA, 22 bp, Homo sapiens
gagggaggggagctccaccctc

SEQ ID NO: 9053520 - DNA, 22 bp, Homo sapiens
gaggctgcactggctaaaggct

SEQ ID NO: 9053521 - DNA, 22 bp, Homo sapiens
gagggctgcaatgagacagaga

SEQ ID NO: 9053522 - DNA, 22 bp, Homo sapiens
gagggaggtgatactgaacgta

SEQ ID NO: 9053523 - DNA, 18 bp, Homo sapiens
gagggagtagctgaggtt

SEQ ID NO: 9053524 - DNA, 22 bp, Homo sapiens
gagggctgctgccagatatgcc

SEQ ID NO: 9053525 - DNA, 22 bp, Homo sapiens
gagggctgctggaaaaatgcag

SEQ ID NO: 9053526 - DNA, 22 bp, Homo sapiens
gaggggaaaacaggaattaaca

SEQ ID NO: 9053527 - DNA, 22 bp, Homo sapiens
gaggggctgggcagtccctgga

SEQ ID NO: 9053528 - DNA, 22 bp, Homo sapiens
gaggaacttcatctctatgcca

SEQ ID NO: 9053529 - DNA, 18 bp, Homo sapiens
gaggaaacaaggcagagg

SEQ ID NO: 9053530 - DNA, 22 bp, Homo sapiens
gagctgctgtgaggggagcttc

SEQ ID NO: 9053531 - DNA, 22 bp, Homo sapiens
gagctgctggctcctcaggtta

SEQ ID NO: 9053532 - DNA, 22 bp, Homo sapiens
gagctgagatcatgtacactag

SEQ ID NO: 9053533 - DNA, 22 bp, Homo sapiens
gagctgagatcgtgccattgca

SEQ ID NO: 9053534 - DNA, 22 bp, Homo sapiens
gagccctgcgtgtctgggggca

SEQ ID NO: 9053535 - DNA, 22 bp, Homo sapiens
gagctgaggctcaggctggcgt

SEQ ID NO: 9053536 - DNA, 22 bp, Homo sapiens
gagctgaggccagagtcttctg

SEQ ID NO: 9053537 - DNA, 22 bp, Homo sapiens
gagctgaggctgaggcctcact

SEQ ID NO: 9053538 - DNA, 22 bp, Homo sapiens
gagctgagcctgggtggaccgc

SEQ ID NO: 9053539 - DNA, 22 bp, Homo sapiens
gagctgagcttaactccttgaa

SEQ ID NO: 9053540 - DNA, 22 bp, Homo sapiens
gagctgaggatacatcagtgaa

SEQ ID NO: 9053541 - DNA, 22 bp, Homo sapiens
gagctgagatttgaagcaagtt

SEQ ID NO: 9053542 - DNA, 22 bp, Homo sapiens
gagctgagcagggagcctcact

SEQ ID NO: 9053543 - DNA, 23 bp, Homo sapiens
gagctgagtgtagggagactagg

SEQ ID NO: 9053544 - DNA, 22 bp, Homo sapiens
gagctgagtctgcagtcgccat

SEQ ID NO: 9053545 - DNA, 22 bp, Homo sapiens
gagctgagtatgaaggatgtga

SEQ ID NO: 9053546 - DNA, 22 bp, Homo sapiens
gagctgagtatcccactgaagt

SEQ ID NO: 9053547 - DNA, 22 bp, Homo sapiens
gagctgagtagaggctgctccc

SEQ ID NO: 9053548 - DNA, 22 bp, Homo sapiens
gagctgagggtctaggagggtt

SEQ ID NO: 9053549 - DNA, 22 bp, Homo sapiens
gagctgaggtgatgtggtcgtt

SEQ ID NO: 9053550 - DNA, 18 bp, Homo sapiens
gagcatgggcagtgggga

SEQ ID NO: 9053551 - DNA, 22 bp, Homo sapiens
gagcatggcagctgagggcagg

SEQ ID NO: 9053552 - DNA, 20 bp, Homo sapiens
gagcagtggagtttccaggg

SEQ ID NO: 9053553 - DNA, 20 bp, Homo sapiens
gagcagtgagccagggaaag

SEQ ID NO: 9053554 - DNA, 22 bp, Homo sapiens
gagccaggtttgaatctcagtc

SEQ ID NO: 9053555 - DNA, 22 bp, Homo sapiens
ctgggagatgactcagagcagg

SEQ ID NO: 9053556 - DNA, 22 bp, Homo sapiens
ctgggagaggctgctccgctct

SEQ ID NO: 9053557 - DNA, 22 bp, Homo sapiens
ctgcttccatgcaatggcagtc

SEQ ID NO: 9053558 - DNA, 20 bp, Homo sapiens
ctgcttccaggctcaccccc

SEQ ID NO: 9053559 - DNA, 21 bp, Homo sapiens
ctgcttcctctcttcatggca

SEQ ID NO: 9053560 - DNA, 22 bp, Homo sapiens
ctgcttcctccctgtaaaggca

SEQ ID NO: 9053561 - DNA, 22 bp, Homo sapiens
ctgcttccatggtctggagact

SEQ ID NO: 9053562 - DNA, 22 bp, Homo sapiens
ctgggctgtttgttctggtctc

SEQ ID NO: 9053563 - DNA, 22 bp, Homo sapiens
ctgtctgctatgcttgttgtca

SEQ ID NO: 9053564 - DNA, 19 bp, Homo sapiens
ctgtctgcggggcctgttc

SEQ ID NO: 9053565 - DNA, 22 bp, Homo sapiens
ctgtctgctagaacatctatac

SEQ ID NO: 9053566 - DNA, 22 bp, Homo sapiens
ctgtcacctgccagcataccca

SEQ ID NO: 9053567 - DNA, 22 bp, Homo sapiens
ctgtcacttaaattcaggctga

SEQ ID NO: 9053568 - DNA, 22 bp, Homo sapiens
ctgtcaaatggaaacttatcct

SEQ ID NO: 9053569 - DNA, 22 bp, Homo sapiens
ctgtattttttaagaatatctc

SEQ ID NO: 9053570 - DNA, 22 bp, Homo sapiens
ctgtcaatttatgttgacatgc

SEQ ID NO: 9053571 - DNA, 22 bp, Homo sapiens
ctgtatttgtcctctatttatt

SEQ ID NO: 9053572 - DNA, 22 bp, Homo sapiens
ctgtatataatgtatgcatggg

SEQ ID NO: 9053573 - DNA, 22 bp, Homo sapiens
ctgtatataatgtatgcatggg

SEQ ID NO: 9053574 - DNA, 22 bp, Homo sapiens
ctggtctgagggctcttgaggc

SEQ ID NO: 9053575 - DNA, 20 bp, Homo sapiens
ctggggagctgctcccacga

SEQ ID NO: 9053576 - DNA, 22 bp, Homo sapiens
ctgtacatatgtctccagagtg

SEQ ID NO: 9053577 - DNA, 22 bp, Homo sapiens
ctgtacatcccaagatatttct

SEQ ID NO: 9053578 - DNA, 20 bp, Homo sapiens
ctgtacatcaccaaggtgac

SEQ ID NO: 9053579 - DNA, 22 bp, Homo sapiens
ctgtacatcccgagagccagta

SEQ ID NO: 9053580 - DNA, 22 bp, Homo sapiens
ctgtacatctctgaggacagta

SEQ ID NO: 9053581 - DNA, 22 bp, Homo sapiens
ctgtacataaaggaataggtgt

SEQ ID NO: 9053582 - DNA, 22 bp, Homo sapiens
ctgtacaagtccttcatcaggg

SEQ ID NO: 9053583 - DNA, 22 bp, Homo sapiens
cttaaactgaaagctacaagat

SEQ ID NO: 9053584 - DNA, 22 bp, Homo sapiens
ctgtttgttggctattgacagt

SEQ ID NO: 9053585 - DNA, 17 bp, Homo sapiens
ctgtttgttctgggagc

SEQ ID NO: 9053586 - DNA, 22 bp, Homo sapiens
ctgtttgtgatttctacgattt

SEQ ID NO: 9053587 - DNA, 22 bp, Homo sapiens
ctgtttgtgattagcagtgggt

SEQ ID NO: 9053588 - DNA, 22 bp, Homo sapiens
ctgtttgtccaacttgtcccga

SEQ ID NO: 9053589 - DNA, 22 bp, Homo sapiens
ctgtttgtctctctcctgaccc

SEQ ID NO: 9053590 - DNA, 22 bp, Homo sapiens
ctgtggaaggtttagataggta

SEQ ID NO: 9053591 - DNA, 22 bp, Homo sapiens
cttacaaaggagaggagatagg

SEQ ID NO: 9053592 - DNA, 22 bp, Homo sapiens
cttaaattttcatctacaagaa

SEQ ID NO: 9053593 - DNA, 22 bp, Homo sapiens
cttaaaggaggttttgtttcca

SEQ ID NO: 9053594 - DNA, 22 bp, Homo sapiens
cttacagagaagaaaatgtagt

SEQ ID NO: 9053595 - DNA, 22 bp, Homo sapiens
cttacactttccgaaagcttgt

SEQ ID NO: 9053596 - DNA, 22 bp, Homo sapiens
cttacacagtctggcacttctt

SEQ ID NO: 9053597 - DNA, 22 bp, Homo sapiens
cttacaaatacacttaggagag

SEQ ID NO: 9053598 - DNA, 22 bp, Homo sapiens
cttacattaagtaagagattga

SEQ ID NO: 9053599 - DNA, 22 bp, Homo sapiens
cttagaaataatggtttcagtt

SEQ ID NO: 9053600 - DNA, 22 bp, Homo sapiens
cttagcaatttaactgactcta

SEQ ID NO: 9053601 - DNA, 22 bp, Homo sapiens
cttagaaatgcagattctcagg

SEQ ID NO: 9053602 - DNA, 22 bp, Homo sapiens
cttccaagttgctctgctgacc

SEQ ID NO: 9053603 - DNA, 22 bp, Homo sapiens
cttctaacatcctacaatgcaa

SEQ ID NO: 9053604 - DNA, 22 bp, Homo sapiens
cttcctttccccaatcatatcg

SEQ ID NO: 9053605 - DNA, 22 bp, Homo sapiens
cttcctggtttgaagctcgccg

SEQ ID NO: 9053606 - DNA, 22 bp, Homo sapiens
cttctacacatccctcttgctt

SEQ ID NO: 9053607 - DNA, 20 bp, Homo sapiens
cttccttttccttcgtcaaa

SEQ ID NO: 9053608 - DNA, 22 bp, Homo sapiens
cttctagagctggagcaaatgt

SEQ ID NO: 9053609 - DNA, 22 bp, Homo sapiens
cttatacacgaacacaaggtgt

SEQ ID NO: 9053610 - DNA, 22 bp, Homo sapiens
cttagtatctatgaagtgaaaa

SEQ ID NO: 9053611 - DNA, 22 bp, Homo sapiens
cttagcttctctgcatctgtgt

SEQ ID NO: 9053612 - DNA, 22 bp, Homo sapiens
cttagctttaaaagtgagatct

SEQ ID NO: 9053613 - DNA, 22 bp, Homo sapiens
cttagcatgcagtgttctgccc

SEQ ID NO: 9053614 - DNA, 22 bp, Homo sapiens
cttatatttgtcaactttacaa

SEQ ID NO: 9053615 - DNA, 19 bp, Homo sapiens
cttatacagattttctcat

SEQ ID NO: 9053616 - DNA, 22 bp, Homo sapiens
cttcattacttgctcgtagcac

SEQ ID NO: 9053617 - DNA, 22 bp, Homo sapiens
ctttacaaactataaagtgcgg

SEQ ID NO: 9053618 - DNA, 22 bp, Homo sapiens
ctttacaaagcaattttgtctc

SEQ ID NO: 9053619 - DNA, 22 bp, Homo sapiens
ctttaattctcaggtgcacata

SEQ ID NO: 9053620 - DNA, 22 bp, Homo sapiens
ctttacaaagcaattttgtctc

SEQ ID NO: 9053621 - DNA, 22 bp, Homo sapiens
ctttaacagttccattcaattt

SEQ ID NO: 9053622 - DNA, 22 bp, Homo sapiens
ctttaatcaagataagtatact

SEQ ID NO: 9053623 - DNA, 22 bp, Homo sapiens
cttctgggttgcaggtcttggc

SEQ ID NO: 9053624 - DNA, 19 bp, Homo sapiens
cttctggccctgagccacc

SEQ ID NO: 9053625 - DNA, 22 bp, Homo sapiens
cttctggcaatcccagggtctt

SEQ ID NO: 9053626 - DNA, 21 bp, Homo sapiens
cttttacattcagtcatgatg

SEQ ID NO: 9053627 - DNA, 22 bp, Homo sapiens
cttttacagtggacctgccatt

SEQ ID NO: 9053628 - DNA, 22 bp, Homo sapiens
ctttgattccaggcacatgttt

SEQ ID NO: 9053629 - DNA, 22 bp, Homo sapiens
cttttcctcaggaggagacgcg

SEQ ID NO: 9053630 - DNA, 22 bp, Homo sapiens
cttttcctattgattctgttac

SEQ ID NO: 9053631 - DNA, 22 bp, Homo sapiens
gaaaatacttcagtgttctggc

SEQ ID NO: 9053632 - DNA, 22 bp, Homo sapiens
gaaaattgaatcagtagctgat

SEQ ID NO: 9053633 - DNA, 22 bp, Homo sapiens
gaaaatttagaactgaacttct

SEQ ID NO: 9053634 - DNA, 22 bp, Homo sapiens
gaaaatttctgccacatgtgtg

SEQ ID NO: 9053635 - DNA, 22 bp, Homo sapiens
gaaacaactactattgatttct

SEQ ID NO: 9053636 - DNA, 22 bp, Homo sapiens
gaaagagaggggctgagatgca

SEQ ID NO: 9053637 - DNA, 22 bp, Homo sapiens
gaaacacatatgaacagttgat

SEQ ID NO: 9053638 - DNA, 23 bp, Homo sapiens
ccagggagtgctactatcaagcc

SEQ ID NO: 9053639 - DNA, 22 bp, Homo sapiens
ccagggagtttccaatctgaga

SEQ ID NO: 9053640 - DNA, 22 bp, Homo sapiens
ccagggagtttccaatctgaga

SEQ ID NO: 9053641 - DNA, 17 bp, Homo sapiens
ccagggaggggccgcgc

SEQ ID NO: 9053642 - DNA, 23 bp, Homo sapiens
ccagggaggttgattggttaccc

SEQ ID NO: 9053643 - DNA, 23 bp, Homo sapiens
ccagggaggttgattggttaccc

SEQ ID NO: 9053644 - DNA, 22 bp, Homo sapiens
ccagggagggtcctgtggcttc

SEQ ID NO: 9053645 - DNA, 22 bp, Homo sapiens
ccagggagggtcctgtggcttc

SEQ ID NO: 9053646 - DNA, 22 bp, Homo sapiens
tgaaatgagagcacagaataaa

SEQ ID NO: 9053647 - DNA, 22 bp, Homo sapiens
tgaaacactttcaattacatat

SEQ ID NO: 9053648 - DNA, 22 bp, Homo sapiens
tgaaacaattagaatgtaatga

SEQ ID NO: 9053649 - DNA, 17 bp, Homo sapiens
tgaaacaccaagactgt

SEQ ID NO: 9053650 - DNA, 22 bp, Homo sapiens
tgaaacaaatttggaaaatcta

SEQ ID NO: 9053651 - DNA, 22 bp, Homo sapiens
tgaaacaaatttggaaaatcta

SEQ ID NO: 9053652 - DNA, 23 bp, Homo sapiens
ccaggcctctcagagggtgtgcc

SEQ ID NO: 9053653 - DNA, 22 bp, Homo sapiens
ccaggcctctggctgcttagtc

SEQ ID NO: 9053654 - DNA, 19 bp, Homo sapiens
ccaggcctctggggcctgt

SEQ ID NO: 9053655 - DNA, 22 bp, Homo sapiens
ccaggcctgattgggaatcttg

SEQ ID NO: 9053656 - DNA, 22 bp, Homo sapiens
tcttacaagaaataagccaatg

SEQ ID NO: 9053657 - DNA, 22 bp, Homo sapiens
tcttaattgagaacagtgtagg

SEQ ID NO: 9053658 - DNA, 22 bp, Homo sapiens
tcttacaagtcacccgctttct

SEQ ID NO: 9053659 - DNA, 22 bp, Homo sapiens
tcttacaagaaggaaaagggag

SEQ ID NO: 9053660 - DNA, 20 bp, Homo sapiens
tcttacaatcgttacatcca

SEQ ID NO: 9053661 - DNA, 22 bp, Homo sapiens
tcttacccggcaacgtgtgtcg

SEQ ID NO: 9053662 - DNA, 22 bp, Homo sapiens
ccaggcagagtgctccagaaag

SEQ ID NO: 9053663 - DNA, 19 bp, Homo sapiens
ccaggcctcctgggaggtc

SEQ ID NO: 9053664 - DNA, 22 bp, Homo sapiens
ccaggcctcctgtgagtggacc

SEQ ID NO: 9053665 - DNA, 22 bp, Homo sapiens
ccaggcagcctgctccattctg

SEQ ID NO: 9053666 - DNA, 17 bp, Homo sapiens
tcttctcttccagtctt

SEQ ID NO: 9053667 - DNA, 22 bp, Homo sapiens
ccaggagagcaaaggtcactct

SEQ ID NO: 9053668 - DNA, 22 bp, Homo sapiens
tctgggctatatggtctctgct

SEQ ID NO: 9053669 - DNA, 22 bp, Homo sapiens
tctgggctcacgagtctggaca

SEQ ID NO: 9053670 - DNA, 22 bp, Homo sapiens
tctgttcttgcttttctccaac

SEQ ID NO: 9053671 - DNA, 22 bp, Homo sapiens
tctgttcttaaagcattcttgc

SEQ ID NO: 9053672 - DNA, 22 bp, Homo sapiens
tctgttctattggtctatgtgt

SEQ ID NO: 9053673 - DNA, 22 bp, Homo sapiens
tctgttctaagcattctatgtg

SEQ ID NO: 9053674 - DNA, 21 bp, Homo sapiens
tctgtggcggactctaggccc

SEQ ID NO: 9053675 - DNA, 22 bp, Homo sapiens
ccaggagccactcaggcccaca

SEQ ID NO: 9053676 - DNA, 22 bp, Homo sapiens
ccaggagcagggctggctgcac

SEQ ID NO: 9053677 - DNA, 22 bp, Homo sapiens
tgcactttaaaaaatggtgatg

SEQ ID NO: 9053678 - DNA, 22 bp, Homo sapiens
tgcactttatttcctctcacac

SEQ ID NO: 9053679 - DNA, 22 bp, Homo sapiens
tgcactttgcaggcatggaaac

SEQ ID NO: 9053680 - DNA, 22 bp, Homo sapiens
tgcagagagacccctgggccag

SEQ ID NO: 9053681 - DNA, 22 bp, Homo sapiens
tgcagagagacccctgggccag

SEQ ID NO: 9053682 - DNA, 22 bp, Homo sapiens
tgcagagagatcctcagggttt

SEQ ID NO: 9053683 - DNA, 22 bp, Homo sapiens
tgcagagaagaggacagttcta

SEQ ID NO: 9053684 - DNA, 22 bp, Homo sapiens
tgcagagaagaggacagttcta

SEQ ID NO: 9053685 - DNA, 22 bp, Homo sapiens
tgcactccaggctgggtgacag

SEQ ID NO: 9053686 - DNA, 22 bp, Homo sapiens
tgcactccaggctgggtgacag

SEQ ID NO: 9053687 - DNA, 22 bp, Homo sapiens
tgcagctgctcattctctcagt

SEQ ID NO: 9053688 - DNA, 22 bp, Homo sapiens
tgcagctgcctagggctggctt

SEQ ID NO: 9053689 - DNA, 22 bp, Homo sapiens
tgcaggaattttttgcagaaag

SEQ ID NO: 9053690 - DNA, 17 bp, Homo sapiens
ccatactgacatattga

SEQ ID NO: 9053691 - DNA, 22 bp, Homo sapiens
ccatacacacaccaaatttgta

SEQ ID NO: 9053692 - DNA, 22 bp, Homo sapiens
ccatacacacaccaaatttgta

SEQ ID NO: 9053693 - DNA, 22 bp, Homo sapiens
ccagtgttttccagtttgccca

SEQ ID NO: 9053694 - DNA, 21 bp, Homo sapiens
ccatccactgagtggttccct

SEQ ID NO: 9053695 - DNA, 22 bp, Homo sapiens
ccatccacagtcttgattattt

SEQ ID NO: 9053696 - DNA, 23 bp, Homo sapiens
ccatcaggcctccgtgtccagcc

SEQ ID NO: 9053697 - DNA, 18 bp, Homo sapiens
ccatcaccctaactagtg

SEQ ID NO: 9053698 - DNA, 22 bp, Homo sapiens
ccatcacagtccccatcgtgat

SEQ ID NO: 9053699 - DNA, 22 bp, Homo sapiens
ccatatcagaagattgtcaccc

SEQ ID NO: 9053700 - DNA, 20 bp, Homo sapiens
ccagtccacctgagacatgt

SEQ ID NO: 9053701 - DNA, 22 bp, Homo sapiens
ccagtccagtgccatgcatggc

SEQ ID NO: 9053702 - DNA, 22 bp, Homo sapiens
ccagtccaggccatggattttg

SEQ ID NO: 9053703 - DNA, 22 bp, Homo sapiens
ccagtccacgtcaagaagaggt

SEQ ID NO: 9053704 - DNA, 22 bp, Homo sapiens
ccagtccagtgccatgcatggc

SEQ ID NO: 9053705 - DNA, 22 bp, Homo sapiens
ccaggtgggaggaaagcagaga

SEQ ID NO: 9053706 - DNA, 22 bp, Homo sapiens
ccaggtggcttctgcccgatgt

SEQ ID NO: 9053707 - DNA, 22 bp, Homo sapiens
ccaggtggaggtgtgaggtcct

SEQ ID NO: 9053708 - DNA, 22 bp, Homo sapiens
ccaggtggccctgccctactct

SEQ ID NO: 9053709 - DNA, 22 bp, Homo sapiens
ccaggtggataaggtttctgga

SEQ ID NO: 9053710 - DNA, 22 bp, Homo sapiens
ccaggtggacttgatttgaata

SEQ ID NO: 9053711 - DNA, 22 bp, Homo sapiens
ccaggtggacggcgagtacagg

SEQ ID NO: 9053712 - DNA, 22 bp, Homo sapiens
ccagtccatggattcccaaggt

SEQ ID NO: 9053713 - DNA, 22 bp, Homo sapiens
ccagtcccatctctgtcgctta

SEQ ID NO: 9053714 - DNA, 22 bp, Homo sapiens
tgagccatgggactccaaggga

SEQ ID NO: 9053715 - DNA, 22 bp, Homo sapiens
ccagtgcattgccgtgtctagg

SEQ ID NO: 9053716 - DNA, 22 bp, Homo sapiens
tgggctcctcgtcactcgctgt

SEQ ID NO: 9053717 - DNA, 22 bp, Homo sapiens
tggggagaggtatcattgagat

SEQ ID NO: 9053718 - DNA, 22 bp, Homo sapiens
tggggagagattgaggagtttt

SEQ ID NO: 9053719 - DNA, 22 bp, Homo sapiens
tggggagagttacaaggaatct

SEQ ID NO: 9053720 - DNA, 23 bp, Homo sapiens
tggggagagttaccctggaagcg

SEQ ID NO: 9053721 - DNA, 22 bp, Homo sapiens
tggggagcacggtagggaaatg

SEQ ID NO: 9053722 - DNA, 22 bp, Homo sapiens
cctgcaggctgcaggccagttc

SEQ ID NO: 9053723 - DNA, 22 bp, Homo sapiens
cctgcaggctgcaggccagttc

SEQ ID NO: 9053724 - DNA, 22 bp, Homo sapiens
cctgcagggaatcgaggcagaa

SEQ ID NO: 9053725 - DNA, 22 bp, Homo sapiens
cctgcagggaatcgaggcagaa

SEQ ID NO: 9053726 - DNA, 22 bp, Homo sapiens
tgggctcatggcccagcactgg

SEQ ID NO: 9053727 - DNA, 22 bp, Homo sapiens
tgggctcatgtttctttgagga

SEQ ID NO: 9053728 - DNA, 22 bp, Homo sapiens
tgggcaggataatatctcatgt

SEQ ID NO: 9053729 - DNA, 22 bp, Homo sapiens
tgggtccacaaacatcagatat

SEQ ID NO: 9053730 - DNA, 22 bp, Homo sapiens
tggtaattaatttgataggttc

SEQ ID NO: 9053731 - DNA, 19 bp, Homo sapiens
cctgcagggatgagaggtt

SEQ ID NO: 9053732 - DNA, 19 bp, Homo sapiens
cctgcagggatgagaggtt

SEQ ID NO: 9053733 - DNA, 19 bp, Homo sapiens
cctgcagggatgagaggtt

SEQ ID NO: 9053734 - DNA, 22 bp, Homo sapiens
cctgcaggggagagacttctag

SEQ ID NO: 9053735 - DNA, 22 bp, Homo sapiens
cctgcaggtccccggatgcgca

SEQ ID NO: 9053736 - DNA, 22 bp, Homo sapiens
cctgcaggtaaggctaactgcc

SEQ ID NO: 9053737 - DNA, 22 bp, Homo sapiens
cctgcaggggagagacttctag

SEQ ID NO: 9053738 - DNA, 22 bp, Homo sapiens
cctgcagggtgctgccacagat

SEQ ID NO: 9053739 - DNA, 22 bp, Homo sapiens
cctgcagggtgctgccacagat

SEQ ID NO: 9053740 - DNA, 22 bp, Homo sapiens
cctgccagaaaagagggagttc

SEQ ID NO: 9053741 - DNA, 22 bp, Homo sapiens
cctgcaggtccccggatgcgca

SEQ ID NO: 9053742 - DNA, 22 bp, Homo sapiens
cctgcaggttgcagaggcggaa

SEQ ID NO: 9053743 - DNA, 22 bp, Homo sapiens
cctgcaggttgcagaggcggaa

SEQ ID NO: 9053744 - DNA, 22 bp, Homo sapiens
cctgcaggtttcccccggacgg

SEQ ID NO: 9053745 - DNA, 22 bp, Homo sapiens
cctgcctgattccaggatggct

SEQ ID NO: 9053746 - DNA, 22 bp, Homo sapiens
cctgcctgcaaaatgggacaag

SEQ ID NO: 9053747 - DNA, 19 bp, Homo sapiens
cctgcctgagctgtccctc

SEQ ID NO: 9053748 - DNA, 22 bp, Homo sapiens
cctgcctcaggactctgcatat

SEQ ID NO: 9053749 - DNA, 22 bp, Homo sapiens
cctgccctgtcactggctaggg

SEQ ID NO: 9053750 - DNA, 22 bp, Homo sapiens
tggtagcaacatctcagtggct

SEQ ID NO: 9053751 - DNA, 22 bp, Homo sapiens
cctccagtcacctggatgagaa

SEQ ID NO: 9053752 - DNA, 22 bp, Homo sapiens
cctcccaccgtatctcagtggc

SEQ ID NO: 9053753 - DNA, 22 bp, Homo sapiens
cctccagggcagacggggagca

SEQ ID NO: 9053754 - DNA, 22 bp, Homo sapiens
tggcattttagacatgatggtg

SEQ ID NO: 9053755 - DNA, 22 bp, Homo sapiens
tggcatttgggctggcttttct

SEQ ID NO: 9053756 - DNA, 22 bp, Homo sapiens
tggcagtgggaagctggaagtc

SEQ ID NO: 9053757 - DNA, 22 bp, Homo sapiens
tggcatttctgttagactctca

SEQ ID NO: 9053758 - DNA, 22 bp, Homo sapiens
tgggacagggaatctgatcccc

SEQ ID NO: 9053759 - DNA, 22 bp, Homo sapiens
tgggagagcactgcagccccgg

SEQ ID NO: 9053760 - DNA, 22 bp, Homo sapiens
tgggagagataggcttctggac

SEQ ID NO: 9053761 - DNA, 22 bp, Homo sapiens
tgggacagagtgagctttggcc

SEQ ID NO: 9053762 - DNA, 22 bp, Homo sapiens
tggcttctttccactgtcctgt

SEQ ID NO: 9053763 - DNA, 22 bp, Homo sapiens
tggcttctttgtgacagctctt

SEQ ID NO: 9053764 - DNA, 22 bp, Homo sapiens
cctctcccctcccaaggcggga

SEQ ID NO: 9053765 - DNA, 22 bp, Homo sapiens
cctctcccaggcgcggcggcag

SEQ ID NO: 9053766 - DNA, 22 bp, Homo sapiens
tgcttcctatccacacaatgcc

SEQ ID NO: 9053767 - DNA, 22 bp, Homo sapiens
tgcttcctatccacacaatgcc

SEQ ID NO: 9053768 - DNA, 22 bp, Homo sapiens
tgcttcctatccacacaatgcc

SEQ ID NO: 9053769 - DNA, 22 bp, Homo sapiens
tgcttcctgaggccgtcttctc

SEQ ID NO: 9053770 - DNA, 22 bp, Homo sapiens
tgcttcctgaggccgtcttctc

SEQ ID NO: 9053771 - DNA, 22 bp, Homo sapiens
tgcttccttgagctctccaatc

SEQ ID NO: 9053772 - DNA, 22 bp, Homo sapiens
tgcttccttgagctctccaatc

SEQ ID NO: 9053773 - DNA, 22 bp, Homo sapiens
tgcttccttgatcattcccaaa

SEQ ID NO: 9053774 - DNA, 22 bp, Homo sapiens
tgcttccttcccgttcttctcc

SEQ ID NO: 9053775 - DNA, 22 bp, Homo sapiens
ccctccctatgtagatgatgtt

SEQ ID NO: 9053776 - DNA, 22 bp, Homo sapiens
ccctccctctgctgggtgtaga

SEQ ID NO: 9053777 - DNA, 22 bp, Homo sapiens
ccctccagtgtcccagtgggga

SEQ ID NO: 9053778 - DNA, 22 bp, Homo sapiens
tgctaggggcactaaaagctga

SEQ ID NO: 9053779 - DNA, 22 bp, Homo sapiens
tgcaggtgctgtgtcaagagag

SEQ ID NO: 9053780 - DNA, 22 bp, Homo sapiens
tgcaggtgccatcgctgctcat

SEQ ID NO: 9053781 - DNA, 22 bp, Homo sapiens
tgctgcctggtttcttcttgct

SEQ ID NO: 9053782 - DNA, 22 bp, Homo sapiens
tgctgcctggagccttttgttt

SEQ ID NO: 9053783 - DNA, 22 bp, Homo sapiens
cccaggtctccttctttagctg

SEQ ID NO: 9053784 - DNA, 19 bp, Homo sapiens
cccagtccttgtcctgggc

SEQ ID NO: 9053785 - DNA, 22 bp, Homo sapiens
cccagtccagaccatgacctca

SEQ ID NO: 9053786 - DNA, 22 bp, Homo sapiens
tggagatgcacgagcaggtgga

SEQ ID NO: 9053787 - DNA, 16 bp, Homo sapiens
tggaggcatctggccc

SEQ ID NO: 9053788 - DNA, 22 bp, Homo sapiens
ccctccctttgtctttatgaac

SEQ ID NO: 9053789 - DNA, 22 bp, Homo sapiens
ccctccctttgcagcagtgcat

SEQ ID NO: 9053790 - DNA, 22 bp, Homo sapiens
ccctccctgaagaagttactct

SEQ ID NO: 9053791 - DNA, 22 bp, Homo sapiens
ccctccctgtgtgcctcatttg

SEQ ID NO: 9053792 - DNA, 22 bp, Homo sapiens
ccctcccttccaagttgaggac

SEQ ID NO: 9053793 - DNA, 22 bp, Homo sapiens
tggagacatttctcattaaaaa

SEQ ID NO: 9053794 - DNA, 19 bp, Homo sapiens
tggcagggagagtttgaag

SEQ ID NO: 9053795 - DNA, 22 bp, Homo sapiens
tggcagggaatacagatgttta

SEQ ID NO: 9053796 - DNA, 22 bp, Homo sapiens
ccctttagcccctgcagagact

SEQ ID NO: 9053797 - DNA, 22 bp, Homo sapiens
tggcacttgcttcagatgatgt

SEQ ID NO: 9053798 - DNA, 22 bp, Homo sapiens
tggcacagtcctgggtgcctgc

SEQ ID NO: 9053799 - DNA, 22 bp, Homo sapiens
ccctggagtcctggcagttgat

SEQ ID NO: 9053800 - DNA, 23 bp, Homo sapiens
ccctggagtaaattcttggaagg

SEQ ID NO: 9053801 - DNA, 22 bp, Homo sapiens
ccctggaggttgaggctgcagt

SEQ ID NO: 9053802 - DNA, 22 bp, Homo sapiens
ccctggaggtggaggttgcagg

SEQ ID NO: 9053803 - DNA, 22 bp, Homo sapiens
tatattcaatgattagtatcag

SEQ ID NO: 9053804 - DNA, 22 bp, Homo sapiens
tatattcaatgattagtatcag

SEQ ID NO: 9053805 - DNA, 22 bp, Homo sapiens
tatatacaaggtaggtttaggt

SEQ ID NO: 9053806 - DNA, 22 bp, Homo sapiens
tagtgtctgaatgcacctgttt

SEQ ID NO: 9053807 - DNA, 22 bp, Homo sapiens
tagtgttctaagaacatccatg

SEQ ID NO: 9053808 - DNA, 22 bp, Homo sapiens
tagtaacagatttatacagtct

SEQ ID NO: 9053809 - DNA, 22 bp, Homo sapiens
cagggctggatcctccagactc

SEQ ID NO: 9053810 - DNA, 22 bp, Homo sapiens
tatgtacatggagagcaattga

SEQ ID NO: 9053811 - DNA, 22 bp, Homo sapiens
tatgtacatggagagcaattga

SEQ ID NO: 9053812 - DNA, 22 bp, Homo sapiens
tatgtacatgatttcatttgct

SEQ ID NO: 9053813 - DNA, 22 bp, Homo sapiens
tatgtacatggagagcaattga

SEQ ID NO: 9053814 - DNA, 22 bp, Homo sapiens
tatgtacatcttgagcaatgaa

SEQ ID NO: 9053815 - DNA, 22 bp, Homo sapiens
tatgtacatgatttcatttgct

SEQ ID NO: 9053816 - DNA, 22 bp, Homo sapiens
cagtacttatttctatttaggg

SEQ ID NO: 9053817 - DNA, 22 bp, Homo sapiens
cagtactgcttgtgggagcaga

SEQ ID NO: 9053818 - DNA, 22 bp, Homo sapiens
tatgtacatcgttgaattcaaa

SEQ ID NO: 9053819 - DNA, 22 bp, Homo sapiens
tatgtacatcgttgaattcaaa

SEQ ID NO: 9053820 - DNA, 22 bp, Homo sapiens
caggtggggcgccctcaggcag

SEQ ID NO: 9053821 - DNA, 22 bp, Homo sapiens
caggtggggcgccctcaggcag

SEQ ID NO: 9053822 - DNA, 22 bp, Homo sapiens
caggtggggagagtgtggagca

SEQ ID NO: 9053823 - DNA, 22 bp, Homo sapiens
caggtggggcagctgtgggagc

SEQ ID NO: 9053824 - DNA, 22 bp, Homo sapiens
caggtgggcttgggagaacact

SEQ ID NO: 9053825 - DNA, 22 bp, Homo sapiens
caggtgggctgcctctccagct

SEQ ID NO: 9053826 - DNA, 22 bp, Homo sapiens
caggtgggcgtggcgagaaggc

SEQ ID NO: 9053827 - DNA, 22 bp, Homo sapiens
caggtgggccggggtttgttct

SEQ ID NO: 9053828 - DNA, 22 bp, Homo sapiens
tatgatatgcactttatcagaa

SEQ ID NO: 9053829 - DNA, 22 bp, Homo sapiens
tatattccagttcatctcttga

SEQ ID NO: 9053830 - DNA, 22 bp, Homo sapiens
tatattgtagctgatgacaaat

SEQ ID NO: 9053831 - DNA, 21 bp, Homo sapiens
tcaaagcacatatttgcacat

SEQ ID NO: 9053832 - DNA, 22 bp, Homo sapiens
tcaaagcacacttagtggtaga

SEQ ID NO: 9053833 - DNA, 22 bp, Homo sapiens
tcaaaggaatttgattttgatg

SEQ ID NO: 9053834 - DNA, 23 bp, Homo sapiens
tcaaaggaggcatcgttctgcag

SEQ ID NO: 9053835 - DNA, 22 bp, Homo sapiens
cagtactttgcatcattccact

SEQ ID NO: 9053836 - DNA, 22 bp, Homo sapiens
cagtactttgaagatattttag

SEQ ID NO: 9053837 - DNA, 22 bp, Homo sapiens
cagtagacacatttgtttttcc

SEQ ID NO: 9053838 - DNA, 20 bp, Homo sapiens
tattccaagggtagagaaaa

SEQ ID NO: 9053839 - DNA, 22 bp, Homo sapiens
tattccagaaatcaccatttcc

SEQ ID NO: 9053840 - DNA, 22 bp, Homo sapiens
tattccagataccttgtgtaag

SEQ ID NO: 9053841 - DNA, 22 bp, Homo sapiens
tattccagatgaaatcattcag

SEQ ID NO: 9053842 - DNA, 22 bp, Homo sapiens
tattccagcagtctgccccgct

SEQ ID NO: 9053843 - DNA, 22 bp, Homo sapiens
tattccagccgcttgagctcgc

SEQ ID NO: 9053844 - DNA, 17 bp, Homo sapiens
tattccaggaaataaag

SEQ ID NO: 9053845 - DNA, 22 bp, Homo sapiens
tattccaggacaggtgtgctgt

SEQ ID NO: 9053846 - DNA, 22 bp, Homo sapiens
tattccaggggaaggtatcctg

SEQ ID NO: 9053847 - DNA, 22 bp, Homo sapiens
tattccaggtattcttcaagag

SEQ ID NO: 9053848 - DNA, 22 bp, Homo sapiens
tattccagtcctatcctctttt

SEQ ID NO: 9053849 - DNA, 22 bp, Homo sapiens
tattccagtgtgatctttgtag

SEQ ID NO: 9053850 - DNA, 22 bp, Homo sapiens
tattccaggtttcttgttgtat

SEQ ID NO: 9053851 - DNA, 22 bp, Homo sapiens
tattccagtatgtctggtgtcc

SEQ ID NO: 9053852 - DNA, 22 bp, Homo sapiens
tattcccattccacttatcaag

SEQ ID NO: 9053853 - DNA, 22 bp, Homo sapiens
tattcccagcctctttctatct

SEQ ID NO: 9053854 - DNA, 22 bp, Homo sapiens
tattccagttcaccttttcatc

SEQ ID NO: 9053855 - DNA, 19 bp, Homo sapiens
tcaaattcctaagttctgg

SEQ ID NO: 9053856 - DNA, 22 bp, Homo sapiens
tcaaattctattctatactcag

SEQ ID NO: 9053857 - DNA, 22 bp, Homo sapiens
cagtcccatgagcccagaacat

SEQ ID NO: 9053858 - DNA, 22 bp, Homo sapiens
cagtctggaggtcagctggctt

SEQ ID NO: 9053859 - DNA, 22 bp, Homo sapiens
cagtctggaggtcagctggctt

SEQ ID NO: 9053860 - DNA, 22 bp, Homo sapiens
cagtctggatctgtgctgctgt

SEQ ID NO: 9053861 - DNA, 22 bp, Homo sapiens
cagtgctgttgtaagctcattg

SEQ ID NO: 9053862 - DNA, 22 bp, Homo sapiens
cagtgcagttggtggcaggggt

SEQ ID NO: 9053863 - DNA, 22 bp, Homo sapiens
cagtgcaggtttagggctgggg

SEQ ID NO: 9053864 - DNA, 22 bp, Homo sapiens
cagtgcagaggccagggaggat

SEQ ID NO: 9053865 - DNA, 22 bp, Homo sapiens
cagtgcaggtggcagaggacag

SEQ ID NO: 9053866 - DNA, 20 bp, Homo sapiens
tcacacatggtaagctatga

SEQ ID NO: 9053867 - DNA, 22 bp, Homo sapiens
tcacacatttctcaagtgtagg

SEQ ID NO: 9053868 - DNA, 22 bp, Homo sapiens
tcacacatttctcaagtgtagg

SEQ ID NO: 9053869 - DNA, 22 bp, Homo sapiens
tagaaatgttggtattaacatt

SEQ ID NO: 9053870 - DNA, 22 bp, Homo sapiens
tagaaatgttagatgtattgag

SEQ ID NO: 9053871 - DNA, 22 bp, Homo sapiens
tagacattggccattcctgtgg

SEQ ID NO: 9053872 - DNA, 22 bp, Homo sapiens
tagacattggccattcctgtgg

SEQ ID NO: 9053873 - DNA, 22 bp, Homo sapiens
tagacattatgtattaagttct

SEQ ID NO: 9053874 - DNA, 22 bp, Homo sapiens
tagacattatgtattaagttct

SEQ ID NO: 9053875 - DNA, 22 bp, Homo sapiens
tagacatttggagttttatgac

SEQ ID NO: 9053876 - DNA, 22 bp, Homo sapiens
tagacatttggcatggttttca

SEQ ID NO: 9053877 - DNA, 22 bp, Homo sapiens
tagacatttgaatgtgaaatga

SEQ ID NO: 9053878 - DNA, 22 bp, Homo sapiens
tagacatttggagttttatgac

SEQ ID NO: 9053879 - DNA, 22 bp, Homo sapiens
tagacatttctggttattgaca

SEQ ID NO: 9053880 - DNA, 22 bp, Homo sapiens
tagacattaggtaggttcatgg

SEQ ID NO: 9053881 - DNA, 22 bp, Homo sapiens
tagacagtgagctatgagtggt

SEQ ID NO: 9053882 - DNA, 22 bp, Homo sapiens
caggctgcagcagcagtggccc

SEQ ID NO: 9053883 - DNA, 22 bp, Homo sapiens
taccctctcccggtccagcttt

SEQ ID NO: 9053884 - DNA, 22 bp, Homo sapiens
caggctgcagaggcctttcatg

SEQ ID NO: 9053885 - DNA, 22 bp, Homo sapiens
caggctgcaagaaaggcattca

SEQ ID NO: 9053886 - DNA, 22 bp, Homo sapiens
tagaaagaacttcatgtaaaac

SEQ ID NO: 9053887 - DNA, 22 bp, Homo sapiens
tagaaagacaatgggaagtgct

SEQ ID NO: 9053888 - DNA, 22 bp, Homo sapiens
tagaaagacagaggttttgtct

SEQ ID NO: 9053889 - DNA, 22 bp, Homo sapiens
tacctagaccagttacaatgca

SEQ ID NO: 9053890 - DNA, 22 bp, Homo sapiens
tagaaagagcatagtattataa

SEQ ID NO: 9053891 - DNA, 22 bp, Homo sapiens
tagaaagactgtccagatttca

SEQ ID NO: 9053892 - DNA, 22 bp, Homo sapiens
tagaaagacatgggccagcagc

SEQ ID NO: 9053893 - DNA, 22 bp, Homo sapiens
tagaaagatctgtaggcaagag

SEQ ID NO: 9053894 - DNA, 22 bp, Homo sapiens
tagaaagagctttgcttccttt

SEQ ID NO: 9053895 - DNA, 19 bp, Homo sapiens
tagaaagatgatgggtggg

SEQ ID NO: 9053896 - DNA, 22 bp, Homo sapiens
cagggcataagatgaggctgta

SEQ ID NO: 9053897 - DNA, 22 bp, Homo sapiens
tagcattaaaggtaagacatta

SEQ ID NO: 9053898 - DNA, 22 bp, Homo sapiens
tagcatctttttctgtcttcta

SEQ ID NO: 9053899 - DNA, 22 bp, Homo sapiens
tagcagtgtctaggtaggccat

SEQ ID NO: 9053900 - DNA, 22 bp, Homo sapiens
cagggatgagcagatggagcaa

SEQ ID NO: 9053901 - DNA, 22 bp, Homo sapiens
tagcacaaagagtctttcagag

SEQ ID NO: 9053902 - DNA, 22 bp, Homo sapiens
cagggaggctgtcttatgcctg

SEQ ID NO: 9053903 - DNA, 22 bp, Homo sapiens
cagggagggacaattgtcacct

SEQ ID NO: 9053904 - DNA, 22 bp, Homo sapiens
cagggagggaggaaaatttgct

SEQ ID NO: 9053905 - DNA, 22 bp, Homo sapiens
cagggagctttcccaggaccct

SEQ ID NO: 9053906 - DNA, 22 bp, Homo sapiens
tagacatttgtcaagaatgact

SEQ ID NO: 9053907 - DNA, 22 bp, Homo sapiens
cagggagctttgtcttctcatt

SEQ ID NO: 9053908 - DNA, 22 bp, Homo sapiens
cagggaggatgggctgttttgc

SEQ ID NO: 9053909 - DNA, 23 bp, Homo sapiens
cagggaggagatactgtgtatct

SEQ ID NO: 9053910 - DNA, 22 bp, Homo sapiens
tacagcctcgaactcctgcatt

SEQ ID NO: 9053911 - DNA, 22 bp, Homo sapiens
tacagcctgatttggagccact

SEQ ID NO: 9053912 - DNA, 22 bp, Homo sapiens
tacagcctcttccctggagtgg

SEQ ID NO: 9053913 - DNA, 22 bp, Homo sapiens
tacagccttcatctttgccttg

SEQ ID NO: 9053914 - DNA, 22 bp, Homo sapiens
tacagcctgttacctatatttg

SEQ ID NO: 9053915 - DNA, 22 bp, Homo sapiens
tacagcctggcactaccctggg

SEQ ID NO: 9053916 - DNA, 22 bp, Homo sapiens
tacagccatcatgtatgtatat

SEQ ID NO: 9053917 - DNA, 20 bp, Homo sapiens
tacagcctattcaccacata

SEQ ID NO: 9053918 - DNA, 22 bp, Homo sapiens
tacagcctccacaggccaagtg

SEQ ID NO: 9053919 - DNA, 22 bp, Homo sapiens
tacagcctcatcacgggagctg

SEQ ID NO: 9053920 - DNA, 22 bp, Homo sapiens
tacagcctcacatttacttaca

SEQ ID NO: 9053921 - DNA, 22 bp, Homo sapiens
tacagcagggcgctgtgatgaa

SEQ ID NO: 9053922 - DNA, 20 bp, Homo sapiens
tacagagagctagctctctg

SEQ ID NO: 9053923 - DNA, 22 bp, Homo sapiens
tacagagagtacagcatccaca

SEQ ID NO: 9053924 - DNA, 22 bp, Homo sapiens
caggcctgtctgcacatgaggc

SEQ ID NO: 9053925 - DNA, 22 bp, Homo sapiens
caggctcccgctccactgggca

SEQ ID NO: 9053926 - DNA, 22 bp, Homo sapiens
caggctccttcccagggatggt

SEQ ID NO: 9053927 - DNA, 22 bp, Homo sapiens
caggctcccaccctcctgcagc

SEQ ID NO: 9053928 - DNA, 22 bp, Homo sapiens
tacagttcacagtatcataaat

SEQ ID NO: 9053929 - DNA, 22 bp, Homo sapiens
tacacagaacctggtgtacagt

SEQ ID NO: 9053930 - DNA, 22 bp, Homo sapiens
tacacagactcttcaattcaga

SEQ ID NO: 9053931 - DNA, 22 bp, Homo sapiens
tacacagaggctgatgtcttag

SEQ ID NO: 9053932 - DNA, 22 bp, Homo sapiens
tacacagatatgtgatcaatca

SEQ ID NO: 9053933 - DNA, 22 bp, Homo sapiens
tacacagactcttcaattcaga

SEQ ID NO: 9053934 - DNA, 22 bp, Homo sapiens
tacacagactcttcaattcaga

SEQ ID NO: 9053935 - DNA, 22 bp, Homo sapiens
tacacagggagagattggaaac

SEQ ID NO: 9053936 - DNA, 22 bp, Homo sapiens
tacacagatttcagtatcatca

SEQ ID NO: 9053937 - DNA, 22 bp, Homo sapiens
tacacagatttcagtatcatca

SEQ ID NO: 9053938 - DNA, 22 bp, Homo sapiens
tacacagatttcagtatcatca

SEQ ID NO: 9053939 - DNA, 22 bp, Homo sapiens
cagctctgcctctggggctgag

SEQ ID NO: 9053940 - DNA, 22 bp, Homo sapiens
cagctctgcctctggggctgag

SEQ ID NO: 9053941 - DNA, 20 bp, Homo sapiens
gtggagaggctggcgggact

SEQ ID NO: 9053942 - DNA, 22 bp, Homo sapiens
tacactgagcaggaagaagtgg

SEQ ID NO: 9053943 - DNA, 22 bp, Homo sapiens
tacactgtacgctctgcttcaa

SEQ ID NO: 9053944 - DNA, 22 bp, Homo sapiens
tacactgtacgctctgcttcaa

SEQ ID NO: 9053945 - DNA, 22 bp, Homo sapiens
tacagacattcaattttgaccc

SEQ ID NO: 9053946 - DNA, 22 bp, Homo sapiens
tacagacatttactccactcct

SEQ ID NO: 9053947 - DNA, 22 bp, Homo sapiens
tacagagaactcatagaaagaa

SEQ ID NO: 9053948 - DNA, 22 bp, Homo sapiens
tacactgtttttggaaagaaga

SEQ ID NO: 9053949 - DNA, 19 bp, Homo sapiens
tacacttgtaatgagcaga

SEQ ID NO: 9053950 - DNA, 22 bp, Homo sapiens
tacagacattcaattttgaccc

SEQ ID NO: 9053951 - DNA, 22 bp, Homo sapiens
tacactttcgtttgtggattag

SEQ ID NO: 9053952 - DNA, 22 bp, Homo sapiens
tacactttatggatcctacttt

SEQ ID NO: 9053953 - DNA, 22 bp, Homo sapiens
caggccacagctaaagaggatt

SEQ ID NO: 9053954 - DNA, 22 bp, Homo sapiens
tcacttatgccagctctggaag

SEQ ID NO: 9053955 - DNA, 22 bp, Homo sapiens
tcactgtttcctgtactggaca

SEQ ID NO: 9053956 - DNA, 22 bp, Homo sapiens
tcactgtttgcagtgaagagaa

SEQ ID NO: 9053957 - DNA, 22 bp, Homo sapiens
tcacttaaaaattctagttatg

SEQ ID NO: 9053958 - DNA, 22 bp, Homo sapiens
tcacttagatggggatcatcac

SEQ ID NO: 9053959 - DNA, 22 bp, Homo sapiens
tcactgttgatgggcatgcagg

SEQ ID NO: 9053960 - DNA, 22 bp, Homo sapiens
tcactgttgacctggaagtggg

SEQ ID NO: 9053961 - DNA, 22 bp, Homo sapiens
catcaatgtgcagagatgaacg

SEQ ID NO: 9053962 - DNA, 22 bp, Homo sapiens
catcaaagttggtatatttgca

SEQ ID NO: 9053963 - DNA, 22 bp, Homo sapiens
catcaaatctgacttttcttcc

SEQ ID NO: 9053964 - DNA, 22 bp, Homo sapiens
catcataaaattgagataactg

SEQ ID NO: 9053965 - DNA, 22 bp, Homo sapiens
catcataataacccagacacag

SEQ ID NO: 9053966 - DNA, 22 bp, Homo sapiens
catcatactgtttacactcaaa

SEQ ID NO: 9053967 - DNA, 22 bp, Homo sapiens
tcagtgtcttgacctgggtgtg

SEQ ID NO: 9053968 - DNA, 22 bp, Homo sapiens
tcagtgtgaggggctgggtcct

SEQ ID NO: 9053969 - DNA, 23 bp, Homo sapiens
tcagtgtgcaagaatggagaagc

SEQ ID NO: 9053970 - DNA, 22 bp, Homo sapiens
tcagtgtgcacatggtagcagt

SEQ ID NO: 9053971 - DNA, 22 bp, Homo sapiens
catcagctcttcattcttgatt

SEQ ID NO: 9053972 - DNA, 22 bp, Homo sapiens
tcatacaactaagagtttcaga

SEQ ID NO: 9053973 - DNA, 22 bp, Homo sapiens
tcataatgaccccagagtccgc

SEQ ID NO: 9053974 - DNA, 22 bp, Homo sapiens
tcataatgtagttcatggctgg

SEQ ID NO: 9053975 - DNA, 22 bp, Homo sapiens
tcatcacatgtgtagtcatccc

SEQ ID NO: 9053976 - DNA, 22 bp, Homo sapiens
tcatcagagccattgttaagaa

SEQ ID NO: 9053977 - DNA, 22 bp, Homo sapiens
tcatcagactgactgtggttct

SEQ ID NO: 9053978 - DNA, 22 bp, Homo sapiens
tcatcactgtatcattgataga

SEQ ID NO: 9053979 - DNA, 22 bp, Homo sapiens
tcatcacatatgtcatgatttg

SEQ ID NO: 9053980 - DNA, 22 bp, Homo sapiens
tcatcacaattttatgaccctc

SEQ ID NO: 9053981 - DNA, 22 bp, Homo sapiens
tcatacataaataagagtttag

SEQ ID NO: 9053982 - DNA, 22 bp, Homo sapiens
catccttcaaaggctacaatta

SEQ ID NO: 9053983 - DNA, 22 bp, Homo sapiens
catccttctcaaagagtgcatg

SEQ ID NO: 9053984 - DNA, 22 bp, Homo sapiens
catgtaatcctggggagatgaa

SEQ ID NO: 9053985 - DNA, 22 bp, Homo sapiens
catgcttcatgcaaaattctga

SEQ ID NO: 9053986 - DNA, 22 bp, Homo sapiens
catgcttcctccaaactaccct

SEQ ID NO: 9053987 - DNA, 22 bp, Homo sapiens
catgcttgctgcctcattgttc

SEQ ID NO: 9053988 - DNA, 22 bp, Homo sapiens
catgctttgggtcagaaatgcc

SEQ ID NO: 9053989 - DNA, 22 bp, Homo sapiens
tccaagcactgttaattaaact

SEQ ID NO: 9053990 - DNA, 22 bp, Homo sapiens
tccaagcatgtggtcaggagcc

SEQ ID NO: 9053991 - DNA, 22 bp, Homo sapiens
tccaagatctacagcagtttag

SEQ ID NO: 9053992 - DNA, 22 bp, Homo sapiens
catgcattttctattcactcag

SEQ ID NO: 9053993 - DNA, 22 bp, Homo sapiens
catgctctctggcaacttgtgt

SEQ ID NO: 9053994 - DNA, 22 bp, Homo sapiens
catgctctagattctctctaat

SEQ ID NO: 9053995 - DNA, 23 bp, Homo sapiens
catgtacacacagctgtacagtg

SEQ ID NO: 9053996 - DNA, 22 bp, Homo sapiens
catgtacactcatgtaactata

SEQ ID NO: 9053997 - DNA, 22 bp, Homo sapiens
tccaggcttgagaccaggctct

SEQ ID NO: 9053998 - DNA, 22 bp, Homo sapiens
tccaggctttggggcaggagcg

SEQ ID NO: 9053999 - DNA, 22 bp, Homo sapiens
cattacaaagttataaacagtt

SEQ ID NO: 9054000 - DNA, 22 bp, Homo sapiens
cattacaaagttataaacagtt

SEQ ID NO: 9054001 - DNA, 22 bp, Homo sapiens
cattacaaccccaaattacaaa

SEQ ID NO: 9054002 - DNA, 22 bp, Homo sapiens
tccagggcaggtgctgggctct

SEQ ID NO: 9054003 - DNA, 22 bp, Homo sapiens
tccagggcagtgactacagcgg

SEQ ID NO: 9054004 - DNA, 22 bp, Homo sapiens
tccaggtcccagactgggcagc

SEQ ID NO: 9054005 - DNA, 20 bp, Homo sapiens
tccaggtaacatctctctgg

SEQ ID NO: 9054006 - DNA, 22 bp, Homo sapiens
tccaggtcagacttctgtgccc

SEQ ID NO: 9054007 - DNA, 22 bp, Homo sapiens
tccagggcatgctcagactcag

SEQ ID NO: 9054008 - DNA, 22 bp, Homo sapiens
ccagagggagccaccagggtgt

SEQ ID NO: 9054009 - DNA, 22 bp, Homo sapiens
tctcagtggatctcagaatttt

SEQ ID NO: 9054010 - DNA, 22 bp, Homo sapiens
tctcagtgtttaaaaagatttc

SEQ ID NO: 9054011 - DNA, 22 bp, Homo sapiens
tctcagtgttgttctgcagatg

SEQ ID NO: 9054012 - DNA, 22 bp, Homo sapiens
tctcagtgtgttttctctcaga

SEQ ID NO: 9054013 - DNA, 22 bp, Homo sapiens
tctcagtgttatctatctgcct

SEQ ID NO: 9054014 - DNA, 22 bp, Homo sapiens
tctcagtggcttcctcactttt

SEQ ID NO: 9054015 - DNA, 22 bp, Homo sapiens
tctcagtggcttcctcactttt

SEQ ID NO: 9054016 - DNA, 22 bp, Homo sapiens
tctcagtgggaagggcacagtt

SEQ ID NO: 9054017 - DNA, 22 bp, Homo sapiens
tctcagtggtggcattccagac

SEQ ID NO: 9054018 - DNA, 22 bp, Homo sapiens
tctcagtgggttaaaagagaag

SEQ ID NO: 9054019 - DNA, 22 bp, Homo sapiens
tctcagtggtgttttgagtcca

SEQ ID NO: 9054020 - DNA, 22 bp, Homo sapiens
tctcagtgtggtgcttaggata

SEQ ID NO: 9054021 - DNA, 22 bp, Homo sapiens
tctcagtgtgttgagaggtctg

SEQ ID NO: 9054022 - DNA, 22 bp, Homo sapiens
tctcagagaagtgatgagcaat

SEQ ID NO: 9054023 - DNA, 22 bp, Homo sapiens
tctatacacacaaagaatgctt

SEQ ID NO: 9054024 - DNA, 22 bp, Homo sapiens
tctatacatgtgcacacacatc

SEQ ID NO: 9054025 - DNA, 23 bp, Homo sapiens
tctatacatactgcagcctctgg

SEQ ID NO: 9054026 - DNA, 22 bp, Homo sapiens
tctatacaagtttcactttgac

SEQ ID NO: 9054027 - DNA, 21 bp, Homo sapiens
tctataactatagtgacagat

SEQ ID NO: 9054028 - DNA, 22 bp, Homo sapiens
tctataaatgcagatatgtgtg

SEQ ID NO: 9054029 - DNA, 22 bp, Homo sapiens
ccaccccaaatgaagacctctc

SEQ ID NO: 9054030 - DNA, 22 bp, Homo sapiens
ccaccccaaatgaagacctctc

SEQ ID NO: 9054031 - DNA, 18 bp, Homo sapiens
tctagaaacccagactct

SEQ ID NO: 9054032 - DNA, 22 bp, Homo sapiens
catttcactattcactaaaagg

SEQ ID NO: 9054033 - DNA, 22 bp, Homo sapiens
catttcacagtatattcaaaat

SEQ ID NO: 9054034 - DNA, 22 bp, Homo sapiens
catttcaccttagagaattatt

SEQ ID NO: 9054035 - DNA, 22 bp, Homo sapiens
tccatagtgaatgggtaatgca

SEQ ID NO: 9054036 - DNA, 21 bp, Homo sapiens
catttcatgattatagaaatg

SEQ ID NO: 9054037 - DNA, 22 bp, Homo sapiens
catttcatagttgtcacaataa

SEQ ID NO: 9054038 - DNA, 22 bp, Homo sapiens
catttcacgcacactcattact

SEQ ID NO: 9054039 - DNA, 22 bp, Homo sapiens
catttccagctcctgcatcatg

SEQ ID NO: 9054040 - DNA, 22 bp, Homo sapiens
cattttatgtttatggagtgct

SEQ ID NO: 9054041 - DNA, 22 bp, Homo sapiens
ccaaaaagtacatttaggtgtg

SEQ ID NO: 9054042 - DNA, 22 bp, Homo sapiens
ccaaaaagctcagagatatgtt

SEQ ID NO: 9054043 - DNA, 22 bp, Homo sapiens
ccaaaaagctcagagatatgtt

SEQ ID NO: 9054044 - DNA, 22 bp, Homo sapiens
cattttcatgagtttctgttca

SEQ ID NO: 9054045 - DNA, 22 bp, Homo sapiens
ccaacacagatgtgttagtgtt

SEQ ID NO: 9054046 - DNA, 22 bp, Homo sapiens
ccaaattaaatcatacagacag

SEQ ID NO: 9054047 - DNA, 22 bp, Homo sapiens
tcctgccttagagcaaggaaaa

SEQ ID NO: 9054048 - DNA, 22 bp, Homo sapiens
tcctgccttagagcaaggaaaa

SEQ ID NO: 9054049 - DNA, 22 bp, Homo sapiens
tcctgccttagagcaaggaaaa

SEQ ID NO: 9054050 - DNA, 19 bp, Homo sapiens
tcctgcccaccagccaggg

SEQ ID NO: 9054051 - DNA, 22 bp, Homo sapiens
tcctgcccagagctctccactc

SEQ ID NO: 9054052 - DNA, 22 bp, Homo sapiens
tcctgccttgcctgggacatca

SEQ ID NO: 9054053 - DNA, 22 bp, Homo sapiens
ccacagggcacaagggaggttg

SEQ ID NO: 9054054 - DNA, 16 bp, Homo sapiens
tcctggcctttggaag

SEQ ID NO: 9054055 - DNA, 22 bp, Homo sapiens
tcctggccttgcgtcttgggag

SEQ ID NO: 9054056 - DNA, 20 bp, Homo sapiens
tcctggccttctcgggcagt

SEQ ID NO: 9054057 - DNA, 17 bp, Homo sapiens
tcctggcctggtgtgtg

SEQ ID NO: 9054058 - DNA, 22 bp, Homo sapiens
tcctggcctgtctggagtagct

SEQ ID NO: 9054059 - DNA, 22 bp, Homo sapiens
tcctggccttagcgaggcggtc

SEQ ID NO: 9054060 - DNA, 22 bp, Homo sapiens
ttctatctcatatgtgttctag

SEQ ID NO: 9054061 - DNA, 22 bp, Homo sapiens
ttctcaaagaaagctgtcatta

SEQ ID NO: 9054062 - DNA, 22 bp, Homo sapiens
ttctcaaagggtggtttgcaaa

SEQ ID NO: 9054063 - DNA, 22 bp, Homo sapiens
ttctcaaagtgtgctccctgga

SEQ ID NO: 9054064 - DNA, 22 bp, Homo sapiens
ttctatgattcatttagaagtt

SEQ ID NO: 9054065 - DNA, 22 bp, Homo sapiens
ttctcagaattgactgggagca

SEQ ID NO: 9054066 - DNA, 22 bp, Homo sapiens
ttctcagaaaatgtagagaaaa

SEQ ID NO: 9054067 - DNA, 22 bp, Homo sapiens
ttctcagaaaagcaagctttct

SEQ ID NO: 9054068 - DNA, 22 bp, Homo sapiens
ttctcacagtacctaacatgta

SEQ ID NO: 9054069 - DNA, 22 bp, Homo sapiens
ttctcagatatttgtatggaac

SEQ ID NO: 9054070 - DNA, 22 bp, Homo sapiens
ttctcagatatttactgagcat

SEQ ID NO: 9054071 - DNA, 22 bp, Homo sapiens
ttctcagagtgaccaagtcttt

SEQ ID NO: 9054072 - DNA, 21 bp, Homo sapiens
ttctcagagtctattacagtt

SEQ ID NO: 9054073 - DNA, 22 bp, Homo sapiens
ttctcagaggctgctaagtgca

SEQ ID NO: 9054074 - DNA, 19 bp, Homo sapiens
ttctcagagcttgcagcac

SEQ ID NO: 9054075 - DNA, 22 bp, Homo sapiens
ttctcagaggagtcgggagctg

SEQ ID NO: 9054076 - DNA, 22 bp, Homo sapiens
ttctcagagcactgctgacaaa

SEQ ID NO: 9054077 - DNA, 22 bp, Homo sapiens
ttctcagagctcactgtagtaa

SEQ ID NO: 9054078 - DNA, 22 bp, Homo sapiens
ttctcagacttccagcaccagc

SEQ ID NO: 9054079 - DNA, 18 bp, Homo sapiens
ttctcagactttggaagt

SEQ ID NO: 9054080 - DNA, 22 bp, Homo sapiens
ttctcagagcactgctgacaaa

SEQ ID NO: 9054081 - DNA, 22 bp, Homo sapiens
ttctaaacttcaattctaaatt

SEQ ID NO: 9054082 - DNA, 22 bp, Homo sapiens
ttctaaacggcttcacaggaat

SEQ ID NO: 9054083 - DNA, 22 bp, Homo sapiens
ttcgctttgcccgttgtcattt

SEQ ID NO: 9054084 - DNA, 22 bp, Homo sapiens
ttctaactccacttcccactcc

SEQ ID NO: 9054085 - DNA, 22 bp, Homo sapiens
ttctaaattttggaagatgcag

SEQ ID NO: 9054086 - DNA, 21 bp, Homo sapiens
ttcctttttatggcttagtgg

SEQ ID NO: 9054087 - DNA, 22 bp, Homo sapiens
ttctctgttttcccctcgatgt

SEQ ID NO: 9054088 - DNA, 22 bp, Homo sapiens
ttctcttacattttctcagcct

SEQ ID NO: 9054089 - DNA, 19 bp, Homo sapiens
ttctctgtgctagactctg

SEQ ID NO: 9054090 - DNA, 22 bp, Homo sapiens
ttctctgtagttgcctggtgga

SEQ ID NO: 9054091 - DNA, 23 bp, Homo sapiens
ttctctttagatttacattactc

SEQ ID NO: 9054092 - DNA, 22 bp, Homo sapiens
ttctctttgacattattcaggt

SEQ ID NO: 9054093 - DNA, 22 bp, Homo sapiens
ttctcttttagaggctccatga

SEQ ID NO: 9054094 - DNA, 21 bp, Homo sapiens
ttctgcattaaggtggagata

SEQ ID NO: 9054095 - DNA, 23 bp, Homo sapiens
ttctgcatgtttcagagctggga

SEQ ID NO: 9054096 - DNA, 22 bp, Homo sapiens
ttctgcattgacttttatttcc

SEQ ID NO: 9054097 - DNA, 22 bp, Homo sapiens
ttctgcatttaaaatattacta

SEQ ID NO: 9054098 - DNA, 22 bp, Homo sapiens
ttctgcatttctaataagttcc

SEQ ID NO: 9054099 - DNA, 20 bp, Homo sapiens
ttctgcctagggttagcctg

SEQ ID NO: 9054100 - DNA, 22 bp, Homo sapiens
ttctgccagtgatcaataattg

SEQ ID NO: 9054101 - DNA, 19 bp, Homo sapiens
ttgaaagattagctttcta

SEQ ID NO: 9054102 - DNA, 22 bp, Homo sapiens
ttctttttggatagctgatgaa

SEQ ID NO: 9054103 - DNA, 22 bp, Homo sapiens
ttctttttatcttcccataaga

SEQ ID NO: 9054104 - DNA, 22 bp, Homo sapiens
ttgaaaacagcgtagattcaca

SEQ ID NO: 9054105 - DNA, 22 bp, Homo sapiens
ttgaaaacatttatattagaat

SEQ ID NO: 9054106 - DNA, 22 bp, Homo sapiens
ttgagaaggtggtcatttgcaa

SEQ ID NO: 9054107 - DNA, 22 bp, Homo sapiens
ttgagaatgatgagattcttcc

SEQ ID NO: 9054108 - DNA, 22 bp, Homo sapiens
ttgagggaaataactgatgctt

SEQ ID NO: 9054109 - DNA, 22 bp, Homo sapiens
ttgagggacagaggtgctgtct

SEQ ID NO: 9054110 - DNA, 22 bp, Homo sapiens
ttgagggagaaagctgaggtgt

SEQ ID NO: 9054111 - DNA, 22 bp, Homo sapiens
ttgagatagatctcatcttccc

SEQ ID NO: 9054112 - DNA, 22 bp, Homo sapiens
ttgaggtaataaacagccattc

SEQ ID NO: 9054113 - DNA, 22 bp, Homo sapiens
ttgagggtctggatctgctgct

SEQ ID NO: 9054114 - DNA, 22 bp, Homo sapiens
ttgaggtatattcacatatatc

SEQ ID NO: 9054115 - DNA, 22 bp, Homo sapiens
ttgaggtagttctattgtgagt

SEQ ID NO: 9054116 - DNA, 22 bp, Homo sapiens
ttgagggatttacagaggtggg

SEQ ID NO: 9054117 - DNA, 18 bp, Homo sapiens
ttgagggaggggcagagt

SEQ ID NO: 9054118 - DNA, 22 bp, Homo sapiens
ttgagggattgcaccagaagag

SEQ ID NO: 9054119 - DNA, 22 bp, Homo sapiens
ttcttcctctgtaaaaggtgac

SEQ ID NO: 9054120 - DNA, 22 bp, Homo sapiens
ttcttccttggtttcctggata

SEQ ID NO: 9054121 - DNA, 22 bp, Homo sapiens
ttcttcctcagcagggctgcct

SEQ ID NO: 9054122 - DNA, 22 bp, Homo sapiens
ttcttcctctgtaaaaggtgac

SEQ ID NO: 9054123 - DNA, 22 bp, Homo sapiens
ttcttcttcaagtgctgcattc

SEQ ID NO: 9054124 - DNA, 22 bp, Homo sapiens
ttctttctttgtagtcctgaac

SEQ ID NO: 9054125 - DNA, 22 bp, Homo sapiens
ttcaatatctctaagaatgagg

SEQ ID NO: 9054126 - DNA, 22 bp, Homo sapiens
ttcaatcatttttacatagtcc

SEQ ID NO: 9054127 - DNA, 22 bp, Homo sapiens
ttcaagtaaatcactttttgtc

SEQ ID NO: 9054128 - DNA, 22 bp, Homo sapiens
ttcaagtacattgtgttttcct

SEQ ID NO: 9054129 - DNA, 22 bp, Homo sapiens
ttcaagtagtcacacatgatat

SEQ ID NO: 9054130 - DNA, 22 bp, Homo sapiens
ttcaatatctctaagaatgagg

SEQ ID NO: 9054131 - DNA, 22 bp, Homo sapiens
ttcaatatctctaagaatgagg

SEQ ID NO: 9054132 - DNA, 20 bp, Homo sapiens
ttcagaaataaggaatgagg

SEQ ID NO: 9054133 - DNA, 22 bp, Homo sapiens
ttcagaaatccctcttctaccc

SEQ ID NO: 9054134 - DNA, 22 bp, Homo sapiens
ttcactgttgagttcctgatat

SEQ ID NO: 9054135 - DNA, 22 bp, Homo sapiens
ttcactgtgatggtgcagaggc

SEQ ID NO: 9054136 - DNA, 22 bp, Homo sapiens
ttcagaaatgaatattggtatt

SEQ ID NO: 9054137 - DNA, 22 bp, Homo sapiens
ttcagaaatccctcttctaccc

SEQ ID NO: 9054138 - DNA, 22 bp, Homo sapiens
ttcagaaatcgagtttcatgtc

SEQ ID NO: 9054139 - DNA, 22 bp, Homo sapiens
ttcagaaatcgagtttcatgtc

SEQ ID NO: 9054140 - DNA, 22 bp, Homo sapiens
ttcatactcactccaataactg

SEQ ID NO: 9054141 - DNA, 22 bp, Homo sapiens
ttcatagtgattgttcagatag

SEQ ID NO: 9054142 - DNA, 22 bp, Homo sapiens
ttcataggcaccctgtctgagg

SEQ ID NO: 9054143 - DNA, 23 bp, Homo sapiens
ttcataggcacattgcgcacaga

SEQ ID NO: 9054144 - DNA, 22 bp, Homo sapiens
ttcataggatcaaaagctgttt

SEQ ID NO: 9054145 - DNA, 22 bp, Homo sapiens
ttcataggatagagtgagattt

SEQ ID NO: 9054146 - DNA, 22 bp, Homo sapiens
ttcataggagagaagaaagtgt

SEQ ID NO: 9054147 - DNA, 21 bp, Homo sapiens
ttcataggacgactgtctgtc

SEQ ID NO: 9054148 - DNA, 22 bp, Homo sapiens
ttcataggaatttaaagaggaa

SEQ ID NO: 9054149 - DNA, 22 bp, Homo sapiens
ttcataggaaatagtgttcttt

SEQ ID NO: 9054150 - DNA, 22 bp, Homo sapiens
ttcataggaaaatgctggcccc

SEQ ID NO: 9054151 - DNA, 22 bp, Homo sapiens
ttcataggaaaaatgtgaggtg

SEQ ID NO: 9054152 - DNA, 22 bp, Homo sapiens
ttcataggtggatgctgccagg

SEQ ID NO: 9054153 - DNA, 22 bp, Homo sapiens
ttcataggtttgctgtgaacat

SEQ ID NO: 9054154 - DNA, 19 bp, Homo sapiens
ttcataggtgagcatacag

SEQ ID NO: 9054155 - DNA, 22 bp, Homo sapiens
ttcataggtcaaaaaacaagag

SEQ ID NO: 9054156 - DNA, 22 bp, Homo sapiens
ttcataggtacagggaatttct

SEQ ID NO: 9054157 - DNA, 22 bp, Homo sapiens
ttcatagggtatttccatagta

SEQ ID NO: 9054158 - DNA, 22 bp, Homo sapiens
ttcatagggctggggtgggagc

SEQ ID NO: 9054159 - DNA, 22 bp, Homo sapiens
ttcatagggagagtggtggaaa

SEQ ID NO: 9054160 - DNA, 22 bp, Homo sapiens
ttcataggcagcactggctcct

SEQ ID NO: 9054161 - DNA, 22 bp, Homo sapiens
ttcatattatgatttgaaatgc

SEQ ID NO: 9054162 - DNA, 22 bp, Homo sapiens
ttcatattatgatttgaaatgc

SEQ ID NO: 9054163 - DNA, 22 bp, Homo sapiens
ttcatattcaaatactctgctt

SEQ ID NO: 9054164 - DNA, 22 bp, Homo sapiens
ttcatattgcttccgtggagtg

SEQ ID NO: 9054165 - DNA, 22 bp, Homo sapiens
ttcatatttgaaacagaagtta

SEQ ID NO: 9054166 - DNA, 22 bp, Homo sapiens
ttcatatttctttaaggacttt

SEQ ID NO: 9054167 - DNA, 22 bp, Homo sapiens
ttcatcaaaaggctgaggggaa

SEQ ID NO: 9054168 - DNA, 22 bp, Homo sapiens
ttcatattttctgcttgctcac

SEQ ID NO: 9054169 - DNA, 22 bp, Homo sapiens
ttccaaaacaatattctgtgaa

SEQ ID NO: 9054170 - DNA, 22 bp, Homo sapiens
ttccaatccaaacttcaccttt

SEQ ID NO: 9054171 - DNA, 22 bp, Homo sapiens
ttccatatctgttgcatatcat

SEQ ID NO: 9054172 - DNA, 22 bp, Homo sapiens
ttccatatctgttgcatatcat

SEQ ID NO: 9054173 - DNA, 22 bp, Homo sapiens
ttccataatcaccttattcttt

SEQ ID NO: 9054174 - DNA, 22 bp, Homo sapiens
ttcccatgcctggcccctatcc

SEQ ID NO: 9054175 - DNA, 22 bp, Homo sapiens
ttccatgagtagcagtatttcc

SEQ ID NO: 9054176 - DNA, 22 bp, Homo sapiens
ttccatattgtactctttggag

SEQ ID NO: 9054177 - DNA, 22 bp, Homo sapiens
ttccatgtgagtacactgtgat

SEQ ID NO: 9054178 - DNA, 22 bp, Homo sapiens
ttatgcagatggcatgaggagg

SEQ ID NO: 9054179 - DNA, 22 bp, Homo sapiens
ttatgcagatggcatgaggagg

SEQ ID NO: 9054180 - DNA, 22 bp, Homo sapiens
ttatgcatatagcagatacgag

SEQ ID NO: 9054181 - DNA, 22 bp, Homo sapiens
ttatgcctccgaaacctggagt

SEQ ID NO: 9054182 - DNA, 22 bp, Homo sapiens
ttatggcaagggttttaatttg

SEQ ID NO: 9054183 - DNA, 22 bp, Homo sapiens
ttatgtgaggttcagctttatc

SEQ ID NO: 9054184 - DNA, 22 bp, Homo sapiens
ttatgcagagttgagaggaatg

SEQ ID NO: 9054185 - DNA, 22 bp, Homo sapiens
ttatacactgcagaaccagcat

SEQ ID NO: 9054186 - DNA, 22 bp, Homo sapiens
ttatacacgtttatggagctac

SEQ ID NO: 9054187 - DNA, 22 bp, Homo sapiens
ttatacacaattcttttactac

SEQ ID NO: 9054188 - DNA, 22 bp, Homo sapiens
ttataattgcttattagaccca

SEQ ID NO: 9054189 - DNA, 22 bp, Homo sapiens
tcctctgctccaggctggactt

SEQ ID NO: 9054190 - DNA, 19 bp, Homo sapiens
tcctccttacttcctcttg

SEQ ID NO: 9054191 - DNA, 20 bp, Homo sapiens
tcctccttgcagagcccaga

SEQ ID NO: 9054192 - DNA, 22 bp, Homo sapiens
tcctctggcccagctgcctctg

SEQ ID NO: 9054193 - DNA, 22 bp, Homo sapiens
tcctctggctctttccctagga

SEQ ID NO: 9054194 - DNA, 22 bp, Homo sapiens
tcctctggctctttccctagga

SEQ ID NO: 9054195 - DNA, 22 bp, Homo sapiens
tcctctggaacctcacccttgc

SEQ ID NO: 9054196 - DNA, 22 bp, Homo sapiens
tcctctgctccatctttactgt

SEQ ID NO: 9054197 - DNA, 21 bp, Homo sapiens
tcctctgctctcataccacaa

SEQ ID NO: 9054198 - DNA, 22 bp, Homo sapiens
ttcaaaagcggtccaggaagat

SEQ ID NO: 9054199 - DNA, 22 bp, Homo sapiens
ttcaaaagtaatcagtattaga

SEQ ID NO: 9054200 - DNA, 22 bp, Homo sapiens
ttattttggtaaatgtttgcct

SEQ ID NO: 9054201 - DNA, 22 bp, Homo sapiens
ttattttgtagctctgatcttt

SEQ ID NO: 9054202 - DNA, 22 bp, Homo sapiens
ttcaaaagactcagatgtagcg

SEQ ID NO: 9054203 - DNA, 22 bp, Homo sapiens
ttattttgccacaggtgacctt

SEQ ID NO: 9054204 - DNA, 22 bp, Homo sapiens
ttattttgagagaatgtgtgct

SEQ ID NO: 9054205 - DNA, 22 bp, Homo sapiens
ttcaagaaggtacatttacatc

SEQ ID NO: 9054206 - DNA, 22 bp, Homo sapiens
ttcaaacacagacagcagcatg

SEQ ID NO: 9054207 - DNA, 22 bp, Homo sapiens
ttcaagaatcttcctgaccact

SEQ ID NO: 9054208 - DNA, 22 bp, Homo sapiens
ttcaaggagattggagtctact

SEQ ID NO: 9054209 - DNA, 22 bp, Homo sapiens
ttcaaggaaaccagcatttggt

SEQ ID NO: 9054210 - DNA, 22 bp, Homo sapiens
ttatttaatgtgatctgaagag

SEQ ID NO: 9054211 - DNA, 22 bp, Homo sapiens
ttatttactggatggccttggg

SEQ ID NO: 9054212 - DNA, 22 bp, Homo sapiens
ttatttacaactcttctcttcc

SEQ ID NO: 9054213 - DNA, 22 bp, Homo sapiens
ttatttatatctctgcagttta

SEQ ID NO: 9054214 - DNA, 22 bp, Homo sapiens
ttatttaaaagtggtaagattc

SEQ ID NO: 9054215 - DNA, 22 bp, Homo sapiens
ttatttaaaagtggtaagattc

SEQ ID NO: 9054216 - DNA, 22 bp, Homo sapiens
ttatttaaaagtggtaagattc

SEQ ID NO: 9054217 - DNA, 22 bp, Homo sapiens
ttatgttttatggctatatcat

SEQ ID NO: 9054218 - DNA, 22 bp, Homo sapiens
ttgtagaatcattatttctagt

SEQ ID NO: 9054219 - DNA, 22 bp, Homo sapiens
ttgtagaaaattagatgcatgg

SEQ ID NO: 9054220 - DNA, 19 bp, Homo sapiens
ttggggtgaatgccagaca

SEQ ID NO: 9054221 - DNA, 18 bp, Homo sapiens
ttggggtgaggccaggaa

SEQ ID NO: 9054222 - DNA, 22 bp, Homo sapiens
ttgtattctgttacagcaacat

SEQ ID NO: 9054223 - DNA, 22 bp, Homo sapiens
ttgttatttaggtctgggttag

SEQ ID NO: 9054224 - DNA, 22 bp, Homo sapiens
ttgttatttacaacaatcctat

SEQ ID NO: 9054225 - DNA, 22 bp, Homo sapiens
ttgttatttacaacaatcctat

SEQ ID NO: 9054226 - DNA, 22 bp, Homo sapiens
ttgttattattactaagtcttc

SEQ ID NO: 9054227 - DNA, 22 bp, Homo sapiens
ttgttcatcaggtgacacatac

SEQ ID NO: 9054228 - DNA, 22 bp, Homo sapiens
ttgggctcaggagtttgagacc

SEQ ID NO: 9054229 - DNA, 22 bp, Homo sapiens
ttggctcacaaggacggttgct

SEQ ID NO: 9054230 - DNA, 22 bp, Homo sapiens
ttggctcaaaacttagattcca

SEQ ID NO: 9054231 - DNA, 22 bp, Homo sapiens
ttggctcacctgtctacccaga

SEQ ID NO: 9054232 - DNA, 20 bp, Homo sapiens
ttggctcagatttttatggg

SEQ ID NO: 9054233 - DNA, 22 bp, Homo sapiens
ttggctcacctggagcctgttg

SEQ ID NO: 9054234 - DNA, 22 bp, Homo sapiens
ttggctcacatgattatggagg

SEQ ID NO: 9054235 - DNA, 22 bp, Homo sapiens
ttggctcagctgggactgttga

SEQ ID NO: 9054236 - DNA, 22 bp, Homo sapiens
ttggctcagcatcttggtgcca

SEQ ID NO: 9054237 - DNA, 22 bp, Homo sapiens
ttggctcaggacccctgtgact

SEQ ID NO: 9054238 - DNA, 22 bp, Homo sapiens
ttggctcaggctttcattgtaa

SEQ ID NO: 9054239 - DNA, 22 bp, Homo sapiens
ttggctcatgctgttttgtgca

SEQ ID NO: 9054240 - DNA, 22 bp, Homo sapiens
ttggctcattaaagatgataat

SEQ ID NO: 9054241 - DNA, 20 bp, Homo sapiens
ttggctcatgcaacacctac

SEQ ID NO: 9054242 - DNA, 22 bp, Homo sapiens
ttggctcagtgtgagggagatg

SEQ ID NO: 9054243 - DNA, 22 bp, Homo sapiens
ttggaatcaattcatgttgcaa

SEQ ID NO: 9054244 - DNA, 22 bp, Homo sapiens
ttggaattcaagttgtagctta

SEQ ID NO: 9054245 - DNA, 21 bp, Homo sapiens
ttggatgtatttatgttttag

SEQ ID NO: 9054246 - DNA, 22 bp, Homo sapiens
ttggattcagtcttgcagattc

SEQ ID NO: 9054247 - DNA, 22 bp, Homo sapiens
ttggcaattcaccaaggctcgc

SEQ ID NO: 9054248 - DNA, 23 bp, Homo sapiens
ttgcttctgtgcaattcagtact

SEQ ID NO: 9054249 - DNA, 22 bp, Homo sapiens
ttgctatactcattagttattt

SEQ ID NO: 9054250 - DNA, 22 bp, Homo sapiens
ttgaggtattgatattttatga

SEQ ID NO: 9054251 - DNA, 22 bp, Homo sapiens
ttgccactaactagctgtgaga

SEQ ID NO: 9054252 - DNA, 22 bp, Homo sapiens
ttgccacacaagtaaagaaaca

SEQ ID NO: 9054253 - DNA, 22 bp, Homo sapiens
ttgcattttggttgtaaatatg

SEQ ID NO: 9054254 - DNA, 22 bp, Homo sapiens
ttgccactgaaccagtcttgca

SEQ ID NO: 9054255 - DNA, 23 bp, Homo sapiens
tttatttatttaggctgagggat

SEQ ID NO: 9054256 - DNA, 22 bp, Homo sapiens
tttatttataagccacttgctg

SEQ ID NO: 9054257 - DNA, 21 bp, Homo sapiens
tttatttatataggacacatg

SEQ ID NO: 9054258 - DNA, 22 bp, Homo sapiens
tttatttatccttctggattgc

SEQ ID NO: 9054259 - DNA, 22 bp, Homo sapiens
tttcaagtggcgagataaggaa

SEQ ID NO: 9054260 - DNA, 22 bp, Homo sapiens
tttcacaacgttgtggtgagag

SEQ ID NO: 9054261 - DNA, 18 bp, Homo sapiens
tttcacaacctccagagg

SEQ ID NO: 9054262 - DNA, 22 bp, Homo sapiens
tttcacaacgttgtggtgagag

SEQ ID NO: 9054263 - DNA, 22 bp, Homo sapiens
tttcacaactgcttatttgaga

SEQ ID NO: 9054264 - DNA, 18 bp, Homo sapiens
tttcacaacctccagagg

SEQ ID NO: 9054265 - DNA, 18 bp, Homo sapiens
tttcacaacctccagagg

SEQ ID NO: 9054266 - DNA, 19 bp, Homo sapiens
tttcaatggcttagagaaa

SEQ ID NO: 9054267 - DNA, 22 bp, Homo sapiens
tttcacaacacaatctcgttaa

SEQ ID NO: 9054268 - DNA, 22 bp, Homo sapiens
tttcacaagacagctactgttg

SEQ ID NO: 9054269 - DNA, 22 bp, Homo sapiens
tttcacaagtaaagtcctaagt

SEQ ID NO: 9054270 - DNA, 22 bp, Homo sapiens
tttcacaagtttcaggattctg

SEQ ID NO: 9054271 - DNA, 22 bp, Homo sapiens
tttcacaagtttcaggattctg

SEQ ID NO: 9054272 - DNA, 22 bp, Homo sapiens
tttcacaagacagctactgttg

SEQ ID NO: 9054273 - DNA, 22 bp, Homo sapiens
tttcacaactgcttatttgaga

SEQ ID NO: 9054274 - DNA, 22 bp, Homo sapiens
tttcacaatcaaatggtgaaat

SEQ ID NO: 9054275 - DNA, 22 bp, Homo sapiens
tttcacaatcaaatggtgaaat

SEQ ID NO: 9054276 - DNA, 22 bp, Homo sapiens
tttcacatcagaggtagattag

SEQ ID NO: 9054277 - DNA, 22 bp, Homo sapiens
tttcacatgtatataggcatta

SEQ ID NO: 9054278 - DNA, 22 bp, Homo sapiens
tttcacatcatgggatggaagc

SEQ ID NO: 9054279 - DNA, 22 bp, Homo sapiens
tttcacatgcagcagggaagtg

SEQ ID NO: 9054280 - DNA, 22 bp, Homo sapiens
tttcacattctctggttatcga

SEQ ID NO: 9054281 - DNA, 22 bp, Homo sapiens
tttcacattcttctgaatctac

SEQ ID NO: 9054282 - DNA, 23 bp, Homo sapiens
tttcacattaatgtttagcagga

SEQ ID NO: 9054283 - DNA, 22 bp, Homo sapiens
tttcacatgtggaatgccaggt

SEQ ID NO: 9054284 - DNA, 22 bp, Homo sapiens
tttcacatttaggcgtgaattg

SEQ ID NO: 9054285 - DNA, 22 bp, Homo sapiens
tttctaaaatagattttatggt

SEQ ID NO: 9054286 - DNA, 22 bp, Homo sapiens
tttccttttggctaggtgtgaa

SEQ ID NO: 9054287 - DNA, 21 bp, Homo sapiens
tttcgcatgtgttaactgtga

SEQ ID NO: 9054288 - DNA, 22 bp, Homo sapiens
tttccttttataaggcttgagg

SEQ ID NO: 9054289 - DNA, 22 bp, Homo sapiens
tttcctttgtgcaggccttggg

SEQ ID NO: 9054290 - DNA, 22 bp, Homo sapiens
tttcctttgcccaatacatgtc

SEQ ID NO: 9054291 - DNA, 22 bp, Homo sapiens
tttccttttaagcagtcggcct

SEQ ID NO: 9054292 - DNA, 22 bp, Homo sapiens
tttcctttctggtttggtcata

SEQ ID NO: 9054293 - DNA, 22 bp, Homo sapiens
tttccttgcacattggtttcca

SEQ ID NO: 9054294 - DNA, 22 bp, Homo sapiens
tttcctttgagggtcctacact

SEQ ID NO: 9054295 - DNA, 22 bp, Homo sapiens
tttcctttgcccaatacatgtc

SEQ ID NO: 9054296 - DNA, 22 bp, Homo sapiens
tttcctttgggagcatgaattt

SEQ ID NO: 9054297 - DNA, 22 bp, Homo sapiens
tttcctttgggcacccgagctc

SEQ ID NO: 9054298 - DNA, 22 bp, Homo sapiens
tttcatcttatttgtctacatc

SEQ ID NO: 9054299 - DNA, 22 bp, Homo sapiens
tttcatcatcaaaatagtgagg

SEQ ID NO: 9054300 - DNA, 22 bp, Homo sapiens
tttcatatgggcattggcaata

SEQ ID NO: 9054301 - DNA, 23 bp, Homo sapiens
tttcatcagttgatctggacagc

SEQ ID NO: 9054302 - DNA, 22 bp, Homo sapiens
tttcataatgtcacagtcaaaa

SEQ ID NO: 9054303 - DNA, 23 bp, Homo sapiens
tttcatatggtgtggatgaagaa

SEQ ID NO: 9054304 - DNA, 22 bp, Homo sapiens
tttcatattgtccagtcagcgc

SEQ ID NO: 9054305 - DNA, 22 bp, Homo sapiens
tttcatattattccttgagtct

SEQ ID NO: 9054306 - DNA, 22 bp, Homo sapiens
tttcataatagtgcagtttgtt

SEQ ID NO: 9054307 - DNA, 22 bp, Homo sapiens
tttcataaacagtagaagacta

SEQ ID NO: 9054308 - DNA, 21 bp, Homo sapiens
tttatgtacttcatagagtag

SEQ ID NO: 9054309 - DNA, 22 bp, Homo sapiens
tttatgtcaaaactacagttgg

SEQ ID NO: 9054310 - DNA, 22 bp, Homo sapiens
tttatgtcactttgaaagagag

SEQ ID NO: 9054311 - DNA, 22 bp, Homo sapiens
tttatgtcactttgaaagagag

SEQ ID NO: 9054312 - DNA, 19 bp, Homo sapiens
tttatgtcattgaggtcat

SEQ ID NO: 9054313 - DNA, 22 bp, Homo sapiens
tttatgtttgacaatgatctgg

SEQ ID NO: 9054314 - DNA, 22 bp, Homo sapiens
tttattgccctgtagtacagga

SEQ ID NO: 9054315 - DNA, 22 bp, Homo sapiens
tttatgacttctaatctgaagc

SEQ ID NO: 9054316 - DNA, 22 bp, Homo sapiens
tttatgtaatttcataggtgtg

SEQ ID NO: 9054317 - DNA, 22 bp, Homo sapiens
tttatgaactacagatataact

SEQ ID NO: 9054318 - DNA, 22 bp, Homo sapiens
tttatgacaagcattactgatt

SEQ ID NO: 9054319 - DNA, 22 bp, Homo sapiens
tttattgctgtgttagggacag

SEQ ID NO: 9054320 - DNA, 16 bp, Homo sapiens
tttatttactagtgtt

SEQ ID NO: 9054321 - DNA, 22 bp, Homo sapiens
tttatctgatattcagcgattt

SEQ ID NO: 9054322 - DNA, 22 bp, Homo sapiens
tttatctgttgtacatttatgc

SEQ ID NO: 9054323 - DNA, 22 bp, Homo sapiens
tttatctgttgtacctgcattg

SEQ ID NO: 9054324 - DNA, 22 bp, Homo sapiens
tttatctgtatatctcaagtgt

SEQ ID NO: 9054325 - DNA, 22 bp, Homo sapiens
tttagcatgttcctttcataga

SEQ ID NO: 9054326 - DNA, 22 bp, Homo sapiens
tttagcattaagcttttcaaat

SEQ ID NO: 9054327 - DNA, 22 bp, Homo sapiens
tttagcattcctgggatgattt

SEQ ID NO: 9054328 - DNA, 22 bp, Homo sapiens
tttagcattactaaaatgaaaa

SEQ ID NO: 9054329 - DNA, 22 bp, Homo sapiens
tttaggaatattttctttcagg

SEQ ID NO: 9054330 - DNA, 22 bp, Homo sapiens
tttaggaatgtggtttttgagc

SEQ ID NO: 9054331 - DNA, 22 bp, Homo sapiens
ttgtttaaaagaaatcatagaa

SEQ ID NO: 9054332 - DNA, 22 bp, Homo sapiens
ttgtttaaaagaaatcatagaa

SEQ ID NO: 9054333 - DNA, 22 bp, Homo sapiens
ttgtttaaaatgtagcaagaaa

SEQ ID NO: 9054334 - DNA, 22 bp, Homo sapiens
ttgtttaaaagaaatcatagaa

SEQ ID NO: 9054335 - DNA, 22 bp, Homo sapiens
tttaacttagaagagatatcct

SEQ ID NO: 9054336 - DNA, 22 bp, Homo sapiens
tttaacttagaagagatatcct

SEQ ID NO: 9054337 - DNA, 22 bp, Homo sapiens
tttaacatgttcaagaaacata

SEQ ID NO: 9054338 - DNA, 22 bp, Homo sapiens
tttaaccagtttacaaagaatt

SEQ ID NO: 9054339 - DNA, 22 bp, Homo sapiens
tttaaccagtttacaaagaatt

SEQ ID NO: 9054340 - DNA, 23 bp, Homo sapiens
tttaacatttgaacatgtggcca

SEQ ID NO: 9054341 - DNA, 22 bp, Homo sapiens
tttaacatgtgaattttggaag

SEQ ID NO: 9054342 - DNA, 22 bp, Homo sapiens
tttaacatgtaattgctgcttt

SEQ ID NO: 9054343 - DNA, 22 bp, Homo sapiens
tttaacagatgtgaaattttca

SEQ ID NO: 9054344 - DNA, 22 bp, Homo sapiens
tttacagacaacttaatagggg

SEQ ID NO: 9054345 - DNA, 22 bp, Homo sapiens
tttacagagaatgtacataaag

SEQ ID NO: 9054346 - DNA, 22 bp, Homo sapiens
tttacagagaatgtacataaag

SEQ ID NO: 9054347 - DNA, 22 bp, Homo sapiens
tttaagatcatttgtattatcc

SEQ ID NO: 9054348 - DNA, 22 bp, Homo sapiens
tttaagagcctgtacaaatatt

SEQ ID NO: 9054349 - DNA, 22 bp, Homo sapiens
tttaagagcctgtacaaatatt

SEQ ID NO: 9054350 - DNA, 22 bp, Homo sapiens
tttaagagttaaactttgacct

SEQ ID NO: 9054351 - DNA, 22 bp, Homo sapiens
tttaagagctagtatgtcattt

SEQ ID NO: 9054352 - DNA, 22 bp, Homo sapiens
tttaagaagttatgttataaat

SEQ ID NO: 9054353 - DNA, 22 bp, Homo sapiens
tttaagagcatttgcaatttat

SEQ ID NO: 9054354 - DNA, 22 bp, Homo sapiens
tttacactgacagcacataagg

SEQ ID NO: 9054355 - DNA, 19 bp, Homo sapiens
ttttccttctatatgtttc

SEQ ID NO: 9054356 - DNA, 22 bp, Homo sapiens
ttttccttctagagcagatttc

SEQ ID NO: 9054357 - DNA, 22 bp, Homo sapiens
ttttccttcacctcttgagcct

SEQ ID NO: 9054358 - DNA, 22 bp, Homo sapiens
ttttccttcatatcccttatgt

SEQ ID NO: 9054359 - DNA, 18 bp, Homo sapiens
ttttccttccaccttgaa

SEQ ID NO: 9054360 - DNA, 22 bp, Homo sapiens
ttttccttaacagagggagaaa

SEQ ID NO: 9054361 - DNA, 22 bp, Homo sapiens
ttttccttagcttctctgcgag

SEQ ID NO: 9054362 - DNA, 22 bp, Homo sapiens
ttttttatctatggtagtacca

SEQ ID NO: 9054363 - DNA, 22 bp, Homo sapiens
ttttgtatagtcaaagacaaga

SEQ ID NO: 9054364 - DNA, 23 bp, Homo sapiens
ttttaatttggacataagaagat

SEQ ID NO: 9054365 - DNA, 23 bp, Homo sapiens
ttttaatttggacataagaagat

SEQ ID NO: 9054366 - DNA, 22 bp, Homo sapiens
tttgtggcaggagcggagaccg

SEQ ID NO: 9054367 - DNA, 22 bp, Homo sapiens
tttgtgtaccttgtacatttgt

SEQ ID NO: 9054368 - DNA, 22 bp, Homo sapiens
tttgtgtatgcttcacctagcc

SEQ ID NO: 9054369 - DNA, 22 bp, Homo sapiens
ttttacagttccatgcaaagcg

SEQ ID NO: 9054370 - DNA, 22 bp, Homo sapiens
ttttacacctcagatgagcaga

SEQ ID NO: 9054371 - DNA, 22 bp, Homo sapiens
ttttacaagctgagtcgttaaa

SEQ ID NO: 9054372 - DNA, 22 bp, Homo sapiens
ttttacacctcagatgagcaga

SEQ ID NO: 9054373 - DNA, 19 bp, Homo sapiens
tttgtgcagcaacattaat

SEQ ID NO: 9054374 - DNA, 22 bp, Homo sapiens
tttgtgcagataggagacaatc

SEQ ID NO: 9054375 - DNA, 22 bp, Homo sapiens
tttgtcttatccaatctctcag

SEQ ID NO: 9054376 - DNA, 22 bp, Homo sapiens
tttgtccttgaatcaattcaca

SEQ ID NO: 9054377 - DNA, 19 bp, Homo sapiens
tttgtctctgaataatatt

SEQ ID NO: 9054378 - DNA, 22 bp, Homo sapiens
ttttacttcattcctgacttca

SEQ ID NO: 9054379 - DNA, 22 bp, Homo sapiens
ttttacttaattcttggtcatg

SEQ ID NO: 9054380 - DNA, 22 bp, Homo sapiens
ttttagaaggaatgctatggtg

SEQ ID NO: 9054381 - DNA, 22 bp, Homo sapiens
ttttagaaagatccctggcagg

SEQ ID NO: 9054382 - DNA, 22 bp, Homo sapiens
ttttactttggatacagtactt

SEQ ID NO: 9054383 - DNA, 22 bp, Homo sapiens
ttttcacaagggtccaactagt

SEQ ID NO: 9054384 - DNA, 22 bp, Homo sapiens
ttttcacaagggtccaactagt

SEQ ID NO: 9054385 - DNA, 22 bp, Homo sapiens
tttgaagaagctgacctatttt

SEQ ID NO: 9054386 - DNA, 22 bp, Homo sapiens
tttgaagacatattgttacata

SEQ ID NO: 9054387 - DNA, 22 bp, Homo sapiens
tttgagaaggtgacaaattcta

SEQ ID NO: 9054388 - DNA, 22 bp, Homo sapiens
tttctattggcgtcactgttgt

SEQ ID NO: 9054389 - DNA, 22 bp, Homo sapiens
tttctattgatctaataaacat

SEQ ID NO: 9054390 - DNA, 22 bp, Homo sapiens
tttctatatgaggagctaaagt

SEQ ID NO: 9054391 - DNA, 22 bp, Homo sapiens
tttctattctggatctgtggca

SEQ ID NO: 9054392 - DNA, 22 bp, Homo sapiens
tttggccacttcatagatcatt

SEQ ID NO: 9054393 - DNA, 22 bp, Homo sapiens
tttggccaggtctggaaacagt

SEQ ID NO: 9054394 - DNA, 22 bp, Homo sapiens
tttggccatatctatactcagc

SEQ ID NO: 9054395 - DNA, 22 bp, Homo sapiens
tttgtcatcccttttgaaactg

SEQ ID NO: 9054396 - DNA, 22 bp, Homo sapiens
tttgtcatcagttattaatatg

SEQ ID NO: 9054397 - DNA, 22 bp, Homo sapiens
tttgtcatcagttattaatatg

SEQ ID NO: 9054398 - DNA, 22 bp, Homo sapiens
tttgtcatcccttttgaaactg

SEQ ID NO: 9054399 - DNA, 22 bp, Homo sapiens
tttgtcataactctgctgcaag

SEQ ID NO: 9054400 - DNA, 22 bp, Homo sapiens
tttgtcatatcacacaattttg

SEQ ID NO: 9054401 - DNA, 22 bp, Homo sapiens
tttgtcatttccctgattaaag

SEQ ID NO: 9054402 - DNA, 22 bp, Homo sapiens
tttgggcaggcttttccctaga

SEQ ID NO: 9054403 - DNA, 22 bp, Homo sapiens
tttgggctggtttgccatgccc

SEQ ID NO: 9054404 - DNA, 22 bp, Homo sapiens
tttggggatgacaggttaggaa

SEQ ID NO: 9054405 - DNA, 22 bp, Homo sapiens
tttgcataagtcatgtccagtg

SEQ ID NO: 9054406 - DNA, 22 bp, Homo sapiens
tttgcataaaggagcatttctc

SEQ ID NO: 9054407 - DNA, 22 bp, Homo sapiens
tttgcatacatgagaatgtctt

SEQ ID NO: 9054408 - DNA, 22 bp, Homo sapiens
tttgcataccctccctgtgctg

SEQ ID NO: 9054409 - DNA, 22 bp, Homo sapiens
tttgcataggatggacatttta

SEQ ID NO: 9054410 - DNA, 22 bp, Homo sapiens
tttgcatattaatatctgcgct

SEQ ID NO: 9054411 - DNA, 19 bp, Homo sapiens
tttgagaagttattatcta

SEQ ID NO: 9054412 - DNA, 22 bp, Homo sapiens
atatataatacttgctgtgggc

SEQ ID NO: 9054413 - DNA, 22 bp, Homo sapiens
atataaagtgtttagaaagctg

SEQ ID NO: 9054414 - DNA, 22 bp, Homo sapiens
atataacatacatacagaaaag

SEQ ID NO: 9054415 - DNA, 22 bp, Homo sapiens
ctgggaaggggaaggtcctctc

SEQ ID NO: 9054416 - DNA, 22 bp, Homo sapiens
ctgggagagaagcgaagctggg

SEQ ID NO: 9054417 - DNA, 22 bp, Homo sapiens
atatatacaactagattaaaag

SEQ ID NO: 9054418 - DNA, 22 bp, Homo sapiens
atatatacaactagattaaaag

SEQ ID NO: 9054419 - DNA, 22 bp, Homo sapiens
atatatactttgacacattctg

SEQ ID NO: 9054420 - DNA, 22 bp, Homo sapiens
atatgattccactattgtatgg

SEQ ID NO: 9054421 - DNA, 22 bp, Homo sapiens
atatgcaagcacatagaatact

SEQ ID NO: 9054422 - DNA, 22 bp, Homo sapiens
atatgaaagtaagcatgtgtgt

SEQ ID NO: 9054423 - DNA, 22 bp, Homo sapiens
atatttactgctgtggtgaagg

SEQ ID NO: 9054424 - DNA, 22 bp, Homo sapiens
atatgttttgtgcttcattggt

SEQ ID NO: 9054425 - DNA, 22 bp, Homo sapiens
atatttctctcagacatggaag

SEQ ID NO: 9054426 - DNA, 18 bp, Homo sapiens
atatgttaattaggtagg

SEQ ID NO: 9054427 - DNA, 20 bp, Homo sapiens
atatttcttaagaactttca

SEQ ID NO: 9054428 - DNA, 22 bp, Homo sapiens
atatttctgggggtgtgtttct

SEQ ID NO: 9054429 - DNA, 22 bp, Homo sapiens
atatttctctcagacatggaag

SEQ ID NO: 9054430 - DNA, 22 bp, Homo sapiens
atatttcttgagcacctggtat

SEQ ID NO: 9054431 - DNA, 22 bp, Homo sapiens
atatttcttgagcacctggtat

SEQ ID NO: 9054432 - DNA, 23 bp, Homo sapiens
atatgtcatgcaccagcacttta

SEQ ID NO: 9054433 - DNA, 22 bp, Homo sapiens
atatggtaagagtatatttact

SEQ ID NO: 9054434 - DNA, 22 bp, Homo sapiens
atcattttgtgacaatgcctgt

SEQ ID NO: 9054435 - DNA, 22 bp, Homo sapiens
atccaaaatttactgtagcatt

SEQ ID NO: 9054436 - DNA, 22 bp, Homo sapiens
atcatttttaagagactcttct

SEQ ID NO: 9054437 - DNA, 22 bp, Homo sapiens
atccaattacgttttttgtcat

SEQ ID NO: 9054438 - DNA, 22 bp, Homo sapiens
atccccaggggcattcaagctt

SEQ ID NO: 9054439 - DNA, 22 bp, Homo sapiens
atccccctgtatctggaagaat

SEQ ID NO: 9054440 - DNA, 22 bp, Homo sapiens
atccacaggtcatgtaatgtgg

SEQ ID NO: 9054441 - DNA, 22 bp, Homo sapiens
atcctcgtctgcacatcaaagg

SEQ ID NO: 9054442 - DNA, 22 bp, Homo sapiens
atcctctctgtgacagggaacg

SEQ ID NO: 9054443 - DNA, 22 bp, Homo sapiens
atcctctctcccataccagtct

SEQ ID NO: 9054444 - DNA, 23 bp, Homo sapiens
atcctctctccatcccactgtgc

SEQ ID NO: 9054445 - DNA, 22 bp, Homo sapiens
atcctctgtggattacacctag

SEQ ID NO: 9054446 - DNA, 22 bp, Homo sapiens
atcctctgtggattacacctag

SEQ ID NO: 9054447 - DNA, 19 bp, Homo sapiens
atcctaaatccagtttcta

SEQ ID NO: 9054448 - DNA, 22 bp, Homo sapiens
atcctaaagcagacagcaggtt

SEQ ID NO: 9054449 - DNA, 21 bp, Homo sapiens
atcctatttctgaaaacctgc

SEQ ID NO: 9054450 - DNA, 22 bp, Homo sapiens
ctgtcttttcttctcattgatg

SEQ ID NO: 9054451 - DNA, 22 bp, Homo sapiens
ctgtctttttagagagtaggat

SEQ ID NO: 9054452 - DNA, 22 bp, Homo sapiens
ctgtcttctaccttcaacctcc

SEQ ID NO: 9054453 - DNA, 22 bp, Homo sapiens
ctgtcttctcctttgtttcagg

SEQ ID NO: 9054454 - DNA, 19 bp, Homo sapiens
atcacatgtcaagagcagg

SEQ ID NO: 9054455 - DNA, 22 bp, Homo sapiens
atcatgttaaatatttcaatct

SEQ ID NO: 9054456 - DNA, 22 bp, Homo sapiens
ctgtcctccagacgacagtccc

SEQ ID NO: 9054457 - DNA, 22 bp, Homo sapiens
ctgtcctccagacgacagtccc

SEQ ID NO: 9054458 - DNA, 22 bp, Homo sapiens
atcacatcgaggagcaatcaga

SEQ ID NO: 9054459 - DNA, 22 bp, Homo sapiens
atcacatatttaagaaacatgt

SEQ ID NO: 9054460 - DNA, 22 bp, Homo sapiens
atcacatggaatgattttagac

SEQ ID NO: 9054461 - DNA, 22 bp, Homo sapiens
atcacatggaatgattttagac

SEQ ID NO: 9054462 - DNA, 17 bp, Homo sapiens
ataaaggcaagtattat

SEQ ID NO: 9054463 - DNA, 22 bp, Homo sapiens
ataaaggccaaaatttgcattt

SEQ ID NO: 9054464 - DNA, 22 bp, Homo sapiens
ataaaagtaggaccaacttaca

SEQ ID NO: 9054465 - DNA, 22 bp, Homo sapiens
ataaaagtctgcttatttgggc

SEQ ID NO: 9054466 - DNA, 22 bp, Homo sapiens
ctgcagctggagcatcttctca

SEQ ID NO: 9054467 - DNA, 22 bp, Homo sapiens
ctgcagctgccagtgatttcag

SEQ ID NO: 9054468 - DNA, 22 bp, Homo sapiens
ctgcagctggagcatcttctca

SEQ ID NO: 9054469 - DNA, 22 bp, Homo sapiens
ctgcagctgctcatgttacttg

SEQ ID NO: 9054470 - DNA, 22 bp, Homo sapiens
ctgcagctgcagttctgagaga

SEQ ID NO: 9054471 - DNA, 22 bp, Homo sapiens
agtttaaatcatgttttgtaac

SEQ ID NO: 9054472 - DNA, 22 bp, Homo sapiens
agttgtcccggtctagccactt

SEQ ID NO: 9054473 - DNA, 22 bp, Homo sapiens
ctgcagagcaagttctctgttg

SEQ ID NO: 9054474 - DNA, 22 bp, Homo sapiens
ctgcagctcctctctgtgcccc

SEQ ID NO: 9054475 - DNA, 22 bp, Homo sapiens
ctgagggtcaacttgattgtat

SEQ ID NO: 9054476 - DNA, 22 bp, Homo sapiens
ctgaggctttgtgtgcatgcct

SEQ ID NO: 9054477 - DNA, 22 bp, Homo sapiens
ctgaggcttggaggggtctggt

SEQ ID NO: 9054478 - DNA, 22 bp, Homo sapiens
ctgaggcttggaggggtctggt

SEQ ID NO: 9054479 - DNA, 22 bp, Homo sapiens
agttggagaagaggtcgggaat

SEQ ID NO: 9054480 - DNA, 22 bp, Homo sapiens
agttggagtgaacatgagattg

SEQ ID NO: 9054481 - DNA, 22 bp, Homo sapiens
agttgggtttgtgtcagttgca

SEQ ID NO: 9054482 - DNA, 22 bp, Homo sapiens
agttctttaacgagtaagattt

SEQ ID NO: 9054483 - DNA, 22 bp, Homo sapiens
agttcttcataaccttactgtg

SEQ ID NO: 9054484 - DNA, 22 bp, Homo sapiens
ctctttggtcgcatcatccatt

SEQ ID NO: 9054485 - DNA, 22 bp, Homo sapiens
ctggagggagattcaaaggagg

SEQ ID NO: 9054486 - DNA, 22 bp, Homo sapiens
ctggagggagattcaaaggagg

SEQ ID NO: 9054487 - DNA, 22 bp, Homo sapiens
atacagaattcactacagtttc

SEQ ID NO: 9054488 - DNA, 18 bp, Homo sapiens
atacagagacctcaagga

SEQ ID NO: 9054489 - DNA, 22 bp, Homo sapiens
atacagaattcactacagtttc

SEQ ID NO: 9054490 - DNA, 22 bp, Homo sapiens
atacagaagttttccacttatt

SEQ ID NO: 9054491 - DNA, 22 bp, Homo sapiens
atacttctggtgacaaagtctt

SEQ ID NO: 9054492 - DNA, 22 bp, Homo sapiens
atacttgaggtagcaacttaag

SEQ ID NO: 9054493 - DNA, 22 bp, Homo sapiens
atactgaaaaagaagtgttgaa

SEQ ID NO: 9054494 - DNA, 22 bp, Homo sapiens
ctggagggatgtagggtgtatt

SEQ ID NO: 9054495 - DNA, 22 bp, Homo sapiens
ctggagggctgcagcgaggctg

SEQ ID NO: 9054496 - DNA, 22 bp, Homo sapiens
ctgcccactatgttgtcatggg

SEQ ID NO: 9054497 - DNA, 22 bp, Homo sapiens
ctgctctggctgtgtacttcag

SEQ ID NO: 9054498 - DNA, 22 bp, Homo sapiens
ctgctctggcgtactcggcatc

SEQ ID NO: 9054499 - DNA, 21 bp, Homo sapiens
ctgctctggggaccggctgtg

SEQ ID NO: 9054500 - DNA, 22 bp, Homo sapiens
ataatacatggttgatcttttc

SEQ ID NO: 9054501 - DNA, 22 bp, Homo sapiens
ctgctctgcagcttggactccc

SEQ ID NO: 9054502 - DNA, 20 bp, Homo sapiens
ctgctctgctttgcaggtgg

SEQ ID NO: 9054503 - DNA, 19 bp, Homo sapiens
atacaagactagcatttac

SEQ ID NO: 9054504 - DNA, 22 bp, Homo sapiens
atacaagactcagcacagacgg

SEQ ID NO: 9054505 - DNA, 22 bp, Homo sapiens
atacaagatcactccagaaaat

SEQ ID NO: 9054506 - DNA, 18 bp, Homo sapiens
atacaagatcaagtgttc

SEQ ID NO: 9054507 - DNA, 18 bp, Homo sapiens
atacaagatcaagtgttc

SEQ ID NO: 9054508 - DNA, 22 bp, Homo sapiens
atacaagtgatataattgtttc

SEQ ID NO: 9054509 - DNA, 22 bp, Homo sapiens
atacaagatcactccagaaaat

SEQ ID NO: 9054510 - DNA, 22 bp, Homo sapiens
ctgctttaagtattcaacaaag

SEQ ID NO: 9054511 - DNA, 19 bp, Homo sapiens
atacaagactagcatttac

SEQ ID NO: 9054512 - DNA, 22 bp, Homo sapiens
atacaagacagtaggaaactga

SEQ ID NO: 9054513 - DNA, 22 bp, Homo sapiens
ataatatttgcattactgtgat

SEQ ID NO: 9054514 - DNA, 22 bp, Homo sapiens
ataatattgagtcaggacctga

SEQ ID NO: 9054515 - DNA, 22 bp, Homo sapiens
ctgcttctaagaacctgcagct

SEQ ID NO: 9054516 - DNA, 18 bp, Homo sapiens
ctgcttctgtctgccagt

SEQ ID NO: 9054517 - DNA, 22 bp, Homo sapiens
ctcagctgcagcctggctggca

SEQ ID NO: 9054518 - DNA, 22 bp, Homo sapiens
agtctcagcaagcatggctagt

SEQ ID NO: 9054519 - DNA, 22 bp, Homo sapiens
agtctcagctacttgggaggct

SEQ ID NO: 9054520 - DNA, 22 bp, Homo sapiens
ctcagctctgacaggaggcatc

SEQ ID NO: 9054521 - DNA, 20 bp, Homo sapiens
ctcagctcttcagggcaagt

SEQ ID NO: 9054522 - DNA, 22 bp, Homo sapiens
ctcagggacggaggcttgcgga

SEQ ID NO: 9054523 - DNA, 22 bp, Homo sapiens
ctcagggacaaggggagacccc

SEQ ID NO: 9054524 - DNA, 22 bp, Homo sapiens
ctcagggacgttagaggacagg

SEQ ID NO: 9054525 - DNA, 22 bp, Homo sapiens
agtctccttaaatatttcccag

SEQ ID NO: 9054526 - DNA, 23 bp, Homo sapiens
agtctcagctggaaacatgtgtc

SEQ ID NO: 9054527 - DNA, 22 bp, Homo sapiens
ctcagtgctttggatcctggat

SEQ ID NO: 9054528 - DNA, 20 bp, Homo sapiens
ctcagtgtattctgggtgct

SEQ ID NO: 9054529 - DNA, 22 bp, Homo sapiens
ctcagacccccagagctgctaa

SEQ ID NO: 9054530 - DNA, 22 bp, Homo sapiens
ctcagaaattacaaaagggaca

SEQ ID NO: 9054531 - DNA, 22 bp, Homo sapiens
ctcagaaagtgacaggggggtg

SEQ ID NO: 9054532 - DNA, 22 bp, Homo sapiens
ctcagaaatcccactctgtgta

SEQ ID NO: 9054533 - DNA, 22 bp, Homo sapiens
cggggttcatccatgctgtggc

SEQ ID NO: 9054534 - DNA, 22 bp, Homo sapiens
agtatcttcaagtttcttctag

SEQ ID NO: 9054535 - DNA, 22 bp, Homo sapiens
cggggtccgggcagtaggctgc

SEQ ID NO: 9054536 - DNA, 21 bp, Homo sapiens
ctcaaatgccagttttattta

SEQ ID NO: 9054537 - DNA, 22 bp, Homo sapiens
ctcaaaatggttaattttaata

SEQ ID NO: 9054538 - DNA, 22 bp, Homo sapiens
ctatttatgtccaagtgtttta

SEQ ID NO: 9054539 - DNA, 22 bp, Homo sapiens
ctatttatctatttctgaatga

SEQ ID NO: 9054540 - DNA, 22 bp, Homo sapiens
ctctccccacaccctctgcatg

SEQ ID NO: 9054541 - DNA, 22 bp, Homo sapiens
ctctcccagtcaggctcaggat

SEQ ID NO: 9054542 - DNA, 22 bp, Homo sapiens
agtgctggaaagggacggagga

SEQ ID NO: 9054543 - DNA, 22 bp, Homo sapiens
agtgctggattacaggcgtgag

SEQ ID NO: 9054544 - DNA, 22 bp, Homo sapiens
agtgctggagggaggcaggttc

SEQ ID NO: 9054545 - DNA, 22 bp, Homo sapiens
ctcctgcaagcctccccaagca

SEQ ID NO: 9054546 - DNA, 22 bp, Homo sapiens
ctccttctgggcctggcagtgg

SEQ ID NO: 9054547 - DNA, 22 bp, Homo sapiens
ctcgcaggacagtgctaggact

SEQ ID NO: 9054548 - DNA, 22 bp, Homo sapiens
ctctgtcacttctccagctgag

SEQ ID NO: 9054549 - DNA, 22 bp, Homo sapiens
ctctgtcaggctgcagatgctc

SEQ ID NO: 9054550 - DNA, 22 bp, Homo sapiens
ctctgtcagagtgttgtcccca

SEQ ID NO: 9054551 - DNA, 22 bp, Homo sapiens
ctctggggttagatctgatgct

SEQ ID NO: 9054552 - DNA, 22 bp, Homo sapiens
agtgggagaatgaataagggcc

SEQ ID NO: 9054553 - DNA, 22 bp, Homo sapiens
agtgggagagaagcaagtagta

SEQ ID NO: 9054554 - DNA, 22 bp, Homo sapiens
ctctggggttaagcttccatgg

SEQ ID NO: 9054555 - DNA, 22 bp, Homo sapiens
ctctggagaggttcccatggga

SEQ ID NO: 9054556 - DNA, 22 bp, Homo sapiens
ctctggagatggttctcaattg

SEQ ID NO: 9054557 - DNA, 22 bp, Homo sapiens
ctcttagtaatgccatgaagca

SEQ ID NO: 9054558 - DNA, 22 bp, Homo sapiens
ctcttcttgtctctggttagaa

SEQ ID NO: 9054559 - DNA, 22 bp, Homo sapiens
cctggctgcttcctctgccatg

SEQ ID NO: 9054560 - DNA, 22 bp, Homo sapiens
cctggctgctttcactatggag

SEQ ID NO: 9054561 - DNA, 23 bp, Homo sapiens
cctggctggattctctgcattca

SEQ ID NO: 9054562 - DNA, 20 bp, Homo sapiens
cctggctggtggaggaaagg

SEQ ID NO: 9054563 - DNA, 22 bp, Homo sapiens
cctggctggtggcagcgacaag

SEQ ID NO: 9054564 - DNA, 22 bp, Homo sapiens
cctggccacagggctctgcatt

SEQ ID NO: 9054565 - DNA, 22 bp, Homo sapiens
cctggccacccagccttggcca

SEQ ID NO: 9054566 - DNA, 22 bp, Homo sapiens
cctgcccccgtcagaggtgatg

SEQ ID NO: 9054567 - DNA, 22 bp, Homo sapiens
cctctgcacttcaccttagctc

SEQ ID NO: 9054568 - DNA, 22 bp, Homo sapiens
ccttgccttggtccttcgcagg

SEQ ID NO: 9054569 - DNA, 22 bp, Homo sapiens
ccttgctcaagctagtgacggg

SEQ ID NO: 9054570 - DNA, 22 bp, Homo sapiens
aggtggggctgggaaagattcc

SEQ ID NO: 9054571 - DNA, 22 bp, Homo sapiens
aggtggggctgggaaagattcc

SEQ ID NO: 9054572 - DNA, 22 bp, Homo sapiens
ccttggctaggcagcggctgtc

SEQ ID NO: 9054573 - DNA, 17 bp, Homo sapiens
aggtgctggagcatcag

SEQ ID NO: 9054574 - DNA, 22 bp, Homo sapiens
aggtgctggagtagaagaaaaa

SEQ ID NO: 9054575 - DNA, 22 bp, Homo sapiens
ccttttcaactaagattctgca

SEQ ID NO: 9054576 - DNA, 22 bp, Homo sapiens
cgagcatgatgacggctgtggc

SEQ ID NO: 9054577 - DNA, 22 bp, Homo sapiens
aggtggggtgttggatgtttat

SEQ ID NO: 9054578 - DNA, 22 bp, Homo sapiens
aggtggggtgagctgcagacta

SEQ ID NO: 9054579 - DNA, 22 bp, Homo sapiens
aggtgggggctgtgtccttgac

SEQ ID NO: 9054580 - DNA, 22 bp, Homo sapiens
aggtgggggctgtgtccttgac

SEQ ID NO: 9054581 - DNA, 22 bp, Homo sapiens
cctttattcaattagtcctaat

SEQ ID NO: 9054582 - DNA, 22 bp, Homo sapiens
cctttattcaattagtcctaat

SEQ ID NO: 9054583 - DNA, 22 bp, Homo sapiens
cgctccaagcttgatgggacca

SEQ ID NO: 9054584 - DNA, 22 bp, Homo sapiens
cggaggggtttgaacagaggag

SEQ ID NO: 9054585 - DNA, 22 bp, Homo sapiens
cggaggggatacattttctgaa

SEQ ID NO: 9054586 - DNA, 22 bp, Homo sapiens
agtatatgccagagagatagct

SEQ ID NO: 9054587 - DNA, 22 bp, Homo sapiens
cattcccacgtgttctttgctt

SEQ ID NO: 9054588 - DNA, 21 bp, Homo sapiens
cattcctcggctcatagagga

SEQ ID NO: 9054589 - DNA, 19 bp, Homo sapiens
aggcagcacccagtccttg

SEQ ID NO: 9054590 - DNA, 22 bp, Homo sapiens
cattaacactttggatttagac

SEQ ID NO: 9054591 - DNA, 22 bp, Homo sapiens
cattattaattcagcacatgct

SEQ ID NO: 9054592 - DNA, 19 bp, Homo sapiens
aggcagcattctggggctt

SEQ ID NO: 9054593 - DNA, 22 bp, Homo sapiens
aggcagcatttgaatccaggtc

SEQ ID NO: 9054594 - DNA, 20 bp, Homo sapiens
catgccatgtctactgaggc

SEQ ID NO: 9054595 - DNA, 22 bp, Homo sapiens
catgccatgtgtgaggagagga

SEQ ID NO: 9054596 - DNA, 20 bp, Homo sapiens
catgcctgctggtatctggc

SEQ ID NO: 9054597 - DNA, 22 bp, Homo sapiens
catgccatttggtggattgaga

SEQ ID NO: 9054598 - DNA, 22 bp, Homo sapiens
catgcaggaggaaaaagcagct

SEQ ID NO: 9054599 - DNA, 22 bp, Homo sapiens
catggccaggcccagggcccag

SEQ ID NO: 9054600 - DNA, 22 bp, Homo sapiens
catgcacagagcttggtcattg

SEQ ID NO: 9054601 - DNA, 22 bp, Homo sapiens
catgcacatgtggctatgtaat

SEQ ID NO: 9054602 - DNA, 22 bp, Homo sapiens
catgcacttacctgaaattcaa

SEQ ID NO: 9054603 - DNA, 22 bp, Homo sapiens
catgaaagcaggaatggtttta

SEQ ID NO: 9054604 - DNA, 22 bp, Homo sapiens
aggaggcactcactctcagggt

SEQ ID NO: 9054605 - DNA, 20 bp, Homo sapiens
cagtcctgcaggcgggagaa

SEQ ID NO: 9054606 - DNA, 20 bp, Homo sapiens
cagtcctgcaggcgggagaa

SEQ ID NO: 9054607 - DNA, 22 bp, Homo sapiens
cagtcctgaggaagagctgctg

SEQ ID NO: 9054608 - DNA, 22 bp, Homo sapiens
cagtcctgagctcctgggctga

SEQ ID NO: 9054609 - DNA, 22 bp, Homo sapiens
cagtcctgagctcctgggctga

SEQ ID NO: 9054610 - DNA, 22 bp, Homo sapiens
cagtcctgaatactggacggtg

SEQ ID NO: 9054611 - DNA, 22 bp, Homo sapiens
cagtcctgagccaatcatgatg

SEQ ID NO: 9054612 - DNA, 22 bp, Homo sapiens
cagtcctgctggccttccctgg

SEQ ID NO: 9054613 - DNA, 22 bp, Homo sapiens
cagtcctggagcccttcttggc

SEQ ID NO: 9054614 - DNA, 22 bp, Homo sapiens
cagtcctgctggccttccctgg

SEQ ID NO: 9054615 - DNA, 20 bp, Homo sapiens
cagtcctgccccttggggac

SEQ ID NO: 9054616 - DNA, 22 bp, Homo sapiens
cagtcctgctagtgtgaaaagc

SEQ ID NO: 9054617 - DNA, 22 bp, Homo sapiens
cagtcctgcccaggctgacaga

SEQ ID NO: 9054618 - DNA, 20 bp, Homo sapiens
cagtcctgccccttggggac

SEQ ID NO: 9054619 - DNA, 22 bp, Homo sapiens
aggacagcaaccgttattcaca

SEQ ID NO: 9054620 - DNA, 22 bp, Homo sapiens
aggaagctggggtgttcttcat

SEQ ID NO: 9054621 - DNA, 22 bp, Homo sapiens
aggagaaaacagtgttttgcct

SEQ ID NO: 9054622 - DNA, 22 bp, Homo sapiens
aggacaggattccttgccttgc

SEQ ID NO: 9054623 - DNA, 22 bp, Homo sapiens
aggactttagagccagaaagac

SEQ ID NO: 9054624 - DNA, 21 bp, Homo sapiens
aggacaggaactggctgaata

SEQ ID NO: 9054625 - DNA, 22 bp, Homo sapiens
aggacagcccccaacagcaaca

SEQ ID NO: 9054626 - DNA, 22 bp, Homo sapiens
aggagacagaatttaaatttgg

SEQ ID NO: 9054627 - DNA, 22 bp, Homo sapiens
cagtctcttttcagctccatcc

SEQ ID NO: 9054628 - DNA, 22 bp, Homo sapiens
cagtctctctccttgcaggcgt

SEQ ID NO: 9054629 - DNA, 22 bp, Homo sapiens
cagtctctcttgtagtgcagct

SEQ ID NO: 9054630 - DNA, 23 bp, Homo sapiens
aggagaagagatttccacatgca

SEQ ID NO: 9054631 - DNA, 22 bp, Homo sapiens
aggagctgataaaagggggtca

SEQ ID NO: 9054632 - DNA, 22 bp, Homo sapiens
aggagctgataaaagggggtca

SEQ ID NO: 9054633 - DNA, 22 bp, Homo sapiens
aggagctgagtcagcccgacag

SEQ ID NO: 9054634 - DNA, 22 bp, Homo sapiens
aggagctgagggagcgcccttg

SEQ ID NO: 9054635 - DNA, 22 bp, Homo sapiens
aggagctgaagtctctgcactc

SEQ ID NO: 9054636 - DNA, 20 bp, Homo sapiens
aggagctgaattagagggtt

SEQ ID NO: 9054637 - DNA, 20 bp, Homo sapiens
aggagctgaattagagggtt

SEQ ID NO: 9054638 - DNA, 22 bp, Homo sapiens
aggagctgacttgtaaagcatt

SEQ ID NO: 9054639 - DNA, 22 bp, Homo sapiens
aggagctgaaacttctcatatg

SEQ ID NO: 9054640 - DNA, 20 bp, Homo sapiens
aggagctctgtgctgggaag

SEQ ID NO: 9054641 - DNA, 22 bp, Homo sapiens
aggagctctcccatgctgcaga

SEQ ID NO: 9054642 - DNA, 20 bp, Homo sapiens
aggaggcaatgtagataagc

SEQ ID NO: 9054643 - DNA, 22 bp, Homo sapiens
aggagaggggtaggattaattt

SEQ ID NO: 9054644 - DNA, 22 bp, Homo sapiens
aggagaggggtaggattaattt

SEQ ID NO: 9054645 - DNA, 22 bp, Homo sapiens
aggagaggcatcaagaaaatcg

SEQ ID NO: 9054646 - DNA, 22 bp, Homo sapiens
aggagctcaaagatgccaggag

SEQ ID NO: 9054647 - DNA, 22 bp, Homo sapiens
aggagctagacttagatcttcc

SEQ ID NO: 9054648 - DNA, 22 bp, Homo sapiens
aggagctccagcccagggaagt

SEQ ID NO: 9054649 - DNA, 22 bp, Homo sapiens
aggagctcccgtgaggagacca

SEQ ID NO: 9054650 - DNA, 22 bp, Homo sapiens
aggagctcatgtggctgcctgt

SEQ ID NO: 9054651 - DNA, 22 bp, Homo sapiens
aggagctcagcctgcagggagc

SEQ ID NO: 9054652 - DNA, 22 bp, Homo sapiens
agctgctccaatttttaccatt

SEQ ID NO: 9054653 - DNA, 22 bp, Homo sapiens
agctgctcgaagccggtggccc

SEQ ID NO: 9054654 - DNA, 22 bp, Homo sapiens
agctgctcttgggtgacttcaa

SEQ ID NO: 9054655 - DNA, 22 bp, Homo sapiens
agctgctcttcatttcccccca

SEQ ID NO: 9054656 - DNA, 22 bp, Homo sapiens
agctggcagtatgactggtgac

SEQ ID NO: 9054657 - DNA, 23 bp, Homo sapiens
agctgaggctgtgggtgtcagag

SEQ ID NO: 9054658 - DNA, 22 bp, Homo sapiens
agctgaggctctgagagggaag

SEQ ID NO: 9054659 - DNA, 23 bp, Homo sapiens
agctgaggcagaggggcattctc

SEQ ID NO: 9054660 - DNA, 22 bp, Homo sapiens
agctgaggcatgatgctatcag

SEQ ID NO: 9054661 - DNA, 22 bp, Homo sapiens
agctgaggcatggacaggctgc

SEQ ID NO: 9054662 - DNA, 22 bp, Homo sapiens
agctgaggccacgagtgaaggg

SEQ ID NO: 9054663 - DNA, 22 bp, Homo sapiens
agctgaggcctgatttcgccgt

SEQ ID NO: 9054664 - DNA, 22 bp, Homo sapiens
agctgcagtatgaggctggtgg

SEQ ID NO: 9054665 - DNA, 22 bp, Homo sapiens
agctgcaggcgccggggccgat

SEQ ID NO: 9054666 - DNA, 22 bp, Homo sapiens
cagctcctgcctgggcagctgt

SEQ ID NO: 9054667 - DNA, 22 bp, Homo sapiens
agctcctgtgtgaagcctccct

SEQ ID NO: 9054668 - DNA, 22 bp, Homo sapiens
agctctctgataaattgataaa

SEQ ID NO: 9054669 - DNA, 22 bp, Homo sapiens
cagctctgaagaaaggtgtcta

SEQ ID NO: 9054670 - DNA, 22 bp, Homo sapiens
cagctctgaagaaaggtgtcta

SEQ ID NO: 9054671 - DNA, 22 bp, Homo sapiens
aggaacaactgattcagtcaac

SEQ ID NO: 9054672 - DNA, 22 bp, Homo sapiens
aggaaccagacagaactgaatg

SEQ ID NO: 9054673 - DNA, 22 bp, Homo sapiens
agctttatatgttgtttctcca

SEQ ID NO: 9054674 - DNA, 17 bp, Homo sapiens
aggaaacattttctttc

SEQ ID NO: 9054675 - DNA, 22 bp, Homo sapiens
agctttatataaaagagtacat

SEQ ID NO: 9054676 - DNA, 22 bp, Homo sapiens
agctttatagaaaggatcagtg

SEQ ID NO: 9054677 - DNA, 22 bp, Homo sapiens
agcttgttagaaatgtagactc

SEQ ID NO: 9054678 - DNA, 22 bp, Homo sapiens
agctttaaaaatccaatatcca

SEQ ID NO: 9054679 - DNA, 22 bp, Homo sapiens
caggcctggagtgcaatggcac

SEQ ID NO: 9054680 - DNA, 22 bp, Homo sapiens
caggcctggctgcagctcgcct

SEQ ID NO: 9054681 - DNA, 22 bp, Homo sapiens
agctgtttaaatgacttacttt

SEQ ID NO: 9054682 - DNA, 22 bp, Homo sapiens
agctgttccaggcctcattgct

SEQ ID NO: 9054683 - DNA, 23 bp, Homo sapiens
agcttgcttttcccagtactgca

SEQ ID NO: 9054684 - DNA, 22 bp, Homo sapiens
agcttcttaagttcctgcagca

SEQ ID NO: 9054685 - DNA, 22 bp, Homo sapiens
agcttcttttacagctcatgct

SEQ ID NO: 9054686 - DNA, 22 bp, Homo sapiens
aggctccattccaggagctaga

SEQ ID NO: 9054687 - DNA, 22 bp, Homo sapiens
ccaggctctgccaggcccttga

SEQ ID NO: 9054688 - DNA, 22 bp, Homo sapiens
ccaggcctagcccctgagggta

SEQ ID NO: 9054689 - DNA, 22 bp, Homo sapiens
aggctccacggcaggatgctgt

SEQ ID NO: 9054690 - DNA, 22 bp, Homo sapiens
ccaggcagggctcaaggaacct

SEQ ID NO: 9054691 - DNA, 22 bp, Homo sapiens
aggcctcagcctgccaggcctg

SEQ ID NO: 9054692 - DNA, 22 bp, Homo sapiens
ccagtgcacagccaggcaggtg

SEQ ID NO: 9054693 - DNA, 22 bp, Homo sapiens
ccagtctgctgtggtaggaaga

SEQ ID NO: 9054694 - DNA, 22 bp, Homo sapiens
aggctgagccacggggctggct

SEQ ID NO: 9054695 - DNA, 22 bp, Homo sapiens
aggctgagcctgggcgtggtgg

SEQ ID NO: 9054696 - DNA, 22 bp, Homo sapiens
aggctgagcaaagggccttacc

SEQ ID NO: 9054697 - DNA, 22 bp, Homo sapiens
aggcagtggctgagaccagggg

SEQ ID NO: 9054698 - DNA, 22 bp, Homo sapiens
aggcatttgagtccatgggtga

SEQ ID NO: 9054699 - DNA, 22 bp, Homo sapiens
aggcagtgatgagtcatgaata

SEQ ID NO: 9054700 - DNA, 22 bp, Homo sapiens
aggcagtgagaaatagcaagat

SEQ ID NO: 9054701 - DNA, 22 bp, Homo sapiens
aggcagtggaaggagaaagcaa

SEQ ID NO: 9054702 - DNA, 22 bp, Homo sapiens
aggcagtcagccctgctagggt

SEQ ID NO: 9054703 - DNA, 22 bp, Homo sapiens
aggcaggttggtgagaagactg

SEQ ID NO: 9054704 - DNA, 22 bp, Homo sapiens
aggccagcttccagaggggcag

SEQ ID NO: 9054705 - DNA, 22 bp, Homo sapiens
aggcccagtagtcgacggcgct

SEQ ID NO: 9054706 - DNA, 22 bp, Homo sapiens
aggcccagtagtgctgccttta

SEQ ID NO: 9054707 - DNA, 22 bp, Homo sapiens
aggcccagtagtgctgccttta

SEQ ID NO: 9054708 - DNA, 22 bp, Homo sapiens
aggcccagtcctctgccgtctg

SEQ ID NO: 9054709 - DNA, 22 bp, Homo sapiens
aggcccagtgtggcttcctgga

SEQ ID NO: 9054710 - DNA, 22 bp, Homo sapiens
aggcattttctgtatggacaga

SEQ ID NO: 9054711 - DNA, 22 bp, Homo sapiens
aggcatttttattgtccttaaa

SEQ ID NO: 9054712 - DNA, 22 bp, Homo sapiens
aggcatttttgttaatctttgg

SEQ ID NO: 9054713 - DNA, 22 bp, Homo sapiens
aggccagcctcaggcagggacc

SEQ ID NO: 9054714 - DNA, 22 bp, Homo sapiens
aggccacaaccaccctgtgccc

SEQ ID NO: 9054715 - DNA, 22 bp, Homo sapiens
aggccacaagaaaatgcttcat

SEQ ID NO: 9054716 - DNA, 22 bp, Homo sapiens
cctcagtgagatgctcagcgaa

SEQ ID NO: 9054717 - DNA, 22 bp, Homo sapiens
cctcagtgacctattgcattca

SEQ ID NO: 9054718 - DNA, 22 bp, Homo sapiens
cctcgcggcactcgggccggat

SEQ ID NO: 9054719 - DNA, 22 bp, Homo sapiens
cctagacacttatggaagtgag

SEQ ID NO: 9054720 - DNA, 22 bp, Homo sapiens
cctagacattaagcttgggttt

SEQ ID NO: 9054721 - DNA, 22 bp, Homo sapiens
ccctgtgtcttcttgcctttgt

SEQ ID NO: 9054722 - DNA, 22 bp, Homo sapiens
ccctgtgtagttaactttccac

SEQ ID NO: 9054723 - DNA, 22 bp, Homo sapiens
agggccagctagagccctcgcc

SEQ ID NO: 9054724 - DNA, 22 bp, Homo sapiens
agggccagggaaacgatcagca

SEQ ID NO: 9054725 - DNA, 22 bp, Homo sapiens
agggcagctctcacctctggcc

SEQ ID NO: 9054726 - DNA, 22 bp, Homo sapiens
agggcagcccttctgggagggc

SEQ ID NO: 9054727 - DNA, 22 bp, Homo sapiens
agggaggagaatggactccttc

SEQ ID NO: 9054728 - DNA, 22 bp, Homo sapiens
agggaggaccaatgtgtggtta

SEQ ID NO: 9054729 - DNA, 22 bp, Homo sapiens
agggcagcattgcctttctcca

SEQ ID NO: 9054730 - DNA, 22 bp, Homo sapiens
agggcagcagctgtccctgaga

SEQ ID NO: 9054731 - DNA, 22 bp, Homo sapiens
agggcagcagctcctcctagct

SEQ ID NO: 9054732 - DNA, 22 bp, Homo sapiens
cccagcctgatctcggccagct

SEQ ID NO: 9054733 - DNA, 22 bp, Homo sapiens
cccagctccttacagggccgaa

SEQ ID NO: 9054734 - DNA, 22 bp, Homo sapiens
cccagctccttggatgggcagg

SEQ ID NO: 9054735 - DNA, 22 bp, Homo sapiens
cccagctctaggagtggtggca

SEQ ID NO: 9054736 - DNA, 22 bp, Homo sapiens
agggagccagagttgggagctc

SEQ ID NO: 9054737 - DNA, 22 bp, Homo sapiens
agggagctttttcatgtgtcta

SEQ ID NO: 9054738 - DNA, 22 bp, Homo sapiens
agggaaggaaaagctgtcgctt

SEQ ID NO: 9054739 - DNA, 22 bp, Homo sapiens
agggaaggaggccatgtgtccc

SEQ ID NO: 9054740 - DNA, 22 bp, Homo sapiens
agggaagggcagggtctatgca

SEQ ID NO: 9054741 - DNA, 22 bp, Homo sapiens
agggagaggttgaaacctcagt

SEQ ID NO: 9054742 - DNA, 22 bp, Homo sapiens
agggagaggctgaactatccta

SEQ ID NO: 9054743 - DNA, 22 bp, Homo sapiens
gtattttaagtgactactaggt

SEQ ID NO: 9054744 - DNA, 22 bp, Homo sapiens
gtattttactgctcaaagctct

SEQ ID NO: 9054745 - DNA, 22 bp, Homo sapiens
cagccactggtgccaggctgtt

SEQ ID NO: 9054746 - DNA, 21 bp, Homo sapiens
cagcccagagcagtggggcca

SEQ ID NO: 9054747 - DNA, 22 bp, Homo sapiens
cagccaagaaccacagacccag

SEQ ID NO: 9054748 - DNA, 22 bp, Homo sapiens
cagcccagcagggtctggccct

SEQ ID NO: 9054749 - DNA, 22 bp, Homo sapiens
gtaaaattctagcatctgaaag

SEQ ID NO: 9054750 - DNA, 22 bp, Homo sapiens
cagcaatagtgtgtttgtttca

SEQ ID NO: 9054751 - DNA, 22 bp, Homo sapiens
cagcaataatgtctacaaatct

SEQ ID NO: 9054752 - DNA, 22 bp, Homo sapiens
ggttcccggatctccgagtccc

SEQ ID NO: 9054753 - DNA, 22 bp, Homo sapiens
ggtgggggagacttggtcaaga

SEQ ID NO: 9054754 - DNA, 22 bp, Homo sapiens
ggtggggtcacgacagagggaa

SEQ ID NO: 9054755 - DNA, 16 bp, Homo sapiens
ggtggggtagttagaa

SEQ ID NO: 9054756 - DNA, 21 bp, Homo sapiens
ggtggggtacctaaggtagct

SEQ ID NO: 9054757 - DNA, 20 bp, Homo sapiens
gggtgggagagtctgagggt

SEQ ID NO: 9054758 - DNA, 22 bp, Homo sapiens
cagcagcaaatctagaagagga

SEQ ID NO: 9054759 - DNA, 22 bp, Homo sapiens
cagcaggattggatacatctca

SEQ ID NO: 9054760 - DNA, 22 bp, Homo sapiens
cagcaggcccagagtttcatgg

SEQ ID NO: 9054761 - DNA, 22 bp, Homo sapiens
gtatttctagaaaatgcagatt

SEQ ID NO: 9054762 - DNA, 22 bp, Homo sapiens
gtatttctagaaccaaaagcca

SEQ ID NO: 9054763 - DNA, 22 bp, Homo sapiens
gtatttctttatctggtcagaa

SEQ ID NO: 9054764 - DNA, 22 bp, Homo sapiens
gtatttctttccattatagtca

SEQ ID NO: 9054765 - DNA, 15 bp, Homo sapiens
gtatttcttttatat

SEQ ID NO: 9054766 - DNA, 22 bp, Homo sapiens
gtatttctttacatatgctcat

SEQ ID NO: 9054767 - DNA, 22 bp, Homo sapiens
gtatttcttgtacttccttgtc

SEQ ID NO: 9054768 - DNA, 22 bp, Homo sapiens
gtatttcttccacggtggattt

SEQ ID NO: 9054769 - DNA, 22 bp, Homo sapiens
gtatttcttggaaatcctttta

SEQ ID NO: 9054770 - DNA, 22 bp, Homo sapiens
gtatttctgcaaagtgtgtgac

SEQ ID NO: 9054771 - DNA, 22 bp, Homo sapiens
gtatttctagtttcttccacag

SEQ ID NO: 9054772 - DNA, 22 bp, Homo sapiens
gtatttctagaatggtagcact

SEQ ID NO: 9054773 - DNA, 22 bp, Homo sapiens
gtatttctggtaactgctgcta

SEQ ID NO: 9054774 - DNA, 22 bp, Homo sapiens
gtatttctggttaaatgtgcta

SEQ ID NO: 9054775 - DNA, 16 bp, Homo sapiens
gtatttcttagacttt

SEQ ID NO: 9054776 - DNA, 22 bp, Homo sapiens
gtatcttttggtggaaaaataa

SEQ ID NO: 9054777 - DNA, 22 bp, Homo sapiens
gtatctttccacatcttcagta

SEQ ID NO: 9054778 - DNA, 21 bp, Homo sapiens
cagagctgaagggtgtagtgt

SEQ ID NO: 9054779 - DNA, 22 bp, Homo sapiens
cagagctgacccaaggattgaa

SEQ ID NO: 9054780 - DNA, 23 bp, Homo sapiens
cagagctgattaaacttaatctc

SEQ ID NO: 9054781 - DNA, 22 bp, Homo sapiens
cagagctgagtcttcaaggttg

SEQ ID NO: 9054782 - DNA, 22 bp, Homo sapiens
cagagctgagaatgttgatgct

SEQ ID NO: 9054783 - DNA, 22 bp, Homo sapiens
cagagctgcaaatgcccctccg

SEQ ID NO: 9054784 - DNA, 22 bp, Homo sapiens
cagagctgattggatccagaga

SEQ ID NO: 9054785 - DNA, 22 bp, Homo sapiens
cagagctgcacattctatgatg

SEQ ID NO: 9054786 - DNA, 22 bp, Homo sapiens
cagagctgcacattctatgatg

SEQ ID NO: 9054787 - DNA, 22 bp, Homo sapiens
ggggaaactgaggcacagacag

SEQ ID NO: 9054788 - DNA, 22 bp, Homo sapiens
ggggaaacatgttgttcagacc

SEQ ID NO: 9054789 - DNA, 22 bp, Homo sapiens
gggctgtgtactatgaggaggg

SEQ ID NO: 9054790 - DNA, 22 bp, Homo sapiens
ggggaaaggccatggcaagaac

SEQ ID NO: 9054791 - DNA, 22 bp, Homo sapiens
cagagctgcgctttttcctggt

SEQ ID NO: 9054792 - DNA, 22 bp, Homo sapiens
cagagctgcagattgaaggcat

SEQ ID NO: 9054793 - DNA, 22 bp, Homo sapiens
cagagctgctcatggtggccag

SEQ ID NO: 9054794 - DNA, 19 bp, Homo sapiens
cagagctgctggcctcgtc

SEQ ID NO: 9054795 - DNA, 22 bp, Homo sapiens
cagagccctagtcctgatggcc

SEQ ID NO: 9054796 - DNA, 21 bp, Homo sapiens
gggcgaggcctgatgtggctc

SEQ ID NO: 9054797 - DNA, 22 bp, Homo sapiens
gggcgagggcgaaagcgagagc

SEQ ID NO: 9054798 - DNA, 22 bp, Homo sapiens
cagaggctgggacctcaggcat

SEQ ID NO: 9054799 - DNA, 22 bp, Homo sapiens
cagaggtgtacagagggaggcc

SEQ ID NO: 9054800 - DNA, 22 bp, Homo sapiens
gggtcgagggtctcgcccttcc

SEQ ID NO: 9054801 - DNA, 22 bp, Homo sapiens
gggtgcaggggaccctagggac

SEQ ID NO: 9054802 - DNA, 22 bp, Homo sapiens
gggtgcagtggttcacgcctgt

SEQ ID NO: 9054803 - DNA, 22 bp, Homo sapiens
cagagctggtgttacaagtcca

SEQ ID NO: 9054804 - DNA, 22 bp, Homo sapiens
cagagctgtatttatctttcca

SEQ ID NO: 9054805 - DNA, 20 bp, Homo sapiens
ggggaagaaaaggatgtgat

SEQ ID NO: 9054806 - DNA, 22 bp, Homo sapiens
cagagctggtaagtggtagagg

SEQ ID NO: 9054807 - DNA, 22 bp, Homo sapiens
cagagctggtgtgtcctggcat

SEQ ID NO: 9054808 - DNA, 22 bp, Homo sapiens
cagaggccccagaactagctct

SEQ ID NO: 9054809 - DNA, 22 bp, Homo sapiens
cagaggccatatttcttcactc

SEQ ID NO: 9054810 - DNA, 22 bp, Homo sapiens
gggaaaaataatgcacagatat

SEQ ID NO: 9054811 - DNA, 22 bp, Homo sapiens
gggaaaaataatgcacagatat

SEQ ID NO: 9054812 - DNA, 22 bp, Homo sapiens
gggaaacagcccaggctcaggg

SEQ ID NO: 9054813 - DNA, 22 bp, Homo sapiens
gggacaatggaggcctctctcc

SEQ ID NO: 9054814 - DNA, 22 bp, Homo sapiens
gggaaggacattctgggctcag

SEQ ID NO: 9054815 - DNA, 22 bp, Homo sapiens
gggaagctgcgtggtctagggc

SEQ ID NO: 9054816 - DNA, 22 bp, Homo sapiens
gggagcaggacataatagcaat

SEQ ID NO: 9054817 - DNA, 22 bp, Homo sapiens
gggaggtgaaaggtcatgtgtg

SEQ ID NO: 9054818 - DNA, 22 bp, Homo sapiens
cagacaggctagccagactcac

SEQ ID NO: 9054819 - DNA, 22 bp, Homo sapiens
gggaggggttgcatgtttgagt

SEQ ID NO: 9054820 - DNA, 22 bp, Homo sapiens
gggaggggttgcatgtttgagt

SEQ ID NO: 9054821 - DNA, 20 bp, Homo sapiens
gggcaaggaaacagccccca

SEQ ID NO: 9054822 - DNA, 22 bp, Homo sapiens
gggcaagtgttttgtctgcctg

SEQ ID NO: 9054823 - DNA, 22 bp, Homo sapiens
gctgcagagtgatgaagtgggg

SEQ ID NO: 9054824 - DNA, 22 bp, Homo sapiens
gctgcagagtgatgaagtgggg

SEQ ID NO: 9054825 - DNA, 22 bp, Homo sapiens
gctgcagagggtcttagagagg

SEQ ID NO: 9054826 - DNA, 19 bp, Homo sapiens
gctgcagaggtgaagaaga

SEQ ID NO: 9054827 - DNA, 22 bp, Homo sapiens
gctgcagagggaggggctcgca

SEQ ID NO: 9054828 - DNA, 19 bp, Homo sapiens
gctcctggatgacctgtgg

SEQ ID NO: 9054829 - DNA, 19 bp, Homo sapiens
gctcctggatgacctgtgg

SEQ ID NO: 9054830 - DNA, 22 bp, Homo sapiens
caaagtaactgcctttccaatt

SEQ ID NO: 9054831 - DNA, 22 bp, Homo sapiens
caaagtaatttggagatatata

SEQ ID NO: 9054832 - DNA, 22 bp, Homo sapiens
caaagtatatttcatagtctca

SEQ ID NO: 9054833 - DNA, 22 bp, Homo sapiens
gctgcagtgagccaagatcgtg

SEQ ID NO: 9054834 - DNA, 22 bp, Homo sapiens
gctgcagtgagccaagatcgtg

SEQ ID NO: 9054835 - DNA, 22 bp, Homo sapiens
gctgcaggtttgtctagtctgg

SEQ ID NO: 9054836 - DNA, 22 bp, Homo sapiens
caacatatgattttgtatataa

SEQ ID NO: 9054837 - DNA, 22 bp, Homo sapiens
caacatataatatttgagttct

SEQ ID NO: 9054838 - DNA, 22 bp, Homo sapiens
caacatatgattttgtatataa

SEQ ID NO: 9054839 - DNA, 22 bp, Homo sapiens
caacatatttttatgtaggtca

SEQ ID NO: 9054840 - DNA, 22 bp, Homo sapiens
caacatctgtatcattagtaca

SEQ ID NO: 9054841 - DNA, 22 bp, Homo sapiens
caacatctttgtgtatgtgaga

SEQ ID NO: 9054842 - DNA, 20 bp, Homo sapiens
caacatgagcaagtgaactg

SEQ ID NO: 9054843 - DNA, 22 bp, Homo sapiens
caacatttgtgatgagcaaact

SEQ ID NO: 9054844 - DNA, 22 bp, Homo sapiens
caacatttgagtaaagaaatgg

SEQ ID NO: 9054845 - DNA, 22 bp, Homo sapiens
caagagtttaaatcaatggcca

SEQ ID NO: 9054846 - DNA, 22 bp, Homo sapiens
caagagttgagggatgtcagtt

SEQ ID NO: 9054847 - DNA, 22 bp, Homo sapiens
caagatatatgtatgattccat

SEQ ID NO: 9054848 - DNA, 22 bp, Homo sapiens
caagatatgtgttgttagctct

SEQ ID NO: 9054849 - DNA, 22 bp, Homo sapiens
caagatcttcctcaatagacct

SEQ ID NO: 9054850 - DNA, 22 bp, Homo sapiens
caagatgacaaggctggaggct

SEQ ID NO: 9054851 - DNA, 22 bp, Homo sapiens
caaggagaaaacggcttctgaa

SEQ ID NO: 9054852 - DNA, 22 bp, Homo sapiens
caaggagagtaattgaatgaga

SEQ ID NO: 9054853 - DNA, 22 bp, Homo sapiens
caaggagagtaattgaatgaga

SEQ ID NO: 9054854 - DNA, 22 bp, Homo sapiens
caaggagataaaatgttgagct

SEQ ID NO: 9054855 - DNA, 22 bp, Homo sapiens
caactaatcctttgaaaagaag

SEQ ID NO: 9054856 - DNA, 22 bp, Homo sapiens
gctgcctgccttgcctggagga

SEQ ID NO: 9054857 - DNA, 22 bp, Homo sapiens
gctgccttcccaggcctttgct

SEQ ID NO: 9054858 - DNA, 22 bp, Homo sapiens
caacctgatgaattgaatttaa

SEQ ID NO: 9054859 - DNA, 20 bp, Homo sapiens
gctgccttgtcctgcttggt

SEQ ID NO: 9054860 - DNA, 20 bp, Homo sapiens
gctgccttgtcctgcttggt

SEQ ID NO: 9054861 - DNA, 22 bp, Homo sapiens
gctgccttcccggaatgtcatc

SEQ ID NO: 9054862 - DNA, 22 bp, Homo sapiens
caagacaagatctaagcatgct

SEQ ID NO: 9054863 - DNA, 22 bp, Homo sapiens
cacaataaatgtttgctgatga

SEQ ID NO: 9054864 - DNA, 22 bp, Homo sapiens
cacaatactatttttaggtctt

SEQ ID NO: 9054865 - DNA, 22 bp, Homo sapiens
cacaatgcagcatgtaaatgca

SEQ ID NO: 9054866 - DNA, 22 bp, Homo sapiens
cacaatgtatatgtatatcaaa

SEQ ID NO: 9054867 - DNA, 22 bp, Homo sapiens
ggaaaagacagaattctagaat

SEQ ID NO: 9054868 - DNA, 22 bp, Homo sapiens
ggaaaatgggaacctgaagcca

SEQ ID NO: 9054869 - DNA, 21 bp, Homo sapiens
ggaaaattcagagtgcaattt

SEQ ID NO: 9054870 - DNA, 22 bp, Homo sapiens
cacaactttaggaaccacattc

SEQ ID NO: 9054871 - DNA, 22 bp, Homo sapiens
cacaaggttctgtaaaatcaaa

SEQ ID NO: 9054872 - DNA, 22 bp, Homo sapiens
cacaaaggagaatgtcagcata

SEQ ID NO: 9054873 - DNA, 22 bp, Homo sapiens
cacaaacatcaatcctgttttc

SEQ ID NO: 9054874 - DNA, 22 bp, Homo sapiens
cacaaaatatcaagcactttta

SEQ ID NO: 9054875 - DNA, 22 bp, Homo sapiens
cacaaaatctttctcgattatt

SEQ ID NO: 9054876 - DNA, 22 bp, Homo sapiens
cacaaagtgggtggaaaactaa

SEQ ID NO: 9054877 - DNA, 22 bp, Homo sapiens
cacaaagtctgcagctgctgta

SEQ ID NO: 9054878 - DNA, 22 bp, Homo sapiens
cacaaagtgggtggaaaactaa

SEQ ID NO: 9054879 - DNA, 22 bp, Homo sapiens
ggaaaactgtatttgaataact

SEQ ID NO: 9054880 - DNA, 22 bp, Homo sapiens
cacaaagttggacaacgcaccc

SEQ ID NO: 9054881 - DNA, 22 bp, Homo sapiens
ggaaaagaattgcagtgaagta

SEQ ID NO: 9054882 - DNA, 23 bp, Homo sapiens
cacacctgttaagaagagtgcct

SEQ ID NO: 9054883 - DNA, 22 bp, Homo sapiens
cacacatttcagatgctacaat

SEQ ID NO: 9054884 - DNA, 22 bp, Homo sapiens
cacaatttccttgcttcacttt

SEQ ID NO: 9054885 - DNA, 22 bp, Homo sapiens
cacaatttggacttcactggtt

SEQ ID NO: 9054886 - DNA, 22 bp, Homo sapiens
cacaatttggggtgcccactgt

SEQ ID NO: 9054887 - DNA, 22 bp, Homo sapiens
cacaatttggtgctaaagaaag

SEQ ID NO: 9054888 - DNA, 22 bp, Homo sapiens
cacaatttgttttatcagtatt

SEQ ID NO: 9054889 - DNA, 22 bp, Homo sapiens
cacaatttgtattttgcatcca

SEQ ID NO: 9054890 - DNA, 22 bp, Homo sapiens
cacaatttgtttgctcttagtc

SEQ ID NO: 9054891 - DNA, 22 bp, Homo sapiens
cacaatttccaagtcatgttat

SEQ ID NO: 9054892 - DNA, 22 bp, Homo sapiens
cacaatttcagttgcatgcaac

SEQ ID NO: 9054893 - DNA, 22 bp, Homo sapiens
cacaatttccattgagcagcag

SEQ ID NO: 9054894 - DNA, 18 bp, Homo sapiens
cacaatttacagatgaca

SEQ ID NO: 9054895 - DNA, 22 bp, Homo sapiens
gcttctcgggcctgatgtcgtc

SEQ ID NO: 9054896 - DNA, 20 bp, Homo sapiens
gcttctcagggcttctctga

SEQ ID NO: 9054897 - DNA, 18 bp, Homo sapiens
gcttctcatttctaagca

SEQ ID NO: 9054898 - DNA, 22 bp, Homo sapiens
gcttctcatgtttatttttaca

SEQ ID NO: 9054899 - DNA, 22 bp, Homo sapiens
cacaaaatatcaagcactttta

SEQ ID NO: 9054900 - DNA, 22 bp, Homo sapiens
caatttctcgaactctaatcca

SEQ ID NO: 9054901 - DNA, 20 bp, Homo sapiens
caaggcagaccagagtgagt

SEQ ID NO: 9054902 - DNA, 22 bp, Homo sapiens
gctgtctccatagctgtgtgtc

SEQ ID NO: 9054903 - DNA, 21 bp, Homo sapiens
gctgtctcctccttgcaccag

SEQ ID NO: 9054904 - DNA, 22 bp, Homo sapiens
caaggcagcgttcctttctgga

SEQ ID NO: 9054905 - DNA, 19 bp, Homo sapiens
gctgtctgatgctgaggtc

SEQ ID NO: 9054906 - DNA, 22 bp, Homo sapiens
gctgtctcgcctgacactggct

SEQ ID NO: 9054907 - DNA, 21 bp, Homo sapiens
gctgtctctggctcctgggaa

SEQ ID NO: 9054908 - DNA, 22 bp, Homo sapiens
cacagtgtctgtgcttcagtgt

SEQ ID NO: 9054909 - DNA, 22 bp, Homo sapiens
cacagtgtgactgaccttcagc

SEQ ID NO: 9054910 - DNA, 22 bp, Homo sapiens
cacagtgtagactaataataga

SEQ ID NO: 9054911 - DNA, 22 bp, Homo sapiens
ggatgttctggggttctcttgt

SEQ ID NO: 9054912 - DNA, 22 bp, Homo sapiens
ggagggagtcagctgattagaa

SEQ ID NO: 9054913 - DNA, 22 bp, Homo sapiens
ggagggagggctagaccaaaga

SEQ ID NO: 9054914 - DNA, 22 bp, Homo sapiens
cacactgacctgaacttagcat

SEQ ID NO: 9054915 - DNA, 22 bp, Homo sapiens
cacactgataggcttgacaggc

SEQ ID NO: 9054916 - DNA, 22 bp, Homo sapiens
cacactgactggaatcaaggat

SEQ ID NO: 9054917 - DNA, 22 bp, Homo sapiens
cacactgatagcactaagtcag

SEQ ID NO: 9054918 - DNA, 22 bp, Homo sapiens
cacactgcttacacaaaatgat

SEQ ID NO: 9054919 - DNA, 22 bp, Homo sapiens
cacactgtcaggtaaataacac

SEQ ID NO: 9054920 - DNA, 22 bp, Homo sapiens
cacagcttgtttagtgactcac

SEQ ID NO: 9054921 - DNA, 22 bp, Homo sapiens
cactgctttttctcctcactgg

SEQ ID NO: 9054922 - DNA, 22 bp, Homo sapiens
ggctagggatctagaccaggac

SEQ ID NO: 9054923 - DNA, 22 bp, Homo sapiens
ggctagggatctagaccaggac

SEQ ID NO: 9054924 - DNA, 22 bp, Homo sapiens
ggctagggagacagagggcatg

SEQ ID NO: 9054925 - DNA, 22 bp, Homo sapiens
cactgcatggatgatggctgta

SEQ ID NO: 9054926 - DNA, 22 bp, Homo sapiens
cactgacagtatcagagctgtt

SEQ ID NO: 9054927 - DNA, 22 bp, Homo sapiens
cactgaagctttcattctcttg

SEQ ID NO: 9054928 - DNA, 22 bp, Homo sapiens
cactgaaggaaggactactgca

SEQ ID NO: 9054929 - DNA, 22 bp, Homo sapiens
cactgagagatgtgtcacagca

SEQ ID NO: 9054930 - DNA, 22 bp, Homo sapiens
cactgactgcccgctgtacatt

SEQ ID NO: 9054931 - DNA, 22 bp, Homo sapiens
cactgcagtaactctaggactg

SEQ ID NO: 9054932 - DNA, 22 bp, Homo sapiens
cactgcactccagcttgggtga

SEQ ID NO: 9054933 - DNA, 22 bp, Homo sapiens
cacccagagcagacactgtcca

SEQ ID NO: 9054934 - DNA, 22 bp, Homo sapiens
cacccacattccatcactctgc

SEQ ID NO: 9054935 - DNA, 22 bp, Homo sapiens
caccatttagtagcaagagctc

SEQ ID NO: 9054936 - DNA, 22 bp, Homo sapiens
cacccacatggaaattcacagt

SEQ ID NO: 9054937 - DNA, 22 bp, Homo sapiens
caccattccaggccttaagaag

SEQ ID NO: 9054938 - DNA, 22 bp, Homo sapiens
caccagtctttattttgttatt

SEQ ID NO: 9054939 - DNA, 19 bp, Homo sapiens
ggcagctcttgtcttctgc

SEQ ID NO: 9054940 - DNA, 22 bp, Homo sapiens
caccccagtctaaaaccagcct

SEQ ID NO: 9054941 - DNA, 22 bp, Homo sapiens
cactctgagaaacactaaacca

SEQ ID NO: 9054942 - DNA, 22 bp, Homo sapiens
cactctgagaagtacaagctcc

SEQ ID NO: 9054943 - DNA, 22 bp, Homo sapiens
cacccccagcagggaaaggagg

SEQ ID NO: 9054944 - DNA, 22 bp, Homo sapiens
cacccccacctgtgggctcctg

SEQ ID NO: 9054945 - DNA, 22 bp, Homo sapiens
cacccccaggagctccagggac

SEQ ID NO: 9054946 - DNA, 22 bp, Homo sapiens
caccctcccgtcagcccctggg

SEQ ID NO: 9054947 - DNA, 22 bp, Homo sapiens
attaaatggtggtcattcattt

SEQ ID NO: 9054948 - DNA, 22 bp, Homo sapiens
attaaatactgcaggctaagca

SEQ ID NO: 9054949 - DNA, 22 bp, Homo sapiens
atgtttttcataccagtgttgg

SEQ ID NO: 9054950 - DNA, 22 bp, Homo sapiens
atgtttttaaatagacttacag

SEQ ID NO: 9054951 - DNA, 22 bp, Homo sapiens
atgtttttggcttcaagtttct

SEQ ID NO: 9054952 - DNA, 22 bp, Homo sapiens
attaaaagagataatgtgtgtt

SEQ ID NO: 9054953 - DNA, 22 bp, Homo sapiens
attaaattagcaaactgtgaaa

SEQ ID NO: 9054954 - DNA, 22 bp, Homo sapiens
atgtgtttgtacctttaaatat

SEQ ID NO: 9054955 - DNA, 22 bp, Homo sapiens
atgtgttaatgagcaatgacct

SEQ ID NO: 9054956 - DNA, 22 bp, Homo sapiens
atgtgttaatgtcaaccagaaa

SEQ ID NO: 9054957 - DNA, 22 bp, Homo sapiens
atgttttgctggatgttggcta

SEQ ID NO: 9054958 - DNA, 22 bp, Homo sapiens
atgttttaccctttgcacaaac

SEQ ID NO: 9054959 - DNA, 22 bp, Homo sapiens
atgttttatgttccactcaagg

SEQ ID NO: 9054960 - DNA, 22 bp, Homo sapiens
gatgatcatctgtaaagttaga

SEQ ID NO: 9054961 - DNA, 18 bp, Homo sapiens
attaatcataaaatgctg

SEQ ID NO: 9054962 - DNA, 22 bp, Homo sapiens
attacaataaggtttatttgta

SEQ ID NO: 9054963 - DNA, 22 bp, Homo sapiens
attacaataatacatgctcatt

SEQ ID NO: 9054964 - DNA, 22 bp, Homo sapiens
attacaataatacatgctcatt

SEQ ID NO: 9054965 - DNA, 22 bp, Homo sapiens
gcaacttaggagttagagcatg

SEQ ID NO: 9054966 - DNA, 22 bp, Homo sapiens
attacaactgttcccactgtct

SEQ ID NO: 9054967 - DNA, 22 bp, Homo sapiens
attacaactacataatctcaga

SEQ ID NO: 9054968 - DNA, 22 bp, Homo sapiens
attacaaaagaagggagaaggt

SEQ ID NO: 9054969 - DNA, 22 bp, Homo sapiens
attacaaaagaagggagaaggt

SEQ ID NO: 9054970 - DNA, 22 bp, Homo sapiens
gcaaggtatgtagtattaactc

SEQ ID NO: 9054971 - DNA, 22 bp, Homo sapiens
attagaatgcagggttcattgt

SEQ ID NO: 9054972 - DNA, 22 bp, Homo sapiens
gcaagttatttccatttaaagc

SEQ ID NO: 9054973 - DNA, 22 bp, Homo sapiens
attattcagtcttgtaaggagt

SEQ ID NO: 9054974 - DNA, 22 bp, Homo sapiens
attattcaatcatattaaaagt

SEQ ID NO: 9054975 - DNA, 22 bp, Homo sapiens
attattaaagctacatcaagga

SEQ ID NO: 9054976 - DNA, 22 bp, Homo sapiens
attattaaaatgtgtttctctt

SEQ ID NO: 9054977 - DNA, 22 bp, Homo sapiens
attattcttatgtcatcatggc

SEQ ID NO: 9054978 - DNA, 20 bp, Homo sapiens
attattcatacatgtgtgac

SEQ ID NO: 9054979 - DNA, 20 bp, Homo sapiens
attattcatacatgtgtgac

SEQ ID NO: 9054980 - DNA, 22 bp, Homo sapiens
attattcattggtaggcaagct

SEQ ID NO: 9054981 - DNA, 22 bp, Homo sapiens
attgctgtaaattatcttatta

SEQ ID NO: 9054982 - DNA, 22 bp, Homo sapiens
attgcacttcagcctgggtgac

SEQ ID NO: 9054983 - DNA, 22 bp, Homo sapiens
attgcactccggcctgggtgac

SEQ ID NO: 9054984 - DNA, 22 bp, Homo sapiens
attgaaaaatgactattgctta

SEQ ID NO: 9054985 - DNA, 22 bp, Homo sapiens
attgaagattaaatgcttcctt

SEQ ID NO: 9054986 - DNA, 22 bp, Homo sapiens
attcttatttaaatagagtctg

SEQ ID NO: 9054987 - DNA, 22 bp, Homo sapiens
attcttaaatttaggtctgtga

SEQ ID NO: 9054988 - DNA, 22 bp, Homo sapiens
attcttattaaatagccagaag

SEQ ID NO: 9054989 - DNA, 22 bp, Homo sapiens
attcttattatagtaaaacagt

SEQ ID NO: 9054990 - DNA, 22 bp, Homo sapiens
attctatctctatatttctgca

SEQ ID NO: 9054991 - DNA, 22 bp, Homo sapiens
attctattaatatttctaggaa

SEQ ID NO: 9054992 - DNA, 22 bp, Homo sapiens
attctattttttaagaagtagt

SEQ ID NO: 9054993 - DNA, 22 bp, Homo sapiens
attctagagtttcaatccaagg

SEQ ID NO: 9054994 - DNA, 22 bp, Homo sapiens
attctagataagaaaagggctg

SEQ ID NO: 9054995 - DNA, 22 bp, Homo sapiens
attctcagctttcaaatagaca

SEQ ID NO: 9054996 - DNA, 22 bp, Homo sapiens
attattgtgataggtgtcagtg

SEQ ID NO: 9054997 - DNA, 22 bp, Homo sapiens
attatttacagtgtgctcgaag

SEQ ID NO: 9054998 - DNA, 22 bp, Homo sapiens
attatttatcctcttggtctat

SEQ ID NO: 9054999 - DNA, 22 bp, Homo sapiens
attatttagaaatcgattgaaa

SEQ ID NO: 9055000 - DNA, 22 bp, Homo sapiens
attcagtattctgctgcataat

SEQ ID NO: 9055001 - DNA, 23 bp, Homo sapiens
gcagagctgccctattgccttgg

SEQ ID NO: 9055002 - DNA, 22 bp, Homo sapiens
gcagagctggaactggtactca

SEQ ID NO: 9055003 - DNA, 22 bp, Homo sapiens
gcagagctgttaatggagctga

SEQ ID NO: 9055004 - DNA, 20 bp, Homo sapiens
gcagagctgttctgtgggga

SEQ ID NO: 9055005 - DNA, 22 bp, Homo sapiens
gcagagctggtacttgagcctg

SEQ ID NO: 9055006 - DNA, 22 bp, Homo sapiens
attcagttagtagatttggtca

SEQ ID NO: 9055007 - DNA, 22 bp, Homo sapiens
attctacacctctctcatttag

SEQ ID NO: 9055008 - DNA, 22 bp, Homo sapiens
attctacacctctctcatttag

SEQ ID NO: 9055009 - DNA, 22 bp, Homo sapiens
attctacagatgaaagcggctg

SEQ ID NO: 9055010 - DNA, 22 bp, Homo sapiens
attctacaggactggcaatccc

SEQ ID NO: 9055011 - DNA, 22 bp, Homo sapiens
attctactcattgatctatata

SEQ ID NO: 9055012 - DNA, 22 bp, Homo sapiens
attctactgcttggaatatctt

SEQ ID NO: 9055013 - DNA, 18 bp, Homo sapiens
attctagaagatgccttg

SEQ ID NO: 9055014 - DNA, 21 bp, Homo sapiens
attctagacaacactgaaatc

SEQ ID NO: 9055015 - DNA, 22 bp, Homo sapiens
attctagaatttaaatttgcca

SEQ ID NO: 9055016 - DNA, 22 bp, Homo sapiens
gcagcagggtgccagctttgca

SEQ ID NO: 9055017 - DNA, 22 bp, Homo sapiens
gcagcaggcttttcataccttg

SEQ ID NO: 9055018 - DNA, 22 bp, Homo sapiens
attcctgaagaaggtatgttgc

SEQ ID NO: 9055019 - DNA, 22 bp, Homo sapiens
attcctgagacttatctgtttc

SEQ ID NO: 9055020 - DNA, 22 bp, Homo sapiens
gcagcaggcacttaccgttgct

SEQ ID NO: 9055021 - DNA, 22 bp, Homo sapiens
attccctgaaattgtgctttca

SEQ ID NO: 9055022 - DNA, 22 bp, Homo sapiens
caaaaagcttaggtaacaagcc

SEQ ID NO: 9055023 - DNA, 22 bp, Homo sapiens
attttttagaacctggcctgat

SEQ ID NO: 9055024 - DNA, 22 bp, Homo sapiens
caaactttcagttataacatga

SEQ ID NO: 9055025 - DNA, 22 bp, Homo sapiens
caaacttttcctggaaaagatt

SEQ ID NO: 9055026 - DNA, 22 bp, Homo sapiens
caaactttgcaaaacttacagt

SEQ ID NO: 9055027 - DNA, 22 bp, Homo sapiens
caaactttcagttataacatga

SEQ ID NO: 9055028 - DNA, 22 bp, Homo sapiens
caaactctgtaggacagttcaa

SEQ ID NO: 9055029 - DNA, 22 bp, Homo sapiens
caaactattgttcacaagacaa

SEQ ID NO: 9055030 - DNA, 22 bp, Homo sapiens
caaaccttgcagaactgggcag

SEQ ID NO: 9055031 - DNA, 22 bp, Homo sapiens
caaaccttgtaaatgccaaact

SEQ ID NO: 9055032 - DNA, 22 bp, Homo sapiens
gcctggctgaggcctctgctaa

SEQ ID NO: 9055033 - DNA, 22 bp, Homo sapiens
atttctcactcacagtccatgt

SEQ ID NO: 9055034 - DNA, 22 bp, Homo sapiens
atttctcaagtaaatgagtcat

SEQ ID NO: 9055035 - DNA, 22 bp, Homo sapiens
atttctcactgagcagataaaa

SEQ ID NO: 9055036 - DNA, 22 bp, Homo sapiens
gcctcgaggctgagaaggcaca

SEQ ID NO: 9055037 - DNA, 22 bp, Homo sapiens
atttcaggccaccagatgtctt

SEQ ID NO: 9055038 - DNA, 22 bp, Homo sapiens
atttcagattcgagaggaagtg

SEQ ID NO: 9055039 - DNA, 22 bp, Homo sapiens
atttccttcccagatttggttc

SEQ ID NO: 9055040 - DNA, 22 bp, Homo sapiens
atttccttgcaacttaggcatg

SEQ ID NO: 9055041 - DNA, 22 bp, Homo sapiens
atttctataggaggacagtatt

SEQ ID NO: 9055042 - DNA, 22 bp, Homo sapiens
atttctcaaaggaatagagtga

SEQ ID NO: 9055043 - DNA, 22 bp, Homo sapiens
atttcagagtgagagtgctcaa

SEQ ID NO: 9055044 - DNA, 22 bp, Homo sapiens
atttcagattcagaaatgtagg

SEQ ID NO: 9055045 - DNA, 22 bp, Homo sapiens
atttcagaatgtcctaatttag

SEQ ID NO: 9055046 - DNA, 22 bp, Homo sapiens
atttcagactgtgttggaaaat

SEQ ID NO: 9055047 - DNA, 22 bp, Homo sapiens
atttcagactgtgttggaaaat

SEQ ID NO: 9055048 - DNA, 22 bp, Homo sapiens
atttcacaaaccatcctgattt

SEQ ID NO: 9055049 - DNA, 22 bp, Homo sapiens
atttcacaaaccatcctgattt

SEQ ID NO: 9055050 - DNA, 22 bp, Homo sapiens
atttattgagagggaggggaat

SEQ ID NO: 9055051 - DNA, 22 bp, Homo sapiens
atttattggatgcttacttggg

SEQ ID NO: 9055052 - DNA, 22 bp, Homo sapiens
gccaggagtgtcccactcattt

SEQ ID NO: 9055053 - DNA, 22 bp, Homo sapiens
atttactctggctggaatacaa

SEQ ID NO: 9055054 - DNA, 22 bp, Homo sapiens
atttagaaattccaaaagtatt

SEQ ID NO: 9055055 - DNA, 22 bp, Homo sapiens
attgcttttccttaacacatgc

SEQ ID NO: 9055056 - DNA, 22 bp, Homo sapiens
attggaaatacagtagaaaaat

SEQ ID NO: 9055057 - DNA, 22 bp, Homo sapiens
atttaattaatcatggtgaatt

SEQ ID NO: 9055058 - DNA, 22 bp, Homo sapiens
atttaattaatcatggtgaatt

SEQ ID NO: 9055059 - DNA, 22 bp, Homo sapiens
atttaattgttcttctggctat

SEQ ID NO: 9055060 - DNA, 22 bp, Homo sapiens
atttaatttacatttgacagag

SEQ ID NO: 9055061 - DNA, 22 bp, Homo sapiens
atttaatttacatttgacagag

SEQ ID NO: 9055062 - DNA, 22 bp, Homo sapiens
atttaatttatagatgtggata

SEQ ID NO: 9055063 - DNA, 22 bp, Homo sapiens
atttaatttatagatgtggata

SEQ ID NO: 9055064 - DNA, 22 bp, Homo sapiens
atttaatttatagatgtggata

SEQ ID NO: 9055065 - DNA, 22 bp, Homo sapiens
atttaatttggagagagaaacc

SEQ ID NO: 9055066 - DNA, 22 bp, Homo sapiens
atttaatttgtgtctttagctg

SEQ ID NO: 9055067 - DNA, 22 bp, Homo sapiens
atttaatttggagagagaaacc

SEQ ID NO: 9055068 - DNA, 22 bp, Homo sapiens
atttaattttctcaacagtgct

SEQ ID NO: 9055069 - DNA, 22 bp, Homo sapiens
atgcacttaaataacataactt

SEQ ID NO: 9055070 - DNA, 22 bp, Homo sapiens
atgcagaaagcggcaaacaggt

SEQ ID NO: 9055071 - DNA, 22 bp, Homo sapiens
atgcagaagactgaaaagctga

SEQ ID NO: 9055072 - DNA, 22 bp, Homo sapiens
atgcagaacgtttgtgaaactt

SEQ ID NO: 9055073 - DNA, 22 bp, Homo sapiens
atgcagatctgtgaaaggaata

SEQ ID NO: 9055074 - DNA, 22 bp, Homo sapiens
atgcagatgggtgccaaagtct

SEQ ID NO: 9055075 - DNA, 22 bp, Homo sapiens
atgcagatatgcaaactgtagt

SEQ ID NO: 9055076 - DNA, 22 bp, Homo sapiens
atgcagatggtggatggagaaa

SEQ ID NO: 9055077 - DNA, 22 bp, Homo sapiens
atgcagatttaattagtatagg

SEQ ID NO: 9055078 - DNA, 22 bp, Homo sapiens
atgcagagacagatgtggcatg

SEQ ID NO: 9055079 - DNA, 19 bp, Homo sapiens
atgcagagaatggcagtag

SEQ ID NO: 9055080 - DNA, 22 bp, Homo sapiens
atgcagagcttccagtggcctg

SEQ ID NO: 9055081 - DNA, 21 bp, Homo sapiens
atgcagagaactccagggaag

SEQ ID NO: 9055082 - DNA, 21 bp, Homo sapiens
atgcagagaactccagggaag

SEQ ID NO: 9055083 - DNA, 20 bp, Homo sapiens
atgcaaactcacaaaatacc

SEQ ID NO: 9055084 - DNA, 22 bp, Homo sapiens
atgcaaataaacagtctagttg

SEQ ID NO: 9055085 - DNA, 22 bp, Homo sapiens
atgcaaatcttaagtatgtgtg

SEQ ID NO: 9055086 - DNA, 22 bp, Homo sapiens
gacactgaagtcactaagcagg

SEQ ID NO: 9055087 - DNA, 22 bp, Homo sapiens
atgcattgaggatgacatgagt

SEQ ID NO: 9055088 - DNA, 22 bp, Homo sapiens
atgcatgtattatctagatgag

SEQ ID NO: 9055089 - DNA, 22 bp, Homo sapiens
atgcatgtatatattacactca

SEQ ID NO: 9055090 - DNA, 22 bp, Homo sapiens
atgcatgtgtgagagcaagagg

SEQ ID NO: 9055091 - DNA, 22 bp, Homo sapiens
atgcattcagcggaatgcttag

SEQ ID NO: 9055092 - DNA, 22 bp, Homo sapiens
atgcattcagcggaatgcttag

SEQ ID NO: 9055093 - DNA, 22 bp, Homo sapiens
atgcagcagtttacaaagcaat

SEQ ID NO: 9055094 - DNA, 22 bp, Homo sapiens
atgcatgcttcttatagtactt

SEQ ID NO: 9055095 - DNA, 21 bp, Homo sapiens
atgcatctatcttctactcca

SEQ ID NO: 9055096 - DNA, 20 bp, Homo sapiens
atgcatctggtatctttcct

SEQ ID NO: 9055097 - DNA, 22 bp, Homo sapiens
atgcatctatgacttagacatt

SEQ ID NO: 9055098 - DNA, 19 bp, Homo sapiens
atgcatctgcattgacagg

SEQ ID NO: 9055099 - DNA, 22 bp, Homo sapiens
atgagtgtgaagttagctcagt

SEQ ID NO: 9055100 - DNA, 22 bp, Homo sapiens
atgattagttaccttgatttaa

SEQ ID NO: 9055101 - DNA, 19 bp, Homo sapiens
atgaggtagcagctggtgc

SEQ ID NO: 9055102 - DNA, 22 bp, Homo sapiens
gaaagcaagttgactgcagaat

SEQ ID NO: 9055103 - DNA, 19 bp, Homo sapiens
atgaggaactgaggctcag

SEQ ID NO: 9055104 - DNA, 22 bp, Homo sapiens
atgaagcagatttattactcac

SEQ ID NO: 9055105 - DNA, 22 bp, Homo sapiens
atgaagcaattagaaacttgaa

SEQ ID NO: 9055106 - DNA, 20 bp, Homo sapiens
cttggtggctctgggaagtg

SEQ ID NO: 9055107 - DNA, 22 bp, Homo sapiens
atcttcctttgccatgggatag

SEQ ID NO: 9055108 - DNA, 22 bp, Homo sapiens
atctacactataacagaatgct

SEQ ID NO: 9055109 - DNA, 22 bp, Homo sapiens
atctacatgttgatttaaagaa

SEQ ID NO: 9055110 - DNA, 22 bp, Homo sapiens
cttgctctgggaagaaaaagtc

SEQ ID NO: 9055111 - DNA, 22 bp, Homo sapiens
cttgctctagatgttcagagct

SEQ ID NO: 9055112 - DNA, 22 bp, Homo sapiens
cttgctctttgatgaattttcc

SEQ ID NO: 9055113 - DNA, 22 bp, Homo sapiens
cttgctcttttcactgtaatat

SEQ ID NO: 9055114 - DNA, 22 bp, Homo sapiens
atgaaaacggaccagagctatt

SEQ ID NO: 9055115 - DNA, 22 bp, Homo sapiens
atctttttgacatggtgatggt

SEQ ID NO: 9055116 - DNA, 22 bp, Homo sapiens
atcttttttgtcttggtcactg

SEQ ID NO: 9055117 - DNA, 22 bp, Homo sapiens
atctttttactaacactgctta

SEQ ID NO: 9055118 - DNA, 22 bp, Homo sapiens
atctttttatctgtttggaaca

SEQ ID NO: 9055119 - DNA, 22 bp, Homo sapiens
atcttgatcaaggctatcatga

SEQ ID NO: 9055120 - DNA, 22 bp, Homo sapiens
atgaaacatgagaaatggagag

SEQ ID NO: 9055121 - DNA, 22 bp, Homo sapiens
atgaaacatgagaaatggagag

SEQ ID NO: 9055122 - DNA, 22 bp, Homo sapiens
atgaaataaatacccacacata

SEQ ID NO: 9055123 - DNA, 22 bp, Homo sapiens
atgaaatatcttgaagaaattc

SEQ ID NO: 9055124 - DNA, 22 bp, Homo sapiens
atgaaatatcttgaagaaattc

SEQ ID NO: 9055125 - DNA, 22 bp, Homo sapiens
atgaaatgtaagtagagagttt

SEQ ID NO: 9055126 - DNA, 22 bp, Homo sapiens
atgaaatgctgagaggtgcttc

SEQ ID NO: 9055127 - DNA, 22 bp, Homo sapiens
atgaaatgtatgagtctgggtt

SEQ ID NO: 9055128 - DNA, 22 bp, Homo sapiens
cttttcatgccagcccatcaca

SEQ ID NO: 9055129 - DNA, 23 bp, Homo sapiens
cttttcattgccttagcgcagag

SEQ ID NO: 9055130 - DNA, 22 bp, Homo sapiens
cttttattttgaattaagggct

SEQ ID NO: 9055131 - DNA, 22 bp, Homo sapiens
cttttacatttgttgaagagta

SEQ ID NO: 9055132 - DNA, 22 bp, Homo sapiens
atgtctttggctttgacatggc

SEQ ID NO: 9055133 - DNA, 22 bp, Homo sapiens
atgtctttcttgtgtcccaaga

SEQ ID NO: 9055134 - DNA, 22 bp, Homo sapiens
atgtctttataaatgtataatg

SEQ ID NO: 9055135 - DNA, 22 bp, Homo sapiens
gaggctgctgttagccctgggc

SEQ ID NO: 9055136 - DNA, 22 bp, Homo sapiens
gaggggaagacttctggacagt

SEQ ID NO: 9055137 - DNA, 22 bp, Homo sapiens
gaggggagacagggaaatcagt

SEQ ID NO: 9055138 - DNA, 22 bp, Homo sapiens
gaggagctgggctgagagggtc

SEQ ID NO: 9055139 - DNA, 22 bp, Homo sapiens
gaggagctggctgtcgggaggc

SEQ ID NO: 9055140 - DNA, 22 bp, Homo sapiens
atgtacattttcctaatgtttt

SEQ ID NO: 9055141 - DNA, 18 bp, Homo sapiens
atgtacatttgctaaagc

SEQ ID NO: 9055142 - DNA, 22 bp, Homo sapiens
gaggagctgaggctgaggcctc

SEQ ID NO: 9055143 - DNA, 22 bp, Homo sapiens
gaggagctgcagggggagtcta

SEQ ID NO: 9055144 - DNA, 22 bp, Homo sapiens
atgccactgcgctctagcctgg

SEQ ID NO: 9055145 - DNA, 21 bp, Homo sapiens
atggaaaaacaggtagagcat

SEQ ID NO: 9055146 - DNA, 22 bp, Homo sapiens
atgccacttcattccagcctcg

SEQ ID NO: 9055147 - DNA, 22 bp, Homo sapiens
atggaaatgatggaacattaaa

SEQ ID NO: 9055148 - DNA, 22 bp, Homo sapiens
gacactgagaaatattcagaca

SEQ ID NO: 9055149 - DNA, 22 bp, Homo sapiens
atgccactgcacttcagcttgg

SEQ ID NO: 9055150 - DNA, 22 bp, Homo sapiens
atgccactgcgctccagcctgg

SEQ ID NO: 9055151 - DNA, 22 bp, Homo sapiens
atgccactgcgctccagcctgg

SEQ ID NO: 9055152 - DNA, 22 bp, Homo sapiens
atgccactgcgctccagcctgg

SEQ ID NO: 9055153 - DNA, 22 bp, Homo sapiens
gacagcaaagcagagccaaggc

SEQ ID NO: 9055154 - DNA, 22 bp, Homo sapiens
gacagcaacactcaattctgca

SEQ ID NO: 9055155 - DNA, 22 bp, Homo sapiens
atggagactgcgtctgccatcc

SEQ ID NO: 9055156 - DNA, 22 bp, Homo sapiens
gagaaatgcatgcatgtcatca

SEQ ID NO: 9055157 - DNA, 22 bp, Homo sapiens
gagaaatgctagcttaggaatc

SEQ ID NO: 9055158 - DNA, 22 bp, Homo sapiens
atggcagagggattgaacagct

SEQ ID NO: 9055159 - DNA, 22 bp, Homo sapiens
gagagctgtgttcattctacca

SEQ ID NO: 9055160 - DNA, 22 bp, Homo sapiens
gagagctgtggtttgaccaggc

SEQ ID NO: 9055161 - DNA, 22 bp, Homo sapiens
gagccagctacatggtctgcaa

SEQ ID NO: 9055162 - DNA, 22 bp, Homo sapiens
gagccaggaagaaggccttact

SEQ ID NO: 9055163 - DNA, 22 bp, Homo sapiens
gagccaggaggcagagactgca

SEQ ID NO: 9055164 - DNA, 22 bp, Homo sapiens
gagccaggaggcagagactgca

SEQ ID NO: 9055165 - DNA, 22 bp, Homo sapiens
gagccaggagatacctaagggg

SEQ ID NO: 9055166 - DNA, 22 bp, Homo sapiens
atggctgctgccttcccctgct

SEQ ID NO: 9055167 - DNA, 22 bp, Homo sapiens
atggctgctctggatggagtcc

SEQ ID NO: 9055168 - DNA, 22 bp, Homo sapiens
atggctgcctgggcgctggccg

SEQ ID NO: 9055169 - DNA, 22 bp, Homo sapiens
gagccagggagggtctggtata

SEQ ID NO: 9055170 - DNA, 22 bp, Homo sapiens
atggctgcatcatcctggttga

SEQ ID NO: 9055171 - DNA, 22 bp, Homo sapiens
gagccaggcccgtacttgctgt

SEQ ID NO: 9055172 - DNA, 22 bp, Homo sapiens
gagccaggcaccttctgtgttg

SEQ ID NO: 9055173 - DNA, 22 bp, Homo sapiens
atggccagtgtttccctcagtt

SEQ ID NO: 9055174 - DNA, 22 bp, Homo sapiens
gagcagtgactggagcatgaga

SEQ ID NO: 9055175 - DNA, 22 bp, Homo sapiens
cagaaatgacaaagtaagagga

SEQ ID NO: 9055176 - DNA, 22 bp, Homo sapiens
cagagatggcggctgttgtgtt

SEQ ID NO: 9055177 - DNA, 22 bp, Homo sapiens
cagagatgggtcgcagagatgg

SEQ ID NO: 9055178 - DNA, 17 bp, Homo sapiens
agccaggtacaagtcca

SEQ ID NO: 9055179 - DNA, 22 bp, Homo sapiens
agccaggtaataaaggtcaaca

SEQ ID NO: 9055180 - DNA, 22 bp, Homo sapiens
agccaggtactcttgtgaccat

SEQ ID NO: 9055181 - DNA, 22 bp, Homo sapiens
agccaggtcaggaaaggtccca

SEQ ID NO: 9055182 - DNA, 22 bp, Homo sapiens
agccaggtcagctcaccctgct

SEQ ID NO: 9055183 - DNA, 22 bp, Homo sapiens
agccaggtctaaggacatcagg

SEQ ID NO: 9055184 - DNA, 22 bp, Homo sapiens
agccaggtttctttagctgtca

SEQ ID NO: 9055185 - DNA, 22 bp, Homo sapiens
agccaggttgggccttttcttt

SEQ ID NO: 9055186 - DNA, 22 bp, Homo sapiens
agccaggttaaaccacagtcaa

SEQ ID NO: 9055187 - DNA, 18 bp, Homo sapiens
agccaggtggaatggaac

SEQ ID NO: 9055188 - DNA, 22 bp, Homo sapiens
agccaggtgcagtggcacacac

SEQ ID NO: 9055189 - DNA, 22 bp, Homo sapiens
cagacagagtcttcccatcagt

SEQ ID NO: 9055190 - DNA, 22 bp, Homo sapiens
agcccagctttgaaccatatca

SEQ ID NO: 9055191 - DNA, 22 bp, Homo sapiens
cagagctggagaagtggattta

SEQ ID NO: 9055192 - DNA, 22 bp, Homo sapiens
cagagctggacttaaatatatt

SEQ ID NO: 9055193 - DNA, 22 bp, Homo sapiens
cagagctggacttaaatatatt

SEQ ID NO: 9055194 - DNA, 22 bp, Homo sapiens
cagagctgcttcccagtttgtg

SEQ ID NO: 9055195 - DNA, 22 bp, Homo sapiens
cagagctggagcttgaatggag

SEQ ID NO: 9055196 - DNA, 22 bp, Homo sapiens
cagagctggcctgtgatttttg

SEQ ID NO: 9055197 - DNA, 22 bp, Homo sapiens
cagagctggagggaaccctggc

SEQ ID NO: 9055198 - DNA, 22 bp, Homo sapiens
cagagctggcggtgagaagaca

SEQ ID NO: 9055199 - DNA, 23 bp, Homo sapiens
agcccctttaagtccggctgatg

SEQ ID NO: 9055200 - DNA, 19 bp, Homo sapiens
agccccttggtactgtcct

SEQ ID NO: 9055201 - DNA, 22 bp, Homo sapiens
agccccttgcacttccccacgc

SEQ ID NO: 9055202 - DNA, 22 bp, Homo sapiens
agccccttgctgccctctagag

SEQ ID NO: 9055203 - DNA, 22 bp, Homo sapiens
cagaggctaagggtagcttggg

SEQ ID NO: 9055204 - DNA, 22 bp, Homo sapiens
cagcagaggtggttcacattgt

SEQ ID NO: 9055205 - DNA, 22 bp, Homo sapiens
cagcagaggttttgctccatga

SEQ ID NO: 9055206 - DNA, 22 bp, Homo sapiens
cagccctggctagggcgagggc

SEQ ID NO: 9055207 - DNA, 22 bp, Homo sapiens
cagccctgggagttggggccga

SEQ ID NO: 9055208 - DNA, 22 bp, Homo sapiens
agctccctgcacgaccctgccc

SEQ ID NO: 9055209 - DNA, 22 bp, Homo sapiens
cagccctggcctcttcgctttc

SEQ ID NO: 9055210 - DNA, 22 bp, Homo sapiens
cagccctggccccaggtggtct

SEQ ID NO: 9055211 - DNA, 22 bp, Homo sapiens
cagcaggaggtgagatgtgacc

SEQ ID NO: 9055212 - DNA, 22 bp, Homo sapiens
cagcaggaggtgagtagcaggt

SEQ ID NO: 9055213 - DNA, 22 bp, Homo sapiens
cagcaggataggtttctttgga

SEQ ID NO: 9055214 - DNA, 22 bp, Homo sapiens
agcctttatactgtgtaaggca

SEQ ID NO: 9055215 - DNA, 22 bp, Homo sapiens
agccttgacactggggaaactg

SEQ ID NO: 9055216 - DNA, 22 bp, Homo sapiens
agcctttaactggataaagtgt

SEQ ID NO: 9055217 - DNA, 22 bp, Homo sapiens
agcctttaacacttcacattga

SEQ ID NO: 9055218 - DNA, 22 bp, Homo sapiens
agcctttaacacttcacattga

SEQ ID NO: 9055219 - DNA, 22 bp, Homo sapiens
agcaaacattcagcagattggc

SEQ ID NO: 9055220 - DNA, 22 bp, Homo sapiens
attttctgagtccagaatttac

SEQ ID NO: 9055221 - DNA, 22 bp, Homo sapiens
agcacaaaaacattcccagagt

SEQ ID NO: 9055222 - DNA, 22 bp, Homo sapiens
agcacagagaagatttcaatta

SEQ ID NO: 9055223 - DNA, 17 bp, Homo sapiens
agcagaagtcagaggga

SEQ ID NO: 9055224 - DNA, 22 bp, Homo sapiens
caaatgttattcattcttgttt

SEQ ID NO: 9055225 - DNA, 22 bp, Homo sapiens
caaatgttgctgtaatgtttgt

SEQ ID NO: 9055226 - DNA, 22 bp, Homo sapiens
caaatgatccttgcaagctgtg

SEQ ID NO: 9055227 - DNA, 22 bp, Homo sapiens
caaatgcaggtcagcaggtgtc

SEQ ID NO: 9055228 - DNA, 22 bp, Homo sapiens
caaatgcatagaaagatgaaac

SEQ ID NO: 9055229 - DNA, 22 bp, Homo sapiens
caaggcagttccccagagggct

SEQ ID NO: 9055230 - DNA, 22 bp, Homo sapiens
caaggcaggtctgaggaggttg

SEQ ID NO: 9055231 - DNA, 22 bp, Homo sapiens
caaggcaggcagttcacttgag

SEQ ID NO: 9055232 - DNA, 22 bp, Homo sapiens
caatgaaagcaactgcctataa

SEQ ID NO: 9055233 - DNA, 22 bp, Homo sapiens
caatgaaagcaactgcctataa

SEQ ID NO: 9055234 - DNA, 22 bp, Homo sapiens
caatgaaagcaactgcctataa

SEQ ID NO: 9055235 - DNA, 22 bp, Homo sapiens
caactgaaaagattctacgcag

SEQ ID NO: 9055236 - DNA, 22 bp, Homo sapiens
agcagcacacgggagaaagaca

SEQ ID NO: 9055237 - DNA, 22 bp, Homo sapiens
agcagagtgtgaaggcagggct

SEQ ID NO: 9055238 - DNA, 22 bp, Homo sapiens
caacttcttggcttcctaatgg

SEQ ID NO: 9055239 - DNA, 22 bp, Homo sapiens
caaggcaggcagttcacttgag

SEQ ID NO: 9055240 - DNA, 22 bp, Homo sapiens
caatgaaattgagatccagaga

SEQ ID NO: 9055241 - DNA, 22 bp, Homo sapiens
agcagggctccatttcactgcc

SEQ ID NO: 9055242 - DNA, 22 bp, Homo sapiens
cacagtcaatgtagaaatatga

SEQ ID NO: 9055243 - DNA, 22 bp, Homo sapiens
cacagtcagcctctagtagcat

SEQ ID NO: 9055244 - DNA, 22 bp, Homo sapiens
cacagtcccattcgagagtaat

SEQ ID NO: 9055245 - DNA, 22 bp, Homo sapiens
cacagtccagactcctggagtt

SEQ ID NO: 9055246 - DNA, 22 bp, Homo sapiens
agcaggtgatcgcgtgtgctcc

SEQ ID NO: 9055247 - DNA, 22 bp, Homo sapiens
cacatccttcatactcagctct

SEQ ID NO: 9055248 - DNA, 22 bp, Homo sapiens
cacatccctggagttacccagt

SEQ ID NO: 9055249 - DNA, 22 bp, Homo sapiens
cacatattgtagttcaccagga

SEQ ID NO: 9055250 - DNA, 22 bp, Homo sapiens
cactctgggctcttgtttcaga

SEQ ID NO: 9055251 - DNA, 22 bp, Homo sapiens
caccagggctctgagctctgaa

SEQ ID NO: 9055252 - DNA, 22 bp, Homo sapiens
atttattatgggatttggctca

SEQ ID NO: 9055253 - DNA, 22 bp, Homo sapiens
atttagtaagtacttgttgaat

SEQ ID NO: 9055254 - DNA, 22 bp, Homo sapiens
atttattattgtggttacttct

SEQ ID NO: 9055255 - DNA, 22 bp, Homo sapiens
atttattattgtggttacttct

SEQ ID NO: 9055256 - DNA, 22 bp, Homo sapiens
atttattctccagatggcgaga

SEQ ID NO: 9055257 - DNA, 22 bp, Homo sapiens
agagtggggaaggtgttgagaa

SEQ ID NO: 9055258 - DNA, 22 bp, Homo sapiens
agagtgggcctctgagtcccag

SEQ ID NO: 9055259 - DNA, 22 bp, Homo sapiens
agagtgggcaggagcctcgact

SEQ ID NO: 9055260 - DNA, 22 bp, Homo sapiens
agagtgggcctagctgtaaaag

SEQ ID NO: 9055261 - DNA, 22 bp, Homo sapiens
agagtgggacacgggcgctgtc

SEQ ID NO: 9055262 - DNA, 22 bp, Homo sapiens
atttagcaaaaaatgatgaagc

SEQ ID NO: 9055263 - DNA, 22 bp, Homo sapiens
agagtggggacagggcctgtcc

SEQ ID NO: 9055264 - DNA, 22 bp, Homo sapiens
atttagacaccagcttgtaagg

SEQ ID NO: 9055265 - DNA, 22 bp, Homo sapiens
atttagacatgtatctgatagc

SEQ ID NO: 9055266 - DNA, 22 bp, Homo sapiens
atttaagactgacttcaccagt

SEQ ID NO: 9055267 - DNA, 22 bp, Homo sapiens
attgttaataactattacattg

SEQ ID NO: 9055268 - DNA, 18 bp, Homo sapiens
atttaatgaactgaaagc

SEQ ID NO: 9055269 - DNA, 22 bp, Homo sapiens
atttaatgggtagacattgtta

SEQ ID NO: 9055270 - DNA, 22 bp, Homo sapiens
agagggtgggcacgtgatggat

SEQ ID NO: 9055271 - DNA, 22 bp, Homo sapiens
agatgaaagatttttatagaga

SEQ ID NO: 9055272 - DNA, 22 bp, Homo sapiens
agatgaaagatttttatagaga

SEQ ID NO: 9055273 - DNA, 22 bp, Homo sapiens
agatgaaagatttttatagaga

SEQ ID NO: 9055274 - DNA, 22 bp, Homo sapiens
agatgaaaagataagcagcaat

SEQ ID NO: 9055275 - DNA, 22 bp, Homo sapiens
agatgacaaatcaggggacggg

SEQ ID NO: 9055276 - DNA, 22 bp, Homo sapiens
agatgacaaatcaggggacggg

SEQ ID NO: 9055277 - DNA, 22 bp, Homo sapiens
agatgaagatatctgcaggggc

SEQ ID NO: 9055278 - DNA, 22 bp, Homo sapiens
agatgaagactcaggagcaggt

SEQ ID NO: 9055279 - DNA, 22 bp, Homo sapiens
agatgaaatttgtgttgagttg

SEQ ID NO: 9055280 - DNA, 23 bp, Homo sapiens
agatgaaagcttcccatcacagt

SEQ ID NO: 9055281 - DNA, 23 bp, Homo sapiens
agatgaaagcttcccatcacagt

SEQ ID NO: 9055282 - DNA, 19 bp, Homo sapiens
atttccaagaattggagag

SEQ ID NO: 9055283 - DNA, 22 bp, Homo sapiens
atttccaatttcatccatgtcc

SEQ ID NO: 9055284 - DNA, 22 bp, Homo sapiens
atttccaatctctgcatatggg

SEQ ID NO: 9055285 - DNA, 22 bp, Homo sapiens
agatgtgaatgaattctgctgg

SEQ ID NO: 9055286 - DNA, 22 bp, Homo sapiens
agatgtgagaatcaagtgacca

SEQ ID NO: 9055287 - DNA, 20 bp, Homo sapiens
agcaaacaggctccaccaga

SEQ ID NO: 9055288 - DNA, 22 bp, Homo sapiens
agcaaacagtgtgctaagaaat

SEQ ID NO: 9055289 - DNA, 22 bp, Homo sapiens
agatttcagatgctcggcagtt

SEQ ID NO: 9055290 - DNA, 22 bp, Homo sapiens
agatttcaggttggggcagaag

SEQ ID NO: 9055291 - DNA, 22 bp, Homo sapiens
attcaaagcccagtaaacattg

SEQ ID NO: 9055292 - DNA, 22 bp, Homo sapiens
attcacaattagaagtagataa

SEQ ID NO: 9055293 - DNA, 22 bp, Homo sapiens
attataaatattttctaggggt

SEQ ID NO: 9055294 - DNA, 22 bp, Homo sapiens
attataaacctttgagggtggg

SEQ ID NO: 9055295 - DNA, 22 bp, Homo sapiens
attataaagaacatgtgtgtgg

SEQ ID NO: 9055296 - DNA, 22 bp, Homo sapiens
attcacagttcattagctgtaa

SEQ ID NO: 9055297 - DNA, 22 bp, Homo sapiens
attcagcaaacatttattatct

SEQ ID NO: 9055298 - DNA, 22 bp, Homo sapiens
attcagattcctaggtttcatt

SEQ ID NO: 9055299 - DNA, 22 bp, Homo sapiens
attcagcacaatttggccaata

SEQ ID NO: 9055300 - DNA, 22 bp, Homo sapiens
attcagcaagctatgggacagg

SEQ ID NO: 9055301 - DNA, 22 bp, Homo sapiens
attcagcattcattatgcgcca

SEQ ID NO: 9055302 - DNA, 22 bp, Homo sapiens
attcagctaagtgcttcatgct

SEQ ID NO: 9055303 - DNA, 22 bp, Homo sapiens
attcagcattggcaccatggat

SEQ ID NO: 9055304 - DNA, 22 bp, Homo sapiens
attcagctgatggtatttaaat

SEQ ID NO: 9055305 - DNA, 22 bp, Homo sapiens
attcagcttcaatgtcttcacc

SEQ ID NO: 9055306 - DNA, 22 bp, Homo sapiens
agagggagtgaaatggaataga

SEQ ID NO: 9055307 - DNA, 22 bp, Homo sapiens
agagggcagcagcaacaactct

SEQ ID NO: 9055308 - DNA, 22 bp, Homo sapiens
attaaagacagcagatggatgg

SEQ ID NO: 9055309 - DNA, 22 bp, Homo sapiens
attaaagaaacccagcatgtga

SEQ ID NO: 9055310 - DNA, 22 bp, Homo sapiens
atgtttgttgatcatttatgaa

SEQ ID NO: 9055311 - DNA, 22 bp, Homo sapiens
atgtttgttgaatgaagaaagg

SEQ ID NO: 9055312 - DNA, 22 bp, Homo sapiens
atgtttgttgaacatctactgc

SEQ ID NO: 9055313 - DNA, 22 bp, Homo sapiens
atgtttgtgtttgctatgcggt

SEQ ID NO: 9055314 - DNA, 22 bp, Homo sapiens
atgtttgtgtttcccattcagg

SEQ ID NO: 9055315 - DNA, 22 bp, Homo sapiens
atgtttgtccctgacatcctct

SEQ ID NO: 9055316 - DNA, 22 bp, Homo sapiens
atgtttgtaggtaagtgacact

SEQ ID NO: 9055317 - DNA, 22 bp, Homo sapiens
atgtttgtcaggattgtaatta

SEQ ID NO: 9055318 - DNA, 22 bp, Homo sapiens
atgtttgtgggataaacaaatg

SEQ ID NO: 9055319 - DNA, 22 bp, Homo sapiens
atgtttgtgttacactctgcag

SEQ ID NO: 9055320 - DNA, 22 bp, Homo sapiens
attaaagttgaaattgaactga

SEQ ID NO: 9055321 - DNA, 22 bp, Homo sapiens
attagatgtgtttaagtagaga

SEQ ID NO: 9055322 - DNA, 22 bp, Homo sapiens
attagcaaggttcatgagaaga

SEQ ID NO: 9055323 - DNA, 22 bp, Homo sapiens
attagcatattaaatagtcatt

SEQ ID NO: 9055324 - DNA, 22 bp, Homo sapiens
attagcacataagaggtatagg

SEQ ID NO: 9055325 - DNA, 22 bp, Homo sapiens
attagctatatgctatgtgcca

SEQ ID NO: 9055326 - DNA, 22 bp, Homo sapiens
attagctatcaaaggttaatga

SEQ ID NO: 9055327 - DNA, 22 bp, Homo sapiens
atgttaaataatcccttaaagc

SEQ ID NO: 9055328 - DNA, 22 bp, Homo sapiens
atgtcttctaagctctaagctg

SEQ ID NO: 9055329 - DNA, 22 bp, Homo sapiens
agaatacatcaatctattttct

SEQ ID NO: 9055330 - DNA, 22 bp, Homo sapiens
agaatacatcaatctattttct

SEQ ID NO: 9055331 - DNA, 22 bp, Homo sapiens
agaatacatctagtgctgcatg

SEQ ID NO: 9055332 - DNA, 20 bp, Homo sapiens
atctttgtctctgtagttgt

SEQ ID NO: 9055333 - DNA, 22 bp, Homo sapiens
atctttgtgctaatgtagttct

SEQ ID NO: 9055334 - DNA, 22 bp, Homo sapiens
atctttatatatctcctctgaa

SEQ ID NO: 9055335 - DNA, 22 bp, Homo sapiens
atctttagattagaaactctaa

SEQ ID NO: 9055336 - DNA, 22 bp, Homo sapiens
atcttagggttctgtttttaag

SEQ ID NO: 9055337 - DNA, 22 bp, Homo sapiens
atcttattgctgttgccagata

SEQ ID NO: 9055338 - DNA, 22 bp, Homo sapiens
agaagagaactgccaaacactt

SEQ ID NO: 9055339 - DNA, 22 bp, Homo sapiens
agaagacagagtctacattcta

SEQ ID NO: 9055340 - DNA, 17 bp, Homo sapiens
agaatgcaaagcaggct

SEQ ID NO: 9055341 - DNA, 22 bp, Homo sapiens
agaatgcaaatgatcccacaca

SEQ ID NO: 9055342 - DNA, 22 bp, Homo sapiens
agaatgcagtttgaaataaggt

SEQ ID NO: 9055343 - DNA, 22 bp, Homo sapiens
agaatgcagtttgaaataaggt

SEQ ID NO: 9055344 - DNA, 22 bp, Homo sapiens
agaatgataatgccatgatgga

SEQ ID NO: 9055345 - DNA, 22 bp, Homo sapiens
agaatgatactctatgccaaat

SEQ ID NO: 9055346 - DNA, 22 bp, Homo sapiens
agaatgattttggacaatatgg

SEQ ID NO: 9055347 - DNA, 22 bp, Homo sapiens
agacacagaagttgctgttggg

SEQ ID NO: 9055348 - DNA, 22 bp, Homo sapiens
agacacagattttggaaaagat

SEQ ID NO: 9055349 - DNA, 22 bp, Homo sapiens
agacacagcaataactactgtt

SEQ ID NO: 9055350 - DNA, 22 bp, Homo sapiens
agacacagatggtacctgagcc

SEQ ID NO: 9055351 - DNA, 19 bp, Homo sapiens
agacacacttgatatgtgt

SEQ ID NO: 9055352 - DNA, 22 bp, Homo sapiens
agacacagaacacaaaagcata

SEQ ID NO: 9055353 - DNA, 22 bp, Homo sapiens
agacacagtgagtttctttccc

SEQ ID NO: 9055354 - DNA, 22 bp, Homo sapiens
agacacagtttgggatgggttg

SEQ ID NO: 9055355 - DNA, 22 bp, Homo sapiens
agacacagtgctgggtgctgag

SEQ ID NO: 9055356 - DNA, 22 bp, Homo sapiens
agacacagtgttgaaggctagt

SEQ ID NO: 9055357 - DNA, 22 bp, Homo sapiens
agacacataggaccacactgtg

SEQ ID NO: 9055358 - DNA, 21 bp, Homo sapiens
agacacaggggttgctggggt

SEQ ID NO: 9055359 - DNA, 22 bp, Homo sapiens
agacacaggattctgcatttct

SEQ ID NO: 9055360 - DNA, 22 bp, Homo sapiens
agacacagctaccataatacca

SEQ ID NO: 9055361 - DNA, 22 bp, Homo sapiens
agacacagcagtgcctgcctca

SEQ ID NO: 9055362 - DNA, 22 bp, Homo sapiens
agacacagctgcaggaggtggg

SEQ ID NO: 9055363 - DNA, 22 bp, Homo sapiens
agacacagtataagcacaacaa

SEQ ID NO: 9055364 - DNA, 22 bp, Homo sapiens
agacacagtctgtctggaggag

SEQ ID NO: 9055365 - DNA, 22 bp, Homo sapiens
agacacagtacttgccctcatg

SEQ ID NO: 9055366 - DNA, 22 bp, Homo sapiens
agacacaggtgtaatttctgct

SEQ ID NO: 9055367 - DNA, 22 bp, Homo sapiens
agacacaggtgtaatttctgct

SEQ ID NO: 9055368 - DNA, 22 bp, Homo sapiens
atgcagggaggtaagaggtgcc

SEQ ID NO: 9055369 - DNA, 22 bp, Homo sapiens
atgcagggacctttgctttggt

SEQ ID NO: 9055370 - DNA, 22 bp, Homo sapiens
atgcagggaaaagagatattat

SEQ ID NO: 9055371 - DNA, 23 bp, Homo sapiens
atgcagggttacagggctgactt

SEQ ID NO: 9055372 - DNA, 22 bp, Homo sapiens
atgcagggtctccgtgtgacga

SEQ ID NO: 9055373 - DNA, 22 bp, Homo sapiens
atgcagggttatttcaaaaata

SEQ ID NO: 9055374 - DNA, 22 bp, Homo sapiens
atgcaggggcagcagagcctgg

SEQ ID NO: 9055375 - DNA, 22 bp, Homo sapiens
atgcagggcagagtacgttagc

SEQ ID NO: 9055376 - DNA, 22 bp, Homo sapiens
atgcagggattaaatgactgcc

SEQ ID NO: 9055377 - DNA, 22 bp, Homo sapiens
atgcaggggccgcctggccagg

SEQ ID NO: 9055378 - DNA, 22 bp, Homo sapiens
atgcaggggctgtgttttgggt

SEQ ID NO: 9055379 - DNA, 22 bp, Homo sapiens
atggaaaaggctgatttcatta

SEQ ID NO: 9055380 - DNA, 22 bp, Homo sapiens
atggaaaagggtctttcatttc

SEQ ID NO: 9055381 - DNA, 19 bp, Homo sapiens
atggaaaatgccagactga

SEQ ID NO: 9055382 - DNA, 19 bp, Homo sapiens
atggaaaattgtactcaat

SEQ ID NO: 9055383 - DNA, 22 bp, Homo sapiens
agactccttctcactgcctgta

SEQ ID NO: 9055384 - DNA, 22 bp, Homo sapiens
agactaagcggttcttttcaat

SEQ ID NO: 9055385 - DNA, 22 bp, Homo sapiens
agactaaattgggatgtgttgt

SEQ ID NO: 9055386 - DNA, 22 bp, Homo sapiens
agacggattacctgaggtcagg

SEQ ID NO: 9055387 - DNA, 22 bp, Homo sapiens
atggaaatatctttagagctta

SEQ ID NO: 9055388 - DNA, 22 bp, Homo sapiens
atggcagatggctggagcaggt

SEQ ID NO: 9055389 - DNA, 22 bp, Homo sapiens
atggagtttggggtcaaatact

SEQ ID NO: 9055390 - DNA, 22 bp, Homo sapiens
atggagttctttaaattcacag

SEQ ID NO: 9055391 - DNA, 18 bp, Homo sapiens
atggctcaggaatggctt

SEQ ID NO: 9055392 - DNA, 22 bp, Homo sapiens
atggctcagcgcctttctgtgg

SEQ ID NO: 9055393 - DNA, 22 bp, Homo sapiens
atgtcttcatagcttatatcca

SEQ ID NO: 9055394 - DNA, 22 bp, Homo sapiens
atgtacacacacatctttgcgt

SEQ ID NO: 9055395 - DNA, 20 bp, Homo sapiens
atgtaaaattataaggctga

SEQ ID NO: 9055396 - DNA, 22 bp, Homo sapiens
atggttttatttctctatagct

SEQ ID NO: 9055397 - DNA, 22 bp, Homo sapiens
actaaagatgtctaaatatatt

SEQ ID NO: 9055398 - DNA, 22 bp, Homo sapiens
actaaagaagccaaagttttct

SEQ ID NO: 9055399 - DNA, 22 bp, Homo sapiens
actaaaaactactgccaatagc

SEQ ID NO: 9055400 - DNA, 23 bp, Homo sapiens
acgggagggctgtttgcttggtg

SEQ ID NO: 9055401 - DNA, 22 bp, Homo sapiens
accttaaaggccgaagtaaaga

SEQ ID NO: 9055402 - DNA, 22 bp, Homo sapiens
accttaaaggccgaagtaaaga

SEQ ID NO: 9055403 - DNA, 22 bp, Homo sapiens
accttaaaggccgaagtaaaga

SEQ ID NO: 9055404 - DNA, 22 bp, Homo sapiens
actatttactcaaatgaggttg

SEQ ID NO: 9055405 - DNA, 22 bp, Homo sapiens
actcaacagggaacaagatcag

SEQ ID NO: 9055406 - DNA, 22 bp, Homo sapiens
actatgtacccaaagatctgat

SEQ ID NO: 9055407 - DNA, 22 bp, Homo sapiens
actatgtaaactggcgtgggag

SEQ ID NO: 9055408 - DNA, 22 bp, Homo sapiens
actatgtatactagatgtgtaa

SEQ ID NO: 9055409 - DNA, 22 bp, Homo sapiens
actatgtaggctcaacttccac

SEQ ID NO: 9055410 - DNA, 22 bp, Homo sapiens
actatgtattgtatgggctggt

SEQ ID NO: 9055411 - DNA, 22 bp, Homo sapiens
actatacattgaatgttaaggt

SEQ ID NO: 9055412 - DNA, 20 bp, Homo sapiens
agggtggggacgttctgact

SEQ ID NO: 9055413 - DNA, 22 bp, Homo sapiens
acctgtggatcagattcttgta

SEQ ID NO: 9055414 - DNA, 22 bp, Homo sapiens
acctgcttgagccagtatgaga

SEQ ID NO: 9055415 - DNA, 22 bp, Homo sapiens
actgaagcacatttgccatgaa

SEQ ID NO: 9055416 - DNA, 22 bp, Homo sapiens
actgaagcttgggtggaactta

SEQ ID NO: 9055417 - DNA, 22 bp, Homo sapiens
actgaaatgaaatctatcatct

SEQ ID NO: 9055418 - DNA, 22 bp, Homo sapiens
agtctgggagaaggtgagatta

SEQ ID NO: 9055419 - DNA, 22 bp, Homo sapiens
agtctggggtctggtagaacga

SEQ ID NO: 9055420 - DNA, 22 bp, Homo sapiens
actccaggaaacttaggggaaa

SEQ ID NO: 9055421 - DNA, 22 bp, Homo sapiens
actccaggcatctgcttctgct

SEQ ID NO: 9055422 - DNA, 22 bp, Homo sapiens
actccagggaggtgagtgtgcg

SEQ ID NO: 9055423 - DNA, 22 bp, Homo sapiens
actccacatttgaacacagttc

SEQ ID NO: 9055424 - DNA, 22 bp, Homo sapiens
actccacatttgaacacagttc

SEQ ID NO: 9055425 - DNA, 22 bp, Homo sapiens
actccaaggccacatgcattcc

SEQ ID NO: 9055426 - DNA, 22 bp, Homo sapiens
agtctctggactgggagatggc

SEQ ID NO: 9055427 - DNA, 22 bp, Homo sapiens
agtggctgctggagtggagatg

SEQ ID NO: 9055428 - DNA, 22 bp, Homo sapiens
actgctctgttttcatatgttt

SEQ ID NO: 9055429 - DNA, 22 bp, Homo sapiens
actgctctctttgcaggggcta

SEQ ID NO: 9055430 - DNA, 22 bp, Homo sapiens
actgcttacccggcctgacttc

SEQ ID NO: 9055431 - DNA, 20 bp, Homo sapiens
actgcttctttctctgacct

SEQ ID NO: 9055432 - DNA, 22 bp, Homo sapiens
actgcacaaggcctggacacac

SEQ ID NO: 9055433 - DNA, 21 bp, Homo sapiens
actgcacactatgtgaattga

SEQ ID NO: 9055434 - DNA, 22 bp, Homo sapiens
actgcacagaaccttagaatat

SEQ ID NO: 9055435 - DNA, 22 bp, Homo sapiens
actgcacagaagaaactatcaa

SEQ ID NO: 9055436 - DNA, 22 bp, Homo sapiens
actgcaaagggaagccctttct

SEQ ID NO: 9055437 - DNA, 22 bp, Homo sapiens
actgcaaagggaagccctttct

SEQ ID NO: 9055438 - DNA, 22 bp, Homo sapiens
actgcaaacatagtacttgagc

SEQ ID NO: 9055439 - DNA, 22 bp, Homo sapiens
actgcaaaaatgggtgcattca

SEQ ID NO: 9055440 - DNA, 22 bp, Homo sapiens
atcattgaatataagtgctatt

SEQ ID NO: 9055441 - DNA, 22 bp, Homo sapiens
atcatttacaaactcagcattg

SEQ ID NO: 9055442 - DNA, 22 bp, Homo sapiens
atcatttacaatgaaagcctga

SEQ ID NO: 9055443 - DNA, 22 bp, Homo sapiens
atcatttagtggggcattggaa

SEQ ID NO: 9055444 - DNA, 20 bp, Homo sapiens
atcagcaactgccactcagt

SEQ ID NO: 9055445 - DNA, 22 bp, Homo sapiens
atccagctttgtctggtcttcg

SEQ ID NO: 9055446 - DNA, 22 bp, Homo sapiens
agaacctttctttagaaattca

SEQ ID NO: 9055447 - DNA, 22 bp, Homo sapiens
atcatttgtgcatagtaacaga

SEQ ID NO: 9055448 - DNA, 22 bp, Homo sapiens
atccactctcccattcatgcat

SEQ ID NO: 9055449 - DNA, 22 bp, Homo sapiens
atcatttatgccccaattagat

SEQ ID NO: 9055450 - DNA, 19 bp, Homo sapiens
atcacctggtgtttccttg

SEQ ID NO: 9055451 - DNA, 20 bp, Homo sapiens
atcacctgtaggttctttgt

SEQ ID NO: 9055452 - DNA, 22 bp, Homo sapiens
atcacctgcacaaatgtgttcc

SEQ ID NO: 9055453 - DNA, 22 bp, Homo sapiens
atcacctggccattgggttaac

SEQ ID NO: 9055454 - DNA, 22 bp, Homo sapiens
atcactgaaatactgaaattac

SEQ ID NO: 9055455 - DNA, 22 bp, Homo sapiens
atcaccagtaagttttcagttt

SEQ ID NO: 9055456 - DNA, 22 bp, Homo sapiens
atcactgggcttctaatcactg

SEQ ID NO: 9055457 - DNA, 22 bp, Homo sapiens
agaaacatttagattatatgtc

SEQ ID NO: 9055458 - DNA, 21 bp, Homo sapiens
agaaacatgatcaaaggaacc

SEQ ID NO: 9055459 - DNA, 22 bp, Homo sapiens
agaaacatattcagtgagtaat

SEQ ID NO: 9055460 - DNA, 22 bp, Homo sapiens
agaaacatcattggaacacaag

SEQ ID NO: 9055461 - DNA, 22 bp, Homo sapiens
agaaacagaagggaaagctttt

SEQ ID NO: 9055462 - DNA, 20 bp, Homo sapiens
agaaacagcacaattctgtt

SEQ ID NO: 9055463 - DNA, 22 bp, Homo sapiens
atatacaaagggcaacctcgct

SEQ ID NO: 9055464 - DNA, 22 bp, Homo sapiens
atatacacatctttttaaatat

SEQ ID NO: 9055465 - DNA, 22 bp, Homo sapiens
atatatttgagaatattcatga

SEQ ID NO: 9055466 - DNA, 22 bp, Homo sapiens
atatatttgagaatattcatga

SEQ ID NO: 9055467 - DNA, 22 bp, Homo sapiens
atatccagcagcaggtgagtat

SEQ ID NO: 9055468 - DNA, 22 bp, Homo sapiens
agaaacaaggtgtaggttgacc

SEQ ID NO: 9055469 - DNA, 22 bp, Homo sapiens
atatgaaaatgttttagctgta

SEQ ID NO: 9055470 - DNA, 22 bp, Homo sapiens
atatgaaaatgttttagctgta

SEQ ID NO: 9055471 - DNA, 22 bp, Homo sapiens
agaaaataaattgatggtggaa

SEQ ID NO: 9055472 - DNA, 21 bp, Homo sapiens
agtttcctcaactgcagaagg

SEQ ID NO: 9055473 - DNA, 22 bp, Homo sapiens
agtttccttgggcatttgttta

SEQ ID NO: 9055474 - DNA, 22 bp, Homo sapiens
agtttcctgggagattcttaca

SEQ ID NO: 9055475 - DNA, 17 bp, Homo sapiens
actgtcttttacaccct

SEQ ID NO: 9055476 - DNA, 22 bp, Homo sapiens
actgtcatgatcgaagatgtca

SEQ ID NO: 9055477 - DNA, 22 bp, Homo sapiens
actgtaaattacataagaacag

SEQ ID NO: 9055478 - DNA, 22 bp, Homo sapiens
actgtcatcttgtaagcaatgt

SEQ ID NO: 9055479 - DNA, 22 bp, Homo sapiens
actgtcatgacgtttgtcaccc

SEQ ID NO: 9055480 - DNA, 22 bp, Homo sapiens
actgtaaaggtgattagaagtt

SEQ ID NO: 9055481 - DNA, 22 bp, Homo sapiens
agtttacccactgttgaaatta

SEQ ID NO: 9055482 - DNA, 22 bp, Homo sapiens
agtttacttgaatgatgaattc

SEQ ID NO: 9055483 - DNA, 22 bp, Homo sapiens
agtttacataaaaaggcagagg

SEQ ID NO: 9055484 - DNA, 22 bp, Homo sapiens
acttgatttttataataaatgg

SEQ ID NO: 9055485 - DNA, 22 bp, Homo sapiens
acttgattttgaacctttctac

SEQ ID NO: 9055486 - DNA, 22 bp, Homo sapiens
acttcatgttgtttacaactta

SEQ ID NO: 9055487 - DNA, 22 bp, Homo sapiens
acttccaaagaagtgattacag

SEQ ID NO: 9055488 - DNA, 23 bp, Homo sapiens
acttcatggcactgtcttagagg

SEQ ID NO: 9055489 - DNA, 22 bp, Homo sapiens
acttgcatttaaatattgaata

SEQ ID NO: 9055490 - DNA, 22 bp, Homo sapiens
acttgcatgtcaggaaattaac

SEQ ID NO: 9055491 - DNA, 22 bp, Homo sapiens
actgttacagggcactgaacat

SEQ ID NO: 9055492 - DNA, 22 bp, Homo sapiens
actgttacagagcaggaaattg

SEQ ID NO: 9055493 - DNA, 22 bp, Homo sapiens
actgtgtgggccgctcactggg

SEQ ID NO: 9055494 - DNA, 22 bp, Homo sapiens
acttatttcatggatcataatg

SEQ ID NO: 9055495 - DNA, 22 bp, Homo sapiens
actgttatgttattacccatgt

SEQ ID NO: 9055496 - DNA, 19 bp, Homo sapiens
acttcaaatcttagagaaa

SEQ ID NO: 9055497 - DNA, 17 bp, Homo sapiens
acttcaagttcagtgac

SEQ ID NO: 9055498 - DNA, 22 bp, Homo sapiens
aggctagctgtttcagggctag

SEQ ID NO: 9055499 - DNA, 22 bp, Homo sapiens
aggctatttccactcttctcat

SEQ ID NO: 9055500 - DNA, 19 bp, Homo sapiens
acatttaaattcagatctc

SEQ ID NO: 9055501 - DNA, 22 bp, Homo sapiens
acatttaaccaaactgtttaat

SEQ ID NO: 9055502 - DNA, 22 bp, Homo sapiens
acatttaacctttgaggaactg

SEQ ID NO: 9055503 - DNA, 22 bp, Homo sapiens
acatttaagttaaaacctcagt

SEQ ID NO: 9055504 - DNA, 22 bp, Homo sapiens
acatttaagttaaaacctcagt

SEQ ID NO: 9055505 - DNA, 22 bp, Homo sapiens
aggcgcagacatacagggtctg

SEQ ID NO: 9055506 - DNA, 22 bp, Homo sapiens
aggcgcagaaggccaggggcct

SEQ ID NO: 9055507 - DNA, 22 bp, Homo sapiens
acatttacagtgctagacaatc

SEQ ID NO: 9055508 - DNA, 21 bp, Homo sapiens
acatgagacacacatatatgt

SEQ ID NO: 9055509 - DNA, 22 bp, Homo sapiens
acatgacttttctcttccagag

SEQ ID NO: 9055510 - DNA, 22 bp, Homo sapiens
acatgaaagttattctgagttg

SEQ ID NO: 9055511 - DNA, 22 bp, Homo sapiens
acatgaaagttattctgagttg

SEQ ID NO: 9055512 - DNA, 22 bp, Homo sapiens
aggcagggctgggattagactc

SEQ ID NO: 9055513 - DNA, 22 bp, Homo sapiens
acatgaggaactcaggagtcac

SEQ ID NO: 9055514 - DNA, 22 bp, Homo sapiens
acatgaggtgctataggtctac

SEQ ID NO: 9055515 - DNA, 22 bp, Homo sapiens
acatgatcttatgtagaagatc

SEQ ID NO: 9055516 - DNA, 22 bp, Homo sapiens
acatgatcccacctgcctataa

SEQ ID NO: 9055517 - DNA, 22 bp, Homo sapiens
acatgatctgacttgcttttta

SEQ ID NO: 9055518 - DNA, 22 bp, Homo sapiens
acatgcaaatgtgcatgcatgt

SEQ ID NO: 9055519 - DNA, 22 bp, Homo sapiens
acatgcacacctatatacatgt

SEQ ID NO: 9055520 - DNA, 22 bp, Homo sapiens
acatgcacacgattcagtctgg

SEQ ID NO: 9055521 - DNA, 22 bp, Homo sapiens
aggcccttaggacccctgcgtg

SEQ ID NO: 9055522 - DNA, 22 bp, Homo sapiens
acatggcaaaagggactttaca

SEQ ID NO: 9055523 - DNA, 22 bp, Homo sapiens
agggcctgggccagcacccttt

SEQ ID NO: 9055524 - DNA, 22 bp, Homo sapiens
agggcctggggtagcttactgc

SEQ ID NO: 9055525 - DNA, 22 bp, Homo sapiens
agggcctgggtctgtactcctc

SEQ ID NO: 9055526 - DNA, 22 bp, Homo sapiens
acccacacatctctaattcagt

SEQ ID NO: 9055527 - DNA, 22 bp, Homo sapiens
acccacacctccgtatatcact

SEQ ID NO: 9055528 - DNA, 22 bp, Homo sapiens
agggagctctttggtcttgccg

SEQ ID NO: 9055529 - DNA, 22 bp, Homo sapiens
agggagctctttggtcttgccg

SEQ ID NO: 9055530 - DNA, 22 bp, Homo sapiens
agggagctattgtgttactttg

SEQ ID NO: 9055531 - DNA, 22 bp, Homo sapiens
agggagctaggatcctgaaggt

SEQ ID NO: 9055532 - DNA, 23 bp, Homo sapiens
agggagctaaaaggctggagcag

SEQ ID NO: 9055533 - DNA, 22 bp, Homo sapiens
agggagccttcctggctgtggt

SEQ ID NO: 9055534 - DNA, 17 bp, Homo sapiens
agggacagcagtttagg

SEQ ID NO: 9055535 - DNA, 22 bp, Homo sapiens
agggacagatgaatgactgagt

SEQ ID NO: 9055536 - DNA, 22 bp, Homo sapiens
accaaaacctgctactaaagga

SEQ ID NO: 9055537 - DNA, 22 bp, Homo sapiens
accaaacttctgggctcctttg

SEQ ID NO: 9055538 - DNA, 22 bp, Homo sapiens
acatttttctaggaggcaaggt

SEQ ID NO: 9055539 - DNA, 22 bp, Homo sapiens
acagctcctggggctttaatgg

SEQ ID NO: 9055540 - DNA, 22 bp, Homo sapiens
acagctctccctcagagaaatg

SEQ ID NO: 9055541 - DNA, 22 bp, Homo sapiens
acagctctgagatattactatt

SEQ ID NO: 9055542 - DNA, 22 bp, Homo sapiens
acagctctgagatattactatt

SEQ ID NO: 9055543 - DNA, 22 bp, Homo sapiens
acagctcactcacagggctagt

SEQ ID NO: 9055544 - DNA, 22 bp, Homo sapiens
acagccttgtagcatcttagcc

SEQ ID NO: 9055545 - DNA, 21 bp, Homo sapiens
acagccttgtgatggagacag

SEQ ID NO: 9055546 - DNA, 22 bp, Homo sapiens
acagcctttaaccatttcttcc

SEQ ID NO: 9055547 - DNA, 16 bp, Homo sapiens
acagccttcttctttg

SEQ ID NO: 9055548 - DNA, 22 bp, Homo sapiens
acagccttgagctcaaaaggaa

SEQ ID NO: 9055549 - DNA, 22 bp, Homo sapiens
acagccttctgtgtgtgtacaa

SEQ ID NO: 9055550 - DNA, 23 bp, Homo sapiens
acagccttctggggcttctgggc

SEQ ID NO: 9055551 - DNA, 22 bp, Homo sapiens
acagccttgggttctctggggg

SEQ ID NO: 9055552 - DNA, 22 bp, Homo sapiens
acagccttgcttatttgtctct

SEQ ID NO: 9055553 - DNA, 22 bp, Homo sapiens
acagccttgatattaattgtct

SEQ ID NO: 9055554 - DNA, 22 bp, Homo sapiens
aggaatgtcatagaataatcat

SEQ ID NO: 9055555 - DNA, 22 bp, Homo sapiens
aggaatgtaaatctagatttta

SEQ ID NO: 9055556 - DNA, 22 bp, Homo sapiens
aggaatgtaatagtgtggctca

SEQ ID NO: 9055557 - DNA, 22 bp, Homo sapiens
agctttatgcttcctacaagct

SEQ ID NO: 9055558 - DNA, 22 bp, Homo sapiens
agctttatgggagcttagataa

SEQ ID NO: 9055559 - DNA, 22 bp, Homo sapiens
agctttatgggagcttagataa

SEQ ID NO: 9055560 - DNA, 22 bp, Homo sapiens
acagctgtgggctctgcatata

SEQ ID NO: 9055561 - DNA, 22 bp, Homo sapiens
acagctgtggccacttgcatcc

SEQ ID NO: 9055562 - DNA, 22 bp, Homo sapiens
acagctgtgatttctatcatga

SEQ ID NO: 9055563 - DNA, 22 bp, Homo sapiens
acagctgtggggactcttgccc

SEQ ID NO: 9055564 - DNA, 22 bp, Homo sapiens
agctttatcttcacctgggaat

SEQ ID NO: 9055565 - DNA, 22 bp, Homo sapiens
agctttatcccttgcccatcga

SEQ ID NO: 9055566 - DNA, 22 bp, Homo sapiens
agctttatgaggagaccttagt

SEQ ID NO: 9055567 - DNA, 22 bp, Homo sapiens
agctttatcagaggagtctcta

SEQ ID NO: 9055568 - DNA, 22 bp, Homo sapiens
agctttatcacaatattggcta

SEQ ID NO: 9055569 - DNA, 22 bp, Homo sapiens
agctttatcacaatattggcta

SEQ ID NO: 9055570 - DNA, 22 bp, Homo sapiens
agctttatatttaatgaattct

SEQ ID NO: 9055571 - DNA, 22 bp, Homo sapiens
acagtacaagcaatgcattttt

SEQ ID NO: 9055572 - DNA, 18 bp, Homo sapiens
acagggatggggtaagtg

SEQ ID NO: 9055573 - DNA, 22 bp, Homo sapiens
acagggattatgactgacagcc

SEQ ID NO: 9055574 - DNA, 22 bp, Homo sapiens
acagggagtgcaattcatattg

SEQ ID NO: 9055575 - DNA, 18 bp, Homo sapiens
acagggagggcgctgggg

SEQ ID NO: 9055576 - DNA, 22 bp, Homo sapiens
acagggagtctgaggggatagt

SEQ ID NO: 9055577 - DNA, 22 bp, Homo sapiens
aggagctgttttgttcagcaaa

SEQ ID NO: 9055578 - DNA, 21 bp, Homo sapiens
aggagctgtgtgcttcctttc

SEQ ID NO: 9055579 - DNA, 21 bp, Homo sapiens
aggagctgtgttagctggtcg

SEQ ID NO: 9055580 - DNA, 22 bp, Homo sapiens
aggagctggagtccaggcaagt

SEQ ID NO: 9055581 - DNA, 22 bp, Homo sapiens
acagtgttctgctttttaatcc

SEQ ID NO: 9055582 - DNA, 22 bp, Homo sapiens
acagtgttttagaaaagcttga

SEQ ID NO: 9055583 - DNA, 20 bp, Homo sapiens
acagtgtttttgagtagagc

SEQ ID NO: 9055584 - DNA, 22 bp, Homo sapiens
acagtgttttgtctggcagggc

SEQ ID NO: 9055585 - DNA, 22 bp, Homo sapiens
acagtgttttcttaaggagaaa

SEQ ID NO: 9055586 - DNA, 22 bp, Homo sapiens
acagtgttttatgagaattgtt

SEQ ID NO: 9055587 - DNA, 22 bp, Homo sapiens
acagtgatcagttactgtctgt

SEQ ID NO: 9055588 - DNA, 22 bp, Homo sapiens
acagttatctttgaaatagaga

SEQ ID NO: 9055589 - DNA, 22 bp, Homo sapiens
acagttaataagtagtaagtca

SEQ ID NO: 9055590 - DNA, 22 bp, Homo sapiens
acagttaagcagtatgatcaca

SEQ ID NO: 9055591 - DNA, 22 bp, Homo sapiens
acataaaggtgactaacatctt

SEQ ID NO: 9055592 - DNA, 22 bp, Homo sapiens
aggcaggcacacttcctccagg

SEQ ID NO: 9055593 - DNA, 22 bp, Homo sapiens
acagtcttcccttattccactc

SEQ ID NO: 9055594 - DNA, 22 bp, Homo sapiens
acagtcttatgcatacactatt

SEQ ID NO: 9055595 - DNA, 22 bp, Homo sapiens
acagtgttcttgatattacagt

SEQ ID NO: 9055596 - DNA, 22 bp, Homo sapiens
acagtgttcttggcgctgagtg

SEQ ID NO: 9055597 - DNA, 22 bp, Homo sapiens
acagtgttgaggtgcttgtttc

SEQ ID NO: 9055598 - DNA, 22 bp, Homo sapiens
acagtgttgtatttagtttgat

SEQ ID NO: 9055599 - DNA, 22 bp, Homo sapiens
acagtgttgtggctcttaatag

SEQ ID NO: 9055600 - DNA, 22 bp, Homo sapiens
acagtgtttaaaataatatgct

SEQ ID NO: 9055601 - DNA, 22 bp, Homo sapiens
acagtgtttaaaaatcagatct

SEQ ID NO: 9055602 - DNA, 22 bp, Homo sapiens
aaggagctgggagggacacatg

SEQ ID NO: 9055603 - DNA, 22 bp, Homo sapiens
aaggagcttgttcgccttcctc

SEQ ID NO: 9055604 - DNA, 22 bp, Homo sapiens
aaggagctttcattacagcctt

SEQ ID NO: 9055605 - DNA, 22 bp, Homo sapiens
aaggagacatttgcagagcacc

SEQ ID NO: 9055606 - DNA, 22 bp, Homo sapiens
aaggagacatttgcagagcacc

SEQ ID NO: 9055607 - DNA, 22 bp, Homo sapiens
acatatgtgttgtacatgcatg

SEQ ID NO: 9055608 - DNA, 22 bp, Homo sapiens
acatatgcgatcataggatgca

SEQ ID NO: 9055609 - DNA, 22 bp, Homo sapiens
acatatgtgtctgcacatgccc

SEQ ID NO: 9055610 - DNA, 19 bp, Homo sapiens
acatatgtggatatacatg

SEQ ID NO: 9055611 - DNA, 22 bp, Homo sapiens
acagtgtttcacttaaccgttt

SEQ ID NO: 9055612 - DNA, 22 bp, Homo sapiens
acagtgtttatgtacagattgt

SEQ ID NO: 9055613 - DNA, 22 bp, Homo sapiens
acagtgtttaagagatggcatt

SEQ ID NO: 9055614 - DNA, 22 bp, Homo sapiens
acagtgtttggcaatgcatgca

SEQ ID NO: 9055615 - DNA, 22 bp, Homo sapiens
aagctattgaatttatagcata

SEQ ID NO: 9055616 - DNA, 22 bp, Homo sapiens
aagcattttgttttaagaatga

SEQ ID NO: 9055617 - DNA, 22 bp, Homo sapiens
aagcattttgccacttgaagtt

SEQ ID NO: 9055618 - DNA, 22 bp, Homo sapiens
aagcatttttcacagcaacagc

SEQ ID NO: 9055619 - DNA, 22 bp, Homo sapiens
aagcattttgttttaagaatga

SEQ ID NO: 9055620 - DNA, 22 bp, Homo sapiens
aagcattttagataaagcatca

SEQ ID NO: 9055621 - DNA, 22 bp, Homo sapiens
aagcattttagataaagcatca

SEQ ID NO: 9055622 - DNA, 22 bp, Homo sapiens
acagccttattctttagtttac

SEQ ID NO: 9055623 - DNA, 22 bp, Homo sapiens
acagccttactatactaaacag

SEQ ID NO: 9055624 - DNA, 22 bp, Homo sapiens
acagccttattgcgagcaaggc

SEQ ID NO: 9055625 - DNA, 22 bp, Homo sapiens
acagccttcgaagtttcttcct

SEQ ID NO: 9055626 - DNA, 22 bp, Homo sapiens
acagccttctctattggcctca

SEQ ID NO: 9055627 - DNA, 22 bp, Homo sapiens
acagccttctcttcactgtgtc

SEQ ID NO: 9055628 - DNA, 21 bp, Homo sapiens
acagccttacctggggtgtga

SEQ ID NO: 9055629 - DNA, 22 bp, Homo sapiens
aagccaaataatgtaggtacat

SEQ ID NO: 9055630 - DNA, 22 bp, Homo sapiens
aagccaagagttaactatttgt

SEQ ID NO: 9055631 - DNA, 22 bp, Homo sapiens
aagcatttttgaaatggtagga

SEQ ID NO: 9055632 - DNA, 22 bp, Homo sapiens
aagcctttctctctgggaagga

SEQ ID NO: 9055633 - DNA, 22 bp, Homo sapiens
aagcctttgtttgggaagtttt

SEQ ID NO: 9055634 - DNA, 22 bp, Homo sapiens
aagcgcagacacagagagtgga

SEQ ID NO: 9055635 - DNA, 22 bp, Homo sapiens
aagcgccatggttcctgcgcag

SEQ ID NO: 9055636 - DNA, 19 bp, Homo sapiens
aagcgtttcccacttgctt

SEQ ID NO: 9055637 - DNA, 22 bp, Homo sapiens
acattttgaaagggaaattgtt

SEQ ID NO: 9055638 - DNA, 22 bp, Homo sapiens
acattttacagttgtctggcta

SEQ ID NO: 9055639 - DNA, 22 bp, Homo sapiens
acattttacaccaagacttctt

SEQ ID NO: 9055640 - DNA, 22 bp, Homo sapiens
accagggaccgccacactgcaa

SEQ ID NO: 9055641 - DNA, 22 bp, Homo sapiens
acccagagcccttagcacagac

SEQ ID NO: 9055642 - DNA, 22 bp, Homo sapiens
aaggggaaaaagtgttaggagt

SEQ ID NO: 9055643 - DNA, 22 bp, Homo sapiens
accctgaagaaacttctaagtg

SEQ ID NO: 9055644 - DNA, 22 bp, Homo sapiens
aaggctctgcaaaacctccaag

SEQ ID NO: 9055645 - DNA, 22 bp, Homo sapiens
aaggctctctgatggcagcagt

SEQ ID NO: 9055646 - DNA, 22 bp, Homo sapiens
aaggctcggcaatgtgcggctc

SEQ ID NO: 9055647 - DNA, 22 bp, Homo sapiens
aaggctcaattaactaagaagt

SEQ ID NO: 9055648 - DNA, 22 bp, Homo sapiens
acattgtttgagaatacagatg

SEQ ID NO: 9055649 - DNA, 22 bp, Homo sapiens
acatttaaatacctatgtttct

SEQ ID NO: 9055650 - DNA, 22 bp, Homo sapiens
acatttctcttgatgtctctat

SEQ ID NO: 9055651 - DNA, 22 bp, Homo sapiens
acatttctcttgatgtctctat

SEQ ID NO: 9055652 - DNA, 22 bp, Homo sapiens
acatttctcttgatgtctctat

SEQ ID NO: 9055653 - DNA, 22 bp, Homo sapiens
actggacaggttcatggtttta

SEQ ID NO: 9055654 - DNA, 22 bp, Homo sapiens
actgcgtggggagctgtgacta

SEQ ID NO: 9055655 - DNA, 22 bp, Homo sapiens
actggctgagttgcttcagcaa

SEQ ID NO: 9055656 - DNA, 22 bp, Homo sapiens
actggctgaagtttactttttg

SEQ ID NO: 9055657 - DNA, 22 bp, Homo sapiens
actggctgaggaagttgccact

SEQ ID NO: 9055658 - DNA, 22 bp, Homo sapiens
aatacagaggaaacatttaata

SEQ ID NO: 9055659 - DNA, 22 bp, Homo sapiens
aataccttttcagtgcacaaaa

SEQ ID NO: 9055660 - DNA, 22 bp, Homo sapiens
aataccttttcagtgcacaaaa

SEQ ID NO: 9055661 - DNA, 22 bp, Homo sapiens
aataccttccaacatcaagaca

SEQ ID NO: 9055662 - DNA, 22 bp, Homo sapiens
actggctgaaagtaaagaacac

SEQ ID NO: 9055663 - DNA, 22 bp, Homo sapiens
actggctgaaagtaaagaacac

SEQ ID NO: 9055664 - DNA, 22 bp, Homo sapiens
actataaaaggataaaccagaa

SEQ ID NO: 9055665 - DNA, 22 bp, Homo sapiens
actataaaaggataaaccagaa

SEQ ID NO: 9055666 - DNA, 22 bp, Homo sapiens
actatacaccaaaatattaagg

SEQ ID NO: 9055667 - DNA, 22 bp, Homo sapiens
actatacagaagaggataggaa

SEQ ID NO: 9055668 - DNA, 22 bp, Homo sapiens
actatacaccaaaatattaagg

SEQ ID NO: 9055669 - DNA, 22 bp, Homo sapiens
actatacaagattagggatttg

SEQ ID NO: 9055670 - DNA, 22 bp, Homo sapiens
actcagaagatataatgactca

SEQ ID NO: 9055671 - DNA, 22 bp, Homo sapiens
actatacagtatgtacgtgcac

SEQ ID NO: 9055672 - DNA, 22 bp, Homo sapiens
actatacataaaacatttgggt

SEQ ID NO: 9055673 - DNA, 22 bp, Homo sapiens
actcagactataagcttatttt

SEQ ID NO: 9055674 - DNA, 22 bp, Homo sapiens
actcagagaaacagcagggtgt

SEQ ID NO: 9055675 - DNA, 22 bp, Homo sapiens
actctacagaatgaatacctgt

SEQ ID NO: 9055676 - DNA, 22 bp, Homo sapiens
actctataaagatacctcaatt

SEQ ID NO: 9055677 - DNA, 22 bp, Homo sapiens
acgtgcatatgtatacacacat

SEQ ID NO: 9055678 - DNA, 23 bp, Homo sapiens
acctaaatagctgtgttgaagta

SEQ ID NO: 9055679 - DNA, 22 bp, Homo sapiens
acctacagatctttgaatgtgt

SEQ ID NO: 9055680 - DNA, 22 bp, Homo sapiens
acctacagagatctgcattttt

SEQ ID NO: 9055681 - DNA, 22 bp, Homo sapiens
acctttatcgccatcattgtgc

SEQ ID NO: 9055682 - DNA, 22 bp, Homo sapiens
acctagaatttaaaacattgct

SEQ ID NO: 9055683 - DNA, 22 bp, Homo sapiens
acctagaaactgacagaatatt

SEQ ID NO: 9055684 - DNA, 23 bp, Homo sapiens
acctagaaatacgttttacatgg

SEQ ID NO: 9055685 - DNA, 22 bp, Homo sapiens
aagtctcagaaaactagtgtgg

SEQ ID NO: 9055686 - DNA, 22 bp, Homo sapiens
actacacagggatgtgactacc

SEQ ID NO: 9055687 - DNA, 22 bp, Homo sapiens
aatatagaatcactttccttca

SEQ ID NO: 9055688 - DNA, 22 bp, Homo sapiens
aatactgagatcccacaaagca

SEQ ID NO: 9055689 - DNA, 22 bp, Homo sapiens
aatactagttattaaagctttt

SEQ ID NO: 9055690 - DNA, 22 bp, Homo sapiens
actgggcttatgctgtggagta

SEQ ID NO: 9055691 - DNA, 22 bp, Homo sapiens
actgggcttatttcttgtgaac

SEQ ID NO: 9055692 - DNA, 22 bp, Homo sapiens
actttaaaaagagccttctaac

SEQ ID NO: 9055693 - DNA, 22 bp, Homo sapiens
actgttcttcccatttatattg

SEQ ID NO: 9055694 - DNA, 22 bp, Homo sapiens
actgttctcctttggctatatc

SEQ ID NO: 9055695 - DNA, 22 bp, Homo sapiens
actttatgctaaactttactct

SEQ ID NO: 9055696 - DNA, 23 bp, Homo sapiens
actttattgaccccaggtcagtt

SEQ ID NO: 9055697 - DNA, 23 bp, Homo sapiens
actttattgaccccaggtcagtt

SEQ ID NO: 9055698 - DNA, 22 bp, Homo sapiens
aatcacatgaaaactgtgtgtt

SEQ ID NO: 9055699 - DNA, 22 bp, Homo sapiens
aatcagaaagaggtcatgttgc

SEQ ID NO: 9055700 - DNA, 22 bp, Homo sapiens
aatcagaaagatcttgatgaga

SEQ ID NO: 9055701 - DNA, 22 bp, Homo sapiens
aatcagaaagaggtcatgttgc

SEQ ID NO: 9055702 - DNA, 22 bp, Homo sapiens
actttcttatccatgatctcac

SEQ ID NO: 9055703 - DNA, 22 bp, Homo sapiens
agaacaaatcgatggaagcctg

SEQ ID NO: 9055704 - DNA, 22 bp, Homo sapiens
agaacaaggctgtttccaatgc

SEQ ID NO: 9055705 - DNA, 22 bp, Homo sapiens
agaacaaggctgtttccaatgc

SEQ ID NO: 9055706 - DNA, 22 bp, Homo sapiens
agaacaaaattagaggagtgca

SEQ ID NO: 9055707 - DNA, 22 bp, Homo sapiens
agaaatgacacacatgagacat

SEQ ID NO: 9055708 - DNA, 22 bp, Homo sapiens
aatgatttggcaaaggaatcca

SEQ ID NO: 9055709 - DNA, 22 bp, Homo sapiens
aatgatgtatgtgtgcacgcat

SEQ ID NO: 9055710 - DNA, 23 bp, Homo sapiens
aatgatttcatgatgatagcagc

SEQ ID NO: 9055711 - DNA, 22 bp, Homo sapiens
aatgattggcactagatacaca

SEQ ID NO: 9055712 - DNA, 22 bp, Homo sapiens
aatgatgtcgaaaagtaagctc

SEQ ID NO: 9055713 - DNA, 22 bp, Homo sapiens
agaaatgacaagactgatcagg

SEQ ID NO: 9055714 - DNA, 22 bp, Homo sapiens
agaaatagaggaaaggtttgac

SEQ ID NO: 9055715 - DNA, 22 bp, Homo sapiens
agaaatgaaaccaaagcctaga

SEQ ID NO: 9055716 - DNA, 22 bp, Homo sapiens
agaaatctttgaagtgtaatgt

SEQ ID NO: 9055717 - DNA, 22 bp, Homo sapiens
aatcataattcaaataagctta

SEQ ID NO: 9055718 - DNA, 22 bp, Homo sapiens
agaaatactttgtaaatctcac

SEQ ID NO: 9055719 - DNA, 22 bp, Homo sapiens
aatcagcaggcttctaaatttt

SEQ ID NO: 9055720 - DNA, 22 bp, Homo sapiens
aatcagctaaataaactagtca

SEQ ID NO: 9055721 - DNA, 22 bp, Homo sapiens
aatcagaactcctaccacagag

SEQ ID NO: 9055722 - DNA, 22 bp, Homo sapiens
aatcagaaattctacatcacaa

SEQ ID NO: 9055723 - DNA, 22 bp, Homo sapiens
aatcagaatttgtcccctgagt

SEQ ID NO: 9055724 - DNA, 22 bp, Homo sapiens
aatcagaatttattgaatcttt

SEQ ID NO: 9055725 - DNA, 22 bp, Homo sapiens
aattccagtctctgctctattt

SEQ ID NO: 9055726 - DNA, 22 bp, Homo sapiens
aattccagtctctgctctattt

SEQ ID NO: 9055727 - DNA, 22 bp, Homo sapiens
aattccagggtacctctgattt

SEQ ID NO: 9055728 - DNA, 22 bp, Homo sapiens
agagcctggacttttctgagcc

SEQ ID NO: 9055729 - DNA, 22 bp, Homo sapiens
agagcctggaggttctgctgaa

SEQ ID NO: 9055730 - DNA, 22 bp, Homo sapiens
agagcctgctacctcattccag

SEQ ID NO: 9055731 - DNA, 20 bp, Homo sapiens
agagcctggaaaaagacatc

SEQ ID NO: 9055732 - DNA, 22 bp, Homo sapiens
agagacaggatatctgctcatg

SEQ ID NO: 9055733 - DNA, 22 bp, Homo sapiens
agagccaggcggctgggcacct

SEQ ID NO: 9055734 - DNA, 22 bp, Homo sapiens
agagccaggctcccatggggca

SEQ ID NO: 9055735 - DNA, 22 bp, Homo sapiens
aattaaaaaaggagagcttgct

SEQ ID NO: 9055736 - DNA, 22 bp, Homo sapiens
agaccccctttaatggaagtgc

SEQ ID NO: 9055737 - DNA, 22 bp, Homo sapiens
aattaaatgacaggggaagatg

SEQ ID NO: 9055738 - DNA, 23 bp, Homo sapiens
aattaaattgctagatccagggc

SEQ ID NO: 9055739 - DNA, 22 bp, Homo sapiens
aattaaattggtttagagagga

SEQ ID NO: 9055740 - DNA, 22 bp, Homo sapiens
agagacagatctgagggacctc

SEQ ID NO: 9055741 - DNA, 22 bp, Homo sapiens
agacaattgttctaagtaaaaa

SEQ ID NO: 9055742 - DNA, 22 bp, Homo sapiens
aatggagacttcaaaatggatt

SEQ ID NO: 9055743 - DNA, 22 bp, Homo sapiens
aatggcagaggcaaagatggta

SEQ ID NO: 9055744 - DNA, 22 bp, Homo sapiens
aatgtcttcagtgtatacatgg

SEQ ID NO: 9055745 - DNA, 22 bp, Homo sapiens
aatggtttaacatatgcttgag

SEQ ID NO: 9055746 - DNA, 22 bp, Homo sapiens
aatggtttgatggacaaaatga

SEQ ID NO: 9055747 - DNA, 22 bp, Homo sapiens
acaagatagcttagaagattca

SEQ ID NO: 9055748 - DNA, 22 bp, Homo sapiens
acaagatgtgtttatacaagct

SEQ ID NO: 9055749 - DNA, 22 bp, Homo sapiens
acaagcataagtgagatgaata

SEQ ID NO: 9055750 - DNA, 22 bp, Homo sapiens
acaagcatgtggtaaaaagacc

SEQ ID NO: 9055751 - DNA, 22 bp, Homo sapiens
acaagcatcaggttcagcaata

SEQ ID NO: 9055752 - DNA, 22 bp, Homo sapiens
acaagcttccaggtgatgctga

SEQ ID NO: 9055753 - DNA, 22 bp, Homo sapiens
acaagcgggccacagtgctggt

SEQ ID NO: 9055754 - DNA, 22 bp, Homo sapiens
acaagctccttattcagctggg

SEQ ID NO: 9055755 - DNA, 22 bp, Homo sapiens
acaatgaagggagacacttgct

SEQ ID NO: 9055756 - DNA, 22 bp, Homo sapiens
acaatgaagataatgttgcagt

SEQ ID NO: 9055757 - DNA, 22 bp, Homo sapiens
acaatgaatttaataccttatt

SEQ ID NO: 9055758 - DNA, 22 bp, Homo sapiens
acaatgaatatcatgaagtact

SEQ ID NO: 9055759 - DNA, 19 bp, Homo sapiens
acaatgaatgtgttctctt

SEQ ID NO: 9055760 - DNA, 22 bp, Homo sapiens
acaatgaaaggtattctgaact

SEQ ID NO: 9055761 - DNA, 22 bp, Homo sapiens
acaatgaacacacaaggaattc

SEQ ID NO: 9055762 - DNA, 22 bp, Homo sapiens
acaatgaacgctttttaactgt

SEQ ID NO: 9055763 - DNA, 22 bp, Homo sapiens
acaatgaaccaaatttaccaat

SEQ ID NO: 9055764 - DNA, 22 bp, Homo sapiens
acaatcattccgttcacaacag

SEQ ID NO: 9055765 - DNA, 22 bp, Homo sapiens
acaatgaaaaaatttactgtgg

SEQ ID NO: 9055766 - DNA, 22 bp, Homo sapiens
acaatgaaagcaagaagacggc

SEQ ID NO: 9055767 - DNA, 19 bp, Homo sapiens
acaaattggcaaaatgcaa

SEQ ID NO: 9055768 - DNA, 20 bp, Homo sapiens
acaacaaacttgcttaagga

SEQ ID NO: 9055769 - DNA, 22 bp, Homo sapiens
acaaattgcctagtctagcatc

SEQ ID NO: 9055770 - DNA, 22 bp, Homo sapiens
acaaattgccccattttgaact

SEQ ID NO: 9055771 - DNA, 22 bp, Homo sapiens
acaacaatctaccctagcttct

SEQ ID NO: 9055772 - DNA, 22 bp, Homo sapiens
acaacaaagacacttgaaatga

SEQ ID NO: 9055773 - DNA, 22 bp, Homo sapiens
acaacagagctggactgagagg

SEQ ID NO: 9055774 - DNA, 22 bp, Homo sapiens
acaagagtgagattatcatgta

SEQ ID NO: 9055775 - DNA, 22 bp, Homo sapiens
acaagataaggtgtcagtgtgt

SEQ ID NO: 9055776 - DNA, 22 bp, Homo sapiens
acaagagattatctacagatga

SEQ ID NO: 9055777 - DNA, 22 bp, Homo sapiens
acaagagattatctacagatga

SEQ ID NO: 9055778 - DNA, 22 bp, Homo sapiens
acaactagcaggtattaatttt

SEQ ID NO: 9055779 - DNA, 22 bp, Homo sapiens
acaagaattatttctagttaac

SEQ ID NO: 9055780 - DNA, 23 bp, Homo sapiens
acaaccagcactggagggcacca

SEQ ID NO: 9055781 - DNA, 19 bp, Homo sapiens
agataagagttgactgtgg

SEQ ID NO: 9055782 - DNA, 22 bp, Homo sapiens
agataagatagtccagcacaat

SEQ ID NO: 9055783 - DNA, 19 bp, Homo sapiens
aattctgtttcagcagatc

SEQ ID NO: 9055784 - DNA, 22 bp, Homo sapiens
aattgcaacaggtagacttttc

SEQ ID NO: 9055785 - DNA, 22 bp, Homo sapiens
aattgcaggcaccagcaggagc

SEQ ID NO: 9055786 - DNA, 22 bp, Homo sapiens
aattgcataaatttcatagcat

SEQ ID NO: 9055787 - DNA, 22 bp, Homo sapiens
aattgcataaaattcaactctg

SEQ ID NO: 9055788 - DNA, 22 bp, Homo sapiens
aattgcatatatatgaggccat

SEQ ID NO: 9055789 - DNA, 22 bp, Homo sapiens
aattgcagcagcttcagcagtt

SEQ ID NO: 9055790 - DNA, 22 bp, Homo sapiens
aattgcattacagaaactttca

SEQ ID NO: 9055791 - DNA, 22 bp, Homo sapiens
aattgcatgttaatgactaagt

SEQ ID NO: 9055792 - DNA, 22 bp, Homo sapiens
agaggctctttgagctgggaga

SEQ ID NO: 9055793 - DNA, 22 bp, Homo sapiens
agaggctctggtgcagcatgca

SEQ ID NO: 9055794 - DNA, 22 bp, Homo sapiens
agaggccctctctctcctgatg

SEQ ID NO: 9055795 - DNA, 22 bp, Homo sapiens
aattgcttagttgcaactatgc

SEQ ID NO: 9055796 - DNA, 22 bp, Homo sapiens
aattgcttagagaatccaggta

SEQ ID NO: 9055797 - DNA, 22 bp, Homo sapiens
aattgctcccattgtgcaccct

SEQ ID NO: 9055798 - DNA, 22 bp, Homo sapiens
aattgcttcattaacatttagg

SEQ ID NO: 9055799 - DNA, 19 bp, Homo sapiens
acaaagctgtgagcagctt

SEQ ID NO: 9055800 - DNA, 22 bp, Homo sapiens
acaaagacgggataaggtttgg

SEQ ID NO: 9055801 - DNA, 22 bp, Homo sapiens
acaaagaaggaattggtcttta

SEQ ID NO: 9055802 - DNA, 22 bp, Homo sapiens
agagggggaaaatagaggtgtt

SEQ ID NO: 9055803 - DNA, 22 bp, Homo sapiens
acaaagtaggtcatcaaagctc

SEQ ID NO: 9055804 - DNA, 22 bp, Homo sapiens
acaaagtagtcaaagtagatga

SEQ ID NO: 9055805 - DNA, 22 bp, Homo sapiens
acaaagtaggaagattagctga

SEQ ID NO: 9055806 - DNA, 22 bp, Homo sapiens
acaaagtaggtcatcaaagctc

SEQ ID NO: 9055807 - DNA, 22 bp, Homo sapiens
acaaagtaagggctaatgagca

SEQ ID NO: 9055808 - DNA, 23 bp, Homo sapiens
acaaagtaattcctgcttccaaa

SEQ ID NO: 9055809 - DNA, 22 bp, Homo sapiens
acagatgatgtgcacagataga

SEQ ID NO: 9055810 - DNA, 22 bp, Homo sapiens
acagatgaggctggcgagggca

SEQ ID NO: 9055811 - DNA, 22 bp, Homo sapiens
acagatgaggtgtttggagagc

SEQ ID NO: 9055812 - DNA, 22 bp, Homo sapiens
acagatgagttaaagcagagtg

SEQ ID NO: 9055813 - DNA, 22 bp, Homo sapiens
acagatgagttagaataggcag

SEQ ID NO: 9055814 - DNA, 22 bp, Homo sapiens
acagatgagttagaataggcag

SEQ ID NO: 9055815 - DNA, 22 bp, Homo sapiens
acagatgaggaatttatttggt

SEQ ID NO: 9055816 - DNA, 22 bp, Homo sapiens
acagagctgggatctgaaccca

SEQ ID NO: 9055817 - DNA, 22 bp, Homo sapiens
acagagctaaatttcaatccca

SEQ ID NO: 9055818 - DNA, 22 bp, Homo sapiens
acagagctaatgttgcataggc

SEQ ID NO: 9055819 - DNA, 19 bp, Homo sapiens
acagagctctctgcttctg

SEQ ID NO: 9055820 - DNA, 22 bp, Homo sapiens
agcctctagaccctggcctgca

SEQ ID NO: 9055821 - DNA, 20 bp, Homo sapiens
acagatggcagttattacat

SEQ ID NO: 9055822 - DNA, 22 bp, Homo sapiens
acagattcactgcactggccat

SEQ ID NO: 9055823 - DNA, 22 bp, Homo sapiens
acagcaattttgtgcacaagtg

SEQ ID NO: 9055824 - DNA, 22 bp, Homo sapiens
agctcctgcgcacggtgcacac

SEQ ID NO: 9055825 - DNA, 22 bp, Homo sapiens
agctcctgcgcacggtgcacac

SEQ ID NO: 9055826 - DNA, 22 bp, Homo sapiens
agctcctgcccaggaaggctct

SEQ ID NO: 9055827 - DNA, 22 bp, Homo sapiens
agctcctgcagactcctgctca

SEQ ID NO: 9055828 - DNA, 22 bp, Homo sapiens
agctcctgcaccaggggcccct

SEQ ID NO: 9055829 - DNA, 22 bp, Homo sapiens
agctcctgcaccaggggcccct

SEQ ID NO: 9055830 - DNA, 19 bp, Homo sapiens
agccagggtccagacatgt

SEQ ID NO: 9055831 - DNA, 22 bp, Homo sapiens
agccagggtctctcgctctgtt

SEQ ID NO: 9055832 - DNA, 22 bp, Homo sapiens
agccagggtctctcgctctgtt

SEQ ID NO: 9055833 - DNA, 22 bp, Homo sapiens
acagagactgggatgcctgcct

SEQ ID NO: 9055834 - DNA, 22 bp, Homo sapiens
acagagacttggagcaggctga

SEQ ID NO: 9055835 - DNA, 22 bp, Homo sapiens
acagagactgggagcaagaggc

SEQ ID NO: 9055836 - DNA, 22 bp, Homo sapiens
acagagacaaatgttagtagtt

SEQ ID NO: 9055837 - DNA, 22 bp, Homo sapiens
acagagacacggaagctaaaga

SEQ ID NO: 9055838 - DNA, 22 bp, Homo sapiens
acagagacaggcagacagtctt

SEQ ID NO: 9055839 - DNA, 22 bp, Homo sapiens
acagagaccagttacagcgtcc

SEQ ID NO: 9055840 - DNA, 22 bp, Homo sapiens
acagacacaggcgtggagtcgc

SEQ ID NO: 9055841 - DNA, 22 bp, Homo sapiens
acagacacaggcctgggctcct

SEQ ID NO: 9055842 - DNA, 22 bp, Homo sapiens
acagaaagaccttgtaacactt

SEQ ID NO: 9055843 - DNA, 22 bp, Homo sapiens
acagacagaggctccatgagga

SEQ ID NO: 9055844 - DNA, 22 bp, Homo sapiens
agccaggggattcatcagggac

SEQ ID NO: 9055845 - DNA, 22 bp, Homo sapiens
acagacactgcactcccacctt

SEQ ID NO: 9055846 - DNA, 18 bp, Homo sapiens
acagacacttagtatgag

SEQ ID NO: 9055847 - DNA, 22 bp, Homo sapiens
acactttgatagataatgcagg

SEQ ID NO: 9055848 - DNA, 22 bp, Homo sapiens
acactttagaaaaaagaatggt

SEQ ID NO: 9055849 - DNA, 22 bp, Homo sapiens
acactttagtatgaagaggtag

SEQ ID NO: 9055850 - DNA, 22 bp, Homo sapiens
acactgagtattgagtagggta

SEQ ID NO: 9055851 - DNA, 21 bp, Homo sapiens
acactgacaaccatccacgag

SEQ ID NO: 9055852 - DNA, 22 bp, Homo sapiens
acactgaatgtttaagaacttg

SEQ ID NO: 9055853 - DNA, 22 bp, Homo sapiens
acactgacgcttgacagtcacc

SEQ ID NO: 9055854 - DNA, 22 bp, Homo sapiens
acactgacacctgccctcaggt

SEQ ID NO: 9055855 - DNA, 17 bp, Homo sapiens
acactgacatgccacac

SEQ ID NO: 9055856 - DNA, 22 bp, Homo sapiens
acactgactgggcagtatagtc

SEQ ID NO: 9055857 - DNA, 22 bp, Homo sapiens
acactgactgggacagaagacc

SEQ ID NO: 9055858 - DNA, 22 bp, Homo sapiens
acactcaccctcccactgcctg

SEQ ID NO: 9055859 - DNA, 22 bp, Homo sapiens
acactctacagagcaatctacc

SEQ ID NO: 9055860 - DNA, 22 bp, Homo sapiens
acactctgtaatgtcacactcc

SEQ ID NO: 9055861 - DNA, 22 bp, Homo sapiens
acactctgtaatgtcacactcc

SEQ ID NO: 9055862 - DNA, 22 bp, Homo sapiens
acactgaatcagaaattgttgg

SEQ ID NO: 9055863 - DNA, 22 bp, Homo sapiens
acactagctaaatgctgattaa

SEQ ID NO: 9055864 - DNA, 22 bp, Homo sapiens
acacattaacctttgaaattct

SEQ ID NO: 9055865 - DNA, 22 bp, Homo sapiens
acacatgtgattctaagacagc

SEQ ID NO: 9055866 - DNA, 22 bp, Homo sapiens
acacatgtgattctaagacagc

SEQ ID NO: 9055867 - DNA, 22 bp, Homo sapiens
acacatgtatggcacttacatt

SEQ ID NO: 9055868 - DNA, 22 bp, Homo sapiens
acacagagtttgacacatggga

SEQ ID NO: 9055869 - DNA, 22 bp, Homo sapiens
acacagatgcattacacatcta

SEQ ID NO: 9055870 - DNA, 22 bp, Homo sapiens
acacagagttattatgtgaact

SEQ ID NO: 9055871 - DNA, 21 bp, Homo sapiens
acacagaggcatcatcacttt

SEQ ID NO: 9055872 - DNA, 22 bp, Homo sapiens
agcagcaaaagagaatagtttg

SEQ ID NO: 9055873 - DNA, 22 bp, Homo sapiens
agcagatgtttcagagcaggct

SEQ ID NO: 9055874 - DNA, 22 bp, Homo sapiens
agcagatgcgtctgagtgggag

SEQ ID NO: 9055875 - DNA, 22 bp, Homo sapiens
agcagatggtgtcatgggatgg

SEQ ID NO: 9055876 - DNA, 22 bp, Homo sapiens
agcagatgaatcccagataaag

SEQ ID NO: 9055877 - DNA, 22 bp, Homo sapiens
aacatgtcttactttgctttct

SEQ ID NO: 9055878 - DNA, 22 bp, Homo sapiens
aacatgtacctacaatcagaat

SEQ ID NO: 9055879 - DNA, 22 bp, Homo sapiens
aacatgtagcagaaacgactaa

SEQ ID NO: 9055880 - DNA, 19 bp, Homo sapiens
aacatctgtaactattttc

SEQ ID NO: 9055881 - DNA, 19 bp, Homo sapiens
aacatctgtaactattttc

SEQ ID NO: 9055882 - DNA, 22 bp, Homo sapiens
aacatgaaaacctccacagcaa

SEQ ID NO: 9055883 - DNA, 20 bp, Homo sapiens
aatacatgagcacactttca

SEQ ID NO: 9055884 - DNA, 22 bp, Homo sapiens
aatacatgttttctactattct

SEQ ID NO: 9055885 - DNA, 22 bp, Homo sapiens
aatacatgttttctactattct

SEQ ID NO: 9055886 - DNA, 22 bp, Homo sapiens
aacagctattagaacttcatgg

SEQ ID NO: 9055887 - DNA, 22 bp, Homo sapiens
aacagctagtggtctagacttt

SEQ ID NO: 9055888 - DNA, 22 bp, Homo sapiens
aacagctaccttctcactgtgc

SEQ ID NO: 9055889 - DNA, 23 bp, Homo sapiens
aagtggttttgaacccggaccct

SEQ ID NO: 9055890 - DNA, 22 bp, Homo sapiens
aagtggtttgattcagtttatg

SEQ ID NO: 9055891 - DNA, 22 bp, Homo sapiens
aagtggttttaagaggttcctt

SEQ ID NO: 9055892 - DNA, 21 bp, Homo sapiens
aagtggtttaggttaccgggg

SEQ ID NO: 9055893 - DNA, 22 bp, Homo sapiens
aagtggtttgagcacagtgctg

SEQ ID NO: 9055894 - DNA, 21 bp, Homo sapiens
aagtggtttacatccagctgt

SEQ ID NO: 9055895 - DNA, 22 bp, Homo sapiens
aagtggttgcttgtgagtcccc

SEQ ID NO: 9055896 - DNA, 22 bp, Homo sapiens
aagtggttattttgatctagaa

SEQ ID NO: 9055897 - DNA, 22 bp, Homo sapiens
aacatcagtattctcatctgta

SEQ ID NO: 9055898 - DNA, 22 bp, Homo sapiens
aacatcaggatcttgttacagt

SEQ ID NO: 9055899 - DNA, 22 bp, Homo sapiens
aacatcagaagtagaagactca

SEQ ID NO: 9055900 - DNA, 19 bp, Homo sapiens
aacatcatggctctttcca

SEQ ID NO: 9055901 - DNA, 22 bp, Homo sapiens
aatgacagagatagaagggatg

SEQ ID NO: 9055902 - DNA, 22 bp, Homo sapiens
aatgacaagacatagtctctga

SEQ ID NO: 9055903 - DNA, 22 bp, Homo sapiens
aatgacaataatcattaacttt

SEQ ID NO: 9055904 - DNA, 22 bp, Homo sapiens
aatgacaatattaatttggagg

SEQ ID NO: 9055905 - DNA, 22 bp, Homo sapiens
aatgacaaatatggaagcctga

SEQ ID NO: 9055906 - DNA, 22 bp, Homo sapiens
aatggcttagctcagcgctcag

SEQ ID NO: 9055907 - DNA, 22 bp, Homo sapiens
aatggcttctgaagcacacttt

SEQ ID NO: 9055908 - DNA, 22 bp, Homo sapiens
aatgctttcttataaccactgc

SEQ ID NO: 9055909 - DNA, 22 bp, Homo sapiens
aatggccattgggtcatgctag

SEQ ID NO: 9055910 - DNA, 22 bp, Homo sapiens
aacctgaatttaattgaaatga

SEQ ID NO: 9055911 - DNA, 23 bp, Homo sapiens
aacctgaactagggtcttgcata

SEQ ID NO: 9055912 - DNA, 22 bp, Homo sapiens
aacctgaattacttttgcacca

SEQ ID NO: 9055913 - DNA, 22 bp, Homo sapiens
aacctgaaactacattcttgat

SEQ ID NO: 9055914 - DNA, 22 bp, Homo sapiens
aacctgaaagtagtaaaagctg

SEQ ID NO: 9055915 - DNA, 22 bp, Homo sapiens
aacctgaagaaaatatttgctg

SEQ ID NO: 9055916 - DNA, 22 bp, Homo sapiens
aatgaatgttttaaggcataaa

SEQ ID NO: 9055917 - DNA, 22 bp, Homo sapiens
aaatgcatgtatgtaatatgct

SEQ ID NO: 9055918 - DNA, 22 bp, Homo sapiens
aaggaagacacagatgaagtga

SEQ ID NO: 9055919 - DNA, 22 bp, Homo sapiens
aaatgtcagaggaacatattga

SEQ ID NO: 9055920 - DNA, 22 bp, Homo sapiens
aaatgtcagaggaacatattga

SEQ ID NO: 9055921 - DNA, 22 bp, Homo sapiens
aaatgtcagaagctttacttct

SEQ ID NO: 9055922 - DNA, 22 bp, Homo sapiens
aaggaagatatatcaagcttaa

SEQ ID NO: 9055923 - DNA, 22 bp, Homo sapiens
aaattattttcagaatggagaa

SEQ ID NO: 9055924 - DNA, 23 bp, Homo sapiens
aaattattgctcttcaattgcct

SEQ ID NO: 9055925 - DNA, 22 bp, Homo sapiens
aaattcaattaactttcatgct

SEQ ID NO: 9055926 - DNA, 22 bp, Homo sapiens
aaattcaattaactttcatgct

SEQ ID NO: 9055927 - DNA, 22 bp, Homo sapiens
aaattattttcagaatggagaa

SEQ ID NO: 9055928 - DNA, 22 bp, Homo sapiens
aaattattcaaaaagctgtgtt

SEQ ID NO: 9055929 - DNA, 22 bp, Homo sapiens
aaattcacaagagcattgcctg

SEQ ID NO: 9055930 - DNA, 22 bp, Homo sapiens
aaggcagccatagcaccatcca

SEQ ID NO: 9055931 - DNA, 22 bp, Homo sapiens
aaggcagccctggctcagcctg

SEQ ID NO: 9055932 - DNA, 22 bp, Homo sapiens
aaggcagatataaagactagag

SEQ ID NO: 9055933 - DNA, 22 bp, Homo sapiens
aaggcagatataaagactagag

SEQ ID NO: 9055934 - DNA, 22 bp, Homo sapiens
aaggcagcaccgcctcctgaaa

SEQ ID NO: 9055935 - DNA, 22 bp, Homo sapiens
aaatttcttgaggctctctagc

SEQ ID NO: 9055936 - DNA, 22 bp, Homo sapiens
aaatttctaagtcaagaagaac

SEQ ID NO: 9055937 - DNA, 22 bp, Homo sapiens
aaatttctggaagtgtcagagt

SEQ ID NO: 9055938 - DNA, 22 bp, Homo sapiens
aacacagacatagtgattacag

SEQ ID NO: 9055939 - DNA, 22 bp, Homo sapiens
aacacagaagtgccaagagcca

SEQ ID NO: 9055940 - DNA, 22 bp, Homo sapiens
aacacaatcttccagtttgctg

SEQ ID NO: 9055941 - DNA, 22 bp, Homo sapiens
aacacagatcaaaatatttcct

SEQ ID NO: 9055942 - DNA, 22 bp, Homo sapiens
aacagacaactcctgtggctca

SEQ ID NO: 9055943 - DNA, 22 bp, Homo sapiens
aacagaagggggtatttacatt

SEQ ID NO: 9055944 - DNA, 22 bp, Homo sapiens
aacactttttatatattgtatc

SEQ ID NO: 9055945 - DNA, 22 bp, Homo sapiens
aacagaatcttgggttcttttc

SEQ ID NO: 9055946 - DNA, 22 bp, Homo sapiens
aacactttttagtaaagattga

SEQ ID NO: 9055947 - DNA, 22 bp, Homo sapiens
aacactttttagtaaagattga

SEQ ID NO: 9055948 - DNA, 22 bp, Homo sapiens
aacactttttagtaaagattga

SEQ ID NO: 9055949 - DNA, 22 bp, Homo sapiens
aacactttgttgcctatgaacg

SEQ ID NO: 9055950 - DNA, 22 bp, Homo sapiens
aacactttttcctcctgtctgg

SEQ ID NO: 9055951 - DNA, 22 bp, Homo sapiens
aacactttttatatattgtatc

SEQ ID NO: 9055952 - DNA, 22 bp, Homo sapiens
aacactttggaatagagatagg

SEQ ID NO: 9055953 - DNA, 22 bp, Homo sapiens
aacactttggaatagagatagg

SEQ ID NO: 9055954 - DNA, 22 bp, Homo sapiens
aacactttggatgcagaaccaa

SEQ ID NO: 9055955 - DNA, 22 bp, Homo sapiens
aagagacaatgtcttttggata

SEQ ID NO: 9055956 - DNA, 22 bp, Homo sapiens
aagagacagagccatgtttcta

SEQ ID NO: 9055957 - DNA, 22 bp, Homo sapiens
aagagaatacaagcaggcagga

SEQ ID NO: 9055958 - DNA, 22 bp, Homo sapiens
aagagaaggccctgacccaccc

SEQ ID NO: 9055959 - DNA, 21 bp, Homo sapiens
aagagacatttctcatcagca

SEQ ID NO: 9055960 - DNA, 19 bp, Homo sapiens
acaatgttgttggacactc

SEQ ID NO: 9055961 - DNA, 22 bp, Homo sapiens
acaatgttttgaaacatctagg

SEQ ID NO: 9055962 - DNA, 22 bp, Homo sapiens
acacaaacagtctatagcacca

SEQ ID NO: 9055963 - DNA, 21 bp, Homo sapiens
acacaaacctcctcagcctgg

SEQ ID NO: 9055964 - DNA, 22 bp, Homo sapiens
acacaaagttggatgacaaaat

SEQ ID NO: 9055965 - DNA, 22 bp, Homo sapiens
acacaaagttggatgacaaaat

SEQ ID NO: 9055966 - DNA, 22 bp, Homo sapiens
acacaaagctattgagtgtcat

SEQ ID NO: 9055967 - DNA, 22 bp, Homo sapiens
acacaaagctattgagtgtcat

SEQ ID NO: 9055968 - DNA, 20 bp, Homo sapiens
acacaaagcaatggagtaca

SEQ ID NO: 9055969 - DNA, 22 bp, Homo sapiens
acacaaagttggatgacaaaat

SEQ ID NO: 9055970 - DNA, 22 bp, Homo sapiens
aagagcaacttggaaacactca

SEQ ID NO: 9055971 - DNA, 22 bp, Homo sapiens
aagagcaagtgggtagtgaagc

SEQ ID NO: 9055972 - DNA, 22 bp, Homo sapiens
aatttcagggtgaatggactga

SEQ ID NO: 9055973 - DNA, 22 bp, Homo sapiens
aatttcagtatgaagtttcaca

SEQ ID NO: 9055974 - DNA, 22 bp, Homo sapiens
aatttcagctcaaacttgtgtt

SEQ ID NO: 9055975 - DNA, 22 bp, Homo sapiens
aatttcagcttaagttgtttgg

SEQ ID NO: 9055976 - DNA, 22 bp, Homo sapiens
aatttcagcaacgggagcctag

SEQ ID NO: 9055977 - DNA, 22 bp, Homo sapiens
aatttcagaggtagagattcta

SEQ ID NO: 9055978 - DNA, 21 bp, Homo sapiens
aatttcagacccattttgcct

SEQ ID NO: 9055979 - DNA, 22 bp, Homo sapiens
aatttcagaccatttgcaatta

SEQ ID NO: 9055980 - DNA, 22 bp, Homo sapiens
aatttcagaactatctgggagt

SEQ ID NO: 9055981 - DNA, 22 bp, Homo sapiens
aatttcactgtggagcacattt

SEQ ID NO: 9055982 - DNA, 22 bp, Homo sapiens
aatttccagaccccatccacag

SEQ ID NO: 9055983 - DNA, 22 bp, Homo sapiens
aatttgttagcatactctagtt

SEQ ID NO: 9055984 - DNA, 22 bp, Homo sapiens
aagaccataatgtaagatgaat

SEQ ID NO: 9055985 - DNA, 22 bp, Homo sapiens
aagaccatttaatggagaaaga

SEQ ID NO: 9055986 - DNA, 22 bp, Homo sapiens
aagactttccctcatcagaacg

SEQ ID NO: 9055987 - DNA, 22 bp, Homo sapiens
aagagaacagtcaccatgcaca

SEQ ID NO: 9055988 - DNA, 22 bp, Homo sapiens
aagactttctgtaaagctacag

SEQ ID NO: 9055989 - DNA, 22 bp, Homo sapiens
aatggctttgacattttcaaat

SEQ ID NO: 9055990 - DNA, 22 bp, Homo sapiens
aagaaactgaaagtggcttcat

SEQ ID NO: 9055991 - DNA, 22 bp, Homo sapiens
aagaaacctagtctggagcagc

SEQ ID NO: 9055992 - DNA, 22 bp, Homo sapiens
aagaaaacatgatctaatttaa

SEQ ID NO: 9055993 - DNA, 22 bp, Homo sapiens
aagaaaacaatgacttgccagc

SEQ ID NO: 9055994 - DNA, 22 bp, Homo sapiens
aagaacaactgctttaaaagca

SEQ ID NO: 9055995 - DNA, 22 bp, Homo sapiens
aagaacaactgctttaaaagca

SEQ ID NO: 9055996 - DNA, 17 bp, Homo sapiens
aagaacactcaatagca

SEQ ID NO: 9055997 - DNA, 22 bp, Homo sapiens
aatttcactggaaaagataatt

SEQ ID NO: 9055998 - DNA, 22 bp, Homo sapiens
aatttcactgataaagactcca

SEQ ID NO: 9055999 - DNA, 22 bp, Homo sapiens
aatttcacagtgaactttgagg

SEQ ID NO: 9056000 - DNA, 22 bp, Homo sapiens
aatttcacataaggctcattgg

SEQ ID NO: 9056001 - DNA, 22 bp, Homo sapiens
aatttcacctatcacttaagcc

SEQ ID NO: 9056002 - DNA, 22 bp, Homo sapiens
aatttcacctgcactacatcgc

SEQ ID NO: 9056003 - DNA, 22 bp, Homo sapiens
aagaaatggcttcatctgagta

SEQ ID NO: 9056004 - DNA, 22 bp, Homo sapiens
aattctcaggtaaaagttaagt

SEQ ID NO: 9056005 - DNA, 22 bp, Homo sapiens
aattctctccagggtaacatca

SEQ ID NO: 9056006 - DNA, 22 bp, Homo sapiens
aattctcaggaatttcatctgt

SEQ ID NO: 9056007 - DNA, 22 bp, Homo sapiens
aattctcaggaatttcatctgt

SEQ ID NO: 9056008 - DNA, 22 bp, Homo sapiens
aagaaagagatcactcctccat

SEQ ID NO: 9056009 - DNA, 22 bp, Homo sapiens
aagaaagataaggtttgcttgg

SEQ ID NO: 9056010 - DNA, 22 bp, Homo sapiens
aagaaagataaggtttgcttgg

SEQ ID NO: 9056011 - DNA, 21 bp, Homo sapiens
aagaaagataattaaggaccc

SEQ ID NO: 9056012 - DNA, 20 bp, Homo sapiens
aagaaacttgaaagtacaag

SEQ ID NO: 9056013 - DNA, 20 bp, Homo sapiens
aagaaacttgaaagtacaag

SEQ ID NO: 9056014 - DNA, 20 bp, Homo sapiens
aagaaacttgaaagtacaag

SEQ ID NO: 9056015 - DNA, 22 bp, Homo sapiens
aagaaagagatcactcctccat

SEQ ID NO: 9056016 - DNA, 20 bp, Homo sapiens
aagaaacttgaaagtacaag

SEQ ID NO: 9056017 - DNA, 22 bp, Homo sapiens
aagcaatatactgatatgatta

SEQ ID NO: 9056018 - DNA, 20 bp, Homo sapiens
aagcaatatagtgcaaatgt

SEQ ID NO: 9056019 - DNA, 22 bp, Homo sapiens
aagcaatagggtaatctactca

SEQ ID NO: 9056020 - DNA, 22 bp, Homo sapiens
aagcaatgtgttaatgaatgag

SEQ ID NO: 9056021 - DNA, 22 bp, Homo sapiens
acagcagagccagtggctctag

SEQ ID NO: 9056022 - DNA, 22 bp, Homo sapiens
acagcagactttctacagctca

SEQ ID NO: 9056023 - DNA, 22 bp, Homo sapiens
aagcagctggaagagtaagatg

SEQ ID NO: 9056024 - DNA, 22 bp, Homo sapiens
acagcagagcctagcttaatct

SEQ ID NO: 9056025 - DNA, 21 bp, Homo sapiens
aagcagcttaataaagtatgt

SEQ ID NO: 9056026 - DNA, 22 bp, Homo sapiens
acacatgagaaacatcagttgt

SEQ ID NO: 9056027 - DNA, 19 bp, Homo sapiens
acacatgaggagggacccc

SEQ ID NO: 9056028 - DNA, 22 bp, Homo sapiens
acacatgagaaacatcagttgt

SEQ ID NO: 9056029 - DNA, 22 bp, Homo sapiens
acacatgataagaaagtttaaa

SEQ ID NO: 9056030 - DNA, 22 bp, Homo sapiens
acacatgcacaacagttctttc

SEQ ID NO: 9056031 - DNA, 22 bp, Homo sapiens
acacatgataagaaagtttaaa

SEQ ID NO: 9056032 - DNA, 22 bp, Homo sapiens
aagagcaggacagaatcagaac

SEQ ID NO: 9056033 - DNA, 22 bp, Homo sapiens
acacatgaaataatattatgca

SEQ ID NO: 9056034 - DNA, 22 bp, Homo sapiens
acacatcttagactgaaatatg

SEQ ID NO: 9056035 - DNA, 22 bp, Homo sapiens
aagatggcttagagtcctggtg

SEQ ID NO: 9056036 - DNA, 22 bp, Homo sapiens
aagatgcggttgaccatggtgt

SEQ ID NO: 9056037 - DNA, 22 bp, Homo sapiens
aagatgcggttgaccatggtgt

SEQ ID NO: 9056038 - DNA, 22 bp, Homo sapiens
aagatgaatcagtatgtgtcct

SEQ ID NO: 9056039 - DNA, 22 bp, Homo sapiens
aagcaaagacagtttgagtgga

SEQ ID NO: 9056040 - DNA, 22 bp, Homo sapiens
aagcaataaataatttttagta

SEQ ID NO: 9056041 - DNA, 22 bp, Homo sapiens
aagcaataatcccaaagtgctg

SEQ ID NO: 9056042 - DNA, 22 bp, Homo sapiens
aagcaaggcaacctatgtccag

SEQ ID NO: 9056043 - DNA, 22 bp, Homo sapiens
aacactgtcttatacttcaatg

SEQ ID NO: 9056044 - DNA, 22 bp, Homo sapiens
aacacttaaggagagatcaaat

SEQ ID NO: 9056045 - DNA, 22 bp, Homo sapiens
aacacattttgcctaggcaata

SEQ ID NO: 9056046 - DNA, 22 bp, Homo sapiens
aacactgtatcagtcttcaata

SEQ ID NO: 9056047 - DNA, 22 bp, Homo sapiens
aaagcaagatgcatccgtcaag

SEQ ID NO: 9056048 - DNA, 22 bp, Homo sapiens
aaagcaagtctctacaaagtac

SEQ ID NO: 9056049 - DNA, 23 bp, Homo sapiens
aaagcaaggaattggcaacagag

SEQ ID NO: 9056050 - DNA, 22 bp, Homo sapiens
aaagcagaactgagagagctgg

SEQ ID NO: 9056051 - DNA, 22 bp, Homo sapiens
aaagcactttgagactgacagg

SEQ ID NO: 9056052 - DNA, 22 bp, Homo sapiens
aaagcactttgagactgacagg

SEQ ID NO: 9056053 - DNA, 22 bp, Homo sapiens
aaagcagagatcatggcttgta

SEQ ID NO: 9056054 - DNA, 22 bp, Homo sapiens
aaagcagattctgatgcagtag

SEQ ID NO: 9056055 - DNA, 22 bp, Homo sapiens
aacataaatttgaagtggcaaa

SEQ ID NO: 9056056 - DNA, 22 bp, Homo sapiens
aaagcagaggtgatatgactta

SEQ ID NO: 9056057 - DNA, 22 bp, Homo sapiens
aaagcagaggtgatatgactta

SEQ ID NO: 9056058 - DNA, 22 bp, Homo sapiens
aaagcagaggttgcagtgagct

SEQ ID NO: 9056059 - DNA, 22 bp, Homo sapiens
aaagcccatgtggaagtacagg

SEQ ID NO: 9056060 - DNA, 22 bp, Homo sapiens
aaagcctcccaggttatgagta

SEQ ID NO: 9056061 - DNA, 22 bp, Homo sapiens
aacatataaactcttaagttca

SEQ ID NO: 9056062 - DNA, 22 bp, Homo sapiens
aacataatgtggccaaagtcac

SEQ ID NO: 9056063 - DNA, 22 bp, Homo sapiens
aacatacatatttcagtgtcca

SEQ ID NO: 9056064 - DNA, 22 bp, Homo sapiens
aaaggcaggactgcagcatagg

SEQ ID NO: 9056065 - DNA, 23 bp, Homo sapiens
aaaggcaggcctaggacatattg

SEQ ID NO: 9056066 - DNA, 22 bp, Homo sapiens
aaaggcagagttgttggaggca

SEQ ID NO: 9056067 - DNA, 22 bp, Homo sapiens
aacccgagggccccaggctcgg

SEQ ID NO: 9056068 - DNA, 22 bp, Homo sapiens
aacatttgtttggcttcaatta

SEQ ID NO: 9056069 - DNA, 22 bp, Homo sapiens
aaagccttgggatttgtgatca

SEQ ID NO: 9056070 - DNA, 22 bp, Homo sapiens
aaagccttgggatttgtgatca

SEQ ID NO: 9056071 - DNA, 22 bp, Homo sapiens
aaagccttggtcatctggttcc

SEQ ID NO: 9056072 - DNA, 22 bp, Homo sapiens
aaagccttggtcatctggttcc

SEQ ID NO: 9056073 - DNA, 22 bp, Homo sapiens
aaagcctcccaggttatgagta

SEQ ID NO: 9056074 - DNA, 22 bp, Homo sapiens
aaagccttgcccgtcactggga

SEQ ID NO: 9056075 - DNA, 22 bp, Homo sapiens
aaagccttcttcggtctgtgat

SEQ ID NO: 9056076 - DNA, 22 bp, Homo sapiens
aactgtacgataataaatttgt

SEQ ID NO: 9056077 - DNA, 22 bp, Homo sapiens
aaagtaagaccaagtgatcatt

SEQ ID NO: 9056078 - DNA, 22 bp, Homo sapiens
aagaaataagacttctctgtcc

SEQ ID NO: 9056079 - DNA, 22 bp, Homo sapiens
aagaaataagacttctctgtcc

SEQ ID NO: 9056080 - DNA, 22 bp, Homo sapiens
aagactctatctttagagatca

SEQ ID NO: 9056081 - DNA, 22 bp, Homo sapiens
aagactgtctgggacaagatga

SEQ ID NO: 9056082 - DNA, 22 bp, Homo sapiens
aagactgtatgagacaatataa

SEQ ID NO: 9056083 - DNA, 22 bp, Homo sapiens
aaagtttacagtgcacatgggt

SEQ ID NO: 9056084 - DNA, 22 bp, Homo sapiens
aaagtttaggctttgaaaccag

SEQ ID NO: 9056085 - DNA, 22 bp, Homo sapiens
aagacgcaccctttgagggcac

SEQ ID NO: 9056086 - DNA, 22 bp, Homo sapiens
aagacctgcacagtttaccatt

SEQ ID NO: 9056087 - DNA, 22 bp, Homo sapiens
aagacctgcatgcggactaaca

SEQ ID NO: 9056088 - DNA, 22 bp, Homo sapiens
aagacctgcagtttctctacct

SEQ ID NO: 9056089 - DNA, 22 bp, Homo sapiens
aaagtgattatgctgtcaaaga

SEQ ID NO: 9056090 - DNA, 22 bp, Homo sapiens
aaagtgattatgctgtcaaaga

SEQ ID NO: 9056091 - DNA, 22 bp, Homo sapiens
aagaacatggtaggataacaaa

SEQ ID NO: 9056092 - DNA, 22 bp, Homo sapiens
aaagttttagaactaggaagca

SEQ ID NO: 9056093 - DNA, 22 bp, Homo sapiens
aaagtttccaagttacaccatt

SEQ ID NO: 9056094 - DNA, 22 bp, Homo sapiens
aagaggaggatgctttacagct

SEQ ID NO: 9056095 - DNA, 22 bp, Homo sapiens
aaatactgctgctattcctttt

SEQ ID NO: 9056096 - DNA, 22 bp, Homo sapiens
aaatactggcaagtgctaattc

SEQ ID NO: 9056097 - DNA, 22 bp, Homo sapiens
aagataaactcttgatttctga

SEQ ID NO: 9056098 - DNA, 22 bp, Homo sapiens
aaatctgtttcaggtatatttg

SEQ ID NO: 9056099 - DNA, 22 bp, Homo sapiens
aaatctgaaatagtgtgaagta

SEQ ID NO: 9056100 - DNA, 22 bp, Homo sapiens
aagattaaaggggagacaagct

SEQ ID NO: 9056101 - DNA, 22 bp, Homo sapiens
aagatgttgcattagaatacct

SEQ ID NO: 9056102 - DNA, 22 bp, Homo sapiens
aagatcaccttgacatgaaaag

SEQ ID NO: 9056103 - DNA, 22 bp, Homo sapiens
aagatcaccaagtaacagtctg

SEQ ID NO: 9056104 - DNA, 22 bp, Homo sapiens
aagatcaagtgtactttatgta

SEQ ID NO: 9056105 - DNA, 22 bp, Homo sapiens
aagcaggatggaggttgagtta

SEQ ID NO: 9056106 - DNA, 22 bp, Homo sapiens
aagcaggagatgggtgcttttc

SEQ ID NO: 9056107 - DNA, 22 bp, Homo sapiens
aagcaggagatgggtgcttttc

SEQ ID NO: 9056108 - DNA, 21 bp, Homo sapiens
aaaaagctggggcatgcatgc

SEQ ID NO: 9056109 - DNA, 21 bp, Homo sapiens
aaaaagctggggcatgcatgc

SEQ ID NO: 9056110 - DNA, 22 bp, Homo sapiens
aaaaactgcaattacttttgtc

SEQ ID NO: 9056111 - DNA, 22 bp, Homo sapiens
aaaaagatgtcctgaagtttag

SEQ ID NO: 9056112 - DNA, 22 bp, Homo sapiens
aaaaaggttgatccagattagg

SEQ ID NO: 9056113 - DNA, 22 bp, Homo sapiens
aaaaagcttaaatgagcagttc

SEQ ID NO: 9056114 - DNA, 22 bp, Homo sapiens
aaaaaggctaagcatcttgtgc

SEQ ID NO: 9056115 - DNA, 22 bp, Homo sapiens
aaaaagtttcaactgccaactc

SEQ ID NO: 9056116 - DNA, 18 bp, Homo sapiens
aaaaagtgctcaggccta

SEQ ID NO: 9056117 - DNA, 22 bp, Homo sapiens
aaaaatacttcacttctgggtg

SEQ ID NO: 9056118 - DNA, 22 bp, Homo sapiens
aaaaggcagtgcaagagagggt

SEQ ID NO: 9056119 - DNA, 22 bp, Homo sapiens
aaaacccttctgcagactctga

SEQ ID NO: 9056120 - DNA, 22 bp, Homo sapiens
aaaaccaggcttgctgtgctcg

SEQ ID NO: 9056121 - DNA, 22 bp, Homo sapiens
aaaaccaggtagcaaaggagac

SEQ ID NO: 9056122 - DNA, 22 bp, Homo sapiens
aaaactctgcagttagtttcta

SEQ ID NO: 9056123 - DNA, 22 bp, Homo sapiens
aaaactgaaatacgatccaatg

SEQ ID NO: 9056124 - DNA, 22 bp, Homo sapiens
aaaaccttctagactttatatt

SEQ ID NO: 9056125 - DNA, 22 bp, Homo sapiens
aaaactacatttgacattttgt

SEQ ID NO: 9056126 - DNA, 22 bp, Homo sapiens
aaaactacatttgacattttgt

SEQ ID NO: 9056127 - DNA, 22 bp, Homo sapiens
aaaattcatggcttgggaaaag

SEQ ID NO: 9056128 - DNA, 22 bp, Homo sapiens
aaaactttcagggatacagaaa

SEQ ID NO: 9056129 - DNA, 22 bp, Homo sapiens
aaaaggttttgagtacaaatat

SEQ ID NO: 9056130 - DNA, 22 bp, Homo sapiens
aaaagtaattgcaattttgtag

SEQ ID NO: 9056131 - DNA, 22 bp, Homo sapiens
aaacagcttgtttcaggaaagt

SEQ ID NO: 9056132 - DNA, 22 bp, Homo sapiens
aaaagtaattgcaattttgtag

SEQ ID NO: 9056133 - DNA, 22 bp, Homo sapiens
aaaagtaattgcagttttgtca

SEQ ID NO: 9056134 - DNA, 22 bp, Homo sapiens
aaaatatgaagttgtcagtatg

SEQ ID NO: 9056135 - DNA, 22 bp, Homo sapiens
aaacaggcttatattttgctct

SEQ ID NO: 9056136 - DNA, 22 bp, Homo sapiens
aaacaggcttccattagagcaa

SEQ ID NO: 9056137 - DNA, 22 bp, Homo sapiens
aaacaggcgcttactaagaaaa

SEQ ID NO: 9056138 - DNA, 22 bp, Homo sapiens
aaacaggctctgcgggatgctc

SEQ ID NO: 9056139 - DNA, 22 bp, Homo sapiens
aaacaggcttttaagtcaatag

SEQ ID NO: 9056140 - DNA, 22 bp, Homo sapiens
aaacaggcttgcaacatgtttt

SEQ ID NO: 9056141 - DNA, 22 bp, Homo sapiens
aaacaggcatcactcagcaaag

SEQ ID NO: 9056142 - DNA, 19 bp, Homo sapiens
aaacaggccgagtgcctaa

SEQ ID NO: 9056143 - DNA, 22 bp, Homo sapiens
aaacaggcacatagtaacattt

SEQ ID NO: 9056144 - DNA, 22 bp, Homo sapiens
aaacagctttcagaatctctca

SEQ ID NO: 9056145 - DNA, 22 bp, Homo sapiens
aaaatgtgatctacaaatgcaa

SEQ ID NO: 9056146 - DNA, 22 bp, Homo sapiens
aaaatattttagggccaggaga

SEQ ID NO: 9056147 - DNA, 20 bp, Homo sapiens
aaaatatgtataactcttct

SEQ ID NO: 9056148 - DNA, 22 bp, Homo sapiens
aaaatatgtataactcttctgc

SEQ ID NO: 9056149 - DNA, 17 bp, Homo sapiens
aaaattctgtaaagagg

SEQ ID NO: 9056150 - DNA, 17 bp, Homo sapiens
aaaattctgtaaagagg

SEQ ID NO: 9056151 - DNA, 22 bp, Homo sapiens
aaaattgagagtcttgtgcaag

SEQ ID NO: 9056152 - DNA, 22 bp, Homo sapiens
aaaattgaagtgatcaggaact

SEQ ID NO: 9056153 - DNA, 22 bp, Homo sapiens
aaagagccagctacctcagttt

SEQ ID NO: 9056154 - DNA, 21 bp, Homo sapiens
aaagagcccgctgagaggttc

SEQ ID NO: 9056155 - DNA, 22 bp, Homo sapiens
aaaattgaggccagtatgccat

SEQ ID NO: 9056156 - DNA, 22 bp, Homo sapiens
aaaattgaggctcatgttaaat

SEQ ID NO: 9056157 - DNA, 22 bp, Homo sapiens
aaaattgagagttatagatggt

SEQ ID NO: 9056158 - DNA, 22 bp, Homo sapiens
aaagagctggcatttatagtct

SEQ ID NO: 9056159 - DNA, 22 bp, Homo sapiens
aaagagctcacagtccactgga

SEQ ID NO: 9056160 - DNA, 22 bp, Homo sapiens
aaagagctgggacttaaagtgc

SEQ ID NO: 9056161 - DNA, 22 bp, Homo sapiens
aaacacaagatggcctcttctg

SEQ ID NO: 9056162 - DNA, 22 bp, Homo sapiens
aaagagcaagctgagatttgaa

SEQ ID NO: 9056163 - DNA, 22 bp, Homo sapiens
aaagagatgtgccaaatagcct

SEQ ID NO: 9056164 - DNA, 22 bp, Homo sapiens
aaagactaagaagagtattatt

SEQ ID NO: 9056165 - DNA, 22 bp, Homo sapiens
aaagactacacgggaaagagct

SEQ ID NO: 9056166 - DNA, 22 bp, Homo sapiens
aaagaaatagatggcatttaaa

SEQ ID NO: 9056167 - DNA, 22 bp, Homo sapiens
aaagaaatagatggcatttaaa

SEQ ID NO: 9056168 - DNA, 22 bp, Homo sapiens
aaagaaatacctttctcagctt

SEQ ID NO: 9056169 - DNA, 22 bp, Homo sapiens
aaagaacaaatgatatatggtt

SEQ ID NO: 9056170 - DNA, 16 bp, Homo sapiens
aaagaaacaggtgtcc

SEQ ID NO: 9056171 - DNA, 22 bp, Homo sapiens
aaagaaacctatcagccacatg

SEQ ID NO: 9056172 - DNA, 22 bp, Homo sapiens
aaagaaacctatcagccacatg

SEQ ID NO: 9056173 - DNA, 22 bp, Homo sapiens
aaatagttagccctgcatatat

SEQ ID NO: 9056174 - DNA, 22 bp, Homo sapiens
aaacttctctccctactttgtg

SEQ ID NO: 9056175 - DNA, 22 bp, Homo sapiens
aaactttaggaaggaatttaca

SEQ ID NO: 9056176 - DNA, 22 bp, Homo sapiens
aaacttctggctacaagcaata

SEQ ID NO: 9056177 - DNA, 22 bp, Homo sapiens
aaacagctggtctcaaatgttc

SEQ ID NO: 9056178 - DNA, 22 bp, Homo sapiens
aaacatgatgcctgtactaaga

SEQ ID NO: 9056179 - DNA, 22 bp, Homo sapiens
aaacatgatgtcatatatgcca

SEQ ID NO: 9056180 - DNA, 22 bp, Homo sapiens
aaacagctcaagaagttactct

SEQ ID NO: 9056181 - DNA, 22 bp, Homo sapiens
aaacagctccttagtttccatc

SEQ ID NO: 9056182 - DNA, 22 bp, Homo sapiens
aaacagctacttctgtataatg

SEQ ID NO: 9056183 - DNA, 22 bp, Homo sapiens
aaacagcagctgtttaatttgc

SEQ ID NO: 9056184 - DNA, 22 bp, Homo sapiens
aaacagctaagtacattcaagg

SEQ ID NO: 9056185 - DNA, 22 bp, Homo sapiens
aaagccagagtgtgttagagac

SEQ ID NO: 9056186 - DNA, 22 bp, Homo sapiens
aaacattccctaatgtgtccgt

SEQ ID NO: 9056187 - DNA, 22 bp, Homo sapiens
aaacattgacctcatcctggca

SEQ ID NO: 9056188 - DNA, 22 bp, Homo sapiens
aaacattgctaaataatgctgc

SEQ ID NO: 9056189 - DNA, 22 bp, Homo sapiens
aaactgtatagggaaaagtaga

SEQ ID NO: 9056190 - DNA, 22 bp, Homo sapiens
aaactgtcattggatgcatttg

SEQ ID NO: 9056191 - DNA, 18 bp, Homo sapiens
aaactgtatttctttcta

SEQ ID NO: 9056192 - DNA, 22 bp, Homo sapiens
aaactgtaagagaataaactac

SEQ ID NO: 9056193 - DNA, 22 bp, Homo sapiens
aaacattccatttctatgtaag

SEQ ID NO: 9056194 - DNA, 22 bp, Homo sapiens
aaacatgcattcaagaaaatct

SEQ ID NO: 9056195 - DNA, 22 bp, Homo sapiens
aaacatgctggatttagaatat

SEQ ID NO: 9056196 - DNA, 22 bp, Homo sapiens
aaacatgctatgttttggataa

SEQ ID NO: 9056197 - DNA, 22 bp, Homo sapiens
aaacatggccattcagactgtg

SEQ ID NO: 9056198 - DNA, 22 bp, Homo sapiens
ggctcaggtttccttcccagct

SEQ ID NO: 9056199 - DNA, 20 bp, Homo sapiens
ggctcatcttgtctgctgac

SEQ ID NO: 9056200 - DNA, 22 bp, Homo sapiens
ggctcaggactgcagcgtagag

SEQ ID NO: 9056201 - DNA, 22 bp, Homo sapiens
ggcccctcagcatctgagtcag

SEQ ID NO: 9056202 - DNA, 22 bp, Homo sapiens
ggccccagttcactcctggccg

SEQ ID NO: 9056203 - DNA, 22 bp, Homo sapiens
ggcccagcctcagacatgccct

SEQ ID NO: 9056204 - DNA, 22 bp, Homo sapiens
ggccccagattctgggctgggt

SEQ ID NO: 9056205 - DNA, 22 bp, Homo sapiens
ggccagaagttggaaaagagcc

SEQ ID NO: 9056206 - DNA, 22 bp, Homo sapiens
ggcaggtgctctgtgggcctgg

SEQ ID NO: 9056207 - DNA, 22 bp, Homo sapiens
ggcaggtgcttgtcgaaggcct

SEQ ID NO: 9056208 - DNA, 22 bp, Homo sapiens
ggctgcaagacaaggttggttt

SEQ ID NO: 9056209 - DNA, 22 bp, Homo sapiens
ggctgcaaaggaaaagtggtga

SEQ ID NO: 9056210 - DNA, 22 bp, Homo sapiens
ggctgcaaataacaactagctt

SEQ ID NO: 9056211 - DNA, 22 bp, Homo sapiens
ggctgcagagctggtgccctgg

SEQ ID NO: 9056212 - DNA, 22 bp, Homo sapiens
ggctgcagagctgggtgggcct

SEQ ID NO: 9056213 - DNA, 22 bp, Homo sapiens
ggctcctggaaagccctcgctc

SEQ ID NO: 9056214 - DNA, 22 bp, Homo sapiens
ggctcctgggcagctgctccct

SEQ ID NO: 9056215 - DNA, 22 bp, Homo sapiens
ggctctataaaggggcgcgcgc

SEQ ID NO: 9056216 - DNA, 22 bp, Homo sapiens
ggctctatgtggtggttttgat

SEQ ID NO: 9056217 - DNA, 22 bp, Homo sapiens
ggctctatttgtgtgttcgtaa

SEQ ID NO: 9056218 - DNA, 22 bp, Homo sapiens
ggctgcaggaacgacggagggg

SEQ ID NO: 9056219 - DNA, 22 bp, Homo sapiens
ggctgcaggcagaggctgtctg

SEQ ID NO: 9056220 - DNA, 19 bp, Homo sapiens
ggctgcctggagcgagggc

SEQ ID NO: 9056221 - DNA, 22 bp, Homo sapiens
ggctgccttcatagaccatggg

SEQ ID NO: 9056222 - DNA, 22 bp, Homo sapiens
ggctgctcggagcctcctgtga

SEQ ID NO: 9056223 - DNA, 22 bp, Homo sapiens
ggctgctcggagcctcctgtga

SEQ ID NO: 9056224 - DNA, 22 bp, Homo sapiens
ggctgctcggcagctcctgagc

SEQ ID NO: 9056225 - DNA, 22 bp, Homo sapiens
ggctgctcggcagctcctgagc

SEQ ID NO: 9056226 - DNA, 22 bp, Homo sapiens
ggctgctctgccttccagctgg

SEQ ID NO: 9056227 - DNA, 23 bp, Homo sapiens
ggctgctcttttcatgctgtttc

SEQ ID NO: 9056228 - DNA, 22 bp, Homo sapiens
ggcttcctggagaaggtctgag

SEQ ID NO: 9056229 - DNA, 22 bp, Homo sapiens
ggcttcctggggcctcctgcaa

SEQ ID NO: 9056230 - DNA, 22 bp, Homo sapiens
gggaagaagacatggtgaaggc

SEQ ID NO: 9056231 - DNA, 22 bp, Homo sapiens
gggaacagcatatctgaagggt

SEQ ID NO: 9056232 - DNA, 22 bp, Homo sapiens
gggaacagggcctgagctgggg

SEQ ID NO: 9056233 - DNA, 22 bp, Homo sapiens
ggctggctatctgtggttgcct

SEQ ID NO: 9056234 - DNA, 22 bp, Homo sapiens
ggggacagttaaagaccaagac

SEQ ID NO: 9056235 - DNA, 22 bp, Homo sapiens
ggggacagttaaagaccaagac

SEQ ID NO: 9056236 - DNA, 23 bp, Homo sapiens
ggggacagagggcagcccgcatc

SEQ ID NO: 9056237 - DNA, 16 bp, Homo sapiens
ggggaaggcaagaggg

SEQ ID NO: 9056238 - DNA, 22 bp, Homo sapiens
gggggtgaggacaggagcactg

SEQ ID NO: 9056239 - DNA, 16 bp, Homo sapiens
gggggtgagagagagt

SEQ ID NO: 9056240 - DNA, 20 bp, Homo sapiens
gggtccaggactctgaattt

SEQ ID NO: 9056241 - DNA, 22 bp, Homo sapiens
gggtccagctacatcagggtgg

SEQ ID NO: 9056242 - DNA, 22 bp, Homo sapiens
gggtccaggcgtggcccagatg

SEQ ID NO: 9056243 - DNA, 22 bp, Homo sapiens
gggtccaggcactatgctaagt

SEQ ID NO: 9056244 - DNA, 22 bp, Homo sapiens
gggtccaggcggcatagttgta

SEQ ID NO: 9056245 - DNA, 22 bp, Homo sapiens
gggtccagggccagtggctgag

SEQ ID NO: 9056246 - DNA, 22 bp, Homo sapiens
gggtccagggacgtttctgcag

SEQ ID NO: 9056247 - DNA, 22 bp, Homo sapiens
gggggtcccaagctgggctgct

SEQ ID NO: 9056248 - DNA, 22 bp, Homo sapiens
gggggctcctcccagctgccag

SEQ ID NO: 9056249 - DNA, 22 bp, Homo sapiens
gggccacattgaagggtgggta

SEQ ID NO: 9056250 - DNA, 22 bp, Homo sapiens
gggccaggtggaccccagcctc

SEQ ID NO: 9056251 - DNA, 22 bp, Homo sapiens
gggccagtctgactctgctggt

SEQ ID NO: 9056252 - DNA, 21 bp, Homo sapiens
gggccacaccttctgcagacc

SEQ ID NO: 9056253 - DNA, 20 bp, Homo sapiens
gggcagatgtttttatgttg

SEQ ID NO: 9056254 - DNA, 22 bp, Homo sapiens
gggccatgagaggttcatcaac

SEQ ID NO: 9056255 - DNA, 22 bp, Homo sapiens
gggcccagccctctgctcactg

SEQ ID NO: 9056256 - DNA, 22 bp, Homo sapiens
gggcggggggagctggaatgaa

SEQ ID NO: 9056257 - DNA, 22 bp, Homo sapiens
gggcggggggagctggaatgaa

SEQ ID NO: 9056258 - DNA, 22 bp, Homo sapiens
gggatctgacttgctggtgggt

SEQ ID NO: 9056259 - DNA, 22 bp, Homo sapiens
gggatgctggtgcctgtggcac

SEQ ID NO: 9056260 - DNA, 22 bp, Homo sapiens
gggaccagtgtctgtgagaaaa

SEQ ID NO: 9056261 - DNA, 22 bp, Homo sapiens
gggaggagcttggagattcact

SEQ ID NO: 9056262 - DNA, 22 bp, Homo sapiens
gggaggagcttggagattcact

SEQ ID NO: 9056263 - DNA, 22 bp, Homo sapiens
ggaagtagaagtaatgaaatca

SEQ ID NO: 9056264 - DNA, 22 bp, Homo sapiens
ggaatatagccagtaacagtca

SEQ ID NO: 9056265 - DNA, 22 bp, Homo sapiens
ggagaaggtggctcagcaaagg

SEQ ID NO: 9056266 - DNA, 22 bp, Homo sapiens
ggagacacagagcaacaaaata

SEQ ID NO: 9056267 - DNA, 22 bp, Homo sapiens
ggagacagcaggaagaaatatc

SEQ ID NO: 9056268 - DNA, 22 bp, Homo sapiens
ggagacactggaaagtattaca

SEQ ID NO: 9056269 - DNA, 22 bp, Homo sapiens
ggagctagcctgtctctgttta

SEQ ID NO: 9056270 - DNA, 22 bp, Homo sapiens
ggagctgaaccccatcgtgctg

SEQ ID NO: 9056271 - DNA, 22 bp, Homo sapiens
ggagctgagacccagtggctga

SEQ ID NO: 9056272 - DNA, 22 bp, Homo sapiens
ggagctgaaggggtgggctcag

SEQ ID NO: 9056273 - DNA, 22 bp, Homo sapiens
ggagctgatgacgtcaccatgg

SEQ ID NO: 9056274 - DNA, 22 bp, Homo sapiens
ggagctgatggtagaagaatga

SEQ ID NO: 9056275 - DNA, 22 bp, Homo sapiens
ggagctgatggtagaagaatga

SEQ ID NO: 9056276 - DNA, 22 bp, Homo sapiens
ggagctgaggtaacagtgagtg

SEQ ID NO: 9056277 - DNA, 22 bp, Homo sapiens
ggagctgagtgggtttattgat

SEQ ID NO: 9056278 - DNA, 22 bp, Homo sapiens
ggagctgagttcttcagccggg

SEQ ID NO: 9056279 - DNA, 22 bp, Homo sapiens
ggagctgaggaatagctttgat

SEQ ID NO: 9056280 - DNA, 22 bp, Homo sapiens
ggagctgaggctgaggcctcac

SEQ ID NO: 9056281 - DNA, 22 bp, Homo sapiens
ggagctgaggacactacatttt

SEQ ID NO: 9056282 - DNA, 22 bp, Homo sapiens
ggagctgagagtagtccctttt

SEQ ID NO: 9056283 - DNA, 22 bp, Homo sapiens
ggagctgagcagcgatggcgga

SEQ ID NO: 9056284 - DNA, 22 bp, Homo sapiens
ggaggagcatgagagggtagtg

SEQ ID NO: 9056285 - DNA, 22 bp, Homo sapiens
ggaggcagaatagagtgtgggt

SEQ ID NO: 9056286 - DNA, 22 bp, Homo sapiens
ggaggaggcaagtaccagatgc

SEQ ID NO: 9056287 - DNA, 22 bp, Homo sapiens
ggaggagctgctgtgggggccc

SEQ ID NO: 9056288 - DNA, 22 bp, Homo sapiens
ggaagaaagcacacaaacttga

SEQ ID NO: 9056289 - DNA, 22 bp, Homo sapiens
ggaaggtgctccctggacagag

SEQ ID NO: 9056290 - DNA, 22 bp, Homo sapiens
ggaagaaatctggttaagagat

SEQ ID NO: 9056291 - DNA, 22 bp, Homo sapiens
ggaagggagtagttggaatgca

SEQ ID NO: 9056292 - DNA, 19 bp, Homo sapiens
ggaaacaggggccagagga

SEQ ID NO: 9056293 - DNA, 22 bp, Homo sapiens
ggaaacagctctttggggctgt

SEQ ID NO: 9056294 - DNA, 19 bp, Homo sapiens
ggaaacagcacacttttga

SEQ ID NO: 9056295 - DNA, 22 bp, Homo sapiens
ggaaacagcaaattatggcaat

SEQ ID NO: 9056296 - DNA, 22 bp, Homo sapiens
ggaaacagagggcacctgagcc

SEQ ID NO: 9056297 - DNA, 22 bp, Homo sapiens
ggaaacagagggcacctgagcc

SEQ ID NO: 9056298 - DNA, 22 bp, Homo sapiens
ggaaacaaaccactcatggtgg

SEQ ID NO: 9056299 - DNA, 22 bp, Homo sapiens
ggaaagaatcaagtgatcctgt

SEQ ID NO: 9056300 - DNA, 22 bp, Homo sapiens
ggaaagaatagagactttatca

SEQ ID NO: 9056301 - DNA, 22 bp, Homo sapiens
ggaaagaaccctggatggctgg

SEQ ID NO: 9056302 - DNA, 22 bp, Homo sapiens
ggaaagaaccctggatggctgg

SEQ ID NO: 9056303 - DNA, 22 bp, Homo sapiens
ggaaagaaagtgtgaacaactt

SEQ ID NO: 9056304 - DNA, 22 bp, Homo sapiens
gcttcatgggtgtgcaacctgt

SEQ ID NO: 9056305 - DNA, 22 bp, Homo sapiens
gcttattttatcctattcacta

SEQ ID NO: 9056306 - DNA, 22 bp, Homo sapiens
gcttctgcgcctagcctcaggt

SEQ ID NO: 9056307 - DNA, 22 bp, Homo sapiens
gcttctgctgttgaagccacca

SEQ ID NO: 9056308 - DNA, 23 bp, Homo sapiens
gcttctgccatttgctagctgtg

SEQ ID NO: 9056309 - DNA, 22 bp, Homo sapiens
gcttctgcgcacgcttcttccc

SEQ ID NO: 9056310 - DNA, 22 bp, Homo sapiens
gcttctgccttgcactttgtca

SEQ ID NO: 9056311 - DNA, 22 bp, Homo sapiens
gcttctgcagggtcctcgctgt

SEQ ID NO: 9056312 - DNA, 22 bp, Homo sapiens
gcttctgcagagccgtcctgag

SEQ ID NO: 9056313 - DNA, 22 bp, Homo sapiens
gcttctgcagccaaagaagccg

SEQ ID NO: 9056314 - DNA, 22 bp, Homo sapiens
gcttctgatgtcagacttctgg

SEQ ID NO: 9056315 - DNA, 22 bp, Homo sapiens
gcttctaattttttacagaata

SEQ ID NO: 9056316 - DNA, 22 bp, Homo sapiens
gcttcggggtccaagcgcgtgt

SEQ ID NO: 9056317 - DNA, 22 bp, Homo sapiens
gcttctcaattctcaccctcca

SEQ ID NO: 9056318 - DNA, 22 bp, Homo sapiens
gcttcctgtaggcaggtccaag

SEQ ID NO: 9056319 - DNA, 22 bp, Homo sapiens
gcttcctgtaggcaggtccaag

SEQ ID NO: 9056320 - DNA, 22 bp, Homo sapiens
gcttccttctaccacatcatgc

SEQ ID NO: 9056321 - DNA, 22 bp, Homo sapiens
gcttccttattgttgccatagt

SEQ ID NO: 9056322 - DNA, 22 bp, Homo sapiens
gcttccttctaccacatcatgc

SEQ ID NO: 9056323 - DNA, 21 bp, Homo sapiens
gctgggctccagtctgccgct

SEQ ID NO: 9056324 - DNA, 22 bp, Homo sapiens
gctgggctctgtcatgccttcc

SEQ ID NO: 9056325 - DNA, 22 bp, Homo sapiens
gcttattttcaccttctctcag

SEQ ID NO: 9056326 - DNA, 22 bp, Homo sapiens
gcttacaagggtaggaagtcta

SEQ ID NO: 9056327 - DNA, 22 bp, Homo sapiens
gcttacaatcatttcagtttag

SEQ ID NO: 9056328 - DNA, 22 bp, Homo sapiens
gctgggctgagctagacttggc

SEQ ID NO: 9056329 - DNA, 22 bp, Homo sapiens
gcttacaagccagctgtaccac

SEQ ID NO: 9056330 - DNA, 22 bp, Homo sapiens
gcttacaagatcgtgctccagt

SEQ ID NO: 9056331 - DNA, 22 bp, Homo sapiens
gcttacaaacaacagaaattaa

SEQ ID NO: 9056332 - DNA, 22 bp, Homo sapiens
gcttacaagatcgtgctccagt

SEQ ID NO: 9056333 - DNA, 22 bp, Homo sapiens
gcttaattctggctcagtttcc

SEQ ID NO: 9056334 - DNA, 22 bp, Homo sapiens
gcttaattctggctcagtttcc

SEQ ID NO: 9056335 - DNA, 20 bp, Homo sapiens
ggagggtggaagaaagcaag

SEQ ID NO: 9056336 - DNA, 22 bp, Homo sapiens
ggaggtggaggttgcagtgagc

SEQ ID NO: 9056337 - DNA, 22 bp, Homo sapiens
ggaggtggtggcagtgacaatt

SEQ ID NO: 9056338 - DNA, 22 bp, Homo sapiens
ggagtaaggctcagaggaaatg

SEQ ID NO: 9056339 - DNA, 22 bp, Homo sapiens
ggaggggtggaaggagtgcctg

SEQ ID NO: 9056340 - DNA, 22 bp, Homo sapiens
ggaggggtgagaatggctgcct

SEQ ID NO: 9056341 - DNA, 22 bp, Homo sapiens
ggagggggaagaagctaaagac

SEQ ID NO: 9056342 - DNA, 22 bp, Homo sapiens
ggaggggagtctcccaaagccg

SEQ ID NO: 9056343 - DNA, 22 bp, Homo sapiens
ggaggggaggattaatgacaaa

SEQ ID NO: 9056344 - DNA, 22 bp, Homo sapiens
ggagggctcgtcatccaccact

SEQ ID NO: 9056345 - DNA, 22 bp, Homo sapiens
ggagggctgccaggtggagcgg

SEQ ID NO: 9056346 - DNA, 22 bp, Homo sapiens
ggagggctgtagaggagacctg

SEQ ID NO: 9056347 - DNA, 22 bp, Homo sapiens
ggagggcacaggaccagaaatc

SEQ ID NO: 9056348 - DNA, 22 bp, Homo sapiens
ggagggaaccttggctggattg

SEQ ID NO: 9056349 - DNA, 21 bp, Homo sapiens
ggagggcagcccagactggct

SEQ ID NO: 9056350 - DNA, 22 bp, Homo sapiens
ggcaggtgctaagagaggtaaa

SEQ ID NO: 9056351 - DNA, 17 bp, Homo sapiens
ggcaggtgcggggccgc

SEQ ID NO: 9056352 - DNA, 17 bp, Homo sapiens
ggcaggtgcggggccgc

SEQ ID NO: 9056353 - DNA, 22 bp, Homo sapiens
ggcaggctgggtgtcatggagt

SEQ ID NO: 9056354 - DNA, 22 bp, Homo sapiens
ggcaggcagcctccatccacag

SEQ ID NO: 9056355 - DNA, 22 bp, Homo sapiens
ggcaggcattgcaacatgtaca

SEQ ID NO: 9056356 - DNA, 22 bp, Homo sapiens
ggcaggcattagagattcccag

SEQ ID NO: 9056357 - DNA, 22 bp, Homo sapiens
ggcaggcgtggtggcctcagaa

SEQ ID NO: 9056358 - DNA, 22 bp, Homo sapiens
ggcaggctcagcagccaaggag

SEQ ID NO: 9056359 - DNA, 22 bp, Homo sapiens
ggcaggctcttggccttatgag

SEQ ID NO: 9056360 - DNA, 23 bp, Homo sapiens
ggcagctctcatctgatgactga

SEQ ID NO: 9056361 - DNA, 22 bp, Homo sapiens
ggcagctctgatgatgctctgg

SEQ ID NO: 9056362 - DNA, 22 bp, Homo sapiens
ggcagaggaagctggaagtggg

SEQ ID NO: 9056363 - DNA, 22 bp, Homo sapiens
ggcagctctgctaattgagcct

SEQ ID NO: 9056364 - DNA, 22 bp, Homo sapiens
ggcagctctgctccttggctcc

SEQ ID NO: 9056365 - DNA, 22 bp, Homo sapiens
ggcaggcagatggctgcaccaa

SEQ ID NO: 9056366 - DNA, 19 bp, Homo sapiens
ggagtgggtagttagtggt

SEQ ID NO: 9056367 - DNA, 22 bp, Homo sapiens
ggagtgggcagcactgccctgt

SEQ ID NO: 9056368 - DNA, 22 bp, Homo sapiens
ggagtgggaacaatgacatggt

SEQ ID NO: 9056369 - DNA, 22 bp, Homo sapiens
ggagttgattttggatatatta

SEQ ID NO: 9056370 - DNA, 22 bp, Homo sapiens
ggagtgtgggatggagctcagg

SEQ ID NO: 9056371 - DNA, 22 bp, Homo sapiens
ggcacagagctttgtcccagtt

SEQ ID NO: 9056372 - DNA, 22 bp, Homo sapiens
gtacatgattccccataaaaag

SEQ ID NO: 9056373 - DNA, 22 bp, Homo sapiens
gtacattcagcttagcacttct

SEQ ID NO: 9056374 - DNA, 22 bp, Homo sapiens
gtacattctaaactgtatgccc

SEQ ID NO: 9056375 - DNA, 22 bp, Homo sapiens
gtacagtcttcttaatgctttt

SEQ ID NO: 9056376 - DNA, 22 bp, Homo sapiens
gtacatacgtagatccatcatt

SEQ ID NO: 9056377 - DNA, 22 bp, Homo sapiens
gtaaacattactgtgctgtata

SEQ ID NO: 9056378 - DNA, 22 bp, Homo sapiens
gtaaagctctcatttaatatca

SEQ ID NO: 9056379 - DNA, 22 bp, Homo sapiens
gtaaagcaggtagttgggacac

SEQ ID NO: 9056380 - DNA, 22 bp, Homo sapiens
gtacacaaaagaggaaaccgga

SEQ ID NO: 9056381 - DNA, 22 bp, Homo sapiens
gtacacaaagtgagacttgata

SEQ ID NO: 9056382 - DNA, 18 bp, Homo sapiens
gtacacaaagtcaaagta

SEQ ID NO: 9056383 - DNA, 22 bp, Homo sapiens
gtacacaaataataaagttaca

SEQ ID NO: 9056384 - DNA, 22 bp, Homo sapiens
gtacacacaatctctggtcagt

SEQ ID NO: 9056385 - DNA, 21 bp, Homo sapiens
gtacacacaggtggatgggct

SEQ ID NO: 9056386 - DNA, 22 bp, Homo sapiens
ggtgagtttcatggttgtttac

SEQ ID NO: 9056387 - DNA, 22 bp, Homo sapiens
ggtgcaggcggtggggcaagta

SEQ ID NO: 9056388 - DNA, 22 bp, Homo sapiens
gggtggggttcaggaatcttca

SEQ ID NO: 9056389 - DNA, 22 bp, Homo sapiens
gggtggggtgtatcggatccta

SEQ ID NO: 9056390 - DNA, 22 bp, Homo sapiens
gggtggggccaggcaatttgca

SEQ ID NO: 9056391 - DNA, 22 bp, Homo sapiens
gggtggggcccaggaaatctat

SEQ ID NO: 9056392 - DNA, 22 bp, Homo sapiens
ggtgaggggagagtgaaagaaa

SEQ ID NO: 9056393 - DNA, 22 bp, Homo sapiens
ggtgtccactcagcccgtcctg

SEQ ID NO: 9056394 - DNA, 21 bp, Homo sapiens
ggtgtccagaggagtccccag

SEQ ID NO: 9056395 - DNA, 22 bp, Homo sapiens
gtatgtctatagtttttaaata

SEQ ID NO: 9056396 - DNA, 22 bp, Homo sapiens
gtccagggaaatagcgacaggg

SEQ ID NO: 9056397 - DNA, 22 bp, Homo sapiens
gtccatggcatttccgtcacat

SEQ ID NO: 9056398 - DNA, 22 bp, Homo sapiens
gtccatggcagagcccttctgc

SEQ ID NO: 9056399 - DNA, 22 bp, Homo sapiens
gtccatggttgctttcatgtaa

SEQ ID NO: 9056400 - DNA, 18 bp, Homo sapiens
gtccatggcctccaccca

SEQ ID NO: 9056401 - DNA, 22 bp, Homo sapiens
gtccatgcttaaataccttaaa

SEQ ID NO: 9056402 - DNA, 22 bp, Homo sapiens
gtccatgcagtcacctccagct

SEQ ID NO: 9056403 - DNA, 22 bp, Homo sapiens
gtccatctcttattgatcctaa

SEQ ID NO: 9056404 - DNA, 22 bp, Homo sapiens
gtccagtggtcaattatctgga

SEQ ID NO: 9056405 - DNA, 20 bp, Homo sapiens
gtccagtgggccttcatttc

SEQ ID NO: 9056406 - DNA, 19 bp, Homo sapiens
gtccagtgttttccagtca

SEQ ID NO: 9056407 - DNA, 22 bp, Homo sapiens
gtccagttgtatgtccagtgtc

SEQ ID NO: 9056408 - DNA, 22 bp, Homo sapiens
gtccagtttcagggtctgcgct

SEQ ID NO: 9056409 - DNA, 22 bp, Homo sapiens
gtccagtgacaagtagctggcc

SEQ ID NO: 9056410 - DNA, 22 bp, Homo sapiens
gtccaggtctggaccctgagcc

SEQ ID NO: 9056411 - DNA, 22 bp, Homo sapiens
gtcccaggtgggctccacctct

SEQ ID NO: 9056412 - DNA, 22 bp, Homo sapiens
gtcctgtgtcccagagaaagag

SEQ ID NO: 9056413 - DNA, 22 bp, Homo sapiens
gtcgccatgacaacaccagccg

SEQ ID NO: 9056414 - DNA, 22 bp, Homo sapiens
gtccttggcttgaggcacctca

SEQ ID NO: 9056415 - DNA, 22 bp, Homo sapiens
gtctgagaggagccaagtattg

SEQ ID NO: 9056416 - DNA, 22 bp, Homo sapiens
gtctgagggacagagtcctggc

SEQ ID NO: 9056417 - DNA, 22 bp, Homo sapiens
gtggctcatctttgggaagtaa

SEQ ID NO: 9056418 - DNA, 19 bp, Homo sapiens
gtggctcatgtagtgggcc

SEQ ID NO: 9056419 - DNA, 22 bp, Homo sapiens
gtggctcagttaacttccatgt

SEQ ID NO: 9056420 - DNA, 22 bp, Homo sapiens
gtggctcagcggagctctgcac

SEQ ID NO: 9056421 - DNA, 22 bp, Homo sapiens
gtggcctctgttggctcctagg

SEQ ID NO: 9056422 - DNA, 22 bp, Homo sapiens
gtgggagaaattagctctagtt

SEQ ID NO: 9056423 - DNA, 22 bp, Homo sapiens
gtggcattgacatgtaaacagt

SEQ ID NO: 9056424 - DNA, 22 bp, Homo sapiens
gtggcaggagagacacagccat

SEQ ID NO: 9056425 - DNA, 22 bp, Homo sapiens
gtggcaggatcacggctcactg

SEQ ID NO: 9056426 - DNA, 22 bp, Homo sapiens
gtggcccaggcttggcgctggc

SEQ ID NO: 9056427 - DNA, 16 bp, Homo sapiens
gtggattcccagcctg

SEQ ID NO: 9056428 - DNA, 22 bp, Homo sapiens
gtggcagaggctctgggaccag

SEQ ID NO: 9056429 - DNA, 17 bp, Homo sapiens
gtggaggtgctctggta

SEQ ID NO: 9056430 - DNA, 22 bp, Homo sapiens
gtggagggaatgaatcttctct

SEQ ID NO: 9056431 - DNA, 22 bp, Homo sapiens
gtgcctggaactgggtaggctg

SEQ ID NO: 9056432 - DNA, 22 bp, Homo sapiens
gtgcctggaactgggtaggctg

SEQ ID NO: 9056433 - DNA, 22 bp, Homo sapiens
gtgacatgcatggtgctggtgg

SEQ ID NO: 9056434 - DNA, 22 bp, Homo sapiens
gtgacaaaggtcaagcttttga

SEQ ID NO: 9056435 - DNA, 22 bp, Homo sapiens
gtgaaggccgtccttggggact

SEQ ID NO: 9056436 - DNA, 22 bp, Homo sapiens
gtggaaggtgaaggagcagcga

SEQ ID NO: 9056437 - DNA, 22 bp, Homo sapiens
gtgcctggcacacagaaggcaa

SEQ ID NO: 9056438 - DNA, 20 bp, Homo sapiens
gtgcctggagaagaggctgt

SEQ ID NO: 9056439 - DNA, 22 bp, Homo sapiens
gttcgcatcttgatcatggact

SEQ ID NO: 9056440 - DNA, 22 bp, Homo sapiens
gttctattactccctgcttctt

SEQ ID NO: 9056441 - DNA, 22 bp, Homo sapiens
gttattttatctctgagaggtt

SEQ ID NO: 9056442 - DNA, 22 bp, Homo sapiens
gttgtgattgtagctaaactag

SEQ ID NO: 9056443 - DNA, 22 bp, Homo sapiens
gttctcctcttagctgtgccac

SEQ ID NO: 9056444 - DNA, 21 bp, Homo sapiens
gttctattttgcaaacttctg

SEQ ID NO: 9056445 - DNA, 22 bp, Homo sapiens
gttctctatcattagtgaattt

SEQ ID NO: 9056446 - DNA, 22 bp, Homo sapiens
gttctccttgtggctgcagcag

SEQ ID NO: 9056447 - DNA, 22 bp, Homo sapiens
gttctcctggctcccaccctgc

SEQ ID NO: 9056448 - DNA, 22 bp, Homo sapiens
gttctcctcttgtcccaggctg

SEQ ID NO: 9056449 - DNA, 22 bp, Homo sapiens
gtgtggggaggagagagccctt

SEQ ID NO: 9056450 - DNA, 22 bp, Homo sapiens
gtgggcagcaccagggaagtgt

SEQ ID NO: 9056451 - DNA, 20 bp, Homo sapiens
gtgggcagcaggcatactgg

SEQ ID NO: 9056452 - DNA, 22 bp, Homo sapiens
gtgggcagagcaagggaactca

SEQ ID NO: 9056453 - DNA, 22 bp, Homo sapiens
gtgggctcccctggcatgtcca

SEQ ID NO: 9056454 - DNA, 22 bp, Homo sapiens
gtgggctcaggcctctgtgggg

SEQ ID NO: 9056455 - DNA, 22 bp, Homo sapiens
gtgggggatgctgagttggaaa

SEQ ID NO: 9056456 - DNA, 22 bp, Homo sapiens
gtgggggacccaggtgctgtcc

SEQ ID NO: 9056457 - DNA, 22 bp, Homo sapiens
gtggggaggcattcttctccct

SEQ ID NO: 9056458 - DNA, 22 bp, Homo sapiens
gtggggaggcctaagcaagttg

SEQ ID NO: 9056459 - DNA, 22 bp, Homo sapiens
gtggggtagatctttctcagga

SEQ ID NO: 9056460 - DNA, 22 bp, Homo sapiens
gtgggggtggaaaggcaagttg

SEQ ID NO: 9056461 - DNA, 22 bp, Homo sapiens
gtgggggtttcattaagacaat

SEQ ID NO: 9056462 - DNA, 18 bp, Homo sapiens
gtggggtgttgtgaggat

SEQ ID NO: 9056463 - DNA, 22 bp, Homo sapiens
gtgggtgctgtcaggcagggaa

SEQ ID NO: 9056464 - DNA, 22 bp, Homo sapiens
gtgggtggagactgggtgcaag

SEQ ID NO: 9056465 - DNA, 22 bp, Homo sapiens
gtgggtggaggcgtcgagggca

SEQ ID NO: 9056466 - DNA, 22 bp, Homo sapiens
gtggtccatcatgcagagctcc

SEQ ID NO: 9056467 - DNA, 22 bp, Homo sapiens
gtggtgtaggtcacagttagga

SEQ ID NO: 9056468 - DNA, 22 bp, Homo sapiens
gtggtgtaggtcacagttagga

SEQ ID NO: 9056469 - DNA, 22 bp, Homo sapiens
gtggtgagttcaggctggggtg

SEQ ID NO: 9056470 - DNA, 22 bp, Homo sapiens
gtggttccgaatatttatttct

SEQ ID NO: 9056471 - DNA, 22 bp, Homo sapiens
taaatcttgtggcaatgcttct

SEQ ID NO: 9056472 - DNA, 22 bp, Homo sapiens
taaatcagggagtcatctgcga

SEQ ID NO: 9056473 - DNA, 22 bp, Homo sapiens
taaatcaggaaggaaacttgga

SEQ ID NO: 9056474 - DNA, 22 bp, Homo sapiens
taaatccagcttctaatttaga

SEQ ID NO: 9056475 - DNA, 22 bp, Homo sapiens
taaatcagtaaggcatattctc

SEQ ID NO: 9056476 - DNA, 22 bp, Homo sapiens
taaatagaatctaaactgctca

SEQ ID NO: 9056477 - DNA, 22 bp, Homo sapiens
taaatgacattcttaagtcttg

SEQ ID NO: 9056478 - DNA, 22 bp, Homo sapiens
taacactgaaaatgatgcatgt

SEQ ID NO: 9056479 - DNA, 22 bp, Homo sapiens
taacactgatttgttctcaggg

SEQ ID NO: 9056480 - DNA, 22 bp, Homo sapiens
taacactgccatgctggagtca

SEQ ID NO: 9056481 - DNA, 22 bp, Homo sapiens
taacactggtatttcatttagt

SEQ ID NO: 9056482 - DNA, 22 bp, Homo sapiens
taacactggcttttgctgaggc

SEQ ID NO: 9056483 - DNA, 22 bp, Homo sapiens
taacactgtggtgttctttgtc

SEQ ID NO: 9056484 - DNA, 22 bp, Homo sapiens
taacagaatagcagaaacagaa

SEQ ID NO: 9056485 - DNA, 22 bp, Homo sapiens
taacactgtaaacctagatgtt

SEQ ID NO: 9056486 - DNA, 22 bp, Homo sapiens
taacactgtccaaagaattcca

SEQ ID NO: 9056487 - DNA, 22 bp, Homo sapiens
taagaaatttagttatagaatg

SEQ ID NO: 9056488 - DNA, 22 bp, Homo sapiens
taacagcagggttacaggcatt

SEQ ID NO: 9056489 - DNA, 22 bp, Homo sapiens
gtttaagaaaattcatgttgtt

SEQ ID NO: 9056490 - DNA, 22 bp, Homo sapiens
gtttaataatgttgaattacta

SEQ ID NO: 9056491 - DNA, 22 bp, Homo sapiens
gtttaacatctgtgaagctgct

SEQ ID NO: 9056492 - DNA, 22 bp, Homo sapiens
taaaggcatgcaggtgaatgta

SEQ ID NO: 9056493 - DNA, 22 bp, Homo sapiens
taaaggcagttctgattaggtc

SEQ ID NO: 9056494 - DNA, 22 bp, Homo sapiens
taaaggcacggagttgttatgg

SEQ ID NO: 9056495 - DNA, 22 bp, Homo sapiens
taaaggcaaatgtgtgtttgtg

SEQ ID NO: 9056496 - DNA, 22 bp, Homo sapiens
taaagcaggccacatatgtgat

SEQ ID NO: 9056497 - DNA, 22 bp, Homo sapiens
taaagcttgtattgcaatattt

SEQ ID NO: 9056498 - DNA, 22 bp, Homo sapiens
taaagctgaaatgattatgaca

SEQ ID NO: 9056499 - DNA, 22 bp, Homo sapiens
taaagcaggtgctcagtgacca

SEQ ID NO: 9056500 - DNA, 22 bp, Homo sapiens
taaagcagtatgatggaaggat

SEQ ID NO: 9056501 - DNA, 22 bp, Homo sapiens
gcaatcaatgatttatatttgt

SEQ ID NO: 9056502 - DNA, 22 bp, Homo sapiens
gcaatcaatgatttatatttgt

SEQ ID NO: 9056503 - DNA, 20 bp, Homo sapiens
gcaattaatttttggttaca

SEQ ID NO: 9056504 - DNA, 22 bp, Homo sapiens
gcacaaaggtggaaggaggaag

SEQ ID NO: 9056505 - DNA, 22 bp, Homo sapiens
gcacaagaataaccatatttaa

SEQ ID NO: 9056506 - DNA, 22 bp, Homo sapiens
gcacaagaaatcatggactgaa

SEQ ID NO: 9056507 - DNA, 23 bp, Homo sapiens
gcacaagacctggcagcttccat

SEQ ID NO: 9056508 - DNA, 23 bp, Homo sapiens
gcacaagacctggcagcttccat

SEQ ID NO: 9056509 - DNA, 22 bp, Homo sapiens
gcaatttctgaggctgtccttc

SEQ ID NO: 9056510 - DNA, 21 bp, Homo sapiens
gcaatttcataagttttagtt

SEQ ID NO: 9056511 - DNA, 22 bp, Homo sapiens
gcacaaagatgaatacagaatg

SEQ ID NO: 9056512 - DNA, 22 bp, Homo sapiens
gcacaaaggtggaaggaggaag

SEQ ID NO: 9056513 - DNA, 22 bp, Homo sapiens
gcacaaagatgaatacagaatg

SEQ ID NO: 9056514 - DNA, 22 bp, Homo sapiens
gcaatataaccagttgtcatgc

SEQ ID NO: 9056515 - DNA, 22 bp, Homo sapiens
gatttttatataaagtgagaaa

SEQ ID NO: 9056516 - DNA, 22 bp, Homo sapiens
gatttttatataaagtgagaaa

SEQ ID NO: 9056517 - DNA, 22 bp, Homo sapiens
gatttcttggcccactctcaga

SEQ ID NO: 9056518 - DNA, 22 bp, Homo sapiens
gatttctttatgaagtacagaa

SEQ ID NO: 9056519 - DNA, 22 bp, Homo sapiens
gatttctttagctcatcagatc

SEQ ID NO: 9056520 - DNA, 22 bp, Homo sapiens
gatttctttgaattagagaggt

SEQ ID NO: 9056521 - DNA, 22 bp, Homo sapiens
gatttctttgtacccacaatcc

SEQ ID NO: 9056522 - DNA, 22 bp, Homo sapiens
gatttcttgataattcaaatcc

SEQ ID NO: 9056523 - DNA, 22 bp, Homo sapiens
gatttcttgacccctgtctcag

SEQ ID NO: 9056524 - DNA, 22 bp, Homo sapiens
gatttcttctctcccaagagga

SEQ ID NO: 9056525 - DNA, 22 bp, Homo sapiens
gatttcttcaggagcagaggag

SEQ ID NO: 9056526 - DNA, 22 bp, Homo sapiens
gatttcttcattcattagatgg

SEQ ID NO: 9056527 - DNA, 22 bp, Homo sapiens
gatttcacccacttcccagtgt

SEQ ID NO: 9056528 - DNA, 22 bp, Homo sapiens
gatttcacagtggtccaaggca

SEQ ID NO: 9056529 - DNA, 21 bp, Homo sapiens
gattttaaagagactgccaca

SEQ ID NO: 9056530 - DNA, 22 bp, Homo sapiens
gatttgtctatattcaaatatg

SEQ ID NO: 9056531 - DNA, 22 bp, Homo sapiens
gattttcatttgcactctagaa

SEQ ID NO: 9056532 - DNA, 22 bp, Homo sapiens
gattttcatgataaacttgtga

SEQ ID NO: 9056533 - DNA, 22 bp, Homo sapiens
gcagaaaccacagtgtctttta

SEQ ID NO: 9056534 - DNA, 22 bp, Homo sapiens
gcagagccccattgctggcggg

SEQ ID NO: 9056535 - DNA, 22 bp, Homo sapiens
gcactttaaagtttggtggcat

SEQ ID NO: 9056536 - DNA, 22 bp, Homo sapiens
gcacacacatgtgagtacatgc

SEQ ID NO: 9056537 - DNA, 22 bp, Homo sapiens
gcacaatttattaatcaggtcc

SEQ ID NO: 9056538 - DNA, 22 bp, Homo sapiens
gcacaattgacattttgggcca

SEQ ID NO: 9056539 - DNA, 22 bp, Homo sapiens
gcacaatttgactctattcata

SEQ ID NO: 9056540 - DNA, 16 bp, Homo sapiens
gcacacacatcaatga

SEQ ID NO: 9056541 - DNA, 22 bp, Homo sapiens
gcacaattttgttgtcatggag

SEQ ID NO: 9056542 - DNA, 22 bp, Homo sapiens
gcacaattatttatgcagtatg

SEQ ID NO: 9056543 - DNA, 22 bp, Homo sapiens
gcacaattccatgggacagccc

SEQ ID NO: 9056544 - DNA, 22 bp, Homo sapiens
gatgtcctgcagaaacatgaga

SEQ ID NO: 9056545 - DNA, 22 bp, Homo sapiens
gatgtagagggaagattttaaa

SEQ ID NO: 9056546 - DNA, 22 bp, Homo sapiens
gatgtagacacttggaggctta

SEQ ID NO: 9056547 - DNA, 21 bp, Homo sapiens
gatgtacatcaagcactttgc

SEQ ID NO: 9056548 - DNA, 22 bp, Homo sapiens
gatgtcttactaactagccttt

SEQ ID NO: 9056549 - DNA, 22 bp, Homo sapiens
gatgccctgcatgagtcctgct

SEQ ID NO: 9056550 - DNA, 22 bp, Homo sapiens
gatgccctggcctgtccccgca

SEQ ID NO: 9056551 - DNA, 20 bp, Homo sapiens
gatgcattagatgcagggta

SEQ ID NO: 9056552 - DNA, 22 bp, Homo sapiens
gatgcattgcatcgagtagctt

SEQ ID NO: 9056553 - DNA, 22 bp, Homo sapiens
gatttagtggcccttggtacac

SEQ ID NO: 9056554 - DNA, 22 bp, Homo sapiens
gatttattggtctttcattggt

SEQ ID NO: 9056555 - DNA, 22 bp, Homo sapiens
gatttattggtctttcattggt

SEQ ID NO: 9056556 - DNA, 22 bp, Homo sapiens
gatttatttttaatcagcaggg

SEQ ID NO: 9056557 - DNA, 22 bp, Homo sapiens
gatttattgtccctgtcctgct

SEQ ID NO: 9056558 - DNA, 22 bp, Homo sapiens
gattgcttatacacaagatgaa

SEQ ID NO: 9056559 - DNA, 19 bp, Homo sapiens
gatttaaacgtggctctat

SEQ ID NO: 9056560 - DNA, 21 bp, Homo sapiens
gattaaatttaagctacatgc

SEQ ID NO: 9056561 - DNA, 22 bp, Homo sapiens
gatgttgagtatcaatgcttta

SEQ ID NO: 9056562 - DNA, 22 bp, Homo sapiens
gatgttaagaaggaattgaagt

SEQ ID NO: 9056563 - DNA, 22 bp, Homo sapiens
gattattttgtgcaataatcgg

SEQ ID NO: 9056564 - DNA, 22 bp, Homo sapiens
gattcaaaaataagctcctatt

SEQ ID NO: 9056565 - DNA, 22 bp, Homo sapiens
gattcacagaacttagtcaagc

SEQ ID NO: 9056566 - DNA, 22 bp, Homo sapiens
gattcacaactgccctgaaggg

SEQ ID NO: 9056567 - DNA, 21 bp, Homo sapiens
gcaggggatagaaatggtctg

SEQ ID NO: 9056568 - DNA, 22 bp, Homo sapiens
gcaggggctgagcaccagcggg

SEQ ID NO: 9056569 - DNA, 22 bp, Homo sapiens
gcaggcactcctaggaccatca

SEQ ID NO: 9056570 - DNA, 22 bp, Homo sapiens
gcaggcagagaaggaacattta

SEQ ID NO: 9056571 - DNA, 22 bp, Homo sapiens
gcaggcagagaggggtttccag

SEQ ID NO: 9056572 - DNA, 14 bp, Homo sapiens
gcaggcagaccacc

SEQ ID NO: 9056573 - DNA, 17 bp, Homo sapiens
gcaggcactgctgcctg

SEQ ID NO: 9056574 - DNA, 22 bp, Homo sapiens
gcaggctggggtagccccactt

SEQ ID NO: 9056575 - DNA, 22 bp, Homo sapiens
gcagggaccttgcccaccctcc

SEQ ID NO: 9056576 - DNA, 22 bp, Homo sapiens
gcagggacgcagcactctccgt

SEQ ID NO: 9056577 - DNA, 22 bp, Homo sapiens
gcagggacgccagggacagcaa

SEQ ID NO: 9056578 - DNA, 22 bp, Homo sapiens
gcagggacgccagggacagcaa

SEQ ID NO: 9056579 - DNA, 22 bp, Homo sapiens
gcaggcaccgggttgctcccct

SEQ ID NO: 9056580 - DNA, 22 bp, Homo sapiens
gcaggcaccacggctcaggtct

SEQ ID NO: 9056581 - DNA, 19 bp, Homo sapiens
gcaggcacagccctgggtg

SEQ ID NO: 9056582 - DNA, 22 bp, Homo sapiens
gcagagctatcttctggatttg

SEQ ID NO: 9056583 - DNA, 22 bp, Homo sapiens
gcagagccctgggggtatggtg

SEQ ID NO: 9056584 - DNA, 22 bp, Homo sapiens
gcagagcctgtgtctgagcaaa

SEQ ID NO: 9056585 - DNA, 22 bp, Homo sapiens
gcagctccttcaatctcaccat

SEQ ID NO: 9056586 - DNA, 22 bp, Homo sapiens
gcagctcccttgaacttctcct

SEQ ID NO: 9056587 - DNA, 22 bp, Homo sapiens
gcagctcaagagaggtgctatg

SEQ ID NO: 9056588 - DNA, 22 bp, Homo sapiens
gcagctcacagtctccgccatc

SEQ ID NO: 9056589 - DNA, 22 bp, Homo sapiens
gcagctcagggagagggcacca

SEQ ID NO: 9056590 - DNA, 22 bp, Homo sapiens
gcagctcagtaaaagaggagca

SEQ ID NO: 9056591 - DNA, 22 bp, Homo sapiens
gcagctcaagagaggtgctatg

SEQ ID NO: 9056592 - DNA, 22 bp, Homo sapiens
gcagtgttgctaggtgcggtga

SEQ ID NO: 9056593 - DNA, 22 bp, Homo sapiens
gccacaggctccagcatcagta

SEQ ID NO: 9056594 - DNA, 20 bp, Homo sapiens
gccagaggccggcaggggct

SEQ ID NO: 9056595 - DNA, 19 bp, Homo sapiens
gccagcagaatgatgaggc

SEQ ID NO: 9056596 - DNA, 19 bp, Homo sapiens
gcaggtgtgaatccgtaga

SEQ ID NO: 9056597 - DNA, 22 bp, Homo sapiens
gcagtgttaggaataaaaatga

SEQ ID NO: 9056598 - DNA, 22 bp, Homo sapiens
gcagtgttctaaattgggtgtg

SEQ ID NO: 9056599 - DNA, 22 bp, Homo sapiens
gcagtgttcttgttgcttttat

SEQ ID NO: 9056600 - DNA, 22 bp, Homo sapiens
gcagtgttgactatggtatgag

SEQ ID NO: 9056601 - DNA, 22 bp, Homo sapiens
gcagtgttgagtggtggctgaa

SEQ ID NO: 9056602 - DNA, 22 bp, Homo sapiens
gcagtgttgagccagctggggg

SEQ ID NO: 9056603 - DNA, 22 bp, Homo sapiens
gcagtgttcagtgaagcaggag

SEQ ID NO: 9056604 - DNA, 22 bp, Homo sapiens
gcagtgttccttctactggggc

SEQ ID NO: 9056605 - DNA, 22 bp, Homo sapiens
gcagtgttatgttttctataat

SEQ ID NO: 9056606 - DNA, 22 bp, Homo sapiens
gcagtggggaatgctggggaga

SEQ ID NO: 9056607 - DNA, 22 bp, Homo sapiens
gcagtggggcgctgggagttgg

SEQ ID NO: 9056608 - DNA, 22 bp, Homo sapiens
gcagtgggcaacaagagctgga

SEQ ID NO: 9056609 - DNA, 22 bp, Homo sapiens
gcaggtgggagccgctgcctga

SEQ ID NO: 9056610 - DNA, 22 bp, Homo sapiens
gcaggtggggctgctaccagaa

SEQ ID NO: 9056611 - DNA, 22 bp, Homo sapiens
gcaggtggtggcgcgcgccctg

SEQ ID NO: 9056612 - DNA, 22 bp, Homo sapiens
gcaggtggtgggggagccgttc

SEQ ID NO: 9056613 - DNA, 22 bp, Homo sapiens
gcaggtggttaaggtcccatgt

SEQ ID NO: 9056614 - DNA, 22 bp, Homo sapiens
gcaggtgggagccgctgcctga

SEQ ID NO: 9056615 - DNA, 19 bp, Homo sapiens
gcaggtggatgtggtcagc

SEQ ID NO: 9056616 - DNA, 22 bp, Homo sapiens
gcagggtgccgacttcagggat

SEQ ID NO: 9056617 - DNA, 22 bp, Homo sapiens
gcagggtgatagtgaggctcag

SEQ ID NO: 9056618 - DNA, 22 bp, Homo sapiens
gcagggtgacgttgcccacctc

SEQ ID NO: 9056619 - DNA, 19 bp, Homo sapiens
gcagggtggcagagctctt

SEQ ID NO: 9056620 - DNA, 22 bp, Homo sapiens
gcagggtggatggcagggccag

SEQ ID NO: 9056621 - DNA, 22 bp, Homo sapiens
gctcagaagatatttgatgctg

SEQ ID NO: 9056622 - DNA, 22 bp, Homo sapiens
gctcagaaatggcagatggaga

SEQ ID NO: 9056623 - DNA, 22 bp, Homo sapiens
gctcagagataaaactgatcag

SEQ ID NO: 9056624 - DNA, 22 bp, Homo sapiens
gctcagagcccgaggcttgcat

SEQ ID NO: 9056625 - DNA, 22 bp, Homo sapiens
gctcagagcagatggtactcag

SEQ ID NO: 9056626 - DNA, 22 bp, Homo sapiens
gctccaggaagggaaatctcca

SEQ ID NO: 9056627 - DNA, 22 bp, Homo sapiens
gctccaggagagggaagcagat

SEQ ID NO: 9056628 - DNA, 22 bp, Homo sapiens
gctccaggagctcacagctcgc

SEQ ID NO: 9056629 - DNA, 22 bp, Homo sapiens
gctccaggaggatgaccttcct

SEQ ID NO: 9056630 - DNA, 22 bp, Homo sapiens
gctccaggaggatgaccttcct

SEQ ID NO: 9056631 - DNA, 22 bp, Homo sapiens
gctcctggctctctgagggctg

SEQ ID NO: 9056632 - DNA, 22 bp, Homo sapiens
gctcctggcatcctgcttttaa

SEQ ID NO: 9056633 - DNA, 22 bp, Homo sapiens
gctcctggcttcactgacatca

SEQ ID NO: 9056634 - DNA, 22 bp, Homo sapiens
gctcctggctctggccaaggga

SEQ ID NO: 9056635 - DNA, 22 bp, Homo sapiens
gctcctgggtgtggctgcccct

SEQ ID NO: 9056636 - DNA, 22 bp, Homo sapiens
gctcctgggctctaccttgcta

SEQ ID NO: 9056637 - DNA, 21 bp, Homo sapiens
gctgaagaactctttattttc

SEQ ID NO: 9056638 - DNA, 22 bp, Homo sapiens
gctgagatgtcgttagatatct

SEQ ID NO: 9056639 - DNA, 22 bp, Homo sapiens
gctgagattacgggcatgagcc

SEQ ID NO: 9056640 - DNA, 22 bp, Homo sapiens
gctgagattggttattccatta

SEQ ID NO: 9056641 - DNA, 22 bp, Homo sapiens
gctgagagtgggtgcagtgctt

SEQ ID NO: 9056642 - DNA, 22 bp, Homo sapiens
gctgaagaccccagctccccag

SEQ ID NO: 9056643 - DNA, 22 bp, Homo sapiens
gctgaagacaatggaattgact

SEQ ID NO: 9056644 - DNA, 21 bp, Homo sapiens
gctgaagacaaattctcttag

SEQ ID NO: 9056645 - DNA, 20 bp, Homo sapiens
gctgaagaagtagcatgtac

SEQ ID NO: 9056646 - DNA, 21 bp, Homo sapiens
gctctgttattttctatgcag

SEQ ID NO: 9056647 - DNA, 22 bp, Homo sapiens
gctcttctcagattgtacactc

SEQ ID NO: 9056648 - DNA, 22 bp, Homo sapiens
gctcttccatttctcttgaact

SEQ ID NO: 9056649 - DNA, 22 bp, Homo sapiens
gctctgtgttccctccaggctc

SEQ ID NO: 9056650 - DNA, 22 bp, Homo sapiens
gctgcctggagctcagcctgcc

SEQ ID NO: 9056651 - DNA, 22 bp, Homo sapiens
gctgcctgggcaggaggcgctg

SEQ ID NO: 9056652 - DNA, 22 bp, Homo sapiens
gctgaggatatagcaggaacaa

SEQ ID NO: 9056653 - DNA, 22 bp, Homo sapiens
gctgaggattacttgaagtcag

SEQ ID NO: 9056654 - DNA, 20 bp, Homo sapiens
gctgaggattcctggcccct

SEQ ID NO: 9056655 - DNA, 22 bp, Homo sapiens
gctgaggattgaagagttgcca

SEQ ID NO: 9056656 - DNA, 22 bp, Homo sapiens
gctgctctacccatgcatctgt

SEQ ID NO: 9056657 - DNA, 22 bp, Homo sapiens
gctgctctcagagctcatgctg

SEQ ID NO: 9056658 - DNA, 22 bp, Homo sapiens
gctgctctccaagcctccttga

SEQ ID NO: 9056659 - DNA, 20 bp, Homo sapiens
gctgctctccacggtctgca

SEQ ID NO: 9056660 - DNA, 22 bp, Homo sapiens
gctgctcttgaggggctcactg

SEQ ID NO: 9056661 - DNA, 22 bp, Homo sapiens
gctgctctgtgacagcctccgg

SEQ ID NO: 9056662 - DNA, 22 bp, Homo sapiens
gctgggagtgggcaagatgaga

SEQ ID NO: 9056663 - DNA, 22 bp, Homo sapiens
gctggcctcatcactgacttct

SEQ ID NO: 9056664 - DNA, 22 bp, Homo sapiens
gctggagagtagtaagcagtta

SEQ ID NO: 9056665 - DNA, 22 bp, Homo sapiens
gcctggagggtccctctctgga

SEQ ID NO: 9056666 - DNA, 22 bp, Homo sapiens
gcctggaggggacagtctctgg

SEQ ID NO: 9056667 - DNA, 22 bp, Homo sapiens
gcctggagggctctagagaggc

SEQ ID NO: 9056668 - DNA, 22 bp, Homo sapiens
gcctggagcctcagcaaggagg

SEQ ID NO: 9056669 - DNA, 19 bp, Homo sapiens
gcctgccagatagtaatga

SEQ ID NO: 9056670 - DNA, 23 bp, Homo sapiens
gcctgccatatacctggaaacag

SEQ ID NO: 9056671 - DNA, 22 bp, Homo sapiens
gcctgccagtgtttgaggattg

SEQ ID NO: 9056672 - DNA, 18 bp, Homo sapiens
gcctgccagccgagggac

SEQ ID NO: 9056673 - DNA, 22 bp, Homo sapiens
gcctggagtactccttgaagtg

SEQ ID NO: 9056674 - DNA, 22 bp, Homo sapiens
gcctggagggttgaggttttgt

SEQ ID NO: 9056675 - DNA, 22 bp, Homo sapiens
gccagtgggtagttggagctgg

SEQ ID NO: 9056676 - DNA, 22 bp, Homo sapiens
gccagtgtggtgtagtcatgaa

SEQ ID NO: 9056677 - DNA, 22 bp, Homo sapiens
gcctcctgttatgccatgtgcc

SEQ ID NO: 9056678 - DNA, 22 bp, Homo sapiens
gcctctgcaattacattgtgcc

SEQ ID NO: 9056679 - DNA, 19 bp, Homo sapiens
gcctctgctggggacaggc

SEQ ID NO: 9056680 - DNA, 22 bp, Homo sapiens
gcctctgctgcaagcctggttg

SEQ ID NO: 9056681 - DNA, 22 bp, Homo sapiens
gcctctgctcggactttgcctc

SEQ ID NO: 9056682 - DNA, 22 bp, Homo sapiens
gagtttaaataacacatttcca

SEQ ID NO: 9056683 - DNA, 22 bp, Homo sapiens
gagtttaaagcatacatatttt

SEQ ID NO: 9056684 - DNA, 22 bp, Homo sapiens
gagtttatgtctttcattgttc

SEQ ID NO: 9056685 - DNA, 22 bp, Homo sapiens
gataaaagaggaaatttgttca

SEQ ID NO: 9056686 - DNA, 22 bp, Homo sapiens
gagtttttccaaggtcacatga

SEQ ID NO: 9056687 - DNA, 22 bp, Homo sapiens
gataaagcaaggatgactgaag

SEQ ID NO: 9056688 - DNA, 22 bp, Homo sapiens
gataaatggctgaagaaatagt

SEQ ID NO: 9056689 - DNA, 21 bp, Homo sapiens
gataaaatgggccttggtcct

SEQ ID NO: 9056690 - DNA, 22 bp, Homo sapiens
gataaacattcttgcacatgtg

SEQ ID NO: 9056691 - DNA, 22 bp, Homo sapiens
gagtgtgggcacgggggccttg

SEQ ID NO: 9056692 - DNA, 18 bp, Homo sapiens
gagtgtggcactgggccc

SEQ ID NO: 9056693 - DNA, 22 bp, Homo sapiens
gagtggggggtccgtctcagtg

SEQ ID NO: 9056694 - DNA, 22 bp, Homo sapiens
gagtggggtctgggcatcagtc

SEQ ID NO: 9056695 - DNA, 22 bp, Homo sapiens
gagtctgtggtattttatcata

SEQ ID NO: 9056696 - DNA, 17 bp, Homo sapiens
gagtctgtgttcatcag

SEQ ID NO: 9056697 - DNA, 22 bp, Homo sapiens
gagtcttctacgctcacacaaa

SEQ ID NO: 9056698 - DNA, 22 bp, Homo sapiens
gagtgagggcagcaggggctgc

SEQ ID NO: 9056699 - DNA, 22 bp, Homo sapiens
gagtgaggctggaatcatggct

SEQ ID NO: 9056700 - DNA, 22 bp, Homo sapiens
gagtctaagtagaatgtgaaaa

SEQ ID NO: 9056701 - DNA, 22 bp, Homo sapiens
gagtggagcaaaagaggtagat

SEQ ID NO: 9056702 - DNA, 22 bp, Homo sapiens
gagtggagcaaaagaggtagat

SEQ ID NO: 9056703 - DNA, 21 bp, Homo sapiens
gagtgggacatgggagtggtt

SEQ ID NO: 9056704 - DNA, 22 bp, Homo sapiens
gagtggctgtgtacatgcccag

SEQ ID NO: 9056705 - DNA, 22 bp, Homo sapiens
gagtgctgaatgcgagaacaga

SEQ ID NO: 9056706 - DNA, 22 bp, Homo sapiens
gatatttttgcagacacctggg

SEQ ID NO: 9056707 - DNA, 22 bp, Homo sapiens
gatcacatctttatgagtattt

SEQ ID NO: 9056708 - DNA, 22 bp, Homo sapiens
gatattttgagaaatcctatga

SEQ ID NO: 9056709 - DNA, 22 bp, Homo sapiens
gatattttcgcagggagaattc

SEQ ID NO: 9056710 - DNA, 22 bp, Homo sapiens
gatatacataggtttctatgca

SEQ ID NO: 9056711 - DNA, 22 bp, Homo sapiens
gatacatttcaaggaggactgg

SEQ ID NO: 9056712 - DNA, 22 bp, Homo sapiens
gatacattccgggagggctacc

SEQ ID NO: 9056713 - DNA, 22 bp, Homo sapiens
gatacattttatctcctaacag

SEQ ID NO: 9056714 - DNA, 22 bp, Homo sapiens
gataccagacagggagggagaa

SEQ ID NO: 9056715 - DNA, 22 bp, Homo sapiens
gatacattccatttctacttaa

SEQ ID NO: 9056716 - DNA, 22 bp, Homo sapiens
gatacattgagggtggaggacc

SEQ ID NO: 9056717 - DNA, 21 bp, Homo sapiens
gatacagagggccactgattg

SEQ ID NO: 9056718 - DNA, 20 bp, Homo sapiens
gatacacagcacagagggcc

SEQ ID NO: 9056719 - DNA, 22 bp, Homo sapiens
gatagctgctgggatattttta

SEQ ID NO: 9056720 - DNA, 22 bp, Homo sapiens
gatataaattaatcaagtgcaa

SEQ ID NO: 9056721 - DNA, 22 bp, Homo sapiens
gatatacagagcattctttgat

SEQ ID NO: 9056722 - DNA, 22 bp, Homo sapiens
gatatacaatccacagttgatt

SEQ ID NO: 9056723 - DNA, 22 bp, Homo sapiens
gataccagacagggagggagaa

SEQ ID NO: 9056724 - DNA, 22 bp, Homo sapiens
gatgaacatattcctctccaga

SEQ ID NO: 9056725 - DNA, 22 bp, Homo sapiens
gatgaagaggcactgacatatt

SEQ ID NO: 9056726 - DNA, 22 bp, Homo sapiens
gatgagacagaatagcccaagg

SEQ ID NO: 9056727 - DNA, 22 bp, Homo sapiens
gatgagaatgtttatcaaatgc

SEQ ID NO: 9056728 - DNA, 22 bp, Homo sapiens
gatgagaaggctcagatccaaa

SEQ ID NO: 9056729 - DNA, 22 bp, Homo sapiens
gatgagaaatggacaggagtgg

SEQ ID NO: 9056730 - DNA, 22 bp, Homo sapiens
gatgcatgtatggagtgagggt

SEQ ID NO: 9056731 - DNA, 22 bp, Homo sapiens
gatgaaatgctgagcctgagtt

SEQ ID NO: 9056732 - DNA, 22 bp, Homo sapiens
gatgaaaaattgctgtgtcata

SEQ ID NO: 9056733 - DNA, 22 bp, Homo sapiens
gatcttgagcaagttgcatccc

SEQ ID NO: 9056734 - DNA, 22 bp, Homo sapiens
gatcttgagcaagttgtgtaac

SEQ ID NO: 9056735 - DNA, 22 bp, Homo sapiens
gatcttgaaatatcttttccta

SEQ ID NO: 9056736 - DNA, 22 bp, Homo sapiens
gagataaatttttgataaatat

SEQ ID NO: 9056737 - DNA, 22 bp, Homo sapiens
gaggaatgttattaaaggagct

SEQ ID NO: 9056738 - DNA, 22 bp, Homo sapiens
gaggaaggtcccatcagaattt

SEQ ID NO: 9056739 - DNA, 23 bp, Homo sapiens
gaggagggtctgacaagtgtagc

SEQ ID NO: 9056740 - DNA, 22 bp, Homo sapiens
gaggaggcttccgggaggcacg

SEQ ID NO: 9056741 - DNA, 22 bp, Homo sapiens
gaggcagaggttgcagtgagct

SEQ ID NO: 9056742 - DNA, 23 bp, Homo sapiens
gaggcagctcctgcagtgccctg

SEQ ID NO: 9056743 - DNA, 22 bp, Homo sapiens
gaggcagctgaaggagtgacag

SEQ ID NO: 9056744 - DNA, 22 bp, Homo sapiens
gagtcaggcactgctgctgctc

SEQ ID NO: 9056745 - DNA, 22 bp, Homo sapiens
gagtccagagattaagcacctc

SEQ ID NO: 9056746 - DNA, 22 bp, Homo sapiens
gaggtccagagcaggttcagtg

SEQ ID NO: 9056747 - DNA, 22 bp, Homo sapiens
gaggtccagccaagcggcaagg

SEQ ID NO: 9056748 - DNA, 22 bp, Homo sapiens
gagggttggtgcaaatgggatg

SEQ ID NO: 9056749 - DNA, 22 bp, Homo sapiens
gaggtagtaagcagagtggggt

SEQ ID NO: 9056750 - DNA, 22 bp, Homo sapiens
gaggtatttttgcatgcctgat

SEQ ID NO: 9056751 - DNA, 22 bp, Homo sapiens
gaggctgcccacacctgcgccg

SEQ ID NO: 9056752 - DNA, 22 bp, Homo sapiens
gagggatctttaggcagcctca

SEQ ID NO: 9056753 - DNA, 22 bp, Homo sapiens
gaggggcacagcagctgttgca

SEQ ID NO: 9056754 - DNA, 22 bp, Homo sapiens
gaggggcaatgagggaaagagt

SEQ ID NO: 9056755 - DNA, 22 bp, Homo sapiens
gaggggcaatgagggaaagagt

SEQ ID NO: 9056756 - DNA, 22 bp, Homo sapiens
gaggggcaagaagttggcctct

SEQ ID NO: 9056757 - DNA, 22 bp, Homo sapiens
gaggggcacagtaaagggtccc

SEQ ID NO: 9056758 - DNA, 22 bp, Homo sapiens
gaggggcagaggtagagaacaa

SEQ ID NO: 9056759 - DNA, 22 bp, Homo sapiens
gaggggcagaggtagagaacaa

SEQ ID NO: 9056760 - DNA, 22 bp, Homo sapiens
gaggggcagtgcacccgggccc

SEQ ID NO: 9056761 - DNA, 22 bp, Homo sapiens
gagggcagagtctaatgatgca

SEQ ID NO: 9056762 - DNA, 22 bp, Homo sapiens
gagggcagtagcctcgtaccct

SEQ ID NO: 9056763 - DNA, 22 bp, Homo sapiens
gaggggaaagtgtgaggctgcg

SEQ ID NO: 9056764 - DNA, 22 bp, Homo sapiens
gaggggaaagttctgcacaagg

SEQ ID NO: 9056765 - DNA, 22 bp, Homo sapiens
gaggggaaagtgtgaggctgcg

SEQ ID NO: 9056766 - DNA, 22 bp, Homo sapiens
gaagttctcaaggatcacagaa

SEQ ID NO: 9056767 - DNA, 22 bp, Homo sapiens
gaattcttttctttctgaaagt

SEQ ID NO: 9056768 - DNA, 23 bp, Homo sapiens
gaattcttaaggtcactaaagtc

SEQ ID NO: 9056769 - DNA, 22 bp, Homo sapiens
gaattgctaaccaattcaaaat

SEQ ID NO: 9056770 - DNA, 22 bp, Homo sapiens
gaattgctaatccaagtgactg

SEQ ID NO: 9056771 - DNA, 22 bp, Homo sapiens
gaattgctagcgcaccaattct

SEQ ID NO: 9056772 - DNA, 22 bp, Homo sapiens
gaattgctaggctgcatgtgtc

SEQ ID NO: 9056773 - DNA, 22 bp, Homo sapiens
gaattgctgaatcatatgttta

SEQ ID NO: 9056774 - DNA, 22 bp, Homo sapiens
gaattgcttgtgaagtgtgtct

SEQ ID NO: 9056775 - DNA, 22 bp, Homo sapiens
gaattgcttctggtatgttact

SEQ ID NO: 9056776 - DNA, 22 bp, Homo sapiens
gaattgcttgctgagattaaag

SEQ ID NO: 9056777 - DNA, 22 bp, Homo sapiens
gaattgctctgcctggccagcc

SEQ ID NO: 9056778 - DNA, 22 bp, Homo sapiens
gaattgctgatgaatctgattg

SEQ ID NO: 9056779 - DNA, 20 bp, Homo sapiens
gacaggagagttaggtaggt

SEQ ID NO: 9056780 - DNA, 22 bp, Homo sapiens
gacacagatgatcaggtgtgga

SEQ ID NO: 9056781 - DNA, 22 bp, Homo sapiens
gacacagatatctctgagatta

SEQ ID NO: 9056782 - DNA, 22 bp, Homo sapiens
gacacagatatctctgagatta

SEQ ID NO: 9056783 - DNA, 22 bp, Homo sapiens
gacacagagataggcctgtgtt

SEQ ID NO: 9056784 - DNA, 22 bp, Homo sapiens
gacacagagctcacagtctcct

SEQ ID NO: 9056785 - DNA, 22 bp, Homo sapiens
gacacagagctcacagtctcct

SEQ ID NO: 9056786 - DNA, 22 bp, Homo sapiens
gacacagagggcaccagatatg

SEQ ID NO: 9056787 - DNA, 22 bp, Homo sapiens
gacacagagggcaccagatatg

SEQ ID NO: 9056788 - DNA, 22 bp, Homo sapiens
gacacagagtattttaagtact

SEQ ID NO: 9056789 - DNA, 22 bp, Homo sapiens
gacacagataatttagttaaaa

SEQ ID NO: 9056790 - DNA, 22 bp, Homo sapiens
gaaggctctggggattgagata

SEQ ID NO: 9056791 - DNA, 22 bp, Homo sapiens
gaagtacaaaggacatggaaac

SEQ ID NO: 9056792 - DNA, 22 bp, Homo sapiens
gaagtggggaagcaacaggaga

SEQ ID NO: 9056793 - DNA, 22 bp, Homo sapiens
gaaggagaggattgtgaggctg

SEQ ID NO: 9056794 - DNA, 22 bp, Homo sapiens
gaaggcctgtggtagtgagacg

SEQ ID NO: 9056795 - DNA, 22 bp, Homo sapiens
gaaggagagaaaggcaattctg

SEQ ID NO: 9056796 - DNA, 22 bp, Homo sapiens
gaaggagaccctgaagatgctg

SEQ ID NO: 9056797 - DNA, 21 bp, Homo sapiens
gaaggagaaagcaagtgctgc

SEQ ID NO: 9056798 - DNA, 22 bp, Homo sapiens
gaaggagaggattgtgaggctg

SEQ ID NO: 9056799 - DNA, 22 bp, Homo sapiens
gaaggagagagacatcgtccct

SEQ ID NO: 9056800 - DNA, 19 bp, Homo sapiens
gaaggagagctgagttagg

SEQ ID NO: 9056801 - DNA, 21 bp, Homo sapiens
gaaggagaaagcaagtgctgc

SEQ ID NO: 9056802 - DNA, 22 bp, Homo sapiens
gaactgtttctggtgaaagagt

SEQ ID NO: 9056803 - DNA, 22 bp, Homo sapiens
gaactgtttttaagtcctaaga

SEQ ID NO: 9056804 - DNA, 23 bp, Homo sapiens
gaactgttgatgaatagaatata

SEQ ID NO: 9056805 - DNA, 22 bp, Homo sapiens
gactgtattacaattggcagca

SEQ ID NO: 9056806 - DNA, 22 bp, Homo sapiens
gagacacagagaggctgtgtga

SEQ ID NO: 9056807 - DNA, 22 bp, Homo sapiens
gagacacaatctcatttacatt

SEQ ID NO: 9056808 - DNA, 22 bp, Homo sapiens
gagacacaggtggttcctgtca

SEQ ID NO: 9056809 - DNA, 22 bp, Homo sapiens
gagacacagttatcaggcatac

SEQ ID NO: 9056810 - DNA, 22 bp, Homo sapiens
gactttattatagtggcaatag

SEQ ID NO: 9056811 - DNA, 22 bp, Homo sapiens
gactttattcgttaactgttaa

SEQ ID NO: 9056812 - DNA, 22 bp, Homo sapiens
gagagctccttcaggaagcttc

SEQ ID NO: 9056813 - DNA, 22 bp, Homo sapiens
gagagctgcaaggtagggcggg

SEQ ID NO: 9056814 - DNA, 22 bp, Homo sapiens
gagagctgcagccgagaggggg

SEQ ID NO: 9056815 - DNA, 18 bp, Homo sapiens
gagagctgctacctagct

SEQ ID NO: 9056816 - DNA, 22 bp, Homo sapiens
gagagctgcattctcagacaca

SEQ ID NO: 9056817 - DNA, 22 bp, Homo sapiens
gagagctgcattctcagacaca

SEQ ID NO: 9056818 - DNA, 22 bp, Homo sapiens
gagagctggccagcttcagtat

SEQ ID NO: 9056819 - DNA, 20 bp, Homo sapiens
gagagctggaaataaagtcc

SEQ ID NO: 9056820 - DNA, 22 bp, Homo sapiens
gagagctgggctttgggtgaag

SEQ ID NO: 9056821 - DNA, 22 bp, Homo sapiens
gaaagtttcttcattaagatgt

SEQ ID NO: 9056822 - DNA, 22 bp, Homo sapiens
gaaagttttcatatataccaaa

SEQ ID NO: 9056823 - DNA, 22 bp, Homo sapiens
gaaataacagctctggaagagt

SEQ ID NO: 9056824 - DNA, 22 bp, Homo sapiens
gaaatacaaagccagccatttt

SEQ ID NO: 9056825 - DNA, 22 bp, Homo sapiens
gaaatacaaagccagccatttt

SEQ ID NO: 9056826 - DNA, 22 bp, Homo sapiens
gaaataatttagaaggtattcc

SEQ ID NO: 9056827 - DNA, 22 bp, Homo sapiens
gaaataatacagtgctcttctc

SEQ ID NO: 9056828 - DNA, 22 bp, Homo sapiens
gaaatacaattttgtcccagct

SEQ ID NO: 9056829 - DNA, 22 bp, Homo sapiens
gaaatacaaatgcctagatcct

SEQ ID NO: 9056830 - DNA, 22 bp, Homo sapiens
gaaatacaaatgcctagatcct

SEQ ID NO: 9056831 - DNA, 22 bp, Homo sapiens
gaaagggagtgaagatggtata

SEQ ID NO: 9056832 - DNA, 21 bp, Homo sapiens
gaaaatacaatgagcttgacc

SEQ ID NO: 9056833 - DNA, 18 bp, Homo sapiens
gaaaatactctgggctca

SEQ ID NO: 9056834 - DNA, 22 bp, Homo sapiens
gaaaatacaaatagccttgaaa

SEQ ID NO: 9056835 - DNA, 22 bp, Homo sapiens
gaaagtttataggttatataat

SEQ ID NO: 9056836 - DNA, 22 bp, Homo sapiens
gaaagggagtggacaacaggca

SEQ ID NO: 9056837 - DNA, 22 bp, Homo sapiens
gaaagggcatgggcatgacaac

SEQ ID NO: 9056838 - DNA, 22 bp, Homo sapiens
gaaaaggaaatttatagagatc

SEQ ID NO: 9056839 - DNA, 22 bp, Homo sapiens
gaaaagggcaagagagagggca

SEQ ID NO: 9056840 - DNA, 22 bp, Homo sapiens
gaaaacatccagagatagacct

SEQ ID NO: 9056841 - DNA, 22 bp, Homo sapiens
gaaaacatccagagatagacct

SEQ ID NO: 9056842 - DNA, 22 bp, Homo sapiens
gaaaagctaggccagttcagct

SEQ ID NO: 9056843 - DNA, 22 bp, Homo sapiens
gaaaagcttactgccacttggc

SEQ ID NO: 9056844 - DNA, 22 bp, Homo sapiens
cttttaatgggagcagtatttg

SEQ ID NO: 9056845 - DNA, 22 bp, Homo sapiens
cttgggctctaaatgccagtga

SEQ ID NO: 9056846 - DNA, 22 bp, Homo sapiens
cttggctgtctataggaaagag

SEQ ID NO: 9056847 - DNA, 22 bp, Homo sapiens
ctttagttgttatttcttcaca

SEQ ID NO: 9056848 - DNA, 22 bp, Homo sapiens
ctttagttgtatcagtcaagtt

SEQ ID NO: 9056849 - DNA, 22 bp, Homo sapiens
ctttagaatttgatataatcaa

SEQ ID NO: 9056850 - DNA, 22 bp, Homo sapiens
ctttacaacctaagttgaagct

SEQ ID NO: 9056851 - DNA, 22 bp, Homo sapiens
ctttgtattcatccgtaataat

SEQ ID NO: 9056852 - DNA, 22 bp, Homo sapiens
ctttgtatctaaatatcttgaa

SEQ ID NO: 9056853 - DNA, 22 bp, Homo sapiens
ctttggcagcctctgctattga

SEQ ID NO: 9056854 - DNA, 22 bp, Homo sapiens
ctttatatattcccaggctgcc

SEQ ID NO: 9056855 - DNA, 22 bp, Homo sapiens
ctttatatccagatgtttggtg

SEQ ID NO: 9056856 - DNA, 22 bp, Homo sapiens
cttctttcccaggcatgtttta

SEQ ID NO: 9056857 - DNA, 22 bp, Homo sapiens
cttgaaatgacaggagcacatc

SEQ ID NO: 9056858 - DNA, 22 bp, Homo sapiens
cttgaaatccagatttcagagg

SEQ ID NO: 9056859 - DNA, 22 bp, Homo sapiens
tgtctcatctcttaaccccact

SEQ ID NO: 9056860 - DNA, 22 bp, Homo sapiens
tgtctcatctcttaaccccact

SEQ ID NO: 9056861 - DNA, 22 bp, Homo sapiens
tgtctctgtgactccttccgcc

SEQ ID NO: 9056862 - DNA, 22 bp, Homo sapiens
tgtctctgtgagatctgacgat

SEQ ID NO: 9056863 - DNA, 22 bp, Homo sapiens
tgtctctgtgcatttgtgcttc

SEQ ID NO: 9056864 - DNA, 22 bp, Homo sapiens
tgtctcttggctctatcactta

SEQ ID NO: 9056865 - DNA, 22 bp, Homo sapiens
tgtctcttgagctgcctgatgc

SEQ ID NO: 9056866 - DNA, 22 bp, Homo sapiens
tgtctatttgaattatcctaat

SEQ ID NO: 9056867 - DNA, 22 bp, Homo sapiens
tgtctattaacacaagaaagga

SEQ ID NO: 9056868 - DNA, 22 bp, Homo sapiens
tgtctattaattccacataaaa

SEQ ID NO: 9056869 - DNA, 22 bp, Homo sapiens
tgtcctggaaaaatggagagtt

SEQ ID NO: 9056870 - DNA, 22 bp, Homo sapiens
cctggctcctgcctctgcaggg

SEQ ID NO: 9056871 - DNA, 22 bp, Homo sapiens
cctggccctggaatagggcagg

SEQ ID NO: 9056872 - DNA, 22 bp, Homo sapiens
cctggccagcgccggctgctcg

SEQ ID NO: 9056873 - DNA, 22 bp, Homo sapiens
tgtccatgggcgtcaggcagga

SEQ ID NO: 9056874 - DNA, 22 bp, Homo sapiens
tgtccaggttagcttcaaacac

SEQ ID NO: 9056875 - DNA, 22 bp, Homo sapiens
cctggcagactgtgagggcagg

SEQ ID NO: 9056876 - DNA, 23 bp, Homo sapiens
cctggcagcaaacgaggaggtta

SEQ ID NO: 9056877 - DNA, 22 bp, Homo sapiens
tgtcattatgaggattacaata

SEQ ID NO: 9056878 - DNA, 22 bp, Homo sapiens
tgtcattagtttcagccattct

SEQ ID NO: 9056879 - DNA, 22 bp, Homo sapiens
cctggcaggcccctcctggatt

SEQ ID NO: 9056880 - DNA, 22 bp, Homo sapiens
cctggcaggtggaggttgcagt

SEQ ID NO: 9056881 - DNA, 22 bp, Homo sapiens
tgtaaacagccccatggagagc

SEQ ID NO: 9056882 - DNA, 22 bp, Homo sapiens
tgtaaacataccagagccaagt

SEQ ID NO: 9056883 - DNA, 22 bp, Homo sapiens
cctggagaccagaggatacttc

SEQ ID NO: 9056884 - DNA, 18 bp, Homo sapiens
tggtccagttcagatata

SEQ ID NO: 9056885 - DNA, 22 bp, Homo sapiens
tggtccagttctgtgatattgc

SEQ ID NO: 9056886 - DNA, 22 bp, Homo sapiens
tggtccagtttagcattgagtg

SEQ ID NO: 9056887 - DNA, 22 bp, Homo sapiens
tggtccagtaagggtggagaga

SEQ ID NO: 9056888 - DNA, 22 bp, Homo sapiens
tggtccagtagcagggatacca

SEQ ID NO: 9056889 - DNA, 22 bp, Homo sapiens
tggtccagtgacagataggcac

SEQ ID NO: 9056890 - DNA, 22 bp, Homo sapiens
tggtccagtcgttcctttcctt

SEQ ID NO: 9056891 - DNA, 22 bp, Homo sapiens
cctggcactgaccaggcactga

SEQ ID NO: 9056892 - DNA, 22 bp, Homo sapiens
tgtcatgggtctaaacattgat

SEQ ID NO: 9056893 - DNA, 22 bp, Homo sapiens
tgtcatgggcatttattgaggg

SEQ ID NO: 9056894 - DNA, 22 bp, Homo sapiens
tgtattaacattaataaaatgg

SEQ ID NO: 9056895 - DNA, 22 bp, Homo sapiens
tgtaggaattccagtgacttca

SEQ ID NO: 9056896 - DNA, 22 bp, Homo sapiens
tgtaaagaaagacgcagagtta

SEQ ID NO: 9056897 - DNA, 22 bp, Homo sapiens
tgtaccactctactaagggttc

SEQ ID NO: 9056898 - DNA, 22 bp, Homo sapiens
tgtaaacatgctgaggctggag

SEQ ID NO: 9056899 - DNA, 23 bp, Homo sapiens
tgtaaacatcaccccctggagtt

SEQ ID NO: 9056900 - DNA, 22 bp, Homo sapiens
tgtaaacatatgtatgtatgta

SEQ ID NO: 9056901 - DNA, 22 bp, Homo sapiens
tgtagtagcattcacgaagtgt

SEQ ID NO: 9056902 - DNA, 22 bp, Homo sapiens
cctggaggtggaggttgcagtg

SEQ ID NO: 9056903 - DNA, 22 bp, Homo sapiens
cctggctgagcctccaggaaga

SEQ ID NO: 9056904 - DNA, 22 bp, Homo sapiens
cctggctgaggggccaaggacc

SEQ ID NO: 9056905 - DNA, 21 bp, Homo sapiens
cctggctgcacagttgctggt

SEQ ID NO: 9056906 - DNA, 22 bp, Homo sapiens
tgtgaaggcagagccagtgaaa

SEQ ID NO: 9056907 - DNA, 22 bp, Homo sapiens
tgtgaagctggatcctggagct

SEQ ID NO: 9056908 - DNA, 22 bp, Homo sapiens
tgtgaaggacttgttccattgt

SEQ ID NO: 9056909 - DNA, 22 bp, Homo sapiens
tgtgaaggtagctcttggcact

SEQ ID NO: 9056910 - DNA, 22 bp, Homo sapiens
tgtgaaggtaaggtttgcttga

SEQ ID NO: 9056911 - DNA, 22 bp, Homo sapiens
tgtctttctatctctagattta

SEQ ID NO: 9056912 - DNA, 23 bp, Homo sapiens
tgtctttgaatgggctgtagaca

SEQ ID NO: 9056913 - DNA, 20 bp, Homo sapiens
cctggctgcattcaggacgg

SEQ ID NO: 9056914 - DNA, 22 bp, Homo sapiens
cctggctgtgtgaccttggcaa

SEQ ID NO: 9056915 - DNA, 22 bp, Homo sapiens
cctggcttcctggagctcacaa

SEQ ID NO: 9056916 - DNA, 22 bp, Homo sapiens
cctggctgcattttgctggatg

SEQ ID NO: 9056917 - DNA, 22 bp, Homo sapiens
cctggctgccgagtgtgcagcg

SEQ ID NO: 9056918 - DNA, 19 bp, Homo sapiens
cctggctgtgaagcctgca

SEQ ID NO: 9056919 - DNA, 22 bp, Homo sapiens
cctggctgtgcattgccggccc

SEQ ID NO: 9056920 - DNA, 23 bp, Homo sapiens
cctggctgtggatttgggcctgc

SEQ ID NO: 9056921 - DNA, 22 bp, Homo sapiens
cctggctgtgcattgccggccc

SEQ ID NO: 9056922 - DNA, 22 bp, Homo sapiens
tgtgcttctcacatcactgttg

SEQ ID NO: 9056923 - DNA, 22 bp, Homo sapiens
cctggggaagtcacttctcttt

SEQ ID NO: 9056924 - DNA, 20 bp, Homo sapiens
cctgggctcaaagcatcctc

SEQ ID NO: 9056925 - DNA, 22 bp, Homo sapiens
cctgggtcccagccaggctttg

SEQ ID NO: 9056926 - DNA, 22 bp, Homo sapiens
cctgggtgatgtgctgccctcg

SEQ ID NO: 9056927 - DNA, 22 bp, Homo sapiens
cctgggtgcccggcccttctct

SEQ ID NO: 9056928 - DNA, 22 bp, Homo sapiens
tgtgttcaccctagcacttaac

SEQ ID NO: 9056929 - DNA, 22 bp, Homo sapiens
cctggggacctgcctcagccct

SEQ ID NO: 9056930 - DNA, 22 bp, Homo sapiens
cctgggcaatatagtgaggccc

SEQ ID NO: 9056931 - DNA, 22 bp, Homo sapiens
cctctacagggcatagcccaaa

SEQ ID NO: 9056932 - DNA, 22 bp, Homo sapiens
cctctatgtacacatttccagc

SEQ ID NO: 9056933 - DNA, 22 bp, Homo sapiens
cctctctcttgtagtccctgcc

SEQ ID NO: 9056934 - DNA, 22 bp, Homo sapiens
cctctggtcccagctctgctgc

SEQ ID NO: 9056935 - DNA, 22 bp, Homo sapiens
cctctgtacaggtcagcatcta

SEQ ID NO: 9056936 - DNA, 22 bp, Homo sapiens
cctctggctgtaccactggcac

SEQ ID NO: 9056937 - DNA, 22 bp, Homo sapiens
cctcccttccccagtagtcaag

SEQ ID NO: 9056938 - DNA, 22 bp, Homo sapiens
cctcccttcagtagagcccaat

SEQ ID NO: 9056939 - DNA, 22 bp, Homo sapiens
tggctcatctttttagacttat

SEQ ID NO: 9056940 - DNA, 22 bp, Homo sapiens
tggctcatgcatcttttctaca

SEQ ID NO: 9056941 - DNA, 22 bp, Homo sapiens
tggctcatgcctgtaatcttag

SEQ ID NO: 9056942 - DNA, 22 bp, Homo sapiens
tggctcatattgagtgatttct

SEQ ID NO: 9056943 - DNA, 20 bp, Homo sapiens
tggcccagtggggcagggtg

SEQ ID NO: 9056944 - DNA, 22 bp, Homo sapiens
cctagtccccaggaggtcagtg

SEQ ID NO: 9056945 - DNA, 22 bp, Homo sapiens
tggcagctgtgtccaggtagaa

SEQ ID NO: 9056946 - DNA, 22 bp, Homo sapiens
tggcagcttgaatgcagtcttt

SEQ ID NO: 9056947 - DNA, 22 bp, Homo sapiens
tggcaagttcatatggtttaag

SEQ ID NO: 9056948 - DNA, 22 bp, Homo sapiens
tggcaagggattgtggagaact

SEQ ID NO: 9056949 - DNA, 22 bp, Homo sapiens
tggcaaggccacaggtgcagtt

SEQ ID NO: 9056950 - DNA, 23 bp, Homo sapiens
tggcaaggaatgggatggagact

SEQ ID NO: 9056951 - DNA, 22 bp, Homo sapiens
tggcaaggctgtgggggcagag

SEQ ID NO: 9056952 - DNA, 22 bp, Homo sapiens
tggcacagggcttggtcgctca

SEQ ID NO: 9056953 - DNA, 22 bp, Homo sapiens
tggcagattctggttgatactt

SEQ ID NO: 9056954 - DNA, 22 bp, Homo sapiens
tggatcatgtgatgtcaggagt

SEQ ID NO: 9056955 - DNA, 22 bp, Homo sapiens
tggatcatcttaagaagtgatt

SEQ ID NO: 9056956 - DNA, 19 bp, Homo sapiens
ccctggagaataccctgga

SEQ ID NO: 9056957 - DNA, 22 bp, Homo sapiens
ccctccaggcctgtcatgttcc

SEQ ID NO: 9056958 - DNA, 22 bp, Homo sapiens
ccctccagggagccatgctggg

SEQ ID NO: 9056959 - DNA, 22 bp, Homo sapiens
ccctcagttttccagtgtgggc

SEQ ID NO: 9056960 - DNA, 22 bp, Homo sapiens
ccctcagtctggctgggaagac

SEQ ID NO: 9056961 - DNA, 22 bp, Homo sapiens
ccctccagccatggacccaggt

SEQ ID NO: 9056962 - DNA, 22 bp, Homo sapiens
tgcagggaatctgtggctggac

SEQ ID NO: 9056963 - DNA, 22 bp, Homo sapiens
tgcagggaccccgaggctctct

SEQ ID NO: 9056964 - DNA, 22 bp, Homo sapiens
tgcagggaatgcttgcagcatg

SEQ ID NO: 9056965 - DNA, 22 bp, Homo sapiens
tgcagggacaggctctggggat

SEQ ID NO: 9056966 - DNA, 22 bp, Homo sapiens
tgcagggacacgaagacaaata

SEQ ID NO: 9056967 - DNA, 22 bp, Homo sapiens
cccagctctggaaggtggggga

SEQ ID NO: 9056968 - DNA, 22 bp, Homo sapiens
cccagctcttcctgggagctaa

SEQ ID NO: 9056969 - DNA, 22 bp, Homo sapiens
cccagctcttttagcggcatct

SEQ ID NO: 9056970 - DNA, 22 bp, Homo sapiens
cccagcttgcccaggactgagg

SEQ ID NO: 9056971 - DNA, 19 bp, Homo sapiens
cccagcttgaccacctgct

SEQ ID NO: 9056972 - DNA, 18 bp, Homo sapiens
cccagcttagcgcccctc

SEQ ID NO: 9056973 - DNA, 22 bp, Homo sapiens
cccagcttctgagggggccttg

SEQ ID NO: 9056974 - DNA, 23 bp, Homo sapiens
cccagctttcccactgccgagag

SEQ ID NO: 9056975 - DNA, 22 bp, Homo sapiens
tgccacagagactttcattgta

SEQ ID NO: 9056976 - DNA, 22 bp, Homo sapiens
tgctgcagcagtgcgggcagct

SEQ ID NO: 9056977 - DNA, 22 bp, Homo sapiens
tgctgcagctaaggtgaggtgc

SEQ ID NO: 9056978 - DNA, 22 bp, Homo sapiens
cccctccctgacctggttgggc

SEQ ID NO: 9056979 - DNA, 22 bp, Homo sapiens
cccccactaagttgagggccct

SEQ ID NO: 9056980 - DNA, 22 bp, Homo sapiens
cccccaaagtttgcacggataa

SEQ ID NO: 9056981 - DNA, 21 bp, Homo sapiens
tgctcagtaaatgctgagtga

SEQ ID NO: 9056982 - DNA, 20 bp, Homo sapiens
tgctgcagacagggccattg

SEQ ID NO: 9056983 - DNA, 23 bp, Homo sapiens
tgctgaagtgttggccctgccca

SEQ ID NO: 9056984 - DNA, 22 bp, Homo sapiens
cccagggactcgggattctagg

SEQ ID NO: 9056985 - DNA, 22 bp, Homo sapiens
cccagggagagcgcggaggcgg

SEQ ID NO: 9056986 - DNA, 22 bp, Homo sapiens
tgctctggagtggcttgtgcac

SEQ ID NO: 9056987 - DNA, 22 bp, Homo sapiens
cccagggaggtagcaggagaaa

SEQ ID NO: 9056988 - DNA, 22 bp, Homo sapiens
ctgagaaattctttctttcact

SEQ ID NO: 9056989 - DNA, 22 bp, Homo sapiens
ctgagaagcaaagaactgcact

SEQ ID NO: 9056990 - DNA, 22 bp, Homo sapiens
ctgagaaatgcatttttccagc

SEQ ID NO: 9056991 - DNA, 22 bp, Homo sapiens
ctgagaaagtgagggttaaaca

SEQ ID NO: 9056992 - DNA, 22 bp, Homo sapiens
ctgaagatgtctgagatgctca

SEQ ID NO: 9056993 - DNA, 22 bp, Homo sapiens
ctgaagatagtgtctgatcatg

SEQ ID NO: 9056994 - DNA, 22 bp, Homo sapiens
ctgaagatgatgatactaagga

SEQ ID NO: 9056995 - DNA, 22 bp, Homo sapiens
tttttaatgcagtctgagacat

SEQ ID NO: 9056996 - DNA, 22 bp, Homo sapiens
ctgaacaaagttcttttgagct

SEQ ID NO: 9056997 - DNA, 22 bp, Homo sapiens
ctctgggttctggcctgcaccc

SEQ ID NO: 9056998 - DNA, 22 bp, Homo sapiens
ctctttgtggaacggcagtgtc

SEQ ID NO: 9056999 - DNA, 22 bp, Homo sapiens
tttttaagagtctggaaatagt

SEQ ID NO: 9057000 - DNA, 22 bp, Homo sapiens
tttttaagctcctttgatgtca

SEQ ID NO: 9057001 - DNA, 22 bp, Homo sapiens
ttttgttttcttagaaacctgg

SEQ ID NO: 9057002 - DNA, 22 bp, Homo sapiens
tttttaagagattctccagtct

SEQ ID NO: 9057003 - DNA, 22 bp, Homo sapiens
ctcttttcaaacctgtttatgg

SEQ ID NO: 9057004 - DNA, 17 bp, Homo sapiens
ctcttttgtcttcttcc

SEQ ID NO: 9057005 - DNA, 22 bp, Homo sapiens
ctctttttcagccttaccaaag

SEQ ID NO: 9057006 - DNA, 22 bp, Homo sapiens
ctctttttcacctctgtcagcg

SEQ ID NO: 9057007 - DNA, 17 bp, Homo sapiens
ctcttttgtcttcttcc

SEQ ID NO: 9057008 - DNA, 22 bp, Homo sapiens
ctctggctggcacctgatctga

SEQ ID NO: 9057009 - DNA, 22 bp, Homo sapiens
ctctggcttagtatgctccaaa

SEQ ID NO: 9057010 - DNA, 22 bp, Homo sapiens
ctctggctgcctctcaggcctg

SEQ ID NO: 9057011 - DNA, 22 bp, Homo sapiens
ctctggctggcacctgatctga

SEQ ID NO: 9057012 - DNA, 22 bp, Homo sapiens
tttgtcttgtaagttaaattca

SEQ ID NO: 9057013 - DNA, 22 bp, Homo sapiens
ttttattcatagggatggagag

SEQ ID NO: 9057014 - DNA, 18 bp, Homo sapiens
ctctgggagaggcataca

SEQ ID NO: 9057015 - DNA, 22 bp, Homo sapiens
ctctgggcaagtttcttcatga

SEQ ID NO: 9057016 - DNA, 22 bp, Homo sapiens
ctgagacattatgacaagtgga

SEQ ID NO: 9057017 - DNA, 22 bp, Homo sapiens
ctgaggagaaagatggtccaag

SEQ ID NO: 9057018 - DNA, 22 bp, Homo sapiens
ctgaggagaaatgggatggttc

SEQ ID NO: 9057019 - DNA, 22 bp, Homo sapiens
ctgaggaggctaatttgaggat

SEQ ID NO: 9057020 - DNA, 22 bp, Homo sapiens
ctgaggagtgggtgggcagtga

SEQ ID NO: 9057021 - DNA, 22 bp, Homo sapiens
ctgaggagggaagtccccaaag

SEQ ID NO: 9057022 - DNA, 22 bp, Homo sapiens
ctgaggagtcagttccactcag

SEQ ID NO: 9057023 - DNA, 22 bp, Homo sapiens
ctgaggagtcagcttactcact

SEQ ID NO: 9057024 - DNA, 22 bp, Homo sapiens
ctgaggaggggcctgagtgaga

SEQ ID NO: 9057025 - DNA, 22 bp, Homo sapiens
ctgaggagtttgggttgttcaa

SEQ ID NO: 9057026 - DNA, 22 bp, Homo sapiens
ctgaggagtttcttatatgtgt

SEQ ID NO: 9057027 - DNA, 22 bp, Homo sapiens
ctgaggagttggtgaataagcc

SEQ ID NO: 9057028 - DNA, 22 bp, Homo sapiens
ctgcaaaagtaattggggcttt

SEQ ID NO: 9057029 - DNA, 22 bp, Homo sapiens
ctgcaaaagtaattgcaggttt

SEQ ID NO: 9057030 - DNA, 22 bp, Homo sapiens
ctgcagaaacctttcctgattt

SEQ ID NO: 9057031 - DNA, 22 bp, Homo sapiens
ctgcagaacaattcctgctgtt

SEQ ID NO: 9057032 - DNA, 22 bp, Homo sapiens
ctgcagaaagctgagatgatta

SEQ ID NO: 9057033 - DNA, 23 bp, Homo sapiens
ctgcagagaactgagggacagcc

SEQ ID NO: 9057034 - DNA, 22 bp, Homo sapiens
ctgcagagcatgaggaggtctg

SEQ ID NO: 9057035 - DNA, 21 bp, Homo sapiens
ctgcagagcatgcaaaatgtt

SEQ ID NO: 9057036 - DNA, 22 bp, Homo sapiens
ctgatctgtcctcctcagagcc

SEQ ID NO: 9057037 - DNA, 22 bp, Homo sapiens
ctgccctggggggcctccttgc

SEQ ID NO: 9057038 - DNA, 22 bp, Homo sapiens
ctgccctgggtgctggggatcc

SEQ ID NO: 9057039 - DNA, 22 bp, Homo sapiens
ctgccaggtgagctccaggcct

SEQ ID NO: 9057040 - DNA, 22 bp, Homo sapiens
ctgcctcagcgttgtggcccta

SEQ ID NO: 9057041 - DNA, 22 bp, Homo sapiens
ctgcctcctcacgtccacagtg

SEQ ID NO: 9057042 - DNA, 22 bp, Homo sapiens
ctgccaggctgtcccaggtccg

SEQ ID NO: 9057043 - DNA, 22 bp, Homo sapiens
ctgcagagtggagcctcggctg

SEQ ID NO: 9057044 - DNA, 22 bp, Homo sapiens
ctgcagaggggttgaagggtcc

SEQ ID NO: 9057045 - DNA, 22 bp, Homo sapiens
ctggcagcattaacagagagca

SEQ ID NO: 9057046 - DNA, 22 bp, Homo sapiens
ctggccacatgtgtgctgagca

SEQ ID NO: 9057047 - DNA, 22 bp, Homo sapiens
ctggataagagttttacttcct

SEQ ID NO: 9057048 - DNA, 22 bp, Homo sapiens
ctggataaatgtttgctttaga

SEQ ID NO: 9057049 - DNA, 22 bp, Homo sapiens
ctggcctggcagggagggcatg

SEQ ID NO: 9057050 - DNA, 22 bp, Homo sapiens
ctggcctgctgggtgaggtcct

SEQ ID NO: 9057051 - DNA, 22 bp, Homo sapiens
ctggccctgtggaggcaggaac

SEQ ID NO: 9057052 - DNA, 22 bp, Homo sapiens
ctggcccagagagcagagctta

SEQ ID NO: 9057053 - DNA, 22 bp, Homo sapiens
ctggctctgtcaccctttctcc

SEQ ID NO: 9057054 - DNA, 22 bp, Homo sapiens
ctggctctgtggcttccttcat

SEQ ID NO: 9057055 - DNA, 22 bp, Homo sapiens
ctggctctgagtggtatcttga

SEQ ID NO: 9057056 - DNA, 22 bp, Homo sapiens
ctggctctaagtgtcagctccc

SEQ ID NO: 9057057 - DNA, 22 bp, Homo sapiens
ctggcctgggagctgctagcgt

SEQ ID NO: 9057058 - DNA, 22 bp, Homo sapiens
ctggcctggggggacacatccc

SEQ ID NO: 9057059 - DNA, 21 bp, Homo sapiens
ctggagggtagagttgggctg

SEQ ID NO: 9057060 - DNA, 22 bp, Homo sapiens
ctggaggggctggcatggtagc

SEQ ID NO: 9057061 - DNA, 22 bp, Homo sapiens
ctggaggggctggcatggtagc

SEQ ID NO: 9057062 - DNA, 22 bp, Homo sapiens
ctggagggctggactaaggaaa

SEQ ID NO: 9057063 - DNA, 22 bp, Homo sapiens
ctggagggcttctgcaggttac

SEQ ID NO: 9057064 - DNA, 22 bp, Homo sapiens
ctggagctcttctgagtgtgct

SEQ ID NO: 9057065 - DNA, 22 bp, Homo sapiens
ctggaggcaaagcagaggcatg

SEQ ID NO: 9057066 - DNA, 22 bp, Homo sapiens
ctgcctgggccatgcccagtcc

SEQ ID NO: 9057067 - DNA, 19 bp, Homo sapiens
ctgcttccttccctcactg

SEQ ID NO: 9057068 - DNA, 22 bp, Homo sapiens
ctgcctgctcaccagggctctg

SEQ ID NO: 9057069 - DNA, 22 bp, Homo sapiens
ctgcctggaccggcagccctcc

SEQ ID NO: 9057070 - DNA, 22 bp, Homo sapiens
ctggaaagacagagggcatggg

SEQ ID NO: 9057071 - DNA, 16 bp, Homo sapiens
ctggaaaggctagctc

SEQ ID NO: 9057072 - DNA, 22 bp, Homo sapiens
ttgagctgcctggctgtggctc

SEQ ID NO: 9057073 - DNA, 22 bp, Homo sapiens
ttgagaaacatctaatctttgt

SEQ ID NO: 9057074 - DNA, 20 bp, Homo sapiens
ttgagcttttagtacagaca

SEQ ID NO: 9057075 - DNA, 22 bp, Homo sapiens
ctattttaagaggccattaggt

SEQ ID NO: 9057076 - DNA, 22 bp, Homo sapiens
ctattttaagaggccattaggt

SEQ ID NO: 9057077 - DNA, 22 bp, Homo sapiens
ctattttgcctgcctagaaatc

SEQ ID NO: 9057078 - DNA, 22 bp, Homo sapiens
ctatttttctgtaccctaattt

SEQ ID NO: 9057079 - DNA, 22 bp, Homo sapiens
ttcctttccctcacagcctcgg

SEQ ID NO: 9057080 - DNA, 22 bp, Homo sapiens
ttcctttcacgttttaatgcac

SEQ ID NO: 9057081 - DNA, 22 bp, Homo sapiens
ttcctttgggaaatcactaagg

SEQ ID NO: 9057082 - DNA, 22 bp, Homo sapiens
ttcctttctgtcagcctgagtg

SEQ ID NO: 9057083 - DNA, 22 bp, Homo sapiens
ttccttttatttgtccaggctt

SEQ ID NO: 9057084 - DNA, 22 bp, Homo sapiens
ttccttttcatatgccccgcgt

SEQ ID NO: 9057085 - DNA, 22 bp, Homo sapiens
ttccttttagaatcatgaagac

SEQ ID NO: 9057086 - DNA, 22 bp, Homo sapiens
ttccttttacaaatagcctcct

SEQ ID NO: 9057087 - DNA, 22 bp, Homo sapiens
ttcctttgggttaagacatctg

SEQ ID NO: 9057088 - DNA, 22 bp, Homo sapiens
ctagcctgggatttgaacttat

SEQ ID NO: 9057089 - DNA, 22 bp, Homo sapiens
ttccttttcttctaccacatgt

SEQ ID NO: 9057090 - DNA, 22 bp, Homo sapiens
ttccttttctcacggggatcca

SEQ ID NO: 9057091 - DNA, 20 bp, Homo sapiens
ttccttttcgcctctctccc

SEQ ID NO: 9057092 - DNA, 22 bp, Homo sapiens
ttccttttcttatgcatcatta

SEQ ID NO: 9057093 - DNA, 22 bp, Homo sapiens
ttccttttcttaaacatatgtg

SEQ ID NO: 9057094 - DNA, 22 bp, Homo sapiens
ctaggccacagggcaaaaagga

SEQ ID NO: 9057095 - DNA, 22 bp, Homo sapiens
ctatttctacacagggtcggcg

SEQ ID NO: 9057096 - DNA, 23 bp, Homo sapiens
ctatttctcatagttcaggtctt

SEQ ID NO: 9057097 - DNA, 23 bp, Homo sapiens
ctatttctcatagttcaggtctt

SEQ ID NO: 9057098 - DNA, 22 bp, Homo sapiens
ctatttctaaacctataagtga

SEQ ID NO: 9057099 - DNA, 22 bp, Homo sapiens
ctatttctgcctaatgacctgt

SEQ ID NO: 9057100 - DNA, 22 bp, Homo sapiens
ctagggagtggcagagctggga

SEQ ID NO: 9057101 - DNA, 22 bp, Homo sapiens
ctatttatgtgctattttgtat

SEQ ID NO: 9057102 - DNA, 22 bp, Homo sapiens
ctatttatgtgctattttgtat

SEQ ID NO: 9057103 - DNA, 22 bp, Homo sapiens
ctattccacttttggcaaagcc

SEQ ID NO: 9057104 - DNA, 22 bp, Homo sapiens
ctatttattgtgggtatccagg

SEQ ID NO: 9057105 - DNA, 21 bp, Homo sapiens
ttcttcctaaatacagatctc

SEQ ID NO: 9057106 - DNA, 21 bp, Homo sapiens
ttcttcctaaatacagatctc

SEQ ID NO: 9057107 - DNA, 22 bp, Homo sapiens
ttcttcctcacactctcaccca

SEQ ID NO: 9057108 - DNA, 22 bp, Homo sapiens
ttcttcctcacactctcaccca

SEQ ID NO: 9057109 - DNA, 22 bp, Homo sapiens
ttctgtcatcctttctagatgt

SEQ ID NO: 9057110 - DNA, 22 bp, Homo sapiens
ttctgtcacagtgctggtatca

SEQ ID NO: 9057111 - DNA, 22 bp, Homo sapiens
ttctgtacttcaggggctctgt

SEQ ID NO: 9057112 - DNA, 22 bp, Homo sapiens
ttctgtatattgtaaagactca

SEQ ID NO: 9057113 - DNA, 22 bp, Homo sapiens
ctacaaagaaagctgaggggaa

SEQ ID NO: 9057114 - DNA, 22 bp, Homo sapiens
ctacaaagaaagtatactggac

SEQ ID NO: 9057115 - DNA, 22 bp, Homo sapiens
ctacaaagtaccacagactggg

SEQ ID NO: 9057116 - DNA, 23 bp, Homo sapiens
ctacaaagtatgagaagacccct

SEQ ID NO: 9057117 - DNA, 22 bp, Homo sapiens
ctacaaagaatttctctagctc

SEQ ID NO: 9057118 - DNA, 22 bp, Homo sapiens
ctacaaagctcttctacaggca

SEQ ID NO: 9057119 - DNA, 22 bp, Homo sapiens
ctacaaatataaaacacagata

SEQ ID NO: 9057120 - DNA, 22 bp, Homo sapiens
ttccttcagcaagtcctgagca

SEQ ID NO: 9057121 - DNA, 22 bp, Homo sapiens
ctaatgcagtatcagaatagca

SEQ ID NO: 9057122 - DNA, 22 bp, Homo sapiens
ctaattctgaaacagtgtcaat

SEQ ID NO: 9057123 - DNA, 22 bp, Homo sapiens
ctaagaaagtattgttttgtgg

SEQ ID NO: 9057124 - DNA, 22 bp, Homo sapiens
ctaagaaaatagaagcatgcta

SEQ ID NO: 9057125 - DNA, 22 bp, Homo sapiens
ttccgctgtttagttgaagttt

SEQ ID NO: 9057126 - DNA, 22 bp, Homo sapiens
ttccggaaggttctctagaatt

SEQ ID NO: 9057127 - DNA, 22 bp, Homo sapiens
ttccctggggaaggtgaccttt

SEQ ID NO: 9057128 - DNA, 22 bp, Homo sapiens
ttcccacagagattacattgaa

SEQ ID NO: 9057129 - DNA, 22 bp, Homo sapiens
ttcccacattctttacattcat

SEQ ID NO: 9057130 - DNA, 22 bp, Homo sapiens
ttcccacagtgttgaatcctct

SEQ ID NO: 9057131 - DNA, 22 bp, Homo sapiens
ttcagaaaggataattggaagg

SEQ ID NO: 9057132 - DNA, 22 bp, Homo sapiens
ttcagaaacatcagtggatgga

SEQ ID NO: 9057133 - DNA, 22 bp, Homo sapiens
ttcagaaaaagaccattgcaat

SEQ ID NO: 9057134 - DNA, 22 bp, Homo sapiens
ttcagaaacagagtgagtgagt

SEQ ID NO: 9057135 - DNA, 22 bp, Homo sapiens
ttcagaaaaaacttcaataagt

SEQ ID NO: 9057136 - DNA, 22 bp, Homo sapiens
ttcactgttggctttgcttgtc

SEQ ID NO: 9057137 - DNA, 21 bp, Homo sapiens
ttcatgagataaccagctgta

SEQ ID NO: 9057138 - DNA, 22 bp, Homo sapiens
ttcagaaaggttaatctggatt

SEQ ID NO: 9057139 - DNA, 22 bp, Homo sapiens
ttcagaaaggtaaatggatttc

SEQ ID NO: 9057140 - DNA, 22 bp, Homo sapiens
ttcagaaaggttaatctggatt

SEQ ID NO: 9057141 - DNA, 19 bp, Homo sapiens
ttcattctcttattgttgt

SEQ ID NO: 9057142 - DNA, 22 bp, Homo sapiens
ttcattctcttagcatagtcct

SEQ ID NO: 9057143 - DNA, 22 bp, Homo sapiens
ttcattctgcagttctcagctc

SEQ ID NO: 9057144 - DNA, 22 bp, Homo sapiens
ttcacataatgatacaaagctt

SEQ ID NO: 9057145 - DNA, 22 bp, Homo sapiens
cctgggtggctgcctgcctttc

SEQ ID NO: 9057146 - DNA, 22 bp, Homo sapiens
cgctgggggaacagcgagggtg

SEQ ID NO: 9057147 - DNA, 22 bp, Homo sapiens
ttcacatggcaatagagaggga

SEQ ID NO: 9057148 - DNA, 22 bp, Homo sapiens
ctcagtgcttctagcttgatga

SEQ ID NO: 9057149 - DNA, 22 bp, Homo sapiens
ttgatacatttttaggataaac

SEQ ID NO: 9057150 - DNA, 22 bp, Homo sapiens
ttggaaaacttacacagagctg

SEQ ID NO: 9057151 - DNA, 22 bp, Homo sapiens
ttggcattgaagtttcattggt

SEQ ID NO: 9057152 - DNA, 22 bp, Homo sapiens
ttggcattggagatgcaagaac

SEQ ID NO: 9057153 - DNA, 22 bp, Homo sapiens
ttggcattcatgggacaacaaa

SEQ ID NO: 9057154 - DNA, 22 bp, Homo sapiens
ttgcttttaatctttgtacatc

SEQ ID NO: 9057155 - DNA, 22 bp, Homo sapiens
ttgcttttgggaaaacatgcct

SEQ ID NO: 9057156 - DNA, 22 bp, Homo sapiens
ttggccacactcactagagccc

SEQ ID NO: 9057157 - DNA, 22 bp, Homo sapiens
ctcataatgtgactgtatttga

SEQ ID NO: 9057158 - DNA, 22 bp, Homo sapiens
ctcatcaccacatataacaaag

SEQ ID NO: 9057159 - DNA, 22 bp, Homo sapiens
ctcatagggtgaggataaaaga

SEQ ID NO: 9057160 - DNA, 22 bp, Homo sapiens
ctcatattcagtcactgatgca

SEQ ID NO: 9057161 - DNA, 22 bp, Homo sapiens
ctcatatatttctgcattcaat

SEQ ID NO: 9057162 - DNA, 22 bp, Homo sapiens
ctcatatatttctgcattcaat

SEQ ID NO: 9057163 - DNA, 22 bp, Homo sapiens
tttaaaaaactagtctgagtct

SEQ ID NO: 9057164 - DNA, 22 bp, Homo sapiens
ctccagtctttcagatgtccct

SEQ ID NO: 9057165 - DNA, 22 bp, Homo sapiens
ttgttaaaggcaaaacaagcac

SEQ ID NO: 9057166 - DNA, 22 bp, Homo sapiens
ttgttaaaggcaaaacaagcac

SEQ ID NO: 9057167 - DNA, 22 bp, Homo sapiens
ctccagggttccccgatccact

SEQ ID NO: 9057168 - DNA, 22 bp, Homo sapiens
ttgtatttgggtagtatagaga

SEQ ID NO: 9057169 - DNA, 22 bp, Homo sapiens
ttgttaaaaatagatttccagg

SEQ ID NO: 9057170 - DNA, 22 bp, Homo sapiens
ctccagggttccccgatccact

SEQ ID NO: 9057171 - DNA, 22 bp, Homo sapiens
ttgtatttgattgtcatatcgt

SEQ ID NO: 9057172 - DNA, 22 bp, Homo sapiens
ctccaggggccagaagcctggc

SEQ ID NO: 9057173 - DNA, 22 bp, Homo sapiens
ctccagggggcatccacacagc

SEQ ID NO: 9057174 - DNA, 22 bp, Homo sapiens
ctccaggggccagaagcctggc

SEQ ID NO: 9057175 - DNA, 22 bp, Homo sapiens
ctccaggggccagaagcctggc

SEQ ID NO: 9057176 - DNA, 22 bp, Homo sapiens
ctccagggcagcatggcagtgg

SEQ ID NO: 9057177 - DNA, 22 bp, Homo sapiens
ctccagggcagcatggcagtgg

SEQ ID NO: 9057178 - DNA, 22 bp, Homo sapiens
ctccagggctaccaggttttag

SEQ ID NO: 9057179 - DNA, 20 bp, Homo sapiens
ctccaggggaagagccttcc

SEQ ID NO: 9057180 - DNA, 20 bp, Homo sapiens
ctccaggggaagagccttcc

SEQ ID NO: 9057181 - DNA, 22 bp, Homo sapiens
ctccagggatgagacagagtag

SEQ ID NO: 9057182 - DNA, 22 bp, Homo sapiens
ctccagggcagcatggcagtgg

SEQ ID NO: 9057183 - DNA, 22 bp, Homo sapiens
ctccagggaggtctgcaggact

SEQ ID NO: 9057184 - DNA, 22 bp, Homo sapiens
ctccagggagctgcgggagcca

SEQ ID NO: 9057185 - DNA, 22 bp, Homo sapiens
ctccaggcgcttaccaagcgct

SEQ ID NO: 9057186 - DNA, 22 bp, Homo sapiens
ctccagggagctgtggaggttt

SEQ ID NO: 9057187 - DNA, 22 bp, Homo sapiens
ctccagggagctgtggaggttt

SEQ ID NO: 9057188 - DNA, 22 bp, Homo sapiens
ctccagggagcttggaaagacc

SEQ ID NO: 9057189 - DNA, 22 bp, Homo sapiens
ctccagggaggagcacgggttc

SEQ ID NO: 9057190 - DNA, 22 bp, Homo sapiens
ctccagggaggagcacgggttc

SEQ ID NO: 9057191 - DNA, 22 bp, Homo sapiens
ctcctcttctgagtaccaggga

SEQ ID NO: 9057192 - DNA, 22 bp, Homo sapiens
ctcctctgtattgattgggact

SEQ ID NO: 9057193 - DNA, 22 bp, Homo sapiens
ctcctctgggtcctggtggcca

SEQ ID NO: 9057194 - DNA, 22 bp, Homo sapiens
ctcctctttagccccagctgga

SEQ ID NO: 9057195 - DNA, 22 bp, Homo sapiens
ctcctggctatgactacatttc

SEQ ID NO: 9057196 - DNA, 17 bp, Homo sapiens
tttagaatacaatgttt

SEQ ID NO: 9057197 - DNA, 22 bp, Homo sapiens
ctcctctggaaattcctctgcc

SEQ ID NO: 9057198 - DNA, 22 bp, Homo sapiens
tttacatgagtagcagatgttc

SEQ ID NO: 9057199 - DNA, 22 bp, Homo sapiens
tttacatggaatattgtcttgt

SEQ ID NO: 9057200 - DNA, 22 bp, Homo sapiens
tttacacatacctctttaaagt

SEQ ID NO: 9057201 - DNA, 22 bp, Homo sapiens
tttacattgcattaggtattat

SEQ ID NO: 9057202 - DNA, 22 bp, Homo sapiens
tttacatgtaatgttatacaaa

SEQ ID NO: 9057203 - DNA, 22 bp, Homo sapiens
tttaaaaaactagtctgagtct

SEQ ID NO: 9057204 - DNA, 22 bp, Homo sapiens
tttaaaaggggtattaagtcca

SEQ ID NO: 9057205 - DNA, 22 bp, Homo sapiens
tttaaattatagttaatgtctg

SEQ ID NO: 9057206 - DNA, 22 bp, Homo sapiens
tttaaatttagaagaaacactg

SEQ ID NO: 9057207 - DNA, 22 bp, Homo sapiens
ctcctgggagtcttcctggatg

SEQ ID NO: 9057208 - DNA, 22 bp, Homo sapiens
ctctccccggtacgagcggccg

SEQ ID NO: 9057209 - DNA, 22 bp, Homo sapiens
tttcagttcatctgtgaagatt

SEQ ID NO: 9057210 - DNA, 22 bp, Homo sapiens
tttcagttgcagtggttgtcta

SEQ ID NO: 9057211 - DNA, 21 bp, Homo sapiens
ctctccagtggttcctgattc

SEQ ID NO: 9057212 - DNA, 20 bp, Homo sapiens
tttcagttatcttgaccttc

SEQ ID NO: 9057213 - DNA, 22 bp, Homo sapiens
tttcagttcatctgtgaagatt

SEQ ID NO: 9057214 - DNA, 22 bp, Homo sapiens
taaagcatgtttcagtaaggtt

SEQ ID NO: 9057215 - DNA, 22 bp, Homo sapiens
taaatatcacctggaattgtta

SEQ ID NO: 9057216 - DNA, 22 bp, Homo sapiens
taaatatcagtccagctcttcc

SEQ ID NO: 9057217 - DNA, 22 bp, Homo sapiens
taaatagagaatcagcttggag

SEQ ID NO: 9057218 - DNA, 22 bp, Homo sapiens
taaagcagtgcaaaagcgtttt

SEQ ID NO: 9057219 - DNA, 22 bp, Homo sapiens
caggagctggataggaccacaa

SEQ ID NO: 9057220 - DNA, 22 bp, Homo sapiens
caggagatgacagggaagaacc

SEQ ID NO: 9057221 - DNA, 22 bp, Homo sapiens
caggagactcagcatccaggat

SEQ ID NO: 9057222 - DNA, 22 bp, Homo sapiens
caggagctgggtctggaagcag

SEQ ID NO: 9057223 - DNA, 22 bp, Homo sapiens
taaatgtaccttctgccttact

SEQ ID NO: 9057224 - DNA, 22 bp, Homo sapiens
taaatgtactgaggcaacagga

SEQ ID NO: 9057225 - DNA, 22 bp, Homo sapiens
taaatgtactgaggcaacagga

SEQ ID NO: 9057226 - DNA, 22 bp, Homo sapiens
caggagtgaaatgaggcccagg

SEQ ID NO: 9057227 - DNA, 22 bp, Homo sapiens
caggagttggtaatattgtgga

SEQ ID NO: 9057228 - DNA, 22 bp, Homo sapiens
caggagtttctattgttccaaa

SEQ ID NO: 9057229 - DNA, 22 bp, Homo sapiens
taacaaaggttgccaaactaag

SEQ ID NO: 9057230 - DNA, 22 bp, Homo sapiens
taacaaagtaccatagactgga

SEQ ID NO: 9057231 - DNA, 22 bp, Homo sapiens
taacaaaggttgccaaactaag

SEQ ID NO: 9057232 - DNA, 22 bp, Homo sapiens
taaaaagtagtgagaatggcgc

SEQ ID NO: 9057233 - DNA, 22 bp, Homo sapiens
taaaaagcagctgagattttct

SEQ ID NO: 9057234 - DNA, 22 bp, Homo sapiens
gttttcttcctgcaattggcat

SEQ ID NO: 9057235 - DNA, 22 bp, Homo sapiens
taaaaaacattactctgtcctg

SEQ ID NO: 9057236 - DNA, 22 bp, Homo sapiens
gttttcctgaaactgatggtgt

SEQ ID NO: 9057237 - DNA, 22 bp, Homo sapiens
gttttcctgttgagtagtattc

SEQ ID NO: 9057238 - DNA, 22 bp, Homo sapiens
gttttctaagtaggtagcacca

SEQ ID NO: 9057239 - DNA, 22 bp, Homo sapiens
gttttctaccagggaagagagt

SEQ ID NO: 9057240 - DNA, 22 bp, Homo sapiens
taaaaatcttatgaatggcaag

SEQ ID NO: 9057241 - DNA, 22 bp, Homo sapiens
taaaaatcttatgaatggcaag

SEQ ID NO: 9057242 - DNA, 22 bp, Homo sapiens
taaaaatcttatgaatggcaag

SEQ ID NO: 9057243 - DNA, 22 bp, Homo sapiens
taaaatcaccaaaagcaggtgg

SEQ ID NO: 9057244 - DNA, 22 bp, Homo sapiens
taaaatcatgacagattgacat

SEQ ID NO: 9057245 - DNA, 22 bp, Homo sapiens
taaaatcatgacagattgacat

SEQ ID NO: 9057246 - DNA, 22 bp, Homo sapiens
taaacatttgttattcttgttt

SEQ ID NO: 9057247 - DNA, 22 bp, Homo sapiens
taaacatttgttattcttgttt

SEQ ID NO: 9057248 - DNA, 21 bp, Homo sapiens
taaaccaggtaatttccattc

SEQ ID NO: 9057249 - DNA, 18 bp, Homo sapiens
taaaccagatgacagttg

SEQ ID NO: 9057250 - DNA, 22 bp, Homo sapiens
taaaccaggtaaagaagctctc

SEQ ID NO: 9057251 - DNA, 22 bp, Homo sapiens
taaaccaagtgtccatattagt

SEQ ID NO: 9057252 - DNA, 22 bp, Homo sapiens
caggagacctggtaagccaagt

SEQ ID NO: 9057253 - DNA, 22 bp, Homo sapiens
caggagactatggcccaaggcc

SEQ ID NO: 9057254 - DNA, 22 bp, Homo sapiens
caggagactcagcatccaggat

SEQ ID NO: 9057255 - DNA, 22 bp, Homo sapiens
caggaagctgtgaaggagacgg

SEQ ID NO: 9057256 - DNA, 22 bp, Homo sapiens
caggaagctgagctgcactgca

SEQ ID NO: 9057257 - DNA, 22 bp, Homo sapiens
caggaagccacaggacaggtag

SEQ ID NO: 9057258 - DNA, 19 bp, Homo sapiens
gtttggcagcaaatcagac

SEQ ID NO: 9057259 - DNA, 18 bp, Homo sapiens
gtttggcataactgatgc

SEQ ID NO: 9057260 - DNA, 22 bp, Homo sapiens
tacaagtatggaatgattctca

SEQ ID NO: 9057261 - DNA, 22 bp, Homo sapiens
tacaaactaacatgtctcatcc

SEQ ID NO: 9057262 - DNA, 22 bp, Homo sapiens
tacaaatgaaccaactttgatg

SEQ ID NO: 9057263 - DNA, 22 bp, Homo sapiens
tacaaatgagttgtatgaacca

SEQ ID NO: 9057264 - DNA, 22 bp, Homo sapiens
tacaagcttttgtgtataaatg

SEQ ID NO: 9057265 - DNA, 22 bp, Homo sapiens
tacaaatgcctgacacacagat

SEQ ID NO: 9057266 - DNA, 22 bp, Homo sapiens
tacaaatgggttaaaatatagt

SEQ ID NO: 9057267 - DNA, 22 bp, Homo sapiens
tacagtaacatgttgtacaagc

SEQ ID NO: 9057268 - DNA, 22 bp, Homo sapiens
tacatcatggcttcatgctgca

SEQ ID NO: 9057269 - DNA, 22 bp, Homo sapiens
tacatcatgaaagcatacatca

SEQ ID NO: 9057270 - DNA, 22 bp, Homo sapiens
tacatcataataatacttagaa

SEQ ID NO: 9057271 - DNA, 22 bp, Homo sapiens
tacatatgagttcgttctatgc

SEQ ID NO: 9057272 - DNA, 22 bp, Homo sapiens
caggcagaaggaagtaccaggc

SEQ ID NO: 9057273 - DNA, 22 bp, Homo sapiens
caggcagaagaagtggaaggac

SEQ ID NO: 9057274 - DNA, 17 bp, Homo sapiens
caggcagacatgtaagc

SEQ ID NO: 9057275 - DNA, 22 bp, Homo sapiens
taattgctttatcctgttagaa

SEQ ID NO: 9057276 - DNA, 22 bp, Homo sapiens
taattgcttgtaaagccctgaa

SEQ ID NO: 9057277 - DNA, 22 bp, Homo sapiens
taattgtatggagaaggctgca

SEQ ID NO: 9057278 - DNA, 22 bp, Homo sapiens
taagacaattcttcagtcacaa

SEQ ID NO: 9057279 - DNA, 22 bp, Homo sapiens
caggcaataaagggttggttgg

SEQ ID NO: 9057280 - DNA, 22 bp, Homo sapiens
caggcaaggaggcactgaggga

SEQ ID NO: 9057281 - DNA, 22 bp, Homo sapiens
caggcaagattagagatgagca

SEQ ID NO: 9057282 - DNA, 22 bp, Homo sapiens
caggcaagatccagaggctgct

SEQ ID NO: 9057283 - DNA, 22 bp, Homo sapiens
taaggcagatgtggaatcaatt

SEQ ID NO: 9057284 - DNA, 22 bp, Homo sapiens
caggcagaaagtattctgtgta

SEQ ID NO: 9057285 - DNA, 22 bp, Homo sapiens
taagcaaataatgcatcaaggg

SEQ ID NO: 9057286 - DNA, 22 bp, Homo sapiens
taagatgtacaaccacttctct

SEQ ID NO: 9057287 - DNA, 22 bp, Homo sapiens
taagattacagtgagaaataaa

SEQ ID NO: 9057288 - DNA, 22 bp, Homo sapiens
taagatgtcatccacatagagt

SEQ ID NO: 9057289 - DNA, 22 bp, Homo sapiens
taagcaaaggattttgatcttt

SEQ ID NO: 9057290 - DNA, 22 bp, Homo sapiens
taagaaacatttttatgacagt

SEQ ID NO: 9057291 - DNA, 22 bp, Homo sapiens
taacatttgctgtctcctatgt

SEQ ID NO: 9057292 - DNA, 22 bp, Homo sapiens
taacttttacatttggctcact

SEQ ID NO: 9057293 - DNA, 22 bp, Homo sapiens
taagaaacatgattaatggcag

SEQ ID NO: 9057294 - DNA, 22 bp, Homo sapiens
taacacttgaagccatttttgc

SEQ ID NO: 9057295 - DNA, 22 bp, Homo sapiens
taacactttggattaaaattct

SEQ ID NO: 9057296 - DNA, 22 bp, Homo sapiens
taacaacatgcaatttaacctt

SEQ ID NO: 9057297 - DNA, 22 bp, Homo sapiens
taacattcctcaaagttttcag

SEQ ID NO: 9057298 - DNA, 22 bp, Homo sapiens
taacattgtcagttcaactgct

SEQ ID NO: 9057299 - DNA, 22 bp, Homo sapiens
taacattgttatgaatcaggtc

SEQ ID NO: 9057300 - DNA, 22 bp, Homo sapiens
taacattacggacatctgtcag

SEQ ID NO: 9057301 - DNA, 20 bp, Homo sapiens
gttaaaagagtaatttgagg

SEQ ID NO: 9057302 - DNA, 22 bp, Homo sapiens
gttacaaatgtaaattctgggg

SEQ ID NO: 9057303 - DNA, 22 bp, Homo sapiens
gttacaaatgccaaagctgaga

SEQ ID NO: 9057304 - DNA, 22 bp, Homo sapiens
gtgtttgtttgggtagctagac

SEQ ID NO: 9057305 - DNA, 22 bp, Homo sapiens
gtgtttgttcgtgactccaaag

SEQ ID NO: 9057306 - DNA, 22 bp, Homo sapiens
gtgtttgtttagtgcagagaga

SEQ ID NO: 9057307 - DNA, 22 bp, Homo sapiens
gtgtttgtctcttggcctacct

SEQ ID NO: 9057308 - DNA, 22 bp, Homo sapiens
gtgtttggtcagacgtccgggg

SEQ ID NO: 9057309 - DNA, 22 bp, Homo sapiens
gtgtttgttcatcctctcttct

SEQ ID NO: 9057310 - DNA, 22 bp, Homo sapiens
gtgtttgtgagctaggtgacat

SEQ ID NO: 9057311 - DNA, 22 bp, Homo sapiens
cagcttccatctccactgccct

SEQ ID NO: 9057312 - DNA, 22 bp, Homo sapiens
caggaaagaaatgagaacacca

SEQ ID NO: 9057313 - DNA, 22 bp, Homo sapiens
gttcacaaatatgcacttacga

SEQ ID NO: 9057314 - DNA, 22 bp, Homo sapiens
gttcacaagagttacagacaga

SEQ ID NO: 9057315 - DNA, 22 bp, Homo sapiens
gttcacaagctgattgtctttc

SEQ ID NO: 9057316 - DNA, 22 bp, Homo sapiens
gttcacaagatgtggtggggag

SEQ ID NO: 9057317 - DNA, 22 bp, Homo sapiens
gttcacaagctgggtttctgca

SEQ ID NO: 9057318 - DNA, 22 bp, Homo sapiens
gttcacaatggctttacctaag

SEQ ID NO: 9057319 - DNA, 22 bp, Homo sapiens
gttcacaatttttactgattgg

SEQ ID NO: 9057320 - DNA, 17 bp, Homo sapiens
cagctttatgctactgt

SEQ ID NO: 9057321 - DNA, 16 bp, Homo sapiens
cagctttatgtcagtg

SEQ ID NO: 9057322 - DNA, 22 bp, Homo sapiens
cagctttattaatgattgtctt

SEQ ID NO: 9057323 - DNA, 22 bp, Homo sapiens
cagctttaggactcataataaa

SEQ ID NO: 9057324 - DNA, 22 bp, Homo sapiens
cagctttagtaacccactgctc

SEQ ID NO: 9057325 - DNA, 20 bp, Homo sapiens
cagctttagatctttgatta

SEQ ID NO: 9057326 - DNA, 22 bp, Homo sapiens
cagctttaccaatatttggaaa

SEQ ID NO: 9057327 - DNA, 22 bp, Homo sapiens
cagctttacctttaggagtaac

SEQ ID NO: 9057328 - DNA, 22 bp, Homo sapiens
cagctttacctttaggagtaac

SEQ ID NO: 9057329 - DNA, 22 bp, Homo sapiens
cagctttagagaaaacatattt

SEQ ID NO: 9057330 - DNA, 22 bp, Homo sapiens
cagctttattgaggtataattg

SEQ ID NO: 9057331 - DNA, 22 bp, Homo sapiens
cagctttatttcacgtgtttgt

SEQ ID NO: 9057332 - DNA, 22 bp, Homo sapiens
gttacatggagcaatgatgcat

SEQ ID NO: 9057333 - DNA, 22 bp, Homo sapiens
gttatgtatgagggaatgatta

SEQ ID NO: 9057334 - DNA, 23 bp, Homo sapiens
gttaccttacttctgtgatcttc

SEQ ID NO: 9057335 - DNA, 22 bp, Homo sapiens
gttatgtattgggaaatccaag

SEQ ID NO: 9057336 - DNA, 22 bp, Homo sapiens
gttattaaagtatttgatgtta

SEQ ID NO: 9057337 - DNA, 22 bp, Homo sapiens
gttattatcttgaggaatctgt

SEQ ID NO: 9057338 - DNA, 22 bp, Homo sapiens
gttattcaatggcttataagga

SEQ ID NO: 9057339 - DNA, 22 bp, Homo sapiens
gttattatttctctccttgcta

SEQ ID NO: 9057340 - DNA, 22 bp, Homo sapiens
gttattctacagtcattgaagt

SEQ ID NO: 9057341 - DNA, 22 bp, Homo sapiens
cagcttggcttcacattctgta

SEQ ID NO: 9057342 - DNA, 22 bp, Homo sapiens
cagcttgggtcaggtgcctgct

SEQ ID NO: 9057343 - DNA, 22 bp, Homo sapiens
cagcttgggggcgctggcctca

SEQ ID NO: 9057344 - DNA, 22 bp, Homo sapiens
gttctgtctgagcaccacagga

SEQ ID NO: 9057345 - DNA, 22 bp, Homo sapiens
gttcttaagaccacaataaaaa

SEQ ID NO: 9057346 - DNA, 22 bp, Homo sapiens
gttcttcaccaaggtcagaggc

SEQ ID NO: 9057347 - DNA, 22 bp, Homo sapiens
gttctgtctgagcaccacagga

SEQ ID NO: 9057348 - DNA, 21 bp, Homo sapiens
gttcttagttatattctcaat

SEQ ID NO: 9057349 - DNA, 22 bp, Homo sapiens
gttgctctgggaaatggattca

SEQ ID NO: 9057350 - DNA, 21 bp, Homo sapiens
gttgctcttcaagaaaatccc

SEQ ID NO: 9057351 - DNA, 22 bp, Homo sapiens
gttcttcagattccatttcagt

SEQ ID NO: 9057352 - DNA, 22 bp, Homo sapiens
gttcttcagcattagaagtcat

SEQ ID NO: 9057353 - DNA, 22 bp, Homo sapiens
gttggctcattttatagacagc

SEQ ID NO: 9057354 - DNA, 22 bp, Homo sapiens
caggaacaactcccagcatctc

SEQ ID NO: 9057355 - DNA, 22 bp, Homo sapiens
caggaacaatcttactactatt

SEQ ID NO: 9057356 - DNA, 22 bp, Homo sapiens
caggaacaatatctgtcctggt

SEQ ID NO: 9057357 - DNA, 22 bp, Homo sapiens
gtttacagtactcacttgcatt

SEQ ID NO: 9057358 - DNA, 22 bp, Homo sapiens
gtttcaaaatgatgctgtaact

SEQ ID NO: 9057359 - DNA, 22 bp, Homo sapiens
gtttcaaaagtcaggctattct

SEQ ID NO: 9057360 - DNA, 22 bp, Homo sapiens
gtttattccagcaatctgctta

SEQ ID NO: 9057361 - DNA, 22 bp, Homo sapiens
gtttattcttcagcaacatctg

SEQ ID NO: 9057362 - DNA, 22 bp, Homo sapiens
gtttattattcaacttcatgtt

SEQ ID NO: 9057363 - DNA, 22 bp, Homo sapiens
gtttattattcaacttcatgtt

SEQ ID NO: 9057364 - DNA, 22 bp, Homo sapiens
gtttattattcaacttcatgtt

SEQ ID NO: 9057365 - DNA, 22 bp, Homo sapiens
gtttcctgtggccacagaataa

SEQ ID NO: 9057366 - DNA, 22 bp, Homo sapiens
gtggctcacgtctgtcatctca

SEQ ID NO: 9057367 - DNA, 22 bp, Homo sapiens
gtggctcacgcctgtaatccca

SEQ ID NO: 9057368 - DNA, 22 bp, Homo sapiens
gtggctcacagcaatgtttcct

SEQ ID NO: 9057369 - DNA, 22 bp, Homo sapiens
gtggctcacacctgtaatccca

SEQ ID NO: 9057370 - DNA, 19 bp, Homo sapiens
gtgggacagacattacata

SEQ ID NO: 9057371 - DNA, 22 bp, Homo sapiens
cagctcttcctcccaccggaca

SEQ ID NO: 9057372 - DNA, 22 bp, Homo sapiens
cagctctttttcacacaacatg

SEQ ID NO: 9057373 - DNA, 22 bp, Homo sapiens
cagctgaaagaaggaagtgtca

SEQ ID NO: 9057374 - DNA, 22 bp, Homo sapiens
cagctgaacatgtagagcatct

SEQ ID NO: 9057375 - DNA, 22 bp, Homo sapiens
cagctgaacctttccctggagc

SEQ ID NO: 9057376 - DNA, 22 bp, Homo sapiens
cagctctgttgccaaagtgggc

SEQ ID NO: 9057377 - DNA, 22 bp, Homo sapiens
cagctctgttgccctggaaacg

SEQ ID NO: 9057378 - DNA, 22 bp, Homo sapiens
cagctgaggaatactagatgta

SEQ ID NO: 9057379 - DNA, 22 bp, Homo sapiens
cagctgaggtcaaagaagcagg

SEQ ID NO: 9057380 - DNA, 22 bp, Homo sapiens
cagctgaagaaagagtggttag

SEQ ID NO: 9057381 - DNA, 22 bp, Homo sapiens
cagctgaagagaggtgctgagt

SEQ ID NO: 9057382 - DNA, 23 bp, Homo sapiens
cagctgaagcagcctgggctgga

SEQ ID NO: 9057383 - DNA, 22 bp, Homo sapiens
cagctctggctattgaggacca

SEQ ID NO: 9057384 - DNA, 20 bp, Homo sapiens
cagctctgggaaagaggcca

SEQ ID NO: 9057385 - DNA, 22 bp, Homo sapiens
cagctctgctgggaggatgcag

SEQ ID NO: 9057386 - DNA, 22 bp, Homo sapiens
cagctctggcgtcagggagcga

SEQ ID NO: 9057387 - DNA, 22 bp, Homo sapiens
cagcccagccttgtctctttat

SEQ ID NO: 9057388 - DNA, 22 bp, Homo sapiens
cagcccagccgagggcctggct

SEQ ID NO: 9057389 - DNA, 21 bp, Homo sapiens
cagcccagcccattgacagtg

SEQ ID NO: 9057390 - DNA, 22 bp, Homo sapiens
gtggcagaccttcccttctcct

SEQ ID NO: 9057391 - DNA, 22 bp, Homo sapiens
cagctgctgttcagttttgttt

SEQ ID NO: 9057392 - DNA, 22 bp, Homo sapiens
cagctgcctgtctggaggcaat

SEQ ID NO: 9057393 - DNA, 19 bp, Homo sapiens
cagctgccttttctttgca

SEQ ID NO: 9057394 - DNA, 22 bp, Homo sapiens
cagctgcaggagaaacagaggc

SEQ ID NO: 9057395 - DNA, 22 bp, Homo sapiens
cagctgcaggaacaaaaatgtg

SEQ ID NO: 9057396 - DNA, 22 bp, Homo sapiens
gtggggcagtggcctgggagca

SEQ ID NO: 9057397 - DNA, 22 bp, Homo sapiens
gtggggcagtggcctgggagca

SEQ ID NO: 9057398 - DNA, 22 bp, Homo sapiens
gtgtgagagaagctgccatgga

SEQ ID NO: 9057399 - DNA, 22 bp, Homo sapiens
gtgtcttagggttgcacagagt

SEQ ID NO: 9057400 - DNA, 18 bp, Homo sapiens
gtgtcttattacagtggg

SEQ ID NO: 9057401 - DNA, 20 bp, Homo sapiens
gtgtgaagccctcaggagga

SEQ ID NO: 9057402 - DNA, 22 bp, Homo sapiens
gtgtcttagaaagactgaatgc

SEQ ID NO: 9057403 - DNA, 22 bp, Homo sapiens
ccagctcatctcagtgaaatgc

SEQ ID NO: 9057404 - DNA, 23 bp, Homo sapiens
ccagcgctcactcagagcatgtt

SEQ ID NO: 9057405 - DNA, 22 bp, Homo sapiens
ccagccttgactgccccagcac

SEQ ID NO: 9057406 - DNA, 22 bp, Homo sapiens
ccagccttgcaccgagccagcc

SEQ ID NO: 9057407 - DNA, 22 bp, Homo sapiens
ccagccttgggggatccaggac

SEQ ID NO: 9057408 - DNA, 19 bp, Homo sapiens
ccagcctttccagtgattg

SEQ ID NO: 9057409 - DNA, 22 bp, Homo sapiens
ccagcctgggtgttagaagaca

SEQ ID NO: 9057410 - DNA, 22 bp, Homo sapiens
ccagcctggggaggcagcttct

SEQ ID NO: 9057411 - DNA, 22 bp, Homo sapiens
ccagccttccagccaatggctg

SEQ ID NO: 9057412 - DNA, 22 bp, Homo sapiens
ccagccttactgcccttcagtg

SEQ ID NO: 9057413 - DNA, 21 bp, Homo sapiens
ccagcctcagatcagggagct

SEQ ID NO: 9057414 - DNA, 22 bp, Homo sapiens
ccagcctggagggcagtggtgg

SEQ ID NO: 9057415 - DNA, 22 bp, Homo sapiens
tctgcctcgctaacagcagcca

SEQ ID NO: 9057416 - DNA, 22 bp, Homo sapiens
tctgcctagtgggacagcagcc

SEQ ID NO: 9057417 - DNA, 22 bp, Homo sapiens
ccagctcctcttcccagtgtca

SEQ ID NO: 9057418 - DNA, 22 bp, Homo sapiens
ccagctctaaacggctctgtgg

SEQ ID NO: 9057419 - DNA, 22 bp, Homo sapiens
tctgccaccttcatcctccact

SEQ ID NO: 9057420 - DNA, 22 bp, Homo sapiens
tctctcttgaagtattagctag

SEQ ID NO: 9057421 - DNA, 23 bp, Homo sapiens
tctctcttagctatgcttatggc

SEQ ID NO: 9057422 - DNA, 22 bp, Homo sapiens
tctcttggaggttcttcctgtt

SEQ ID NO: 9057423 - DNA, 19 bp, Homo sapiens
tctcttgaataggtcaaac

SEQ ID NO: 9057424 - DNA, 22 bp, Homo sapiens
tctcttgtaatttaaaaaatct

SEQ ID NO: 9057425 - DNA, 19 bp, Homo sapiens
ccagcccacagtgactttc

SEQ ID NO: 9057426 - DNA, 21 bp, Homo sapiens
ccagcccagctgtgtcccagc

SEQ ID NO: 9057427 - DNA, 22 bp, Homo sapiens
ccagccccgggccttaccgtgc

SEQ ID NO: 9057428 - DNA, 22 bp, Homo sapiens
ccagccccgggaacctggccgt

SEQ ID NO: 9057429 - DNA, 22 bp, Homo sapiens
ccagccccgggaacctggccgt

SEQ ID NO: 9057430 - DNA, 22 bp, Homo sapiens
ccagcccctatcctcgctccac

SEQ ID NO: 9057431 - DNA, 22 bp, Homo sapiens
tctgagattaagcagagatgga

SEQ ID NO: 9057432 - DNA, 22 bp, Homo sapiens
tctgagatccttgtgttgtttt

SEQ ID NO: 9057433 - DNA, 22 bp, Homo sapiens
tctgtcttctgtagctaataat

SEQ ID NO: 9057434 - DNA, 22 bp, Homo sapiens
tctgtcttctgtagctaataat

SEQ ID NO: 9057435 - DNA, 21 bp, Homo sapiens
tctgtcttcctcagcctaagg

SEQ ID NO: 9057436 - DNA, 22 bp, Homo sapiens
tctgtcatccaggctggaatat

SEQ ID NO: 9057437 - DNA, 22 bp, Homo sapiens
tctgtcatcaaatatgctttct

SEQ ID NO: 9057438 - DNA, 22 bp, Homo sapiens
tctgtcataagtgctgaagtat

SEQ ID NO: 9057439 - DNA, 22 bp, Homo sapiens
ccagcttctccttatgtcctca

SEQ ID NO: 9057440 - DNA, 22 bp, Homo sapiens
ccaggaagcggtgagggctgcc

SEQ ID NO: 9057441 - DNA, 22 bp, Homo sapiens
tctggctgttgttaggttcctg

SEQ ID NO: 9057442 - DNA, 22 bp, Homo sapiens
tctggagctggagggcaaggca

SEQ ID NO: 9057443 - DNA, 22 bp, Homo sapiens
tctggagctggcagggccctgg

SEQ ID NO: 9057444 - DNA, 22 bp, Homo sapiens
ccagcttcatgggcatgcacca

SEQ ID NO: 9057445 - DNA, 19 bp, Homo sapiens
tctgcctctggtcaggctc

SEQ ID NO: 9057446 - DNA, 22 bp, Homo sapiens
tctgcctgagaagtggggtgcc

SEQ ID NO: 9057447 - DNA, 22 bp, Homo sapiens
tctgcgctgccttgatccttgg

SEQ ID NO: 9057448 - DNA, 22 bp, Homo sapiens
ccacaaagttgctgagtttctg

SEQ ID NO: 9057449 - DNA, 22 bp, Homo sapiens
ccacaaagaatgggggaagcat

SEQ ID NO: 9057450 - DNA, 22 bp, Homo sapiens
ccaatgcagataagacaaacac

SEQ ID NO: 9057451 - DNA, 22 bp, Homo sapiens
ccaatttctgcctgagggcttt

SEQ ID NO: 9057452 - DNA, 22 bp, Homo sapiens
ccaatttcctgccagtaccttc

SEQ ID NO: 9057453 - DNA, 22 bp, Homo sapiens
tcctgcagtgtgtctcctgcac

SEQ ID NO: 9057454 - DNA, 22 bp, Homo sapiens
tcctgcagttacatcccagcca

SEQ ID NO: 9057455 - DNA, 22 bp, Homo sapiens
tcctgcagtgtgtctcctgcac

SEQ ID NO: 9057456 - DNA, 22 bp, Homo sapiens
ccacaagatgcaaactctaaca

SEQ ID NO: 9057457 - DNA, 22 bp, Homo sapiens
ccacaagactctgtcagcataa

SEQ ID NO: 9057458 - DNA, 22 bp, Homo sapiens
ccacacagataagtgttttcta

SEQ ID NO: 9057459 - DNA, 22 bp, Homo sapiens
ccacaattttatgatttaggag

SEQ ID NO: 9057460 - DNA, 23 bp, Homo sapiens
ccacaattgagagattctgcaat

SEQ ID NO: 9057461 - DNA, 22 bp, Homo sapiens
ccacaatttatgtattctccta

SEQ ID NO: 9057462 - DNA, 21 bp, Homo sapiens
ccacaattctagttacatatg

SEQ ID NO: 9057463 - DNA, 22 bp, Homo sapiens
ccacaattctgctttaatttct

SEQ ID NO: 9057464 - DNA, 22 bp, Homo sapiens
ccacaattccacagcaacttgc

SEQ ID NO: 9057465 - DNA, 21 bp, Homo sapiens
ccaaatagcctccattaacag

SEQ ID NO: 9057466 - DNA, 22 bp, Homo sapiens
tcctccccaaagcccagcctgg

SEQ ID NO: 9057467 - DNA, 22 bp, Homo sapiens
ccacagagtcttccttctcttc

SEQ ID NO: 9057468 - DNA, 20 bp, Homo sapiens
tcctgcagttcctaggaggg

SEQ ID NO: 9057469 - DNA, 17 bp, Homo sapiens
tcctgccacctgtcagg

SEQ ID NO: 9057470 - DNA, 22 bp, Homo sapiens
tcctgccagctggggctgcttc

SEQ ID NO: 9057471 - DNA, 23 bp, Homo sapiens
tcctgccagatgactcctttctt

SEQ ID NO: 9057472 - DNA, 22 bp, Homo sapiens
tcctgccaggagtgctggccct

SEQ ID NO: 9057473 - DNA, 22 bp, Homo sapiens
ccacagctagggcaatctgatt

SEQ ID NO: 9057474 - DNA, 22 bp, Homo sapiens
ccacagctagggcaatctgatt

SEQ ID NO: 9057475 - DNA, 23 bp, Homo sapiens
ccaaaagcgagtctgttgttccc

SEQ ID NO: 9057476 - DNA, 22 bp, Homo sapiens
ccaaaagcagctgtctgtgaat

SEQ ID NO: 9057477 - DNA, 22 bp, Homo sapiens
catttgaacctggatgttctta

SEQ ID NO: 9057478 - DNA, 22 bp, Homo sapiens
catttgaacctggatgttctta

SEQ ID NO: 9057479 - DNA, 19 bp, Homo sapiens
catttagaagtacatatta

SEQ ID NO: 9057480 - DNA, 22 bp, Homo sapiens
catttattagttagttcgatgt

SEQ ID NO: 9057481 - DNA, 22 bp, Homo sapiens
catttattagttagttcgatgt

SEQ ID NO: 9057482 - DNA, 22 bp, Homo sapiens
tctccagtatctttccaatgaa

SEQ ID NO: 9057483 - DNA, 22 bp, Homo sapiens
tctccagtctcaagacattgag

SEQ ID NO: 9057484 - DNA, 21 bp, Homo sapiens
tctccagttgacagtgtctcc

SEQ ID NO: 9057485 - DNA, 23 bp, Homo sapiens
tctccagtgtctcttcattgagt

SEQ ID NO: 9057486 - DNA, 22 bp, Homo sapiens
tctccataggcagttcataaca

SEQ ID NO: 9057487 - DNA, 19 bp, Homo sapiens
tctccagtttattcttcca

SEQ ID NO: 9057488 - DNA, 18 bp, Homo sapiens
ccagagctggctcctcgc

SEQ ID NO: 9057489 - DNA, 22 bp, Homo sapiens
ccagagctgatgggcccagggt

SEQ ID NO: 9057490 - DNA, 22 bp, Homo sapiens
ccagagctgatgggcccagggt

SEQ ID NO: 9057491 - DNA, 22 bp, Homo sapiens
ccagatatcactgccgtgttgt

SEQ ID NO: 9057492 - DNA, 22 bp, Homo sapiens
ccagagttttatacaacttttt

SEQ ID NO: 9057493 - DNA, 22 bp, Homo sapiens
tctctacataacctcaatactc

SEQ ID NO: 9057494 - DNA, 22 bp, Homo sapiens
tctctagacatggggaatgtca

SEQ ID NO: 9057495 - DNA, 22 bp, Homo sapiens
tctctagtataatatagcaaaa

SEQ ID NO: 9057496 - DNA, 22 bp, Homo sapiens
tctctacaaaaattagcatgca

SEQ ID NO: 9057497 - DNA, 22 bp, Homo sapiens
tctctacacaggattcacatga

SEQ ID NO: 9057498 - DNA, 21 bp, Homo sapiens
tctctacaaattatgttaggt

SEQ ID NO: 9057499 - DNA, 21 bp, Homo sapiens
tctctacactttcactaggct

SEQ ID NO: 9057500 - DNA, 22 bp, Homo sapiens
tctctacagacactgttgactt

SEQ ID NO: 9057501 - DNA, 22 bp, Homo sapiens
tctctacagacactgttgactt

SEQ ID NO: 9057502 - DNA, 22 bp, Homo sapiens
tctctacagatcctatatagaa

SEQ ID NO: 9057503 - DNA, 21 bp, Homo sapiens
ccactctgagtgttgaacaga

SEQ ID NO: 9057504 - DNA, 22 bp, Homo sapiens
ccactgactccaggagctgagg

SEQ ID NO: 9057505 - DNA, 17 bp, Homo sapiens
ccactgactctgacttc

SEQ ID NO: 9057506 - DNA, 16 bp, Homo sapiens
ccacctgcagctctca

SEQ ID NO: 9057507 - DNA, 22 bp, Homo sapiens
ccacagtccgggctggcaggac

SEQ ID NO: 9057508 - DNA, 22 bp, Homo sapiens
ccactgccatgggctaggcatg

SEQ ID NO: 9057509 - DNA, 22 bp, Homo sapiens
tattgctttcagttgctttgag

SEQ ID NO: 9057510 - DNA, 22 bp, Homo sapiens
tattgctcagagaaggagatgt

SEQ ID NO: 9057511 - DNA, 22 bp, Homo sapiens
tattgctcctacagtcaatttc

SEQ ID NO: 9057512 - DNA, 18 bp, Homo sapiens
tattgctctagagagaca

SEQ ID NO: 9057513 - DNA, 22 bp, Homo sapiens
tattgcatttcccacgttcact

SEQ ID NO: 9057514 - DNA, 22 bp, Homo sapiens
tattaaagagagaatcatcatc

SEQ ID NO: 9057515 - DNA, 22 bp, Homo sapiens
tattaaagagagaatcatcatc

SEQ ID NO: 9057516 - DNA, 22 bp, Homo sapiens
tatgtactaactttcattctag

SEQ ID NO: 9057517 - DNA, 22 bp, Homo sapiens
tatgttttaggaattaattgtt

SEQ ID NO: 9057518 - DNA, 22 bp, Homo sapiens
tatgtttgttatcacaactagg

SEQ ID NO: 9057519 - DNA, 22 bp, Homo sapiens
tatggctggaatactgaaaggc

SEQ ID NO: 9057520 - DNA, 22 bp, Homo sapiens
tatggcatttagaaatgtcaga

SEQ ID NO: 9057521 - DNA, 18 bp, Homo sapiens
caggtctgtctgcctccc

SEQ ID NO: 9057522 - DNA, 18 bp, Homo sapiens
caggtctgtctgcctccc

SEQ ID NO: 9057523 - DNA, 22 bp, Homo sapiens
tatgtacatgttaaagggcaaa

SEQ ID NO: 9057524 - DNA, 22 bp, Homo sapiens
caggtctgggttgatggcctgg

SEQ ID NO: 9057525 - DNA, 17 bp, Homo sapiens
caggtctgaggccaggc

SEQ ID NO: 9057526 - DNA, 22 bp, Homo sapiens
tatacagatatctaagatgtaa

SEQ ID NO: 9057527 - DNA, 22 bp, Homo sapiens
cagggtggcacatcacagcatt

SEQ ID NO: 9057528 - DNA, 22 bp, Homo sapiens
tacatgttatttcactattggt

SEQ ID NO: 9057529 - DNA, 22 bp, Homo sapiens
tacatgtgttctgtttcaagtt

SEQ ID NO: 9057530 - DNA, 22 bp, Homo sapiens
tataagaagtgaagaagagtta

SEQ ID NO: 9057531 - DNA, 22 bp, Homo sapiens
tataagaaacaaggcaaatttt

SEQ ID NO: 9057532 - DNA, 22 bp, Homo sapiens
tataagaaacaaggcaaatttt

SEQ ID NO: 9057533 - DNA, 22 bp, Homo sapiens
tataatcctgcttcacattgaa

SEQ ID NO: 9057534 - DNA, 22 bp, Homo sapiens
cagtctcagaggtgggagtggg

SEQ ID NO: 9057535 - DNA, 22 bp, Homo sapiens
cagtctcaccctggaggcccca

SEQ ID NO: 9057536 - DNA, 22 bp, Homo sapiens
cagtgcagacgtggagggggca

SEQ ID NO: 9057537 - DNA, 22 bp, Homo sapiens
tatttactgtatttgaagttga

SEQ ID NO: 9057538 - DNA, 20 bp, Homo sapiens
tatttacaacttagagcctc

SEQ ID NO: 9057539 - DNA, 22 bp, Homo sapiens
tatttacttttaaattgagaac

SEQ ID NO: 9057540 - DNA, 22 bp, Homo sapiens
tatttagatgcatttggattgc

SEQ ID NO: 9057541 - DNA, 20 bp, Homo sapiens
cagtcctgtccctgctgccc

SEQ ID NO: 9057542 - DNA, 22 bp, Homo sapiens
cagtcctgggtgcagcaggaaa

SEQ ID NO: 9057543 - DNA, 22 bp, Homo sapiens
cagtcctggggaccaggctgag

SEQ ID NO: 9057544 - DNA, 22 bp, Homo sapiens
cagtcctgggcaggtcaggcca

SEQ ID NO: 9057545 - DNA, 22 bp, Homo sapiens
cagtcctgggcaggtcaggcca

SEQ ID NO: 9057546 - DNA, 22 bp, Homo sapiens
cagtcctgggcacagccctggg

SEQ ID NO: 9057547 - DNA, 22 bp, Homo sapiens
tatttagttatctttcataaaa

SEQ ID NO: 9057548 - DNA, 22 bp, Homo sapiens
cagtcctgttcctggagtagtt

SEQ ID NO: 9057549 - DNA, 22 bp, Homo sapiens
cagtcctgtctttatgacttca

SEQ ID NO: 9057550 - DNA, 22 bp, Homo sapiens
cagtcctgtgtcccttggtggg

SEQ ID NO: 9057551 - DNA, 22 bp, Homo sapiens
tcactcaggctggagtgcagtg

SEQ ID NO: 9057552 - DNA, 22 bp, Homo sapiens
tcactatctcagtaaagcactc

SEQ ID NO: 9057553 - DNA, 22 bp, Homo sapiens
tcactatgcccagaatacagtt

SEQ ID NO: 9057554 - DNA, 22 bp, Homo sapiens
tcagaaatttaggctggacttg

SEQ ID NO: 9057555 - DNA, 22 bp, Homo sapiens
tcagaaataatgaatgatgggg

SEQ ID NO: 9057556 - DNA, 22 bp, Homo sapiens
tcacccaagaccatcggaagtg

SEQ ID NO: 9057557 - DNA, 22 bp, Homo sapiens
tcaccatcaggataaaatctca

SEQ ID NO: 9057558 - DNA, 22 bp, Homo sapiens
tcaccatcctcacctagaaatg

SEQ ID NO: 9057559 - DNA, 19 bp, Homo sapiens
cagtgctgttcattcagtg

SEQ ID NO: 9057560 - DNA, 23 bp, Homo sapiens
cagtgctggttctgcctgtgggg

SEQ ID NO: 9057561 - DNA, 22 bp, Homo sapiens
cagtgctgtgctggaagctgtt

SEQ ID NO: 9057562 - DNA, 22 bp, Homo sapiens
cagtgctggctgttaggacagt

SEQ ID NO: 9057563 - DNA, 22 bp, Homo sapiens
cagtgctgggcagaggagagcg

SEQ ID NO: 9057564 - DNA, 21 bp, Homo sapiens
cagtgctgcctaatagggagt

SEQ ID NO: 9057565 - DNA, 22 bp, Homo sapiens
cagtgctggagatgggtggaac

SEQ ID NO: 9057566 - DNA, 22 bp, Homo sapiens
cagtgctggaggggtgcttgca

SEQ ID NO: 9057567 - DNA, 22 bp, Homo sapiens
cagtgctggaggctggagggaa

SEQ ID NO: 9057568 - DNA, 22 bp, Homo sapiens
cagtgctgacagggaggaacct

SEQ ID NO: 9057569 - DNA, 22 bp, Homo sapiens
cagtgctgagagcctggccagg

SEQ ID NO: 9057570 - DNA, 19 bp, Homo sapiens
cagtttgtccagaggggac

SEQ ID NO: 9057571 - DNA, 22 bp, Homo sapiens
catactttctttttcacgcata

SEQ ID NO: 9057572 - DNA, 22 bp, Homo sapiens
catacatttatacacatctatg

SEQ ID NO: 9057573 - DNA, 22 bp, Homo sapiens
catacattttgcatatttacca

SEQ ID NO: 9057574 - DNA, 22 bp, Homo sapiens
catacattttgcatatttacca

SEQ ID NO: 9057575 - DNA, 22 bp, Homo sapiens
catacttttgccctgacattct

SEQ ID NO: 9057576 - DNA, 22 bp, Homo sapiens
catactttgggataagagtgga

SEQ ID NO: 9057577 - DNA, 22 bp, Homo sapiens
catactttttagatctgccttc

SEQ ID NO: 9057578 - DNA, 22 bp, Homo sapiens
catacatttatacacatctatg

SEQ ID NO: 9057579 - DNA, 22 bp, Homo sapiens
catacattgctcattcagtatc

SEQ ID NO: 9057580 - DNA, 22 bp, Homo sapiens
catacattacctaacttaatgc

SEQ ID NO: 9057581 - DNA, 22 bp, Homo sapiens
catacattgaaggagaaaggaa

SEQ ID NO: 9057582 - DNA, 22 bp, Homo sapiens
catacattgaatttgcacgtgt

SEQ ID NO: 9057583 - DNA, 22 bp, Homo sapiens
tcagccccacggggtcagccaa

SEQ ID NO: 9057584 - DNA, 22 bp, Homo sapiens
tcagccctagcctcagtccagg

SEQ ID NO: 9057585 - DNA, 22 bp, Homo sapiens
tcagctctgttttgagtggaac

SEQ ID NO: 9057586 - DNA, 22 bp, Homo sapiens
catatacacttccacctctgtg

SEQ ID NO: 9057587 - DNA, 22 bp, Homo sapiens
catcacagaaataaacatacct

SEQ ID NO: 9057588 - DNA, 22 bp, Homo sapiens
catccaccgcgtgcacctctac

SEQ ID NO: 9057589 - DNA, 22 bp, Homo sapiens
catccagggcagccatggcctg

SEQ ID NO: 9057590 - DNA, 22 bp, Homo sapiens
catccaggctgaagtgcagtgg

SEQ ID NO: 9057591 - DNA, 22 bp, Homo sapiens
catcacaggtcctgatgacatt

SEQ ID NO: 9057592 - DNA, 22 bp, Homo sapiens
catcacagtggctgtttattta

SEQ ID NO: 9057593 - DNA, 22 bp, Homo sapiens
catctttagttattgaatatag

SEQ ID NO: 9057594 - DNA, 22 bp, Homo sapiens
catcttaataaatctcctccct

SEQ ID NO: 9057595 - DNA, 22 bp, Homo sapiens
catcttaacaggtctctgaggg

SEQ ID NO: 9057596 - DNA, 22 bp, Homo sapiens
catgagaagtggccttcaaaaa

SEQ ID NO: 9057597 - DNA, 22 bp, Homo sapiens
catgagaaggttttggcatata

SEQ ID NO: 9057598 - DNA, 22 bp, Homo sapiens
catgatgttaggcaggatacta

SEQ ID NO: 9057599 - DNA, 22 bp, Homo sapiens
catgatcagaaagagaagctag

SEQ ID NO: 9057600 - DNA, 22 bp, Homo sapiens
catgatcaccacttgacagccc

SEQ ID NO: 9057601 - DNA, 19 bp, Homo sapiens
tcatgtctctcatctgtga

SEQ ID NO: 9057602 - DNA, 22 bp, Homo sapiens
tcatgtctctatgtgcctatta

SEQ ID NO: 9057603 - DNA, 22 bp, Homo sapiens
catgattgatccttctaaatgc

SEQ ID NO: 9057604 - DNA, 22 bp, Homo sapiens
catgattttgtcttgtgttaat

SEQ ID NO: 9057605 - DNA, 22 bp, Homo sapiens
catgcaaaatgtattttattag

SEQ ID NO: 9057606 - DNA, 22 bp, Homo sapiens
catgatttactaaaatttgttt

SEQ ID NO: 9057607 - DNA, 22 bp, Homo sapiens
catgcaaacacgtaaacattca

SEQ ID NO: 9057608 - DNA, 22 bp, Homo sapiens
catgcaagacaatctttaaaat

SEQ ID NO: 9057609 - DNA, 22 bp, Homo sapiens
tcattttggccatgatacagac

SEQ ID NO: 9057610 - DNA, 22 bp, Homo sapiens
tcattttcccactgaagctgtc

SEQ ID NO: 9057611 - DNA, 22 bp, Homo sapiens
tcattttgcagagctgaggaac

SEQ ID NO: 9057612 - DNA, 20 bp, Homo sapiens
tccagcccagcagcctgaca

SEQ ID NO: 9057613 - DNA, 22 bp, Homo sapiens
tccagcccagctcctctcagaa

SEQ ID NO: 9057614 - DNA, 22 bp, Homo sapiens
catgtacatgcctactatcaat

SEQ ID NO: 9057615 - DNA, 22 bp, Homo sapiens
tctgatgttgatgcttctgcct

SEQ ID NO: 9057616 - DNA, 22 bp, Homo sapiens
tctgcaagagcttcaaggtaga

SEQ ID NO: 9057617 - DNA, 22 bp, Homo sapiens
tctgcaagctcagttctgactt

SEQ ID NO: 9057618 - DNA, 22 bp, Homo sapiens
tctgatatttcattcaaaagta

SEQ ID NO: 9057619 - DNA, 21 bp, Homo sapiens
tctgatggtagatgagatgtg

SEQ ID NO: 9057620 - DNA, 22 bp, Homo sapiens
tctgaggaactggcaaagatgg

SEQ ID NO: 9057621 - DNA, 17 bp, Homo sapiens
tctgaggcctctaggag

SEQ ID NO: 9057622 - DNA, 22 bp, Homo sapiens
tctgacattttgagaatgacat

SEQ ID NO: 9057623 - DNA, 19 bp, Homo sapiens
tctgacacttacacacccc

SEQ ID NO: 9057624 - DNA, 22 bp, Homo sapiens
tctgagctgcccctttactttg

SEQ ID NO: 9057625 - DNA, 22 bp, Homo sapiens
tctgagatttgtatggtgagac

SEQ ID NO: 9057626 - DNA, 22 bp, Homo sapiens
tctgcaggactgaggcctgttt

SEQ ID NO: 9057627 - DNA, 22 bp, Homo sapiens
tctgcaggactgaggcctgttt

SEQ ID NO: 9057628 - DNA, 22 bp, Homo sapiens
tctgcaggaaaaaagtgcctgg

SEQ ID NO: 9057629 - DNA, 18 bp, Homo sapiens
tctgcaggacctcagggc

SEQ ID NO: 9057630 - DNA, 22 bp, Homo sapiens
tctgcaggagcagggcgtggag

SEQ ID NO: 9057631 - DNA, 22 bp, Homo sapiens
tctgcaggagagtgccctagag

SEQ ID NO: 9057632 - DNA, 22 bp, Homo sapiens
tctgcaggatcagagccagagg

SEQ ID NO: 9057633 - DNA, 22 bp, Homo sapiens
tctgcaggaggctggctgcagg

SEQ ID NO: 9057634 - DNA, 22 bp, Homo sapiens
tctgcaggatggatgctcagaa

SEQ ID NO: 9057635 - DNA, 22 bp, Homo sapiens
tctgcaggcatttttggttgtc

SEQ ID NO: 9057636 - DNA, 22 bp, Homo sapiens
tctgcacatgtagtaaatatta

SEQ ID NO: 9057637 - DNA, 22 bp, Homo sapiens
tctgcaagtttatcacttggga

SEQ ID NO: 9057638 - DNA, 22 bp, Homo sapiens
tctgcaagtagatgacagtgag

SEQ ID NO: 9057639 - DNA, 22 bp, Homo sapiens
tctgcacacaatttatctttct

SEQ ID NO: 9057640 - DNA, 22 bp, Homo sapiens
tctgcaggctgtacaggaagca

SEQ ID NO: 9057641 - DNA, 22 bp, Homo sapiens
tctgcaggtaagcgttcttgga

SEQ ID NO: 9057642 - DNA, 22 bp, Homo sapiens
tctgcaggtcacgctccagcct

SEQ ID NO: 9057643 - DNA, 22 bp, Homo sapiens
tctgcaggtagagctcaggaat

SEQ ID NO: 9057644 - DNA, 22 bp, Homo sapiens
tctgcaggtgttggaagggtca

SEQ ID NO: 9057645 - DNA, 22 bp, Homo sapiens
tctgcatatttatcatgagtct

SEQ ID NO: 9057646 - DNA, 22 bp, Homo sapiens
tctgccatcaagatgctctggc

SEQ ID NO: 9057647 - DNA, 22 bp, Homo sapiens
tctgccatcttaattctctttt

SEQ ID NO: 9057648 - DNA, 22 bp, Homo sapiens
tctgccaccaactgtcactaca

SEQ ID NO: 9057649 - DNA, 22 bp, Homo sapiens
tctgcctgttcaagtcttctag

SEQ ID NO: 9057650 - DNA, 22 bp, Homo sapiens
tctgggaggtgttttgagaact

SEQ ID NO: 9057651 - DNA, 22 bp, Homo sapiens
tctgggagtgaagcaacagatg

SEQ ID NO: 9057652 - DNA, 22 bp, Homo sapiens
tctgggcagtacccctctccta

SEQ ID NO: 9057653 - DNA, 20 bp, Homo sapiens
tctggctctttgctcctccc

SEQ ID NO: 9057654 - DNA, 22 bp, Homo sapiens
tctggctgaaattagaaggttc

SEQ ID NO: 9057655 - DNA, 22 bp, Homo sapiens
tctggctgaattagccttgggt

SEQ ID NO: 9057656 - DNA, 22 bp, Homo sapiens
tctggctctctcatcacccaat

SEQ ID NO: 9057657 - DNA, 22 bp, Homo sapiens
tctggctctccagtgctcttag

SEQ ID NO: 9057658 - DNA, 22 bp, Homo sapiens
tctggctctgaattcacttctg

SEQ ID NO: 9057659 - DNA, 22 bp, Homo sapiens
tctggctctgacactactgtta

SEQ ID NO: 9057660 - DNA, 22 bp, Homo sapiens
tctggctctcaacaaatattta

SEQ ID NO: 9057661 - DNA, 22 bp, Homo sapiens
tctggctctcatactcgccagt

SEQ ID NO: 9057662 - DNA, 22 bp, Homo sapiens
tctggctctataactcctagct

SEQ ID NO: 9057663 - DNA, 22 bp, Homo sapiens
tctggctcctggctccactgcc

SEQ ID NO: 9057664 - DNA, 22 bp, Homo sapiens
tctggctcctgagtccatgctc

SEQ ID NO: 9057665 - DNA, 22 bp, Homo sapiens
tctggctcccagcctgctctca

SEQ ID NO: 9057666 - DNA, 22 bp, Homo sapiens
tctggctccacacctcactgca

SEQ ID NO: 9057667 - DNA, 22 bp, Homo sapiens
tctggctccactttcttcattt

SEQ ID NO: 9057668 - DNA, 22 bp, Homo sapiens
tctggccccggtcttcacagct

SEQ ID NO: 9057669 - DNA, 22 bp, Homo sapiens
tctggccccgcatgcactttat

SEQ ID NO: 9057670 - DNA, 22 bp, Homo sapiens
tctggcccctggcagtcctgga

SEQ ID NO: 9057671 - DNA, 22 bp, Homo sapiens
tctggctgtgtaaggtagcacc

SEQ ID NO: 9057672 - DNA, 22 bp, Homo sapiens
tctggctgtcattggaggcccc

SEQ ID NO: 9057673 - DNA, 22 bp, Homo sapiens
tctggctggctcggccgggagt

SEQ ID NO: 9057674 - DNA, 23 bp, Homo sapiens
tctggctgctcctttcaatgctc

SEQ ID NO: 9057675 - DNA, 22 bp, Homo sapiens
tctggaccaacatagcttctgg

SEQ ID NO: 9057676 - DNA, 18 bp, Homo sapiens
tctgctgctgcgtcctgc

SEQ ID NO: 9057677 - DNA, 22 bp, Homo sapiens
tctgctctccatacttccgcac

SEQ ID NO: 9057678 - DNA, 22 bp, Homo sapiens
tctgctctagttgcttcctgcc

SEQ ID NO: 9057679 - DNA, 22 bp, Homo sapiens
tctggagggcccacatccacaa

SEQ ID NO: 9057680 - DNA, 18 bp, Homo sapiens
tctggagggaagctttga

SEQ ID NO: 9057681 - DNA, 22 bp, Homo sapiens
tctggagggggatgcctcatcc

SEQ ID NO: 9057682 - DNA, 22 bp, Homo sapiens
tctggcatttcaggcatctata

SEQ ID NO: 9057683 - DNA, 22 bp, Homo sapiens
tctggcccaagttttcggtgag

SEQ ID NO: 9057684 - DNA, 22 bp, Homo sapiens
tctggcccagcccctgaggtca

SEQ ID NO: 9057685 - DNA, 22 bp, Homo sapiens
tctgtctcaagttcttgcactc

SEQ ID NO: 9057686 - DNA, 18 bp, Homo sapiens
tctgtctctgtccttgct

SEQ ID NO: 9057687 - DNA, 22 bp, Homo sapiens
tctgtctctttgttctgtgagt

SEQ ID NO: 9057688 - DNA, 22 bp, Homo sapiens
tctgtctctcaagggccgtcct

SEQ ID NO: 9057689 - DNA, 21 bp, Homo sapiens
tctgtctctccactgccctgc

SEQ ID NO: 9057690 - DNA, 22 bp, Homo sapiens
tctgtctcctctgaggtgccag

SEQ ID NO: 9057691 - DNA, 22 bp, Homo sapiens
tctgtctcctgccagtgcctct

SEQ ID NO: 9057692 - DNA, 22 bp, Homo sapiens
tctgtccattttccattttggc

SEQ ID NO: 9057693 - DNA, 22 bp, Homo sapiens
tctgtccattcagccatccatc

SEQ ID NO: 9057694 - DNA, 22 bp, Homo sapiens
tctgtcatctgttcagtgctca

SEQ ID NO: 9057695 - DNA, 22 bp, Homo sapiens
tctgtcattgcaataaaatttc

SEQ ID NO: 9057696 - DNA, 22 bp, Homo sapiens
tctgtcatttcaatatggttaa

SEQ ID NO: 9057697 - DNA, 22 bp, Homo sapiens
tctgtcattagccttgactgta

SEQ ID NO: 9057698 - DNA, 22 bp, Homo sapiens
tctgtcattagccttgactgta

SEQ ID NO: 9057699 - DNA, 22 bp, Homo sapiens
tctgtcatttcaatatggttaa

SEQ ID NO: 9057700 - DNA, 22 bp, Homo sapiens
tctgtccagaggtcctggagac

SEQ ID NO: 9057701 - DNA, 19 bp, Homo sapiens
tctgtaacactctagcctt

SEQ ID NO: 9057702 - DNA, 22 bp, Homo sapiens
tctggggtgcagcctggacata

SEQ ID NO: 9057703 - DNA, 22 bp, Homo sapiens
tctgggggttaagtgaggacaa

SEQ ID NO: 9057704 - DNA, 22 bp, Homo sapiens
tctgggtctatcccatgccttt

SEQ ID NO: 9057705 - DNA, 22 bp, Homo sapiens
tctgggtctatgatctcacttc

SEQ ID NO: 9057706 - DNA, 22 bp, Homo sapiens
tctgggtgtggtatcttagcca

SEQ ID NO: 9057707 - DNA, 22 bp, Homo sapiens
tctgggctgtggttccactccg

SEQ ID NO: 9057708 - DNA, 22 bp, Homo sapiens
tctgggggaggaggcatggccc

SEQ ID NO: 9057709 - DNA, 21 bp, Homo sapiens
tctgggggtgagcctagaaat

SEQ ID NO: 9057710 - DNA, 22 bp, Homo sapiens
tctgggggcgaccagggactgc

SEQ ID NO: 9057711 - DNA, 22 bp, Homo sapiens
tctgggcttggattggctctgc

SEQ ID NO: 9057712 - DNA, 22 bp, Homo sapiens
tctgtttagactcagttgaaac

SEQ ID NO: 9057713 - DNA, 23 bp, Homo sapiens
tctgttcttttagctgatcattt

SEQ ID NO: 9057714 - DNA, 22 bp, Homo sapiens
tctgttctttagcctgcttgag

SEQ ID NO: 9057715 - DNA, 22 bp, Homo sapiens
tctgttctttccaacaagacag

SEQ ID NO: 9057716 - DNA, 22 bp, Homo sapiens
tctgttgcaatgtgcatggtga

SEQ ID NO: 9057717 - DNA, 22 bp, Homo sapiens
tctgttagctgtcaaagtgttt

SEQ ID NO: 9057718 - DNA, 22 bp, Homo sapiens
tctgttagagaggtagttcttg

SEQ ID NO: 9057719 - DNA, 17 bp, Homo sapiens
tctgtttctcctttctt

SEQ ID NO: 9057720 - DNA, 22 bp, Homo sapiens
tctgtttattcaatttctatat

SEQ ID NO: 9057721 - DNA, 22 bp, Homo sapiens
tctgttttagataagaaaggct

SEQ ID NO: 9057722 - DNA, 22 bp, Homo sapiens
tcttaaaggcacatagtgtcta

SEQ ID NO: 9057723 - DNA, 22 bp, Homo sapiens
tcttaaaagtatgccaattgga

SEQ ID NO: 9057724 - DNA, 22 bp, Homo sapiens
tcttaacaagctcctcagtgct

SEQ ID NO: 9057725 - DNA, 22 bp, Homo sapiens
tcttaacaagctcctcagtgct

SEQ ID NO: 9057726 - DNA, 22 bp, Homo sapiens
tcttaacatattattttagcac

SEQ ID NO: 9057727 - DNA, 22 bp, Homo sapiens
tcttaacagtgctacagagcag

SEQ ID NO: 9057728 - DNA, 22 bp, Homo sapiens
tcttatcttatacctaacagcc

SEQ ID NO: 9057729 - DNA, 22 bp, Homo sapiens
tcttataaaaggactcccattt

SEQ ID NO: 9057730 - DNA, 23 bp, Homo sapiens
tctgtgtagccaggtctggaggg

SEQ ID NO: 9057731 - DNA, 19 bp, Homo sapiens
tctgtgctgggaggcagca

SEQ ID NO: 9057732 - DNA, 22 bp, Homo sapiens
tctgtgctcattcagtcattca

SEQ ID NO: 9057733 - DNA, 22 bp, Homo sapiens
tctgtgctgtctcagagaaagc

SEQ ID NO: 9057734 - DNA, 22 bp, Homo sapiens
tctgtctttgtcaggaccagag

SEQ ID NO: 9057735 - DNA, 20 bp, Homo sapiens
tcttctgttgccttgttctg

SEQ ID NO: 9057736 - DNA, 22 bp, Homo sapiens
tcttctgttttagattgcatac

SEQ ID NO: 9057737 - DNA, 22 bp, Homo sapiens
tcttcttaaagtatgttctctt

SEQ ID NO: 9057738 - DNA, 22 bp, Homo sapiens
tcttcttcccatccctcaaatg

SEQ ID NO: 9057739 - DNA, 22 bp, Homo sapiens
tcttcttatgtgccattatctc

SEQ ID NO: 9057740 - DNA, 22 bp, Homo sapiens
tcttgaaagcatgagatggaca

SEQ ID NO: 9057741 - DNA, 22 bp, Homo sapiens
tcttgaaacatatgagtaagtg

SEQ ID NO: 9057742 - DNA, 22 bp, Homo sapiens
tcttctgtggctctcaccaccc

SEQ ID NO: 9057743 - DNA, 22 bp, Homo sapiens
tcttctgtattgttaactcagg

SEQ ID NO: 9057744 - DNA, 22 bp, Homo sapiens
tcttctccagtgcttctgcaca

SEQ ID NO: 9057745 - DNA, 22 bp, Homo sapiens
tcttcctttcattcatgtgtta

SEQ ID NO: 9057746 - DNA, 22 bp, Homo sapiens
tcttccttgctccttgtcactt

SEQ ID NO: 9057747 - DNA, 22 bp, Homo sapiens
tcttcctctctaattgatcaga

SEQ ID NO: 9057748 - DNA, 22 bp, Homo sapiens
tcttcatactcatcacataggt

SEQ ID NO: 9057749 - DNA, 22 bp, Homo sapiens
tcttcatactcatcacataggt

SEQ ID NO: 9057750 - DNA, 22 bp, Homo sapiens
tcttcaaagaattttagtaatt

SEQ ID NO: 9057751 - DNA, 22 bp, Homo sapiens
tcttcaaagaattttagtaatt

SEQ ID NO: 9057752 - DNA, 22 bp, Homo sapiens
tcttcaaactgaaaatttagaa

SEQ ID NO: 9057753 - DNA, 22 bp, Homo sapiens
tcttcaaaaatacaggttttca

SEQ ID NO: 9057754 - DNA, 22 bp, Homo sapiens
tcttcaaaatattccatccatt

SEQ ID NO: 9057755 - DNA, 22 bp, Homo sapiens
tcttcaaaccctggctcttcct

SEQ ID NO: 9057756 - DNA, 22 bp, Homo sapiens
tcttcaaaaactgcaccttgct

SEQ ID NO: 9057757 - DNA, 22 bp, Homo sapiens
tcttattttttaatgacagaga

SEQ ID NO: 9057758 - DNA, 22 bp, Homo sapiens
tcttcaaaaaatatccatcagt

SEQ ID NO: 9057759 - DNA, 22 bp, Homo sapiens
tcttattttttaatgacagaga

SEQ ID NO: 9057760 - DNA, 22 bp, Homo sapiens
tcttattttgttagatgctgta

SEQ ID NO: 9057761 - DNA, 22 bp, Homo sapiens
tcttatgcatattcataacaca

SEQ ID NO: 9057762 - DNA, 22 bp, Homo sapiens
tcttattattgttgtaaaagca

SEQ ID NO: 9057763 - DNA, 22 bp, Homo sapiens
tcttcaaatacagtcatattga

SEQ ID NO: 9057764 - DNA, 22 bp, Homo sapiens
tcttcacaccgggcagcaggaa

SEQ ID NO: 9057765 - DNA, 22 bp, Homo sapiens
tctttattgctactggtttgtc

SEQ ID NO: 9057766 - DNA, 22 bp, Homo sapiens
tctttattgctactggtttgtc

SEQ ID NO: 9057767 - DNA, 22 bp, Homo sapiens
tctttattgctactggtttgtc

SEQ ID NO: 9057768 - DNA, 22 bp, Homo sapiens
tctttcattctagtctgaggtt

SEQ ID NO: 9057769 - DNA, 22 bp, Homo sapiens
tctttagtgaccatctcattct

SEQ ID NO: 9057770 - DNA, 20 bp, Homo sapiens
tctttagttcctggcccttt

SEQ ID NO: 9057771 - DNA, 22 bp, Homo sapiens
tctttagctagaaatactctaa

SEQ ID NO: 9057772 - DNA, 22 bp, Homo sapiens
tctttatgtttgaaagtacaat

SEQ ID NO: 9057773 - DNA, 21 bp, Homo sapiens
tctttcctgcccagttgccct

SEQ ID NO: 9057774 - DNA, 17 bp, Homo sapiens
tctttcctgccatgctc

SEQ ID NO: 9057775 - DNA, 22 bp, Homo sapiens
tctttcctctgagctcctgtag

SEQ ID NO: 9057776 - DNA, 23 bp, Homo sapiens
tctttcctcagcacacaccaaga

SEQ ID NO: 9057777 - DNA, 22 bp, Homo sapiens
tctttcctgtaactgctgttca

SEQ ID NO: 9057778 - DNA, 22 bp, Homo sapiens
tctttccttagaataattcttt

SEQ ID NO: 9057779 - DNA, 22 bp, Homo sapiens
tctttctacatcatttgcttct

SEQ ID NO: 9057780 - DNA, 22 bp, Homo sapiens
tctttcccttagaacattaaca

SEQ ID NO: 9057781 - DNA, 23 bp, Homo sapiens
tctttcctaatgaaacagtgaaa

SEQ ID NO: 9057782 - DNA, 22 bp, Homo sapiens
tctttcctaggtgatatgcaat

SEQ ID NO: 9057783 - DNA, 22 bp, Homo sapiens
tctttcctactttattgtgaac

SEQ ID NO: 9057784 - DNA, 22 bp, Homo sapiens
tctttcctagaggctgatgagt

SEQ ID NO: 9057785 - DNA, 22 bp, Homo sapiens
tctttgatgtggttaattatga

SEQ ID NO: 9057786 - DNA, 22 bp, Homo sapiens
tctttgatggagagatagatat

SEQ ID NO: 9057787 - DNA, 22 bp, Homo sapiens
tctttctagtggcctctattct

SEQ ID NO: 9057788 - DNA, 22 bp, Homo sapiens
tctttctggttatgtatagaga

SEQ ID NO: 9057789 - DNA, 22 bp, Homo sapiens
tctttaattgtggaagagcagc

SEQ ID NO: 9057790 - DNA, 22 bp, Homo sapiens
tctttaattcagcatgatgcgg

SEQ ID NO: 9057791 - DNA, 22 bp, Homo sapiens
tcttgaaggggggcagtgttga

SEQ ID NO: 9057792 - DNA, 22 bp, Homo sapiens
tcttggattttaatggatcaaa

SEQ ID NO: 9057793 - DNA, 22 bp, Homo sapiens
tcttggaaccctatgtgatttc

SEQ ID NO: 9057794 - DNA, 22 bp, Homo sapiens
tcttggaacttattattgtaga

SEQ ID NO: 9057795 - DNA, 22 bp, Homo sapiens
tcttggaagcctcaagatactc

SEQ ID NO: 9057796 - DNA, 22 bp, Homo sapiens
tcttggaacttattattgtaga

SEQ ID NO: 9057797 - DNA, 22 bp, Homo sapiens
tcttggaagtagaacacagtct

SEQ ID NO: 9057798 - DNA, 22 bp, Homo sapiens
tcttggaatctccatagagtga

SEQ ID NO: 9057799 - DNA, 22 bp, Homo sapiens
tcttggaatctccatagagtga

SEQ ID NO: 9057800 - DNA, 22 bp, Homo sapiens
tccttcaaagctcctagtgagc

SEQ ID NO: 9057801 - DNA, 22 bp, Homo sapiens
tccttcaaaagttgagagagcc

SEQ ID NO: 9057802 - DNA, 22 bp, Homo sapiens
tccttaacaagatggcatttgt

SEQ ID NO: 9057803 - DNA, 22 bp, Homo sapiens
tccttaaatgaactctgcatga

SEQ ID NO: 9057804 - DNA, 22 bp, Homo sapiens
tccttagacaaagagtgggctt

SEQ ID NO: 9057805 - DNA, 22 bp, Homo sapiens
tccttggaggtgttcatctgcc

SEQ ID NO: 9057806 - DNA, 22 bp, Homo sapiens
tccttctttccccctagtcatt

SEQ ID NO: 9057807 - DNA, 22 bp, Homo sapiens
tccttctttgacaagtggcaga

SEQ ID NO: 9057808 - DNA, 22 bp, Homo sapiens
tccttgagagccactgtcttgg

SEQ ID NO: 9057809 - DNA, 22 bp, Homo sapiens
tcgaactcatagtcgtagctgt

SEQ ID NO: 9057810 - DNA, 22 bp, Homo sapiens
tccttttttatgaagctttgag

SEQ ID NO: 9057811 - DNA, 22 bp, Homo sapiens
tcctttgttaaggaggtttgtt

SEQ ID NO: 9057812 - DNA, 23 bp, Homo sapiens
tcctttgtctttgcatagatggt

SEQ ID NO: 9057813 - DNA, 22 bp, Homo sapiens
tcctttccatgcttctagaggc

SEQ ID NO: 9057814 - DNA, 22 bp, Homo sapiens
tcctttccctttccatcctggc

SEQ ID NO: 9057815 - DNA, 19 bp, Homo sapiens
tcctttctgttcctgagat

SEQ ID NO: 9057816 - DNA, 22 bp, Homo sapiens
tcctttcttcttctgcccatgg

SEQ ID NO: 9057817 - DNA, 22 bp, Homo sapiens
tcgtgaagtcacaataaagtct

SEQ ID NO: 9057818 - DNA, 22 bp, Homo sapiens
tctaaacttgtaaacaagcata

SEQ ID NO: 9057819 - DNA, 22 bp, Homo sapiens
tctaaactacgtcaaaactagt

SEQ ID NO: 9057820 - DNA, 22 bp, Homo sapiens
tctacaaagaagaattaatgtc

SEQ ID NO: 9057821 - DNA, 22 bp, Homo sapiens
tctaactctgccaggacacaga

SEQ ID NO: 9057822 - DNA, 22 bp, Homo sapiens
tctacacatttgtaaaggcatt

SEQ ID NO: 9057823 - DNA, 22 bp, Homo sapiens
tctacactgtagaattataagg

SEQ ID NO: 9057824 - DNA, 22 bp, Homo sapiens
tctacagagagtcatagactca

SEQ ID NO: 9057825 - DNA, 19 bp, Homo sapiens
tctacaaagtggcatcagg

SEQ ID NO: 9057826 - DNA, 22 bp, Homo sapiens
tctacagtagaaagatcccagt

SEQ ID NO: 9057827 - DNA, 22 bp, Homo sapiens
tctacagtgagtcattcaaaca

SEQ ID NO: 9057828 - DNA, 22 bp, Homo sapiens
tctacagtcaagttatattgct

SEQ ID NO: 9057829 - DNA, 22 bp, Homo sapiens
tctacagtgtcaatgtgtcttg

SEQ ID NO: 9057830 - DNA, 22 bp, Homo sapiens
tctaccactcatgctacttact

SEQ ID NO: 9057831 - DNA, 23 bp, Homo sapiens
tctacccacactgctctagaagg

SEQ ID NO: 9057832 - DNA, 22 bp, Homo sapiens
tctagcaccacattaaatagca

SEQ ID NO: 9057833 - DNA, 22 bp, Homo sapiens
tctagagactataatgtgtcct

SEQ ID NO: 9057834 - DNA, 22 bp, Homo sapiens
tctagctgccccgaggcagggt

SEQ ID NO: 9057835 - DNA, 22 bp, Homo sapiens
tctagctgagggtaggagacct

SEQ ID NO: 9057836 - DNA, 22 bp, Homo sapiens
tctatgtctccaccttcgcaga

SEQ ID NO: 9057837 - DNA, 22 bp, Homo sapiens
tctatgtcagcatctttctacc

SEQ ID NO: 9057838 - DNA, 22 bp, Homo sapiens
tctatgtcctttctcccattcc

SEQ ID NO: 9057839 - DNA, 22 bp, Homo sapiens
tctatgtagtgccagctagtat

SEQ ID NO: 9057840 - DNA, 23 bp, Homo sapiens
tctattacttattgtactctgga

SEQ ID NO: 9057841 - DNA, 22 bp, Homo sapiens
tctattagattattctcaagga

SEQ ID NO: 9057842 - DNA, 22 bp, Homo sapiens
tctattacttaccactaattca

SEQ ID NO: 9057843 - DNA, 22 bp, Homo sapiens
tctattatggtacttatcatga

SEQ ID NO: 9057844 - DNA, 22 bp, Homo sapiens
tctatattttgaaaggtattta

SEQ ID NO: 9057845 - DNA, 22 bp, Homo sapiens
tctatgaagtgcaattaactgt

SEQ ID NO: 9057846 - DNA, 22 bp, Homo sapiens
tctatgaaaagtctattcattc

SEQ ID NO: 9057847 - DNA, 22 bp, Homo sapiens
tctagggagctctagcagtggt

SEQ ID NO: 9057848 - DNA, 22 bp, Homo sapiens
tctcaattcatgaagttggaat

SEQ ID NO: 9057849 - DNA, 22 bp, Homo sapiens
tctcacaagctcaaggattagt

SEQ ID NO: 9057850 - DNA, 19 bp, Homo sapiens
tctcacaagcaacattgtt

SEQ ID NO: 9057851 - DNA, 22 bp, Homo sapiens
tctcacaactagaagggaaaga

SEQ ID NO: 9057852 - DNA, 22 bp, Homo sapiens
tctatttaccaaatgtagttcc

SEQ ID NO: 9057853 - DNA, 22 bp, Homo sapiens
tctattcattcaatttagctct

SEQ ID NO: 9057854 - DNA, 22 bp, Homo sapiens
tctattttatactcaaatcttc

SEQ ID NO: 9057855 - DNA, 22 bp, Homo sapiens
tcctggggtttagagggaagtg

SEQ ID NO: 9057856 - DNA, 22 bp, Homo sapiens
tcctggggctctgagcgagaca

SEQ ID NO: 9057857 - DNA, 22 bp, Homo sapiens
tcctgtgctttggaggatgttc

SEQ ID NO: 9057858 - DNA, 21 bp, Homo sapiens
tcctgtaagcttgggtggctc

SEQ ID NO: 9057859 - DNA, 22 bp, Homo sapiens
tcctgtcctgaggctccaggcc

SEQ ID NO: 9057860 - DNA, 22 bp, Homo sapiens
tcctggctgccgtcgtcctgcg

SEQ ID NO: 9057861 - DNA, 21 bp, Homo sapiens
tcctggctttatgctacctct

SEQ ID NO: 9057862 - DNA, 19 bp, Homo sapiens
tcctgctttctactctgct

SEQ ID NO: 9057863 - DNA, 22 bp, Homo sapiens
tcctggagaagaggggcttgga

SEQ ID NO: 9057864 - DNA, 22 bp, Homo sapiens
tcctggagataattgcagtgaa

SEQ ID NO: 9057865 - DNA, 22 bp, Homo sapiens
tcctggagagtgggcgagcaca

SEQ ID NO: 9057866 - DNA, 22 bp, Homo sapiens
tcctggagagaggcctggaaga

SEQ ID NO: 9057867 - DNA, 22 bp, Homo sapiens
tcctggaggggacagcatgggc

SEQ ID NO: 9057868 - DNA, 22 bp, Homo sapiens
tcctggagggctcacaggcggc

SEQ ID NO: 9057869 - DNA, 22 bp, Homo sapiens
tcctggaggcactcgctggggc

SEQ ID NO: 9057870 - DNA, 22 bp, Homo sapiens
taagaacagtgtctgtctcaca

SEQ ID NO: 9057871 - DNA, 23 bp, Homo sapiens
taagaacagacaagcatttacat

SEQ ID NO: 9057872 - DNA, 22 bp, Homo sapiens
taagaacagtagaacagtaggt

SEQ ID NO: 9057873 - DNA, 22 bp, Homo sapiens
tcctgcttccttgtctttagac

SEQ ID NO: 9057874 - DNA, 21 bp, Homo sapiens
tcctggcccactctatcccca

SEQ ID NO: 9057875 - DNA, 22 bp, Homo sapiens
tcctggcccactatgccagcat

SEQ ID NO: 9057876 - DNA, 22 bp, Homo sapiens
tcctggcccactatgccagcat

SEQ ID NO: 9057877 - DNA, 22 bp, Homo sapiens
tcctggcccaatctgcccatga

SEQ ID NO: 9057878 - DNA, 22 bp, Homo sapiens
tcctggcccggccgggcctgct

SEQ ID NO: 9057879 - DNA, 22 bp, Homo sapiens
tcctggcccgatccctgtgaag

SEQ ID NO: 9057880 - DNA, 21 bp, Homo sapiens
tcctggcccactctatcccca

SEQ ID NO: 9057881 - DNA, 22 bp, Homo sapiens
tcctggcctcacagtcctgggt

SEQ ID NO: 9057882 - DNA, 22 bp, Homo sapiens
tcctggcctagagtttgtgttc

SEQ ID NO: 9057883 - DNA, 22 bp, Homo sapiens
tcctggccctgtggcctgcagt

SEQ ID NO: 9057884 - DNA, 22 bp, Homo sapiens
tcctggccgccgcgtggggccg

SEQ ID NO: 9057885 - DNA, 22 bp, Homo sapiens
tcctggcctcgctgtccacctt

SEQ ID NO: 9057886 - DNA, 20 bp, Homo sapiens
tcctggcctccctggggctc

SEQ ID NO: 9057887 - DNA, 22 bp, Homo sapiens
tcctggcctccgttctctgcat

SEQ ID NO: 9057888 - DNA, 22 bp, Homo sapiens
tcctggctctgctgcctcctag

SEQ ID NO: 9057889 - DNA, 21 bp, Homo sapiens
tcctggccagggcactaggca

SEQ ID NO: 9057890 - DNA, 18 bp, Homo sapiens
tcctggccacactacctt

SEQ ID NO: 9057891 - DNA, 22 bp, Homo sapiens
tcctggagtttgtaaggtgagc

SEQ ID NO: 9057892 - DNA, 22 bp, Homo sapiens
tcctggagtttgtggtgatatg

SEQ ID NO: 9057893 - DNA, 22 bp, Homo sapiens
tcctggagttgtgcagtgcaca

SEQ ID NO: 9057894 - DNA, 22 bp, Homo sapiens
tctctagttgaggactgagcag

SEQ ID NO: 9057895 - DNA, 22 bp, Homo sapiens
tctctattaattgacaatggct

SEQ ID NO: 9057896 - DNA, 22 bp, Homo sapiens
tctctatgacaaggtttggttg

SEQ ID NO: 9057897 - DNA, 22 bp, Homo sapiens
tctctatgtgcacaccttggtg

SEQ ID NO: 9057898 - DNA, 20 bp, Homo sapiens
tctctatgaagtcaacagga

SEQ ID NO: 9057899 - DNA, 20 bp, Homo sapiens
tctctattcccacgaggaaa

SEQ ID NO: 9057900 - DNA, 22 bp, Homo sapiens
tctctcaagcactatccaccca

SEQ ID NO: 9057901 - DNA, 22 bp, Homo sapiens
tctctcagaaagcccatgtctg

SEQ ID NO: 9057902 - DNA, 22 bp, Homo sapiens
tctctcctgtgttctgatgttt

SEQ ID NO: 9057903 - DNA, 18 bp, Homo sapiens
tctctgaatattttatgt

SEQ ID NO: 9057904 - DNA, 22 bp, Homo sapiens
tctctgaagatatttattatta

SEQ ID NO: 9057905 - DNA, 22 bp, Homo sapiens
tctctgaataatgctattcttt

SEQ ID NO: 9057906 - DNA, 22 bp, Homo sapiens
tctctctttttaatcatgtaat

SEQ ID NO: 9057907 - DNA, 22 bp, Homo sapiens
tctctggccccatggctgagct

SEQ ID NO: 9057908 - DNA, 22 bp, Homo sapiens
tctctggctcctgccgggtcca

SEQ ID NO: 9057909 - DNA, 22 bp, Homo sapiens
tctctggctggcaccccaggga

SEQ ID NO: 9057910 - DNA, 19 bp, Homo sapiens
tctcttctccctggtttta

SEQ ID NO: 9057911 - DNA, 22 bp, Homo sapiens
tctcttctaattagggtccatg

SEQ ID NO: 9057912 - DNA, 22 bp, Homo sapiens
tctcttctagcttcttgtggtt

SEQ ID NO: 9057913 - DNA, 18 bp, Homo sapiens
tctcttcttggcagtcaa

SEQ ID NO: 9057914 - DNA, 22 bp, Homo sapiens
tctcttccttgacctattgtaa

SEQ ID NO: 9057915 - DNA, 22 bp, Homo sapiens
tctcttcctagtgatgggcttt

SEQ ID NO: 9057916 - DNA, 22 bp, Homo sapiens
tctcttcctcagcctggggcct

SEQ ID NO: 9057917 - DNA, 21 bp, Homo sapiens
tctcttcctccgcgccgccgc

SEQ ID NO: 9057918 - DNA, 22 bp, Homo sapiens
tctcttcccctttcctttaaca

SEQ ID NO: 9057919 - DNA, 21 bp, Homo sapiens
tctcttcccatcaggacacta

SEQ ID NO: 9057920 - DNA, 22 bp, Homo sapiens
tctcttcccggataaagtaagt

SEQ ID NO: 9057921 - DNA, 22 bp, Homo sapiens
tctcttccctttatggtatgtg

SEQ ID NO: 9057922 - DNA, 22 bp, Homo sapiens
tctcttccagtggctttgattt

SEQ ID NO: 9057923 - DNA, 22 bp, Homo sapiens
tctcttccagtaagagtcttta

SEQ ID NO: 9057924 - DNA, 22 bp, Homo sapiens
tctcttccatgtttcagcccca

SEQ ID NO: 9057925 - DNA, 22 bp, Homo sapiens
tctcttaggagaaattcataaa

SEQ ID NO: 9057926 - DNA, 22 bp, Homo sapiens
tctcttaggagaaattcataaa

SEQ ID NO: 9057927 - DNA, 22 bp, Homo sapiens
tctcttcacactacccctgtgt

SEQ ID NO: 9057928 - DNA, 22 bp, Homo sapiens
tctcttatgggatagagagggg

SEQ ID NO: 9057929 - DNA, 22 bp, Homo sapiens
tctctgtgaagctcccgttagg

SEQ ID NO: 9057930 - DNA, 22 bp, Homo sapiens
tctctgtgagatttgtattaag

SEQ ID NO: 9057931 - DNA, 22 bp, Homo sapiens
tctctttctcaaaatgtaagca

SEQ ID NO: 9057932 - DNA, 22 bp, Homo sapiens
tctctttctttgtatgtctatt

SEQ ID NO: 9057933 - DNA, 22 bp, Homo sapiens
tctcttctttggggtgggctca

SEQ ID NO: 9057934 - DNA, 22 bp, Homo sapiens
tctctttaaaaatagtgaaata

SEQ ID NO: 9057935 - DNA, 22 bp, Homo sapiens
tctctttaaagactcagagatt

SEQ ID NO: 9057936 - DNA, 22 bp, Homo sapiens
tctgaaggcatcctcactgcaa

SEQ ID NO: 9057937 - DNA, 22 bp, Homo sapiens
tctcagtgactgctgggtcccc

SEQ ID NO: 9057938 - DNA, 17 bp, Homo sapiens
tctcagtgactgatagc

SEQ ID NO: 9057939 - DNA, 22 bp, Homo sapiens
tctcagtgagcttttctatgtt

SEQ ID NO: 9057940 - DNA, 23 bp, Homo sapiens
tctcagtgcacgcaccatgcctg

SEQ ID NO: 9057941 - DNA, 22 bp, Homo sapiens
tctcagtgatggcccatttgga

SEQ ID NO: 9057942 - DNA, 22 bp, Homo sapiens
tctcagtgcagcaaggaattta

SEQ ID NO: 9057943 - DNA, 23 bp, Homo sapiens
tctcagtgcacgcaccatgcctg

SEQ ID NO: 9057944 - DNA, 22 bp, Homo sapiens
tctcagtgcagagaggctatct

SEQ ID NO: 9057945 - DNA, 23 bp, Homo sapiens
tctcagtgaatctcagaattcgc

SEQ ID NO: 9057946 - DNA, 22 bp, Homo sapiens
tctcagtgacactcttcataca

SEQ ID NO: 9057947 - DNA, 22 bp, Homo sapiens
tctcagtgaagagtataacaaa

SEQ ID NO: 9057948 - DNA, 22 bp, Homo sapiens
tctcagtaattaatgttatgga

SEQ ID NO: 9057949 - DNA, 19 bp, Homo sapiens
tctcagtagactgtatgtt

SEQ ID NO: 9057950 - DNA, 23 bp, Homo sapiens
tctcagtaaatgttagtttaatc

SEQ ID NO: 9057951 - DNA, 22 bp, Homo sapiens
tctcagtcagtttggactgtgt

SEQ ID NO: 9057952 - DNA, 22 bp, Homo sapiens
tctcagtcagccttgatgtccc

SEQ ID NO: 9057953 - DNA, 22 bp, Homo sapiens
tctcagtccaaatgagaggttg

SEQ ID NO: 9057954 - DNA, 22 bp, Homo sapiens
tctcagtggacgtgtctgtctt

SEQ ID NO: 9057955 - DNA, 23 bp, Homo sapiens
tctcagtgccgattgcatacaca

SEQ ID NO: 9057956 - DNA, 22 bp, Homo sapiens
tctcagtgcagcttgacagaga

SEQ ID NO: 9057957 - DNA, 22 bp, Homo sapiens
tctcagtgctatccatattcca

SEQ ID NO: 9057958 - DNA, 19 bp, Homo sapiens
tctcagtgccgctgaccgc

SEQ ID NO: 9057959 - DNA, 22 bp, Homo sapiens
tctcataaggtcagatttcaca

SEQ ID NO: 9057960 - DNA, 22 bp, Homo sapiens
tctcataaactcagttttctca

SEQ ID NO: 9057961 - DNA, 22 bp, Homo sapiens
tctcatcttcattgtctcccat

SEQ ID NO: 9057962 - DNA, 22 bp, Homo sapiens
tctcatctgcgagctctgccag

SEQ ID NO: 9057963 - DNA, 22 bp, Homo sapiens
tctccaggcacttggctgctac

SEQ ID NO: 9057964 - DNA, 22 bp, Homo sapiens
tctccaaatagttatatttaga

SEQ ID NO: 9057965 - DNA, 22 bp, Homo sapiens
tctcatttgtgtgcaattcaga

SEQ ID NO: 9057966 - DNA, 22 bp, Homo sapiens
tctcatttgtgtgcaattcaga

SEQ ID NO: 9057967 - DNA, 23 bp, Homo sapiens
tctcatttcccttgatctatctt

SEQ ID NO: 9057968 - DNA, 22 bp, Homo sapiens
tctcatttgcctcatctataaa

SEQ ID NO: 9057969 - DNA, 22 bp, Homo sapiens
tctcatttgcctcatctataaa

SEQ ID NO: 9057970 - DNA, 22 bp, Homo sapiens
tctcattgcacaatgcagagtg

SEQ ID NO: 9057971 - DNA, 22 bp, Homo sapiens
tctcatgttttacctgtcctca

SEQ ID NO: 9057972 - DNA, 20 bp, Homo sapiens
tctcattatatccaagaggc

SEQ ID NO: 9057973 - DNA, 22 bp, Homo sapiens
tctcagaggcccgacgttctcc

SEQ ID NO: 9057974 - DNA, 22 bp, Homo sapiens
tctcagagggaggattactgcc

SEQ ID NO: 9057975 - DNA, 22 bp, Homo sapiens
tctcagagtgacaatgagaatt

SEQ ID NO: 9057976 - DNA, 22 bp, Homo sapiens
tctcagagtttagagctgagcc

SEQ ID NO: 9057977 - DNA, 22 bp, Homo sapiens
tctcagagtttacggggctgaa

SEQ ID NO: 9057978 - DNA, 22 bp, Homo sapiens
tctcagctgactgctttcctcg

SEQ ID NO: 9057979 - DNA, 20 bp, Homo sapiens
tctcaggccccctccttgct

SEQ ID NO: 9057980 - DNA, 22 bp, Homo sapiens
tctcagaaaagagcttcagaaa

SEQ ID NO: 9057981 - DNA, 22 bp, Homo sapiens
tctcagaaaaaggagaaactgg

SEQ ID NO: 9057982 - DNA, 22 bp, Homo sapiens
tctcagaaaaactttgagggta

SEQ ID NO: 9057983 - DNA, 22 bp, Homo sapiens
tctcacagtatgaattgttcac

SEQ ID NO: 9057984 - DNA, 22 bp, Homo sapiens
tctcagagatctttctgcatgt

SEQ ID NO: 9057985 - DNA, 22 bp, Homo sapiens
tctcagaaggcaagggctgggg

SEQ ID NO: 9057986 - DNA, 22 bp, Homo sapiens
tctcagaactttatatgtatca

SEQ ID NO: 9057987 - DNA, 22 bp, Homo sapiens
tctcagaacctcagtttgctct

SEQ ID NO: 9057988 - DNA, 22 bp, Homo sapiens
tctcagaacacccttctatggt

SEQ ID NO: 9057989 - DNA, 22 bp, Homo sapiens
tctcagaaatgacaggaggtac

SEQ ID NO: 9057990 - DNA, 23 bp, Homo sapiens
tctcagaaaggagaagtaatttg

SEQ ID NO: 9057991 - DNA, 22 bp, Homo sapiens
tctcagaaatactatgttgtca

SEQ ID NO: 9057992 - DNA, 23 bp, Homo sapiens
tctcagaggattcctgggccttg

SEQ ID NO: 9057993 - DNA, 19 bp, Homo sapiens
tctcagagccctagaggcc

SEQ ID NO: 9057994 - DNA, 22 bp, Homo sapiens
tctccagggacatgtttctgga

SEQ ID NO: 9057995 - DNA, 22 bp, Homo sapiens
tctccaggtggcttgggcttct

SEQ ID NO: 9057996 - DNA, 22 bp, Homo sapiens
tctccccagtatggattctctg

SEQ ID NO: 9057997 - DNA, 22 bp, Homo sapiens
tctccccaggggtatgggtatt

SEQ ID NO: 9057998 - DNA, 22 bp, Homo sapiens
tctcccattcagcttgcagtca

SEQ ID NO: 9057999 - DNA, 22 bp, Homo sapiens
tctcctggtatgtatgcacctg

SEQ ID NO: 9058000 - DNA, 22 bp, Homo sapiens
tctcctggtacccttcctagca

SEQ ID NO: 9058001 - DNA, 22 bp, Homo sapiens
tctccttgctacccagtatgtc

SEQ ID NO: 9058002 - DNA, 22 bp, Homo sapiens
tctcctggaagaataccacact

SEQ ID NO: 9058003 - DNA, 22 bp, Homo sapiens
tctcctggatggaccttctctt

SEQ ID NO: 9058004 - DNA, 21 bp, Homo sapiens
tgcattctagcagctctgagg

SEQ ID NO: 9058005 - DNA, 22 bp, Homo sapiens
tgcattcctttgtctgttaaag

SEQ ID NO: 9058006 - DNA, 22 bp, Homo sapiens
tgcattgggttgacatactaaa

SEQ ID NO: 9058007 - DNA, 22 bp, Homo sapiens
tgcattggaaactcagcagcac

SEQ ID NO: 9058008 - DNA, 22 bp, Homo sapiens
tgcattgggttgacatactaaa

SEQ ID NO: 9058009 - DNA, 22 bp, Homo sapiens
tgcatttaagaaaacatgagtc

SEQ ID NO: 9058010 - DNA, 22 bp, Homo sapiens
tgcatttaactagaatattaat

SEQ ID NO: 9058011 - DNA, 18 bp, Homo sapiens
tgcatttagtacatctag

SEQ ID NO: 9058012 - DNA, 22 bp, Homo sapiens
tgcatttagttatgagaaaaac

SEQ ID NO: 9058013 - DNA, 22 bp, Homo sapiens
tgcatttacctggaggtcattt

SEQ ID NO: 9058014 - DNA, 22 bp, Homo sapiens
tgcattttcttccaccaatatc

SEQ ID NO: 9058015 - DNA, 22 bp, Homo sapiens
tgcattttacttacctgttagt

SEQ ID NO: 9058016 - DNA, 22 bp, Homo sapiens
tgcatttttgataactgtgtac

SEQ ID NO: 9058017 - DNA, 22 bp, Homo sapiens
tgcatttttgataactgtgtac

SEQ ID NO: 9058018 - DNA, 22 bp, Homo sapiens
tgcatttttgaggttaactcaa

SEQ ID NO: 9058019 - DNA, 22 bp, Homo sapiens
tgcatttatttgaattgatcta

SEQ ID NO: 9058020 - DNA, 22 bp, Homo sapiens
tgcatttagttttaataaagga

SEQ ID NO: 9058021 - DNA, 22 bp, Homo sapiens
tgccactggctcaatggtgcag

SEQ ID NO: 9058022 - DNA, 22 bp, Homo sapiens
tgccactggctcaatggtgcag

SEQ ID NO: 9058023 - DNA, 22 bp, Homo sapiens
tgcatcatataatgtctatgga

SEQ ID NO: 9058024 - DNA, 22 bp, Homo sapiens
tgcatcatgcggaactggcttt

SEQ ID NO: 9058025 - DNA, 18 bp, Homo sapiens
tgcatcatttatgggtca

SEQ ID NO: 9058026 - DNA, 22 bp, Homo sapiens
tgcatcatttataatgtctttg

SEQ ID NO: 9058027 - DNA, 22 bp, Homo sapiens
tgcatccttccatgggtttcaa

SEQ ID NO: 9058028 - DNA, 22 bp, Homo sapiens
tgcatcctcctttgtcctcttg

SEQ ID NO: 9058029 - DNA, 22 bp, Homo sapiens
tgcatcctcctttgtcctcttg

SEQ ID NO: 9058030 - DNA, 22 bp, Homo sapiens
tgcatctgattctcaggcagaa

SEQ ID NO: 9058031 - DNA, 22 bp, Homo sapiens
tgcatactgaatctgccatcac

SEQ ID NO: 9058032 - DNA, 22 bp, Homo sapiens
tgcatactgctgggggagctct

SEQ ID NO: 9058033 - DNA, 22 bp, Homo sapiens
tgcatactgaatctgccatcac

SEQ ID NO: 9058034 - DNA, 22 bp, Homo sapiens
tgcatactgaacagcatgctaa

SEQ ID NO: 9058035 - DNA, 22 bp, Homo sapiens
tgcatactgaacagcatgctaa

SEQ ID NO: 9058036 - DNA, 22 bp, Homo sapiens
tgcatacttttaatgactgttt

SEQ ID NO: 9058037 - DNA, 22 bp, Homo sapiens
tgcatacttttaatgactgttt

SEQ ID NO: 9058038 - DNA, 22 bp, Homo sapiens
tgcatacttgtatgtgttacat

SEQ ID NO: 9058039 - DNA, 22 bp, Homo sapiens
tgcatacttgtatgtgttacat

SEQ ID NO: 9058040 - DNA, 22 bp, Homo sapiens
tgcatacttggggcctccactc

SEQ ID NO: 9058041 - DNA, 22 bp, Homo sapiens
tgcatactgtggagatttttca

SEQ ID NO: 9058042 - DNA, 22 bp, Homo sapiens
tgcatagggaacctcatgcatt

SEQ ID NO: 9058043 - DNA, 22 bp, Homo sapiens
tgcatgttaagaaaatattgag

SEQ ID NO: 9058044 - DNA, 22 bp, Homo sapiens
tgcatgtgtgacaaggacagtt

SEQ ID NO: 9058045 - DNA, 22 bp, Homo sapiens
tgcatggaggaagatgaatgca

SEQ ID NO: 9058046 - DNA, 22 bp, Homo sapiens
tgcatggagctgtctgcatggt

SEQ ID NO: 9058047 - DNA, 22 bp, Homo sapiens
tgcatgctcaagttagttgtga

SEQ ID NO: 9058048 - DNA, 18 bp, Homo sapiens
tgcatgcttttgtttcca

SEQ ID NO: 9058049 - DNA, 19 bp, Homo sapiens
tgcatcttgcatgggtgag

SEQ ID NO: 9058050 - DNA, 22 bp, Homo sapiens
tgcatctttagtcttatgtctg

SEQ ID NO: 9058051 - DNA, 22 bp, Homo sapiens
tgcagggattgttggcatccat

SEQ ID NO: 9058052 - DNA, 21 bp, Homo sapiens
tgcagggatctttctgcctga

SEQ ID NO: 9058053 - DNA, 22 bp, Homo sapiens
tgcagggcacacgcacgggtgt

SEQ ID NO: 9058054 - DNA, 22 bp, Homo sapiens
tgcagggcagtggaggttgagt

SEQ ID NO: 9058055 - DNA, 22 bp, Homo sapiens
tgcagggccgctggaggtcatg

SEQ ID NO: 9058056 - DNA, 22 bp, Homo sapiens
tgcaggctgctggcagtagctt

SEQ ID NO: 9058057 - DNA, 21 bp, Homo sapiens
tgcaggctgtgcgctcctgcc

SEQ ID NO: 9058058 - DNA, 22 bp, Homo sapiens
tgcagggaatccagtctagggt

SEQ ID NO: 9058059 - DNA, 22 bp, Homo sapiens
tgcagggaaagtgttggcagca

SEQ ID NO: 9058060 - DNA, 22 bp, Homo sapiens
tgcaggtggacacgggagacgg

SEQ ID NO: 9058061 - DNA, 22 bp, Homo sapiens
tgcaggtggatatctcatcaga

SEQ ID NO: 9058062 - DNA, 22 bp, Homo sapiens
tgcaggtgattctgatgcagtt

SEQ ID NO: 9058063 - DNA, 22 bp, Homo sapiens
tgcaggtggctccagggactgc

SEQ ID NO: 9058064 - DNA, 22 bp, Homo sapiens
tgcaggtggattcaatgtggga

SEQ ID NO: 9058065 - DNA, 22 bp, Homo sapiens
tgcaggtggcagcggggcacca

SEQ ID NO: 9058066 - DNA, 22 bp, Homo sapiens
tgcaggtgagtgcaggggctca

SEQ ID NO: 9058067 - DNA, 22 bp, Homo sapiens
tgcaggtgaaaattatgaggat

SEQ ID NO: 9058068 - DNA, 22 bp, Homo sapiens
tgcaggtcatccctgtgcttct

SEQ ID NO: 9058069 - DNA, 22 bp, Homo sapiens
tgcaggtacttgacaacttggg

SEQ ID NO: 9058070 - DNA, 22 bp, Homo sapiens
tgcagggtgtccggaggatcac

SEQ ID NO: 9058071 - DNA, 23 bp, Homo sapiens
tgcaggggaggcttaaagcaggt

SEQ ID NO: 9058072 - DNA, 22 bp, Homo sapiens
tgcagggtggagcggaagcgga

SEQ ID NO: 9058073 - DNA, 22 bp, Homo sapiens
tgcagggtagatgcaggctgtg

SEQ ID NO: 9058074 - DNA, 23 bp, Homo sapiens
tgcaggggaggcttaaagcaggt

SEQ ID NO: 9058075 - DNA, 22 bp, Homo sapiens
tgcagggtagacaggtgaggtc

SEQ ID NO: 9058076 - DNA, 22 bp, Homo sapiens
tgcaggggcttgtctgggcctg

SEQ ID NO: 9058077 - DNA, 22 bp, Homo sapiens
tgcaggtgtggttcctcagcca

SEQ ID NO: 9058078 - DNA, 22 bp, Homo sapiens
tgcaggtgtctgggggcaacag

SEQ ID NO: 9058079 - DNA, 22 bp, Homo sapiens
tgcaggtgtgggcaggggagca

SEQ ID NO: 9058080 - DNA, 22 bp, Homo sapiens
tgcaggtgtctccagggcaggt

SEQ ID NO: 9058081 - DNA, 22 bp, Homo sapiens
tgcaggtggtccttcctctgct

SEQ ID NO: 9058082 - DNA, 20 bp, Homo sapiens
tgcaggtgggcccttctggg

SEQ ID NO: 9058083 - DNA, 22 bp, Homo sapiens
tgcagtctccacctcctgggtg

SEQ ID NO: 9058084 - DNA, 23 bp, Homo sapiens
tgcagtaggatggggctgggcct

SEQ ID NO: 9058085 - DNA, 22 bp, Homo sapiens
tgcagtaaattcaggtacaact

SEQ ID NO: 9058086 - DNA, 20 bp, Homo sapiens
tgcaggtgttggagaaggta

SEQ ID NO: 9058087 - DNA, 22 bp, Homo sapiens
tgcaggtgtgtgcaagggaggg

SEQ ID NO: 9058088 - DNA, 22 bp, Homo sapiens
tgccgtggggctgaggctggag

SEQ ID NO: 9058089 - DNA, 22 bp, Homo sapiens
tgccgcagtgcggggagggccc

SEQ ID NO: 9058090 - DNA, 22 bp, Homo sapiens
tgccgctccaggtctcgcggtg

SEQ ID NO: 9058091 - DNA, 22 bp, Homo sapiens
tgcctattcaatatatgcattt

SEQ ID NO: 9058092 - DNA, 23 bp, Homo sapiens
tgcctattcagcagagtgatagc

SEQ ID NO: 9058093 - DNA, 22 bp, Homo sapiens
tgcctagttctgtatttacagt

SEQ ID NO: 9058094 - DNA, 22 bp, Homo sapiens
tgccctgggaacacagatgcca

SEQ ID NO: 9058095 - DNA, 22 bp, Homo sapiens
tgccctggcttcagctttggct

SEQ ID NO: 9058096 - DNA, 22 bp, Homo sapiens
tgccctgggacatgcagcggag

SEQ ID NO: 9058097 - DNA, 22 bp, Homo sapiens
tgcccttgggtaacttgctgat

SEQ ID NO: 9058098 - DNA, 22 bp, Homo sapiens
tgcccttgaggacagctcccag

SEQ ID NO: 9058099 - DNA, 22 bp, Homo sapiens
tgccctggcattgggttggata

SEQ ID NO: 9058100 - DNA, 22 bp, Homo sapiens
tgccctggatgctgcaggtgtg

SEQ ID NO: 9058101 - DNA, 22 bp, Homo sapiens
tgccctggaaccatctacagtc

SEQ ID NO: 9058102 - DNA, 22 bp, Homo sapiens
tgccctggaggggcttacagtc

SEQ ID NO: 9058103 - DNA, 22 bp, Homo sapiens
tgccctcaagcaacagagagga

SEQ ID NO: 9058104 - DNA, 22 bp, Homo sapiens
tgccctatgaatttattattgg

SEQ ID NO: 9058105 - DNA, 22 bp, Homo sapiens
tgcccctctcctgtgatccaag

SEQ ID NO: 9058106 - DNA, 19 bp, Homo sapiens
tgcctggcaccagctccac

SEQ ID NO: 9058107 - DNA, 22 bp, Homo sapiens
tgcctggcacagagcaggtggc

SEQ ID NO: 9058108 - DNA, 22 bp, Homo sapiens
tgcctggcaccccagtctgcac

SEQ ID NO: 9058109 - DNA, 22 bp, Homo sapiens
tgcctggcaatgccagaagcca

SEQ ID NO: 9058110 - DNA, 22 bp, Homo sapiens
tgcctgcattttgtggctggct

SEQ ID NO: 9058111 - DNA, 22 bp, Homo sapiens
tgcctcaggcacctggcaggtt

SEQ ID NO: 9058112 - DNA, 22 bp, Homo sapiens
tgcctctgttgagccttggctg

SEQ ID NO: 9058113 - DNA, 22 bp, Homo sapiens
tgcctctgtgggccttcctggc

SEQ ID NO: 9058114 - DNA, 22 bp, Homo sapiens
tgccaggcccagctccagagct

SEQ ID NO: 9058115 - DNA, 22 bp, Homo sapiens
tgccagctcccttttctcctcc

SEQ ID NO: 9058116 - DNA, 22 bp, Homo sapiens
tgccagggctgctactggctga

SEQ ID NO: 9058117 - DNA, 22 bp, Homo sapiens
tgccagggccatagggagtcta

SEQ ID NO: 9058118 - DNA, 22 bp, Homo sapiens
tgccagggccatagggagtcta

SEQ ID NO: 9058119 - DNA, 22 bp, Homo sapiens
tgccagggtcagctgcagctct

SEQ ID NO: 9058120 - DNA, 22 bp, Homo sapiens
tgccaggggacctagggatgtc

SEQ ID NO: 9058121 - DNA, 22 bp, Homo sapiens
tgccagggtcctgagggccttg

SEQ ID NO: 9058122 - DNA, 22 bp, Homo sapiens
tgccagggtgtcaggagagcta

SEQ ID NO: 9058123 - DNA, 23 bp, Homo sapiens
tgccagggtttgtttgtggttca

SEQ ID NO: 9058124 - DNA, 22 bp, Homo sapiens
tgccagggtgtcaggagagcta

SEQ ID NO: 9058125 - DNA, 22 bp, Homo sapiens
tgccatcacctttctgaacgtt

SEQ ID NO: 9058126 - DNA, 22 bp, Homo sapiens
tgccatccaacagttccatctt

SEQ ID NO: 9058127 - DNA, 21 bp, Homo sapiens
tgccagggatttacagagcct

SEQ ID NO: 9058128 - DNA, 21 bp, Homo sapiens
tgccagggatttacagagcct

SEQ ID NO: 9058129 - DNA, 20 bp, Homo sapiens
tgccagggccagcagaggct

SEQ ID NO: 9058130 - DNA, 20 bp, Homo sapiens
tgccagggccagcagaggct

SEQ ID NO: 9058131 - DNA, 22 bp, Homo sapiens
tgcccctcagggaacgggtatc

SEQ ID NO: 9058132 - DNA, 22 bp, Homo sapiens
tgcccactggataatgcaaact

SEQ ID NO: 9058133 - DNA, 22 bp, Homo sapiens
tgccatttctcacatatgtatg

SEQ ID NO: 9058134 - DNA, 22 bp, Homo sapiens
tgccatttctttcaatattctt

SEQ ID NO: 9058135 - DNA, 19 bp, Homo sapiens
tgccatttgactgaatgta

SEQ ID NO: 9058136 - DNA, 22 bp, Homo sapiens
tgccatttttgctgggaattta

SEQ ID NO: 9058137 - DNA, 22 bp, Homo sapiens
tgcacttttatatcactctggc

SEQ ID NO: 9058138 - DNA, 21 bp, Homo sapiens
tgcactttgggggacaggctg

SEQ ID NO: 9058139 - DNA, 22 bp, Homo sapiens
tgcacgtgggctctctgctctt

SEQ ID NO: 9058140 - DNA, 22 bp, Homo sapiens
tgcagaagtgagtcatgaggaa

SEQ ID NO: 9058141 - DNA, 22 bp, Homo sapiens
tgcagaagatggtctgagcacc

SEQ ID NO: 9058142 - DNA, 22 bp, Homo sapiens
tgcagaagaccttccagggctg

SEQ ID NO: 9058143 - DNA, 22 bp, Homo sapiens
tgcagaagaatgagcttggagt

SEQ ID NO: 9058144 - DNA, 20 bp, Homo sapiens
tgcagaagaacgttctggtt

SEQ ID NO: 9058145 - DNA, 22 bp, Homo sapiens
tgcagattcaaatgaaatgcaa

SEQ ID NO: 9058146 - DNA, 18 bp, Homo sapiens
tgcagcaagtgctaaata

SEQ ID NO: 9058147 - DNA, 22 bp, Homo sapiens
tgcagcaagtaaccatcttcct

SEQ ID NO: 9058148 - DNA, 22 bp, Homo sapiens
tgcagcaacaagatagaatggc

SEQ ID NO: 9058149 - DNA, 22 bp, Homo sapiens
tgcagagtcctctggagggact

SEQ ID NO: 9058150 - DNA, 19 bp, Homo sapiens
tgcagagggtaggaaggcc

SEQ ID NO: 9058151 - DNA, 22 bp, Homo sapiens
tgcagagtgggagaggtgcggg

SEQ ID NO: 9058152 - DNA, 22 bp, Homo sapiens
tgcagatattctcccaagtgtt

SEQ ID NO: 9058153 - DNA, 21 bp, Homo sapiens
tgcagataattgaaagctgac

SEQ ID NO: 9058154 - DNA, 22 bp, Homo sapiens
tgcagagggaaaaggtgctcct

SEQ ID NO: 9058155 - DNA, 22 bp, Homo sapiens
tgcagagatctgggcgtcggct

SEQ ID NO: 9058156 - DNA, 22 bp, Homo sapiens
tgcagagaaaactcctgggtac

SEQ ID NO: 9058157 - DNA, 22 bp, Homo sapiens
tgcagagaaaactcctgggtac

SEQ ID NO: 9058158 - DNA, 22 bp, Homo sapiens
tgcagaattatggtgctggctt

SEQ ID NO: 9058159 - DNA, 22 bp, Homo sapiens
tgcagaatgtggacagtgggtt

SEQ ID NO: 9058160 - DNA, 23 bp, Homo sapiens
tgcagaggcatgatcactgctca

SEQ ID NO: 9058161 - DNA, 22 bp, Homo sapiens
tgcagaggcgccgtgggtgggg

SEQ ID NO: 9058162 - DNA, 22 bp, Homo sapiens
tgcagaggagtcagcctgggca

SEQ ID NO: 9058163 - DNA, 22 bp, Homo sapiens
tgcagaggagctggaaggctgg

SEQ ID NO: 9058164 - DNA, 19 bp, Homo sapiens
tgcagctgtctctatatta

SEQ ID NO: 9058165 - DNA, 22 bp, Homo sapiens
tgcagctgtaacagaggcctca

SEQ ID NO: 9058166 - DNA, 22 bp, Homo sapiens
tgcaggagaaagtacggagcgt

SEQ ID NO: 9058167 - DNA, 22 bp, Homo sapiens
tgcaggaactgggagggatagt

SEQ ID NO: 9058168 - DNA, 22 bp, Homo sapiens
tgcaggagagtgagtcagtagg

SEQ ID NO: 9058169 - DNA, 22 bp, Homo sapiens
tgcaggagataatggtgcttag

SEQ ID NO: 9058170 - DNA, 22 bp, Homo sapiens
tgcaggagagctggtctggccc

SEQ ID NO: 9058171 - DNA, 22 bp, Homo sapiens
tgcaggagcagagatggctgga

SEQ ID NO: 9058172 - DNA, 22 bp, Homo sapiens
tgcaggaggattttgtggagct

SEQ ID NO: 9058173 - DNA, 22 bp, Homo sapiens
tgcaggagtccaatcaggagac

SEQ ID NO: 9058174 - DNA, 22 bp, Homo sapiens
tgcaggagctgctgtcctgctc

SEQ ID NO: 9058175 - DNA, 19 bp, Homo sapiens
tgcaggaggactgagcaga

SEQ ID NO: 9058176 - DNA, 22 bp, Homo sapiens
tgcaggagcccttgggctctgg

SEQ ID NO: 9058177 - DNA, 21 bp, Homo sapiens
tgcaggctacttctgactcta

SEQ ID NO: 9058178 - DNA, 22 bp, Homo sapiens
tgcaggcaccattctgcctctc

SEQ ID NO: 9058179 - DNA, 21 bp, Homo sapiens
tgcaggagtgtaatgtgaccc

SEQ ID NO: 9058180 - DNA, 23 bp, Homo sapiens
tgcagctcaaagatgggtaaatg

SEQ ID NO: 9058181 - DNA, 21 bp, Homo sapiens
tgcagctgacaccctttggga

SEQ ID NO: 9058182 - DNA, 22 bp, Homo sapiens
tgcagctgcttgattcatcttg

SEQ ID NO: 9058183 - DNA, 22 bp, Homo sapiens
tgcagctggatttatcttttcc

SEQ ID NO: 9058184 - DNA, 22 bp, Homo sapiens
tgcagctgggtctgccctggct

SEQ ID NO: 9058185 - DNA, 22 bp, Homo sapiens
tgcagctgggtctgccctggct

SEQ ID NO: 9058186 - DNA, 21 bp, Homo sapiens
tgcagctgggttctggtttgc

SEQ ID NO: 9058187 - DNA, 22 bp, Homo sapiens
tgcagccatttgaaaagcagtt

SEQ ID NO: 9058188 - DNA, 23 bp, Homo sapiens
tgcagccactcaggagctcagtg

SEQ ID NO: 9058189 - DNA, 22 bp, Homo sapiens
tgcagcagagtgggcctgggtg

SEQ ID NO: 9058190 - DNA, 22 bp, Homo sapiens
tgattcaattatctgatgcttt

SEQ ID NO: 9058191 - DNA, 22 bp, Homo sapiens
tgatgtctctctatactctaac

SEQ ID NO: 9058192 - DNA, 22 bp, Homo sapiens
tgattctgccacgtactggctg

SEQ ID NO: 9058193 - DNA, 20 bp, Homo sapiens
tgattctggtctacgcttta

SEQ ID NO: 9058194 - DNA, 22 bp, Homo sapiens
tgattctgccccttggctctgg

SEQ ID NO: 9058195 - DNA, 22 bp, Homo sapiens
tgattctgagggagcattctgc

SEQ ID NO: 9058196 - DNA, 22 bp, Homo sapiens
tgatttaaaagaaacattgtct

SEQ ID NO: 9058197 - DNA, 22 bp, Homo sapiens
tgattgtttcctatgtacacct

SEQ ID NO: 9058198 - DNA, 22 bp, Homo sapiens
tgattctttggagagctatata

SEQ ID NO: 9058199 - DNA, 23 bp, Homo sapiens
tgatgctgctttcttgaagtatg

SEQ ID NO: 9058200 - DNA, 22 bp, Homo sapiens
tgatgctgttccagttatattg

SEQ ID NO: 9058201 - DNA, 22 bp, Homo sapiens
tgatgctgtgtacctcatggga

SEQ ID NO: 9058202 - DNA, 22 bp, Homo sapiens
tgatgcaatgtttacatcttga

SEQ ID NO: 9058203 - DNA, 22 bp, Homo sapiens
tgatgcaatagagagatagata

SEQ ID NO: 9058204 - DNA, 22 bp, Homo sapiens
tgatgagtttactcttttctaa

SEQ ID NO: 9058205 - DNA, 22 bp, Homo sapiens
tgatgagtaaataaggttgagt

SEQ ID NO: 9058206 - DNA, 22 bp, Homo sapiens
tgatggaagagctaacaatatc

SEQ ID NO: 9058207 - DNA, 22 bp, Homo sapiens
tgatggaaataaaagcatagct

SEQ ID NO: 9058208 - DNA, 22 bp, Homo sapiens
tgatgctttaagattaatctgg

SEQ ID NO: 9058209 - DNA, 22 bp, Homo sapiens
tgatcagcatcttcccagctcg

SEQ ID NO: 9058210 - DNA, 22 bp, Homo sapiens
tgatatttttcactggcctctg

SEQ ID NO: 9058211 - DNA, 22 bp, Homo sapiens
tgatcacaagtctgaagaatga

SEQ ID NO: 9058212 - DNA, 22 bp, Homo sapiens
tgatcccaatctttcctgctcc

SEQ ID NO: 9058213 - DNA, 20 bp, Homo sapiens
tgatatttctggaagtggag

SEQ ID NO: 9058214 - DNA, 22 bp, Homo sapiens
tgatatggaaggaagatgtaca

SEQ ID NO: 9058215 - DNA, 22 bp, Homo sapiens
tgatatggaaggaagatgtaca

SEQ ID NO: 9058216 - DNA, 22 bp, Homo sapiens
tgatatggctaaagaaagtttc

SEQ ID NO: 9058217 - DNA, 22 bp, Homo sapiens
tgatatgtccctcgacatcagg

SEQ ID NO: 9058218 - DNA, 22 bp, Homo sapiens
tgatagaaaatgctgtcaagct

SEQ ID NO: 9058219 - DNA, 17 bp, Homo sapiens
tgatagttcattttaag

SEQ ID NO: 9058220 - DNA, 22 bp, Homo sapiens
tgatacttttcttttagactaa

SEQ ID NO: 9058221 - DNA, 22 bp, Homo sapiens
tgagtgggacctgcgtgtgtca

SEQ ID NO: 9058222 - DNA, 19 bp, Homo sapiens
tgagtgggagcccaggtat

SEQ ID NO: 9058223 - DNA, 22 bp, Homo sapiens
tgagtgggatgagttagaggtg

SEQ ID NO: 9058224 - DNA, 16 bp, Homo sapiens
tgagtgggagaagggg

SEQ ID NO: 9058225 - DNA, 22 bp, Homo sapiens
tgagtgtatatgaaggttgtaa

SEQ ID NO: 9058226 - DNA, 22 bp, Homo sapiens
tgagtgggttatcaggaaaggt

SEQ ID NO: 9058227 - DNA, 19 bp, Homo sapiens
tgagtgggcccctgcagac

SEQ ID NO: 9058228 - DNA, 22 bp, Homo sapiens
tgagtgggattaaatgaggtga

SEQ ID NO: 9058229 - DNA, 22 bp, Homo sapiens
tgatttacaattgtaaaagttt

SEQ ID NO: 9058230 - DNA, 22 bp, Homo sapiens
tgatttaaaagaaacattgtct

SEQ ID NO: 9058231 - DNA, 22 bp, Homo sapiens
tgatttatgaccaagttagaat

SEQ ID NO: 9058232 - DNA, 22 bp, Homo sapiens
tgcaaaaacagccttgaggcct

SEQ ID NO: 9058233 - DNA, 22 bp, Homo sapiens
tgcaaaaattgctggaatcttt

SEQ ID NO: 9058234 - DNA, 22 bp, Homo sapiens
tgcaaaaactgcaattgctttt

SEQ ID NO: 9058235 - DNA, 22 bp, Homo sapiens
tgcaaaaagagcgaggagccct

SEQ ID NO: 9058236 - DNA, 22 bp, Homo sapiens
tgcaaaaaggcagactggtgat

SEQ ID NO: 9058237 - DNA, 22 bp, Homo sapiens
tgcaaatatttccttatagcca

SEQ ID NO: 9058238 - DNA, 22 bp, Homo sapiens
tgcaaagaagccacagtcccag

SEQ ID NO: 9058239 - DNA, 22 bp, Homo sapiens
tgcaaagaagcaacatccttgt

SEQ ID NO: 9058240 - DNA, 22 bp, Homo sapiens
tgcaaagaagcctttgccttct

SEQ ID NO: 9058241 - DNA, 22 bp, Homo sapiens
tgcaaagaagggctgaggagca

SEQ ID NO: 9058242 - DNA, 22 bp, Homo sapiens
tgcaaagaaggggaggaggatt

SEQ ID NO: 9058243 - DNA, 23 bp, Homo sapiens
tgcaaagatttaatgcaggggca

SEQ ID NO: 9058244 - DNA, 22 bp, Homo sapiens
tgcaaagatttatctttctcca

SEQ ID NO: 9058245 - DNA, 22 bp, Homo sapiens
tgcaaagaaggggaggaggatt

SEQ ID NO: 9058246 - DNA, 22 bp, Homo sapiens
tgcaaagatatgagaagctgta

SEQ ID NO: 9058247 - DNA, 22 bp, Homo sapiens
tgcaaagatgaaatattaaagg

SEQ ID NO: 9058248 - DNA, 22 bp, Homo sapiens
tgcaaattgcgatttttattag

SEQ ID NO: 9058249 - DNA, 22 bp, Homo sapiens
tgcaaatgggaaacccagcagt

SEQ ID NO: 9058250 - DNA, 22 bp, Homo sapiens
tgcaaaatgacttctgaaaaga

SEQ ID NO: 9058251 - DNA, 17 bp, Homo sapiens
tgcaaacaatcacatat

SEQ ID NO: 9058252 - DNA, 22 bp, Homo sapiens
tgcaaacagaaagtttattgtg

SEQ ID NO: 9058253 - DNA, 22 bp, Homo sapiens
tgcaaagaaaacactgcaagac

SEQ ID NO: 9058254 - DNA, 23 bp, Homo sapiens
tgcaaagaaatctgggtcattgt

SEQ ID NO: 9058255 - DNA, 22 bp, Homo sapiens
tgcaaagaactaagcagcctta

SEQ ID NO: 9058256 - DNA, 22 bp, Homo sapiens
tgcaaatttctttagtacataa

SEQ ID NO: 9058257 - DNA, 23 bp, Homo sapiens
tgcaacaatgaggaaagctactg

SEQ ID NO: 9058258 - DNA, 21 bp, Homo sapiens
tgcaagaatcaggaagctgcc

SEQ ID NO: 9058259 - DNA, 22 bp, Homo sapiens
tgcaaggcagcaccagctcttg

SEQ ID NO: 9058260 - DNA, 22 bp, Homo sapiens
tgcaatccccgcctcaacagga

SEQ ID NO: 9058261 - DNA, 22 bp, Homo sapiens
tgcacaaacacagagaatagat

SEQ ID NO: 9058262 - DNA, 22 bp, Homo sapiens
tgcacaaatttgtgtatgctca

SEQ ID NO: 9058263 - DNA, 23 bp, Homo sapiens
tgagacactcattcatggagtat

SEQ ID NO: 9058264 - DNA, 22 bp, Homo sapiens
tgagacaataaggctgagaagc

SEQ ID NO: 9058265 - DNA, 22 bp, Homo sapiens
tgagacaacctaattaaacacc

SEQ ID NO: 9058266 - DNA, 22 bp, Homo sapiens
tgagacaacctaattaaacacc

SEQ ID NO: 9058267 - DNA, 22 bp, Homo sapiens
tgagacactctcgggcacattt

SEQ ID NO: 9058268 - DNA, 22 bp, Homo sapiens
tgagacaaaattgacagacaaa

SEQ ID NO: 9058269 - DNA, 22 bp, Homo sapiens
tgagaagattgggcagagtgga

SEQ ID NO: 9058270 - DNA, 22 bp, Homo sapiens
tgagaagcccacactctttcct

SEQ ID NO: 9058271 - DNA, 22 bp, Homo sapiens
tgagaacggatactaagggctg

SEQ ID NO: 9058272 - DNA, 20 bp, Homo sapiens
tgagaaagtagagactcagg

SEQ ID NO: 9058273 - DNA, 22 bp, Homo sapiens
tgagaaaggtatttcatgcact

SEQ ID NO: 9058274 - DNA, 22 bp, Homo sapiens
tgagaaacatatgagagatttg

SEQ ID NO: 9058275 - DNA, 22 bp, Homo sapiens
tgagaaagacagacattcctaa

SEQ ID NO: 9058276 - DNA, 22 bp, Homo sapiens
tgactttaaaataacaagttta

SEQ ID NO: 9058277 - DNA, 18 bp, Homo sapiens
tgagagcattcgaggcaa

SEQ ID NO: 9058278 - DNA, 22 bp, Homo sapiens
tgagagcagaggtgggcagcct

SEQ ID NO: 9058279 - DNA, 22 bp, Homo sapiens
tgagagaaacgttccttacatc

SEQ ID NO: 9058280 - DNA, 22 bp, Homo sapiens
tgagagacacactgtgcatgta

SEQ ID NO: 9058281 - DNA, 20 bp, Homo sapiens
tgagagctgggcagggatac

SEQ ID NO: 9058282 - DNA, 22 bp, Homo sapiens
tgagaggaacaggcagtaggtt

SEQ ID NO: 9058283 - DNA, 22 bp, Homo sapiens
tgagatgtaaggtatgcttact

SEQ ID NO: 9058284 - DNA, 22 bp, Homo sapiens
tgagataataaatagctttctt

SEQ ID NO: 9058285 - DNA, 22 bp, Homo sapiens
tgagataattaaatcaaaacct

SEQ ID NO: 9058286 - DNA, 22 bp, Homo sapiens
tgagatgaataactcctgctaa

SEQ ID NO: 9058287 - DNA, 22 bp, Homo sapiens
tgagatggaaggtgaggcagta

SEQ ID NO: 9058288 - DNA, 22 bp, Homo sapiens
tgagcagagttgtttctcctga

SEQ ID NO: 9058289 - DNA, 22 bp, Homo sapiens
tgagcattggatcaaatgactt

SEQ ID NO: 9058290 - DNA, 22 bp, Homo sapiens
tgagctgcttcttataatgtgt

SEQ ID NO: 9058291 - DNA, 19 bp, Homo sapiens
tgagctgctgctgcccatc

SEQ ID NO: 9058292 - DNA, 18 bp, Homo sapiens
tgagctgctctgtgaaga

SEQ ID NO: 9058293 - DNA, 22 bp, Homo sapiens
tgagctgcattacagcctctgt

SEQ ID NO: 9058294 - DNA, 22 bp, Homo sapiens
tgagctgcattctctttatcat

SEQ ID NO: 9058295 - DNA, 22 bp, Homo sapiens
tgagctgccccctggcctgctc

SEQ ID NO: 9058296 - DNA, 19 bp, Homo sapiens
tgagctgccgtcttccctg

SEQ ID NO: 9058297 - DNA, 22 bp, Homo sapiens
tgagctgccccctggcctgctc

SEQ ID NO: 9058298 - DNA, 22 bp, Homo sapiens
tgagctgctagatgatttatga

SEQ ID NO: 9058299 - DNA, 22 bp, Homo sapiens
tgagctgctctaatctcgcctt

SEQ ID NO: 9058300 - DNA, 22 bp, Homo sapiens
tgagctgcagtgagctgagatg

SEQ ID NO: 9058301 - DNA, 22 bp, Homo sapiens
tgagctgcaagaaaatttcagt

SEQ ID NO: 9058302 - DNA, 22 bp, Homo sapiens
tgagctgatggcatccctgttt

SEQ ID NO: 9058303 - DNA, 22 bp, Homo sapiens
tgagctgcagagatctttgata

SEQ ID NO: 9058304 - DNA, 22 bp, Homo sapiens
tgagctgagtttaaaagctgct

SEQ ID NO: 9058305 - DNA, 23 bp, Homo sapiens
tgagctgagtgagttggcctggg

SEQ ID NO: 9058306 - DNA, 22 bp, Homo sapiens
tgagctgacacccaatcatact

SEQ ID NO: 9058307 - DNA, 22 bp, Homo sapiens
tgagctgacacccaatcatact

SEQ ID NO: 9058308 - DNA, 22 bp, Homo sapiens
tgaggaaaatgtcttatagatt

SEQ ID NO: 9058309 - DNA, 22 bp, Homo sapiens
tgagctcatagctcttattatg

SEQ ID NO: 9058310 - DNA, 22 bp, Homo sapiens
tgagctaagtactctcatcaag

SEQ ID NO: 9058311 - DNA, 22 bp, Homo sapiens
tgaggagcttctggaaagtgca

SEQ ID NO: 9058312 - DNA, 22 bp, Homo sapiens
tgaggatggtcccgaggacact

SEQ ID NO: 9058313 - DNA, 22 bp, Homo sapiens
tgaggatgacgatggcaatggc

SEQ ID NO: 9058314 - DNA, 22 bp, Homo sapiens
tgaggatggtgttggagagggc

SEQ ID NO: 9058315 - DNA, 21 bp, Homo sapiens
tgaggatgtgcagcagcagga

SEQ ID NO: 9058316 - DNA, 22 bp, Homo sapiens
tgaggcagctttttctgtgtgt

SEQ ID NO: 9058317 - DNA, 22 bp, Homo sapiens
tgaggcaggactgagcgggatg

SEQ ID NO: 9058318 - DNA, 22 bp, Homo sapiens
tgaggcaggaggttgagaactg

SEQ ID NO: 9058319 - DNA, 22 bp, Homo sapiens
tgaggcctcataatgagatttc

SEQ ID NO: 9058320 - DNA, 22 bp, Homo sapiens
tgagggtgcatttagcatgtag

SEQ ID NO: 9058321 - DNA, 22 bp, Homo sapiens
tgaggggggtaatcactgggtt

SEQ ID NO: 9058322 - DNA, 22 bp, Homo sapiens
tgaggggcggcctgcagaggcc

SEQ ID NO: 9058323 - DNA, 22 bp, Homo sapiens
tgagggtggccttgtgtggact

SEQ ID NO: 9058324 - DNA, 22 bp, Homo sapiens
tgaggtaataagtgtttgtttt

SEQ ID NO: 9058325 - DNA, 22 bp, Homo sapiens
tgaggtaatgtgtacgttaatt

SEQ ID NO: 9058326 - DNA, 22 bp, Homo sapiens
tgaggtctgcagggctgtgcat

SEQ ID NO: 9058327 - DNA, 22 bp, Homo sapiens
tgagtagagaattcagctaagg

SEQ ID NO: 9058328 - DNA, 22 bp, Homo sapiens
tgagtagacgtgatctagtaac

SEQ ID NO: 9058329 - DNA, 22 bp, Homo sapiens
tgagtctgggcatgttcacttt

SEQ ID NO: 9058330 - DNA, 22 bp, Homo sapiens
tgaggtggttactgtggtgctc

SEQ ID NO: 9058331 - DNA, 22 bp, Homo sapiens
tgaggtgggtgtcaggtcagag

SEQ ID NO: 9058332 - DNA, 22 bp, Homo sapiens
tgaggtggccgaggagcaggac

SEQ ID NO: 9058333 - DNA, 22 bp, Homo sapiens
tgaggtggctagggaggcactc

SEQ ID NO: 9058334 - DNA, 22 bp, Homo sapiens
tgaggggagacagagtggactc

SEQ ID NO: 9058335 - DNA, 22 bp, Homo sapiens
tgaggggaggttggggcacatc

SEQ ID NO: 9058336 - DNA, 22 bp, Homo sapiens
tgagggagcacacactgaagtg

SEQ ID NO: 9058337 - DNA, 22 bp, Homo sapiens
tgaggctcttcctcccctgctc

SEQ ID NO: 9058338 - DNA, 22 bp, Homo sapiens
tgaggctctgcttctgtggctc

SEQ ID NO: 9058339 - DNA, 22 bp, Homo sapiens
tgaggctcattctgcatgccaa

SEQ ID NO: 9058340 - DNA, 18 bp, Homo sapiens
tgaggctcagctcctggt

SEQ ID NO: 9058341 - DNA, 22 bp, Homo sapiens
tgaggctcagtgagccctgcag

SEQ ID NO: 9058342 - DNA, 22 bp, Homo sapiens
tgaggctcagaagtgccaagtg

SEQ ID NO: 9058343 - DNA, 22 bp, Homo sapiens
tgaggctcagagaagtgctgtt

SEQ ID NO: 9058344 - DNA, 23 bp, Homo sapiens
tgaaagcaatgggtctatagtat

SEQ ID NO: 9058345 - DNA, 22 bp, Homo sapiens
tgaaatacacaaatttagtaag

SEQ ID NO: 9058346 - DNA, 22 bp, Homo sapiens
tgaaatcatctgccaataagtt

SEQ ID NO: 9058347 - DNA, 22 bp, Homo sapiens
tgaaatggaattaatttgtatt

SEQ ID NO: 9058348 - DNA, 22 bp, Homo sapiens
tgaaatgttgccatgaggtctc

SEQ ID NO: 9058349 - DNA, 22 bp, Homo sapiens
tgaagcaggcattgactgatga

SEQ ID NO: 9058350 - DNA, 20 bp, Homo sapiens
tgaagattttgtgtttagaa

SEQ ID NO: 9058351 - DNA, 22 bp, Homo sapiens
tgaagaaacagaccaagaggat

SEQ ID NO: 9058352 - DNA, 22 bp, Homo sapiens
tgaagaaacagaccaagaggat

SEQ ID NO: 9058353 - DNA, 22 bp, Homo sapiens
tgaagaaacgcagagaggtagg

SEQ ID NO: 9058354 - DNA, 22 bp, Homo sapiens
tgaagactttgctcttaaccac

SEQ ID NO: 9058355 - DNA, 18 bp, Homo sapiens
tgaaattgcatccatgag

SEQ ID NO: 9058356 - DNA, 22 bp, Homo sapiens
tgaaattccaggagagttaaaa

SEQ ID NO: 9058357 - DNA, 22 bp, Homo sapiens
tgaacaaatggaaataaccagt

SEQ ID NO: 9058358 - DNA, 22 bp, Homo sapiens
tgaactgtggccagtaattaat

SEQ ID NO: 9058359 - DNA, 22 bp, Homo sapiens
tgaacattcctgaatgaagcat

SEQ ID NO: 9058360 - DNA, 19 bp, Homo sapiens
tgaaacaaacttaaaagga

SEQ ID NO: 9058361 - DNA, 22 bp, Homo sapiens
tgaaacaaaattaagattctcg

SEQ ID NO: 9058362 - DNA, 22 bp, Homo sapiens
tgaaacaggatgcagaggagga

SEQ ID NO: 9058363 - DNA, 22 bp, Homo sapiens
tgaaagaactagcatcttcaag

SEQ ID NO: 9058364 - DNA, 22 bp, Homo sapiens
tgaaactgaaaggtatttatag

SEQ ID NO: 9058365 - DNA, 17 bp, Homo sapiens
tgaaagaatcagggaga

SEQ ID NO: 9058366 - DNA, 22 bp, Homo sapiens
tgaaagaagtgtcacattgcca

SEQ ID NO: 9058367 - DNA, 22 bp, Homo sapiens
tgaaagaagtgtcacattgcca

SEQ ID NO: 9058368 - DNA, 22 bp, Homo sapiens
tgaaagaactagcatcttcaag

SEQ ID NO: 9058369 - DNA, 22 bp, Homo sapiens
tgaaagaagggtggaaaatgta

SEQ ID NO: 9058370 - DNA, 22 bp, Homo sapiens
tgaaaaactttaatccataaag

SEQ ID NO: 9058371 - DNA, 22 bp, Homo sapiens
tgaaaatggcctgaagaagcaa

SEQ ID NO: 9058372 - DNA, 22 bp, Homo sapiens
tcttttccttccctacagatct

SEQ ID NO: 9058373 - DNA, 22 bp, Homo sapiens
tcttttaacctaactagcttgg

SEQ ID NO: 9058374 - DNA, 22 bp, Homo sapiens
tctttgttattgctttatctat

SEQ ID NO: 9058375 - DNA, 20 bp, Homo sapiens
tctttgttaattttatctcc

SEQ ID NO: 9058376 - DNA, 23 bp, Homo sapiens
tgaattttggcatattctgaaat

SEQ ID NO: 9058377 - DNA, 23 bp, Homo sapiens
tgaattttggcatattctgaaat

SEQ ID NO: 9058378 - DNA, 22 bp, Homo sapiens
tgacaaaccctgcaaatagctc

SEQ ID NO: 9058379 - DNA, 22 bp, Homo sapiens
tgacaaagaccttcaacaagat

SEQ ID NO: 9058380 - DNA, 22 bp, Homo sapiens
tgaatgaatgaattaatagagt

SEQ ID NO: 9058381 - DNA, 22 bp, Homo sapiens
tgaatgagtcaatcatttagct

SEQ ID NO: 9058382 - DNA, 22 bp, Homo sapiens
tgaatgctttggagccttctaa

SEQ ID NO: 9058383 - DNA, 21 bp, Homo sapiens
tgaatgcttcgtcatcctggc

SEQ ID NO: 9058384 - DNA, 22 bp, Homo sapiens
tgaatgcttggagtcataaaat

SEQ ID NO: 9058385 - DNA, 22 bp, Homo sapiens
tgaatgtgatgctaaacatatg

SEQ ID NO: 9058386 - DNA, 22 bp, Homo sapiens
tgaatgtgatgctaaacatatg

SEQ ID NO: 9058387 - DNA, 22 bp, Homo sapiens
tgaatgtttgatgagaaataga

SEQ ID NO: 9058388 - DNA, 19 bp, Homo sapiens
tgaatacagagatacagaa

SEQ ID NO: 9058389 - DNA, 23 bp, Homo sapiens
tgaaggtattacctgagatgctc

SEQ ID NO: 9058390 - DNA, 22 bp, Homo sapiens
tgaaggtaaaggaaggaggctt

SEQ ID NO: 9058391 - DNA, 22 bp, Homo sapiens
tgaaggctgtcacctgcacctt

SEQ ID NO: 9058392 - DNA, 22 bp, Homo sapiens
tgaaggcttggtggcagcctct

SEQ ID NO: 9058393 - DNA, 22 bp, Homo sapiens
tgaagctagcaggaagagcagg

SEQ ID NO: 9058394 - DNA, 22 bp, Homo sapiens
tgaagccctgtcttatggaaga

SEQ ID NO: 9058395 - DNA, 22 bp, Homo sapiens
tgaagccagggactgacacttc

SEQ ID NO: 9058396 - DNA, 22 bp, Homo sapiens
tgaagcagttctcagaagtggg

SEQ ID NO: 9058397 - DNA, 22 bp, Homo sapiens
tgaaggaggaatgtggcctcca

SEQ ID NO: 9058398 - DNA, 22 bp, Homo sapiens
tgaaggagctgatgtaaggggt

SEQ ID NO: 9058399 - DNA, 22 bp, Homo sapiens
tgaaggagggaagaaggctctg

SEQ ID NO: 9058400 - DNA, 19 bp, Homo sapiens
tgaaggagggggatggcca

SEQ ID NO: 9058401 - DNA, 22 bp, Homo sapiens
tgaagctggaagttaggtagac

SEQ ID NO: 9058402 - DNA, 22 bp, Homo sapiens
tgaagctgtccttgataggggc

SEQ ID NO: 9058403 - DNA, 22 bp, Homo sapiens
tgaagctgtgggcagtggagcc

SEQ ID NO: 9058404 - DNA, 22 bp, Homo sapiens
tgaagctgtaggcatgggcagc

SEQ ID NO: 9058405 - DNA, 22 bp, Homo sapiens
tgaaggagctcaggagatagtc

SEQ ID NO: 9058406 - DNA, 22 bp, Homo sapiens
tgaaggagctcaatgatgatgc

SEQ ID NO: 9058407 - DNA, 22 bp, Homo sapiens
tgaaggagatttttagggaggc

SEQ ID NO: 9058408 - DNA, 21 bp, Homo sapiens
tgaaggagaggaccgagtgct

SEQ ID NO: 9058409 - DNA, 22 bp, Homo sapiens
tgacacttgggctttgagaggt

SEQ ID NO: 9058410 - DNA, 22 bp, Homo sapiens
tgacacttggaagcttggcaac

SEQ ID NO: 9058411 - DNA, 22 bp, Homo sapiens
tgacacttgagagggacacgga

SEQ ID NO: 9058412 - DNA, 20 bp, Homo sapiens
tgacacttgatattgtcagt

SEQ ID NO: 9058413 - DNA, 22 bp, Homo sapiens
tgacacttctgaaacggaagtt

SEQ ID NO: 9058414 - DNA, 22 bp, Homo sapiens
tgacacttctccatcaagtcaa

SEQ ID NO: 9058415 - DNA, 22 bp, Homo sapiens
tgacacttcaaagaccagggtc

SEQ ID NO: 9058416 - DNA, 22 bp, Homo sapiens
tgacacttccagttaaaaatat

SEQ ID NO: 9058417 - DNA, 22 bp, Homo sapiens
tgacacttccggtaaaaaatgc

SEQ ID NO: 9058418 - DNA, 22 bp, Homo sapiens
tgacactttgtgactctgagaa

SEQ ID NO: 9058419 - DNA, 22 bp, Homo sapiens
tgacagaacaggttgggagcaa

SEQ ID NO: 9058420 - DNA, 22 bp, Homo sapiens
tgacacagtgggggatcctttt

SEQ ID NO: 9058421 - DNA, 22 bp, Homo sapiens
tgacacattaaatgctcacaaa

SEQ ID NO: 9058422 - DNA, 22 bp, Homo sapiens
tgaccttatttggagacacagt

SEQ ID NO: 9058423 - DNA, 22 bp, Homo sapiens
tgacctgacatgaattaaaaac

SEQ ID NO: 9058424 - DNA, 22 bp, Homo sapiens
tgacctctgtcctgcagtctgg

SEQ ID NO: 9058425 - DNA, 22 bp, Homo sapiens
tgacggctgggggcagtggtca

SEQ ID NO: 9058426 - DNA, 22 bp, Homo sapiens
tgactaaacgcatgaatagctc

SEQ ID NO: 9058427 - DNA, 22 bp, Homo sapiens
tgactattttttatagattcca

SEQ ID NO: 9058428 - DNA, 22 bp, Homo sapiens
tgacttgtctctttgggagaca

SEQ ID NO: 9058429 - DNA, 22 bp, Homo sapiens
tgacttctgattgcttctattt

SEQ ID NO: 9058430 - DNA, 22 bp, Homo sapiens
tgactgaggcctgataacagtt

SEQ ID NO: 9058431 - DNA, 21 bp, Homo sapiens
tgactgaggcttcttcacaca

SEQ ID NO: 9058432 - DNA, 21 bp, Homo sapiens
tgactgaggcttcttcacaca

SEQ ID NO: 9058433 - DNA, 22 bp, Homo sapiens
tgacatttatcaaagaaatggt

SEQ ID NO: 9058434 - DNA, 21 bp, Homo sapiens
tgacatttccaatataaagcc

SEQ ID NO: 9058435 - DNA, 22 bp, Homo sapiens
tgacatttatcttctacaatga

SEQ ID NO: 9058436 - DNA, 22 bp, Homo sapiens
tgacatttaatccctaaatatt

SEQ ID NO: 9058437 - DNA, 22 bp, Homo sapiens
tgacattctgttaagtctcata

SEQ ID NO: 9058438 - DNA, 22 bp, Homo sapiens
tgacctattagatttccttgcc

SEQ ID NO: 9058439 - DNA, 22 bp, Homo sapiens
tgacatttgagcatacatgtaa

SEQ ID NO: 9058440 - DNA, 22 bp, Homo sapiens
tgacatttgagcatacatgtaa

SEQ ID NO: 9058441 - DNA, 22 bp, Homo sapiens
tgacatttgagagagatataca

SEQ ID NO: 9058442 - DNA, 22 bp, Homo sapiens
tggctgagccacttgttcagat

SEQ ID NO: 9058443 - DNA, 22 bp, Homo sapiens
tggctgaggagggtcttctggt

SEQ ID NO: 9058444 - DNA, 22 bp, Homo sapiens
tggctgcagatctgtgggacac

SEQ ID NO: 9058445 - DNA, 22 bp, Homo sapiens
tggctgcaggggtgtctgacat

SEQ ID NO: 9058446 - DNA, 22 bp, Homo sapiens
tggctgcagtgcttgagatgtc

SEQ ID NO: 9058447 - DNA, 22 bp, Homo sapiens
tggctgcagtgcttgagatgtc

SEQ ID NO: 9058448 - DNA, 22 bp, Homo sapiens
tggctgcagatcaagggcaggc

SEQ ID NO: 9058449 - DNA, 22 bp, Homo sapiens
tggctgcagatcaagggcaggc

SEQ ID NO: 9058450 - DNA, 22 bp, Homo sapiens
tggctgagtttcatgcatcatg

SEQ ID NO: 9058451 - DNA, 20 bp, Homo sapiens
tggctgcacaccaggacagg

SEQ ID NO: 9058452 - DNA, 21 bp, Homo sapiens
tggctcgatttatagcatttc

SEQ ID NO: 9058453 - DNA, 22 bp, Homo sapiens
tggctctcaatggctgtactat

SEQ ID NO: 9058454 - DNA, 20 bp, Homo sapiens
tggctctcaccctgtgcgat

SEQ ID NO: 9058455 - DNA, 22 bp, Homo sapiens
tggctctggagctggcggctga

SEQ ID NO: 9058456 - DNA, 22 bp, Homo sapiens
tggctccaccgccgcggagctc

SEQ ID NO: 9058457 - DNA, 22 bp, Homo sapiens
tggctcatggaattagctatta

SEQ ID NO: 9058458 - DNA, 22 bp, Homo sapiens
tggctcattctactctccctgg

SEQ ID NO: 9058459 - DNA, 22 bp, Homo sapiens
tggctcattctttagaatatac

SEQ ID NO: 9058460 - DNA, 22 bp, Homo sapiens
tggctcagcaagacattgacct

SEQ ID NO: 9058461 - DNA, 22 bp, Homo sapiens
tggctcagcaggttagaaacta

SEQ ID NO: 9058462 - DNA, 22 bp, Homo sapiens
tggctcaggcttgaaaatagat

SEQ ID NO: 9058463 - DNA, 22 bp, Homo sapiens
tggctcagtcatggatgagtaa

SEQ ID NO: 9058464 - DNA, 23 bp, Homo sapiens
tggctcagggtctcttatgaagt

SEQ ID NO: 9058465 - DNA, 22 bp, Homo sapiens
tggctcagtagcagtgtggtca

SEQ ID NO: 9058466 - DNA, 22 bp, Homo sapiens
tggctcagatttttgtaggctt

SEQ ID NO: 9058467 - DNA, 22 bp, Homo sapiens
tggctcagaactacttctagtt

SEQ ID NO: 9058468 - DNA, 22 bp, Homo sapiens
tggctcagaagaaaaggtaaac

SEQ ID NO: 9058469 - DNA, 20 bp, Homo sapiens
tggcggggatgagggagtta

SEQ ID NO: 9058470 - DNA, 22 bp, Homo sapiens
tggcgtctctcataagtatgtg

SEQ ID NO: 9058471 - DNA, 22 bp, Homo sapiens
tggctaacaaggtgaaaccccg

SEQ ID NO: 9058472 - DNA, 22 bp, Homo sapiens
tgggaatgggcctagaaggctg

SEQ ID NO: 9058473 - DNA, 22 bp, Homo sapiens
tgggaatagaacaagatagaga

SEQ ID NO: 9058474 - DNA, 22 bp, Homo sapiens
tgggacagtgtgccttgctcct

SEQ ID NO: 9058475 - DNA, 21 bp, Homo sapiens
tgggacagtgatggctcctcc

SEQ ID NO: 9058476 - DNA, 22 bp, Homo sapiens
tgggaagggtcaacagctggaa

SEQ ID NO: 9058477 - DNA, 22 bp, Homo sapiens
tgggagaagcagtgggacagta

SEQ ID NO: 9058478 - DNA, 22 bp, Homo sapiens
tgggagaagcatggggtgcaga

SEQ ID NO: 9058479 - DNA, 22 bp, Homo sapiens
tgggagaatcttgctctgctac

SEQ ID NO: 9058480 - DNA, 22 bp, Homo sapiens
tgggagaagcagcagccaagtg

SEQ ID NO: 9058481 - DNA, 22 bp, Homo sapiens
tgggagaacccagggtcaggct

SEQ ID NO: 9058482 - DNA, 21 bp, Homo sapiens
tgggagagggctcagctaccc

SEQ ID NO: 9058483 - DNA, 22 bp, Homo sapiens
tgggagaggctgccatcttgca

SEQ ID NO: 9058484 - DNA, 19 bp, Homo sapiens
tgggagaggcaacagagta

SEQ ID NO: 9058485 - DNA, 22 bp, Homo sapiens
tgggagagtgctcaatgtgcaa

SEQ ID NO: 9058486 - DNA, 22 bp, Homo sapiens
tgggaggagccctctgggaagg

SEQ ID NO: 9058487 - DNA, 22 bp, Homo sapiens
tgggagctggggttggacgtct

SEQ ID NO: 9058488 - DNA, 22 bp, Homo sapiens
tgggaggaagtgctaatgggag

SEQ ID NO: 9058489 - DNA, 22 bp, Homo sapiens
tggcttctcagaatactctgga

SEQ ID NO: 9058490 - DNA, 22 bp, Homo sapiens
tggcttctagagcccatccttc

SEQ ID NO: 9058491 - DNA, 22 bp, Homo sapiens
tggcttctgagtctcctgacat

SEQ ID NO: 9058492 - DNA, 18 bp, Homo sapiens
tggcttctgaacaactgc

SEQ ID NO: 9058493 - DNA, 20 bp, Homo sapiens
tggcttctcttcactcctgt

SEQ ID NO: 9058494 - DNA, 22 bp, Homo sapiens
tggcttctccagaaatcttggt

SEQ ID NO: 9058495 - DNA, 22 bp, Homo sapiens
tggcttctcccgacaccctggc

SEQ ID NO: 9058496 - DNA, 22 bp, Homo sapiens
tggcttctccctacaacatgcc

SEQ ID NO: 9058497 - DNA, 22 bp, Homo sapiens
tggcttctccctccccatctag

SEQ ID NO: 9058498 - DNA, 18 bp, Homo sapiens
tggcttctgctagctgga

SEQ ID NO: 9058499 - DNA, 22 bp, Homo sapiens
tggcttctgtccctgctacatt

SEQ ID NO: 9058500 - DNA, 22 bp, Homo sapiens
tgggaaaccatgtgtgtcactt

SEQ ID NO: 9058501 - DNA, 22 bp, Homo sapiens
tggcttcttgacttcttggctg

SEQ ID NO: 9058502 - DNA, 22 bp, Homo sapiens
tggctgtcagctgcctggtgcg

SEQ ID NO: 9058503 - DNA, 22 bp, Homo sapiens
tggcttcaagtctaggttctac

SEQ ID NO: 9058504 - DNA, 22 bp, Homo sapiens
tggctgtcagtcgcctgcattc

SEQ ID NO: 9058505 - DNA, 22 bp, Homo sapiens
tggcagagtctgggcttgggca

SEQ ID NO: 9058506 - DNA, 22 bp, Homo sapiens
tggcagagtcatcacatctgga

SEQ ID NO: 9058507 - DNA, 22 bp, Homo sapiens
tggcagcctgcgtgaaggagct

SEQ ID NO: 9058508 - DNA, 22 bp, Homo sapiens
tggcagctcccagagcttccaa

SEQ ID NO: 9058509 - DNA, 22 bp, Homo sapiens
tggcagctacagacagaggtga

SEQ ID NO: 9058510 - DNA, 22 bp, Homo sapiens
tggcagccttctctgagaaggt

SEQ ID NO: 9058511 - DNA, 21 bp, Homo sapiens
tggcaggcagctggaagcttg

SEQ ID NO: 9058512 - DNA, 22 bp, Homo sapiens
tggcagggagccaccggtcatg

SEQ ID NO: 9058513 - DNA, 18 bp, Homo sapiens
tggcagggaggaaatata

SEQ ID NO: 9058514 - DNA, 22 bp, Homo sapiens
tggcagggagttcgttcacaac

SEQ ID NO: 9058515 - DNA, 22 bp, Homo sapiens
tggcagggcctgctcatcatcc

SEQ ID NO: 9058516 - DNA, 22 bp, Homo sapiens
tggcagggagttgcaggatttc

SEQ ID NO: 9058517 - DNA, 17 bp, Homo sapiens
tggcagctgaaagctct

SEQ ID NO: 9058518 - DNA, 22 bp, Homo sapiens
tggcagctgaggggaggctttg

SEQ ID NO: 9058519 - DNA, 22 bp, Homo sapiens
tggattcacaccattctcctgc

SEQ ID NO: 9058520 - DNA, 19 bp, Homo sapiens
tggatttatattctttatc

SEQ ID NO: 9058521 - DNA, 22 bp, Homo sapiens
tggcacagcttgtcataaactc

SEQ ID NO: 9058522 - DNA, 22 bp, Homo sapiens
tggcagagaacacggctgatct

SEQ ID NO: 9058523 - DNA, 22 bp, Homo sapiens
tggcagagagactctccttgat

SEQ ID NO: 9058524 - DNA, 22 bp, Homo sapiens
tggcagagcccagactccagtc

SEQ ID NO: 9058525 - DNA, 22 bp, Homo sapiens
tggcagagagagtgcagtcgac

SEQ ID NO: 9058526 - DNA, 22 bp, Homo sapiens
tggcacttaatgcatgtgctat

SEQ ID NO: 9058527 - DNA, 22 bp, Homo sapiens
tggcagagaacacacatgattc

SEQ ID NO: 9058528 - DNA, 22 bp, Homo sapiens
tggcacttccgtctgccttgtg

SEQ ID NO: 9058529 - DNA, 22 bp, Homo sapiens
tggcacatggttaatcataatt

SEQ ID NO: 9058530 - DNA, 22 bp, Homo sapiens
tggcacatggtaagactcagta

SEQ ID NO: 9058531 - DNA, 22 bp, Homo sapiens
tggcccagctcagggtgggcgg

SEQ ID NO: 9058532 - DNA, 22 bp, Homo sapiens
tggccagtgattaatgacgctt

SEQ ID NO: 9058533 - DNA, 22 bp, Homo sapiens
tggcccaggaggccagagggca

SEQ ID NO: 9058534 - DNA, 22 bp, Homo sapiens
tggcccaggcgaggtgggcaga

SEQ ID NO: 9058535 - DNA, 22 bp, Homo sapiens
tggccctgacaggtcctgggca

SEQ ID NO: 9058536 - DNA, 22 bp, Homo sapiens
tggccctgtgtgcaggctgcac

SEQ ID NO: 9058537 - DNA, 20 bp, Homo sapiens
tggccctgttttctccaggc

SEQ ID NO: 9058538 - DNA, 22 bp, Homo sapiens
tggcctcttaggacatcctcta

SEQ ID NO: 9058539 - DNA, 22 bp, Homo sapiens
tggcagggtacaccttaacacc

SEQ ID NO: 9058540 - DNA, 22 bp, Homo sapiens
tggcagggtacaccttaacacc

SEQ ID NO: 9058541 - DNA, 22 bp, Homo sapiens
tggcagggtgccagttgcgagt

SEQ ID NO: 9058542 - DNA, 22 bp, Homo sapiens
tggcagttattaatcaagtctt

SEQ ID NO: 9058543 - DNA, 22 bp, Homo sapiens
tggcagtttcatgtgattcaac

SEQ ID NO: 9058544 - DNA, 22 bp, Homo sapiens
tggcatttagttgcgtattgca

SEQ ID NO: 9058545 - DNA, 22 bp, Homo sapiens
tggcatttagaaaacaacatgt

SEQ ID NO: 9058546 - DNA, 22 bp, Homo sapiens
tggcatttcagtattttcataa

SEQ ID NO: 9058547 - DNA, 22 bp, Homo sapiens
tggcatttcctcagtgctcaga

SEQ ID NO: 9058548 - DNA, 23 bp, Homo sapiens
tggcatttctatactggcaagtg

SEQ ID NO: 9058549 - DNA, 22 bp, Homo sapiens
tggccactcctccctgcaggct

SEQ ID NO: 9058550 - DNA, 22 bp, Homo sapiens
tgctctggggagctcctctgcg

SEQ ID NO: 9058551 - DNA, 22 bp, Homo sapiens
tgctcctgtttcatcagctata

SEQ ID NO: 9058552 - DNA, 22 bp, Homo sapiens
tgctctatctttgcttgaggga

SEQ ID NO: 9058553 - DNA, 22 bp, Homo sapiens
tgctctattaattttaacgatg

SEQ ID NO: 9058554 - DNA, 22 bp, Homo sapiens
tgctctatttcttcacctacaa

SEQ ID NO: 9058555 - DNA, 22 bp, Homo sapiens
tgctctatgggacacttctgct

SEQ ID NO: 9058556 - DNA, 22 bp, Homo sapiens
tgctctatatgtctgttttgag

SEQ ID NO: 9058557 - DNA, 22 bp, Homo sapiens
tgctctatctaaaagtcctgga

SEQ ID NO: 9058558 - DNA, 22 bp, Homo sapiens
tgctctatcctgctgagtgatt

SEQ ID NO: 9058559 - DNA, 22 bp, Homo sapiens
tgctcctgagcggtttccatga

SEQ ID NO: 9058560 - DNA, 22 bp, Homo sapiens
tgctcctatcctcctgctgaca

SEQ ID NO: 9058561 - DNA, 22 bp, Homo sapiens
tgctctgtaggggaaagagagc

SEQ ID NO: 9058562 - DNA, 22 bp, Homo sapiens
tgctctgtcaagaaaagatgcc

SEQ ID NO: 9058563 - DNA, 22 bp, Homo sapiens
tgctctgtattctatggcagtt

SEQ ID NO: 9058564 - DNA, 17 bp, Homo sapiens
tgctctgtggtctttta

SEQ ID NO: 9058565 - DNA, 18 bp, Homo sapiens
tgctctgtttaatgattt

SEQ ID NO: 9058566 - DNA, 19 bp, Homo sapiens
tgctgaggatgcaagatcc

SEQ ID NO: 9058567 - DNA, 19 bp, Homo sapiens
tgctgcagtcaggcgaggg

SEQ ID NO: 9058568 - DNA, 22 bp, Homo sapiens
tgctgcaggccttggctgggaa

SEQ ID NO: 9058569 - DNA, 22 bp, Homo sapiens
tgctgcagggaagtcggggggt

SEQ ID NO: 9058570 - DNA, 22 bp, Homo sapiens
tgcctgtcctgaggatgagggt

SEQ ID NO: 9058571 - DNA, 22 bp, Homo sapiens
tgcctgtctcctctgcagggtg

SEQ ID NO: 9058572 - DNA, 22 bp, Homo sapiens
tgcctgtcttaatatctggaaa

SEQ ID NO: 9058573 - DNA, 20 bp, Homo sapiens
tgcctggcctttctctgccc

SEQ ID NO: 9058574 - DNA, 22 bp, Homo sapiens
tgcctggccctgacagccctgg

SEQ ID NO: 9058575 - DNA, 22 bp, Homo sapiens
tgcctggctgaggtgacaggtt

SEQ ID NO: 9058576 - DNA, 21 bp, Homo sapiens
tgcctggcctttgcttttcct

SEQ ID NO: 9058577 - DNA, 22 bp, Homo sapiens
tgcctgtgtatgtgcatgcaca

SEQ ID NO: 9058578 - DNA, 22 bp, Homo sapiens
tgcgatgcaacagcttggcgga

SEQ ID NO: 9058579 - DNA, 22 bp, Homo sapiens
tgctatttctctgctgtaaaat

SEQ ID NO: 9058580 - DNA, 19 bp, Homo sapiens
tgctatttagaacgcctgg

SEQ ID NO: 9058581 - DNA, 22 bp, Homo sapiens
tgctatttgggggctacatgat

SEQ ID NO: 9058582 - DNA, 22 bp, Homo sapiens
tgctaaattcattattgattta

SEQ ID NO: 9058583 - DNA, 22 bp, Homo sapiens
tgcggaaggcagcgcagggtgg

SEQ ID NO: 9058584 - DNA, 22 bp, Homo sapiens
tgcggaaggcagcgcagggtgg

SEQ ID NO: 9058585 - DNA, 22 bp, Homo sapiens
tgctcatcaacatgatgatcat

SEQ ID NO: 9058586 - DNA, 22 bp, Homo sapiens
tgctgtcctgttttggagtaat

SEQ ID NO: 9058587 - DNA, 22 bp, Homo sapiens
tgctgtcttttcccaatcctgg

SEQ ID NO: 9058588 - DNA, 22 bp, Homo sapiens
tgcttaaaaagtaactgctgat

SEQ ID NO: 9058589 - DNA, 22 bp, Homo sapiens
tgcttctgacatgttcttggtt

SEQ ID NO: 9058590 - DNA, 22 bp, Homo sapiens
tgcttctgactaagctgcatga

SEQ ID NO: 9058591 - DNA, 22 bp, Homo sapiens
tgcttctgaaatgcaggtcttc

SEQ ID NO: 9058592 - DNA, 22 bp, Homo sapiens
tgcttctgcaggagctcctgat

SEQ ID NO: 9058593 - DNA, 22 bp, Homo sapiens
tgcttctgctcagcttcctact

SEQ ID NO: 9058594 - DNA, 22 bp, Homo sapiens
tgcttcgaattgggcttctgga

SEQ ID NO: 9058595 - DNA, 22 bp, Homo sapiens
tgcttcatgaggctgagagaag

SEQ ID NO: 9058596 - DNA, 22 bp, Homo sapiens
tgcttcatgaggtagtggcagt

SEQ ID NO: 9058597 - DNA, 17 bp, Homo sapiens
tgcttcatcccgatcct

SEQ ID NO: 9058598 - DNA, 22 bp, Homo sapiens
tgcttcattttgacttagccag

SEQ ID NO: 9058599 - DNA, 22 bp, Homo sapiens
tgcttattctttccacaattca

SEQ ID NO: 9058600 - DNA, 22 bp, Homo sapiens
tgcttattgctttcaagactgt

SEQ ID NO: 9058601 - DNA, 22 bp, Homo sapiens
tgcttattaaacatgcatattc

SEQ ID NO: 9058602 - DNA, 22 bp, Homo sapiens
tgctggggcagaagagccaaga

SEQ ID NO: 9058603 - DNA, 20 bp, Homo sapiens
tgctggggacatacagggtg

SEQ ID NO: 9058604 - DNA, 20 bp, Homo sapiens
tgctggggacatacagggtg

SEQ ID NO: 9058605 - DNA, 23 bp, Homo sapiens
tgctggggtagtttgtggcacag

SEQ ID NO: 9058606 - DNA, 20 bp, Homo sapiens
tgctgcagtttcatgggact

SEQ ID NO: 9058607 - DNA, 20 bp, Homo sapiens
tgctgctttgccactagttg

SEQ ID NO: 9058608 - DNA, 22 bp, Homo sapiens
tgctgctttgatgtgtaaatca

SEQ ID NO: 9058609 - DNA, 22 bp, Homo sapiens
tggagagctcctatttgctgtc

SEQ ID NO: 9058610 - DNA, 22 bp, Homo sapiens
tggagagcacagttcctgcttc

SEQ ID NO: 9058611 - DNA, 22 bp, Homo sapiens
tggactttctagggtagaggaa

SEQ ID NO: 9058612 - DNA, 22 bp, Homo sapiens
tggagaaagctgcatatggaaa

SEQ ID NO: 9058613 - DNA, 22 bp, Homo sapiens
tggagagtggtttgggggacat

SEQ ID NO: 9058614 - DNA, 22 bp, Homo sapiens
tggagctggaatttgagctgga

SEQ ID NO: 9058615 - DNA, 21 bp, Homo sapiens
tggagctccctgcatcccact

SEQ ID NO: 9058616 - DNA, 20 bp, Homo sapiens
tggagctccagcgtccatgt

SEQ ID NO: 9058617 - DNA, 22 bp, Homo sapiens
tggagctgtcactcagaaccaa

SEQ ID NO: 9058618 - DNA, 22 bp, Homo sapiens
tggaggagaatttatggtcgaa

SEQ ID NO: 9058619 - DNA, 19 bp, Homo sapiens
tggaggagaggaaaagtca

SEQ ID NO: 9058620 - DNA, 19 bp, Homo sapiens
tggaggagaggaaaagtca

SEQ ID NO: 9058621 - DNA, 22 bp, Homo sapiens
tggaggagtgtgattgtctgcc

SEQ ID NO: 9058622 - DNA, 22 bp, Homo sapiens
tggaggagtagattttcagagg

SEQ ID NO: 9058623 - DNA, 22 bp, Homo sapiens
tggaggcagtaactgagcaaca

SEQ ID NO: 9058624 - DNA, 20 bp, Homo sapiens
tggaggcacctgtggagatc

SEQ ID NO: 9058625 - DNA, 22 bp, Homo sapiens
tggataaaacgttctgaaaaac

SEQ ID NO: 9058626 - DNA, 22 bp, Homo sapiens
tggataaaacgttctgaaaaac

SEQ ID NO: 9058627 - DNA, 23 bp, Homo sapiens
tggataaaatacttacattcaac

SEQ ID NO: 9058628 - DNA, 22 bp, Homo sapiens
tggagggcgcttagatggaggg

SEQ ID NO: 9058629 - DNA, 22 bp, Homo sapiens
tggagggctaagctgagggata

SEQ ID NO: 9058630 - DNA, 18 bp, Homo sapiens
tggagggcttgctgcagc

SEQ ID NO: 9058631 - DNA, 22 bp, Homo sapiens
tggagggatacaaagatgaaaa

SEQ ID NO: 9058632 - DNA, 22 bp, Homo sapiens
tggaaatttatcaagatataca

SEQ ID NO: 9058633 - DNA, 22 bp, Homo sapiens
tggaacaacatgctggaaaatt

SEQ ID NO: 9058634 - DNA, 22 bp, Homo sapiens
tggaacaaattacaattaactt

SEQ ID NO: 9058635 - DNA, 19 bp, Homo sapiens
tggaacaaactgcaatgac

SEQ ID NO: 9058636 - DNA, 22 bp, Homo sapiens
tggaacaacatgctggaaaatt

SEQ ID NO: 9058637 - DNA, 22 bp, Homo sapiens
tggaacaagacagcatagagct

SEQ ID NO: 9058638 - DNA, 22 bp, Homo sapiens
tggaaagtctcttttgactgta

SEQ ID NO: 9058639 - DNA, 22 bp, Homo sapiens
tggaaagtgagacatatttata

SEQ ID NO: 9058640 - DNA, 19 bp, Homo sapiens
tggaaagtaaccccagagt

SEQ ID NO: 9058641 - DNA, 22 bp, Homo sapiens
tggaaagtgctctagactttct

SEQ ID NO: 9058642 - DNA, 22 bp, Homo sapiens
tggaaagtttctgatttcctaa

SEQ ID NO: 9058643 - DNA, 22 bp, Homo sapiens
tggaaatagctccagttaagca

SEQ ID NO: 9058644 - DNA, 22 bp, Homo sapiens
tggaaatagtaatgcataagtg

SEQ ID NO: 9058645 - DNA, 22 bp, Homo sapiens
tggaaaaactgagacttagaca

SEQ ID NO: 9058646 - DNA, 22 bp, Homo sapiens
tgctttggagagaccattttca

SEQ ID NO: 9058647 - DNA, 22 bp, Homo sapiens
tggaaacagatcataactaagc

SEQ ID NO: 9058648 - DNA, 22 bp, Homo sapiens
tggaaaatgtgactattctaaa

SEQ ID NO: 9058649 - DNA, 19 bp, Homo sapiens
tggaaaatggattgaatca

SEQ ID NO: 9058650 - DNA, 22 bp, Homo sapiens
tggaaaattagtagtgaaaggc

SEQ ID NO: 9058651 - DNA, 22 bp, Homo sapiens
tggaaacaaagtcataagctca

SEQ ID NO: 9058652 - DNA, 22 bp, Homo sapiens
tggaaaatatttaggtgaatga

SEQ ID NO: 9058653 - DNA, 19 bp, Homo sapiens
tggaaaatggattgaatca

SEQ ID NO: 9058654 - DNA, 22 bp, Homo sapiens
tggaaaatcaggggacattgat

SEQ ID NO: 9058655 - DNA, 22 bp, Homo sapiens
tgcttgcaagagatgcaatgac

SEQ ID NO: 9058656 - DNA, 22 bp, Homo sapiens
tgctttaaaccatggatgtgag

SEQ ID NO: 9058657 - DNA, 22 bp, Homo sapiens
tgctttaaatatgaattagcat

SEQ ID NO: 9058658 - DNA, 22 bp, Homo sapiens
tgctttaaaatggactgttttg

SEQ ID NO: 9058659 - DNA, 22 bp, Homo sapiens
tgctttataaccatttctgtgg

SEQ ID NO: 9058660 - DNA, 22 bp, Homo sapiens
tgctttaagagattgttagtac

SEQ ID NO: 9058661 - DNA, 22 bp, Homo sapiens
tgctttaagacactaagtttga

SEQ ID NO: 9058662 - DNA, 22 bp, Homo sapiens
tgctttaagacactaagtttga

SEQ ID NO: 9058663 - DNA, 22 bp, Homo sapiens
tgcttctgttctttcacctacg

SEQ ID NO: 9058664 - DNA, 22 bp, Homo sapiens
tgcttctgttacataccagaac

SEQ ID NO: 9058665 - DNA, 22 bp, Homo sapiens
tgcttctgtctcttatgccttg

SEQ ID NO: 9058666 - DNA, 22 bp, Homo sapiens
tgcttctgtattttgggcttga

SEQ ID NO: 9058667 - DNA, 22 bp, Homo sapiens
tgcttctttactataggcaatt

SEQ ID NO: 9058668 - DNA, 22 bp, Homo sapiens
tgcttctgtttcattgatctta

SEQ ID NO: 9058669 - DNA, 22 bp, Homo sapiens
tgcttctgctttacttggttca

SEQ ID NO: 9058670 - DNA, 19 bp, Homo sapiens
tgcttctggaaccatgatc

SEQ ID NO: 9058671 - DNA, 22 bp, Homo sapiens
tgcttctggaaacagtggctgt

SEQ ID NO: 9058672 - DNA, 22 bp, Homo sapiens
tgcttctggggacaggctgcct

SEQ ID NO: 9058673 - DNA, 19 bp, Homo sapiens
tgcttctggggcttctcca

SEQ ID NO: 9058674 - DNA, 22 bp, Homo sapiens
tgcttctggcttatctcgtgcc

SEQ ID NO: 9058675 - DNA, 22 bp, Homo sapiens
tgcttctgggcctggtgttccc

SEQ ID NO: 9058676 - DNA, 21 bp, Homo sapiens
tgctttctaaaaatactattg

SEQ ID NO: 9058677 - DNA, 22 bp, Homo sapiens
tgctttattcccttctgatgtg

SEQ ID NO: 9058678 - DNA, 22 bp, Homo sapiens
tgctttattcgacatctggtag

SEQ ID NO: 9058679 - DNA, 22 bp, Homo sapiens
tgctttattcagggtttacccc

SEQ ID NO: 9058680 - DNA, 22 bp, Homo sapiens
tgctttattcagtctctgccat

SEQ ID NO: 9058681 - DNA, 22 bp, Homo sapiens
tgctttatgttatcagaagggt

SEQ ID NO: 9058682 - DNA, 22 bp, Homo sapiens
tgctttattaagagagaaattt

SEQ ID NO: 9058683 - DNA, 22 bp, Homo sapiens
tgctttatctgacttggcgctg

SEQ ID NO: 9058684 - DNA, 22 bp, Homo sapiens
tgctttatctgtgagaacctga

SEQ ID NO: 9058685 - DNA, 22 bp, Homo sapiens
tgctttatatctctcttcttag

SEQ ID NO: 9058686 - DNA, 22 bp, Homo sapiens
tgctttatcaaagctatagtga

SEQ ID NO: 9058687 - DNA, 22 bp, Homo sapiens
tgctttataacttagtttatgg

SEQ ID NO: 9058688 - DNA, 22 bp, Homo sapiens
tgctttataacttagtttatgg

SEQ ID NO: 9058689 - DNA, 22 bp, Homo sapiens
tgctttatagacaaggaagtag

SEQ ID NO: 9058690 - DNA, 22 bp, Homo sapiens
tgctttataggggattgcaggc

SEQ ID NO: 9058691 - DNA, 20 bp, Homo sapiens
tgctttatgctatactttgt

SEQ ID NO: 9058692 - DNA, 20 bp, Homo sapiens
tgctttatgctatactttgt

SEQ ID NO: 9058693 - DNA, 22 bp, Homo sapiens
tgctttatggatttgtgtcctg

SEQ ID NO: 9058694 - DNA, 22 bp, Homo sapiens
tgctttatggagcccatctcat

SEQ ID NO: 9058695 - DNA, 18 bp, Homo sapiens
tgctttatgcttatataa

SEQ ID NO: 9058696 - DNA, 21 bp, Homo sapiens
tgctttatgggaaaaatgtca

SEQ ID NO: 9058697 - DNA, 22 bp, Homo sapiens
tgctttatgtggctgatactca

SEQ ID NO: 9058698 - DNA, 22 bp, Homo sapiens
tggaattttgtattagctttga

SEQ ID NO: 9058699 - DNA, 22 bp, Homo sapiens
tggacacaaagatcaaatattg

SEQ ID NO: 9058700 - DNA, 22 bp, Homo sapiens
tggaataaagcagctttagttc

SEQ ID NO: 9058701 - DNA, 22 bp, Homo sapiens
tggaataaaatgtcagttctta

SEQ ID NO: 9058702 - DNA, 22 bp, Homo sapiens
tggaataactcaccaaggtcat

SEQ ID NO: 9058703 - DNA, 22 bp, Homo sapiens
tggaataaggaatctttcagaa

SEQ ID NO: 9058704 - DNA, 23 bp, Homo sapiens
tggaataataaggtacattaaca

SEQ ID NO: 9058705 - DNA, 22 bp, Homo sapiens
tggaaggggccaggcgcggagt

SEQ ID NO: 9058706 - DNA, 22 bp, Homo sapiens
tgtcacttcaggaatgcaggga

SEQ ID NO: 9058707 - DNA, 22 bp, Homo sapiens
tgtcactttggccaagccattg

SEQ ID NO: 9058708 - DNA, 22 bp, Homo sapiens
tgtcactgtgctctgttcattt

SEQ ID NO: 9058709 - DNA, 22 bp, Homo sapiens
tgtcacttcaggaatgcaggga

SEQ ID NO: 9058710 - DNA, 22 bp, Homo sapiens
tgtcaccttgctcatcctcgga

SEQ ID NO: 9058711 - DNA, 22 bp, Homo sapiens
tgtcaccttgcagggctggggc

SEQ ID NO: 9058712 - DNA, 22 bp, Homo sapiens
tgtcacctttacccttttatag

SEQ ID NO: 9058713 - DNA, 22 bp, Homo sapiens
tgtcaccttgatgatggcctag

SEQ ID NO: 9058714 - DNA, 19 bp, Homo sapiens
tgtcaccttctgtcagttt

SEQ ID NO: 9058715 - DNA, 22 bp, Homo sapiens
tgtcacctggaaatcactctaa

SEQ ID NO: 9058716 - DNA, 22 bp, Homo sapiens
tgtcatatgctgtcatagccat

SEQ ID NO: 9058717 - DNA, 22 bp, Homo sapiens
tgtcatatgtaatatgttcatt

SEQ ID NO: 9058718 - DNA, 22 bp, Homo sapiens
tgtcatctcactgatatagatg

SEQ ID NO: 9058719 - DNA, 18 bp, Homo sapiens
tgtcatctgtttaaaacc

SEQ ID NO: 9058720 - DNA, 22 bp, Homo sapiens
tgtcatctgatattacttatag

SEQ ID NO: 9058721 - DNA, 20 bp, Homo sapiens
tgtcatttatttatcaaatg

SEQ ID NO: 9058722 - DNA, 22 bp, Homo sapiens
tgtcatttatcttatagtaatc

SEQ ID NO: 9058723 - DNA, 22 bp, Homo sapiens
tgtcattgaggaaaactaggtg

SEQ ID NO: 9058724 - DNA, 18 bp, Homo sapiens
tgtcattgccagggaagc

SEQ ID NO: 9058725 - DNA, 22 bp, Homo sapiens
tgtcattggtacaaattgattg

SEQ ID NO: 9058726 - DNA, 22 bp, Homo sapiens
tgtccactttgtcagtgtcata

SEQ ID NO: 9058727 - DNA, 22 bp, Homo sapiens
tgtcattttctggttagttaat

SEQ ID NO: 9058728 - DNA, 22 bp, Homo sapiens
tgtccaggagtaaaaagacctg

SEQ ID NO: 9058729 - DNA, 22 bp, Homo sapiens
tgtccaggaccctattctcact

SEQ ID NO: 9058730 - DNA, 22 bp, Homo sapiens
tgtccaggaattgaccctgcaa

SEQ ID NO: 9058731 - DNA, 22 bp, Homo sapiens
tgtcattttcagcttatgcttc

SEQ ID NO: 9058732 - DNA, 22 bp, Homo sapiens
tgtcctgggaatgggatgcagt

SEQ ID NO: 9058733 - DNA, 22 bp, Homo sapiens
tgtcctggggacaagaggccct

SEQ ID NO: 9058734 - DNA, 22 bp, Homo sapiens
tgtccttatctccaaacaatca

SEQ ID NO: 9058735 - DNA, 22 bp, Homo sapiens
tgtccttagggatataaaatat

SEQ ID NO: 9058736 - DNA, 22 bp, Homo sapiens
tgtccttttctttagtgcagct

SEQ ID NO: 9058737 - DNA, 22 bp, Homo sapiens
tgtccttttccccaaattcact

SEQ ID NO: 9058738 - DNA, 22 bp, Homo sapiens
tgtccttgttcctaatgtaaaa

SEQ ID NO: 9058739 - DNA, 22 bp, Homo sapiens
tgtccaggcactgggactctag

SEQ ID NO: 9058740 - DNA, 22 bp, Homo sapiens
tgtccaggcggccttgcctgtt

SEQ ID NO: 9058741 - DNA, 22 bp, Homo sapiens
tgtccaggctggagtgcagtgg

SEQ ID NO: 9058742 - DNA, 22 bp, Homo sapiens
tgtccagggatggggtcaggga

SEQ ID NO: 9058743 - DNA, 22 bp, Homo sapiens
tgtccaggctcccttggtgctg

SEQ ID NO: 9058744 - DNA, 22 bp, Homo sapiens
tgtccaggctaaagtgcagtgg

SEQ ID NO: 9058745 - DNA, 22 bp, Homo sapiens
tgtccaggtcagcagcagggac

SEQ ID NO: 9058746 - DNA, 22 bp, Homo sapiens
tgtccagggggcttacctggag

SEQ ID NO: 9058747 - DNA, 20 bp, Homo sapiens
tgtccaggggatcgttggcc

SEQ ID NO: 9058748 - DNA, 22 bp, Homo sapiens
tgtccaggtggcctctgctgct

SEQ ID NO: 9058749 - DNA, 22 bp, Homo sapiens
tgtccaggtgtgtctaaagaga

SEQ ID NO: 9058750 - DNA, 22 bp, Homo sapiens
tgtccctgatccactggacccc

SEQ ID NO: 9058751 - DNA, 22 bp, Homo sapiens
tgtccctggactccaggagcca

SEQ ID NO: 9058752 - DNA, 22 bp, Homo sapiens
tgtacttgaacttgactgtaga

SEQ ID NO: 9058753 - DNA, 22 bp, Homo sapiens
tgtagaaaattggagcattcat

SEQ ID NO: 9058754 - DNA, 22 bp, Homo sapiens
tgtagaaagaatatgtttcata

SEQ ID NO: 9058755 - DNA, 22 bp, Homo sapiens
tgtagaaagctcttctgaaatc

SEQ ID NO: 9058756 - DNA, 22 bp, Homo sapiens
tgtagaaattagtaagatcaac

SEQ ID NO: 9058757 - DNA, 22 bp, Homo sapiens
tgtagcattttatgtaataagt

SEQ ID NO: 9058758 - DNA, 17 bp, Homo sapiens
tgtagcttctccttctc

SEQ ID NO: 9058759 - DNA, 22 bp, Homo sapiens
tgtaggaaaaacaatgatctgc

SEQ ID NO: 9058760 - DNA, 22 bp, Homo sapiens
tgtaggaagatataaaatatct

SEQ ID NO: 9058761 - DNA, 22 bp, Homo sapiens
tgtaggaactcacagatattct

SEQ ID NO: 9058762 - DNA, 18 bp, Homo sapiens
tgtagagccaggtttgcc

SEQ ID NO: 9058763 - DNA, 22 bp, Homo sapiens
tgtatacattctcttgggtttg

SEQ ID NO: 9058764 - DNA, 22 bp, Homo sapiens
tgtataaatttaaattcctgct

SEQ ID NO: 9058765 - DNA, 22 bp, Homo sapiens
tgtatacactatgctatatggt

SEQ ID NO: 9058766 - DNA, 22 bp, Homo sapiens
tgtatctgtgatgtaggggttt

SEQ ID NO: 9058767 - DNA, 22 bp, Homo sapiens
tgtatcaatcatgtaatttggt

SEQ ID NO: 9058768 - DNA, 22 bp, Homo sapiens
tgtatatacacactcccatgtt

SEQ ID NO: 9058769 - DNA, 22 bp, Homo sapiens
tgtatcaaaccaaattaattct

SEQ ID NO: 9058770 - DNA, 22 bp, Homo sapiens
tgtatattctgcctaaaagctt

SEQ ID NO: 9058771 - DNA, 22 bp, Homo sapiens
tgtcaattatcaaggttcattt

SEQ ID NO: 9058772 - DNA, 22 bp, Homo sapiens
tgtcaattaaagtttgtaggtg

SEQ ID NO: 9058773 - DNA, 22 bp, Homo sapiens
tgtcacaagtaactggcaatgc

SEQ ID NO: 9058774 - DNA, 22 bp, Homo sapiens
tgtcacaatttatttctcttga

SEQ ID NO: 9058775 - DNA, 22 bp, Homo sapiens
tgtcacaaacatacattataga

SEQ ID NO: 9058776 - DNA, 22 bp, Homo sapiens
tgtattttgtgaggatcactct

SEQ ID NO: 9058777 - DNA, 22 bp, Homo sapiens
tgtatttctgctttctctagta

SEQ ID NO: 9058778 - DNA, 18 bp, Homo sapiens
tgtatttctaacagctaa

SEQ ID NO: 9058779 - DNA, 22 bp, Homo sapiens
tgtatttcctggtttagatcaa

SEQ ID NO: 9058780 - DNA, 22 bp, Homo sapiens
tgtatttcgctaggtactccct

SEQ ID NO: 9058781 - DNA, 22 bp, Homo sapiens
tgtatttcaattttagcaccaa

SEQ ID NO: 9058782 - DNA, 20 bp, Homo sapiens
tgtatttcatgcattcctgg

SEQ ID NO: 9058783 - DNA, 22 bp, Homo sapiens
tgtatttaattgtatcatcaca

SEQ ID NO: 9058784 - DNA, 22 bp, Homo sapiens
tgtatgcttgtgtataatataa

SEQ ID NO: 9058785 - DNA, 22 bp, Homo sapiens
tgtatgctttccaaaaatgctg

SEQ ID NO: 9058786 - DNA, 22 bp, Homo sapiens
tgtaaatgaaacagctaaatcc

SEQ ID NO: 9058787 - DNA, 22 bp, Homo sapiens
tggtttctgccctcagagctca

SEQ ID NO: 9058788 - DNA, 22 bp, Homo sapiens
tggtttaatttccatttccttg

SEQ ID NO: 9058789 - DNA, 22 bp, Homo sapiens
tggttctaggctttgtcttttg

SEQ ID NO: 9058790 - DNA, 23 bp, Homo sapiens
tggtggggtcttggagacagcac

SEQ ID NO: 9058791 - DNA, 23 bp, Homo sapiens
tggtggggtcttggagacagcac

SEQ ID NO: 9058792 - DNA, 22 bp, Homo sapiens
tggtggggtcatcgtcagatgc

SEQ ID NO: 9058793 - DNA, 22 bp, Homo sapiens
tggtggggtcatcgtcagatgc

SEQ ID NO: 9058794 - DNA, 22 bp, Homo sapiens
tggtgtctccatcctgccctgc

SEQ ID NO: 9058795 - DNA, 22 bp, Homo sapiens
tgtacaaagagtatagctttga

SEQ ID NO: 9058796 - DNA, 22 bp, Homo sapiens
tgtaagccttccctgagaaagt

SEQ ID NO: 9058797 - DNA, 23 bp, Homo sapiens
tgtaacaatttcatatacatgca

SEQ ID NO: 9058798 - DNA, 22 bp, Homo sapiens
tgtaacatcacagtgatgtttg

SEQ ID NO: 9058799 - DNA, 22 bp, Homo sapiens
tgtaacaaaataccttggattg

SEQ ID NO: 9058800 - DNA, 23 bp, Homo sapiens
tgtaacaattcccagcctttgcc

SEQ ID NO: 9058801 - DNA, 22 bp, Homo sapiens
tgtaacaaatacccttgaagtt

SEQ ID NO: 9058802 - DNA, 22 bp, Homo sapiens
tgtaacaacatttgatttttag

SEQ ID NO: 9058803 - DNA, 21 bp, Homo sapiens
tgtaacaaaatactgcagatt

SEQ ID NO: 9058804 - DNA, 22 bp, Homo sapiens
tgtacctggagagctcttggcc

SEQ ID NO: 9058805 - DNA, 22 bp, Homo sapiens
tgtacagactgtatttacaagt

SEQ ID NO: 9058806 - DNA, 22 bp, Homo sapiens
tgtacacctgtctttacacata

SEQ ID NO: 9058807 - DNA, 22 bp, Homo sapiens
tgtacaaagttaaacctatata

SEQ ID NO: 9058808 - DNA, 22 bp, Homo sapiens
tgtacaatagctattatctcca

SEQ ID NO: 9058809 - DNA, 21 bp, Homo sapiens
tggtggagtgtgctgagcatg

SEQ ID NO: 9058810 - DNA, 22 bp, Homo sapiens
tggtggagcctaggctaagtct

SEQ ID NO: 9058811 - DNA, 16 bp, Homo sapiens
tggtggggaggacagc

SEQ ID NO: 9058812 - DNA, 22 bp, Homo sapiens
tggtgggggaggctgtctagca

SEQ ID NO: 9058813 - DNA, 22 bp, Homo sapiens
tggtggggccagacttcagctc

SEQ ID NO: 9058814 - DNA, 22 bp, Homo sapiens
tggtggggctttccttctgctt

SEQ ID NO: 9058815 - DNA, 22 bp, Homo sapiens
tggtggggattccctccctggc

SEQ ID NO: 9058816 - DNA, 22 bp, Homo sapiens
tggtcgggagcgagcagctatt

SEQ ID NO: 9058817 - DNA, 23 bp, Homo sapiens
tggtctcacttggtaagatgaag

SEQ ID NO: 9058818 - DNA, 19 bp, Homo sapiens
tggtctctgtctctttgca

SEQ ID NO: 9058819 - DNA, 22 bp, Homo sapiens
tggtccagaagatattcaacca

SEQ ID NO: 9058820 - DNA, 22 bp, Homo sapiens
tggtccagatgccttggcttta

SEQ ID NO: 9058821 - DNA, 19 bp, Homo sapiens
tggtccagcttcttctcct

SEQ ID NO: 9058822 - DNA, 22 bp, Homo sapiens
tggtccagactttgacctctca

SEQ ID NO: 9058823 - DNA, 22 bp, Homo sapiens
tggtccagacatttctgaggta

SEQ ID NO: 9058824 - DNA, 22 bp, Homo sapiens
tggtccagggtgtagtacagag

SEQ ID NO: 9058825 - DNA, 22 bp, Homo sapiens
tggtccaggcacccttctagag

SEQ ID NO: 9058826 - DNA, 20 bp, Homo sapiens
tggtccaggacctggtgtcc

SEQ ID NO: 9058827 - DNA, 22 bp, Homo sapiens
tggtccagcttgattctcttct

SEQ ID NO: 9058828 - DNA, 17 bp, Homo sapiens
tggtccaggtggagcca

SEQ ID NO: 9058829 - DNA, 22 bp, Homo sapiens
tggtcctgccccgtgcacagag

SEQ ID NO: 9058830 - DNA, 22 bp, Homo sapiens
tggtcctggaaggtcctgaggg

SEQ ID NO: 9058831 - DNA, 22 bp, Homo sapiens
tgggagtcatcgtgtttggatc

SEQ ID NO: 9058832 - DNA, 22 bp, Homo sapiens
tgggagtcactgttgttgaggg

SEQ ID NO: 9058833 - DNA, 22 bp, Homo sapiens
tgggagtcagacagcctgagat

SEQ ID NO: 9058834 - DNA, 22 bp, Homo sapiens
tgggcagggagctggaaccaca

SEQ ID NO: 9058835 - DNA, 22 bp, Homo sapiens
tgggcaggtgctattttccatg

SEQ ID NO: 9058836 - DNA, 22 bp, Homo sapiens
tgggcaggggccctgcttccgt

SEQ ID NO: 9058837 - DNA, 22 bp, Homo sapiens
tgggccacctgctctgtttcta

SEQ ID NO: 9058838 - DNA, 22 bp, Homo sapiens
tgggctcagggaagcttggcct

SEQ ID NO: 9058839 - DNA, 21 bp, Homo sapiens
tgggctcagccccagccctgc

SEQ ID NO: 9058840 - DNA, 22 bp, Homo sapiens
tgggctcagccttcatgtggcc

SEQ ID NO: 9058841 - DNA, 22 bp, Homo sapiens
tgggctctctttacctcataac

SEQ ID NO: 9058842 - DNA, 22 bp, Homo sapiens
tgggctctggtttcctggctgg

SEQ ID NO: 9058843 - DNA, 22 bp, Homo sapiens
tgggctgcaccctcagcctctg

SEQ ID NO: 9058844 - DNA, 22 bp, Homo sapiens
tgggctgcagagcccggccttc

SEQ ID NO: 9058845 - DNA, 22 bp, Homo sapiens
tgggcctctgccacgctccccc

SEQ ID NO: 9058846 - DNA, 20 bp, Homo sapiens
tgggcctctggtgcctctgg

SEQ ID NO: 9058847 - DNA, 22 bp, Homo sapiens
tgggcctcggggaagcccgtgt

SEQ ID NO: 9058848 - DNA, 22 bp, Homo sapiens
tgggcctcatgcccagccaccc

SEQ ID NO: 9058849 - DNA, 22 bp, Homo sapiens
tgggcctcctccgacagccggg

SEQ ID NO: 9058850 - DNA, 22 bp, Homo sapiens
tgggcctcctgccctggcctag

SEQ ID NO: 9058851 - DNA, 22 bp, Homo sapiens
tggggaaaatgcagaagattac

SEQ ID NO: 9058852 - DNA, 22 bp, Homo sapiens
tggggaaagttcttgaaagtaa

SEQ ID NO: 9058853 - DNA, 22 bp, Homo sapiens
tggggaagggcaccctggagac

SEQ ID NO: 9058854 - DNA, 22 bp, Homo sapiens
tggggatgtaaatgaggtgata

SEQ ID NO: 9058855 - DNA, 22 bp, Homo sapiens
tggggagtgatgcctcggataa

SEQ ID NO: 9058856 - DNA, 22 bp, Homo sapiens
tgggggagagtttagatgattt

SEQ ID NO: 9058857 - DNA, 22 bp, Homo sapiens
tgggggagatagagtctgatgg

SEQ ID NO: 9058858 - DNA, 22 bp, Homo sapiens
tgggggagctcagtccagccca

SEQ ID NO: 9058859 - DNA, 22 bp, Homo sapiens
tgggggagtatagtctggcctc

SEQ ID NO: 9058860 - DNA, 22 bp, Homo sapiens
tgggggagccttcacagtagct

SEQ ID NO: 9058861 - DNA, 22 bp, Homo sapiens
tgggggagcgacagacataatt

SEQ ID NO: 9058862 - DNA, 22 bp, Homo sapiens
tgggggctagaacccagggatt

SEQ ID NO: 9058863 - DNA, 22 bp, Homo sapiens
tgggggctgagtaagatgagat

SEQ ID NO: 9058864 - DNA, 22 bp, Homo sapiens
tggggggcacttcagcacaatg

SEQ ID NO: 9058865 - DNA, 22 bp, Homo sapiens
tgggggtgctgagaagacagga

SEQ ID NO: 9058866 - DNA, 23 bp, Homo sapiens
tgggggtgcacgggccacatctt

SEQ ID NO: 9058867 - DNA, 22 bp, Homo sapiens
tggggtctgagtatctgcattt

SEQ ID NO: 9058868 - DNA, 22 bp, Homo sapiens
tggggtctggagttgcccatga

SEQ ID NO: 9058869 - DNA, 22 bp, Homo sapiens
tgggtccacggaagacttaggg

SEQ ID NO: 9058870 - DNA, 22 bp, Homo sapiens
tgggtccacttctgcactgtgg

SEQ ID NO: 9058871 - DNA, 22 bp, Homo sapiens
tgggtccagtgcagctgcgcgt

SEQ ID NO: 9058872 - DNA, 22 bp, Homo sapiens
tgggtccatggaacagaggtgc

SEQ ID NO: 9058873 - DNA, 22 bp, Homo sapiens
tgggtccagtgtcctggctatg

SEQ ID NO: 9058874 - DNA, 22 bp, Homo sapiens
tgggtgaggagaggctgtctaa

SEQ ID NO: 9058875 - DNA, 17 bp, Homo sapiens
tgggtggtagggagagg

SEQ ID NO: 9058876 - DNA, 16 bp, Homo sapiens
tgggtgggaggagcgg

SEQ ID NO: 9058877 - DNA, 22 bp, Homo sapiens
tgggtggtttatgagtgggttt

SEQ ID NO: 9058878 - DNA, 22 bp, Homo sapiens
tgggttccctgacagcgatgct

SEQ ID NO: 9058879 - DNA, 22 bp, Homo sapiens
tggtatgtaaattgtaactcaa

SEQ ID NO: 9058880 - DNA, 22 bp, Homo sapiens
tggtatgaccgtggtgcaagca

SEQ ID NO: 9058881 - DNA, 22 bp, Homo sapiens
tggtataaaactttttattgaa

SEQ ID NO: 9058882 - DNA, 22 bp, Homo sapiens
tggtcacagtgtattgatcagg

SEQ ID NO: 9058883 - DNA, 22 bp, Homo sapiens
ttaaagagtttattacttgtaa

SEQ ID NO: 9058884 - DNA, 22 bp, Homo sapiens
ttaaagaggcatgggaatgtat

SEQ ID NO: 9058885 - DNA, 22 bp, Homo sapiens
ttaaaccatagtttaacataag

SEQ ID NO: 9058886 - DNA, 22 bp, Homo sapiens
ttaaaccatagtttaacataag

SEQ ID NO: 9058887 - DNA, 22 bp, Homo sapiens
ttaatacagaagcaagacactg

SEQ ID NO: 9058888 - DNA, 22 bp, Homo sapiens
ttaatacactatatgatcacat

SEQ ID NO: 9058889 - DNA, 18 bp, Homo sapiens
ttaatgtggcttactatg

SEQ ID NO: 9058890 - DNA, 22 bp, Homo sapiens
ttaatacaagcatatgcacaca

SEQ ID NO: 9058891 - DNA, 22 bp, Homo sapiens
ttaataataatgagcccatttt

SEQ ID NO: 9058892 - DNA, 22 bp, Homo sapiens
ttaataaagtatgaattggaaa

SEQ ID NO: 9058893 - DNA, 22 bp, Homo sapiens
ttacaaagttctgagttcaaac

SEQ ID NO: 9058894 - DNA, 22 bp, Homo sapiens
ttacaaagtttaaggtggcact

SEQ ID NO: 9058895 - DNA, 22 bp, Homo sapiens
ttacaaagttctgagttcaaac

SEQ ID NO: 9058896 - DNA, 22 bp, Homo sapiens
ttacaaagtgttatgataaaca

SEQ ID NO: 9058897 - DNA, 22 bp, Homo sapiens
ttacaaagtgttatgataaaca

SEQ ID NO: 9058898 - DNA, 20 bp, Homo sapiens
ttacaaagaggcatcgcttt

SEQ ID NO: 9058899 - DNA, 21 bp, Homo sapiens
ttacaaagctacagatgttgc

SEQ ID NO: 9058900 - DNA, 22 bp, Homo sapiens
ttacaaaggtagttttgtctat

SEQ ID NO: 9058901 - DNA, 22 bp, Homo sapiens
ttacaaaggtagttttgtctat

SEQ ID NO: 9058902 - DNA, 22 bp, Homo sapiens
ttacaaaggtagttttgtctat

SEQ ID NO: 9058903 - DNA, 22 bp, Homo sapiens
ttacaaagtgctgcaccatttt

SEQ ID NO: 9058904 - DNA, 22 bp, Homo sapiens
ttacaaagtgctgcaccatttt

SEQ ID NO: 9058905 - DNA, 22 bp, Homo sapiens
ttacaaagtgttatgataaaca

SEQ ID NO: 9058906 - DNA, 20 bp, Homo sapiens
ttacaaagaggcatcgcttt

SEQ ID NO: 9058907 - DNA, 22 bp, Homo sapiens
ttacaaagagaagttgtagaat

SEQ ID NO: 9058908 - DNA, 22 bp, Homo sapiens
ttacaaagaaaattaggcattt

SEQ ID NO: 9058909 - DNA, 22 bp, Homo sapiens
ttacaaagaaaattaggcattt

SEQ ID NO: 9058910 - DNA, 17 bp, Homo sapiens
ttacaacaattcatgag

SEQ ID NO: 9058911 - DNA, 22 bp, Homo sapiens
ttacaacaccaggcagtatcct

SEQ ID NO: 9058912 - DNA, 22 bp, Homo sapiens
ttacaacaaaggcacgtgcatg

SEQ ID NO: 9058913 - DNA, 22 bp, Homo sapiens
ttacaacagacacatattctaa

SEQ ID NO: 9058914 - DNA, 22 bp, Homo sapiens
ttacaacagcgatttacctgtc

SEQ ID NO: 9058915 - DNA, 22 bp, Homo sapiens
ttacaacactacttatccttga

SEQ ID NO: 9058916 - DNA, 22 bp, Homo sapiens
ttacaacatatttagcttgatt

SEQ ID NO: 9058917 - DNA, 21 bp, Homo sapiens
ttacaacatttgtgttctatg

SEQ ID NO: 9058918 - DNA, 22 bp, Homo sapiens
ttacaactctagagaaaagaaa

SEQ ID NO: 9058919 - DNA, 22 bp, Homo sapiens
ttacaactctgaactacagagg

SEQ ID NO: 9058920 - DNA, 22 bp, Homo sapiens
ttacaagacactgctgacacag

SEQ ID NO: 9058921 - DNA, 22 bp, Homo sapiens
ttacaattgagtctattgtatg

SEQ ID NO: 9058922 - DNA, 22 bp, Homo sapiens
ttacaattacttgatctcagct

SEQ ID NO: 9058923 - DNA, 22 bp, Homo sapiens
ttacaagataacctgatgctgt

SEQ ID NO: 9058924 - DNA, 22 bp, Homo sapiens
ttacaagacagtgtggtaaata

SEQ ID NO: 9058925 - DNA, 22 bp, Homo sapiens
ttacaagatgggaaagggaagt

SEQ ID NO: 9058926 - DNA, 22 bp, Homo sapiens
ttacaagatctttgaaggcaag

SEQ ID NO: 9058927 - DNA, 22 bp, Homo sapiens
ttacacaaacacattccagata

SEQ ID NO: 9058928 - DNA, 22 bp, Homo sapiens
ttacacaaaagcaagtgtgtgt

SEQ ID NO: 9058929 - DNA, 22 bp, Homo sapiens
ttacacaaaaataagatatggc

SEQ ID NO: 9058930 - DNA, 22 bp, Homo sapiens
ttacacaaaaataagatatggc

SEQ ID NO: 9058931 - DNA, 22 bp, Homo sapiens
ttacagaatgtgccatttggtc

SEQ ID NO: 9058932 - DNA, 21 bp, Homo sapiens
ttacagaatccatgggaagtc

SEQ ID NO: 9058933 - DNA, 22 bp, Homo sapiens
ttacagcacagtgcttttactg

SEQ ID NO: 9058934 - DNA, 22 bp, Homo sapiens
ttacatgaggttaattaagcat

SEQ ID NO: 9058935 - DNA, 22 bp, Homo sapiens
ttacatgatgatttcataaaca

SEQ ID NO: 9058936 - DNA, 22 bp, Homo sapiens
ttacatgcagagggaagggaga

SEQ ID NO: 9058937 - DNA, 22 bp, Homo sapiens
ttagataatgtagagatatgag

SEQ ID NO: 9058938 - DNA, 22 bp, Homo sapiens
ttagaaagggtgtctgaatctg

SEQ ID NO: 9058939 - DNA, 22 bp, Homo sapiens
ttagaaagctttccatagtcaa

SEQ ID NO: 9058940 - DNA, 22 bp, Homo sapiens
ttagaaaggaatcttcatttca

SEQ ID NO: 9058941 - DNA, 22 bp, Homo sapiens
ttagcaaacaaatgaaatggtt

SEQ ID NO: 9058942 - DNA, 22 bp, Homo sapiens
ttagcagatttcatgtacattt

SEQ ID NO: 9058943 - DNA, 22 bp, Homo sapiens
ttagcatttctggaatcacaag

SEQ ID NO: 9058944 - DNA, 22 bp, Homo sapiens
ttagtaaataaagtctactttc

SEQ ID NO: 9058945 - DNA, 22 bp, Homo sapiens
ttatgatttagaaagattcact

SEQ ID NO: 9058946 - DNA, 22 bp, Homo sapiens
ttatgacatatgagtacaagta

SEQ ID NO: 9058947 - DNA, 22 bp, Homo sapiens
ttatgacaggaaaatcacagaa

SEQ ID NO: 9058948 - DNA, 22 bp, Homo sapiens
ttatgacagaaatgaaaagctg

SEQ ID NO: 9058949 - DNA, 22 bp, Homo sapiens
ttatgacagaaatgaaaagctg

SEQ ID NO: 9058950 - DNA, 22 bp, Homo sapiens
ttattcagtttgtgtagaggtg

SEQ ID NO: 9058951 - DNA, 22 bp, Homo sapiens
ttattcatcagtgcattaattt

SEQ ID NO: 9058952 - DNA, 22 bp, Homo sapiens
ttattccaaatcatggttgcat

SEQ ID NO: 9058953 - DNA, 22 bp, Homo sapiens
ttattccaagataggatagcat

SEQ ID NO: 9058954 - DNA, 22 bp, Homo sapiens
ttattccaatttctcctacaaa

SEQ ID NO: 9058955 - DNA, 22 bp, Homo sapiens
ttattccacagctcagaatttt

SEQ ID NO: 9058956 - DNA, 22 bp, Homo sapiens
ttattccattgtcttttgactt

SEQ ID NO: 9058957 - DNA, 22 bp, Homo sapiens
ttattccattcagttcaacaag

SEQ ID NO: 9058958 - DNA, 22 bp, Homo sapiens
ttattccagtgggtggtttctc

SEQ ID NO: 9058959 - DNA, 22 bp, Homo sapiens
ttattccatagaagtcaaggaa

SEQ ID NO: 9058960 - DNA, 22 bp, Homo sapiens
ttattccattatttcacttagg

SEQ ID NO: 9058961 - DNA, 22 bp, Homo sapiens
ttattccaggcacagaaggagg

SEQ ID NO: 9058962 - DNA, 22 bp, Homo sapiens
ttattccagctaagagtcctgg

SEQ ID NO: 9058963 - DNA, 22 bp, Homo sapiens
ttattccacctccattttccta

SEQ ID NO: 9058964 - DNA, 22 bp, Homo sapiens
ttattccaggtacttggtttct

SEQ ID NO: 9058965 - DNA, 22 bp, Homo sapiens
ttattccagtaatctctgtaat

SEQ ID NO: 9058966 - DNA, 22 bp, Homo sapiens
ttattccatagaagtcaaggaa

SEQ ID NO: 9058967 - DNA, 22 bp, Homo sapiens
ttatttatggccctcacctgat

SEQ ID NO: 9058968 - DNA, 22 bp, Homo sapiens
ttatttatggcactgttggtgg

SEQ ID NO: 9058969 - DNA, 22 bp, Homo sapiens
ttattcttggatctgagtctct

SEQ ID NO: 9058970 - DNA, 22 bp, Homo sapiens
ttattcttcttctcttgccagg

SEQ ID NO: 9058971 - DNA, 19 bp, Homo sapiens
ttattcttaaagtagctta

SEQ ID NO: 9058972 - DNA, 18 bp, Homo sapiens
ttattcttccaggccacc

SEQ ID NO: 9058973 - DNA, 22 bp, Homo sapiens
ttcattcacccaggaaacatct

SEQ ID NO: 9058974 - DNA, 20 bp, Homo sapiens
ttcattcacgtagctgttga

SEQ ID NO: 9058975 - DNA, 22 bp, Homo sapiens
ttcattcatctctaaaatgcct

SEQ ID NO: 9058976 - DNA, 22 bp, Homo sapiens
ttcattcatctctaaaatgcct

SEQ ID NO: 9058977 - DNA, 22 bp, Homo sapiens
ttcattcaggtgtatttatggg

SEQ ID NO: 9058978 - DNA, 23 bp, Homo sapiens
ttcattcaaaaggaaaagtcatg

SEQ ID NO: 9058979 - DNA, 23 bp, Homo sapiens
ttcattcaaaaggaaaagtcatg

SEQ ID NO: 9058980 - DNA, 22 bp, Homo sapiens
ttcatgtttgtaggactgaggc

SEQ ID NO: 9058981 - DNA, 19 bp, Homo sapiens
ttcatgtttgtagatggtg

SEQ ID NO: 9058982 - DNA, 22 bp, Homo sapiens
ttcatgttttgagccattctga

SEQ ID NO: 9058983 - DNA, 19 bp, Homo sapiens
ttcattctttctacttacc

SEQ ID NO: 9058984 - DNA, 22 bp, Homo sapiens
ttcattctttgaatctgaggta

SEQ ID NO: 9058985 - DNA, 21 bp, Homo sapiens
ttcattcatggcataatatag

SEQ ID NO: 9058986 - DNA, 22 bp, Homo sapiens
ttccagaggtagcaatgacttg

SEQ ID NO: 9058987 - DNA, 22 bp, Homo sapiens
ttccagaggcttgaggaaaatt

SEQ ID NO: 9058988 - DNA, 22 bp, Homo sapiens
ttccagaggcttcagggaagaa

SEQ ID NO: 9058989 - DNA, 22 bp, Homo sapiens
ttccagctaactcacatccctt

SEQ ID NO: 9058990 - DNA, 22 bp, Homo sapiens
ttccagccatggtttccctatg

SEQ ID NO: 9058991 - DNA, 22 bp, Homo sapiens
ttccagcccgcgacttgttcag

SEQ ID NO: 9058992 - DNA, 20 bp, Homo sapiens
ttatttctcattctcctact

SEQ ID NO: 9058993 - DNA, 22 bp, Homo sapiens
ttatttcttgtctatgtagcca

SEQ ID NO: 9058994 - DNA, 22 bp, Homo sapiens
ttatttcttgtctatgtagcca

SEQ ID NO: 9058995 - DNA, 22 bp, Homo sapiens
ttatttcttgtctatgtagcca

SEQ ID NO: 9058996 - DNA, 22 bp, Homo sapiens
ttatttctactattttgcctga

SEQ ID NO: 9058997 - DNA, 22 bp, Homo sapiens
ttcaccatgttggccaggctgg

SEQ ID NO: 9058998 - DNA, 19 bp, Homo sapiens
ttcacatttttgtggcact

SEQ ID NO: 9058999 - DNA, 22 bp, Homo sapiens
ttcacatttgaaaggaaagata

SEQ ID NO: 9059000 - DNA, 22 bp, Homo sapiens
ttcacattggttcttgatagct

SEQ ID NO: 9059001 - DNA, 22 bp, Homo sapiens
ttcacattgtgcagattatggt

SEQ ID NO: 9059002 - DNA, 22 bp, Homo sapiens
ttcacattgtggttcatgtgaa

SEQ ID NO: 9059003 - DNA, 22 bp, Homo sapiens
ttcactgagagacatgaaggtc

SEQ ID NO: 9059004 - DNA, 22 bp, Homo sapiens
ttcactggggagatgtggcaga

SEQ ID NO: 9059005 - DNA, 22 bp, Homo sapiens
ttcactatgcttggaaacttct

SEQ ID NO: 9059006 - DNA, 22 bp, Homo sapiens
ttcagctaaggagtttcactgt

SEQ ID NO: 9059007 - DNA, 22 bp, Homo sapiens
ttcaggaaggtcctatagcaga

SEQ ID NO: 9059008 - DNA, 22 bp, Homo sapiens
tgttaaaaccacaggtgaggac

SEQ ID NO: 9059009 - DNA, 22 bp, Homo sapiens
tgtgtgtgtaaaagcatttata

SEQ ID NO: 9059010 - DNA, 22 bp, Homo sapiens
tgtgtggattcatctcaaagag

SEQ ID NO: 9059011 - DNA, 22 bp, Homo sapiens
tgtgtcagaaatcagtgcctcg

SEQ ID NO: 9059012 - DNA, 22 bp, Homo sapiens
tgtgggagaaggaagcaagctg

SEQ ID NO: 9059013 - DNA, 22 bp, Homo sapiens
tgtgggaggaacacagccagaa

SEQ ID NO: 9059014 - DNA, 22 bp, Homo sapiens
tgtggctctcctcctgctgccc

SEQ ID NO: 9059015 - DNA, 22 bp, Homo sapiens
tgtggctccactccacattaat

SEQ ID NO: 9059016 - DNA, 22 bp, Homo sapiens
tgtggaagggacactggactgg

SEQ ID NO: 9059017 - DNA, 22 bp, Homo sapiens
tgtggggacccatgccatgggc

SEQ ID NO: 9059018 - DNA, 22 bp, Homo sapiens
tgtggggactgagtggaggctt

SEQ ID NO: 9059019 - DNA, 22 bp, Homo sapiens
tgtgtacatatctatcctagat

SEQ ID NO: 9059020 - DNA, 22 bp, Homo sapiens
ttaaaaaccatcttcctttcct

SEQ ID NO: 9059021 - DNA, 22 bp, Homo sapiens
tgtttttttatatacctgaagt

SEQ ID NO: 9059022 - DNA, 22 bp, Homo sapiens
tgttttttccttatgcaatctg

SEQ ID NO: 9059023 - DNA, 22 bp, Homo sapiens
ttaaaaatatgtagggcccgat

SEQ ID NO: 9059024 - DNA, 20 bp, Homo sapiens
ttaaaaagagtcacaggaga

SEQ ID NO: 9059025 - DNA, 22 bp, Homo sapiens
ttaaaaatatgtagggcccgat

SEQ ID NO: 9059026 - DNA, 22 bp, Homo sapiens
ttaaaagaatcctgttatcctc

SEQ ID NO: 9059027 - DNA, 22 bp, Homo sapiens
ttaaaagacctgttgaggttag

SEQ ID NO: 9059028 - DNA, 22 bp, Homo sapiens
ttaaaaccatcagctgtaagat

SEQ ID NO: 9059029 - DNA, 22 bp, Homo sapiens
ttaaaatgtacaggggaaagtg

SEQ ID NO: 9059030 - DNA, 22 bp, Homo sapiens
ttaaaattatggcccatttgga

SEQ ID NO: 9059031 - DNA, 22 bp, Homo sapiens
ttaaaatttccccaccatgtat

SEQ ID NO: 9059032 - DNA, 22 bp, Homo sapiens
ttaaacacctgtctagtgtagc

SEQ ID NO: 9059033 - DNA, 23 bp, Homo sapiens
ttaaacactagttcgagtagcat

SEQ ID NO: 9059034 - DNA, 22 bp, Homo sapiens
ttaaaatttccccaccatgtat

SEQ ID NO: 9059035 - DNA, 22 bp, Homo sapiens
ttaaacagacagtaaatgaaac

SEQ ID NO: 9059036 - DNA, 22 bp, Homo sapiens
ttaaacagacagtaaatgaaac

SEQ ID NO: 9059037 - DNA, 22 bp, Homo sapiens
tgtttgttccctctctttcctg

SEQ ID NO: 9059038 - DNA, 23 bp, Homo sapiens
tgtttgtttctatgagagatagc

SEQ ID NO: 9059039 - DNA, 22 bp, Homo sapiens
tgttttatttctccaagaggga

SEQ ID NO: 9059040 - DNA, 22 bp, Homo sapiens
tgttttcaagtcaaggccaaat

SEQ ID NO: 9059041 - DNA, 22 bp, Homo sapiens
tgtttttgtctccttgtctgct

SEQ ID NO: 9059042 - DNA, 22 bp, Homo sapiens
tgttaactaatggtctaacatt

SEQ ID NO: 9059043 - DNA, 22 bp, Homo sapiens
tgttcttttctctaaactgata

SEQ ID NO: 9059044 - DNA, 22 bp, Homo sapiens
tgtttattgctgcaattgtgcc

SEQ ID NO: 9059045 - DNA, 18 bp, Homo sapiens
tgtttattctcctgacag

SEQ ID NO: 9059046 - DNA, 22 bp, Homo sapiens
tgttgtgacctctctgcattca

SEQ ID NO: 9059047 - DNA, 22 bp, Homo sapiens
tgttgtcagtattaatttcaca

SEQ ID NO: 9059048 - DNA, 22 bp, Homo sapiens
tgttgtcagtattaatttcaca

SEQ ID NO: 9059049 - DNA, 22 bp, Homo sapiens
tgtttaaatagaacatactgca

SEQ ID NO: 9059050 - DNA, 19 bp, Homo sapiens
tgtctcctcatgcaagtgt

SEQ ID NO: 9059051 - DNA, 22 bp, Homo sapiens
tgtctcctgagagctggacaga

SEQ ID NO: 9059052 - DNA, 22 bp, Homo sapiens
tgtctctttgggttcctcttgg

SEQ ID NO: 9059053 - DNA, 22 bp, Homo sapiens
tgtctctttgggttcctcttgg

SEQ ID NO: 9059054 - DNA, 22 bp, Homo sapiens
tgtctctgctgcaccttctggg

SEQ ID NO: 9059055 - DNA, 22 bp, Homo sapiens
tgtctctgaaatatgtggctcc

SEQ ID NO: 9059056 - DNA, 22 bp, Homo sapiens
tgtctgcagaagatggcatggg

SEQ ID NO: 9059057 - DNA, 22 bp, Homo sapiens
tgtcttatggcatgtccactgg

SEQ ID NO: 9059058 - DNA, 22 bp, Homo sapiens
tgtcttatgctgcatagactat

SEQ ID NO: 9059059 - DNA, 17 bp, Homo sapiens
tgtcttatctgtcctgt

SEQ ID NO: 9059060 - DNA, 22 bp, Homo sapiens
tgtcttacatgagtcaccccaa

SEQ ID NO: 9059061 - DNA, 22 bp, Homo sapiens
tgtcttattccttctgttcagc

SEQ ID NO: 9059062 - DNA, 22 bp, Homo sapiens
tgtcttattaagaccagtgact

SEQ ID NO: 9059063 - DNA, 22 bp, Homo sapiens
tgtcttcacatgataagccatt

SEQ ID NO: 9059064 - DNA, 22 bp, Homo sapiens
tgtcttcaggagtaaatatcat

SEQ ID NO: 9059065 - DNA, 22 bp, Homo sapiens
tgtcttcagataggcattcttc

SEQ ID NO: 9059066 - DNA, 22 bp, Homo sapiens
tgtcttaagtagattacagcct

SEQ ID NO: 9059067 - DNA, 22 bp, Homo sapiens
tgtcttaatatgtgcattctgt

SEQ ID NO: 9059068 - DNA, 17 bp, Homo sapiens
tgtcttctgaagagagc

SEQ ID NO: 9059069 - DNA, 22 bp, Homo sapiens
tgtcttctgtattcaagtctat

SEQ ID NO: 9059070 - DNA, 22 bp, Homo sapiens
tgtcttctaccttgacagcatt

SEQ ID NO: 9059071 - DNA, 22 bp, Homo sapiens
tgtcttcagtaaaatacactat

SEQ ID NO: 9059072 - DNA, 22 bp, Homo sapiens
tgtcttttggagcatctttctt

SEQ ID NO: 9059073 - DNA, 22 bp, Homo sapiens
tgtctttttactatgttcaatc

SEQ ID NO: 9059074 - DNA, 22 bp, Homo sapiens
tgtcttttacctaatgagctgg

SEQ ID NO: 9059075 - DNA, 22 bp, Homo sapiens
tgtcttttacctaatgagctgg

SEQ ID NO: 9059076 - DNA, 22 bp, Homo sapiens
tgtctttggggctgtacctgtt

SEQ ID NO: 9059077 - DNA, 21 bp, Homo sapiens
tgtctttggcctcattcccag

SEQ ID NO: 9059078 - DNA, 22 bp, Homo sapiens
tgtcttttgccaaagatcagtt

SEQ ID NO: 9059079 - DNA, 22 bp, Homo sapiens
tgtcttttataactgacatata

SEQ ID NO: 9059080 - DNA, 22 bp, Homo sapiens
tgtgcaatcatattttaaaatg

SEQ ID NO: 9059081 - DNA, 22 bp, Homo sapiens
tgtgatttattgaaaagagctt

SEQ ID NO: 9059082 - DNA, 22 bp, Homo sapiens
tgtgcacatatactcatattcc

SEQ ID NO: 9059083 - DNA, 22 bp, Homo sapiens
tgtgcacaggaagctattctct

SEQ ID NO: 9059084 - DNA, 22 bp, Homo sapiens
tgtgccacatacacagtacatt

SEQ ID NO: 9059085 - DNA, 22 bp, Homo sapiens
tgtgctgacaagatcagaaggt

SEQ ID NO: 9059086 - DNA, 22 bp, Homo sapiens
tgtgctctggagttgccttcac

SEQ ID NO: 9059087 - DNA, 22 bp, Homo sapiens
tgtgctcttctgttacttgtag

SEQ ID NO: 9059088 - DNA, 22 bp, Homo sapiens
tgtgctcactctaaattaagat

SEQ ID NO: 9059089 - DNA, 22 bp, Homo sapiens
tgtgctctgcaatcagttcttt

SEQ ID NO: 9059090 - DNA, 22 bp, Homo sapiens
tgtgctctgcccctgactgttt

SEQ ID NO: 9059091 - DNA, 22 bp, Homo sapiens
tgtgctctgactttctcctggt

SEQ ID NO: 9059092 - DNA, 22 bp, Homo sapiens
tgtgagttattttcaggagttt

SEQ ID NO: 9059093 - DNA, 22 bp, Homo sapiens
tgtgagttcttagaaagtcagt

SEQ ID NO: 9059094 - DNA, 22 bp, Homo sapiens
tgtgattcaagaaagtaaaatg

SEQ ID NO: 9059095 - DNA, 22 bp, Homo sapiens
tgtgactggttgtcccgctttc

SEQ ID NO: 9059096 - DNA, 22 bp, Homo sapiens
tgtgactaggcctgagctcttg

SEQ ID NO: 9059097 - DNA, 22 bp, Homo sapiens
tgtgacgttgttctggattccc

SEQ ID NO: 9059098 - DNA, 22 bp, Homo sapiens
tgtgaaggttaaataatatgat

SEQ ID NO: 9059099 - DNA, 22 bp, Homo sapiens
tgtgaatggacaattaaatcta

SEQ ID NO: 9059100 - DNA, 22 bp, Homo sapiens
tgtgacagccagtaaagtaagc

SEQ ID NO: 9059101 - DNA, 20 bp, Homo sapiens
tgtgaaagcagtagaatgac

SEQ ID NO: 9059102 - DNA, 22 bp, Homo sapiens
tgtgaaatctgatgaattgacc

SEQ ID NO: 9059103 - DNA, 22 bp, Homo sapiens
tgtgaaattacttaaaggaaat

SEQ ID NO: 9059104 - DNA, 22 bp, Homo sapiens
aaacatgatgtcatatatgcca

SEQ ID NO: 9059105 - DNA, 22 bp, Homo sapiens
aaacatgatgtcatatatgcca

SEQ ID NO: 9059106 - DNA, 22 bp, Homo sapiens
aaacatgtaagttcagatcacc

SEQ ID NO: 9059107 - DNA, 22 bp, Homo sapiens
aaacatgtaagttcagatcacc

SEQ ID NO: 9059108 - DNA, 22 bp, Homo sapiens
aaacatgtaattctgcttaaga

SEQ ID NO: 9059109 - DNA, 22 bp, Homo sapiens
aaacatgtttagaaagcagctg

SEQ ID NO: 9059110 - DNA, 22 bp, Homo sapiens
aaacattccatttctatgtaag

SEQ ID NO: 9059111 - DNA, 22 bp, Homo sapiens
aaacattccatttctatgtaag

SEQ ID NO: 9059112 - DNA, 20 bp, Homo sapiens
aaacattcatgtacaagtga

SEQ ID NO: 9059113 - DNA, 22 bp, Homo sapiens
aaacattagacaccatatgctc

SEQ ID NO: 9059114 - DNA, 22 bp, Homo sapiens
aaacatgttttctgaatatttt

SEQ ID NO: 9059115 - DNA, 22 bp, Homo sapiens
aaacattcaaagcaggatgtgt

SEQ ID NO: 9059116 - DNA, 22 bp, Homo sapiens
aaacattcacatttgctagtaa

SEQ ID NO: 9059117 - DNA, 22 bp, Homo sapiens
aaacattcacatttgctagtaa

SEQ ID NO: 9059118 - DNA, 22 bp, Homo sapiens
aaacattctcagccctgcttgc

SEQ ID NO: 9059119 - DNA, 22 bp, Homo sapiens
aaactgcaattatgtttgcaga

SEQ ID NO: 9059120 - DNA, 22 bp, Homo sapiens
aaactgcaattacttttgcacc

SEQ ID NO: 9059121 - DNA, 22 bp, Homo sapiens
aaactgcaattacttttgcagc

SEQ ID NO: 9059122 - DNA, 22 bp, Homo sapiens
aaactgcaatgacaggtaggag

SEQ ID NO: 9059123 - DNA, 22 bp, Homo sapiens
aaagccagcaaggtgagtttca

SEQ ID NO: 9059124 - DNA, 22 bp, Homo sapiens
aaagccagagtgtgttagagac

SEQ ID NO: 9059125 - DNA, 20 bp, Homo sapiens
aaagccactggcaagagact

SEQ ID NO: 9059126 - DNA, 22 bp, Homo sapiens
aaacactgaaaattttggtcat

SEQ ID NO: 9059127 - DNA, 22 bp, Homo sapiens
aaacactgaaaattttggtcat

SEQ ID NO: 9059128 - DNA, 22 bp, Homo sapiens
aaacactgaagacctatctggt

SEQ ID NO: 9059129 - DNA, 22 bp, Homo sapiens
aaacactgatggatatttttcc

SEQ ID NO: 9059130 - DNA, 22 bp, Homo sapiens
aaacactgtgggacatcttact

SEQ ID NO: 9059131 - DNA, 22 bp, Homo sapiens
aaacagagggccactgaggctc

SEQ ID NO: 9059132 - DNA, 22 bp, Homo sapiens
aaacagataagggacaatttca

SEQ ID NO: 9059133 - DNA, 22 bp, Homo sapiens
aaacagagtttggtaaatagcc

SEQ ID NO: 9059134 - DNA, 22 bp, Homo sapiens
aaacagataatgctataaatgg

SEQ ID NO: 9059135 - DNA, 22 bp, Homo sapiens
aaacagctaagtacattcaagg

SEQ ID NO: 9059136 - DNA, 22 bp, Homo sapiens
aaacagctaagtacattcaagg

SEQ ID NO: 9059137 - DNA, 22 bp, Homo sapiens
aaacagctaatggccaggaata

SEQ ID NO: 9059138 - DNA, 22 bp, Homo sapiens
aaacagctacttctgtataatg

SEQ ID NO: 9059139 - DNA, 20 bp, Homo sapiens
aaacagctaaaccagctctc

SEQ ID NO: 9059140 - DNA, 22 bp, Homo sapiens
aaacagcagctgtttaatttgc

SEQ ID NO: 9059141 - DNA, 22 bp, Homo sapiens
aaacagcaggaacatcttgcca

SEQ ID NO: 9059142 - DNA, 22 bp, Homo sapiens
aaacagcaattacttttgcacc

SEQ ID NO: 9059143 - DNA, 22 bp, Homo sapiens
aaacagattgaaattcgtagta

SEQ ID NO: 9059144 - DNA, 22 bp, Homo sapiens
aaacagctacttctgtataatg

SEQ ID NO: 9059145 - DNA, 22 bp, Homo sapiens
aaacagctcaagaagttactct

SEQ ID NO: 9059146 - DNA, 22 bp, Homo sapiens
aaacagctccttagtttccatc

SEQ ID NO: 9059147 - DNA, 22 bp, Homo sapiens
aaacagctcaagaagttactct

SEQ ID NO: 9059148 - DNA, 22 bp, Homo sapiens
aaacagctgggaggtagaggcg

SEQ ID NO: 9059149 - DNA, 22 bp, Homo sapiens
aaacagctgcagtacacggcct

SEQ ID NO: 9059150 - DNA, 22 bp, Homo sapiens
aaacagctgcactgctgatgtc

SEQ ID NO: 9059151 - DNA, 22 bp, Homo sapiens
aaacatgatgtcatatatgcca

SEQ ID NO: 9059152 - DNA, 22 bp, Homo sapiens
aaacatgatgcctgtactaaga

SEQ ID NO: 9059153 - DNA, 22 bp, Homo sapiens
aaacatgatgcctgtactaaga

SEQ ID NO: 9059154 - DNA, 22 bp, Homo sapiens
aaacagctggtctcaaatgttc

SEQ ID NO: 9059155 - DNA, 22 bp, Homo sapiens
aaacagctgtcattgttttaaa

SEQ ID NO: 9059156 - DNA, 22 bp, Homo sapiens
aaacttttcctgctcttgtcct

SEQ ID NO: 9059157 - DNA, 22 bp, Homo sapiens
aaacttcattttcaactgcaaa

SEQ ID NO: 9059158 - DNA, 22 bp, Homo sapiens
aaacttcattttcaactgcaaa

SEQ ID NO: 9059159 - DNA, 22 bp, Homo sapiens
aaatagtttagctctcatttca

SEQ ID NO: 9059160 - DNA, 22 bp, Homo sapiens
aaatagttagccctgcatatat

SEQ ID NO: 9059161 - DNA, 22 bp, Homo sapiens
aaatagttcagccacggtgact

SEQ ID NO: 9059162 - DNA, 22 bp, Homo sapiens
aaagaaacctatcagccacatg

SEQ ID NO: 9059163 - DNA, 22 bp, Homo sapiens
aaacttttttaggttcataggc

SEQ ID NO: 9059164 - DNA, 22 bp, Homo sapiens
aaacttttttaggttcataggc

SEQ ID NO: 9059165 - DNA, 22 bp, Homo sapiens
aaagaacaaatgatatatggtt

SEQ ID NO: 9059166 - DNA, 22 bp, Homo sapiens
aaagaaatagatggcatttaaa

SEQ ID NO: 9059167 - DNA, 22 bp, Homo sapiens
aaagactaagaagagtattatt

SEQ ID NO: 9059168 - DNA, 22 bp, Homo sapiens
aaagactaagaagagtattatt

SEQ ID NO: 9059169 - DNA, 22 bp, Homo sapiens
aaagacatgacacattggagag

SEQ ID NO: 9059170 - DNA, 22 bp, Homo sapiens
aaagactctaggtagcttataa

SEQ ID NO: 9059171 - DNA, 22 bp, Homo sapiens
aaagactcactttcagctctgg

SEQ ID NO: 9059172 - DNA, 22 bp, Homo sapiens
aaagaacagatgtgtggtgcat

SEQ ID NO: 9059173 - DNA, 23 bp, Homo sapiens
aaagactctccagagggaagtag

SEQ ID NO: 9059174 - DNA, 22 bp, Homo sapiens
aaagaacagatgtgtggtgcat

SEQ ID NO: 9059175 - DNA, 22 bp, Homo sapiens
aaagaacaatgtggaatctcct

SEQ ID NO: 9059176 - DNA, 22 bp, Homo sapiens
aaagaacaatgtggaatctcct

SEQ ID NO: 9059177 - DNA, 22 bp, Homo sapiens
aaagaacaatgtggaatctcct

SEQ ID NO: 9059178 - DNA, 22 bp, Homo sapiens
aaagactttcacctagcaaaga

SEQ ID NO: 9059179 - DNA, 22 bp, Homo sapiens
aaagactttcacctagcaaaga

SEQ ID NO: 9059180 - DNA, 22 bp, Homo sapiens
aaagactttaggttagaggcat

SEQ ID NO: 9059181 - DNA, 22 bp, Homo sapiens
aaagactttcacctagcaaaga

SEQ ID NO: 9059182 - DNA, 22 bp, Homo sapiens
aaagacttgggagcagtatgct

SEQ ID NO: 9059183 - DNA, 22 bp, Homo sapiens
aaagacttggcttatgatttgc

SEQ ID NO: 9059184 - DNA, 22 bp, Homo sapiens
aaagacttggcttatgatttgc

SEQ ID NO: 9059185 - DNA, 21 bp, Homo sapiens
aaagacttgcctgaaagtgag

SEQ ID NO: 9059186 - DNA, 23 bp, Homo sapiens
aaagactctccagagggaagtag

SEQ ID NO: 9059187 - DNA, 22 bp, Homo sapiens
aaagagatgtgccaaatagcct

SEQ ID NO: 9059188 - DNA, 22 bp, Homo sapiens
aaagagcaccctcaatgtctga

SEQ ID NO: 9059189 - DNA, 22 bp, Homo sapiens
aaagatgtgtaagaaataaaca

SEQ ID NO: 9059190 - DNA, 22 bp, Homo sapiens
aaagatgttatgaaataactat

SEQ ID NO: 9059191 - DNA, 21 bp, Homo sapiens
aaagatgtttcatctgagaaa

SEQ ID NO: 9059192 - DNA, 21 bp, Homo sapiens
aaagatgtttcatctgagaaa

SEQ ID NO: 9059193 - DNA, 21 bp, Homo sapiens
aaagagacaaatggcatatac

SEQ ID NO: 9059194 - DNA, 22 bp, Homo sapiens
aaagagaaacttagaagcctga

SEQ ID NO: 9059195 - DNA, 20 bp, Homo sapiens
aaagagaagcctcaccttgt

SEQ ID NO: 9059196 - DNA, 22 bp, Homo sapiens
aaagagaacttttacccaagaa

SEQ ID NO: 9059197 - DNA, 22 bp, Homo sapiens
aaagagaaacttagaagcctga

SEQ ID NO: 9059198 - DNA, 22 bp, Homo sapiens
aaagagaaaatgatctgtacat

SEQ ID NO: 9059199 - DNA, 22 bp, Homo sapiens
aaacacattttaggaaaatcta

SEQ ID NO: 9059200 - DNA, 22 bp, Homo sapiens
aaacaccaagagctagctatta

SEQ ID NO: 9059201 - DNA, 22 bp, Homo sapiens
aaacacaagatggcctcttctg

SEQ ID NO: 9059202 - DNA, 22 bp, Homo sapiens
aaacacatcattcatgtcgtca

SEQ ID NO: 9059203 - DNA, 22 bp, Homo sapiens
aaaattgaggctcatgttaaat

SEQ ID NO: 9059204 - DNA, 22 bp, Homo sapiens
aaaattgaggctcatgttaaat

SEQ ID NO: 9059205 - DNA, 22 bp, Homo sapiens
aaagagccagctacctcagttt

SEQ ID NO: 9059206 - DNA, 22 bp, Homo sapiens
aaagagctaacattgccgagat

SEQ ID NO: 9059207 - DNA, 17 bp, Homo sapiens
aaaattctgtaaagagg

SEQ ID NO: 9059208 - DNA, 17 bp, Homo sapiens
aaaattctgtaaagagg

SEQ ID NO: 9059209 - DNA, 17 bp, Homo sapiens
aaaattctgtaaagagg

SEQ ID NO: 9059210 - DNA, 22 bp, Homo sapiens
aaactggtaataaaatggatta

SEQ ID NO: 9059211 - DNA, 22 bp, Homo sapiens
aaaatgtgatctacaaatgcaa

SEQ ID NO: 9059212 - DNA, 22 bp, Homo sapiens
aaaattcattcctcagactgcc

SEQ ID NO: 9059213 - DNA, 22 bp, Homo sapiens
aaaattcattcctcagactgcc

SEQ ID NO: 9059214 - DNA, 22 bp, Homo sapiens
aaaatatgtataactcttctgc

SEQ ID NO: 9059215 - DNA, 22 bp, Homo sapiens
aaaatatgtataactcttctgc

SEQ ID NO: 9059216 - DNA, 22 bp, Homo sapiens
aaaatattttagggccaggaga

SEQ ID NO: 9059217 - DNA, 22 bp, Homo sapiens
aaaatattttagggccaggaga

SEQ ID NO: 9059218 - DNA, 22 bp, Homo sapiens
aaaatattttagggccaggaga

SEQ ID NO: 9059219 - DNA, 22 bp, Homo sapiens
aaactgcaattatttttgcaat

SEQ ID NO: 9059220 - DNA, 22 bp, Homo sapiens
aaactgcacaagggtgcatagc

SEQ ID NO: 9059221 - DNA, 22 bp, Homo sapiens
aaactgcacacgatgtgcctga

SEQ ID NO: 9059222 - DNA, 22 bp, Homo sapiens
aaactgcacatgaggctggtgc

SEQ ID NO: 9059223 - DNA, 22 bp, Homo sapiens
aaactgcactttattttgtcaa

SEQ ID NO: 9059224 - DNA, 17 bp, Homo sapiens
aaactggggtcaggagc

SEQ ID NO: 9059225 - DNA, 23 bp, Homo sapiens
aaactgcatctctgagcctcagc

SEQ ID NO: 9059226 - DNA, 22 bp, Homo sapiens
aaactgcaggtcatgacccatt

SEQ ID NO: 9059227 - DNA, 22 bp, Homo sapiens
aaactgcagccttgagttcagg

SEQ ID NO: 9059228 - DNA, 22 bp, Homo sapiens
aaactgcagagccatggttcaa

SEQ ID NO: 9059229 - DNA, 22 bp, Homo sapiens
aaactgcagagccatggttcaa

SEQ ID NO: 9059230 - DNA, 22 bp, Homo sapiens
aaactgcatgaagctgatttta

SEQ ID NO: 9059231 - DNA, 22 bp, Homo sapiens
aaacagctttcagaatctctca

SEQ ID NO: 9059232 - DNA, 22 bp, Homo sapiens
aaacagtaagttctagtattat

SEQ ID NO: 9059233 - DNA, 22 bp, Homo sapiens
aaacagtactcgatttttgtag

SEQ ID NO: 9059234 - DNA, 22 bp, Homo sapiens
aaacagtagaagtgtattttat

SEQ ID NO: 9059235 - DNA, 22 bp, Homo sapiens
aaacagtattatcaatatattt

SEQ ID NO: 9059236 - DNA, 22 bp, Homo sapiens
aaaatatgactgtgctccttaa

SEQ ID NO: 9059237 - DNA, 22 bp, Homo sapiens
aaacagtattatcaatatattt

SEQ ID NO: 9059238 - DNA, 22 bp, Homo sapiens
aaaagtaattgcagttttgtca

SEQ ID NO: 9059239 - DNA, 22 bp, Homo sapiens
aaacagctttcagaatctctca

SEQ ID NO: 9059240 - DNA, 22 bp, Homo sapiens
aaacagcttgtttcaggaaagt

SEQ ID NO: 9059241 - DNA, 22 bp, Homo sapiens
aaaagtaattgcaattttgtag

SEQ ID NO: 9059242 - DNA, 22 bp, Homo sapiens
aaaagtaattgatgcaatcgta

SEQ ID NO: 9059243 - DNA, 22 bp, Homo sapiens
aaaaggaggacatggttacaga

SEQ ID NO: 9059244 - DNA, 19 bp, Homo sapiens
aaaaggagagatcagagtt

SEQ ID NO: 9059245 - DNA, 22 bp, Homo sapiens
aaaattcatagaactgtacgct

SEQ ID NO: 9059246 - DNA, 22 bp, Homo sapiens
aaaaggtagttgccaaataagg

SEQ ID NO: 9059247 - DNA, 22 bp, Homo sapiens
aaaaggtagttgccaaataagg

SEQ ID NO: 9059248 - DNA, 22 bp, Homo sapiens
aaaactttcagggatacagaaa

SEQ ID NO: 9059249 - DNA, 22 bp, Homo sapiens
aaaactgaaccttgagatcttt

SEQ ID NO: 9059250 - DNA, 18 bp, Homo sapiens
aaaatgttcccccattaa

SEQ ID NO: 9059251 - DNA, 22 bp, Homo sapiens
aaaatgttcaagcatgctggtt

SEQ ID NO: 9059252 - DNA, 22 bp, Homo sapiens
aaaattaagtgtctgggaagcc

SEQ ID NO: 9059253 - DNA, 22 bp, Homo sapiens
aaaattaagtgtctgggaagcc

SEQ ID NO: 9059254 - DNA, 21 bp, Homo sapiens
aaaatgtttccttgttggtta

SEQ ID NO: 9059255 - DNA, 22 bp, Homo sapiens
aaaattcatagaactgtacgct

SEQ ID NO: 9059256 - DNA, 22 bp, Homo sapiens
aaaattattcatggcttttgga

SEQ ID NO: 9059257 - DNA, 22 bp, Homo sapiens
aaaattatggagtatcccaaag

SEQ ID NO: 9059258 - DNA, 22 bp, Homo sapiens
aaaattatagatctagtgcctg

SEQ ID NO: 9059259 - DNA, 21 bp, Homo sapiens
aaaatgtttccttgttggtta

SEQ ID NO: 9059260 - DNA, 22 bp, Homo sapiens
aaaattactattgttcctgggc

SEQ ID NO: 9059261 - DNA, 22 bp, Homo sapiens
aaaactacatttgacattttgt

SEQ ID NO: 9059262 - DNA, 22 bp, Homo sapiens
aaaacgatgtttaaaagctctg

SEQ ID NO: 9059263 - DNA, 22 bp, Homo sapiens
aaaactgaaatacgatccaatg

SEQ ID NO: 9059264 - DNA, 22 bp, Homo sapiens
aaaaggcatggaggttgatagt

SEQ ID NO: 9059265 - DNA, 22 bp, Homo sapiens
aaaaggatcagattttgagcag

SEQ ID NO: 9059266 - DNA, 22 bp, Homo sapiens
aaaaggatgttttcatgaaaca

SEQ ID NO: 9059267 - DNA, 22 bp, Homo sapiens
aaaaggatgttttcatgaaaca

SEQ ID NO: 9059268 - DNA, 22 bp, Homo sapiens
aaaaggcagtgcaagagagggt

SEQ ID NO: 9059269 - DNA, 22 bp, Homo sapiens
aaaaggatgttttcatgaaaca

SEQ ID NO: 9059270 - DNA, 22 bp, Homo sapiens
aaaaggcattttgtcaaccata

SEQ ID NO: 9059271 - DNA, 22 bp, Homo sapiens
aaaaggcattttgtcaaccata

SEQ ID NO: 9059272 - DNA, 22 bp, Homo sapiens
aaaaggaggtcactttattcct

SEQ ID NO: 9059273 - DNA, 22 bp, Homo sapiens
aaaaggaggcaaacagcctaga

SEQ ID NO: 9059274 - DNA, 21 bp, Homo sapiens
aaaaggaggcaggtgaacagc

SEQ ID NO: 9059275 - DNA, 21 bp, Homo sapiens
aaaaggaggcaggtgaacagc

SEQ ID NO: 9059276 - DNA, 18 bp, Homo sapiens
aaaaagtgctcaggccta

SEQ ID NO: 9059277 - DNA, 22 bp, Homo sapiens
aaaaagtttcaactgccaactc

SEQ ID NO: 9059278 - DNA, 22 bp, Homo sapiens
aaaaagtttcaactgccaactc

SEQ ID NO: 9059279 - DNA, 22 bp, Homo sapiens
aaaaagtttcaactgccaactc

SEQ ID NO: 9059280 - DNA, 22 bp, Homo sapiens
aaaaatacttcacttctgggtg

SEQ ID NO: 9059281 - DNA, 22 bp, Homo sapiens
aaaaagtattggccatggttga

SEQ ID NO: 9059282 - DNA, 22 bp, Homo sapiens
aaaaaggctaagcatcttgtgc

SEQ ID NO: 9059283 - DNA, 22 bp, Homo sapiens
aaaaagggatttgtgatccagg

SEQ ID NO: 9059284 - DNA, 22 bp, Homo sapiens
aaaaagtattggccatggttga

SEQ ID NO: 9059285 - DNA, 22 bp, Homo sapiens
aaaaagtattggccatggttga

SEQ ID NO: 9059286 - DNA, 22 bp, Homo sapiens
aaaaaggttgatccagattagg

SEQ ID NO: 9059287 - DNA, 22 bp, Homo sapiens
aaaaagatgtcctgaagtttag

SEQ ID NO: 9059288 - DNA, 22 bp, Homo sapiens
aaaaagatgtcctgaagtttag

SEQ ID NO: 9059289 - DNA, 22 bp, Homo sapiens
aagcaggagatgcaggaatgta

SEQ ID NO: 9059290 - DNA, 22 bp, Homo sapiens
aagcaggatggatctagtgttc

SEQ ID NO: 9059291 - DNA, 22 bp, Homo sapiens
aagcaggcagggtggagagttt

SEQ ID NO: 9059292 - DNA, 22 bp, Homo sapiens
aagcaggcatgggaggccatcc

SEQ ID NO: 9059293 - DNA, 22 bp, Homo sapiens
aagcaggcatgggaggccatcc

SEQ ID NO: 9059294 - DNA, 22 bp, Homo sapiens
aagcaggcatcttggaggtcaa

SEQ ID NO: 9059295 - DNA, 22 bp, Homo sapiens
aagattctcactgctcaacttt

SEQ ID NO: 9059296 - DNA, 22 bp, Homo sapiens
aagcagcatatgacagcatcca

SEQ ID NO: 9059297 - DNA, 22 bp, Homo sapiens
aagattctacagtaggtacatt

SEQ ID NO: 9059298 - DNA, 22 bp, Homo sapiens
aagattctagaggaacttctta

SEQ ID NO: 9059299 - DNA, 20 bp, Homo sapiens
aagattcattgtaattaggg

SEQ ID NO: 9059300 - DNA, 22 bp, Homo sapiens
aagattctacaaactctggtaa

SEQ ID NO: 9059301 - DNA, 22 bp, Homo sapiens
aagattcacagagtgaatgaaa

SEQ ID NO: 9059302 - DNA, 22 bp, Homo sapiens
aagattcagccaaattgttcat

SEQ ID NO: 9059303 - DNA, 22 bp, Homo sapiens
aagattcagccaaattgttcat

SEQ ID NO: 9059304 - DNA, 22 bp, Homo sapiens
aagattcagttgatgtgttcca

SEQ ID NO: 9059305 - DNA, 22 bp, Homo sapiens
aagattcacagagtgaatgaaa

SEQ ID NO: 9059306 - DNA, 22 bp, Homo sapiens
aagatgttttaatatttcgagg

SEQ ID NO: 9059307 - DNA, 22 bp, Homo sapiens
aagattatggcagataacaatt

SEQ ID NO: 9059308 - DNA, 22 bp, Homo sapiens
aagatcaagtgctggcagtgtt

SEQ ID NO: 9059309 - DNA, 22 bp, Homo sapiens
aagatcagctcccgagtctgag

SEQ ID NO: 9059310 - DNA, 22 bp, Homo sapiens
aagatattcaaagatttattag

SEQ ID NO: 9059311 - DNA, 22 bp, Homo sapiens
aagatatattttggtgatttca

SEQ ID NO: 9059312 - DNA, 22 bp, Homo sapiens
aagatgttgcaagggactcttc

SEQ ID NO: 9059313 - DNA, 22 bp, Homo sapiens
aagatcaggcgtggaaaacact

SEQ ID NO: 9059314 - DNA, 22 bp, Homo sapiens
aagattaaaggggagacaagct

SEQ ID NO: 9059315 - DNA, 22 bp, Homo sapiens
aagatgttttaatatttcgagg

SEQ ID NO: 9059316 - DNA, 22 bp, Homo sapiens
aagatgtttagatttatacaat

SEQ ID NO: 9059317 - DNA, 22 bp, Homo sapiens
aagatgtttaggtaaaaagttt

SEQ ID NO: 9059318 - DNA, 22 bp, Homo sapiens
aagatgttgggtgcctccggaa

SEQ ID NO: 9059319 - DNA, 22 bp, Homo sapiens
aagatgttgcattagaatacct

SEQ ID NO: 9059320 - DNA, 22 bp, Homo sapiens
aagatgttgtcgttagtgatga

SEQ ID NO: 9059321 - DNA, 18 bp, Homo sapiens
aagatgtttaatgggaag

SEQ ID NO: 9059322 - DNA, 22 bp, Homo sapiens
aagatgtttagatttatacaat

SEQ ID NO: 9059323 - DNA, 22 bp, Homo sapiens
aaatctgttgtaatgtttttta

SEQ ID NO: 9059324 - DNA, 22 bp, Homo sapiens
aaatctttccctttactatcca

SEQ ID NO: 9059325 - DNA, 22 bp, Homo sapiens
aagcccagatgggagcatttca

SEQ ID NO: 9059326 - DNA, 22 bp, Homo sapiens
aagcccagatgggagcatttca

SEQ ID NO: 9059327 - DNA, 22 bp, Homo sapiens
aagcaggcattccagagacaat

SEQ ID NO: 9059328 - DNA, 22 bp, Homo sapiens
aagcaggcattccagagacaat

SEQ ID NO: 9059329 - DNA, 22 bp, Homo sapiens
aagcaggccctgggccagggga

SEQ ID NO: 9059330 - DNA, 22 bp, Homo sapiens
aagcaggcgagggcctggagca

SEQ ID NO: 9059331 - DNA, 22 bp, Homo sapiens
aaatctcaatttgaattgtagc

SEQ ID NO: 9059332 - DNA, 22 bp, Homo sapiens
aaatctcactgtagtcaaagtg

SEQ ID NO: 9059333 - DNA, 22 bp, Homo sapiens
aaatctcagtgttctaagcatt

SEQ ID NO: 9059334 - DNA, 22 bp, Homo sapiens
aagccctgttaggcactgggga

SEQ ID NO: 9059335 - DNA, 22 bp, Homo sapiens
aagccctgttaggcactgggga

SEQ ID NO: 9059336 - DNA, 22 bp, Homo sapiens
aagccctgttaggcactgggga

SEQ ID NO: 9059337 - DNA, 22 bp, Homo sapiens
aagccctgttctttctctcacc

SEQ ID NO: 9059338 - DNA, 22 bp, Homo sapiens
aagccctgttctttctctcacc

SEQ ID NO: 9059339 - DNA, 22 bp, Homo sapiens
aagccctggggttgcacaaggc

SEQ ID NO: 9059340 - DNA, 22 bp, Homo sapiens
aagccctgtaaattgcccttaa

SEQ ID NO: 9059341 - DNA, 22 bp, Homo sapiens
aagccctggggttgcacaaggc

SEQ ID NO: 9059342 - DNA, 22 bp, Homo sapiens
aagccctgtaaattgcccttaa

SEQ ID NO: 9059343 - DNA, 22 bp, Homo sapiens
aagccctgtcaccctgacttca

SEQ ID NO: 9059344 - DNA, 22 bp, Homo sapiens
aagccctgtcaccctgacttca

SEQ ID NO: 9059345 - DNA, 22 bp, Homo sapiens
aagccctgtccggggggaagaa

SEQ ID NO: 9059346 - DNA, 22 bp, Homo sapiens
aagccctgtccggggggaagaa

SEQ ID NO: 9059347 - DNA, 22 bp, Homo sapiens
aagcccttccgtgctgctggat

SEQ ID NO: 9059348 - DNA, 22 bp, Homo sapiens
aagcccttggcgcacaccgggc

SEQ ID NO: 9059349 - DNA, 22 bp, Homo sapiens
aagccctttttcctggtagttt

SEQ ID NO: 9059350 - DNA, 22 bp, Homo sapiens
aagccgggcctgagaaatgaca

SEQ ID NO: 9059351 - DNA, 22 bp, Homo sapiens
aagccgaggccacacagcagga

SEQ ID NO: 9059352 - DNA, 22 bp, Homo sapiens
aagcctaaatgatgctattatg

SEQ ID NO: 9059353 - DNA, 22 bp, Homo sapiens
aaatgcatgtagaataatagag

SEQ ID NO: 9059354 - DNA, 22 bp, Homo sapiens
aaatgcatgtagaataatagag

SEQ ID NO: 9059355 - DNA, 22 bp, Homo sapiens
aaatgcatgtagaataatagag

SEQ ID NO: 9059356 - DNA, 22 bp, Homo sapiens
aaatgcatgtagaataatagag

SEQ ID NO: 9059357 - DNA, 22 bp, Homo sapiens
aaatgcatggtaaatgattgcc

SEQ ID NO: 9059358 - DNA, 22 bp, Homo sapiens
aagccttcagtccgttgcagag

SEQ ID NO: 9059359 - DNA, 22 bp, Homo sapiens
aaatgcatggctgttttaaagc

SEQ ID NO: 9059360 - DNA, 22 bp, Homo sapiens
aagcctctggggcctcatctgt

SEQ ID NO: 9059361 - DNA, 22 bp, Homo sapiens
aagcctctggggcctcatctgt

SEQ ID NO: 9059362 - DNA, 22 bp, Homo sapiens
aagcctcaccttttagaagcta

SEQ ID NO: 9059363 - DNA, 22 bp, Homo sapiens
aagccttcagagttggctggtc

SEQ ID NO: 9059364 - DNA, 22 bp, Homo sapiens
aagccttaaatgtttctaatat

SEQ ID NO: 9059365 - DNA, 22 bp, Homo sapiens
aagcctgtgtttctgctagtct

SEQ ID NO: 9059366 - DNA, 22 bp, Homo sapiens
aaatactggcaagtgctaattc

SEQ ID NO: 9059367 - DNA, 22 bp, Homo sapiens
aaatactctcaataaagaaagt

SEQ ID NO: 9059368 - DNA, 22 bp, Homo sapiens
aagaggtaaccatagcaaccac

SEQ ID NO: 9059369 - DNA, 22 bp, Homo sapiens
aagaggtaaccatagcaaccac

SEQ ID NO: 9059370 - DNA, 22 bp, Homo sapiens
aagaggtaatgactgcttgagt

SEQ ID NO: 9059371 - DNA, 22 bp, Homo sapiens
aaatacattagacggagagtta

SEQ ID NO: 9059372 - DNA, 22 bp, Homo sapiens
aagaggtaatgactgcttgagt

SEQ ID NO: 9059373 - DNA, 22 bp, Homo sapiens
aagaggggtggtctgtgaggat

SEQ ID NO: 9059374 - DNA, 22 bp, Homo sapiens
aagaggggtgtgtgtcaaccca

SEQ ID NO: 9059375 - DNA, 22 bp, Homo sapiens
aagaggggtgtgtgtcaaccca

SEQ ID NO: 9059376 - DNA, 22 bp, Homo sapiens
aaatacatttacagtcgtggct

SEQ ID NO: 9059377 - DNA, 23 bp, Homo sapiens
aaatacctgaattagatattatc

SEQ ID NO: 9059378 - DNA, 22 bp, Homo sapiens
aaatacatttacagtcgtggct

SEQ ID NO: 9059379 - DNA, 23 bp, Homo sapiens
aaatacctgaattagatattatc

SEQ ID NO: 9059380 - DNA, 22 bp, Homo sapiens
aagagggaaattgttggctgct

SEQ ID NO: 9059381 - DNA, 22 bp, Homo sapiens
aagagggagggcaaaggcactg

SEQ ID NO: 9059382 - DNA, 22 bp, Homo sapiens
aagagggctgcaatcttattgc

SEQ ID NO: 9059383 - DNA, 22 bp, Homo sapiens
aaagtttccaagttacaccatt

SEQ ID NO: 9059384 - DNA, 23 bp, Homo sapiens
aaagtttgaagcaacagtagttg

SEQ ID NO: 9059385 - DNA, 22 bp, Homo sapiens
aaagtttgcaatttatgttaat

SEQ ID NO: 9059386 - DNA, 22 bp, Homo sapiens
aaagtttgaatgatatattagt

SEQ ID NO: 9059387 - DNA, 22 bp, Homo sapiens
aaagttttatatgctgcagcga

SEQ ID NO: 9059388 - DNA, 22 bp, Homo sapiens
aaagttttagctgtccagttcc

SEQ ID NO: 9059389 - DNA, 22 bp, Homo sapiens
aaagttttagctgtccagttcc

SEQ ID NO: 9059390 - DNA, 22 bp, Homo sapiens
aaagtttgttgcttacaaagaa

SEQ ID NO: 9059391 - DNA, 22 bp, Homo sapiens
aaagttttagaactaggaagca

SEQ ID NO: 9059392 - DNA, 22 bp, Homo sapiens
aaagtttggatccagcaaaaga

SEQ ID NO: 9059393 - DNA, 22 bp, Homo sapiens
aaagtttgcaatttatgttaat

SEQ ID NO: 9059394 - DNA, 22 bp, Homo sapiens
aagaacatggtaggataacaaa

SEQ ID NO: 9059395 - DNA, 22 bp, Homo sapiens
aagaacatggtaggataacaaa

SEQ ID NO: 9059396 - DNA, 22 bp, Homo sapiens
aagaacatggactgtggggtta

SEQ ID NO: 9059397 - DNA, 22 bp, Homo sapiens
aagaacatgggtgtgggcattc

SEQ ID NO: 9059398 - DNA, 22 bp, Homo sapiens
aagaacatgggtgtgggcattc

SEQ ID NO: 9059399 - DNA, 22 bp, Homo sapiens
aagaacatgctataattatctt

SEQ ID NO: 9059400 - DNA, 22 bp, Homo sapiens
aagaacatgatggccatgtgca

SEQ ID NO: 9059401 - DNA, 22 bp, Homo sapiens
aagaacatgctataattatctt

SEQ ID NO: 9059402 - DNA, 22 bp, Homo sapiens
aagaacatgatggccatgtgca

SEQ ID NO: 9059403 - DNA, 22 bp, Homo sapiens
aagaacatgagttatgatgatt

SEQ ID NO: 9059404 - DNA, 22 bp, Homo sapiens
aagaacatgagttatgatgatt

SEQ ID NO: 9059405 - DNA, 23 bp, Homo sapiens
aaagtgattagcatttctgcaga

SEQ ID NO: 9059406 - DNA, 22 bp, Homo sapiens
aaagtgaggacttgagtactgt

SEQ ID NO: 9059407 - DNA, 23 bp, Homo sapiens
aaagtgacttttataccactaac

SEQ ID NO: 9059408 - DNA, 22 bp, Homo sapiens
aagacagagggaagcaatgatg

SEQ ID NO: 9059409 - DNA, 22 bp, Homo sapiens
aagacagagggaagcaatgatg

SEQ ID NO: 9059410 - DNA, 22 bp, Homo sapiens
aaagtgcagctgaaaacatcct

SEQ ID NO: 9059411 - DNA, 22 bp, Homo sapiens
aagacagagggaagcaatgatg

SEQ ID NO: 9059412 - DNA, 22 bp, Homo sapiens
aaagtgcagaactgttctcact

SEQ ID NO: 9059413 - DNA, 22 bp, Homo sapiens
aaagtgcactagaatccagatt

SEQ ID NO: 9059414 - DNA, 22 bp, Homo sapiens
aaagtgcactagaatccagatt

SEQ ID NO: 9059415 - DNA, 22 bp, Homo sapiens
aaagtgcacctgcttcttcttg

SEQ ID NO: 9059416 - DNA, 22 bp, Homo sapiens
aaagtgcacctgcttcttcttg

SEQ ID NO: 9059417 - DNA, 20 bp, Homo sapiens
aaagtgcacagatacagctc

SEQ ID NO: 9059418 - DNA, 20 bp, Homo sapiens
aaagtgcacagatacagctc

SEQ ID NO: 9059419 - DNA, 19 bp, Homo sapiens
aaagtgattttttctggca

SEQ ID NO: 9059420 - DNA, 22 bp, Homo sapiens
aaagtgatttaagtacctcagg

SEQ ID NO: 9059421 - DNA, 22 bp, Homo sapiens
aaagtgcaaggattacaggcat

SEQ ID NO: 9059422 - DNA, 22 bp, Homo sapiens
aaagtgattatgctgtcaaaga

SEQ ID NO: 9059423 - DNA, 22 bp, Homo sapiens
aagaccctatactcagtgaccc

SEQ ID NO: 9059424 - DNA, 17 bp, Homo sapiens
aagaccctagtctaccc

SEQ ID NO: 9059425 - DNA, 22 bp, Homo sapiens
aagacagatgcaacctgctagc

SEQ ID NO: 9059426 - DNA, 22 bp, Homo sapiens
aagaccttgtctaaacatgtag

SEQ ID NO: 9059427 - DNA, 22 bp, Homo sapiens
aagacctgcgttatcctgcctg

SEQ ID NO: 9059428 - DNA, 22 bp, Homo sapiens
aagactcaaggaacaacacagt

SEQ ID NO: 9059429 - DNA, 22 bp, Homo sapiens
aagactcaaggaacaacacagt

SEQ ID NO: 9059430 - DNA, 22 bp, Homo sapiens
aagactctatctttagagatca

SEQ ID NO: 9059431 - DNA, 22 bp, Homo sapiens
aagactgagtggcttaagaaaa

SEQ ID NO: 9059432 - DNA, 22 bp, Homo sapiens
aagactgagttcaaatcacagc

SEQ ID NO: 9059433 - DNA, 22 bp, Homo sapiens
aagaaataagacttctctgtcc

SEQ ID NO: 9059434 - DNA, 22 bp, Homo sapiens
aagaacagtgtcctgggactcg

SEQ ID NO: 9059435 - DNA, 22 bp, Homo sapiens
aagaacatacagtggcggagtc

SEQ ID NO: 9059436 - DNA, 22 bp, Homo sapiens
aagaacataaacagaaggacag

SEQ ID NO: 9059437 - DNA, 22 bp, Homo sapiens
aagaacagttgggaggtgagcc

SEQ ID NO: 9059438 - DNA, 22 bp, Homo sapiens
aagaacagttgggaggtgagcc

SEQ ID NO: 9059439 - DNA, 22 bp, Homo sapiens
aagaacatgagttatgatgatt

SEQ ID NO: 9059440 - DNA, 22 bp, Homo sapiens
aagaacatgaagtcacaaatgc

SEQ ID NO: 9059441 - DNA, 22 bp, Homo sapiens
aagaacatgaacacaatgttta

SEQ ID NO: 9059442 - DNA, 22 bp, Homo sapiens
aactgtaatgaattgttcatga

SEQ ID NO: 9059443 - DNA, 22 bp, Homo sapiens
aactgtaagagaataaatgtgt

SEQ ID NO: 9059444 - DNA, 22 bp, Homo sapiens
aactgtagggatctgtcttagt

SEQ ID NO: 9059445 - DNA, 22 bp, Homo sapiens
aaagccttctgtctagcagata

SEQ ID NO: 9059446 - DNA, 22 bp, Homo sapiens
aaagccttctgtctagcagata

SEQ ID NO: 9059447 - DNA, 22 bp, Homo sapiens
aaagccttctgtctagcagata

SEQ ID NO: 9059448 - DNA, 22 bp, Homo sapiens
aaagcctgtctggtcatagcta

SEQ ID NO: 9059449 - DNA, 22 bp, Homo sapiens
aaagcctgggttcctcactatc

SEQ ID NO: 9059450 - DNA, 22 bp, Homo sapiens
aacccacaagcagctgtagccc

SEQ ID NO: 9059451 - DNA, 22 bp, Homo sapiens
aacccagccgtgtagctgccgc

SEQ ID NO: 9059452 - DNA, 16 bp, Homo sapiens
aacccacagctcccga

SEQ ID NO: 9059453 - DNA, 22 bp, Homo sapiens
aacccaggagacggagtttgtg

SEQ ID NO: 9059454 - DNA, 22 bp, Homo sapiens
aacccatgttggaagcttatca

SEQ ID NO: 9059455 - DNA, 22 bp, Homo sapiens
aacccgggaggcagaggttgtg

SEQ ID NO: 9059456 - DNA, 22 bp, Homo sapiens
aaccccagtaccccaggatatg

SEQ ID NO: 9059457 - DNA, 22 bp, Homo sapiens
aaccccaggctggaggagtctc

SEQ ID NO: 9059458 - DNA, 18 bp, Homo sapiens
aaaggcagattactggga

SEQ ID NO: 9059459 - DNA, 22 bp, Homo sapiens
aaaggcaggactgcagcatagg

SEQ ID NO: 9059460 - DNA, 22 bp, Homo sapiens
aacccgggaggcagaggttgtg

SEQ ID NO: 9059461 - DNA, 22 bp, Homo sapiens
aaaggcagagttgttggaggca

SEQ ID NO: 9059462 - DNA, 22 bp, Homo sapiens
aaaggcagagttgttggaggca

SEQ ID NO: 9059463 - DNA, 22 bp, Homo sapiens
aaaggcagagtgctcagctggc

SEQ ID NO: 9059464 - DNA, 23 bp, Homo sapiens
aaaggcaggcctaggacatattg

SEQ ID NO: 9059465 - DNA, 22 bp, Homo sapiens
aaaggcaggctttcacatctca

SEQ ID NO: 9059466 - DNA, 22 bp, Homo sapiens
aaaggcagtgggtatgtggatc

SEQ ID NO: 9059467 - DNA, 22 bp, Homo sapiens
aaaggcaggctttcacatctca

SEQ ID NO: 9059468 - DNA, 22 bp, Homo sapiens
aaaggcagtgggtatgtggatc

SEQ ID NO: 9059469 - DNA, 22 bp, Homo sapiens
aaaggcatctagccaagttgag

SEQ ID NO: 9059470 - DNA, 18 bp, Homo sapiens
aaaggcatatatagaagt

SEQ ID NO: 9059471 - DNA, 22 bp, Homo sapiens
aaaggcagtgtgatactgtggt

SEQ ID NO: 9059472 - DNA, 22 bp, Homo sapiens
aaaggcataggatgtggaatcg

SEQ ID NO: 9059473 - DNA, 22 bp, Homo sapiens
aacataatgtggccaaagtcac

SEQ ID NO: 9059474 - DNA, 22 bp, Homo sapiens
aacataagtggcactttgccca

SEQ ID NO: 9059475 - DNA, 22 bp, Homo sapiens
aacataatgtggccaaagtcac

SEQ ID NO: 9059476 - DNA, 22 bp, Homo sapiens
aacataatgtggccaaagtcac

SEQ ID NO: 9059477 - DNA, 22 bp, Homo sapiens
aacatacttgtactatgcatat

SEQ ID NO: 9059478 - DNA, 23 bp, Homo sapiens
aacatactgtttaatattcacag

SEQ ID NO: 9059479 - DNA, 23 bp, Homo sapiens
aacatactgtttaatattcacag

SEQ ID NO: 9059480 - DNA, 22 bp, Homo sapiens
aacatacttatactaaataatg

SEQ ID NO: 9059481 - DNA, 22 bp, Homo sapiens
aacatataaactcttaagttca

SEQ ID NO: 9059482 - DNA, 22 bp, Homo sapiens
aacatagacccagttcaacaaa

SEQ ID NO: 9059483 - DNA, 22 bp, Homo sapiens
aacatagagacaggaagtgctt

SEQ ID NO: 9059484 - DNA, 22 bp, Homo sapiens
aacatagccagaatgtctcctg

SEQ ID NO: 9059485 - DNA, 22 bp, Homo sapiens
aacatagaattgttatattttc

SEQ ID NO: 9059486 - DNA, 22 bp, Homo sapiens
aaagcctcccaggttatgagta

SEQ ID NO: 9059487 - DNA, 22 bp, Homo sapiens
aaagcctcccaggttatgagta

SEQ ID NO: 9059488 - DNA, 22 bp, Homo sapiens
aaagcccatgtggaagtacagg

SEQ ID NO: 9059489 - DNA, 22 bp, Homo sapiens
aaagcagaggttgcagtgagct

SEQ ID NO: 9059490 - DNA, 22 bp, Homo sapiens
aaagcagaggttgcagtgagct

SEQ ID NO: 9059491 - DNA, 22 bp, Homo sapiens
aaagcagaggtgatatgactta

SEQ ID NO: 9059492 - DNA, 22 bp, Homo sapiens
aaagcagaggtgatatgactta

SEQ ID NO: 9059493 - DNA, 22 bp, Homo sapiens
aaagcagaggtgatatgactta

SEQ ID NO: 9059494 - DNA, 19 bp, Homo sapiens
aaagcagaggagcatctga

SEQ ID NO: 9059495 - DNA, 22 bp, Homo sapiens
aaagcagattctgatgcagtag

SEQ ID NO: 9059496 - DNA, 22 bp, Homo sapiens
aaagcagagatcatggcttgta

SEQ ID NO: 9059497 - DNA, 22 bp, Homo sapiens
aaagcagactgatttgcatcac

SEQ ID NO: 9059498 - DNA, 22 bp, Homo sapiens
aaagcagactgatttgcatcac

SEQ ID NO: 9059499 - DNA, 22 bp, Homo sapiens
aaagcagagcagggcacttatg

SEQ ID NO: 9059500 - DNA, 22 bp, Homo sapiens
aaagcagagatcatggcttgta

SEQ ID NO: 9059501 - DNA, 22 bp, Homo sapiens
aaagcacttgaaatctggcagt

SEQ ID NO: 9059502 - DNA, 22 bp, Homo sapiens
aaagcagaactgagagagctgg

SEQ ID NO: 9059503 - DNA, 22 bp, Homo sapiens
aacactttccgtaggtttagta

SEQ ID NO: 9059504 - DNA, 23 bp, Homo sapiens
aaagcaaggaattggcaacagag

SEQ ID NO: 9059505 - DNA, 22 bp, Homo sapiens
aaagcaagtctctacaaagtac

SEQ ID NO: 9059506 - DNA, 22 bp, Homo sapiens
aaagcaagatgcatccgtcaag

SEQ ID NO: 9059507 - DNA, 22 bp, Homo sapiens
aaagcaagatgcatccgtcaag

SEQ ID NO: 9059508 - DNA, 22 bp, Homo sapiens
aacacttagatttttaaggttt

SEQ ID NO: 9059509 - DNA, 22 bp, Homo sapiens
aacacttaaggagagatcaaat

SEQ ID NO: 9059510 - DNA, 22 bp, Homo sapiens
aacacttaaggagagatcaaat

SEQ ID NO: 9059511 - DNA, 22 bp, Homo sapiens
aacacttatccacatttgaaag

SEQ ID NO: 9059512 - DNA, 22 bp, Homo sapiens
aacacttatccacatttgaaag

SEQ ID NO: 9059513 - DNA, 22 bp, Homo sapiens
aacacttaaggagagatcaaat

SEQ ID NO: 9059514 - DNA, 22 bp, Homo sapiens
aacacttctcatcactgcaagc

SEQ ID NO: 9059515 - DNA, 22 bp, Homo sapiens
aacacttctgttgataataagc

SEQ ID NO: 9059516 - DNA, 22 bp, Homo sapiens
aacacttcccgaccatatggct

SEQ ID NO: 9059517 - DNA, 22 bp, Homo sapiens
aacacttcccatcagagggaca

SEQ ID NO: 9059518 - DNA, 22 bp, Homo sapiens
aacacttcaagcagaaggttgg

SEQ ID NO: 9059519 - DNA, 22 bp, Homo sapiens
aaagattatggaacacacatga

SEQ ID NO: 9059520 - DNA, 22 bp, Homo sapiens
aaagattatggcattgaaatac

SEQ ID NO: 9059521 - DNA, 22 bp, Homo sapiens
aaagattagataagatagattt

SEQ ID NO: 9059522 - DNA, 22 bp, Homo sapiens
aaagattaaggtattgttagct

SEQ ID NO: 9059523 - DNA, 22 bp, Homo sapiens
aaagattaggcggcaactgggc

SEQ ID NO: 9059524 - DNA, 22 bp, Homo sapiens
aaagattagataagatagattt

SEQ ID NO: 9059525 - DNA, 21 bp, Homo sapiens
aaagatgtttcatctgagaaa

SEQ ID NO: 9059526 - DNA, 22 bp, Homo sapiens
aaagatgtttgttccaaaattc

SEQ ID NO: 9059527 - DNA, 22 bp, Homo sapiens
aaagattaaatcaaattggtca

SEQ ID NO: 9059528 - DNA, 22 bp, Homo sapiens
aaagatgttttataagttatgg

SEQ ID NO: 9059529 - DNA, 22 bp, Homo sapiens
aaagattgaaagagaatttgtc

SEQ ID NO: 9059530 - DNA, 22 bp, Homo sapiens
aaagattcctttattctccaag

SEQ ID NO: 9059531 - DNA, 22 bp, Homo sapiens
aaagatttaagaataatttgtg

SEQ ID NO: 9059532 - DNA, 22 bp, Homo sapiens
aaagatttatgaagttcaatta

SEQ ID NO: 9059533 - DNA, 22 bp, Homo sapiens
aaagatttaagaataatttgtg

SEQ ID NO: 9059534 - DNA, 22 bp, Homo sapiens
aaagatttatgaagttcaatta

SEQ ID NO: 9059535 - DNA, 22 bp, Homo sapiens
aaagatttgagttctgcttata

SEQ ID NO: 9059536 - DNA, 22 bp, Homo sapiens
aagcaaggcccagagcatcagc

SEQ ID NO: 9059537 - DNA, 22 bp, Homo sapiens
aagcaaggccggaaggaaactc

SEQ ID NO: 9059538 - DNA, 22 bp, Homo sapiens
aagcaagcccaggctcagtcaa

SEQ ID NO: 9059539 - DNA, 22 bp, Homo sapiens
aagcaaggcaacctatgtccag

SEQ ID NO: 9059540 - DNA, 22 bp, Homo sapiens
aagcaagcaaggtgttacatat

SEQ ID NO: 9059541 - DNA, 22 bp, Homo sapiens
aagcaagagttggagtgatgtt

SEQ ID NO: 9059542 - DNA, 22 bp, Homo sapiens
aagcaataatcccaaagtgctg

SEQ ID NO: 9059543 - DNA, 22 bp, Homo sapiens
aagatgttaggaaagttagggt

SEQ ID NO: 9059544 - DNA, 22 bp, Homo sapiens
aagatgttagggtggaagggat

SEQ ID NO: 9059545 - DNA, 22 bp, Homo sapiens
aagcaaagagataaccttttgg

SEQ ID NO: 9059546 - DNA, 22 bp, Homo sapiens
aagcaagacagaagttactgcc

SEQ ID NO: 9059547 - DNA, 22 bp, Homo sapiens
aagatgttaaatctgtagaatt

SEQ ID NO: 9059548 - DNA, 22 bp, Homo sapiens
aagatgttaaattgggggcatt

SEQ ID NO: 9059549 - DNA, 22 bp, Homo sapiens
aagatgttactcaaccaggata

SEQ ID NO: 9059550 - DNA, 22 bp, Homo sapiens
aagatgttagattatggggaca

SEQ ID NO: 9059551 - DNA, 22 bp, Homo sapiens
aagatgttagaggtcatgcaga

SEQ ID NO: 9059552 - DNA, 22 bp, Homo sapiens
aagatgttagaggtcatgcaga

SEQ ID NO: 9059553 - DNA, 22 bp, Homo sapiens
aagatgtgctgtcttgccactc

SEQ ID NO: 9059554 - DNA, 22 bp, Homo sapiens
aagatgaatcagtatgtgtcct

SEQ ID NO: 9059555 - DNA, 22 bp, Homo sapiens
aagatgaatcagtatgtgtcct

SEQ ID NO: 9059556 - DNA, 22 bp, Homo sapiens
aagatgatagatctgtcaatgt

SEQ ID NO: 9059557 - DNA, 22 bp, Homo sapiens
aagatgatagatctgtcaatgt

SEQ ID NO: 9059558 - DNA, 22 bp, Homo sapiens
aagatgatgcagactttgatgt

SEQ ID NO: 9059559 - DNA, 22 bp, Homo sapiens
aagatgatgttgtgttttcact

SEQ ID NO: 9059560 - DNA, 22 bp, Homo sapiens
aagatggcttagagtcctggtg

SEQ ID NO: 9059561 - DNA, 22 bp, Homo sapiens
aagatggctgcagcaattccaa

SEQ ID NO: 9059562 - DNA, 22 bp, Homo sapiens
aagatggagtagtgtaatggtt

SEQ ID NO: 9059563 - DNA, 22 bp, Homo sapiens
aagatgcttgcaaatttctgaa

SEQ ID NO: 9059564 - DNA, 22 bp, Homo sapiens
aagatgcttattgctcctgcag

SEQ ID NO: 9059565 - DNA, 22 bp, Homo sapiens
aagatgtaaaggcaatataaag

SEQ ID NO: 9059566 - DNA, 22 bp, Homo sapiens
aagatgtgcagttcatggcagg

SEQ ID NO: 9059567 - DNA, 22 bp, Homo sapiens
aagatgtgaacagaaccacagg

SEQ ID NO: 9059568 - DNA, 22 bp, Homo sapiens
aagagcaggacagaatcagaac

SEQ ID NO: 9059569 - DNA, 22 bp, Homo sapiens
aagagcaggacagaatcagaac

SEQ ID NO: 9059570 - DNA, 22 bp, Homo sapiens
acacatgataagaaagtttaaa

SEQ ID NO: 9059571 - DNA, 22 bp, Homo sapiens
acacatgacctccgcagcagca

SEQ ID NO: 9059572 - DNA, 22 bp, Homo sapiens
aagatatagatggtggtataaa

SEQ ID NO: 9059573 - DNA, 22 bp, Homo sapiens
acacatttctaaatttttaccg

SEQ ID NO: 9059574 - DNA, 22 bp, Homo sapiens
aagatccttctcactgcagtgt

SEQ ID NO: 9059575 - DNA, 22 bp, Homo sapiens
aagatctagtggatggtgagtg

SEQ ID NO: 9059576 - DNA, 22 bp, Homo sapiens
aagatctattatgagtcaggtc

SEQ ID NO: 9059577 - DNA, 22 bp, Homo sapiens
aagatgaatcagtatgtgtcct

SEQ ID NO: 9059578 - DNA, 22 bp, Homo sapiens
aagatgaaaatttactgtgatg

SEQ ID NO: 9059579 - DNA, 22 bp, Homo sapiens
acacatttattacatgcatgtg

SEQ ID NO: 9059580 - DNA, 22 bp, Homo sapiens
acacatttctaaatttttaccg

SEQ ID NO: 9059581 - DNA, 22 bp, Homo sapiens
acacatttagcaccaggtttat

SEQ ID NO: 9059582 - DNA, 22 bp, Homo sapiens
acacattctttaaatgtctgtt

SEQ ID NO: 9059583 - DNA, 22 bp, Homo sapiens
acacattatctcattaaatact

SEQ ID NO: 9059584 - DNA, 22 bp, Homo sapiens
acacatgattaatgccaagcat

SEQ ID NO: 9059585 - DNA, 22 bp, Homo sapiens
aagcagcttccccaaagtgcct

SEQ ID NO: 9059586 - DNA, 22 bp, Homo sapiens
aagcagcttccctggctcctgg

SEQ ID NO: 9059587 - DNA, 22 bp, Homo sapiens
aagcagcttccctggctcctgg

SEQ ID NO: 9059588 - DNA, 22 bp, Homo sapiens
aagcagcttttgaagagtgagg

SEQ ID NO: 9059589 - DNA, 22 bp, Homo sapiens
aagcagcttttgaagagtgagg

SEQ ID NO: 9059590 - DNA, 22 bp, Homo sapiens
aagcagctttctttcctgtgaa

SEQ ID NO: 9059591 - DNA, 22 bp, Homo sapiens
aagcagctttctttcctgtgaa

SEQ ID NO: 9059592 - DNA, 22 bp, Homo sapiens
acagccagggcattgtcgccga

SEQ ID NO: 9059593 - DNA, 22 bp, Homo sapiens
aagcaggaagctcaggtccttg

SEQ ID NO: 9059594 - DNA, 22 bp, Homo sapiens
aagcaggaagctcaggtccttg

SEQ ID NO: 9059595 - DNA, 21 bp, Homo sapiens
aagcaggaacttcaaagggac

SEQ ID NO: 9059596 - DNA, 22 bp, Homo sapiens
acagccagggcattgtcgccga

SEQ ID NO: 9059597 - DNA, 22 bp, Homo sapiens
acagcagagtggagatgagcac

SEQ ID NO: 9059598 - DNA, 22 bp, Homo sapiens
aagcagctgtgtgacataatct

SEQ ID NO: 9059599 - DNA, 22 bp, Homo sapiens
aagcagctggaagagtaagatg

SEQ ID NO: 9059600 - DNA, 22 bp, Homo sapiens
aagcagctgcaggttcaaagga

SEQ ID NO: 9059601 - DNA, 22 bp, Homo sapiens
aagcagcttaaattagagcctg

SEQ ID NO: 9059602 - DNA, 22 bp, Homo sapiens
aagcagcttaaattagagcctg

SEQ ID NO: 9059603 - DNA, 21 bp, Homo sapiens
aagcagcttaataaagtatgt

SEQ ID NO: 9059604 - DNA, 22 bp, Homo sapiens
aagcagcttaaattagagcctg

SEQ ID NO: 9059605 - DNA, 22 bp, Homo sapiens
aagcagcttaaattagagcctg

SEQ ID NO: 9059606 - DNA, 22 bp, Homo sapiens
acagcagagacactcaggaggc

SEQ ID NO: 9059607 - DNA, 22 bp, Homo sapiens
acagcagagacactcaggaggc

SEQ ID NO: 9059608 - DNA, 22 bp, Homo sapiens
acagcagagacactcaggaggc

SEQ ID NO: 9059609 - DNA, 22 bp, Homo sapiens
acagcagagccagtggctctag

SEQ ID NO: 9059610 - DNA, 22 bp, Homo sapiens
aagcagaggaccgacggaggga

SEQ ID NO: 9059611 - DNA, 22 bp, Homo sapiens
aagcagaggaccgacggaggga

SEQ ID NO: 9059612 - DNA, 22 bp, Homo sapiens
aagcagaggccacagagtgggc

SEQ ID NO: 9059613 - DNA, 22 bp, Homo sapiens
aagcagaggccacagagtgggc

SEQ ID NO: 9059614 - DNA, 22 bp, Homo sapiens
aagcagaggtagggtgtgcagt

SEQ ID NO: 9059615 - DNA, 22 bp, Homo sapiens
aagcagaggtagggtgtgcagt

SEQ ID NO: 9059616 - DNA, 22 bp, Homo sapiens
acagcaaaagacaagaacttaa

SEQ ID NO: 9059617 - DNA, 22 bp, Homo sapiens
aagcaatgtgttaatgaatgag

SEQ ID NO: 9059618 - DNA, 22 bp, Homo sapiens
aagcaatgtgttaatgaatgag

SEQ ID NO: 9059619 - DNA, 23 bp, Homo sapiens
aagcaatgctgagccagttctga

SEQ ID NO: 9059620 - DNA, 22 bp, Homo sapiens
aagcaatgttagaggccttagg

SEQ ID NO: 9059621 - DNA, 19 bp, Homo sapiens
aagcaatgttgtgaatcta

SEQ ID NO: 9059622 - DNA, 22 bp, Homo sapiens
aagcaatatactgatatgatta

SEQ ID NO: 9059623 - DNA, 22 bp, Homo sapiens
aagcaattgtcctgtctctaca

SEQ ID NO: 9059624 - DNA, 22 bp, Homo sapiens
aagcacaatttcaccttcttgt

SEQ ID NO: 9059625 - DNA, 22 bp, Homo sapiens
aagcacaatttaggactgaaat

SEQ ID NO: 9059626 - DNA, 22 bp, Homo sapiens
aagcaccaccctcccaacctgt

SEQ ID NO: 9059627 - DNA, 22 bp, Homo sapiens
aagcagaatttcccactagttg

SEQ ID NO: 9059628 - DNA, 22 bp, Homo sapiens
aagcagacagagaatgggtttg

SEQ ID NO: 9059629 - DNA, 22 bp, Homo sapiens
aagcagaatttcccactagttg

SEQ ID NO: 9059630 - DNA, 22 bp, Homo sapiens
aagcagaatttaatagaaaggt

SEQ ID NO: 9059631 - DNA, 20 bp, Homo sapiens
aagcagaagctgctctcagc

SEQ ID NO: 9059632 - DNA, 20 bp, Homo sapiens
aagcagaagctgctctcagc

SEQ ID NO: 9059633 - DNA, 22 bp, Homo sapiens
aagcagaactgggaagtagtgg

SEQ ID NO: 9059634 - DNA, 22 bp, Homo sapiens
aagcagaactgggaagtagtgg

SEQ ID NO: 9059635 - DNA, 22 bp, Homo sapiens
aagcagaagttgatctaccata

SEQ ID NO: 9059636 - DNA, 22 bp, Homo sapiens
aagcagaagttgatctaccata

SEQ ID NO: 9059637 - DNA, 22 bp, Homo sapiens
aagcagaagttgatctaccata

SEQ ID NO: 9059638 - DNA, 22 bp, Homo sapiens
aagcagagaaaagcttaggttc

SEQ ID NO: 9059639 - DNA, 22 bp, Homo sapiens
aagcagagccaccagctttgga

SEQ ID NO: 9059640 - DNA, 22 bp, Homo sapiens
aagcagagcaagcgtatttatt

SEQ ID NO: 9059641 - DNA, 20 bp, Homo sapiens
aagaaacttgaaagtacaag

SEQ ID NO: 9059642 - DNA, 20 bp, Homo sapiens
aagaaacttgaaagtacaag

SEQ ID NO: 9059643 - DNA, 22 bp, Homo sapiens
aattctcaggaatttcatctgt

SEQ ID NO: 9059644 - DNA, 22 bp, Homo sapiens
aattctcaggaatttcatctgt

SEQ ID NO: 9059645 - DNA, 22 bp, Homo sapiens
aattctatgttcttgagtaaga

SEQ ID NO: 9059646 - DNA, 22 bp, Homo sapiens
aattcctagtccttttccctcc

SEQ ID NO: 9059647 - DNA, 22 bp, Homo sapiens
aagaaatggcttcatctgagta

SEQ ID NO: 9059648 - DNA, 22 bp, Homo sapiens
aagaaatggcttcatctgagta

SEQ ID NO: 9059649 - DNA, 22 bp, Homo sapiens
aagaaatgtagagcctagtaaa

SEQ ID NO: 9059650 - DNA, 22 bp, Homo sapiens
aagaaattaaggaatgcaacga

SEQ ID NO: 9059651 - DNA, 22 bp, Homo sapiens
aatttacacttcatttggaggg

SEQ ID NO: 9059652 - DNA, 22 bp, Homo sapiens
aagaacaactgctttaaaagca

SEQ ID NO: 9059653 - DNA, 22 bp, Homo sapiens
aagaacagattcagcctgaact

SEQ ID NO: 9059654 - DNA, 22 bp, Homo sapiens
aatttaagaacatttcaggact

SEQ ID NO: 9059655 - DNA, 22 bp, Homo sapiens
aatttaaggaggccttcactct

SEQ ID NO: 9059656 - DNA, 22 bp, Homo sapiens
aagaaaacatgatctaatttaa

SEQ ID NO: 9059657 - DNA, 22 bp, Homo sapiens
aagaaacctagtctggagcagc

SEQ ID NO: 9059658 - DNA, 22 bp, Homo sapiens
aagaaaatcagttctggtcagt

SEQ ID NO: 9059659 - DNA, 22 bp, Homo sapiens
aagaaaatcagttctggtcagt

SEQ ID NO: 9059660 - DNA, 22 bp, Homo sapiens
aagaaaccaaccctgccagcac

SEQ ID NO: 9059661 - DNA, 22 bp, Homo sapiens
aagaaacaaccactgctctcct

SEQ ID NO: 9059662 - DNA, 22 bp, Homo sapiens
aatggcttttaaaaatagcatt

SEQ ID NO: 9059663 - DNA, 22 bp, Homo sapiens
aactggaaagatcagtaggaag

SEQ ID NO: 9059664 - DNA, 22 bp, Homo sapiens
aactggaagagtgaatataact

SEQ ID NO: 9059665 - DNA, 22 bp, Homo sapiens
aactggatttaggaacagagaa

SEQ ID NO: 9059666 - DNA, 22 bp, Homo sapiens
aactggctgggaacacctagag

SEQ ID NO: 9059667 - DNA, 22 bp, Homo sapiens
aagaaaacaatgacttgccagc

SEQ ID NO: 9059668 - DNA, 22 bp, Homo sapiens
aactttttctgggatggagggt

SEQ ID NO: 9059669 - DNA, 22 bp, Homo sapiens
aagagaacagtcaccatgcaca

SEQ ID NO: 9059670 - DNA, 22 bp, Homo sapiens
aagagaagaaagtgtctacaca

SEQ ID NO: 9059671 - DNA, 22 bp, Homo sapiens
aagagaagaaagtgtctacaca

SEQ ID NO: 9059672 - DNA, 20 bp, Homo sapiens
aagagaagaagtctttgaaa

SEQ ID NO: 9059673 - DNA, 22 bp, Homo sapiens
aagactttccctcatcagaacg

SEQ ID NO: 9059674 - DNA, 20 bp, Homo sapiens
aattttatctccatcctttg

SEQ ID NO: 9059675 - DNA, 20 bp, Homo sapiens
aattttatctccatcctttg

SEQ ID NO: 9059676 - DNA, 22 bp, Homo sapiens
aattttacttccctcagtgtag

SEQ ID NO: 9059677 - DNA, 20 bp, Homo sapiens
aattttactgtcctatagag

SEQ ID NO: 9059678 - DNA, 20 bp, Homo sapiens
aattttatctccatcctttg

SEQ ID NO: 9059679 - DNA, 22 bp, Homo sapiens
aatttgttagcatactctagtt

SEQ ID NO: 9059680 - DNA, 22 bp, Homo sapiens
aatttgttttcaagtcactgga

SEQ ID NO: 9059681 - DNA, 22 bp, Homo sapiens
aattttacaagaaggcctcgta

SEQ ID NO: 9059682 - DNA, 22 bp, Homo sapiens
aattttacaaaatacctccgat

SEQ ID NO: 9059683 - DNA, 22 bp, Homo sapiens
aattttactaatctgagtgtga

SEQ ID NO: 9059684 - DNA, 22 bp, Homo sapiens
aattttacataggggatatggg

SEQ ID NO: 9059685 - DNA, 22 bp, Homo sapiens
aatttcagatgtcataaatata

SEQ ID NO: 9059686 - DNA, 22 bp, Homo sapiens
aatttcagctcaaacttgtgtt

SEQ ID NO: 9059687 - DNA, 22 bp, Homo sapiens
aagagcagaagtccttggatcc

SEQ ID NO: 9059688 - DNA, 22 bp, Homo sapiens
aagagcaagtgggtagtgaagc

SEQ ID NO: 9059689 - DNA, 22 bp, Homo sapiens
aagagcaagtgggtagtgaagc

SEQ ID NO: 9059690 - DNA, 22 bp, Homo sapiens
acacaaagttggatgacaaaat

SEQ ID NO: 9059691 - DNA, 22 bp, Homo sapiens
acacaaagctattgagtgtcat

SEQ ID NO: 9059692 - DNA, 21 bp, Homo sapiens
acacaaacctcctcagcctgg

SEQ ID NO: 9059693 - DNA, 21 bp, Homo sapiens
acacaaacctcctcagcctgg

SEQ ID NO: 9059694 - DNA, 22 bp, Homo sapiens
acacaaacagtctatagcacca

SEQ ID NO: 9059695 - DNA, 22 bp, Homo sapiens
acacaaacagtctatagcacca

SEQ ID NO: 9059696 - DNA, 22 bp, Homo sapiens
acacaaacagtctatagcacca

SEQ ID NO: 9059697 - DNA, 22 bp, Homo sapiens
acacaaaatcaaagtcctaggc

SEQ ID NO: 9059698 - DNA, 22 bp, Homo sapiens
acaatgttttgaaacatctagg

SEQ ID NO: 9059699 - DNA, 22 bp, Homo sapiens
aagagactttgcagtgtcccta

SEQ ID NO: 9059700 - DNA, 22 bp, Homo sapiens
acaatgttctgtctgacttgtc

SEQ ID NO: 9059701 - DNA, 22 bp, Homo sapiens
aagagacttctagatttgttga

SEQ ID NO: 9059702 - DNA, 22 bp, Homo sapiens
aagagactttgcagtgtcccta

SEQ ID NO: 9059703 - DNA, 22 bp, Homo sapiens
aagagacttgtccgaagttgta

SEQ ID NO: 9059704 - DNA, 21 bp, Homo sapiens
aagagacatttctcatcagca

SEQ ID NO: 9059705 - DNA, 22 bp, Homo sapiens
aagagactatggtgtctatgaa

SEQ ID NO: 9059706 - DNA, 22 bp, Homo sapiens
aagagactaagaaagggcaata

SEQ ID NO: 9059707 - DNA, 21 bp, Homo sapiens
aagagacatttctcatcagca

SEQ ID NO: 9059708 - DNA, 22 bp, Homo sapiens
aagagactggaaactagggtca

SEQ ID NO: 9059709 - DNA, 22 bp, Homo sapiens
aagagactgtaaaggcgtgagt

SEQ ID NO: 9059710 - DNA, 22 bp, Homo sapiens
aagagactggaaactagggtca

SEQ ID NO: 9059711 - DNA, 22 bp, Homo sapiens
aagagactatggtgtctatgaa

SEQ ID NO: 9059712 - DNA, 22 bp, Homo sapiens
aagagaaggccctgacccaccc

SEQ ID NO: 9059713 - DNA, 22 bp, Homo sapiens
aagagaatacaagcaggcagga

SEQ ID NO: 9059714 - DNA, 22 bp, Homo sapiens
aagagaatatcgatagcactct

SEQ ID NO: 9059715 - DNA, 22 bp, Homo sapiens
aagagaatgacaaggagaacct

SEQ ID NO: 9059716 - DNA, 22 bp, Homo sapiens
aagagacaatgtcttttggata

SEQ ID NO: 9059717 - DNA, 22 bp, Homo sapiens
aagagaattctggttttcctat

SEQ ID NO: 9059718 - DNA, 22 bp, Homo sapiens
aacactttggatgcagaaccaa

SEQ ID NO: 9059719 - DNA, 22 bp, Homo sapiens
aacactttggaatagagatagg

SEQ ID NO: 9059720 - DNA, 22 bp, Homo sapiens
aacactttggaatagagatagg

SEQ ID NO: 9059721 - DNA, 22 bp, Homo sapiens
aacactttcttccttgctcagg

SEQ ID NO: 9059722 - DNA, 22 bp, Homo sapiens
aacactttctattattatggtt

SEQ ID NO: 9059723 - DNA, 22 bp, Homo sapiens
aacactttcctgcctttctgat

SEQ ID NO: 9059724 - DNA, 22 bp, Homo sapiens
aacactttctattattatggtt

SEQ ID NO: 9059725 - DNA, 22 bp, Homo sapiens
aacactttttatatattgtatc

SEQ ID NO: 9059726 - DNA, 22 bp, Homo sapiens
aacactttttcctcctgtctgg

SEQ ID NO: 9059727 - DNA, 22 bp, Homo sapiens
aacactttttagtaaagattga

SEQ ID NO: 9059728 - DNA, 22 bp, Homo sapiens
aacactttgttgcctatgaacg

SEQ ID NO: 9059729 - DNA, 22 bp, Homo sapiens
aacactttgggcatggccttcc

SEQ ID NO: 9059730 - DNA, 22 bp, Homo sapiens
aacactttgggcatggccttcc

SEQ ID NO: 9059731 - DNA, 22 bp, Homo sapiens
aacacagggggttacaaattgt

SEQ ID NO: 9059732 - DNA, 20 bp, Homo sapiens
aacacagggttaccatcaga

SEQ ID NO: 9059733 - DNA, 22 bp, Homo sapiens
aacacagggggttacaaattgt

SEQ ID NO: 9059734 - DNA, 20 bp, Homo sapiens
aacacagggttaccatcaga

SEQ ID NO: 9059735 - DNA, 22 bp, Homo sapiens
aacacaggttcattctgtgagg

SEQ ID NO: 9059736 - DNA, 22 bp, Homo sapiens
aacacaggttgctgggcctcac

SEQ ID NO: 9059737 - DNA, 22 bp, Homo sapiens
aacacaggttcattctgtgagg

SEQ ID NO: 9059738 - DNA, 22 bp, Homo sapiens
aacacaggttgctgggcctcac

SEQ ID NO: 9059739 - DNA, 22 bp, Homo sapiens
aacacaggtttgtggtaaataa

SEQ ID NO: 9059740 - DNA, 22 bp, Homo sapiens
aacacagttttccaaaatagag

SEQ ID NO: 9059741 - DNA, 22 bp, Homo sapiens
aacagaatcttgggttcttttc

SEQ ID NO: 9059742 - DNA, 22 bp, Homo sapiens
aacagaatcttgggttcttttc

SEQ ID NO: 9059743 - DNA, 22 bp, Homo sapiens
aacagaatatcaaaagattatg

SEQ ID NO: 9059744 - DNA, 22 bp, Homo sapiens
aacagaatagttgatgtacagt

SEQ ID NO: 9059745 - DNA, 22 bp, Homo sapiens
aacagaatagttgatgtacagt

SEQ ID NO: 9059746 - DNA, 22 bp, Homo sapiens
aacagaaatcatttagggctct

SEQ ID NO: 9059747 - DNA, 22 bp, Homo sapiens
aacagacaactcctgtggctca

SEQ ID NO: 9059748 - DNA, 22 bp, Homo sapiens
aacagacagaaaaatgtgatct

SEQ ID NO: 9059749 - DNA, 22 bp, Homo sapiens
aacagacagaaaaatgtgatct

SEQ ID NO: 9059750 - DNA, 22 bp, Homo sapiens
aacagacatatttttaatatgc

SEQ ID NO: 9059751 - DNA, 22 bp, Homo sapiens
aacagagcattctgcactacaa

SEQ ID NO: 9059752 - DNA, 22 bp, Homo sapiens
aacagagaggccacctcagcag

SEQ ID NO: 9059753 - DNA, 22 bp, Homo sapiens
aacagagaggccacctcagcag

SEQ ID NO: 9059754 - DNA, 22 bp, Homo sapiens
aacacagatcaaaatatttcct

SEQ ID NO: 9059755 - DNA, 22 bp, Homo sapiens
aacacaggaaattggtaaatgg

SEQ ID NO: 9059756 - DNA, 22 bp, Homo sapiens
aacacagctaatttctgtcaat

SEQ ID NO: 9059757 - DNA, 20 bp, Homo sapiens
aacacagataccaaaggttg

SEQ ID NO: 9059758 - DNA, 22 bp, Homo sapiens
aacacaggccagcctgtgcagt

SEQ ID NO: 9059759 - DNA, 22 bp, Homo sapiens
aacacagggactcccaggagaa

SEQ ID NO: 9059760 - DNA, 22 bp, Homo sapiens
aacacagggcagctgctgggaa

SEQ ID NO: 9059761 - DNA, 22 bp, Homo sapiens
aacacagggcagctgctgggaa

SEQ ID NO: 9059762 - DNA, 22 bp, Homo sapiens
aacacaggggcgtggctcttac

SEQ ID NO: 9059763 - DNA, 22 bp, Homo sapiens
aacacaggggcgtggctcttac

SEQ ID NO: 9059764 - DNA, 22 bp, Homo sapiens
aacacagaagtgccaagagcca

SEQ ID NO: 9059765 - DNA, 22 bp, Homo sapiens
aacacagacatagtgattacag

SEQ ID NO: 9059766 - DNA, 22 bp, Homo sapiens
aacacagaagtgccaagagcca

SEQ ID NO: 9059767 - DNA, 22 bp, Homo sapiens
aacacagaagtgccaagagcca

SEQ ID NO: 9059768 - DNA, 22 bp, Homo sapiens
aaatttctggaagtgtcagagt

SEQ ID NO: 9059769 - DNA, 22 bp, Homo sapiens
aaatttcttgaggctctctagc

SEQ ID NO: 9059770 - DNA, 22 bp, Homo sapiens
aaatttcttgaggctctctagc

SEQ ID NO: 9059771 - DNA, 22 bp, Homo sapiens
aaatttgataagccattgttac

SEQ ID NO: 9059772 - DNA, 22 bp, Homo sapiens
aaattttaaggctggaacttaa

SEQ ID NO: 9059773 - DNA, 22 bp, Homo sapiens
aacaatgtgaagtgctgttcag

SEQ ID NO: 9059774 - DNA, 22 bp, Homo sapiens
aacaatgtgaagtgctgttcag

SEQ ID NO: 9059775 - DNA, 22 bp, Homo sapiens
aacaatgtctcatcctatgtgg

SEQ ID NO: 9059776 - DNA, 22 bp, Homo sapiens
aacaatgtcctgtgagatgata

SEQ ID NO: 9059777 - DNA, 22 bp, Homo sapiens
aacaatgtaatctactctgctc

SEQ ID NO: 9059778 - DNA, 22 bp, Homo sapiens
aaggctggtggattatgaggtc

SEQ ID NO: 9059779 - DNA, 22 bp, Homo sapiens
aaggctggtggattatgaggtc

SEQ ID NO: 9059780 - DNA, 22 bp, Homo sapiens
aaggctggttccatccctggtg

SEQ ID NO: 9059781 - DNA, 22 bp, Homo sapiens
aaggctggtcagatgtggtgaa

SEQ ID NO: 9059782 - DNA, 22 bp, Homo sapiens
aaggctggtcagatgtggtgaa

SEQ ID NO: 9059783 - DNA, 22 bp, Homo sapiens
aaggctggtcagatgtggtgaa

SEQ ID NO: 9059784 - DNA, 22 bp, Homo sapiens
aaggctggttccatccctggtg

SEQ ID NO: 9059785 - DNA, 22 bp, Homo sapiens
aaatttctaagtcaagaagaac

SEQ ID NO: 9059786 - DNA, 22 bp, Homo sapiens
aaggcagcaccgcctcctgaaa

SEQ ID NO: 9059787 - DNA, 22 bp, Homo sapiens
aaggcagcaccgcctcctgaaa

SEQ ID NO: 9059788 - DNA, 22 bp, Homo sapiens
aaggcagcaccgcctcctgaaa

SEQ ID NO: 9059789 - DNA, 22 bp, Homo sapiens
aaggcagcagaggaaaggtgct

SEQ ID NO: 9059790 - DNA, 22 bp, Homo sapiens
aaggcagcagaggaaaggtgct

SEQ ID NO: 9059791 - DNA, 22 bp, Homo sapiens
aaggcagcacagcaactgctca

SEQ ID NO: 9059792 - DNA, 22 bp, Homo sapiens
aaggcagcacagcaactgctca

SEQ ID NO: 9059793 - DNA, 22 bp, Homo sapiens
aaggcagcacagcaactgctca

SEQ ID NO: 9059794 - DNA, 22 bp, Homo sapiens
aaggcagcaactaatggatctc

SEQ ID NO: 9059795 - DNA, 22 bp, Homo sapiens
aaggcagcaagaattccaggtt

SEQ ID NO: 9059796 - DNA, 22 bp, Homo sapiens
aaggcagcaagaattccaggtt

SEQ ID NO: 9059797 - DNA, 22 bp, Homo sapiens
aaggcagcaagaattccaggtt

SEQ ID NO: 9059798 - DNA, 22 bp, Homo sapiens
aaggcagcaagaattccaggtt

SEQ ID NO: 9059799 - DNA, 22 bp, Homo sapiens
aaggcagatataaagactagag

SEQ ID NO: 9059800 - DNA, 22 bp, Homo sapiens
aaggcagatataaagactagag

SEQ ID NO: 9059801 - DNA, 22 bp, Homo sapiens
aaggcagatataaagactagag

SEQ ID NO: 9059802 - DNA, 22 bp, Homo sapiens
aaggcagatataaagactagag

SEQ ID NO: 9059803 - DNA, 22 bp, Homo sapiens
aaggcagcaactaatggatctc

SEQ ID NO: 9059804 - DNA, 22 bp, Homo sapiens
aaggcagcaactaatggatctc

SEQ ID NO: 9059805 - DNA, 22 bp, Homo sapiens
aaggcagatataaagactagag

SEQ ID NO: 9059806 - DNA, 22 bp, Homo sapiens
aaggcagccatgtgctttgggt

SEQ ID NO: 9059807 - DNA, 22 bp, Homo sapiens
aaggcagccatgtgctttgggt

SEQ ID NO: 9059808 - DNA, 22 bp, Homo sapiens
aaggcagccatagcaccatcca

SEQ ID NO: 9059809 - DNA, 22 bp, Homo sapiens
aaggcagccatagcaccatcca

SEQ ID NO: 9059810 - DNA, 22 bp, Homo sapiens
aaggcagccctggctcagcctg

SEQ ID NO: 9059811 - DNA, 22 bp, Homo sapiens
aaggcagccagatcctttgggt

SEQ ID NO: 9059812 - DNA, 22 bp, Homo sapiens
aaggcagccctggctcagcctg

SEQ ID NO: 9059813 - DNA, 22 bp, Homo sapiens
aaggcagccctggctcagcctg

SEQ ID NO: 9059814 - DNA, 22 bp, Homo sapiens
aaggcagcagtgcacgactgat

SEQ ID NO: 9059815 - DNA, 19 bp, Homo sapiens
aaggcagcagtagcatcca

SEQ ID NO: 9059816 - DNA, 19 bp, Homo sapiens
aaggcagcagtagcatcca

SEQ ID NO: 9059817 - DNA, 22 bp, Homo sapiens
aaggcagcaggatttggtgact

SEQ ID NO: 9059818 - DNA, 22 bp, Homo sapiens
aaggcagcaggatttggtgact

SEQ ID NO: 9059819 - DNA, 22 bp, Homo sapiens
aaggcagccagatcctttgggt

SEQ ID NO: 9059820 - DNA, 22 bp, Homo sapiens
aaggcagcatgaatccctgtac

SEQ ID NO: 9059821 - DNA, 22 bp, Homo sapiens
aaggcagcagtgcacgactgat

SEQ ID NO: 9059822 - DNA, 22 bp, Homo sapiens
aaggcagcagtgcacgactgat

SEQ ID NO: 9059823 - DNA, 22 bp, Homo sapiens
aaggcagcagtgcacgactgat

SEQ ID NO: 9059824 - DNA, 22 bp, Homo sapiens
aaggcagcatgaatccctgtac

SEQ ID NO: 9059825 - DNA, 22 bp, Homo sapiens
aaggctgagccagggcccctat

SEQ ID NO: 9059826 - DNA, 22 bp, Homo sapiens
aaggctgagccagggcccctat

SEQ ID NO: 9059827 - DNA, 22 bp, Homo sapiens
aaggctgggtttgggatgtgat

SEQ ID NO: 9059828 - DNA, 22 bp, Homo sapiens
aaggctgggtttgggatgtgat

SEQ ID NO: 9059829 - DNA, 22 bp, Homo sapiens
aaggctgggtaacctgtccact

SEQ ID NO: 9059830 - DNA, 19 bp, Homo sapiens
aaggctggtaccataggtt

SEQ ID NO: 9059831 - DNA, 23 bp, Homo sapiens
aaattattgctcttcaattgcct

SEQ ID NO: 9059832 - DNA, 22 bp, Homo sapiens
aaattcaatgatcactggctca

SEQ ID NO: 9059833 - DNA, 22 bp, Homo sapiens
aaattcaattaactttcatgct

SEQ ID NO: 9059834 - DNA, 22 bp, Homo sapiens
aaattcaattaactttcatgct

SEQ ID NO: 9059835 - DNA, 22 bp, Homo sapiens
aaattcaattaactttcatgct

SEQ ID NO: 9059836 - DNA, 22 bp, Homo sapiens
aaattattttcagaatggagaa

SEQ ID NO: 9059837 - DNA, 22 bp, Homo sapiens
aaggaagatatatcaagcttaa

SEQ ID NO: 9059838 - DNA, 22 bp, Homo sapiens
aaggaagagtctagaacaggca

SEQ ID NO: 9059839 - DNA, 22 bp, Homo sapiens
aaggaagaggcaggttttgctg

SEQ ID NO: 9059840 - DNA, 22 bp, Homo sapiens
aaatgtcaaggtgatagatgca

SEQ ID NO: 9059841 - DNA, 22 bp, Homo sapiens
aaatgtcaaggtgatagatgca

SEQ ID NO: 9059842 - DNA, 22 bp, Homo sapiens
aaatgtcaaggtgatagatgca

SEQ ID NO: 9059843 - DNA, 22 bp, Homo sapiens
aaggaagatatatcaagcttaa

SEQ ID NO: 9059844 - DNA, 22 bp, Homo sapiens
aaatgtcagaagctttacttct

SEQ ID NO: 9059845 - DNA, 22 bp, Homo sapiens
aaatgtcagaaaacatggagtg

SEQ ID NO: 9059846 - DNA, 22 bp, Homo sapiens
aaatgtcagaggaacatattga

SEQ ID NO: 9059847 - DNA, 22 bp, Homo sapiens
aaatgtcatatttaagtaggaa

SEQ ID NO: 9059848 - DNA, 22 bp, Homo sapiens
aaggaagacacagatgaagtga

SEQ ID NO: 9059849 - DNA, 22 bp, Homo sapiens
aaggaagactcgcaggtctatg

SEQ ID NO: 9059850 - DNA, 22 bp, Homo sapiens
aaggaaagacaggacggaattc

SEQ ID NO: 9059851 - DNA, 22 bp, Homo sapiens
aaggaagacacagatgaagtga

SEQ ID NO: 9059852 - DNA, 22 bp, Homo sapiens
aaggaagacacagatgaagtga

SEQ ID NO: 9059853 - DNA, 22 bp, Homo sapiens
aaggaagagaatccttctcaga

SEQ ID NO: 9059854 - DNA, 22 bp, Homo sapiens
aaggaagagaatccttctcaga

SEQ ID NO: 9059855 - DNA, 22 bp, Homo sapiens
aaatgcatgtgctatagatgtg

SEQ ID NO: 9059856 - DNA, 22 bp, Homo sapiens
aaatgcatgtatgtaatatgct

SEQ ID NO: 9059857 - DNA, 22 bp, Homo sapiens
aaatgcatgtatgtaatatgct

SEQ ID NO: 9059858 - DNA, 22 bp, Homo sapiens
aaatgcattctgttttcactag

SEQ ID NO: 9059859 - DNA, 22 bp, Homo sapiens
aaatgcattaagtcagaacaat

SEQ ID NO: 9059860 - DNA, 22 bp, Homo sapiens
aaatgcatgtgctatagatgtg

SEQ ID NO: 9059861 - DNA, 22 bp, Homo sapiens
aaatgcatttcactaatgtttc

SEQ ID NO: 9059862 - DNA, 22 bp, Homo sapiens
aaggaaagacaggacggaattc

SEQ ID NO: 9059863 - DNA, 22 bp, Homo sapiens
aaatgcattggtttctacttgt

SEQ ID NO: 9059864 - DNA, 22 bp, Homo sapiens
aaatgcattggtttctacttgt

SEQ ID NO: 9059865 - DNA, 22 bp, Homo sapiens
aaatgcattggtttctacttgt

SEQ ID NO: 9059866 - DNA, 22 bp, Homo sapiens
aacgagctctccttctttcatt

SEQ ID NO: 9059867 - DNA, 22 bp, Homo sapiens
aaccttcctgaggaaagtctaa

SEQ ID NO: 9059868 - DNA, 22 bp, Homo sapiens
aaccttcttgtgcagaactgta

SEQ ID NO: 9059869 - DNA, 22 bp, Homo sapiens
aacctgaatttaattgaaatga

SEQ ID NO: 9059870 - DNA, 22 bp, Homo sapiens
aacctgagataataggagagta

SEQ ID NO: 9059871 - DNA, 22 bp, Homo sapiens
aacctgttccctggtccttgac

SEQ ID NO: 9059872 - DNA, 22 bp, Homo sapiens
aacctctacatccaggaaagga

SEQ ID NO: 9059873 - DNA, 22 bp, Homo sapiens
aacctgaaactacattcttgat

SEQ ID NO: 9059874 - DNA, 22 bp, Homo sapiens
aaccctggggctgctctgcctg

SEQ ID NO: 9059875 - DNA, 22 bp, Homo sapiens
aaccctggggcagctgctaggg

SEQ ID NO: 9059876 - DNA, 22 bp, Homo sapiens
aaccctttctcctgggagagtt

SEQ ID NO: 9059877 - DNA, 22 bp, Homo sapiens
aaccctggagaaggctttggat

SEQ ID NO: 9059878 - DNA, 22 bp, Homo sapiens
aacatgtgtcttgcatttcttg

SEQ ID NO: 9059879 - DNA, 22 bp, Homo sapiens
aacccgggaggtggaggttatg

SEQ ID NO: 9059880 - DNA, 22 bp, Homo sapiens
aacccgggaggcggaggttgtg

SEQ ID NO: 9059881 - DNA, 22 bp, Homo sapiens
aacccacaaaggatttcagctc

SEQ ID NO: 9059882 - DNA, 22 bp, Homo sapiens
aacccgggaggcggaggttgtg

SEQ ID NO: 9059883 - DNA, 22 bp, Homo sapiens
aatggccatatcattgcagagc

SEQ ID NO: 9059884 - DNA, 22 bp, Homo sapiens
aatgctttcaaaaatgtgcagt

SEQ ID NO: 9059885 - DNA, 22 bp, Homo sapiens
aactataatggggttaggaaat

SEQ ID NO: 9059886 - DNA, 22 bp, Homo sapiens
aatggcttctgaagcacacttt

SEQ ID NO: 9059887 - DNA, 22 bp, Homo sapiens
aatggctttaggaatccagtgc

SEQ ID NO: 9059888 - DNA, 22 bp, Homo sapiens
aatggctctgatgttgttgtga

SEQ ID NO: 9059889 - DNA, 22 bp, Homo sapiens
aatggctctgatgttgttgtga

SEQ ID NO: 9059890 - DNA, 22 bp, Homo sapiens
aatggctatacaacatgagtat

SEQ ID NO: 9059891 - DNA, 22 bp, Homo sapiens
aatggctctgatgttgttgtga

SEQ ID NO: 9059892 - DNA, 22 bp, Homo sapiens
aatgacaaatatggaagcctga

SEQ ID NO: 9059893 - DNA, 22 bp, Homo sapiens
aatgacaagacatagtctctga

SEQ ID NO: 9059894 - DNA, 22 bp, Homo sapiens
aatgacaataatcattaacttt

SEQ ID NO: 9059895 - DNA, 22 bp, Homo sapiens
aatgacaagacatagtctctga

SEQ ID NO: 9059896 - DNA, 22 bp, Homo sapiens
aatgacaagacatagtctctga

SEQ ID NO: 9059897 - DNA, 22 bp, Homo sapiens
aatgacaatattaatttggagg

SEQ ID NO: 9059898 - DNA, 22 bp, Homo sapiens
aatgacaatattaatttggagg

SEQ ID NO: 9059899 - DNA, 22 bp, Homo sapiens
aactagaaagaacatatttcca

SEQ ID NO: 9059900 - DNA, 22 bp, Homo sapiens
aactagaaccacttgtatttcc

SEQ ID NO: 9059901 - DNA, 22 bp, Homo sapiens
aactagaaatcactacaggtat

SEQ ID NO: 9059902 - DNA, 19 bp, Homo sapiens
aacatcatggctctttcca

SEQ ID NO: 9059903 - DNA, 22 bp, Homo sapiens
aacatcattatgtccattaatg

SEQ ID NO: 9059904 - DNA, 22 bp, Homo sapiens
aacatctacagtgagatgttag

SEQ ID NO: 9059905 - DNA, 22 bp, Homo sapiens
aacatccccttcatgtcatgat

SEQ ID NO: 9059906 - DNA, 22 bp, Homo sapiens
aacatcatcatgaacaactaat

SEQ ID NO: 9059907 - DNA, 22 bp, Homo sapiens
aacatcatcagatgggtgcttg

SEQ ID NO: 9059908 - DNA, 22 bp, Homo sapiens
aacatcatcatgaacaactaat

SEQ ID NO: 9059909 - DNA, 22 bp, Homo sapiens
aacatcatcctttgagtattta

SEQ ID NO: 9059910 - DNA, 22 bp, Homo sapiens
aacagcttcatcacatggcata

SEQ ID NO: 9059911 - DNA, 22 bp, Homo sapiens
aacagcttgagactggatatgc

SEQ ID NO: 9059912 - DNA, 22 bp, Homo sapiens
aacagcttagaaatgttgctaa

SEQ ID NO: 9059913 - DNA, 22 bp, Homo sapiens
aacagcttactcaatggtgatt

SEQ ID NO: 9059914 - DNA, 22 bp, Homo sapiens
aacatatcatttaaccctcacc

SEQ ID NO: 9059915 - DNA, 22 bp, Homo sapiens
aacatatcatttaaccctcacc

SEQ ID NO: 9059916 - DNA, 22 bp, Homo sapiens
aacatatcataggatgtcattg

SEQ ID NO: 9059917 - DNA, 22 bp, Homo sapiens
aacataaatttgaagtggcaaa

SEQ ID NO: 9059918 - DNA, 22 bp, Homo sapiens
aacatataaactcttaagttca

SEQ ID NO: 9059919 - DNA, 22 bp, Homo sapiens
aagtggttattttgatctagaa

SEQ ID NO: 9059920 - DNA, 22 bp, Homo sapiens
aagtggttgcttgtgagtcccc

SEQ ID NO: 9059921 - DNA, 21 bp, Homo sapiens
aagtggtttacatccagctgt

SEQ ID NO: 9059922 - DNA, 22 bp, Homo sapiens
aagtggtttgagcacagtgctg

SEQ ID NO: 9059923 - DNA, 21 bp, Homo sapiens
aagtggtttaggttaccgggg

SEQ ID NO: 9059924 - DNA, 22 bp, Homo sapiens
aagtggttttaagaggttcctt

SEQ ID NO: 9059925 - DNA, 22 bp, Homo sapiens
aagtggtttgattcagtttatg

SEQ ID NO: 9059926 - DNA, 23 bp, Homo sapiens
aagtggttttgaacccggaccct

SEQ ID NO: 9059927 - DNA, 22 bp, Homo sapiens
aacagctagaattctactggct

SEQ ID NO: 9059928 - DNA, 22 bp, Homo sapiens
aacagctattagaacttcatgg

SEQ ID NO: 9059929 - DNA, 22 bp, Homo sapiens
aacagctgcttcagtacttgaa

SEQ ID NO: 9059930 - DNA, 22 bp, Homo sapiens
aacagctgcttctatcttttca

SEQ ID NO: 9059931 - DNA, 22 bp, Homo sapiens
aacagctattagaacttcatgg

SEQ ID NO: 9059932 - DNA, 22 bp, Homo sapiens
aacagctattcactactatggg

SEQ ID NO: 9059933 - DNA, 22 bp, Homo sapiens
aacagctattcactactatggg

SEQ ID NO: 9059934 - DNA, 22 bp, Homo sapiens
aacagcgtctttccagctgttc

SEQ ID NO: 9059935 - DNA, 22 bp, Homo sapiens
aacagcctgagagaacaatgat

SEQ ID NO: 9059936 - DNA, 22 bp, Homo sapiens
aagtgtctaactggttacttct

SEQ ID NO: 9059937 - DNA, 22 bp, Homo sapiens
aagtgtatatatgacttataaa

SEQ ID NO: 9059938 - DNA, 22 bp, Homo sapiens
aagtgtatatatgacttataaa

SEQ ID NO: 9059939 - DNA, 22 bp, Homo sapiens
aagtgtcctcattcaacatgca

SEQ ID NO: 9059940 - DNA, 22 bp, Homo sapiens
aagtgtattaagcaacgttatt

SEQ ID NO: 9059941 - DNA, 22 bp, Homo sapiens
aagtgtatttttgtactaacat

SEQ ID NO: 9059942 - DNA, 22 bp, Homo sapiens
aatacatgttttctactattct

SEQ ID NO: 9059943 - DNA, 22 bp, Homo sapiens
aatagaatttgtactgtgtttt

SEQ ID NO: 9059944 - DNA, 20 bp, Homo sapiens
aatacatgagcacactttca

SEQ ID NO: 9059945 - DNA, 22 bp, Homo sapiens
aacatctttttgtttgctgaaa

SEQ ID NO: 9059946 - DNA, 22 bp, Homo sapiens
aacatctttgtagtgttctcct

SEQ ID NO: 9059947 - DNA, 22 bp, Homo sapiens
aacatctttttgtttgctgaaa

SEQ ID NO: 9059948 - DNA, 22 bp, Homo sapiens
aacatctttgataaacttagtg

SEQ ID NO: 9059949 - DNA, 22 bp, Homo sapiens
aacatctctgtattttatagac

SEQ ID NO: 9059950 - DNA, 22 bp, Homo sapiens
aacatctaggttctcatcgata

SEQ ID NO: 9059951 - DNA, 22 bp, Homo sapiens
aacatctagttcctatataata

SEQ ID NO: 9059952 - DNA, 22 bp, Homo sapiens
aacatctagttcctatataata

SEQ ID NO: 9059953 - DNA, 22 bp, Homo sapiens
aacatctcatggactacattct

SEQ ID NO: 9059954 - DNA, 22 bp, Homo sapiens
aacatctcagaagtgaccctga

SEQ ID NO: 9059955 - DNA, 22 bp, Homo sapiens
aacatcttcagagaagctaagt

SEQ ID NO: 9059956 - DNA, 22 bp, Homo sapiens
aacatctttacaacagacctag

SEQ ID NO: 9059957 - DNA, 22 bp, Homo sapiens
aacatgtagcagaaacgactaa

SEQ ID NO: 9059958 - DNA, 22 bp, Homo sapiens
aacatgtattttccttggcaac

SEQ ID NO: 9059959 - DNA, 22 bp, Homo sapiens
aacatgtacctacaatcagaat

SEQ ID NO: 9059960 - DNA, 22 bp, Homo sapiens
aacatgtctttagagaaacatt

SEQ ID NO: 9059961 - DNA, 22 bp, Homo sapiens
aacatgtaaatatcattgtact

SEQ ID NO: 9059962 - DNA, 22 bp, Homo sapiens
aacatgtaaccagcattcatct

SEQ ID NO: 9059963 - DNA, 22 bp, Homo sapiens
aacatgtaaccagcattcatct

SEQ ID NO: 9059964 - DNA, 22 bp, Homo sapiens
aacatgtacctacaatcagaat

SEQ ID NO: 9059965 - DNA, 22 bp, Homo sapiens
aacatgtacctacaatcagaat

SEQ ID NO: 9059966 - DNA, 22 bp, Homo sapiens
aatagatactacttagatgtag

SEQ ID NO: 9059967 - DNA, 22 bp, Homo sapiens
aatagatactacttagatgtag

SEQ ID NO: 9059968 - DNA, 22 bp, Homo sapiens
aatagatgggttaaacagcaaa

SEQ ID NO: 9059969 - DNA, 22 bp, Homo sapiens
aatagatactacttagatgtag

SEQ ID NO: 9059970 - DNA, 22 bp, Homo sapiens
aatagatgggttaaacagcaaa

SEQ ID NO: 9059971 - DNA, 22 bp, Homo sapiens
aatagactccagggtctatttt

SEQ ID NO: 9059972 - DNA, 22 bp, Homo sapiens
aatagagacctagatgccatga

SEQ ID NO: 9059973 - DNA, 22 bp, Homo sapiens
aatagactttctttttagaaca

SEQ ID NO: 9059974 - DNA, 22 bp, Homo sapiens
aatagaggagctttggactccc

SEQ ID NO: 9059975 - DNA, 22 bp, Homo sapiens
agcagatgaatcccagataaag

SEQ ID NO: 9059976 - DNA, 22 bp, Homo sapiens
agcagatatgatacttaattta

SEQ ID NO: 9059977 - DNA, 22 bp, Homo sapiens
agcagatgagcctcatgactgg

SEQ ID NO: 9059978 - DNA, 22 bp, Homo sapiens
agcagataggacatttcattct

SEQ ID NO: 9059979 - DNA, 19 bp, Homo sapiens
agcagagccctgaagatcc

SEQ ID NO: 9059980 - DNA, 18 bp, Homo sapiens
agcagagcccatgcattc

SEQ ID NO: 9059981 - DNA, 22 bp, Homo sapiens
agcagagcccttccatggcctt

SEQ ID NO: 9059982 - DNA, 22 bp, Homo sapiens
agcagagcccttccatggcctt

SEQ ID NO: 9059983 - DNA, 22 bp, Homo sapiens
agcagagcctgggctaggggtg

SEQ ID NO: 9059984 - DNA, 22 bp, Homo sapiens
agcagatggtgtcatgggatgg

SEQ ID NO: 9059985 - DNA, 22 bp, Homo sapiens
agcagatgcgtctgagtgggag

SEQ ID NO: 9059986 - DNA, 22 bp, Homo sapiens
agcagatggagaatggagtcag

SEQ ID NO: 9059987 - DNA, 22 bp, Homo sapiens
agcagataggacatttcattct

SEQ ID NO: 9059988 - DNA, 22 bp, Homo sapiens
agcagatgtttcagagcaggct

SEQ ID NO: 9059989 - DNA, 22 bp, Homo sapiens
agcagatgtttcagagcaggct

SEQ ID NO: 9059990 - DNA, 23 bp, Homo sapiens
agcagcaaaaatttatctttctg

SEQ ID NO: 9059991 - DNA, 23 bp, Homo sapiens
acacagaagaagacccaaggaag

SEQ ID NO: 9059992 - DNA, 22 bp, Homo sapiens
acacagaagatctcttaatgct

SEQ ID NO: 9059993 - DNA, 19 bp, Homo sapiens
agcagagcagggccgtggg

SEQ ID NO: 9059994 - DNA, 19 bp, Homo sapiens
agcagagcagggccgtggg

SEQ ID NO: 9059995 - DNA, 22 bp, Homo sapiens
agcagagccaggtctctctgta

SEQ ID NO: 9059996 - DNA, 22 bp, Homo sapiens
agcagagccagaattggaccag

SEQ ID NO: 9059997 - DNA, 22 bp, Homo sapiens
agcagagcagaatgtgaaggtg

SEQ ID NO: 9059998 - DNA, 22 bp, Homo sapiens
agcagaactgatgagacttgag

SEQ ID NO: 9059999 - DNA, 22 bp, Homo sapiens
agcagaacctgcagacctgtct

SEQ ID NO: 9060000 - DNA, 22 bp, Homo sapiens
agcagagaggaggtggccctgt

SEQ ID NO: 9060001 - DNA, 21 bp, Homo sapiens
acaatgcatggaactcatggc

SEQ ID NO: 9060002 - DNA, 22 bp, Homo sapiens
acaatgcaccagcatcttcacc

SEQ ID NO: 9060003 - DNA, 22 bp, Homo sapiens
acaatgcacctattttaaaact

SEQ ID NO: 9060004 - DNA, 22 bp, Homo sapiens
acaatgcatacctagcagctca

SEQ ID NO: 9060005 - DNA, 17 bp, Homo sapiens
acaatgcagtctctagt

SEQ ID NO: 9060006 - DNA, 17 bp, Homo sapiens
acaatgcagtctctagt

SEQ ID NO: 9060007 - DNA, 17 bp, Homo sapiens
acaatgcagtctctagt

SEQ ID NO: 9060008 - DNA, 23 bp, Homo sapiens
acaatgcactttaaatggttccc

SEQ ID NO: 9060009 - DNA, 22 bp, Homo sapiens
acaatgcagcctatggatccag

SEQ ID NO: 9060010 - DNA, 22 bp, Homo sapiens
acaatgcacctattttaaaact

SEQ ID NO: 9060011 - DNA, 23 bp, Homo sapiens
acaatgcactttaaatggttccc

SEQ ID NO: 9060012 - DNA, 21 bp, Homo sapiens
acacagaggcatcatcacttt

SEQ ID NO: 9060013 - DNA, 22 bp, Homo sapiens
acacagagcttctcaactggga

SEQ ID NO: 9060014 - DNA, 22 bp, Homo sapiens
acacagagggcagaagatacat

SEQ ID NO: 9060015 - DNA, 22 bp, Homo sapiens
acacagaggtggccactctttt

SEQ ID NO: 9060016 - DNA, 22 bp, Homo sapiens
acacagaggtggccactctttt

SEQ ID NO: 9060017 - DNA, 22 bp, Homo sapiens
acacagagtttgacacatggga

SEQ ID NO: 9060018 - DNA, 22 bp, Homo sapiens
acacagagtttgacacatggga

SEQ ID NO: 9060019 - DNA, 22 bp, Homo sapiens
acacagagtttgacacatggga

SEQ ID NO: 9060020 - DNA, 22 bp, Homo sapiens
acacagagtggtttgtagaata

SEQ ID NO: 9060021 - DNA, 22 bp, Homo sapiens
acacagagtccttactgaggta

SEQ ID NO: 9060022 - DNA, 22 bp, Homo sapiens
acacagagtatttagaaggggt

SEQ ID NO: 9060023 - DNA, 22 bp, Homo sapiens
acacagagtatcttttgcctag

SEQ ID NO: 9060024 - DNA, 22 bp, Homo sapiens
acacagagtatcttttgcctag

SEQ ID NO: 9060025 - DNA, 22 bp, Homo sapiens
acacagagtccttactgaggta

SEQ ID NO: 9060026 - DNA, 22 bp, Homo sapiens
acacagagtccttactgaggta

SEQ ID NO: 9060027 - DNA, 22 bp, Homo sapiens
agcagctgagccccagctgtga

SEQ ID NO: 9060028 - DNA, 22 bp, Homo sapiens
agcagctgagccccagctgtga

SEQ ID NO: 9060029 - DNA, 22 bp, Homo sapiens
agcagctggggcctgtgacgat

SEQ ID NO: 9060030 - DNA, 22 bp, Homo sapiens
agcagctggggcctgtgacgat

SEQ ID NO: 9060031 - DNA, 22 bp, Homo sapiens
agcagctgggctcagagctggg

SEQ ID NO: 9060032 - DNA, 22 bp, Homo sapiens
agcagctgggctcagagctggg

SEQ ID NO: 9060033 - DNA, 22 bp, Homo sapiens
acacagataatgctcatatagg

SEQ ID NO: 9060034 - DNA, 22 bp, Homo sapiens
agcagctggtgagcaagctcag

SEQ ID NO: 9060035 - DNA, 22 bp, Homo sapiens
agcagctggtaggagtggccac

SEQ ID NO: 9060036 - DNA, 22 bp, Homo sapiens
agcagctggtgagcaagctcag

SEQ ID NO: 9060037 - DNA, 22 bp, Homo sapiens
agcagctggtgagcaagctcag

SEQ ID NO: 9060038 - DNA, 22 bp, Homo sapiens
agcagctggtgagcaagctcag

SEQ ID NO: 9060039 - DNA, 22 bp, Homo sapiens
agcagctggtaggagtggccac

SEQ ID NO: 9060040 - DNA, 22 bp, Homo sapiens
agcagctggtaggagtggccac

SEQ ID NO: 9060041 - DNA, 22 bp, Homo sapiens
agcagctggtaggagtggccac

SEQ ID NO: 9060042 - DNA, 22 bp, Homo sapiens
agcagctggtaggagtggccac

SEQ ID NO: 9060043 - DNA, 22 bp, Homo sapiens
agcagctggtaggagtggccac

SEQ ID NO: 9060044 - DNA, 22 bp, Homo sapiens
agcagctgggtccggcggagca

SEQ ID NO: 9060045 - DNA, 23 bp, Homo sapiens
agcagctggggtgctcttttgtc

SEQ ID NO: 9060046 - DNA, 23 bp, Homo sapiens
agcagctggggtgctcttttgtc

SEQ ID NO: 9060047 - DNA, 22 bp, Homo sapiens
agcagctggggcctgtgacgat

SEQ ID NO: 9060048 - DNA, 22 bp, Homo sapiens
agcagctggggcctgtgacgat

SEQ ID NO: 9060049 - DNA, 17 bp, Homo sapiens
agcagctgggttgatct

SEQ ID NO: 9060050 - DNA, 17 bp, Homo sapiens
agcagctgggttgatct

SEQ ID NO: 9060051 - DNA, 22 bp, Homo sapiens
agcagctgggtccggcggagca

SEQ ID NO: 9060052 - DNA, 17 bp, Homo sapiens
agcagctgggttgatct

SEQ ID NO: 9060053 - DNA, 17 bp, Homo sapiens
agcagctgggttgatct

SEQ ID NO: 9060054 - DNA, 22 bp, Homo sapiens
agcagctgggtccggcggagca

SEQ ID NO: 9060055 - DNA, 22 bp, Homo sapiens
acacatgtatggcacttacatt

SEQ ID NO: 9060056 - DNA, 22 bp, Homo sapiens
acacatgtttgtgtagtcagtt

SEQ ID NO: 9060057 - DNA, 22 bp, Homo sapiens
acacatgtttccaaaagcaccc

SEQ ID NO: 9060058 - DNA, 22 bp, Homo sapiens
acacagggcagagagctggctc

SEQ ID NO: 9060059 - DNA, 19 bp, Homo sapiens
acacagggatcagagggtt

SEQ ID NO: 9060060 - DNA, 22 bp, Homo sapiens
acacagggcggaaagcatgaga

SEQ ID NO: 9060061 - DNA, 22 bp, Homo sapiens
acacagggcggaaagcatgaga

SEQ ID NO: 9060062 - DNA, 22 bp, Homo sapiens
agcagctggttcccgagggcgt

SEQ ID NO: 9060063 - DNA, 22 bp, Homo sapiens
agcagctggtgcaactctaaga

SEQ ID NO: 9060064 - DNA, 22 bp, Homo sapiens
agcagctggttcccgagggcgt

SEQ ID NO: 9060065 - DNA, 18 bp, Homo sapiens
acacaggctgacagcacc

SEQ ID NO: 9060066 - DNA, 18 bp, Homo sapiens
acacaggctgacagcacc

SEQ ID NO: 9060067 - DNA, 22 bp, Homo sapiens
acacaggcatagccatacatgt

SEQ ID NO: 9060068 - DNA, 22 bp, Homo sapiens
acacaggcatagccatacatgt

SEQ ID NO: 9060069 - DNA, 22 bp, Homo sapiens
acactagctaaatgctgattaa

SEQ ID NO: 9060070 - DNA, 22 bp, Homo sapiens
acactagctattaacttcacat

SEQ ID NO: 9060071 - DNA, 22 bp, Homo sapiens
acacattatagagagtataata

SEQ ID NO: 9060072 - DNA, 22 bp, Homo sapiens
acacattataggcaatcaaaag

SEQ ID NO: 9060073 - DNA, 22 bp, Homo sapiens
acactgaatatacaatgaatat

SEQ ID NO: 9060074 - DNA, 22 bp, Homo sapiens
acactgaatatacaatgaatat

SEQ ID NO: 9060075 - DNA, 22 bp, Homo sapiens
acactgaataattgagagttga

SEQ ID NO: 9060076 - DNA, 22 bp, Homo sapiens
acactgaaggctacaaggttga

SEQ ID NO: 9060077 - DNA, 22 bp, Homo sapiens
acactctgtaatgtcacactcc

SEQ ID NO: 9060078 - DNA, 22 bp, Homo sapiens
acactctacagagcaatctacc

SEQ ID NO: 9060079 - DNA, 22 bp, Homo sapiens
acactgacgcttgacagtcacc

SEQ ID NO: 9060080 - DNA, 22 bp, Homo sapiens
acactgacgcttgacagtcacc

SEQ ID NO: 9060081 - DNA, 22 bp, Homo sapiens
acactgactgggacagaagacc

SEQ ID NO: 9060082 - DNA, 22 bp, Homo sapiens
acactgagcttccaagatgggg

SEQ ID NO: 9060083 - DNA, 22 bp, Homo sapiens
acactgaatgtttaagaacttg

SEQ ID NO: 9060084 - DNA, 22 bp, Homo sapiens
acactgaatgtttaagaacttg

SEQ ID NO: 9060085 - DNA, 22 bp, Homo sapiens
acactgaatcagaaattgttgg

SEQ ID NO: 9060086 - DNA, 19 bp, Homo sapiens
acactgaatgtagaattgg

SEQ ID NO: 9060087 - DNA, 19 bp, Homo sapiens
acactgaatgtagaattgg

SEQ ID NO: 9060088 - DNA, 22 bp, Homo sapiens
acactgagtattgagtagggta

SEQ ID NO: 9060089 - DNA, 22 bp, Homo sapiens
acactgagtattgagtagggta

SEQ ID NO: 9060090 - DNA, 22 bp, Homo sapiens
acacttcacccctgctcccagt

SEQ ID NO: 9060091 - DNA, 22 bp, Homo sapiens
acactttagaaaaaagaatggt

SEQ ID NO: 9060092 - DNA, 22 bp, Homo sapiens
acactttactcttacaccattg

SEQ ID NO: 9060093 - DNA, 22 bp, Homo sapiens
acactttagaaaaaagaatggt

SEQ ID NO: 9060094 - DNA, 22 bp, Homo sapiens
acactttgatagataatgcagg

SEQ ID NO: 9060095 - DNA, 22 bp, Homo sapiens
acactttgaagatggaaacttg

SEQ ID NO: 9060096 - DNA, 22 bp, Homo sapiens
acactttgctacatttcatatt

SEQ ID NO: 9060097 - DNA, 22 bp, Homo sapiens
acactttgggctggataattat

SEQ ID NO: 9060098 - DNA, 22 bp, Homo sapiens
acactttgtcctttttcattgt

SEQ ID NO: 9060099 - DNA, 22 bp, Homo sapiens
acactttgttgtggcatatacg

SEQ ID NO: 9060100 - DNA, 22 bp, Homo sapiens
acactttatcaatattcaaaaa

SEQ ID NO: 9060101 - DNA, 22 bp, Homo sapiens
acactttatcaatattcaaaaa

SEQ ID NO: 9060102 - DNA, 22 bp, Homo sapiens
acagaaaatgccagaagggtgg

SEQ ID NO: 9060103 - DNA, 22 bp, Homo sapiens
acagaaacccagaaaacctctc

SEQ ID NO: 9060104 - DNA, 22 bp, Homo sapiens
acagaaaagtttacttttgctc

SEQ ID NO: 9060105 - DNA, 22 bp, Homo sapiens
acagaaaagtttacttttgctc

SEQ ID NO: 9060106 - DNA, 22 bp, Homo sapiens
acagaaaaatgagggagctgga

SEQ ID NO: 9060107 - DNA, 22 bp, Homo sapiens
acagacactgcactcccacctt

SEQ ID NO: 9060108 - DNA, 22 bp, Homo sapiens
acagacagaggctccatgagga

SEQ ID NO: 9060109 - DNA, 22 bp, Homo sapiens
acagacagggcacctgcctcct

SEQ ID NO: 9060110 - DNA, 22 bp, Homo sapiens
acagacagggcacctgcctcct

SEQ ID NO: 9060111 - DNA, 22 bp, Homo sapiens
acagacagaggctccatgagga

SEQ ID NO: 9060112 - DNA, 22 bp, Homo sapiens
acagacagattttgtctgatgt

SEQ ID NO: 9060113 - DNA, 20 bp, Homo sapiens
acagaaagagagaatgtcag

SEQ ID NO: 9060114 - DNA, 22 bp, Homo sapiens
acagaattaatgaaaattacaa

SEQ ID NO: 9060115 - DNA, 22 bp, Homo sapiens
acagaattaatgaaaattacaa

SEQ ID NO: 9060116 - DNA, 22 bp, Homo sapiens
acagacaagtagttcagacaag

SEQ ID NO: 9060117 - DNA, 22 bp, Homo sapiens
acagacaagtagttcagacaag

SEQ ID NO: 9060118 - DNA, 22 bp, Homo sapiens
acagagaccagcatcttctgcc

SEQ ID NO: 9060119 - DNA, 22 bp, Homo sapiens
acagagaccagcatcttctgcc

SEQ ID NO: 9060120 - DNA, 22 bp, Homo sapiens
acagagacaggcagacagtctt

SEQ ID NO: 9060121 - DNA, 22 bp, Homo sapiens
acagagacaggcagacagtctt

SEQ ID NO: 9060122 - DNA, 22 bp, Homo sapiens
acagagaccagttacagcgtcc

SEQ ID NO: 9060123 - DNA, 23 bp, Homo sapiens
acagagacaatggtttcatcttg

SEQ ID NO: 9060124 - DNA, 23 bp, Homo sapiens
acagagacaatggtttcatcttg

SEQ ID NO: 9060125 - DNA, 22 bp, Homo sapiens
acagagaaagttcctctcaggc

SEQ ID NO: 9060126 - DNA, 22 bp, Homo sapiens
acagagaaagtgggctgaagat

SEQ ID NO: 9060127 - DNA, 20 bp, Homo sapiens
acagagactgagacacttgc

SEQ ID NO: 9060128 - DNA, 22 bp, Homo sapiens
acagagactcatgaaagatgac

SEQ ID NO: 9060129 - DNA, 22 bp, Homo sapiens
acagagactgggatgcctgcct

SEQ ID NO: 9060130 - DNA, 22 bp, Homo sapiens
acagagactgggagcaagaggc

SEQ ID NO: 9060131 - DNA, 22 bp, Homo sapiens
acagagagaggcccgaggctgc

SEQ ID NO: 9060132 - DNA, 22 bp, Homo sapiens
acagagagaattgggtttacag

SEQ ID NO: 9060133 - DNA, 22 bp, Homo sapiens
acagagagaggcccgaggctgc

SEQ ID NO: 9060134 - DNA, 22 bp, Homo sapiens
acagagagaaacaatcagcagc

SEQ ID NO: 9060135 - DNA, 22 bp, Homo sapiens
acagagacttggagcaggctga

SEQ ID NO: 9060136 - DNA, 22 bp, Homo sapiens
acagagagaaacaatcagcagc

SEQ ID NO: 9060137 - DNA, 22 bp, Homo sapiens
acagagaaagtgggctgaagat

SEQ ID NO: 9060138 - DNA, 22 bp, Homo sapiens
acagagaaagtgggctgaagat

SEQ ID NO: 9060139 - DNA, 22 bp, Homo sapiens
acagactgtttggttcatgtct

SEQ ID NO: 9060140 - DNA, 22 bp, Homo sapiens
acagactgtgagtctcattttc

SEQ ID NO: 9060141 - DNA, 22 bp, Homo sapiens
acagacattcagctaagtctat

SEQ ID NO: 9060142 - DNA, 22 bp, Homo sapiens
acagacattcatatcctcggta

SEQ ID NO: 9060143 - DNA, 22 bp, Homo sapiens
agctcctgcaccaggggcccct

SEQ ID NO: 9060144 - DNA, 22 bp, Homo sapiens
agctcctgcacccagccttgag

SEQ ID NO: 9060145 - DNA, 22 bp, Homo sapiens
agctcctgcagactcctgctca

SEQ ID NO: 9060146 - DNA, 22 bp, Homo sapiens
agctcctgcccaggaaggctct

SEQ ID NO: 9060147 - DNA, 22 bp, Homo sapiens
agctcctgcccaggaaggctct

SEQ ID NO: 9060148 - DNA, 17 bp, Homo sapiens
agctcctgcccatggct

SEQ ID NO: 9060149 - DNA, 17 bp, Homo sapiens
agctcctgcccatggct

SEQ ID NO: 9060150 - DNA, 22 bp, Homo sapiens
agctcctgcgcacggtgcacac

SEQ ID NO: 9060151 - DNA, 22 bp, Homo sapiens
agctcctgctctttgtccctaa

SEQ ID NO: 9060152 - DNA, 22 bp, Homo sapiens
agctcctgcttgacagaagagg

SEQ ID NO: 9060153 - DNA, 22 bp, Homo sapiens
agctcctgcttgacagaagagg

SEQ ID NO: 9060154 - DNA, 19 bp, Homo sapiens
acagcacagaaatatttca

SEQ ID NO: 9060155 - DNA, 22 bp, Homo sapiens
acagcacaatctgagtcccaga

SEQ ID NO: 9060156 - DNA, 22 bp, Homo sapiens
acagcaattttgtgcacaagtg

SEQ ID NO: 9060157 - DNA, 22 bp, Homo sapiens
acagcacagagtggtatggctg

SEQ ID NO: 9060158 - DNA, 22 bp, Homo sapiens
agctcccagaaggccctgcgcc

SEQ ID NO: 9060159 - DNA, 22 bp, Homo sapiens
agctcccagaaggccctgcgcc

SEQ ID NO: 9060160 - DNA, 22 bp, Homo sapiens
agctcccagaaggccctgcgcc

SEQ ID NO: 9060161 - DNA, 22 bp, Homo sapiens
agctcccagagctcgagagtaa

SEQ ID NO: 9060162 - DNA, 22 bp, Homo sapiens
agctcccagagctcgagagtaa

SEQ ID NO: 9060163 - DNA, 22 bp, Homo sapiens
acagattcactgcactggccat

SEQ ID NO: 9060164 - DNA, 21 bp, Homo sapiens
acagattagcacaatgcaggc

SEQ ID NO: 9060165 - DNA, 20 bp, Homo sapiens
acagatggcagttattacat

SEQ ID NO: 9060166 - DNA, 22 bp, Homo sapiens
acagatggcactttttaggact

SEQ ID NO: 9060167 - DNA, 22 bp, Homo sapiens
acagatggcactttttaggact

SEQ ID NO: 9060168 - DNA, 22 bp, Homo sapiens
acagatggccatattactatat

SEQ ID NO: 9060169 - DNA, 22 bp, Homo sapiens
acagatggagctactaggtaaa

SEQ ID NO: 9060170 - DNA, 19 bp, Homo sapiens
acagatggaggaatctggg

SEQ ID NO: 9060171 - DNA, 22 bp, Homo sapiens
acagatggaggttattatgaac

SEQ ID NO: 9060172 - DNA, 22 bp, Homo sapiens
acagatggcacctttttgctgt

SEQ ID NO: 9060173 - DNA, 22 bp, Homo sapiens
acagatggtactaaacccatat

SEQ ID NO: 9060174 - DNA, 22 bp, Homo sapiens
acagatggtagcattatgttgg

SEQ ID NO: 9060175 - DNA, 22 bp, Homo sapiens
acagatggggcacaaagccaca

SEQ ID NO: 9060176 - DNA, 21 bp, Homo sapiens
acagatgggatgagcacactg

SEQ ID NO: 9060177 - DNA, 21 bp, Homo sapiens
acagatgggatgagcacactg

SEQ ID NO: 9060178 - DNA, 22 bp, Homo sapiens
acagatggtgagccgctgatgt

SEQ ID NO: 9060179 - DNA, 22 bp, Homo sapiens
acagatggttattgtcatttct

SEQ ID NO: 9060180 - DNA, 22 bp, Homo sapiens
acagatggttattgtcatttct

SEQ ID NO: 9060181 - DNA, 22 bp, Homo sapiens
acagatgtaatctattcacatt

SEQ ID NO: 9060182 - DNA, 22 bp, Homo sapiens
agcctcctgtagccctcaccca

SEQ ID NO: 9060183 - DNA, 22 bp, Homo sapiens
agcctctcaaagaaaccctgta

SEQ ID NO: 9060184 - DNA, 20 bp, Homo sapiens
agccctgtttcctggagaga

SEQ ID NO: 9060185 - DNA, 22 bp, Homo sapiens
acagagagctgtgattgagtta

SEQ ID NO: 9060186 - DNA, 22 bp, Homo sapiens
agccctgttgtctgatgatggg

SEQ ID NO: 9060187 - DNA, 22 bp, Homo sapiens
agcctctctgatgtgacagcta

SEQ ID NO: 9060188 - DNA, 22 bp, Homo sapiens
agcctctctccagcttggcaga

SEQ ID NO: 9060189 - DNA, 22 bp, Homo sapiens
agcctctcttatcccttcaaag

SEQ ID NO: 9060190 - DNA, 22 bp, Homo sapiens
agcctctctgttagtcactggg

SEQ ID NO: 9060191 - DNA, 22 bp, Homo sapiens
agcctctccagagcctggcaga

SEQ ID NO: 9060192 - DNA, 22 bp, Homo sapiens
agcctctccagagcctggcaga

SEQ ID NO: 9060193 - DNA, 22 bp, Homo sapiens
acagagccactttggtgcctac

SEQ ID NO: 9060194 - DNA, 22 bp, Homo sapiens
acagagccactttggtgcctac

SEQ ID NO: 9060195 - DNA, 21 bp, Homo sapiens
acagagccgggcacaaagctg

SEQ ID NO: 9060196 - DNA, 22 bp, Homo sapiens
acagagcctccaggagtgctgg

SEQ ID NO: 9060197 - DNA, 22 bp, Homo sapiens
acagagcctccaggagtgctgg

SEQ ID NO: 9060198 - DNA, 22 bp, Homo sapiens
acagagccactttggtgcctac

SEQ ID NO: 9060199 - DNA, 22 bp, Homo sapiens
acagagccaaaaggacatagta

SEQ ID NO: 9060200 - DNA, 22 bp, Homo sapiens
acagagccaaaaggacatagta

SEQ ID NO: 9060201 - DNA, 22 bp, Homo sapiens
acagagcatttgggacagagag

SEQ ID NO: 9060202 - DNA, 22 bp, Homo sapiens
agcctctgatgatcacaggggg

SEQ ID NO: 9060203 - DNA, 22 bp, Homo sapiens
agcctctgactgtcagcaaggt

SEQ ID NO: 9060204 - DNA, 22 bp, Homo sapiens
agcctctgatgatcacaggggg

SEQ ID NO: 9060205 - DNA, 22 bp, Homo sapiens
agcctctctttctggtggctaa

SEQ ID NO: 9060206 - DNA, 19 bp, Homo sapiens
acagagctctctgcttctg

SEQ ID NO: 9060207 - DNA, 22 bp, Homo sapiens
acagagctcccagccatctcct

SEQ ID NO: 9060208 - DNA, 22 bp, Homo sapiens
acagagctcccagccatctcct

SEQ ID NO: 9060209 - DNA, 22 bp, Homo sapiens
acagagctcccagccatctcct

SEQ ID NO: 9060210 - DNA, 17 bp, Homo sapiens
acagagctacatattct

SEQ ID NO: 9060211 - DNA, 22 bp, Homo sapiens
acagagctaatgttgcataggc

SEQ ID NO: 9060212 - DNA, 22 bp, Homo sapiens
acagagctgggatctgaaccca

SEQ ID NO: 9060213 - DNA, 22 bp, Homo sapiens
acagagctgggtgccccctgga

SEQ ID NO: 9060214 - DNA, 22 bp, Homo sapiens
acagagctgggatctgaaccca

SEQ ID NO: 9060215 - DNA, 22 bp, Homo sapiens
acagatgaggaatttatttggt

SEQ ID NO: 9060216 - DNA, 22 bp, Homo sapiens
acagatgagttagaataggcag

SEQ ID NO: 9060217 - DNA, 22 bp, Homo sapiens
acagatgagttagaataggcag

SEQ ID NO: 9060218 - DNA, 22 bp, Homo sapiens
acagatgatgtgcacagataga

SEQ ID NO: 9060219 - DNA, 22 bp, Homo sapiens
acagatgagttaaagcagagtg

SEQ ID NO: 9060220 - DNA, 22 bp, Homo sapiens
acagatgaggtgtttggagagc

SEQ ID NO: 9060221 - DNA, 22 bp, Homo sapiens
acagatgagttaaagcagagtg

SEQ ID NO: 9060222 - DNA, 22 bp, Homo sapiens
acagatgagttaaagcagagtg

SEQ ID NO: 9060223 - DNA, 22 bp, Homo sapiens
acagatgaggctggcgagggca

SEQ ID NO: 9060224 - DNA, 22 bp, Homo sapiens
acagatgaggctggcgagggca

SEQ ID NO: 9060225 - DNA, 22 bp, Homo sapiens
acagatgatgtgcacagataga

SEQ ID NO: 9060226 - DNA, 22 bp, Homo sapiens
acagatgatgtgcacagataga

SEQ ID NO: 9060227 - DNA, 22 bp, Homo sapiens
acagatgatgtgcacagataga

SEQ ID NO: 9060228 - DNA, 22 bp, Homo sapiens
acagatgatttttatgaaaaca

SEQ ID NO: 9060229 - DNA, 22 bp, Homo sapiens
acagatgatttttatgaaaaca

SEQ ID NO: 9060230 - DNA, 22 bp, Homo sapiens
acagatggaatgtgttatggga

SEQ ID NO: 9060231 - DNA, 22 bp, Homo sapiens
acagatggaatgtgttatggga

SEQ ID NO: 9060232 - DNA, 23 bp, Homo sapiens
acaaagtaattcctgcttccaaa

SEQ ID NO: 9060233 - DNA, 22 bp, Homo sapiens
acaaagggggactgcagagggt

SEQ ID NO: 9060234 - DNA, 22 bp, Homo sapiens
agagggggcagcggaccagtga

SEQ ID NO: 9060235 - DNA, 22 bp, Homo sapiens
agagggggtgtcagcactgcag

SEQ ID NO: 9060236 - DNA, 22 bp, Homo sapiens
agagggggtgttccagaagcat

SEQ ID NO: 9060237 - DNA, 22 bp, Homo sapiens
agaggcttgacaatatgattgg

SEQ ID NO: 9060238 - DNA, 22 bp, Homo sapiens
acaaagaaggaattggtcttta

SEQ ID NO: 9060239 - DNA, 20 bp, Homo sapiens
agaggcttccttgggaggag

SEQ ID NO: 9060240 - DNA, 22 bp, Homo sapiens
agaggcttctttctgatttgcg

SEQ ID NO: 9060241 - DNA, 22 bp, Homo sapiens
acaaaggactgaaactggctgt

SEQ ID NO: 9060242 - DNA, 18 bp, Homo sapiens
acaaaggatcatgaggga

SEQ ID NO: 9060243 - DNA, 18 bp, Homo sapiens
acaaaggatcatgaggga

SEQ ID NO: 9060244 - DNA, 18 bp, Homo sapiens
acaaaggatcatgaggga

SEQ ID NO: 9060245 - DNA, 19 bp, Homo sapiens
acaaagctgtgagcagctt

SEQ ID NO: 9060246 - DNA, 19 bp, Homo sapiens
acaaagctgtgagcagctt

SEQ ID NO: 9060247 - DNA, 21 bp, Homo sapiens
acaaaggaagtctcttttaag

SEQ ID NO: 9060248 - DNA, 21 bp, Homo sapiens
acaaaggaagtctcttttaag

SEQ ID NO: 9060249 - DNA, 22 bp, Homo sapiens
agaggctgtgcccaccaggcaa

SEQ ID NO: 9060250 - DNA, 22 bp, Homo sapiens
agaggctgagaaaccctcttct

SEQ ID NO: 9060251 - DNA, 22 bp, Homo sapiens
agaggctgttacactcccagat

SEQ ID NO: 9060252 - DNA, 22 bp, Homo sapiens
agaggctgttacactcccagat

SEQ ID NO: 9060253 - DNA, 22 bp, Homo sapiens
agaggctgtgcccaccaggcaa

SEQ ID NO: 9060254 - DNA, 22 bp, Homo sapiens
aattgcttgatgactagtaatt

SEQ ID NO: 9060255 - DNA, 22 bp, Homo sapiens
aattgcttgatgactagtaatt

SEQ ID NO: 9060256 - DNA, 22 bp, Homo sapiens
aattgcttagagaatccaggta

SEQ ID NO: 9060257 - DNA, 22 bp, Homo sapiens
agaggccctctctctcctgatg

SEQ ID NO: 9060258 - DNA, 22 bp, Homo sapiens
aattgcttgtcttcttccctac

SEQ ID NO: 9060259 - DNA, 22 bp, Homo sapiens
agaggctctggtgcagcatgca

SEQ ID NO: 9060260 - DNA, 22 bp, Homo sapiens
agaggctctggtgcagcatgca

SEQ ID NO: 9060261 - DNA, 22 bp, Homo sapiens
agaggctctgccgcctcaggta

SEQ ID NO: 9060262 - DNA, 22 bp, Homo sapiens
agaggctctgccgcctcaggta

SEQ ID NO: 9060263 - DNA, 22 bp, Homo sapiens
agaggctctaataccagcatgg

SEQ ID NO: 9060264 - DNA, 22 bp, Homo sapiens
agaggctctaataccagcatgg

SEQ ID NO: 9060265 - DNA, 22 bp, Homo sapiens
agaggctctaatcccctccaca

SEQ ID NO: 9060266 - DNA, 22 bp, Homo sapiens
agaggctgaatgatgtcatcat

SEQ ID NO: 9060267 - DNA, 22 bp, Homo sapiens
agaggctgaatgatgtcatcat

SEQ ID NO: 9060268 - DNA, 22 bp, Homo sapiens
agaggctgaatgatgtcatcat

SEQ ID NO: 9060269 - DNA, 22 bp, Homo sapiens
aattgcccgcacattgagaggt

SEQ ID NO: 9060270 - DNA, 22 bp, Homo sapiens
aattgcccatatttgagaatga

SEQ ID NO: 9060271 - DNA, 22 bp, Homo sapiens
aattgcccttacagtaatcaga

SEQ ID NO: 9060272 - DNA, 20 bp, Homo sapiens
aattgcccatcctcctagcc

SEQ ID NO: 9060273 - DNA, 22 bp, Homo sapiens
aattgcaacaggtagacttttc

SEQ ID NO: 9060274 - DNA, 22 bp, Homo sapiens
aattgatggacagagatgaaga

SEQ ID NO: 9060275 - DNA, 22 bp, Homo sapiens
aattcttgttgttagtatattt

SEQ ID NO: 9060276 - DNA, 22 bp, Homo sapiens
aattcttggtcctagtgtataa

SEQ ID NO: 9060277 - DNA, 20 bp, Homo sapiens
aattgaagcagaggagaggc

SEQ ID NO: 9060278 - DNA, 22 bp, Homo sapiens
agataagctgtttttcaagaat

SEQ ID NO: 9060279 - DNA, 17 bp, Homo sapiens
agataagcttcagagct

SEQ ID NO: 9060280 - DNA, 22 bp, Homo sapiens
agataagctgtttttcaagaat

SEQ ID NO: 9060281 - DNA, 22 bp, Homo sapiens
agataataaatgttttaggttt

SEQ ID NO: 9060282 - DNA, 22 bp, Homo sapiens
agataataagtctggtaataat

SEQ ID NO: 9060283 - DNA, 22 bp, Homo sapiens
agataataagtctggtaataat

SEQ ID NO: 9060284 - DNA, 22 bp, Homo sapiens
acaaccttctggagatatctgt

SEQ ID NO: 9060285 - DNA, 22 bp, Homo sapiens
acaaccatgtcagttcaaacca

SEQ ID NO: 9060286 - DNA, 22 bp, Homo sapiens
acaagaatgtagattagttaag

SEQ ID NO: 9060287 - DNA, 22 bp, Homo sapiens
agataataagtctggtaataat

SEQ ID NO: 9060288 - DNA, 22 bp, Homo sapiens
acaagactgtgctctaagagtg

SEQ ID NO: 9060289 - DNA, 22 bp, Homo sapiens
acaagagacaagaggttcttct

SEQ ID NO: 9060290 - DNA, 22 bp, Homo sapiens
acaagaattatttctagttaac

SEQ ID NO: 9060291 - DNA, 22 bp, Homo sapiens
acaagactgtgctctaagagtg

SEQ ID NO: 9060292 - DNA, 22 bp, Homo sapiens
acaagagattatctacagatga

SEQ ID NO: 9060293 - DNA, 22 bp, Homo sapiens
acaagagattatctacagatga

SEQ ID NO: 9060294 - DNA, 22 bp, Homo sapiens
agataaattcctaagatttcag

SEQ ID NO: 9060295 - DNA, 22 bp, Homo sapiens
agataacatgttgcagattctg

SEQ ID NO: 9060296 - DNA, 22 bp, Homo sapiens
agataactcattttgtatatcc

SEQ ID NO: 9060297 - DNA, 22 bp, Homo sapiens
agataactggtttacattattg

SEQ ID NO: 9060298 - DNA, 22 bp, Homo sapiens
acaacacatgtgtatatgtgtg

SEQ ID NO: 9060299 - DNA, 22 bp, Homo sapiens
acaacagagctggactgagagg

SEQ ID NO: 9060300 - DNA, 22 bp, Homo sapiens
acaacacagctttcctcaagtt

SEQ ID NO: 9060301 - DNA, 22 bp, Homo sapiens
acaacacatgtgtatatgtgtg

SEQ ID NO: 9060302 - DNA, 22 bp, Homo sapiens
acaacacatgtgtatatgtgtg

SEQ ID NO: 9060303 - DNA, 22 bp, Homo sapiens
acaacaaagacacttgaaatga

SEQ ID NO: 9060304 - DNA, 22 bp, Homo sapiens
acaacaaggcttttcattcata

SEQ ID NO: 9060305 - DNA, 22 bp, Homo sapiens
acaacacagcaaaaccccatct

SEQ ID NO: 9060306 - DNA, 22 bp, Homo sapiens
acaacaatctaccctagcttct

SEQ ID NO: 9060307 - DNA, 22 bp, Homo sapiens
acaaattgccccattttgaact

SEQ ID NO: 9060308 - DNA, 22 bp, Homo sapiens
acaacaaagacacttgaaatga

SEQ ID NO: 9060309 - DNA, 22 bp, Homo sapiens
acaatgaaagcaagaagacggc

SEQ ID NO: 9060310 - DNA, 22 bp, Homo sapiens
acaatcttattagtagtataga

SEQ ID NO: 9060311 - DNA, 22 bp, Homo sapiens
acaatcattccgttcacaacag

SEQ ID NO: 9060312 - DNA, 22 bp, Homo sapiens
acaatcacacatgcaattatac

SEQ ID NO: 9060313 - DNA, 22 bp, Homo sapiens
acaatcttattagtagtataga

SEQ ID NO: 9060314 - DNA, 22 bp, Homo sapiens
acaatcattggcttcattacaa

SEQ ID NO: 9060315 - DNA, 22 bp, Homo sapiens
acaatgaacgctttttaactgt

SEQ ID NO: 9060316 - DNA, 22 bp, Homo sapiens
acaatgaacacacaaggaattc

SEQ ID NO: 9060317 - DNA, 22 bp, Homo sapiens
acaatgaaccaaatttaccaat

SEQ ID NO: 9060318 - DNA, 22 bp, Homo sapiens
acaatgaacacacaaggaattc

SEQ ID NO: 9060319 - DNA, 22 bp, Homo sapiens
acaatgattttttagagtagtt

SEQ ID NO: 9060320 - DNA, 22 bp, Homo sapiens
acaatgattttttagagtagtt

SEQ ID NO: 9060321 - DNA, 22 bp, Homo sapiens
acaatgcaataggagctagaaa

SEQ ID NO: 9060322 - DNA, 22 bp, Homo sapiens
acaatgcaataggagctagaaa

SEQ ID NO: 9060323 - DNA, 22 bp, Homo sapiens
acaatgcaattgtaaggtgtgt

SEQ ID NO: 9060324 - DNA, 22 bp, Homo sapiens
acaatgcaataggagctagaaa

SEQ ID NO: 9060325 - DNA, 22 bp, Homo sapiens
acaatgaagataatgttgcagt

SEQ ID NO: 9060326 - DNA, 22 bp, Homo sapiens
acaatgaagggagacacttgct

SEQ ID NO: 9060327 - DNA, 22 bp, Homo sapiens
acaatgaatatcatgaagtact

SEQ ID NO: 9060328 - DNA, 22 bp, Homo sapiens
acaatgaatatcatgaagtact

SEQ ID NO: 9060329 - DNA, 22 bp, Homo sapiens
acaatgaatactaagcaccagg

SEQ ID NO: 9060330 - DNA, 22 bp, Homo sapiens
acaatagacaaagtgaatggct

SEQ ID NO: 9060331 - DNA, 22 bp, Homo sapiens
acaatcacacatgcaattatac

SEQ ID NO: 9060332 - DNA, 22 bp, Homo sapiens
acaagcataagtgagatgaata

SEQ ID NO: 9060333 - DNA, 22 bp, Homo sapiens
acaagcataagtgagatgaata

SEQ ID NO: 9060334 - DNA, 22 bp, Homo sapiens
acaagcatcaggttcagcaata

SEQ ID NO: 9060335 - DNA, 17 bp, Homo sapiens
acaagcagtggccatgg

SEQ ID NO: 9060336 - DNA, 23 bp, Homo sapiens
acaagatagggataaaaagataa

SEQ ID NO: 9060337 - DNA, 22 bp, Homo sapiens
acaagcagagattaaatgtttt

SEQ ID NO: 9060338 - DNA, 22 bp, Homo sapiens
acaagcagagattaaatgtttt

SEQ ID NO: 9060339 - DNA, 22 bp, Homo sapiens
acaagatttaatgcaacccaag

SEQ ID NO: 9060340 - DNA, 22 bp, Homo sapiens
aatggtttggactattcaatag

SEQ ID NO: 9060341 - DNA, 19 bp, Homo sapiens
aatggtttgatgaagtata

SEQ ID NO: 9060342 - DNA, 22 bp, Homo sapiens
aatggtttgatggacaaaatga

SEQ ID NO: 9060343 - DNA, 22 bp, Homo sapiens
aatggtttgtacctgtccttgg

SEQ ID NO: 9060344 - DNA, 22 bp, Homo sapiens
aatggttttgcaggtttgtgga

SEQ ID NO: 9060345 - DNA, 22 bp, Homo sapiens
aatggttttctagaacatgaaa

SEQ ID NO: 9060346 - DNA, 22 bp, Homo sapiens
aatggtttaacatatgcttgag

SEQ ID NO: 9060347 - DNA, 22 bp, Homo sapiens
aatggtttagttaagactgagt

SEQ ID NO: 9060348 - DNA, 22 bp, Homo sapiens
aatggtcattggtggttattgg

SEQ ID NO: 9060349 - DNA, 22 bp, Homo sapiens
aatggtttatggggaccgcaaa

SEQ ID NO: 9060350 - DNA, 22 bp, Homo sapiens
aatggtttcaaacacactaagt

SEQ ID NO: 9060351 - DNA, 22 bp, Homo sapiens
aatggtttctgaagttaggcag

SEQ ID NO: 9060352 - DNA, 23 bp, Homo sapiens
aatgggtgcaactatccatgaca

SEQ ID NO: 9060353 - DNA, 22 bp, Homo sapiens
aatggtaatttgcagaaagtcc

SEQ ID NO: 9060354 - DNA, 22 bp, Homo sapiens
aatggtcactatgtaaggtgat

SEQ ID NO: 9060355 - DNA, 22 bp, Homo sapiens
aatggtcaaaaagatacgtaaa

SEQ ID NO: 9060356 - DNA, 22 bp, Homo sapiens
aatggtaatatttcatagttgt

SEQ ID NO: 9060357 - DNA, 22 bp, Homo sapiens
aatggtaatggagagaactact

SEQ ID NO: 9060358 - DNA, 22 bp, Homo sapiens
aatggtaatattggcacagaaa

SEQ ID NO: 9060359 - DNA, 22 bp, Homo sapiens
aatggtaaatgtaacagcattc

SEQ ID NO: 9060360 - DNA, 22 bp, Homo sapiens
aatgtcttcagtgtatacatgg

SEQ ID NO: 9060361 - DNA, 22 bp, Homo sapiens
aatgtcttcagttctgtattgt

SEQ ID NO: 9060362 - DNA, 22 bp, Homo sapiens
aatgtgaactttgtcatgtaac

SEQ ID NO: 9060363 - DNA, 18 bp, Homo sapiens
aatgtgaatatttacttc

SEQ ID NO: 9060364 - DNA, 18 bp, Homo sapiens
aatgtgaatatttacttc

SEQ ID NO: 9060365 - DNA, 22 bp, Homo sapiens
aatgtgaactttgtcatgtaac

SEQ ID NO: 9060366 - DNA, 22 bp, Homo sapiens
aatgtaaaatatcttgtacttg

SEQ ID NO: 9060367 - DNA, 22 bp, Homo sapiens
aatggttttgtctcatcaatgt

SEQ ID NO: 9060368 - DNA, 22 bp, Homo sapiens
aatggttttgctttagtattct

SEQ ID NO: 9060369 - DNA, 22 bp, Homo sapiens
aatggtttttagtgagatcgat

SEQ ID NO: 9060370 - DNA, 22 bp, Homo sapiens
aatggtttttgcatattcaggt

SEQ ID NO: 9060371 - DNA, 22 bp, Homo sapiens
aatgtgaggccttggtagttat

SEQ ID NO: 9060372 - DNA, 22 bp, Homo sapiens
aatgtgatcgctttagaagctt

SEQ ID NO: 9060373 - DNA, 22 bp, Homo sapiens
aatgtgcagtgcctgaagcatg

SEQ ID NO: 9060374 - DNA, 22 bp, Homo sapiens
aatgtgattttctcactccctt

SEQ ID NO: 9060375 - DNA, 22 bp, Homo sapiens
aatgtgattttcccagtagaat

SEQ ID NO: 9060376 - DNA, 22 bp, Homo sapiens
aatgtggccacttttttctggg

SEQ ID NO: 9060377 - DNA, 22 bp, Homo sapiens
aatgtggcattgtcattattgg

SEQ ID NO: 9060378 - DNA, 22 bp, Homo sapiens
aatgtgctttgttcagccattt

SEQ ID NO: 9060379 - DNA, 23 bp, Homo sapiens
aatgtgctgtattcatttctgga

SEQ ID NO: 9060380 - DNA, 22 bp, Homo sapiens
aatggcatgggaaatgcagtgg

SEQ ID NO: 9060381 - DNA, 22 bp, Homo sapiens
aatggcagaatgggccagaagc

SEQ ID NO: 9060382 - DNA, 22 bp, Homo sapiens
aatggcactttataaatgttaa

SEQ ID NO: 9060383 - DNA, 22 bp, Homo sapiens
aatggcagaggcaaagatggta

SEQ ID NO: 9060384 - DNA, 22 bp, Homo sapiens
aatgggataatagaagtagaat

SEQ ID NO: 9060385 - DNA, 22 bp, Homo sapiens
aatggagacttcaaaatggatt

SEQ ID NO: 9060386 - DNA, 22 bp, Homo sapiens
aatggagacttcaaaatggatt

SEQ ID NO: 9060387 - DNA, 22 bp, Homo sapiens
aatggagaggctgtgagtgaga

SEQ ID NO: 9060388 - DNA, 22 bp, Homo sapiens
aatggagacttcaaaatggatt

SEQ ID NO: 9060389 - DNA, 22 bp, Homo sapiens
aatggagactgacacaaagata

SEQ ID NO: 9060390 - DNA, 22 bp, Homo sapiens
agacaattaaaaaattatgctt

SEQ ID NO: 9060391 - DNA, 22 bp, Homo sapiens
aatggcaagctgaactcagaag

SEQ ID NO: 9060392 - DNA, 22 bp, Homo sapiens
aatggcaagagccacagaggcg

SEQ ID NO: 9060393 - DNA, 22 bp, Homo sapiens
aatggcaacatggtatagtgag

SEQ ID NO: 9060394 - DNA, 22 bp, Homo sapiens
aatggcaacatggtatagtgag

SEQ ID NO: 9060395 - DNA, 22 bp, Homo sapiens
aatggcaaaaggataacaagga

SEQ ID NO: 9060396 - DNA, 22 bp, Homo sapiens
aatggcaaagtgttttcatacc

SEQ ID NO: 9060397 - DNA, 22 bp, Homo sapiens
aatggcaaaaggagttagttga

SEQ ID NO: 9060398 - DNA, 22 bp, Homo sapiens
aatggcaaaaggataacaagga

SEQ ID NO: 9060399 - DNA, 22 bp, Homo sapiens
aatggcaattcagtgaaattat

SEQ ID NO: 9060400 - DNA, 22 bp, Homo sapiens
aatggcaagctgaactcagaag

SEQ ID NO: 9060401 - DNA, 20 bp, Homo sapiens
agacaaaatgacttcatgca

SEQ ID NO: 9060402 - DNA, 23 bp, Homo sapiens
agaagcagcttctggagtatcgg

SEQ ID NO: 9060403 - DNA, 22 bp, Homo sapiens
agaagcagcaagcccttcaaag

SEQ ID NO: 9060404 - DNA, 23 bp, Homo sapiens
agaagcagcttctggagtatcgg

SEQ ID NO: 9060405 - DNA, 23 bp, Homo sapiens
agaagcagcttctggagtatcgg

SEQ ID NO: 9060406 - DNA, 22 bp, Homo sapiens
agaagcagactctgaggcaagg

SEQ ID NO: 9060407 - DNA, 22 bp, Homo sapiens
agaagcagactctgaggcaagg

SEQ ID NO: 9060408 - DNA, 22 bp, Homo sapiens
agaagcagactctgaggcaagg

SEQ ID NO: 9060409 - DNA, 22 bp, Homo sapiens
agaagcagactctgaggcaagg

SEQ ID NO: 9060410 - DNA, 22 bp, Homo sapiens
agaagcagactctgaggcaagg

SEQ ID NO: 9060411 - DNA, 22 bp, Homo sapiens
agaagcagactctgaggcaagg

SEQ ID NO: 9060412 - DNA, 22 bp, Homo sapiens
agacaatggagagcagagtact

SEQ ID NO: 9060413 - DNA, 22 bp, Homo sapiens
agacaatggagagcagagtact

SEQ ID NO: 9060414 - DNA, 22 bp, Homo sapiens
agacaatggagagcagagtact

SEQ ID NO: 9060415 - DNA, 22 bp, Homo sapiens
agacaatggagggaaatacttc

SEQ ID NO: 9060416 - DNA, 22 bp, Homo sapiens
agacaatggctaagtaacctgt

SEQ ID NO: 9060417 - DNA, 22 bp, Homo sapiens
agacaatggagggaaatacttc

SEQ ID NO: 9060418 - DNA, 22 bp, Homo sapiens
agacaatgtttggtctacactt

SEQ ID NO: 9060419 - DNA, 19 bp, Homo sapiens
agacaatggggttggcagt

SEQ ID NO: 9060420 - DNA, 19 bp, Homo sapiens
agacaatggggttggcagt

SEQ ID NO: 9060421 - DNA, 22 bp, Homo sapiens
agacaatgtcaaggtgatcatc

SEQ ID NO: 9060422 - DNA, 20 bp, Homo sapiens
agacaatgagtgacagagtt

SEQ ID NO: 9060423 - DNA, 20 bp, Homo sapiens
agacaatgagtgacagagtt

SEQ ID NO: 9060424 - DNA, 22 bp, Homo sapiens
agacaatgcaagcagggagtgg

SEQ ID NO: 9060425 - DNA, 22 bp, Homo sapiens
agacaatatgtatattaagaat

SEQ ID NO: 9060426 - DNA, 22 bp, Homo sapiens
agagacagatctgagggacctc

SEQ ID NO: 9060427 - DNA, 22 bp, Homo sapiens
agagacagatctgagggacctc

SEQ ID NO: 9060428 - DNA, 22 bp, Homo sapiens
agagacagatctgagggacctc

SEQ ID NO: 9060429 - DNA, 22 bp, Homo sapiens
agagacagaggcaatatagctt

SEQ ID NO: 9060430 - DNA, 18 bp, Homo sapiens
agagacagcagcaaaaga

SEQ ID NO: 9060431 - DNA, 18 bp, Homo sapiens
agagacagcagcaaaaga

SEQ ID NO: 9060432 - DNA, 18 bp, Homo sapiens
agagacagcagcaaaaga

SEQ ID NO: 9060433 - DNA, 22 bp, Homo sapiens
agagacaggagttctgtttcca

SEQ ID NO: 9060434 - DNA, 22 bp, Homo sapiens
agagacaggatatctgctcatg

SEQ ID NO: 9060435 - DNA, 22 bp, Homo sapiens
agagacaggaatggcattaaga

SEQ ID NO: 9060436 - DNA, 22 bp, Homo sapiens
agagacaggaatggcattaaga

SEQ ID NO: 9060437 - DNA, 22 bp, Homo sapiens
agagacaggagttctgtttcca

SEQ ID NO: 9060438 - DNA, 22 bp, Homo sapiens
aattaaattggtttagagagga

SEQ ID NO: 9060439 - DNA, 22 bp, Homo sapiens
aattaaattggtttagagagga

SEQ ID NO: 9060440 - DNA, 23 bp, Homo sapiens
aattaaattgctagatccagggc

SEQ ID NO: 9060441 - DNA, 23 bp, Homo sapiens
aattaaattgctagatccagggc

SEQ ID NO: 9060442 - DNA, 22 bp, Homo sapiens
aattaaatgacaggggaagatg

SEQ ID NO: 9060443 - DNA, 22 bp, Homo sapiens
aattaaatgacaggggaagatg

SEQ ID NO: 9060444 - DNA, 22 bp, Homo sapiens
aattaaaggtcatgttaaaggg

SEQ ID NO: 9060445 - DNA, 22 bp, Homo sapiens
agaccccatacctcagcaggta

SEQ ID NO: 9060446 - DNA, 22 bp, Homo sapiens
aatgtgtaaatgaggagtcttg

SEQ ID NO: 9060447 - DNA, 18 bp, Homo sapiens
agaccctctaagggcagt

SEQ ID NO: 9060448 - DNA, 21 bp, Homo sapiens
aatgtggtacattacatgcat

SEQ ID NO: 9060449 - DNA, 22 bp, Homo sapiens
agaccctgcattttccagggtt

SEQ ID NO: 9060450 - DNA, 22 bp, Homo sapiens
agaccctggggaaagtcacttc

SEQ ID NO: 9060451 - DNA, 22 bp, Homo sapiens
agaccctgcacctctcgtgggc

SEQ ID NO: 9060452 - DNA, 22 bp, Homo sapiens
agaccctctgccagatgcttta

SEQ ID NO: 9060453 - DNA, 22 bp, Homo sapiens
aattaaaaaaggagagcttgct

SEQ ID NO: 9060454 - DNA, 20 bp, Homo sapiens
agaccctgtgtcctgtggcc

SEQ ID NO: 9060455 - DNA, 22 bp, Homo sapiens
agaccctgtcagtgttaggaaa

SEQ ID NO: 9060456 - DNA, 22 bp, Homo sapiens
agaccctggtaaacactccagg

SEQ ID NO: 9060457 - DNA, 22 bp, Homo sapiens
agagccaggctcccatggggca

SEQ ID NO: 9060458 - DNA, 22 bp, Homo sapiens
agagccaggctctacctgggtt

SEQ ID NO: 9060459 - DNA, 22 bp, Homo sapiens
agagccaggtgtagtctcggag

SEQ ID NO: 9060460 - DNA, 22 bp, Homo sapiens
agagccaggtgctgctgtttga

SEQ ID NO: 9060461 - DNA, 22 bp, Homo sapiens
agagccaggcggctgggcacct

SEQ ID NO: 9060462 - DNA, 22 bp, Homo sapiens
agagccaggcggctgggcacct

SEQ ID NO: 9060463 - DNA, 22 bp, Homo sapiens
agagcagtcaggctaggacact

SEQ ID NO: 9060464 - DNA, 22 bp, Homo sapiens
agagacaggatatctgctcatg

SEQ ID NO: 9060465 - DNA, 22 bp, Homo sapiens
agagacaggatatctgctcatg

SEQ ID NO: 9060466 - DNA, 22 bp, Homo sapiens
agagacagggttttgccatgtt

SEQ ID NO: 9060467 - DNA, 22 bp, Homo sapiens
agagcaggtggcaactctggga

SEQ ID NO: 9060468 - DNA, 20 bp, Homo sapiens
agagcctggaaaaagacatc

SEQ ID NO: 9060469 - DNA, 22 bp, Homo sapiens
agagcctgctgtgtaagtcaca

SEQ ID NO: 9060470 - DNA, 22 bp, Homo sapiens
agagcctgcatcaggcttgggg

SEQ ID NO: 9060471 - DNA, 22 bp, Homo sapiens
agagcctggacctgagctacaa

SEQ ID NO: 9060472 - DNA, 22 bp, Homo sapiens
agagcctggacctgagctacaa

SEQ ID NO: 9060473 - DNA, 22 bp, Homo sapiens
agagccagttacaactgtggag

SEQ ID NO: 9060474 - DNA, 22 bp, Homo sapiens
agagcctggcaaaaggtcctgc

SEQ ID NO: 9060475 - DNA, 22 bp, Homo sapiens
agagcctggaggttctgctgaa

SEQ ID NO: 9060476 - DNA, 22 bp, Homo sapiens
aattctgatgaataaatcatcc

SEQ ID NO: 9060477 - DNA, 22 bp, Homo sapiens
aattctgatgatactgcattgt

SEQ ID NO: 9060478 - DNA, 22 bp, Homo sapiens
aatcagagaagtttcctatgcc

SEQ ID NO: 9060479 - DNA, 22 bp, Homo sapiens
aatcagagcaagacatggaaca

SEQ ID NO: 9060480 - DNA, 22 bp, Homo sapiens
aatcagagcaagacatggaaca

SEQ ID NO: 9060481 - DNA, 17 bp, Homo sapiens
aatcagatttctgagga

SEQ ID NO: 9060482 - DNA, 22 bp, Homo sapiens
aatcagagtcccaagatctgta

SEQ ID NO: 9060483 - DNA, 22 bp, Homo sapiens
aatcagaggaagtcaacggatc

SEQ ID NO: 9060484 - DNA, 22 bp, Homo sapiens
aatcagagccctctgagcttca

SEQ ID NO: 9060485 - DNA, 21 bp, Homo sapiens
aatcagaggcttcctagttgg

SEQ ID NO: 9060486 - DNA, 22 bp, Homo sapiens
aatcagaatcagttgacacagc

SEQ ID NO: 9060487 - DNA, 22 bp, Homo sapiens
aatcaggacccactctacagtt

SEQ ID NO: 9060488 - DNA, 22 bp, Homo sapiens
aatcataattcaaataagctta

SEQ ID NO: 9060489 - DNA, 22 bp, Homo sapiens
aatcataattcaaataagctta

SEQ ID NO: 9060490 - DNA, 22 bp, Homo sapiens
aatcataattcaaataagctta

SEQ ID NO: 9060491 - DNA, 22 bp, Homo sapiens
aatcaggcacagcgactgcagc

SEQ ID NO: 9060492 - DNA, 22 bp, Homo sapiens
agaaatctttgaagtgtaatgt

SEQ ID NO: 9060493 - DNA, 22 bp, Homo sapiens
agaaatagaggaaaggtttgac

SEQ ID NO: 9060494 - DNA, 22 bp, Homo sapiens
agaaatgaaaccaaagcctaga

SEQ ID NO: 9060495 - DNA, 22 bp, Homo sapiens
agaaatgacaagactgatcagg

SEQ ID NO: 9060496 - DNA, 22 bp, Homo sapiens
agaaatgacaagactgatcagg

SEQ ID NO: 9060497 - DNA, 22 bp, Homo sapiens
agaaatgaagcaggagttatta

SEQ ID NO: 9060498 - DNA, 22 bp, Homo sapiens
agaaatgaatatgtagtggtta

SEQ ID NO: 9060499 - DNA, 22 bp, Homo sapiens
aatgattctatttgcagcttgg

SEQ ID NO: 9060500 - DNA, 22 bp, Homo sapiens
aatgattgtcattccaaaaagt

SEQ ID NO: 9060501 - DNA, 23 bp, Homo sapiens
aatgatttcatgatgatagcagc

SEQ ID NO: 9060502 - DNA, 22 bp, Homo sapiens
aatgatggttaaacactggagg

SEQ ID NO: 9060503 - DNA, 22 bp, Homo sapiens
aatgatgccctggagttttgca

SEQ ID NO: 9060504 - DNA, 22 bp, Homo sapiens
aatgatggtcatggcaactttt

SEQ ID NO: 9060505 - DNA, 22 bp, Homo sapiens
aatgatttggcaaaggaatcca

SEQ ID NO: 9060506 - DNA, 22 bp, Homo sapiens
aatgatttcccctacacagaag

SEQ ID NO: 9060507 - DNA, 22 bp, Homo sapiens
agaagcagaaggaagcagggcc

SEQ ID NO: 9060508 - DNA, 22 bp, Homo sapiens
agaagcagaaaagggcactttt

SEQ ID NO: 9060509 - DNA, 22 bp, Homo sapiens
agaagcagaaggaagcagggcc

SEQ ID NO: 9060510 - DNA, 22 bp, Homo sapiens
agaagcagaaggaagcagggcc

SEQ ID NO: 9060511 - DNA, 22 bp, Homo sapiens
agaagcagaaggaagcagggcc

SEQ ID NO: 9060512 - DNA, 22 bp, Homo sapiens
agaagcagaaggaagcagggcc

SEQ ID NO: 9060513 - DNA, 22 bp, Homo sapiens
agaaattatgcagtagttttat

SEQ ID NO: 9060514 - DNA, 22 bp, Homo sapiens
agaaattatgcagtagttttat

SEQ ID NO: 9060515 - DNA, 22 bp, Homo sapiens
agaaatgacacacatgagacat

SEQ ID NO: 9060516 - DNA, 22 bp, Homo sapiens
agaaatgacacacatgagacat

SEQ ID NO: 9060517 - DNA, 22 bp, Homo sapiens
agaaattattagtgaatagtct

SEQ ID NO: 9060518 - DNA, 22 bp, Homo sapiens
agaaattattagtgaatagtct

SEQ ID NO: 9060519 - DNA, 22 bp, Homo sapiens
agaaattcctaaggtacacaag

SEQ ID NO: 9060520 - DNA, 22 bp, Homo sapiens
agaaattcaattctaattagct

SEQ ID NO: 9060521 - DNA, 22 bp, Homo sapiens
agaacaaatcgatggaagcctg

SEQ ID NO: 9060522 - DNA, 20 bp, Homo sapiens
agaacaagtactaaaggaga

SEQ ID NO: 9060523 - DNA, 22 bp, Homo sapiens
agaacaatgcgtattttactcc

SEQ ID NO: 9060524 - DNA, 22 bp, Homo sapiens
agaacaatgttaaattattaag

SEQ ID NO: 9060525 - DNA, 22 bp, Homo sapiens
aatgatgagaactggagtaatt

SEQ ID NO: 9060526 - DNA, 22 bp, Homo sapiens
actttcttatccatgatctcac

SEQ ID NO: 9060527 - DNA, 22 bp, Homo sapiens
actttcttcttatgcattaagg

SEQ ID NO: 9060528 - DNA, 22 bp, Homo sapiens
actttcttcttatgcattaagg

SEQ ID NO: 9060529 - DNA, 22 bp, Homo sapiens
actttcttaggctgtataaatg

SEQ ID NO: 9060530 - DNA, 22 bp, Homo sapiens
aatcagaaagaggtcatgttgc

SEQ ID NO: 9060531 - DNA, 22 bp, Homo sapiens
aatcagaaagatcttgatgaga

SEQ ID NO: 9060532 - DNA, 22 bp, Homo sapiens
actttgaaactaaaattcatta

SEQ ID NO: 9060533 - DNA, 22 bp, Homo sapiens
actttgaaactaaaattcatta

SEQ ID NO: 9060534 - DNA, 22 bp, Homo sapiens
aatcacatctcattcaacagcc

SEQ ID NO: 9060535 - DNA, 22 bp, Homo sapiens
actttgaaatgtgtaagagaga

SEQ ID NO: 9060536 - DNA, 22 bp, Homo sapiens
actttgaaatgtgtaagagaga

SEQ ID NO: 9060537 - DNA, 23 bp, Homo sapiens
actttattgaccccaggtcagtt

SEQ ID NO: 9060538 - DNA, 22 bp, Homo sapiens
actgttcttgtaacacttaaat

SEQ ID NO: 9060539 - DNA, 22 bp, Homo sapiens
actgttgaagtgccagcttgat

SEQ ID NO: 9060540 - DNA, 22 bp, Homo sapiens
actgttgaagtgccagcttgat

SEQ ID NO: 9060541 - DNA, 22 bp, Homo sapiens
actgggcttatgctgtggagta

SEQ ID NO: 9060542 - DNA, 22 bp, Homo sapiens
actgggcttatttcttgtgaac

SEQ ID NO: 9060543 - DNA, 23 bp, Homo sapiens
actgggcttatgaggaggcttgt

SEQ ID NO: 9060544 - DNA, 23 bp, Homo sapiens
actgggcttatgaggaggcttgt

SEQ ID NO: 9060545 - DNA, 22 bp, Homo sapiens
actgggctgttttttgagtgga

SEQ ID NO: 9060546 - DNA, 23 bp, Homo sapiens
actgggcttatgaggaggcttgt

SEQ ID NO: 9060547 - DNA, 22 bp, Homo sapiens
actgggctgttccttatttcta

SEQ ID NO: 9060548 - DNA, 22 bp, Homo sapiens
actgggctgtggacacccagcg

SEQ ID NO: 9060549 - DNA, 22 bp, Homo sapiens
actgggctgtaaagagaggcaa

SEQ ID NO: 9060550 - DNA, 22 bp, Homo sapiens
actgggctgtggacacccagcg

SEQ ID NO: 9060551 - DNA, 22 bp, Homo sapiens
actgggctggttagttttacta

SEQ ID NO: 9060552 - DNA, 22 bp, Homo sapiens
actgggctggggctcattctcc

SEQ ID NO: 9060553 - DNA, 22 bp, Homo sapiens
actgggctgcttgagtgccttc

SEQ ID NO: 9060554 - DNA, 22 bp, Homo sapiens
actgggctgcttgagtgccttc

SEQ ID NO: 9060555 - DNA, 22 bp, Homo sapiens
aatactatgtagccaaaataat

SEQ ID NO: 9060556 - DNA, 22 bp, Homo sapiens
aatactatgtagccaaaataat

SEQ ID NO: 9060557 - DNA, 22 bp, Homo sapiens
aatactgcatacagtttctcat

SEQ ID NO: 9060558 - DNA, 22 bp, Homo sapiens
actgggctgcctggttcttcta

SEQ ID NO: 9060559 - DNA, 22 bp, Homo sapiens
aatactatgttgtgacacatga

SEQ ID NO: 9060560 - DNA, 22 bp, Homo sapiens
aatatagaatcactttccttca

SEQ ID NO: 9060561 - DNA, 22 bp, Homo sapiens
aatatactatactactttctgg

SEQ ID NO: 9060562 - DNA, 22 bp, Homo sapiens
actgggcttcacttggcacatc

SEQ ID NO: 9060563 - DNA, 19 bp, Homo sapiens
actgggcttgtcctcgtgg

SEQ ID NO: 9060564 - DNA, 22 bp, Homo sapiens
aatagtatttatttggaaaaag

SEQ ID NO: 9060565 - DNA, 22 bp, Homo sapiens
aatagtacaatctacagacata

SEQ ID NO: 9060566 - DNA, 22 bp, Homo sapiens
aatataattttattcctagagt

SEQ ID NO: 9060567 - DNA, 22 bp, Homo sapiens
actgttcaagcaaatgacattg

SEQ ID NO: 9060568 - DNA, 22 bp, Homo sapiens
actgttcacccagcactagcag

SEQ ID NO: 9060569 - DNA, 22 bp, Homo sapiens
aatatagttctagaaatatttt

SEQ ID NO: 9060570 - DNA, 22 bp, Homo sapiens
aatatagttctagaaatatttt

SEQ ID NO: 9060571 - DNA, 22 bp, Homo sapiens
aatatagttctagaaatatttt

SEQ ID NO: 9060572 - DNA, 22 bp, Homo sapiens
aatatagtgttagctcatttga

SEQ ID NO: 9060573 - DNA, 22 bp, Homo sapiens
aatatagctcactataccatgg

SEQ ID NO: 9060574 - DNA, 22 bp, Homo sapiens
aagtctctgactcacacaatgt

SEQ ID NO: 9060575 - DNA, 22 bp, Homo sapiens
aagtctcagaaaactagtgtgg

SEQ ID NO: 9060576 - DNA, 22 bp, Homo sapiens
aagtctagtatccttcttgact

SEQ ID NO: 9060577 - DNA, 20 bp, Homo sapiens
acgtggccaccagtggctta

SEQ ID NO: 9060578 - DNA, 20 bp, Homo sapiens
acgtggccaccagtggctta

SEQ ID NO: 9060579 - DNA, 22 bp, Homo sapiens
acctttatcgccatcattgtgc

SEQ ID NO: 9060580 - DNA, 22 bp, Homo sapiens
acctacatggctttaagtaagt

SEQ ID NO: 9060581 - DNA, 22 bp, Homo sapiens
acctacatggctttaagtaagt

SEQ ID NO: 9060582 - DNA, 22 bp, Homo sapiens
acctacatgttccacatagttg

SEQ ID NO: 9060583 - DNA, 22 bp, Homo sapiens
acctacatgttccacatagttg

SEQ ID NO: 9060584 - DNA, 23 bp, Homo sapiens
acctacattatagggatatgggt

SEQ ID NO: 9060585 - DNA, 22 bp, Homo sapiens
acctaataaaggtaaattctgt

SEQ ID NO: 9060586 - DNA, 22 bp, Homo sapiens
acctaagaaatccagagatttc

SEQ ID NO: 9060587 - DNA, 22 bp, Homo sapiens
acctacatacggaaatatttac

SEQ ID NO: 9060588 - DNA, 22 bp, Homo sapiens
acctacatacggaaatatttac

SEQ ID NO: 9060589 - DNA, 22 bp, Homo sapiens
acctacatagttaagtaacaaa

SEQ ID NO: 9060590 - DNA, 22 bp, Homo sapiens
acctacatagttaagtaacaaa

SEQ ID NO: 9060591 - DNA, 22 bp, Homo sapiens
acctaaatctacctcatgtttt

SEQ ID NO: 9060592 - DNA, 22 bp, Homo sapiens
accgggtaggtgtcaactctga

SEQ ID NO: 9060593 - DNA, 22 bp, Homo sapiens
acggtgctgggtattggggttc

SEQ ID NO: 9060594 - DNA, 22 bp, Homo sapiens
actctcccagctatatgtggtg

SEQ ID NO: 9060595 - DNA, 22 bp, Homo sapiens
actctcccacgttcgactctaa

SEQ ID NO: 9060596 - DNA, 22 bp, Homo sapiens
actctccctgctatccacttcc

SEQ ID NO: 9060597 - DNA, 22 bp, Homo sapiens
actctccctgagagggaggcat

SEQ ID NO: 9060598 - DNA, 22 bp, Homo sapiens
actctccctgagagggaggcat

SEQ ID NO: 9060599 - DNA, 22 bp, Homo sapiens
actctaatgctaatagtatttt

SEQ ID NO: 9060600 - DNA, 22 bp, Homo sapiens
actctataaagatacctcaatt

SEQ ID NO: 9060601 - DNA, 22 bp, Homo sapiens
actccctccaaatctgcacagt

SEQ ID NO: 9060602 - DNA, 22 bp, Homo sapiens
actcagacgaaaacatgaacat

SEQ ID NO: 9060603 - DNA, 22 bp, Homo sapiens
actcagagaatatctagaagga

SEQ ID NO: 9060604 - DNA, 22 bp, Homo sapiens
actcagagaatatctagaagga

SEQ ID NO: 9060605 - DNA, 22 bp, Homo sapiens
actatacataaaacatttgggt

SEQ ID NO: 9060606 - DNA, 22 bp, Homo sapiens
actatacattgaatgttaaggt

SEQ ID NO: 9060607 - DNA, 22 bp, Homo sapiens
actcagaaccatttactctgag

SEQ ID NO: 9060608 - DNA, 22 bp, Homo sapiens
actataacccatggaatataag

SEQ ID NO: 9060609 - DNA, 23 bp, Homo sapiens
actataaagttgttctgatttac

SEQ ID NO: 9060610 - DNA, 22 bp, Homo sapiens
actataaaaggataaaccagaa

SEQ ID NO: 9060611 - DNA, 22 bp, Homo sapiens
actataaaaggataaaccagaa

SEQ ID NO: 9060612 - DNA, 22 bp, Homo sapiens
actacagaagtcttattagaga

SEQ ID NO: 9060613 - DNA, 22 bp, Homo sapiens
actggcctatcagcatgagtct

SEQ ID NO: 9060614 - DNA, 22 bp, Homo sapiens
actggccttgggtaaagcccct

SEQ ID NO: 9060615 - DNA, 22 bp, Homo sapiens
actggccaggcagcagtagctt

SEQ ID NO: 9060616 - DNA, 22 bp, Homo sapiens
actggccaggcagcagtagctt

SEQ ID NO: 9060617 - DNA, 22 bp, Homo sapiens
aatacctaggatgtgctgggtg

SEQ ID NO: 9060618 - DNA, 22 bp, Homo sapiens
aataccatgataattaattcat

SEQ ID NO: 9060619 - DNA, 22 bp, Homo sapiens
aataccatgcagaaataacata

SEQ ID NO: 9060620 - DNA, 22 bp, Homo sapiens
aatacgtcccatcatctttttc

SEQ ID NO: 9060621 - DNA, 22 bp, Homo sapiens
aatacgtctgaatgcattctca

SEQ ID NO: 9060622 - DNA, 22 bp, Homo sapiens
aatacagaggaaacatttaata

SEQ ID NO: 9060623 - DNA, 22 bp, Homo sapiens
aatacagaggaaacatttaata

SEQ ID NO: 9060624 - DNA, 22 bp, Homo sapiens
aatacatgttttctactattct

SEQ ID NO: 9060625 - DNA, 22 bp, Homo sapiens
aatacagaggcttccagtaaaa

SEQ ID NO: 9060626 - DNA, 22 bp, Homo sapiens
actgcgctccagcctgggtgac

SEQ ID NO: 9060627 - DNA, 22 bp, Homo sapiens
actggacagaggaaatatggag

SEQ ID NO: 9060628 - DNA, 22 bp, Homo sapiens
actgcactccagcctgggtgac

SEQ ID NO: 9060629 - DNA, 22 bp, Homo sapiens
actgcactccagcctgggtgac

SEQ ID NO: 9060630 - DNA, 22 bp, Homo sapiens
actgcactccagcctgggtgac

SEQ ID NO: 9060631 - DNA, 23 bp, Homo sapiens
actggacagagtggacgaggctg

SEQ ID NO: 9060632 - DNA, 22 bp, Homo sapiens
actggacagaggaaatatggag

SEQ ID NO: 9060633 - DNA, 22 bp, Homo sapiens
actggaggattcctggaaggcg

SEQ ID NO: 9060634 - DNA, 22 bp, Homo sapiens
actgagagaagggattttaagt

SEQ ID NO: 9060635 - DNA, 22 bp, Homo sapiens
actctggctgccttgtgagcat

SEQ ID NO: 9060636 - DNA, 22 bp, Homo sapiens
actctggctattcactataata

SEQ ID NO: 9060637 - DNA, 22 bp, Homo sapiens
actctggcgggcgggcgagcca

SEQ ID NO: 9060638 - DNA, 22 bp, Homo sapiens
actctggccccaggatctgtgt

SEQ ID NO: 9060639 - DNA, 22 bp, Homo sapiens
actctggccctcctgctgccag

SEQ ID NO: 9060640 - DNA, 22 bp, Homo sapiens
actctggccaggtgcggtatgt

SEQ ID NO: 9060641 - DNA, 22 bp, Homo sapiens
actctggccatcttggaccttg

SEQ ID NO: 9060642 - DNA, 22 bp, Homo sapiens
actctcccttatctaactttac

SEQ ID NO: 9060643 - DNA, 21 bp, Homo sapiens
actctgctgcgggcttggcct

SEQ ID NO: 9060644 - DNA, 22 bp, Homo sapiens
actctgcttattgctgcaggca

SEQ ID NO: 9060645 - DNA, 22 bp, Homo sapiens
actctggcactgggtacctcag

SEQ ID NO: 9060646 - DNA, 22 bp, Homo sapiens
actctggcagcagaaccagtgt

SEQ ID NO: 9060647 - DNA, 22 bp, Homo sapiens
actctggcaagcttccacttcc

SEQ ID NO: 9060648 - DNA, 22 bp, Homo sapiens
actgcactccagcctgggtaac

SEQ ID NO: 9060649 - DNA, 22 bp, Homo sapiens
actgcactccagcctgggtaac

SEQ ID NO: 9060650 - DNA, 22 bp, Homo sapiens
actgcactccaacctgggtgac

SEQ ID NO: 9060651 - DNA, 22 bp, Homo sapiens
actgcactccaacctgggtgac

SEQ ID NO: 9060652 - DNA, 22 bp, Homo sapiens
actgcactccaacctgggtgac

SEQ ID NO: 9060653 - DNA, 22 bp, Homo sapiens
actgcactccaacctgggtgac

SEQ ID NO: 9060654 - DNA, 22 bp, Homo sapiens
actgagttatgggtatgccttg

SEQ ID NO: 9060655 - DNA, 22 bp, Homo sapiens
actgcactccaacctgggtgac

SEQ ID NO: 9060656 - DNA, 22 bp, Homo sapiens
actgagtgtaggactttgagtt

SEQ ID NO: 9060657 - DNA, 22 bp, Homo sapiens
actgaggttgaaatagtgatgt

SEQ ID NO: 9060658 - DNA, 22 bp, Homo sapiens
acatttctcttgatgtctctat

SEQ ID NO: 9060659 - DNA, 22 bp, Homo sapiens
acatttctcttgatgtctctat

SEQ ID NO: 9060660 - DNA, 22 bp, Homo sapiens
acatttcatttgcagtatggat

SEQ ID NO: 9060661 - DNA, 22 bp, Homo sapiens
aaggctgggaaacatgcaggcc

SEQ ID NO: 9060662 - DNA, 22 bp, Homo sapiens
aaggctggcaatatatttgtta

SEQ ID NO: 9060663 - DNA, 22 bp, Homo sapiens
acatttctgctagaataggtga

SEQ ID NO: 9060664 - DNA, 22 bp, Homo sapiens
acatttctggagtttctcaaca

SEQ ID NO: 9060665 - DNA, 22 bp, Homo sapiens
acatttgtgcaacgtatccaca

SEQ ID NO: 9060666 - DNA, 19 bp, Homo sapiens
aaggctggagaaggcctct

SEQ ID NO: 9060667 - DNA, 19 bp, Homo sapiens
aaggctggagaaggcctct

SEQ ID NO: 9060668 - DNA, 21 bp, Homo sapiens
aaggctggagatgcaggtctg

SEQ ID NO: 9060669 - DNA, 22 bp, Homo sapiens
aaggctggagatggttggaatg

SEQ ID NO: 9060670 - DNA, 21 bp, Homo sapiens
aaggctggagatgcaggtctg

SEQ ID NO: 9060671 - DNA, 22 bp, Homo sapiens
aaggctggacctggatgaatct

SEQ ID NO: 9060672 - DNA, 19 bp, Homo sapiens
acatttaaattcagatctc

SEQ ID NO: 9060673 - DNA, 22 bp, Homo sapiens
aaggctcactgtagagtaattg

SEQ ID NO: 9060674 - DNA, 22 bp, Homo sapiens
aaggctcagctactcagcctgc

SEQ ID NO: 9060675 - DNA, 22 bp, Homo sapiens
aaggctcagtaataagttggaa

SEQ ID NO: 9060676 - DNA, 22 bp, Homo sapiens
aaggctatctggcctccttgcc

SEQ ID NO: 9060677 - DNA, 22 bp, Homo sapiens
aaggctaagtaaggctctttct

SEQ ID NO: 9060678 - DNA, 22 bp, Homo sapiens
aaggctaagtaaggctctttct

SEQ ID NO: 9060679 - DNA, 22 bp, Homo sapiens
aaggccttttcagttcctcctt

SEQ ID NO: 9060680 - DNA, 22 bp, Homo sapiens
aaggccttttcagttcctcctt

SEQ ID NO: 9060681 - DNA, 22 bp, Homo sapiens
aaggcctttgccccgatacagg

SEQ ID NO: 9060682 - DNA, 22 bp, Homo sapiens
aaggcctttcctgctttgaatg

SEQ ID NO: 9060683 - DNA, 22 bp, Homo sapiens
aaggcctttgggggcctggtcc

SEQ ID NO: 9060684 - DNA, 22 bp, Homo sapiens
aaggcctttcttatcagtagat

SEQ ID NO: 9060685 - DNA, 22 bp, Homo sapiens
aaggcctttgccccgatacagg

SEQ ID NO: 9060686 - DNA, 22 bp, Homo sapiens
aaggctcggcaatgtgcggctc

SEQ ID NO: 9060687 - DNA, 22 bp, Homo sapiens
aaggctctgcaaaacctccaag

SEQ ID NO: 9060688 - DNA, 22 bp, Homo sapiens
aaggctctgcaaaacctccaag

SEQ ID NO: 9060689 - DNA, 22 bp, Homo sapiens
aaggctctgcaaaacctccaag

SEQ ID NO: 9060690 - DNA, 22 bp, Homo sapiens
aaggcagataagaattcagcaa

SEQ ID NO: 9060691 - DNA, 20 bp, Homo sapiens
aaggcagagtgggttggagc

SEQ ID NO: 9060692 - DNA, 20 bp, Homo sapiens
aaggcagagtgggttggagc

SEQ ID NO: 9060693 - DNA, 20 bp, Homo sapiens
aaggcagagtgggttggagc

SEQ ID NO: 9060694 - DNA, 22 bp, Homo sapiens
aaggcctcttctctctggagat

SEQ ID NO: 9060695 - DNA, 22 bp, Homo sapiens
aaggcctccctgtgtgcaggtg

SEQ ID NO: 9060696 - DNA, 22 bp, Homo sapiens
aaggcctccctctttcatggga

SEQ ID NO: 9060697 - DNA, 22 bp, Homo sapiens
aaggcccttcggcttcctcagc

SEQ ID NO: 9060698 - DNA, 18 bp, Homo sapiens
aaggcctagtccctctct

SEQ ID NO: 9060699 - DNA, 22 bp, Homo sapiens
aaggcctcaggtgaggctgccc

SEQ ID NO: 9060700 - DNA, 22 bp, Homo sapiens
aaggccttgcctgacagcacca

SEQ ID NO: 9060701 - DNA, 22 bp, Homo sapiens
aaggccttgccgaaggatgcca

SEQ ID NO: 9060702 - DNA, 22 bp, Homo sapiens
aaggccttctcttgtgtctgtg

SEQ ID NO: 9060703 - DNA, 22 bp, Homo sapiens
aaggccttctaccaaggctggg

SEQ ID NO: 9060704 - DNA, 22 bp, Homo sapiens
aaggccttctcttgtgtctgtg

SEQ ID NO: 9060705 - DNA, 22 bp, Homo sapiens
aaggccttgccgaaggatgcca

SEQ ID NO: 9060706 - DNA, 22 bp, Homo sapiens
aaggcctttctagctttgtgct

SEQ ID NO: 9060707 - DNA, 22 bp, Homo sapiens
aaggcctttcctgctttgaatg

SEQ ID NO: 9060708 - DNA, 22 bp, Homo sapiens
aaggccttggttctgagcaata

SEQ ID NO: 9060709 - DNA, 22 bp, Homo sapiens
aaggcctttaggctttcattgt

SEQ ID NO: 9060710 - DNA, 22 bp, Homo sapiens
aaggcctttcaggattttgctc

SEQ ID NO: 9060711 - DNA, 22 bp, Homo sapiens
aaggccttggttctgagcaata

SEQ ID NO: 9060712 - DNA, 22 bp, Homo sapiens
aaggccttggttctgagcaata

SEQ ID NO: 9060713 - DNA, 22 bp, Homo sapiens
aaggccttggctctctgtgtgc

SEQ ID NO: 9060714 - DNA, 22 bp, Homo sapiens
aaggcctgggagtactgggaca

SEQ ID NO: 9060715 - DNA, 22 bp, Homo sapiens
aaggccttaaagctctctccag

SEQ ID NO: 9060716 - DNA, 22 bp, Homo sapiens
aaggccttaaagctctctccag

SEQ ID NO: 9060717 - DNA, 22 bp, Homo sapiens
aaggccttccctttgagccgca

SEQ ID NO: 9060718 - DNA, 22 bp, Homo sapiens
aaggccttctaccaaggctggg

SEQ ID NO: 9060719 - DNA, 22 bp, Homo sapiens
aaggccttccctttgagccgca

SEQ ID NO: 9060720 - DNA, 22 bp, Homo sapiens
aaggcctgggaggcctctcttc

SEQ ID NO: 9060721 - DNA, 22 bp, Homo sapiens
aaggcctgggaggcctctcttc

SEQ ID NO: 9060722 - DNA, 22 bp, Homo sapiens
aaggcctgctcagctgtctgtg

SEQ ID NO: 9060723 - DNA, 22 bp, Homo sapiens
aaggcctgctcagctgtctgtg

SEQ ID NO: 9060724 - DNA, 18 bp, Homo sapiens
aaggcctagtccctctct

SEQ ID NO: 9060725 - DNA, 22 bp, Homo sapiens
aaggcctgaacatgaggagatg

SEQ ID NO: 9060726 - DNA, 22 bp, Homo sapiens
accctcttgagggaagcacttt

SEQ ID NO: 9060727 - DNA, 22 bp, Homo sapiens
accctgagaaagtcacatgcat

SEQ ID NO: 9060728 - DNA, 22 bp, Homo sapiens
accctgagaaagtcacatgcat

SEQ ID NO: 9060729 - DNA, 20 bp, Homo sapiens
accctgaggctccccagcct

SEQ ID NO: 9060730 - DNA, 22 bp, Homo sapiens
accctgagccgccaggaaggcc

SEQ ID NO: 9060731 - DNA, 22 bp, Homo sapiens
accctgccgtgggctgcttgtg

SEQ ID NO: 9060732 - DNA, 22 bp, Homo sapiens
accctgccctctccagctcagg

SEQ ID NO: 9060733 - DNA, 22 bp, Homo sapiens
accctgaggggtatagcagaag

SEQ ID NO: 9060734 - DNA, 22 bp, Homo sapiens
accctgagtcagacagcctgac

SEQ ID NO: 9060735 - DNA, 22 bp, Homo sapiens
accctgatataggtccaagagc

SEQ ID NO: 9060736 - DNA, 22 bp, Homo sapiens
acccagagtgtctgtctcagtc

SEQ ID NO: 9060737 - DNA, 22 bp, Homo sapiens
acccagagtcatgtttattccc

SEQ ID NO: 9060738 - DNA, 22 bp, Homo sapiens
acccagagtcatggcacttagc

SEQ ID NO: 9060739 - DNA, 22 bp, Homo sapiens
acccagagtcagacagccatgg

SEQ ID NO: 9060740 - DNA, 22 bp, Homo sapiens
acccagagtcagacagccatgg

SEQ ID NO: 9060741 - DNA, 22 bp, Homo sapiens
acccagagtaacagatggattc

SEQ ID NO: 9060742 - DNA, 22 bp, Homo sapiens
acccagagtcagacagccatgg

SEQ ID NO: 9060743 - DNA, 22 bp, Homo sapiens
acccagaggtgtctagcaagct

SEQ ID NO: 9060744 - DNA, 22 bp, Homo sapiens
acccagaggcggaggttgcagt

SEQ ID NO: 9060745 - DNA, 22 bp, Homo sapiens
acccagaggtgtctagcaagct

SEQ ID NO: 9060746 - DNA, 22 bp, Homo sapiens
acccagagctgggcttggcaaa

SEQ ID NO: 9060747 - DNA, 22 bp, Homo sapiens
acccagaggcggaggttgcagt

SEQ ID NO: 9060748 - DNA, 22 bp, Homo sapiens
acccaggaggtggaggctgcag

SEQ ID NO: 9060749 - DNA, 22 bp, Homo sapiens
aagggcttttaagatttatcct

SEQ ID NO: 9060750 - DNA, 22 bp, Homo sapiens
acccagagcccttagcacagac

SEQ ID NO: 9060751 - DNA, 22 bp, Homo sapiens
accatgttggccaagctggtct

SEQ ID NO: 9060752 - DNA, 22 bp, Homo sapiens
accatgttggccaagctggtct

SEQ ID NO: 9060753 - DNA, 22 bp, Homo sapiens
accatgttggccaagctggtct

SEQ ID NO: 9060754 - DNA, 22 bp, Homo sapiens
acccagagctgggcttggcaaa

SEQ ID NO: 9060755 - DNA, 19 bp, Homo sapiens
acccagagccctttgcagg

SEQ ID NO: 9060756 - DNA, 19 bp, Homo sapiens
acccagagccctttgcagg

SEQ ID NO: 9060757 - DNA, 22 bp, Homo sapiens
acccagagcccttagcacagac

SEQ ID NO: 9060758 - DNA, 21 bp, Homo sapiens
accaggcttgtgggagggagc

SEQ ID NO: 9060759 - DNA, 22 bp, Homo sapiens
acattttacaccaagacttctt

SEQ ID NO: 9060760 - DNA, 22 bp, Homo sapiens
acattttacagttgtctggcta

SEQ ID NO: 9060761 - DNA, 22 bp, Homo sapiens
acattttaatatgcttagtgtg

SEQ ID NO: 9060762 - DNA, 22 bp, Homo sapiens
acattttacaccaagacttctt

SEQ ID NO: 9060763 - DNA, 19 bp, Homo sapiens
accaggcttatggtcagtg

SEQ ID NO: 9060764 - DNA, 19 bp, Homo sapiens
accaggcttatggtcagtg

SEQ ID NO: 9060765 - DNA, 19 bp, Homo sapiens
aagctaagacctgaaggtt

SEQ ID NO: 9060766 - DNA, 22 bp, Homo sapiens
aagctaatagccagttttcttc

SEQ ID NO: 9060767 - DNA, 22 bp, Homo sapiens
aagctaagtggaagtcttatca

SEQ ID NO: 9060768 - DNA, 22 bp, Homo sapiens
aagctaagattacagatttggg

SEQ ID NO: 9060769 - DNA, 22 bp, Homo sapiens
aagctaagggtgtttaagcagg

SEQ ID NO: 9060770 - DNA, 22 bp, Homo sapiens
aagctaagggtgtttaagcagg

SEQ ID NO: 9060771 - DNA, 22 bp, Homo sapiens
aagctaagtataggtgaatcct

SEQ ID NO: 9060772 - DNA, 22 bp, Homo sapiens
aagctaagtggaagtcttatca

SEQ ID NO: 9060773 - DNA, 21 bp, Homo sapiens
aagctacagaaaataatttga

SEQ ID NO: 9060774 - DNA, 22 bp, Homo sapiens
aagctatagagtgtaagatgat

SEQ ID NO: 9060775 - DNA, 22 bp, Homo sapiens
aagccctggggttgcacaaggc

SEQ ID NO: 9060776 - DNA, 22 bp, Homo sapiens
aagccttccctttttgagctca

SEQ ID NO: 9060777 - DNA, 22 bp, Homo sapiens
aagccctgggatgttcagcagt

SEQ ID NO: 9060778 - DNA, 22 bp, Homo sapiens
aagccctggggttgcacaaggc

SEQ ID NO: 9060779 - DNA, 22 bp, Homo sapiens
aagccttgctcttgaaaaagtt

SEQ ID NO: 9060780 - DNA, 22 bp, Homo sapiens
aagccaagagttaactatttgt

SEQ ID NO: 9060781 - DNA, 22 bp, Homo sapiens
aagccaaggagaatggcctcag

SEQ ID NO: 9060782 - DNA, 22 bp, Homo sapiens
aagccctggctcagctcaccag

SEQ ID NO: 9060783 - DNA, 22 bp, Homo sapiens
aagccctgggatgttcagcagt

SEQ ID NO: 9060784 - DNA, 22 bp, Homo sapiens
aagccctgggatgttcagcagt

SEQ ID NO: 9060785 - DNA, 22 bp, Homo sapiens
acagcctgtttgatctggtgct

SEQ ID NO: 9060786 - DNA, 22 bp, Homo sapiens
acagcctgtttgatctggtgct

SEQ ID NO: 9060787 - DNA, 22 bp, Homo sapiens
acagcctgtgtaccagctggga

SEQ ID NO: 9060788 - DNA, 22 bp, Homo sapiens
acagcctgtgtaccagctggga

SEQ ID NO: 9060789 - DNA, 19 bp, Homo sapiens
acagcctgttggtggggct

SEQ ID NO: 9060790 - DNA, 21 bp, Homo sapiens
acagcctgtcatctcatggtc

SEQ ID NO: 9060791 - DNA, 22 bp, Homo sapiens
acagcctgtgtaccagctggga

SEQ ID NO: 9060792 - DNA, 21 bp, Homo sapiens
acagcctgtcatctcatggtc

SEQ ID NO: 9060793 - DNA, 22 bp, Homo sapiens
acagccttattgcgagcaaggc

SEQ ID NO: 9060794 - DNA, 22 bp, Homo sapiens
aagcattttagtaatgaacttg

SEQ ID NO: 9060795 - DNA, 22 bp, Homo sapiens
aagcattttgttttaagaatga

SEQ ID NO: 9060796 - DNA, 22 bp, Homo sapiens
aagctcagaggtagataatgtt

SEQ ID NO: 9060797 - DNA, 22 bp, Homo sapiens
aagctattgaatttatagcata

SEQ ID NO: 9060798 - DNA, 22 bp, Homo sapiens
aagctcagcagccaggccctgt

SEQ ID NO: 9060799 - DNA, 22 bp, Homo sapiens
aagctcagagtagctcagcgtc

SEQ ID NO: 9060800 - DNA, 22 bp, Homo sapiens
aagctcagagtctcggagggaa

SEQ ID NO: 9060801 - DNA, 22 bp, Homo sapiens
aagctcaggaaagagtctggtt

SEQ ID NO: 9060802 - DNA, 22 bp, Homo sapiens
aagctccccgaaacccacctct

SEQ ID NO: 9060803 - DNA, 22 bp, Homo sapiens
aagctcattaattagaagctaa

SEQ ID NO: 9060804 - DNA, 22 bp, Homo sapiens
aagctcaggctggacctggctt

SEQ ID NO: 9060805 - DNA, 22 bp, Homo sapiens
aagctctgaggtgagcaatcgg

SEQ ID NO: 9060806 - DNA, 17 bp, Homo sapiens
acagggcagaaacagct

SEQ ID NO: 9060807 - DNA, 22 bp, Homo sapiens
aagctctgctcagcagactagg

SEQ ID NO: 9060808 - DNA, 20 bp, Homo sapiens
aagctctgcttcatgtggtc

SEQ ID NO: 9060809 - DNA, 22 bp, Homo sapiens
aagctctggggtacacatctgc

SEQ ID NO: 9060810 - DNA, 22 bp, Homo sapiens
aagctgccttccatgtgaggaa

SEQ ID NO: 9060811 - DNA, 23 bp, Homo sapiens
aagctgccttcgcagttggtctg

SEQ ID NO: 9060812 - DNA, 22 bp, Homo sapiens
aagctggaacatcttgaggaag

SEQ ID NO: 9060813 - DNA, 22 bp, Homo sapiens
aagctgccttgctgaggagaaa

SEQ ID NO: 9060814 - DNA, 22 bp, Homo sapiens
aagctgctggtgactgggctga

SEQ ID NO: 9060815 - DNA, 22 bp, Homo sapiens
aagctgcctgggaggaagggct

SEQ ID NO: 9060816 - DNA, 22 bp, Homo sapiens
aagctgcctgccacgctagata

SEQ ID NO: 9060817 - DNA, 22 bp, Homo sapiens
aagctgcctagagttgaatgtc

SEQ ID NO: 9060818 - DNA, 18 bp, Homo sapiens
aagctgccctcaggcagg

SEQ ID NO: 9060819 - DNA, 22 bp, Homo sapiens
aagctgccctcattcccagtgc

SEQ ID NO: 9060820 - DNA, 22 bp, Homo sapiens
aagctgccctgtgttagagttc

SEQ ID NO: 9060821 - DNA, 22 bp, Homo sapiens
acagggcagcaactttgtgcct

SEQ ID NO: 9060822 - DNA, 22 bp, Homo sapiens
acagggcagagggcagttggta

SEQ ID NO: 9060823 - DNA, 22 bp, Homo sapiens
acagggcagagaggcaggcttg

SEQ ID NO: 9060824 - DNA, 22 bp, Homo sapiens
acagggcagagaggcaggcttg

SEQ ID NO: 9060825 - DNA, 22 bp, Homo sapiens
acagggcagaaatgttgcatct

SEQ ID NO: 9060826 - DNA, 22 bp, Homo sapiens
aaggaggaatgtagccagctcc

SEQ ID NO: 9060827 - DNA, 22 bp, Homo sapiens
aaggaggaattctgagttcatg

SEQ ID NO: 9060828 - DNA, 22 bp, Homo sapiens
aaggaggaatttcagggtgaat

SEQ ID NO: 9060829 - DNA, 22 bp, Homo sapiens
aaggaggcaccctgagcctgcc

SEQ ID NO: 9060830 - DNA, 22 bp, Homo sapiens
aaggaggcaccctgagcctgcc

SEQ ID NO: 9060831 - DNA, 22 bp, Homo sapiens
aaggaggagtggggtcctggaa

SEQ ID NO: 9060832 - DNA, 22 bp, Homo sapiens
acatagaacctggcacatagta

SEQ ID NO: 9060833 - DNA, 20 bp, Homo sapiens
acatatgaatgatagagcca

SEQ ID NO: 9060834 - DNA, 22 bp, Homo sapiens
acatagaacctggcacatagta

SEQ ID NO: 9060835 - DNA, 22 bp, Homo sapiens
acatatgtgcttatatccatga

SEQ ID NO: 9060836 - DNA, 22 bp, Homo sapiens
acatatgtgttgtacatgcatg

SEQ ID NO: 9060837 - DNA, 22 bp, Homo sapiens
acatatgcgatcataggatgca

SEQ ID NO: 9060838 - DNA, 22 bp, Homo sapiens
acatatgtgttgtacatgcatg

SEQ ID NO: 9060839 - DNA, 22 bp, Homo sapiens
aaggcagagattagcagaatga

SEQ ID NO: 9060840 - DNA, 22 bp, Homo sapiens
aaggcagaggaaggtctagttt

SEQ ID NO: 9060841 - DNA, 22 bp, Homo sapiens
aaggcagagattagcagaatga

SEQ ID NO: 9060842 - DNA, 22 bp, Homo sapiens
aaggcagagattagcagaatga

SEQ ID NO: 9060843 - DNA, 22 bp, Homo sapiens
aaggcagagattagcagaatga

SEQ ID NO: 9060844 - DNA, 22 bp, Homo sapiens
aaggcagaggaaggtctagttt

SEQ ID NO: 9060845 - DNA, 22 bp, Homo sapiens
aaggcagagggctggatcagag

SEQ ID NO: 9060846 - DNA, 22 bp, Homo sapiens
aaggcagagggctggatcagag

SEQ ID NO: 9060847 - DNA, 22 bp, Homo sapiens
aaggcagagggctggatcagag

SEQ ID NO: 9060848 - DNA, 22 bp, Homo sapiens
aaggcagagggctggatcagag

SEQ ID NO: 9060849 - DNA, 22 bp, Homo sapiens
aaggcagagggctggatcagag

SEQ ID NO: 9060850 - DNA, 22 bp, Homo sapiens
aaggcagagtctatcttggaag

SEQ ID NO: 9060851 - DNA, 22 bp, Homo sapiens
aaggagacatttgcagagcacc

SEQ ID NO: 9060852 - DNA, 22 bp, Homo sapiens
aaggagacatttgcagagcacc

SEQ ID NO: 9060853 - DNA, 22 bp, Homo sapiens
aaggagagagctttgctggaac

SEQ ID NO: 9060854 - DNA, 22 bp, Homo sapiens
aaggagagagctttgctggaac

SEQ ID NO: 9060855 - DNA, 22 bp, Homo sapiens
aaggagaagtctgttgagattg

SEQ ID NO: 9060856 - DNA, 22 bp, Homo sapiens
aagctggactctgccatttact

SEQ ID NO: 9060857 - DNA, 22 bp, Homo sapiens
aagctggagagttaggtgaata

SEQ ID NO: 9060858 - DNA, 22 bp, Homo sapiens
aaggagctgggagggacacatg

SEQ ID NO: 9060859 - DNA, 22 bp, Homo sapiens
aaggagctgggagggacacatg

SEQ ID NO: 9060860 - DNA, 22 bp, Homo sapiens
aaggagctcccggcagaccagg

SEQ ID NO: 9060861 - DNA, 22 bp, Homo sapiens
aaggagctcccggcagaccagg

SEQ ID NO: 9060862 - DNA, 21 bp, Homo sapiens
aaggagcctaggaggctcagg

SEQ ID NO: 9060863 - DNA, 22 bp, Homo sapiens
aaggagagtacaggagttggta

SEQ ID NO: 9060864 - DNA, 22 bp, Homo sapiens
aaggagaggttgtccgtgttgt

SEQ ID NO: 9060865 - DNA, 22 bp, Homo sapiens
aaggagagtacaggagttggta

SEQ ID NO: 9060866 - DNA, 22 bp, Homo sapiens
acagtgtttaaaaatcagatct

SEQ ID NO: 9060867 - DNA, 17 bp, Homo sapiens
acagtgtctatgaaatg

SEQ ID NO: 9060868 - DNA, 22 bp, Homo sapiens
acagtgtccttgtggtccctgt

SEQ ID NO: 9060869 - DNA, 22 bp, Homo sapiens
acagtcttaatggataggagct

SEQ ID NO: 9060870 - DNA, 22 bp, Homo sapiens
acagtctttaatttctttgtgg

SEQ ID NO: 9060871 - DNA, 22 bp, Homo sapiens
aggcaggcaagttcatatgagg

SEQ ID NO: 9060872 - DNA, 22 bp, Homo sapiens
aggcaggcaaccacctgggaag

SEQ ID NO: 9060873 - DNA, 22 bp, Homo sapiens
aggcaggcacacttcctccagg

SEQ ID NO: 9060874 - DNA, 22 bp, Homo sapiens
aggcaggattgctgacaacaat

SEQ ID NO: 9060875 - DNA, 21 bp, Homo sapiens
aggcaggattcaaacacagag

SEQ ID NO: 9060876 - DNA, 22 bp, Homo sapiens
aggcaggcaaccacctgggaag

SEQ ID NO: 9060877 - DNA, 22 bp, Homo sapiens
aggcaggattgctgacaacaat

SEQ ID NO: 9060878 - DNA, 22 bp, Homo sapiens
acagttttttcaacattggaat

SEQ ID NO: 9060879 - DNA, 21 bp, Homo sapiens
acagttttaaggagcacatgg

SEQ ID NO: 9060880 - DNA, 22 bp, Homo sapiens
acataaatagattattgggagg

SEQ ID NO: 9060881 - DNA, 22 bp, Homo sapiens
aggcagctggaggcagagacta

SEQ ID NO: 9060882 - DNA, 22 bp, Homo sapiens
aggcagctggaggcagagacta

SEQ ID NO: 9060883 - DNA, 22 bp, Homo sapiens
aggcagctggaggcagagacta

SEQ ID NO: 9060884 - DNA, 21 bp, Homo sapiens
aggcaggattcaaacacagag

SEQ ID NO: 9060885 - DNA, 22 bp, Homo sapiens
aggcagctggaggcagagacta

SEQ ID NO: 9060886 - DNA, 22 bp, Homo sapiens
aggcagcagtgataagatagga

SEQ ID NO: 9060887 - DNA, 22 bp, Homo sapiens
aggcagcatccagaggagaatg

SEQ ID NO: 9060888 - DNA, 22 bp, Homo sapiens
aggcagcatccagaggagaatg

SEQ ID NO: 9060889 - DNA, 21 bp, Homo sapiens
aggcagcatctgatttatatg

SEQ ID NO: 9060890 - DNA, 22 bp, Homo sapiens
aggcagcatgctctgcttctac

SEQ ID NO: 9060891 - DNA, 22 bp, Homo sapiens
aggcagcatgctctgcttctac

SEQ ID NO: 9060892 - DNA, 22 bp, Homo sapiens
aggcagcatgctctgcttctac

SEQ ID NO: 9060893 - DNA, 22 bp, Homo sapiens
aggcagcagtgataagatagga

SEQ ID NO: 9060894 - DNA, 22 bp, Homo sapiens
aggcagcaattgaaatcattgt

SEQ ID NO: 9060895 - DNA, 22 bp, Homo sapiens
aggcagcaattgaaatcattgt

SEQ ID NO: 9060896 - DNA, 22 bp, Homo sapiens
aggcagcatgggccccagctcc

SEQ ID NO: 9060897 - DNA, 16 bp, Homo sapiens
aggcagcatgttagtg

SEQ ID NO: 9060898 - DNA, 22 bp, Homo sapiens
aggcagcatgggccccagctcc

SEQ ID NO: 9060899 - DNA, 22 bp, Homo sapiens
aggcagcatgggcccagagtcc

SEQ ID NO: 9060900 - DNA, 22 bp, Homo sapiens
aggcagcatgggcccagagtcc

SEQ ID NO: 9060901 - DNA, 22 bp, Homo sapiens
aggcagcattcaggggtgatga

SEQ ID NO: 9060902 - DNA, 22 bp, Homo sapiens
acagttaataagtagtaagtca

SEQ ID NO: 9060903 - DNA, 22 bp, Homo sapiens
acagttaattaacattaagggg

SEQ ID NO: 9060904 - DNA, 22 bp, Homo sapiens
acagttaatcaaatggcatatg

SEQ ID NO: 9060905 - DNA, 22 bp, Homo sapiens
acagttaatatgtgacagaact

SEQ ID NO: 9060906 - DNA, 22 bp, Homo sapiens
acagttacatcacttactgaca

SEQ ID NO: 9060907 - DNA, 22 bp, Homo sapiens
acagttacattaaacaaaagga

SEQ ID NO: 9060908 - DNA, 22 bp, Homo sapiens
acagttaggtcctaaaattctg

SEQ ID NO: 9060909 - DNA, 22 bp, Homo sapiens
acagttattctttatgcaacca

SEQ ID NO: 9060910 - DNA, 22 bp, Homo sapiens
acagttcaagtcttagacaaca

SEQ ID NO: 9060911 - DNA, 22 bp, Homo sapiens
acagttcaagtcttagacaaca

SEQ ID NO: 9060912 - DNA, 22 bp, Homo sapiens
acagttcaagacatcagtatga

SEQ ID NO: 9060913 - DNA, 22 bp, Homo sapiens
acagttcaagtcttagacaaca

SEQ ID NO: 9060914 - DNA, 22 bp, Homo sapiens
acagtgatcagttactgtctgt

SEQ ID NO: 9060915 - DNA, 18 bp, Homo sapiens
acagtgattgttctatgc

SEQ ID NO: 9060916 - DNA, 22 bp, Homo sapiens
acagtgattggcactgattcag

SEQ ID NO: 9060917 - DNA, 22 bp, Homo sapiens
acagtgcaaaccctcgggaaag

SEQ ID NO: 9060918 - DNA, 22 bp, Homo sapiens
acagtgcaaaccctcgggaaag

SEQ ID NO: 9060919 - DNA, 22 bp, Homo sapiens
acagtgttttcttaaggagaaa

SEQ ID NO: 9060920 - DNA, 22 bp, Homo sapiens
acagttaaatatttctactggg

SEQ ID NO: 9060921 - DNA, 22 bp, Homo sapiens
acagttaagcagtatgatcaca

SEQ ID NO: 9060922 - DNA, 22 bp, Homo sapiens
acagtgcacatcctgagtgatt

SEQ ID NO: 9060923 - DNA, 22 bp, Homo sapiens
acagtgcaaacttttgtctcct

SEQ ID NO: 9060924 - DNA, 22 bp, Homo sapiens
acagtgcaaacttttgtctcct

SEQ ID NO: 9060925 - DNA, 22 bp, Homo sapiens
acagtgcacatcctgagtgatt

SEQ ID NO: 9060926 - DNA, 22 bp, Homo sapiens
acagtgcaaataggactgtctt

SEQ ID NO: 9060927 - DNA, 22 bp, Homo sapiens
acagtgcaaataggactgtctt

SEQ ID NO: 9060928 - DNA, 22 bp, Homo sapiens
aggagctggagtccaggcaagt

SEQ ID NO: 9060929 - DNA, 21 bp, Homo sapiens
aggagctgtgtgcttcctttc

SEQ ID NO: 9060930 - DNA, 21 bp, Homo sapiens
aggagctgtgttagctggtcg

SEQ ID NO: 9060931 - DNA, 21 bp, Homo sapiens
aggagctgtgttagctggtcg

SEQ ID NO: 9060932 - DNA, 21 bp, Homo sapiens
aggagctgtgttagctggtcg

SEQ ID NO: 9060933 - DNA, 22 bp, Homo sapiens
aggagcttcagagagaacctgg

SEQ ID NO: 9060934 - DNA, 22 bp, Homo sapiens
aggagcttcagagagaacctgg

SEQ ID NO: 9060935 - DNA, 22 bp, Homo sapiens
aggagctgttttgttcagcaaa

SEQ ID NO: 9060936 - DNA, 22 bp, Homo sapiens
aggagctgttttgttcagcaaa

SEQ ID NO: 9060937 - DNA, 22 bp, Homo sapiens
aggagctgttttgttcagcaaa

SEQ ID NO: 9060938 - DNA, 22 bp, Homo sapiens
aggagctgttttgttcagcaaa

SEQ ID NO: 9060939 - DNA, 22 bp, Homo sapiens
acagggagtctgaggggatagt

SEQ ID NO: 9060940 - DNA, 18 bp, Homo sapiens
acagggagggcgctgggg

SEQ ID NO: 9060941 - DNA, 18 bp, Homo sapiens
acagggatggggtaagtg

SEQ ID NO: 9060942 - DNA, 22 bp, Homo sapiens
acagggcaacctctgggagact

SEQ ID NO: 9060943 - DNA, 17 bp, Homo sapiens
aggagtctcagatgagc

SEQ ID NO: 9060944 - DNA, 22 bp, Homo sapiens
aggagtcctcatgtctgtgcga

SEQ ID NO: 9060945 - DNA, 22 bp, Homo sapiens
aggagtctgaactggtcccctg

SEQ ID NO: 9060946 - DNA, 17 bp, Homo sapiens
aggagtctcagatgagc

SEQ ID NO: 9060947 - DNA, 22 bp, Homo sapiens
aggagtctgttgaaatgtctat

SEQ ID NO: 9060948 - DNA, 22 bp, Homo sapiens
aggagtgcaaatagtccagaga

SEQ ID NO: 9060949 - DNA, 22 bp, Homo sapiens
aggagtggaattactgggttct

SEQ ID NO: 9060950 - DNA, 22 bp, Homo sapiens
aggaggaactcagaaagaaggt

SEQ ID NO: 9060951 - DNA, 21 bp, Homo sapiens
acagtaaattccctgcaaaga

SEQ ID NO: 9060952 - DNA, 21 bp, Homo sapiens
aggaggaacccgtggctgggc

SEQ ID NO: 9060953 - DNA, 22 bp, Homo sapiens
aggaggaaaaaggccacagcaa

SEQ ID NO: 9060954 - DNA, 20 bp, Homo sapiens
aggaggaaaaaatgacgagc

SEQ ID NO: 9060955 - DNA, 23 bp, Homo sapiens
aggaggaaaagttatctgctgag

SEQ ID NO: 9060956 - DNA, 22 bp, Homo sapiens
aggaggaaagaaggcccccagc

SEQ ID NO: 9060957 - DNA, 22 bp, Homo sapiens
aggaggaaagaaggcccccagc

SEQ ID NO: 9060958 - DNA, 22 bp, Homo sapiens
acagtaacctctcctctgaagg

SEQ ID NO: 9060959 - DNA, 22 bp, Homo sapiens
acagtaattaaggtctgaaacg

SEQ ID NO: 9060960 - DNA, 22 bp, Homo sapiens
acagtaattaaacattctgatt

SEQ ID NO: 9060961 - DNA, 22 bp, Homo sapiens
acagtaatcatatgattttctc

SEQ ID NO: 9060962 - DNA, 22 bp, Homo sapiens
acaggcctgggttcaaatttgg

SEQ ID NO: 9060963 - DNA, 22 bp, Homo sapiens
acaggcctgggttcaaatttgg

SEQ ID NO: 9060964 - DNA, 22 bp, Homo sapiens
acaggcctggggtacaagttct

SEQ ID NO: 9060965 - DNA, 22 bp, Homo sapiens
acaggcctggaaaggaaggagt

SEQ ID NO: 9060966 - DNA, 22 bp, Homo sapiens
agctttatgcttcctacaagct

SEQ ID NO: 9060967 - DNA, 22 bp, Homo sapiens
acaggcctagctaatgctttcc

SEQ ID NO: 9060968 - DNA, 22 bp, Homo sapiens
acaggcctacgaagtcaggtgc

SEQ ID NO: 9060969 - DNA, 22 bp, Homo sapiens
acaggcctagggtcaatttcct

SEQ ID NO: 9060970 - DNA, 22 bp, Homo sapiens
acaggcctagggtcaatttcct

SEQ ID NO: 9060971 - DNA, 22 bp, Homo sapiens
acaggcctatgttccattgcag

SEQ ID NO: 9060972 - DNA, 18 bp, Homo sapiens
acaggcctcagtcctgca

SEQ ID NO: 9060973 - DNA, 18 bp, Homo sapiens
acaggcctcagtcctgca

SEQ ID NO: 9060974 - DNA, 22 bp, Homo sapiens
acaggcctcaagacacccaggt

SEQ ID NO: 9060975 - DNA, 22 bp, Homo sapiens
acaggcctcaaatagggtgcct

SEQ ID NO: 9060976 - DNA, 22 bp, Homo sapiens
acaggcctgacacacagagggc

SEQ ID NO: 9060977 - DNA, 22 bp, Homo sapiens
acaggcctgacacacagagggc

SEQ ID NO: 9060978 - DNA, 22 bp, Homo sapiens
acaggcctcccatccggagccc

SEQ ID NO: 9060979 - DNA, 18 bp, Homo sapiens
acaggcctcagtcctgca

SEQ ID NO: 9060980 - DNA, 22 bp, Homo sapiens
acaggcctcccatccggagccc

SEQ ID NO: 9060981 - DNA, 22 bp, Homo sapiens
acaggcctgagattttgcattt

SEQ ID NO: 9060982 - DNA, 22 bp, Homo sapiens
acaggcctgatgccttggctgg

SEQ ID NO: 9060983 - DNA, 22 bp, Homo sapiens
acaggcctgatgccttggctgg

SEQ ID NO: 9060984 - DNA, 22 bp, Homo sapiens
acaggcctgatgttatcctatt

SEQ ID NO: 9060985 - DNA, 22 bp, Homo sapiens
acaggcctgatgttatcctatt

SEQ ID NO: 9060986 - DNA, 17 bp, Homo sapiens
acaggcctgcttgcact

SEQ ID NO: 9060987 - DNA, 17 bp, Homo sapiens
acaggcctgcttgcact

SEQ ID NO: 9060988 - DNA, 22 bp, Homo sapiens
acagctgtggggactcttgccc

SEQ ID NO: 9060989 - DNA, 22 bp, Homo sapiens
acagctgtgttttataatcagc

SEQ ID NO: 9060990 - DNA, 22 bp, Homo sapiens
acagcttcacccattatccctg

SEQ ID NO: 9060991 - DNA, 22 bp, Homo sapiens
acagcttccagtattcttgaaa

SEQ ID NO: 9060992 - DNA, 23 bp, Homo sapiens
acagctgttgaaatttcagtggg

SEQ ID NO: 9060993 - DNA, 23 bp, Homo sapiens
acagcttcctggcatggagaacc

SEQ ID NO: 9060994 - DNA, 23 bp, Homo sapiens
acagcttcctactttgctgctgc

SEQ ID NO: 9060995 - DNA, 22 bp, Homo sapiens
acaggcccagctcttcaccaga

SEQ ID NO: 9060996 - DNA, 22 bp, Homo sapiens
acaggccataaaggcaggccct

SEQ ID NO: 9060997 - DNA, 22 bp, Homo sapiens
acaggccataaaggcaggccct

SEQ ID NO: 9060998 - DNA, 22 bp, Homo sapiens
acagctgtgacttagagaagtt

SEQ ID NO: 9060999 - DNA, 22 bp, Homo sapiens
acagctgtgacttagagaagtt

SEQ ID NO: 9061000 - DNA, 22 bp, Homo sapiens
agctgggtgaaggcagatggct

SEQ ID NO: 9061001 - DNA, 22 bp, Homo sapiens
agctgggtcttgggccaggaga

SEQ ID NO: 9061002 - DNA, 22 bp, Homo sapiens
agctgggtcttgggccaggaga

SEQ ID NO: 9061003 - DNA, 22 bp, Homo sapiens
acaggctgcccgctccccacct

SEQ ID NO: 9061004 - DNA, 22 bp, Homo sapiens
acaggctctggggcaggatggc

SEQ ID NO: 9061005 - DNA, 22 bp, Homo sapiens
acaggctgcctaccaagtatca

SEQ ID NO: 9061006 - DNA, 22 bp, Homo sapiens
acaggctgcctaccaagtatca

SEQ ID NO: 9061007 - DNA, 22 bp, Homo sapiens
acaggctgctgagccatttgct

SEQ ID NO: 9061008 - DNA, 22 bp, Homo sapiens
acaggctgctgagccatttgct

SEQ ID NO: 9061009 - DNA, 22 bp, Homo sapiens
acaggctgcctaccaagtatca

SEQ ID NO: 9061010 - DNA, 22 bp, Homo sapiens
acaggctgcccgctccccacct

SEQ ID NO: 9061011 - DNA, 22 bp, Homo sapiens
acaggctgctgggctccgtgct

SEQ ID NO: 9061012 - DNA, 22 bp, Homo sapiens
acaggctgctgggctccgtgct

SEQ ID NO: 9061013 - DNA, 22 bp, Homo sapiens
acaggctgctgggctccgtgct

SEQ ID NO: 9061014 - DNA, 22 bp, Homo sapiens
acaggctggaggaggaccaaga

SEQ ID NO: 9061015 - DNA, 22 bp, Homo sapiens
acaggctggtggtcctggccat

SEQ ID NO: 9061016 - DNA, 22 bp, Homo sapiens
acaggctgggcgcttcctgcgg

SEQ ID NO: 9061017 - DNA, 22 bp, Homo sapiens
acaggctgggcgcttcctgcgg

SEQ ID NO: 9061018 - DNA, 22 bp, Homo sapiens
aggaatggttatggggatagta

SEQ ID NO: 9061019 - DNA, 22 bp, Homo sapiens
aggaatgtattattccttctgg

SEQ ID NO: 9061020 - DNA, 19 bp, Homo sapiens
aggaatggaattaattctg

SEQ ID NO: 9061021 - DNA, 22 bp, Homo sapiens
aggaatggtgctcagcagaaat

SEQ ID NO: 9061022 - DNA, 23 bp, Homo sapiens
aggaatggctagaagtgtgaccc

SEQ ID NO: 9061023 - DNA, 22 bp, Homo sapiens
acaggctggtttgtaaaagatg

SEQ ID NO: 9061024 - DNA, 22 bp, Homo sapiens
acaggctgtacttctaatcatc

SEQ ID NO: 9061025 - DNA, 18 bp, Homo sapiens
acaggctgtgggaatggt

SEQ ID NO: 9061026 - DNA, 22 bp, Homo sapiens
aggaatgattcaagacttggct

SEQ ID NO: 9061027 - DNA, 22 bp, Homo sapiens
acagccttctcttcactgtgtc

SEQ ID NO: 9061028 - DNA, 23 bp, Homo sapiens
acagccttctggggcttctgggc

SEQ ID NO: 9061029 - DNA, 22 bp, Homo sapiens
acagcctgctgcctgcttcttg

SEQ ID NO: 9061030 - DNA, 22 bp, Homo sapiens
agctgccttttgagaaagctca

SEQ ID NO: 9061031 - DNA, 22 bp, Homo sapiens
agctgctatgacaacaccagcc

SEQ ID NO: 9061032 - DNA, 21 bp, Homo sapiens
agctgcctttagagagaacca

SEQ ID NO: 9061033 - DNA, 17 bp, Homo sapiens
agctgccttgcttgagc

SEQ ID NO: 9061034 - DNA, 17 bp, Homo sapiens
agctgccttgcttgagc

SEQ ID NO: 9061035 - DNA, 22 bp, Homo sapiens
agctgcctgtcctaggccatca

SEQ ID NO: 9061036 - DNA, 22 bp, Homo sapiens
agctgccttatggagtatgaaa

SEQ ID NO: 9061037 - DNA, 22 bp, Homo sapiens
agctgccttaaattactttgtg

SEQ ID NO: 9061038 - DNA, 22 bp, Homo sapiens
agctgccttatggagtatgaaa

SEQ ID NO: 9061039 - DNA, 22 bp, Homo sapiens
agctgcctgggcttgtacacct

SEQ ID NO: 9061040 - DNA, 21 bp, Homo sapiens
acagcagacaggcttaggacc

SEQ ID NO: 9061041 - DNA, 22 bp, Homo sapiens
agctgcaggcccatgctcagtc

SEQ ID NO: 9061042 - DNA, 22 bp, Homo sapiens
agctgccagcatcccggaaggg

SEQ ID NO: 9061043 - DNA, 22 bp, Homo sapiens
acagcagaataatgagtaatag

SEQ ID NO: 9061044 - DNA, 23 bp, Homo sapiens
acagcacccatgtcatctggctc

SEQ ID NO: 9061045 - DNA, 22 bp, Homo sapiens
agctgccatctgaagaactgca

SEQ ID NO: 9061046 - DNA, 22 bp, Homo sapiens
agctgccagggactgggcatgg

SEQ ID NO: 9061047 - DNA, 22 bp, Homo sapiens
agctgccaggcccctgagaacc

SEQ ID NO: 9061048 - DNA, 22 bp, Homo sapiens
agctgccaggcccctgagaacc

SEQ ID NO: 9061049 - DNA, 17 bp, Homo sapiens
agctgccagggagtgtg

SEQ ID NO: 9061050 - DNA, 22 bp, Homo sapiens
agctgccatccgaggtgtcaga

SEQ ID NO: 9061051 - DNA, 22 bp, Homo sapiens
agctgccatcctgttcagcacc

SEQ ID NO: 9061052 - DNA, 22 bp, Homo sapiens
agctgccatcagcctttggatg

SEQ ID NO: 9061053 - DNA, 21 bp, Homo sapiens
acagccttgtgatggagacag

SEQ ID NO: 9061054 - DNA, 22 bp, Homo sapiens
acagctaagggcacaggtcacc

SEQ ID NO: 9061055 - DNA, 22 bp, Homo sapiens
acagctcagacatcactgctct

SEQ ID NO: 9061056 - DNA, 22 bp, Homo sapiens
acagctcagacatcactgctct

SEQ ID NO: 9061057 - DNA, 22 bp, Homo sapiens
acagctcatttgtaaaacggag

SEQ ID NO: 9061058 - DNA, 22 bp, Homo sapiens
acagctatctgactttgactca

SEQ ID NO: 9061059 - DNA, 22 bp, Homo sapiens
acagctcctaacaaaggctctc

SEQ ID NO: 9061060 - DNA, 22 bp, Homo sapiens
acagctcttaggcagaaccaac

SEQ ID NO: 9061061 - DNA, 22 bp, Homo sapiens
acagctctggtcctttagagag

SEQ ID NO: 9061062 - DNA, 22 bp, Homo sapiens
agctggggttgcacacattttg

SEQ ID NO: 9061063 - DNA, 22 bp, Homo sapiens
agctgggtacagcctgtgccta

SEQ ID NO: 9061064 - DNA, 22 bp, Homo sapiens
agctggggctgcagagaacagg

SEQ ID NO: 9061065 - DNA, 23 bp, Homo sapiens
acagctgcacctggccgcctggc

SEQ ID NO: 9061066 - DNA, 22 bp, Homo sapiens
acatttttctaggaggcaaggt

SEQ ID NO: 9061067 - DNA, 22 bp, Homo sapiens
acatttttcacatttgtagggt

SEQ ID NO: 9061068 - DNA, 22 bp, Homo sapiens
acatttttcacatttgtagggt

SEQ ID NO: 9061069 - DNA, 22 bp, Homo sapiens
acatttttattcatcaaagcag

SEQ ID NO: 9061070 - DNA, 22 bp, Homo sapiens
acatttttattcatcaaagcag

SEQ ID NO: 9061071 - DNA, 22 bp, Homo sapiens
acatttttattcatcaaagcag

SEQ ID NO: 9061072 - DNA, 22 bp, Homo sapiens
acatttgtcttctttcagatta

SEQ ID NO: 9061073 - DNA, 22 bp, Homo sapiens
acatttgtcttctttcagatta

SEQ ID NO: 9061074 - DNA, 20 bp, Homo sapiens
acattttggcatactctcaa

SEQ ID NO: 9061075 - DNA, 22 bp, Homo sapiens
acatttttactgggcatctgca

SEQ ID NO: 9061076 - DNA, 22 bp, Homo sapiens
acatttttatcctgagtgccag

SEQ ID NO: 9061077 - DNA, 22 bp, Homo sapiens
accaaaacctgctactaaagga

SEQ ID NO: 9061078 - DNA, 22 bp, Homo sapiens
accaaaacctgctactaaagga

SEQ ID NO: 9061079 - DNA, 22 bp, Homo sapiens
accaaaaattgtggggctgaat

SEQ ID NO: 9061080 - DNA, 22 bp, Homo sapiens
accaaaaagatatgttgaagcc

SEQ ID NO: 9061081 - DNA, 22 bp, Homo sapiens
acatttttgggttgatgtctga

SEQ ID NO: 9061082 - DNA, 22 bp, Homo sapiens
acattttttagagtcccacatt

SEQ ID NO: 9061083 - DNA, 22 bp, Homo sapiens
aggctggatctctgttgccttc

SEQ ID NO: 9061084 - DNA, 22 bp, Homo sapiens
aggctggatttatggggacttc

SEQ ID NO: 9061085 - DNA, 22 bp, Homo sapiens
aggctggatgtgcctcaccgag

SEQ ID NO: 9061086 - DNA, 22 bp, Homo sapiens
aggctggagtgtgcagtggcgc

SEQ ID NO: 9061087 - DNA, 22 bp, Homo sapiens
aggctggatctctgttgccttc

SEQ ID NO: 9061088 - DNA, 22 bp, Homo sapiens
aggctggagtgtgcagtggcgc

SEQ ID NO: 9061089 - DNA, 22 bp, Homo sapiens
aggctggcaaggcagatgtgtg

SEQ ID NO: 9061090 - DNA, 22 bp, Homo sapiens
aggctggatttatggggacttc

SEQ ID NO: 9061091 - DNA, 22 bp, Homo sapiens
aggctggcagccacctcagcag

SEQ ID NO: 9061092 - DNA, 23 bp, Homo sapiens
aggctttatggtagaaagtttgc

SEQ ID NO: 9061093 - DNA, 22 bp, Homo sapiens
aggctttatttgatctatatgc

SEQ ID NO: 9061094 - DNA, 22 bp, Homo sapiens
agggaagaatcactgggatgtt

SEQ ID NO: 9061095 - DNA, 22 bp, Homo sapiens
agggaagaatcactgggatgtt

SEQ ID NO: 9061096 - DNA, 22 bp, Homo sapiens
agggaagagcttgcaagaaacc

SEQ ID NO: 9061097 - DNA, 22 bp, Homo sapiens
agggaagaggaccagagtctct

SEQ ID NO: 9061098 - DNA, 22 bp, Homo sapiens
agggaagaggaccagagtctct

SEQ ID NO: 9061099 - DNA, 22 bp, Homo sapiens
agggaagaggaccagagtctct

SEQ ID NO: 9061100 - DNA, 22 bp, Homo sapiens
agggacagatgaatgactgagt

SEQ ID NO: 9061101 - DNA, 22 bp, Homo sapiens
agggacagatgaatgactgagt

SEQ ID NO: 9061102 - DNA, 22 bp, Homo sapiens
agggaatgtgaaaacacctctc

SEQ ID NO: 9061103 - DNA, 22 bp, Homo sapiens
agggaattcactggaacgccct

SEQ ID NO: 9061104 - DNA, 22 bp, Homo sapiens
agggaagccctggctgagaccc

SEQ ID NO: 9061105 - DNA, 22 bp, Homo sapiens
agggaagctgctgggtccacct

SEQ ID NO: 9061106 - DNA, 22 bp, Homo sapiens
agggaagccaagccttagagaa

SEQ ID NO: 9061107 - DNA, 22 bp, Homo sapiens
agggaagcaggaatagctctga

SEQ ID NO: 9061108 - DNA, 23 bp, Homo sapiens
agggagctaaaaggctggagcag

SEQ ID NO: 9061109 - DNA, 22 bp, Homo sapiens
agggagccttcctggctgtggt

SEQ ID NO: 9061110 - DNA, 22 bp, Homo sapiens
agggagctaggatcctgaaggt

SEQ ID NO: 9061111 - DNA, 22 bp, Homo sapiens
accaggccctccagctgcgtgg

SEQ ID NO: 9061112 - DNA, 20 bp, Homo sapiens
accaggcccggtgtctcctc

SEQ ID NO: 9061113 - DNA, 22 bp, Homo sapiens
accaggcccaccgcatgctcct

SEQ ID NO: 9061114 - DNA, 22 bp, Homo sapiens
agggacagtatccatctcacag

SEQ ID NO: 9061115 - DNA, 22 bp, Homo sapiens
accaggagttgggggtgggacc

SEQ ID NO: 9061116 - DNA, 20 bp, Homo sapiens
accaggccccgggccctgca

SEQ ID NO: 9061117 - DNA, 22 bp, Homo sapiens
accaggcccgctgctatggtgg

SEQ ID NO: 9061118 - DNA, 22 bp, Homo sapiens
agggagctcacagtccagtaga

SEQ ID NO: 9061119 - DNA, 22 bp, Homo sapiens
agggagctcgatgcctgagtgt

SEQ ID NO: 9061120 - DNA, 22 bp, Homo sapiens
accatttaaggaaaatgtatca

SEQ ID NO: 9061121 - DNA, 22 bp, Homo sapiens
accattgccccctagtgtctgt

SEQ ID NO: 9061122 - DNA, 22 bp, Homo sapiens
accattctttacacttatttct

SEQ ID NO: 9061123 - DNA, 22 bp, Homo sapiens
acccacagaacctgtgacaaca

SEQ ID NO: 9061124 - DNA, 22 bp, Homo sapiens
agggcagcttccatagtctggc

SEQ ID NO: 9061125 - DNA, 22 bp, Homo sapiens
acccacacctccgtatatcact

SEQ ID NO: 9061126 - DNA, 22 bp, Homo sapiens
acccacacatctctaattcagt

SEQ ID NO: 9061127 - DNA, 22 bp, Homo sapiens
acccacacctccgtatatcact

SEQ ID NO: 9061128 - DNA, 22 bp, Homo sapiens
acccacacatctctaattcagt

SEQ ID NO: 9061129 - DNA, 22 bp, Homo sapiens
acccaaagcaatattcatcagt

SEQ ID NO: 9061130 - DNA, 22 bp, Homo sapiens
acccaagacacgtgtcctcagc

SEQ ID NO: 9061131 - DNA, 22 bp, Homo sapiens
agggcatctagttccctctctt

SEQ ID NO: 9061132 - DNA, 22 bp, Homo sapiens
agggcatctctaacagtctcct

SEQ ID NO: 9061133 - DNA, 22 bp, Homo sapiens
agggcagtgggaaagcctgctc

SEQ ID NO: 9061134 - DNA, 22 bp, Homo sapiens
acccaggagcaggctgggcagt

SEQ ID NO: 9061135 - DNA, 22 bp, Homo sapiens
agggcctgggtctgtactcctc

SEQ ID NO: 9061136 - DNA, 22 bp, Homo sapiens
agggcctggggtagcttactgc

SEQ ID NO: 9061137 - DNA, 22 bp, Homo sapiens
agggcctggggtagcttactgc

SEQ ID NO: 9061138 - DNA, 22 bp, Homo sapiens
agggcctggtgacctgggtcct

SEQ ID NO: 9061139 - DNA, 22 bp, Homo sapiens
agggcctggtgacctgggtcct

SEQ ID NO: 9061140 - DNA, 22 bp, Homo sapiens
agggcctggttctgtgtaggga

SEQ ID NO: 9061141 - DNA, 22 bp, Homo sapiens
accccagctctgagccacacca

SEQ ID NO: 9061142 - DNA, 22 bp, Homo sapiens
agggcctggttctgtgtaggga

SEQ ID NO: 9061143 - DNA, 22 bp, Homo sapiens
accccttttatagaagaacaga

SEQ ID NO: 9061144 - DNA, 22 bp, Homo sapiens
acccgccctcagccttaccgtg

SEQ ID NO: 9061145 - DNA, 22 bp, Homo sapiens
accccaggaagtggaggtcatg

SEQ ID NO: 9061146 - DNA, 22 bp, Homo sapiens
accctactaaatgtggtatgtc

SEQ ID NO: 9061147 - DNA, 22 bp, Homo sapiens
acccggagtcggaggttgcagt

SEQ ID NO: 9061148 - DNA, 22 bp, Homo sapiens
accctcaacaaattcactctat

SEQ ID NO: 9061149 - DNA, 22 bp, Homo sapiens
accctcaacaaattcactctat

SEQ ID NO: 9061150 - DNA, 22 bp, Homo sapiens
agggcctgggccagcacccttt

SEQ ID NO: 9061151 - DNA, 22 bp, Homo sapiens
agggcctgggccagcacccttt

SEQ ID NO: 9061152 - DNA, 22 bp, Homo sapiens
agggcctgggccagcacccttt

SEQ ID NO: 9061153 - DNA, 22 bp, Homo sapiens
agggcctgggatgtcctcctag

SEQ ID NO: 9061154 - DNA, 22 bp, Homo sapiens
agggcctgggatgtcctcctag

SEQ ID NO: 9061155 - DNA, 22 bp, Homo sapiens
agggcctgggaagaggaaccct

SEQ ID NO: 9061156 - DNA, 22 bp, Homo sapiens
acccaggctagagtgcagtggt

SEQ ID NO: 9061157 - DNA, 22 bp, Homo sapiens
acccaggctagagtgcagtggt

SEQ ID NO: 9061158 - DNA, 22 bp, Homo sapiens
acccaggctagggtgcagtggc

SEQ ID NO: 9061159 - DNA, 22 bp, Homo sapiens
acccaggctagggtgcagtggc

SEQ ID NO: 9061160 - DNA, 22 bp, Homo sapiens
acccaggcctgagagacaggag

SEQ ID NO: 9061161 - DNA, 22 bp, Homo sapiens
acccaggcgggagtgcagtgtc

SEQ ID NO: 9061162 - DNA, 22 bp, Homo sapiens
acccaggcgggagtgcagtgtc

SEQ ID NO: 9061163 - DNA, 22 bp, Homo sapiens
acatggcaaaagggactttaca

SEQ ID NO: 9061164 - DNA, 22 bp, Homo sapiens
acatggcaaaaccccgtttcta

SEQ ID NO: 9061165 - DNA, 22 bp, Homo sapiens
acatggatcaacctattttctt

SEQ ID NO: 9061166 - DNA, 22 bp, Homo sapiens
acatggagaccagatggaagta

SEQ ID NO: 9061167 - DNA, 22 bp, Homo sapiens
acatggagctcaaacatgagtg

SEQ ID NO: 9061168 - DNA, 17 bp, Homo sapiens
acatggcagttcacgct

SEQ ID NO: 9061169 - DNA, 22 bp, Homo sapiens
acatggcaggaatcatgtgttt

SEQ ID NO: 9061170 - DNA, 22 bp, Homo sapiens
acatggcaggaatcatgtgttt

SEQ ID NO: 9061171 - DNA, 22 bp, Homo sapiens
acatggcacccagatctcaaaa

SEQ ID NO: 9061172 - DNA, 22 bp, Homo sapiens
acatggcattcactcccacagg

SEQ ID NO: 9061173 - DNA, 19 bp, Homo sapiens
acatggcatcccaggaggt

SEQ ID NO: 9061174 - DNA, 22 bp, Homo sapiens
aggcccttaggacccctgcgtg

SEQ ID NO: 9061175 - DNA, 22 bp, Homo sapiens
aggcccttaggacccctgcgtg

SEQ ID NO: 9061176 - DNA, 22 bp, Homo sapiens
aggcccttcttggtggctcagg

SEQ ID NO: 9061177 - DNA, 22 bp, Homo sapiens
aggccctgttatgagccactgt

SEQ ID NO: 9061178 - DNA, 22 bp, Homo sapiens
aggcccttggactcatgctcga

SEQ ID NO: 9061179 - DNA, 22 bp, Homo sapiens
aggccgaactccaactcctggg

SEQ ID NO: 9061180 - DNA, 22 bp, Homo sapiens
acatggaaaactaactgctttt

SEQ ID NO: 9061181 - DNA, 22 bp, Homo sapiens
aggcccttgggtcctctccaca

SEQ ID NO: 9061182 - DNA, 22 bp, Homo sapiens
aggcccttggactcatgctcga

SEQ ID NO: 9061183 - DNA, 22 bp, Homo sapiens
aggcccttggactcatgctcga

SEQ ID NO: 9061184 - DNA, 22 bp, Homo sapiens
acatggaagataaaaatactca

SEQ ID NO: 9061185 - DNA, 20 bp, Homo sapiens
acatggaaggtcaaactatc

SEQ ID NO: 9061186 - DNA, 22 bp, Homo sapiens
acatggaagcaaagttctattt

SEQ ID NO: 9061187 - DNA, 22 bp, Homo sapiens
acatggaagcaaagttctattt

SEQ ID NO: 9061188 - DNA, 22 bp, Homo sapiens
aggccctgtaaggtgtggagat

SEQ ID NO: 9061189 - DNA, 22 bp, Homo sapiens
aggccctgtaaggtgtggagat

SEQ ID NO: 9061190 - DNA, 22 bp, Homo sapiens
aggccctgtccatggtgctgaa

SEQ ID NO: 9061191 - DNA, 22 bp, Homo sapiens
aggccctgttatgagccactgt

SEQ ID NO: 9061192 - DNA, 20 bp, Homo sapiens
acatgcacgtgtgtatatat

SEQ ID NO: 9061193 - DNA, 22 bp, Homo sapiens
acatgcagacgggatcctggca

SEQ ID NO: 9061194 - DNA, 22 bp, Homo sapiens
acatgcataaactacttcttat

SEQ ID NO: 9061195 - DNA, 22 bp, Homo sapiens
acatgcaggaaaatgcacagat

SEQ ID NO: 9061196 - DNA, 22 bp, Homo sapiens
acatgcacacgattcagtctgg

SEQ ID NO: 9061197 - DNA, 22 bp, Homo sapiens
acatgattggactccttcccct

SEQ ID NO: 9061198 - DNA, 22 bp, Homo sapiens
acatgcaactaaagggtgccac

SEQ ID NO: 9061199 - DNA, 22 bp, Homo sapiens
acatgcaaagccacaggacccg

SEQ ID NO: 9061200 - DNA, 22 bp, Homo sapiens
acatgatttgcatgatttgtaa

SEQ ID NO: 9061201 - DNA, 22 bp, Homo sapiens
acatgattttagtatcataata

SEQ ID NO: 9061202 - DNA, 22 bp, Homo sapiens
acatgatttttaaagagataat

SEQ ID NO: 9061203 - DNA, 22 bp, Homo sapiens
acatgcaaaaatatatttatga

SEQ ID NO: 9061204 - DNA, 22 bp, Homo sapiens
acatgatttttctttgactcta

SEQ ID NO: 9061205 - DNA, 22 bp, Homo sapiens
acatgattaaaagattttaaag

SEQ ID NO: 9061206 - DNA, 22 bp, Homo sapiens
acatgattcttgataggcattg

SEQ ID NO: 9061207 - DNA, 22 bp, Homo sapiens
acatgattaaaagattttaaag

SEQ ID NO: 9061208 - DNA, 22 bp, Homo sapiens
acatgattgtctggcttggcca

SEQ ID NO: 9061209 - DNA, 22 bp, Homo sapiens
acatgatttcagggaattctca

SEQ ID NO: 9061210 - DNA, 22 bp, Homo sapiens
acatgaggtgctataggtctac

SEQ ID NO: 9061211 - DNA, 22 bp, Homo sapiens
acatgagaggctgtggagtaca

SEQ ID NO: 9061212 - DNA, 22 bp, Homo sapiens
acatgagaggctgtggagtaca

SEQ ID NO: 9061213 - DNA, 22 bp, Homo sapiens
aggcagggctgggattagactc

SEQ ID NO: 9061214 - DNA, 22 bp, Homo sapiens
aggcaggggagctggaagggta

SEQ ID NO: 9061215 - DNA, 22 bp, Homo sapiens
acatgaaagttattctgagttg

SEQ ID NO: 9061216 - DNA, 22 bp, Homo sapiens
acatgaaagttattctgagttg

SEQ ID NO: 9061217 - DNA, 22 bp, Homo sapiens
acatgagaagctgcaacatgac

SEQ ID NO: 9061218 - DNA, 22 bp, Homo sapiens
aggcaggcagctgtcaccactc

SEQ ID NO: 9061219 - DNA, 17 bp, Homo sapiens
aggcaggcagagcggga

SEQ ID NO: 9061220 - DNA, 17 bp, Homo sapiens
aggcaggcagagcggga

SEQ ID NO: 9061221 - DNA, 17 bp, Homo sapiens
aggcaggcagagcggga

SEQ ID NO: 9061222 - DNA, 22 bp, Homo sapiens
aggcaggcactccggaagtgtc

SEQ ID NO: 9061223 - DNA, 22 bp, Homo sapiens
aggcagggaccagttgttttct

SEQ ID NO: 9061224 - DNA, 23 bp, Homo sapiens
aggcaggcagttcagctgttgtt

SEQ ID NO: 9061225 - DNA, 22 bp, Homo sapiens
aggcaggctggtctgaagagtg

SEQ ID NO: 9061226 - DNA, 22 bp, Homo sapiens
acatttacattttctctggcct

SEQ ID NO: 9061227 - DNA, 22 bp, Homo sapiens
acatttaccctggaacattgga

SEQ ID NO: 9061228 - DNA, 22 bp, Homo sapiens
acatttacttatcaaaagtcag

SEQ ID NO: 9061229 - DNA, 22 bp, Homo sapiens
acatttacagtgctagacaatc

SEQ ID NO: 9061230 - DNA, 19 bp, Homo sapiens
aggctgcaaggtggtgggc

SEQ ID NO: 9061231 - DNA, 19 bp, Homo sapiens
aggctgcaaggtggtgggc

SEQ ID NO: 9061232 - DNA, 22 bp, Homo sapiens
aggctgagtttctcattctcgc

SEQ ID NO: 9061233 - DNA, 22 bp, Homo sapiens
aggctgatgctggctgaggctg

SEQ ID NO: 9061234 - DNA, 22 bp, Homo sapiens
aggctgagtgctcccctagatg

SEQ ID NO: 9061235 - DNA, 22 bp, Homo sapiens
aggctgagtttctcattctcgc

SEQ ID NO: 9061236 - DNA, 22 bp, Homo sapiens
aggctgagggctcctgagggca

SEQ ID NO: 9061237 - DNA, 22 bp, Homo sapiens
aggctgagggctcctgagggca

SEQ ID NO: 9061238 - DNA, 22 bp, Homo sapiens
aggctgaggctttccttggaga

SEQ ID NO: 9061239 - DNA, 22 bp, Homo sapiens
aggctgaggctttccttggaga

SEQ ID NO: 9061240 - DNA, 22 bp, Homo sapiens
acatttcactgttcacagcagg

SEQ ID NO: 9061241 - DNA, 22 bp, Homo sapiens
aggctgaggctggcagctccag

SEQ ID NO: 9061242 - DNA, 22 bp, Homo sapiens
aggcgcagaaggccaggggcct

SEQ ID NO: 9061243 - DNA, 22 bp, Homo sapiens
aggcgcagacatacagggtctg

SEQ ID NO: 9061244 - DNA, 22 bp, Homo sapiens
aggcgagaggcttgggctagta

SEQ ID NO: 9061245 - DNA, 22 bp, Homo sapiens
aggcctttgtggagctcatggc

SEQ ID NO: 9061246 - DNA, 22 bp, Homo sapiens
aggcctttgtggagctcatggc

SEQ ID NO: 9061247 - DNA, 20 bp, Homo sapiens
aggccttgtttatagtgaga

SEQ ID NO: 9061248 - DNA, 22 bp, Homo sapiens
aggcctttgtacaataatcata

SEQ ID NO: 9061249 - DNA, 20 bp, Homo sapiens
aggccttgtttatagtgaga

SEQ ID NO: 9061250 - DNA, 22 bp, Homo sapiens
aggcgcagggtttggacccagg

SEQ ID NO: 9061251 - DNA, 22 bp, Homo sapiens
aggcgcagggtttggacccagg

SEQ ID NO: 9061252 - DNA, 22 bp, Homo sapiens
aggctagctgattgccttagaa

SEQ ID NO: 9061253 - DNA, 22 bp, Homo sapiens
aggccttgtattaatttgtttt

SEQ ID NO: 9061254 - DNA, 22 bp, Homo sapiens
aggccttgtgagaagcagagaa

SEQ ID NO: 9061255 - DNA, 18 bp, Homo sapiens
aggccttgggtagcctga

SEQ ID NO: 9061256 - DNA, 22 bp, Homo sapiens
aggccttgtaatggaggggaaa

SEQ ID NO: 9061257 - DNA, 22 bp, Homo sapiens
aggccttgggccatagtctcct

SEQ ID NO: 9061258 - DNA, 22 bp, Homo sapiens
aggccttgtaatggaggggaaa

SEQ ID NO: 9061259 - DNA, 22 bp, Homo sapiens
aggccttgggagcagtgtttgt

SEQ ID NO: 9061260 - DNA, 22 bp, Homo sapiens
aggccttggcatgctgccctgc

SEQ ID NO: 9061261 - DNA, 22 bp, Homo sapiens
aggccttggcagaggccaggct

SEQ ID NO: 9061262 - DNA, 22 bp, Homo sapiens
aggccttgccaatgagagaact

SEQ ID NO: 9061263 - DNA, 22 bp, Homo sapiens
aggccttggaagccagggagcc

SEQ ID NO: 9061264 - DNA, 22 bp, Homo sapiens
aggccttgatttaaattttgat

SEQ ID NO: 9061265 - DNA, 22 bp, Homo sapiens
aggccttgaaccttgctgggtg

SEQ ID NO: 9061266 - DNA, 22 bp, Homo sapiens
aggccttgatttaaattttgat

SEQ ID NO: 9061267 - DNA, 22 bp, Homo sapiens
aggccttgccaatgagagaact

SEQ ID NO: 9061268 - DNA, 22 bp, Homo sapiens
aggccttaccatagctgtagca

SEQ ID NO: 9061269 - DNA, 22 bp, Homo sapiens
aggccttaccatagctgtagca

SEQ ID NO: 9061270 - DNA, 22 bp, Homo sapiens
aggccttcctcggagacaggga

SEQ ID NO: 9061271 - DNA, 22 bp, Homo sapiens
aggcctgtttcttgtccagctc

SEQ ID NO: 9061272 - DNA, 22 bp, Homo sapiens
aggcctgtctggggctcagcca

SEQ ID NO: 9061273 - DNA, 22 bp, Homo sapiens
acatttaatgatcctactgtga

SEQ ID NO: 9061274 - DNA, 22 bp, Homo sapiens
acatttaagttaaaacctcagt

SEQ ID NO: 9061275 - DNA, 22 bp, Homo sapiens
acatttaaccaaactgtttaat

SEQ ID NO: 9061276 - DNA, 22 bp, Homo sapiens
aggctatttccactcttctcat

SEQ ID NO: 9061277 - DNA, 22 bp, Homo sapiens
aggctatggtggggccagtggc

SEQ ID NO: 9061278 - DNA, 23 bp, Homo sapiens
aggctagtttgtgactttctttg

SEQ ID NO: 9061279 - DNA, 22 bp, Homo sapiens
aggctagggtaacagatgtggc

SEQ ID NO: 9061280 - DNA, 22 bp, Homo sapiens
aggctagggtaacagatgtggc

SEQ ID NO: 9061281 - DNA, 22 bp, Homo sapiens
aggctaggggcagtgccagcat

SEQ ID NO: 9061282 - DNA, 22 bp, Homo sapiens
aggctaggaatcaagcctttct

SEQ ID NO: 9061283 - DNA, 22 bp, Homo sapiens
aggctaggaacagcccggccct

SEQ ID NO: 9061284 - DNA, 22 bp, Homo sapiens
aggctaggcatgtgctaccaca

SEQ ID NO: 9061285 - DNA, 22 bp, Homo sapiens
aggctaggccttgccctggaac

SEQ ID NO: 9061286 - DNA, 22 bp, Homo sapiens
aggctaggccttgccctggaac

SEQ ID NO: 9061287 - DNA, 22 bp, Homo sapiens
aggctaggctgatgcctcttcc

SEQ ID NO: 9061288 - DNA, 22 bp, Homo sapiens
aggctaggctgatgcctcttcc

SEQ ID NO: 9061289 - DNA, 22 bp, Homo sapiens
acttcaaattttcagaagaaat

SEQ ID NO: 9061290 - DNA, 22 bp, Homo sapiens
acttcaaattttcagaagaaat

SEQ ID NO: 9061291 - DNA, 22 bp, Homo sapiens
acttcagagactttatggtcca

SEQ ID NO: 9061292 - DNA, 22 bp, Homo sapiens
acttcacagatatttatttggt

SEQ ID NO: 9061293 - DNA, 22 bp, Homo sapiens
acttcacagaaattttatgagg

SEQ ID NO: 9061294 - DNA, 22 bp, Homo sapiens
acttcaaatgtgacaatgtgaa

SEQ ID NO: 9061295 - DNA, 22 bp, Homo sapiens
acttcaaatctcttgaaagcaa

SEQ ID NO: 9061296 - DNA, 22 bp, Homo sapiens
acttcaaaatgagtttcctggt

SEQ ID NO: 9061297 - DNA, 22 bp, Homo sapiens
acttcaaacaattaacagagaa

SEQ ID NO: 9061298 - DNA, 22 bp, Homo sapiens
acttagaattaaatatttttgg

SEQ ID NO: 9061299 - DNA, 22 bp, Homo sapiens
actgtgttcaattaaaaagctt

SEQ ID NO: 9061300 - DNA, 22 bp, Homo sapiens
actgtgttcacacttacaaatg

SEQ ID NO: 9061301 - DNA, 22 bp, Homo sapiens
actgtgtggaccactctgaggc

SEQ ID NO: 9061302 - DNA, 22 bp, Homo sapiens
actgtgtgggccgctcactggg

SEQ ID NO: 9061303 - DNA, 22 bp, Homo sapiens
actgtgtgtttgtctagcacag

SEQ ID NO: 9061304 - DNA, 22 bp, Homo sapiens
actgttaagtatgaagtaaggc

SEQ ID NO: 9061305 - DNA, 21 bp, Homo sapiens
actgttaagacgtagctgggg

SEQ ID NO: 9061306 - DNA, 22 bp, Homo sapiens
actgttaattcaatcaacaggt

SEQ ID NO: 9061307 - DNA, 22 bp, Homo sapiens
actgttaacggtatgatgctcg

SEQ ID NO: 9061308 - DNA, 22 bp, Homo sapiens
actgttaagaaggaggatggaa

SEQ ID NO: 9061309 - DNA, 22 bp, Homo sapiens
actgttaaagtaattaattgtc

SEQ ID NO: 9061310 - DNA, 22 bp, Homo sapiens
actgtgtttctgaaacaagagg

SEQ ID NO: 9061311 - DNA, 22 bp, Homo sapiens
actgttaaagtaattaattgtc

SEQ ID NO: 9061312 - DNA, 22 bp, Homo sapiens
actgtgtgccctgacgccaggg

SEQ ID NO: 9061313 - DNA, 20 bp, Homo sapiens
actgtgtgatctggaaagct

SEQ ID NO: 9061314 - DNA, 22 bp, Homo sapiens
actgtgtgctggacatgatgtt

SEQ ID NO: 9061315 - DNA, 22 bp, Homo sapiens
actgtgtgctggacatgatgtt

SEQ ID NO: 9061316 - DNA, 22 bp, Homo sapiens
actgtgtggaaatttgtgaggg

SEQ ID NO: 9061317 - DNA, 22 bp, Homo sapiens
actgtgtcctatttccttgaca

SEQ ID NO: 9061318 - DNA, 22 bp, Homo sapiens
actgtgtcctcatgtggcagaa

SEQ ID NO: 9061319 - DNA, 22 bp, Homo sapiens
actgtgtgaaacatcaatgtgt

SEQ ID NO: 9061320 - DNA, 22 bp, Homo sapiens
acttgcatcttagagactcacc

SEQ ID NO: 9061321 - DNA, 22 bp, Homo sapiens
acttgccccagaattgctgctg

SEQ ID NO: 9061322 - DNA, 22 bp, Homo sapiens
acttgctcaatgcttgaagcca

SEQ ID NO: 9061323 - DNA, 22 bp, Homo sapiens
acttggctgggagagttgaaga

SEQ ID NO: 9061324 - DNA, 22 bp, Homo sapiens
acttggctttagtagtaactga

SEQ ID NO: 9061325 - DNA, 22 bp, Homo sapiens
acttggcaagtatctataaagt

SEQ ID NO: 9061326 - DNA, 21 bp, Homo sapiens
acttggcagaacgcagaaggc

SEQ ID NO: 9061327 - DNA, 22 bp, Homo sapiens
acttcatattgtttccactaga

SEQ ID NO: 9061328 - DNA, 22 bp, Homo sapiens
acttcagtaggtgatatgtgca

SEQ ID NO: 9061329 - DNA, 22 bp, Homo sapiens
acttcattgctaagaacaaggt

SEQ ID NO: 9061330 - DNA, 22 bp, Homo sapiens
acttcattcattttcacgaatg

SEQ ID NO: 9061331 - DNA, 22 bp, Homo sapiens
acttgatttttataataaatgg

SEQ ID NO: 9061332 - DNA, 22 bp, Homo sapiens
acttctttcacaatgtttctag

SEQ ID NO: 9061333 - DNA, 22 bp, Homo sapiens
acttctttcacaatgtttctag

SEQ ID NO: 9061334 - DNA, 22 bp, Homo sapiens
acttgcaaagtgagggagtgtt

SEQ ID NO: 9061335 - DNA, 22 bp, Homo sapiens
acttccagagggtgtggaaata

SEQ ID NO: 9061336 - DNA, 22 bp, Homo sapiens
acttccagaattagaatttaag

SEQ ID NO: 9061337 - DNA, 22 bp, Homo sapiens
agtttacatatttgtcggagtc

SEQ ID NO: 9061338 - DNA, 22 bp, Homo sapiens
agtttacatcttcaatctcatt

SEQ ID NO: 9061339 - DNA, 22 bp, Homo sapiens
agtttacatcttcaatctcatt

SEQ ID NO: 9061340 - DNA, 22 bp, Homo sapiens
agtttacatgacgtgtatttca

SEQ ID NO: 9061341 - DNA, 22 bp, Homo sapiens
agtttacatgacgtgtatttca

SEQ ID NO: 9061342 - DNA, 22 bp, Homo sapiens
agtttagacaaagtcttgcatt

SEQ ID NO: 9061343 - DNA, 22 bp, Homo sapiens
agtttagacaaagtcttgcatt

SEQ ID NO: 9061344 - DNA, 22 bp, Homo sapiens
agtttagaagaggaacttgtta

SEQ ID NO: 9061345 - DNA, 22 bp, Homo sapiens
agtttagaaaatctgtttcttc

SEQ ID NO: 9061346 - DNA, 22 bp, Homo sapiens
actgtaaaagaaggtctttgca

SEQ ID NO: 9061347 - DNA, 22 bp, Homo sapiens
actggttttggaaatcagtaca

SEQ ID NO: 9061348 - DNA, 22 bp, Homo sapiens
actggttttccaggttacttct

SEQ ID NO: 9061349 - DNA, 22 bp, Homo sapiens
actggtttgggacaatttgtgc

SEQ ID NO: 9061350 - DNA, 22 bp, Homo sapiens
actggtttgtctattgtcattc

SEQ ID NO: 9061351 - DNA, 17 bp, Homo sapiens
actggttttggcagcat

SEQ ID NO: 9061352 - DNA, 22 bp, Homo sapiens
actggtttttccatatgagatg

SEQ ID NO: 9061353 - DNA, 22 bp, Homo sapiens
actggtttttctcatgaaaatg

SEQ ID NO: 9061354 - DNA, 22 bp, Homo sapiens
actgtaaaacaggtttcatcat

SEQ ID NO: 9061355 - DNA, 22 bp, Homo sapiens
actggcagtggcagcagaaaga

SEQ ID NO: 9061356 - DNA, 20 bp, Homo sapiens
actggcagcctgcctgctgt

SEQ ID NO: 9061357 - DNA, 20 bp, Homo sapiens
actggcagcctgcctgctgt

SEQ ID NO: 9061358 - DNA, 22 bp, Homo sapiens
actggcaggctgctggccggcg

SEQ ID NO: 9061359 - DNA, 22 bp, Homo sapiens
actggcaggctgctggccggcg

SEQ ID NO: 9061360 - DNA, 22 bp, Homo sapiens
actggcagtgtcgtttacatga

SEQ ID NO: 9061361 - DNA, 22 bp, Homo sapiens
agttgcagccttcaggagaccc

SEQ ID NO: 9061362 - DNA, 22 bp, Homo sapiens
agtttacacttttgattcttat

SEQ ID NO: 9061363 - DNA, 22 bp, Homo sapiens
agtttacactatgaaaagacta

SEQ ID NO: 9061364 - DNA, 22 bp, Homo sapiens
agtttacagttctcatcgcaac

SEQ ID NO: 9061365 - DNA, 22 bp, Homo sapiens
agtttacagatgctacaggagc

SEQ ID NO: 9061366 - DNA, 22 bp, Homo sapiens
agtttacacttttgattcttat

SEQ ID NO: 9061367 - DNA, 22 bp, Homo sapiens
actgtaaaggtgattagaagtt

SEQ ID NO: 9061368 - DNA, 22 bp, Homo sapiens
actgtaaagcttttctcatgcg

SEQ ID NO: 9061369 - DNA, 22 bp, Homo sapiens
actgtaaagaggtgtatcttta

SEQ ID NO: 9061370 - DNA, 22 bp, Homo sapiens
actgtaaattacataagaacag

SEQ ID NO: 9061371 - DNA, 22 bp, Homo sapiens
actgtctgctggcccctggtta

SEQ ID NO: 9061372 - DNA, 22 bp, Homo sapiens
actgtctgtacttcttgcaagg

SEQ ID NO: 9061373 - DNA, 22 bp, Homo sapiens
actgtctgtgccagatgctggg

SEQ ID NO: 9061374 - DNA, 22 bp, Homo sapiens
actgtctgtcctgctctccgtg

SEQ ID NO: 9061375 - DNA, 22 bp, Homo sapiens
actgtgaacggactgaagccca

SEQ ID NO: 9061376 - DNA, 22 bp, Homo sapiens
actgtgaacggactgaagccca

SEQ ID NO: 9061377 - DNA, 22 bp, Homo sapiens
actgtgaatcactactagtaga

SEQ ID NO: 9061378 - DNA, 22 bp, Homo sapiens
agtttccttggattcaatttgg

SEQ ID NO: 9061379 - DNA, 22 bp, Homo sapiens
agtttccttggattcaatttgg

SEQ ID NO: 9061380 - DNA, 22 bp, Homo sapiens
agtttccttgggcatttgttta

SEQ ID NO: 9061381 - DNA, 21 bp, Homo sapiens
actgtgccaggcacaaaaaca

SEQ ID NO: 9061382 - DNA, 22 bp, Homo sapiens
actgtggggttcctggtacttg

SEQ ID NO: 9061383 - DNA, 22 bp, Homo sapiens
actgtgggtcccagctgtgtct

SEQ ID NO: 9061384 - DNA, 22 bp, Homo sapiens
actgtgggtgagggcaaatcaa

SEQ ID NO: 9061385 - DNA, 21 bp, Homo sapiens
actgtgggtctgaccacctgg

SEQ ID NO: 9061386 - DNA, 22 bp, Homo sapiens
agtttcatttcttagtaccagt

SEQ ID NO: 9061387 - DNA, 21 bp, Homo sapiens
actgtgaagatgctataaact

SEQ ID NO: 9061388 - DNA, 22 bp, Homo sapiens
agaaaataaattgatggtggaa

SEQ ID NO: 9061389 - DNA, 22 bp, Homo sapiens
agaaaattagattttactgtgt

SEQ ID NO: 9061390 - DNA, 22 bp, Homo sapiens
atatctttgtttttgccaagat

SEQ ID NO: 9061391 - DNA, 22 bp, Homo sapiens
atatctttcaaagccaaaagta

SEQ ID NO: 9061392 - DNA, 22 bp, Homo sapiens
atatctttcaaagccaaaagta

SEQ ID NO: 9061393 - DNA, 22 bp, Homo sapiens
atatcttttagagcaagcttgt

SEQ ID NO: 9061394 - DNA, 22 bp, Homo sapiens
atatgaaaagaagtcaccattg

SEQ ID NO: 9061395 - DNA, 22 bp, Homo sapiens
atatgaaaatgttttagctgta

SEQ ID NO: 9061396 - DNA, 22 bp, Homo sapiens
agaaacagaaccaggtgtcatt

SEQ ID NO: 9061397 - DNA, 22 bp, Homo sapiens
agaaacaacttgtttctcttgc

SEQ ID NO: 9061398 - DNA, 22 bp, Homo sapiens
agaaaatttaaagagacacaca

SEQ ID NO: 9061399 - DNA, 22 bp, Homo sapiens
agaaacaacttgtttctcttgc

SEQ ID NO: 9061400 - DNA, 22 bp, Homo sapiens
agaaaatttattcatgttagtt

SEQ ID NO: 9061401 - DNA, 22 bp, Homo sapiens
atatattttgaatagcctctgt

SEQ ID NO: 9061402 - DNA, 22 bp, Homo sapiens
atatctggttggtaatataaca

SEQ ID NO: 9061403 - DNA, 22 bp, Homo sapiens
atatctcattaccttgctgttc

SEQ ID NO: 9061404 - DNA, 22 bp, Homo sapiens
atatctaggctgaatgtaaaat

SEQ ID NO: 9061405 - DNA, 22 bp, Homo sapiens
atatcttctttattttgtgagg

SEQ ID NO: 9061406 - DNA, 22 bp, Homo sapiens
atatctgtgtttcccttttgct

SEQ ID NO: 9061407 - DNA, 22 bp, Homo sapiens
atatatttgagaatattcatga

SEQ ID NO: 9061408 - DNA, 22 bp, Homo sapiens
atatatttgagaatattcatga

SEQ ID NO: 9061409 - DNA, 22 bp, Homo sapiens
atatatttactctcctgttgca

SEQ ID NO: 9061410 - DNA, 22 bp, Homo sapiens
atatatttactctcctgttgca

SEQ ID NO: 9061411 - DNA, 22 bp, Homo sapiens
atatatttactctcctgttgca

SEQ ID NO: 9061412 - DNA, 22 bp, Homo sapiens
atatatttgagaatattcatga

SEQ ID NO: 9061413 - DNA, 22 bp, Homo sapiens
atatatttgagaatattcatga

SEQ ID NO: 9061414 - DNA, 22 bp, Homo sapiens
atatacacatctttttaaatat

SEQ ID NO: 9061415 - DNA, 22 bp, Homo sapiens
atatacaaagggcaacctcgct

SEQ ID NO: 9061416 - DNA, 22 bp, Homo sapiens
atataatttttggttagctcaa

SEQ ID NO: 9061417 - DNA, 22 bp, Homo sapiens
atataattctcaggtttgacta

SEQ ID NO: 9061418 - DNA, 22 bp, Homo sapiens
atataatttttggttagctcaa

SEQ ID NO: 9061419 - DNA, 22 bp, Homo sapiens
atataatagtttcataaaggct

SEQ ID NO: 9061420 - DNA, 22 bp, Homo sapiens
atagtttaaggaactatgcgat

SEQ ID NO: 9061421 - DNA, 22 bp, Homo sapiens
atagtttacaaaaatgatgcat

SEQ ID NO: 9061422 - DNA, 22 bp, Homo sapiens
acttgggagggtgtgggcagct

SEQ ID NO: 9061423 - DNA, 22 bp, Homo sapiens
atatattggtgtcagaaagagt

SEQ ID NO: 9061424 - DNA, 22 bp, Homo sapiens
atatataacctggataaggctt

SEQ ID NO: 9061425 - DNA, 22 bp, Homo sapiens
actttgtaaattgttgtgactc

SEQ ID NO: 9061426 - DNA, 22 bp, Homo sapiens
actttgtaggaaaaagtcacaa

SEQ ID NO: 9061427 - DNA, 21 bp, Homo sapiens
actttgggaggtgtgaggggc

SEQ ID NO: 9061428 - DNA, 20 bp, Homo sapiens
agaaacagcacaattctgtt

SEQ ID NO: 9061429 - DNA, 22 bp, Homo sapiens
agaaacagcattagcatcaatt

SEQ ID NO: 9061430 - DNA, 22 bp, Homo sapiens
agaaacagcattagcatcaatt

SEQ ID NO: 9061431 - DNA, 22 bp, Homo sapiens
agaaacagaagggaaagctttt

SEQ ID NO: 9061432 - DNA, 22 bp, Homo sapiens
agaaacatcattgtttggtatt

SEQ ID NO: 9061433 - DNA, 22 bp, Homo sapiens
agaaacatcattgtttggtatt

SEQ ID NO: 9061434 - DNA, 22 bp, Homo sapiens
agaaacatcattggaacacaag

SEQ ID NO: 9061435 - DNA, 22 bp, Homo sapiens
agaaacagcattagcatcaatt

SEQ ID NO: 9061436 - DNA, 22 bp, Homo sapiens
agaaacatcttggcaactggaa

SEQ ID NO: 9061437 - DNA, 22 bp, Homo sapiens
agaaacatcgcttagtcctcat

SEQ ID NO: 9061438 - DNA, 22 bp, Homo sapiens
agaaacatcctgctttccattt

SEQ ID NO: 9061439 - DNA, 22 bp, Homo sapiens
agaaacatttagattatatgtc

SEQ ID NO: 9061440 - DNA, 22 bp, Homo sapiens
atcactggagtgaaaggcaaac

SEQ ID NO: 9061441 - DNA, 22 bp, Homo sapiens
atcactgcacacctgaggtata

SEQ ID NO: 9061442 - DNA, 22 bp, Homo sapiens
atcactgtggaaaactgtatgg

SEQ ID NO: 9061443 - DNA, 22 bp, Homo sapiens
atcactgtgtatgtatatgcag

SEQ ID NO: 9061444 - DNA, 22 bp, Homo sapiens
atcactgtgtatgtatatgcag

SEQ ID NO: 9061445 - DNA, 22 bp, Homo sapiens
atcagagtgtaagttctttcct

SEQ ID NO: 9061446 - DNA, 22 bp, Homo sapiens
atcagagtgggtctggcatgag

SEQ ID NO: 9061447 - DNA, 22 bp, Homo sapiens
atcagagtcagaggctagagct

SEQ ID NO: 9061448 - DNA, 22 bp, Homo sapiens
atcagaggtgttgaaacatgac

SEQ ID NO: 9061449 - DNA, 22 bp, Homo sapiens
atcagaggacctagttgggcag

SEQ ID NO: 9061450 - DNA, 22 bp, Homo sapiens
atcaccaggcaaaatgtcagag

SEQ ID NO: 9061451 - DNA, 23 bp, Homo sapiens
atcaccagcggaagctgcagacc

SEQ ID NO: 9061452 - DNA, 23 bp, Homo sapiens
atcaccagcggaagctgcagacc

SEQ ID NO: 9061453 - DNA, 21 bp, Homo sapiens
atcacattggctgttattatt

SEQ ID NO: 9061454 - DNA, 22 bp, Homo sapiens
atcactgaatgcaaagctggga

SEQ ID NO: 9061455 - DNA, 22 bp, Homo sapiens
atcactatgggcattatattta

SEQ ID NO: 9061456 - DNA, 22 bp, Homo sapiens
atcatttggggaattgtggaca

SEQ ID NO: 9061457 - DNA, 22 bp, Homo sapiens
atccacttgccactgtatagtt

SEQ ID NO: 9061458 - DNA, 22 bp, Homo sapiens
atcattttatggctgagaggac

SEQ ID NO: 9061459 - DNA, 22 bp, Homo sapiens
atccacttggctggttgttcta

SEQ ID NO: 9061460 - DNA, 22 bp, Homo sapiens
atccagcacttgttcatgtgaa

SEQ ID NO: 9061461 - DNA, 23 bp, Homo sapiens
atccagcctgggggtttaaccac

SEQ ID NO: 9061462 - DNA, 22 bp, Homo sapiens
atccagccagtgtggatgactt

SEQ ID NO: 9061463 - DNA, 22 bp, Homo sapiens
atccagcacttgttcatgtgaa

SEQ ID NO: 9061464 - DNA, 19 bp, Homo sapiens
atcagcaaggtaggatgtg

SEQ ID NO: 9061465 - DNA, 19 bp, Homo sapiens
atcagcaaggtaggatgtg

SEQ ID NO: 9061466 - DNA, 22 bp, Homo sapiens
atcatttatgccccaattagat

SEQ ID NO: 9061467 - DNA, 20 bp, Homo sapiens
atcatctttacaatgtcagt

SEQ ID NO: 9061468 - DNA, 22 bp, Homo sapiens
atcattgtaaataatgctgcca

SEQ ID NO: 9061469 - DNA, 22 bp, Homo sapiens
atcattgtaaataatgctgcca

SEQ ID NO: 9061470 - DNA, 22 bp, Homo sapiens
actgcaaagccagatattatca

SEQ ID NO: 9061471 - DNA, 22 bp, Homo sapiens
actgcaaagggaagccctttct

SEQ ID NO: 9061472 - DNA, 22 bp, Homo sapiens
actgcaaagggaagccctttct

SEQ ID NO: 9061473 - DNA, 22 bp, Homo sapiens
actgcaacacctcctgggttca

SEQ ID NO: 9061474 - DNA, 22 bp, Homo sapiens
actgcaacctccacctcctggg

SEQ ID NO: 9061475 - DNA, 22 bp, Homo sapiens
actgcaacacctcctgggttca

SEQ ID NO: 9061476 - DNA, 22 bp, Homo sapiens
actgcaacctccacctcctggg

SEQ ID NO: 9061477 - DNA, 22 bp, Homo sapiens
actgcctgtagctcttcatctc

SEQ ID NO: 9061478 - DNA, 22 bp, Homo sapiens
actgcctgtgcactggtctttt

SEQ ID NO: 9061479 - DNA, 22 bp, Homo sapiens
actgagggttagtggaccgtgt

SEQ ID NO: 9061480 - DNA, 22 bp, Homo sapiens
actgagggtgcacaggcaggca

SEQ ID NO: 9061481 - DNA, 21 bp, Homo sapiens
actgaatgtgtccaagctgag

SEQ ID NO: 9061482 - DNA, 22 bp, Homo sapiens
actgaataatggtctgtgatct

SEQ ID NO: 9061483 - DNA, 22 bp, Homo sapiens
actgaataaggtgaatgctctg

SEQ ID NO: 9061484 - DNA, 22 bp, Homo sapiens
actgaagtccacacatgtagga

SEQ ID NO: 9061485 - DNA, 22 bp, Homo sapiens
actgaagtctcttttgttctct

SEQ ID NO: 9061486 - DNA, 22 bp, Homo sapiens
actgaagtctcttttgttctct

SEQ ID NO: 9061487 - DNA, 22 bp, Homo sapiens
actgaagtgtaggtgttttcct

SEQ ID NO: 9061488 - DNA, 22 bp, Homo sapiens
actgaagtagtcattgtcatta

SEQ ID NO: 9061489 - DNA, 22 bp, Homo sapiens
actgaagtagtcattgtcatta

SEQ ID NO: 9061490 - DNA, 22 bp, Homo sapiens
actgatgtgacagctgagcaga

SEQ ID NO: 9061491 - DNA, 22 bp, Homo sapiens
actgatttcagggatgagaaga

SEQ ID NO: 9061492 - DNA, 22 bp, Homo sapiens
actgattatgcgtactctctac

SEQ ID NO: 9061493 - DNA, 20 bp, Homo sapiens
actgcttctttctctgacct

SEQ ID NO: 9061494 - DNA, 22 bp, Homo sapiens
agtggctgacaactgggttaac

SEQ ID NO: 9061495 - DNA, 22 bp, Homo sapiens
actgcttacaaaaggaaagaat

SEQ ID NO: 9061496 - DNA, 20 bp, Homo sapiens
agtggctgatggaaagaagc

SEQ ID NO: 9061497 - DNA, 22 bp, Homo sapiens
agtggctgagtgactgtgactc

SEQ ID NO: 9061498 - DNA, 22 bp, Homo sapiens
actgctttagacctagagctct

SEQ ID NO: 9061499 - DNA, 23 bp, Homo sapiens
agtggctgagagtgtttcatatg

SEQ ID NO: 9061500 - DNA, 22 bp, Homo sapiens
agtggctgatgtaggcagtggg

SEQ ID NO: 9061501 - DNA, 22 bp, Homo sapiens
agtggctgatgtaggcagtggg

SEQ ID NO: 9061502 - DNA, 20 bp, Homo sapiens
actgctgtagaccatctgca

SEQ ID NO: 9061503 - DNA, 20 bp, Homo sapiens
actgctgtagaccatctgca

SEQ ID NO: 9061504 - DNA, 22 bp, Homo sapiens
agtggctgctgactttaataca

SEQ ID NO: 9061505 - DNA, 22 bp, Homo sapiens
agtggctgctggagtggagatg

SEQ ID NO: 9061506 - DNA, 22 bp, Homo sapiens
agtggctgctggagtggagatg

SEQ ID NO: 9061507 - DNA, 22 bp, Homo sapiens
agtggctgccaagatataattc

SEQ ID NO: 9061508 - DNA, 22 bp, Homo sapiens
agtggctgctatgatcaggaca

SEQ ID NO: 9061509 - DNA, 22 bp, Homo sapiens
agtggctgattacaaactgagt

SEQ ID NO: 9061510 - DNA, 22 bp, Homo sapiens
agtggctgccaagagcaatgct

SEQ ID NO: 9061511 - DNA, 22 bp, Homo sapiens
actggacagaggaaatatggag

SEQ ID NO: 9061512 - DNA, 22 bp, Homo sapiens
actggacagaggaaatatggag

SEQ ID NO: 9061513 - DNA, 22 bp, Homo sapiens
agtggctgcttctggttgctcc

SEQ ID NO: 9061514 - DNA, 22 bp, Homo sapiens
actggatggtgtcatgagcagc

SEQ ID NO: 9061515 - DNA, 22 bp, Homo sapiens
actggatggtgtcatgagcagc

SEQ ID NO: 9061516 - DNA, 22 bp, Homo sapiens
agtctctggactgggagatggc

SEQ ID NO: 9061517 - DNA, 22 bp, Homo sapiens
agtctctggactgggagatggc

SEQ ID NO: 9061518 - DNA, 22 bp, Homo sapiens
agtctctggactgggagatggc

SEQ ID NO: 9061519 - DNA, 22 bp, Homo sapiens
agtctctgcatgatgcagcaca

SEQ ID NO: 9061520 - DNA, 20 bp, Homo sapiens
agtctctgtagtgcctgaga

SEQ ID NO: 9061521 - DNA, 22 bp, Homo sapiens
agtctctggggaggagtggaaa

SEQ ID NO: 9061522 - DNA, 22 bp, Homo sapiens
agtctctggggaggagtggaaa

SEQ ID NO: 9061523 - DNA, 22 bp, Homo sapiens
agtctctgggcatggttgtgac

SEQ ID NO: 9061524 - DNA, 22 bp, Homo sapiens
agtctctgtcgtagatcagcgt

SEQ ID NO: 9061525 - DNA, 22 bp, Homo sapiens
agtctcttaatgggcagaaagt

SEQ ID NO: 9061526 - DNA, 22 bp, Homo sapiens
actccagggctgaacgaggccc

SEQ ID NO: 9061527 - DNA, 22 bp, Homo sapiens
actccagggctgaacgaggccc

SEQ ID NO: 9061528 - DNA, 22 bp, Homo sapiens
actccagggcttctatgatggt

SEQ ID NO: 9061529 - DNA, 22 bp, Homo sapiens
agtctctgaggttcagatgcct

SEQ ID NO: 9061530 - DNA, 22 bp, Homo sapiens
actccacaccacgggggccgcc

SEQ ID NO: 9061531 - DNA, 22 bp, Homo sapiens
actccacaccacgggggccgcc

SEQ ID NO: 9061532 - DNA, 22 bp, Homo sapiens
actccacaccacgggggccgcc

SEQ ID NO: 9061533 - DNA, 22 bp, Homo sapiens
actccaggcatctgcttctgct

SEQ ID NO: 9061534 - DNA, 19 bp, Homo sapiens
actccagggatgacagaag

SEQ ID NO: 9061535 - DNA, 19 bp, Homo sapiens
actccagggatgacagaag

SEQ ID NO: 9061536 - DNA, 22 bp, Homo sapiens
actccagggaggtgagtgtgcg

SEQ ID NO: 9061537 - DNA, 22 bp, Homo sapiens
actccaggatgtagaatcagag

SEQ ID NO: 9061538 - DNA, 22 bp, Homo sapiens
actccaggatgtagaatcagag

SEQ ID NO: 9061539 - DNA, 22 bp, Homo sapiens
actccaggaaacttaggggaaa

SEQ ID NO: 9061540 - DNA, 22 bp, Homo sapiens
actccagagctcacatgtctaa

SEQ ID NO: 9061541 - DNA, 22 bp, Homo sapiens
agtctggggtctggtagaacga

SEQ ID NO: 9061542 - DNA, 22 bp, Homo sapiens
agtctgggtggctgagctacag

SEQ ID NO: 9061543 - DNA, 22 bp, Homo sapiens
agtctgggtgtgaatgaacttg

SEQ ID NO: 9061544 - DNA, 22 bp, Homo sapiens
actcttcagtacaataatatct

SEQ ID NO: 9061545 - DNA, 21 bp, Homo sapiens
agtctggggaagggatcccag

SEQ ID NO: 9061546 - DNA, 22 bp, Homo sapiens
agtctgggagggatgccagtgt

SEQ ID NO: 9061547 - DNA, 22 bp, Homo sapiens
agtctgggagggatgccagtgt

SEQ ID NO: 9061548 - DNA, 22 bp, Homo sapiens
agtctgggctgtctgcaggagt

SEQ ID NO: 9061549 - DNA, 22 bp, Homo sapiens
agtctgggagaaggtgagatta

SEQ ID NO: 9061550 - DNA, 20 bp, Homo sapiens
agtctggcacctattcctgt

SEQ ID NO: 9061551 - DNA, 22 bp, Homo sapiens
agtctggccttgccttgtcgag

SEQ ID NO: 9061552 - DNA, 17 bp, Homo sapiens
agtctgggacctgcgtg

SEQ ID NO: 9061553 - DNA, 22 bp, Homo sapiens
agtctcttacccaagcagaatg

SEQ ID NO: 9061554 - DNA, 23 bp, Homo sapiens
actgaaaggatcctagcagagac

SEQ ID NO: 9061555 - DNA, 22 bp, Homo sapiens
actgaaagaaccttcctgttgc

SEQ ID NO: 9061556 - DNA, 22 bp, Homo sapiens
actgaaacatatatttgagttt

SEQ ID NO: 9061557 - DNA, 22 bp, Homo sapiens
actgaaaatgaattagaaacag

SEQ ID NO: 9061558 - DNA, 22 bp, Homo sapiens
actcttcattcaagtatgcaaa

SEQ ID NO: 9061559 - DNA, 22 bp, Homo sapiens
actcttcatgctatgctcaact

SEQ ID NO: 9061560 - DNA, 22 bp, Homo sapiens
actgaaaatgaattagaaacag

SEQ ID NO: 9061561 - DNA, 22 bp, Homo sapiens
actgaagctgggcgatgcctcc

SEQ ID NO: 9061562 - DNA, 19 bp, Homo sapiens
actgaagcagggactgaaa

SEQ ID NO: 9061563 - DNA, 22 bp, Homo sapiens
actgaagcacatttgccatgaa

SEQ ID NO: 9061564 - DNA, 17 bp, Homo sapiens
actgaagcatttatgat

SEQ ID NO: 9061565 - DNA, 22 bp, Homo sapiens
actgaaggaaagcctttgcatg

SEQ ID NO: 9061566 - DNA, 22 bp, Homo sapiens
actgaaggctttcccaaggtca

SEQ ID NO: 9061567 - DNA, 22 bp, Homo sapiens
actgaagagcgtgctatgctca

SEQ ID NO: 9061568 - DNA, 22 bp, Homo sapiens
actgaagaacgcatcagtggtt

SEQ ID NO: 9061569 - DNA, 22 bp, Homo sapiens
acctgccttctcaaggacatga

SEQ ID NO: 9061570 - DNA, 22 bp, Homo sapiens
acctgccttctcaaggacatga

SEQ ID NO: 9061571 - DNA, 22 bp, Homo sapiens
acctgccttctcaaggacatga

SEQ ID NO: 9061572 - DNA, 22 bp, Homo sapiens
acctggagaaagcctctccctg

SEQ ID NO: 9061573 - DNA, 22 bp, Homo sapiens
acctggacacctgctgtcatct

SEQ ID NO: 9061574 - DNA, 22 bp, Homo sapiens
acctggagatccatggtgtcga

SEQ ID NO: 9061575 - DNA, 22 bp, Homo sapiens
aggtacagtagacagacagtta

SEQ ID NO: 9061576 - DNA, 22 bp, Homo sapiens
acctgtgcaaagactggtcagg

SEQ ID NO: 9061577 - DNA, 22 bp, Homo sapiens
aggtagcgcaatttcctgggac

SEQ ID NO: 9061578 - DNA, 22 bp, Homo sapiens
aggtactaccagggattttcag

SEQ ID NO: 9061579 - DNA, 22 bp, Homo sapiens
agggtgtgttctcctatgagaa

SEQ ID NO: 9061580 - DNA, 22 bp, Homo sapiens
agggtgtgctgttgggtctttc

SEQ ID NO: 9061581 - DNA, 22 bp, Homo sapiens
agggtggttcttttagtggaag

SEQ ID NO: 9061582 - DNA, 22 bp, Homo sapiens
acctcccagctctgagcttggg

SEQ ID NO: 9061583 - DNA, 22 bp, Homo sapiens
acctcccagctctgagcttggg

SEQ ID NO: 9061584 - DNA, 22 bp, Homo sapiens
acctcccagctctgagcttggg

SEQ ID NO: 9061585 - DNA, 22 bp, Homo sapiens
agggtggggtgctacatcttta

SEQ ID NO: 9061586 - DNA, 22 bp, Homo sapiens
agggtggggtgctacatcttta

SEQ ID NO: 9061587 - DNA, 22 bp, Homo sapiens
agggtggtggcgatgaggacat

SEQ ID NO: 9061588 - DNA, 22 bp, Homo sapiens
acctcccctcaccaatctggtt

SEQ ID NO: 9061589 - DNA, 22 bp, Homo sapiens
acctcccctgactcgaaaccca

SEQ ID NO: 9061590 - DNA, 22 bp, Homo sapiens
acctccccgggagcagcctcct

SEQ ID NO: 9061591 - DNA, 22 bp, Homo sapiens
acctccccgggagcagcctcct

SEQ ID NO: 9061592 - DNA, 22 bp, Homo sapiens
acctccccattaggtcacccac

SEQ ID NO: 9061593 - DNA, 18 bp, Homo sapiens
acctccccattttctgaa

SEQ ID NO: 9061594 - DNA, 18 bp, Homo sapiens
acctccccattttctgaa

SEQ ID NO: 9061595 - DNA, 22 bp, Homo sapiens
acctccccattaggtcacccac

SEQ ID NO: 9061596 - DNA, 22 bp, Homo sapiens
acctccccattaggtcacccac

SEQ ID NO: 9061597 - DNA, 22 bp, Homo sapiens
acctccccacatggtagtgagt

SEQ ID NO: 9061598 - DNA, 22 bp, Homo sapiens
agggctttcggcactctgaggg

SEQ ID NO: 9061599 - DNA, 22 bp, Homo sapiens
agggctttcggcactctgaggg

SEQ ID NO: 9061600 - DNA, 22 bp, Homo sapiens
agggctttacttctcagttcta

SEQ ID NO: 9061601 - DNA, 22 bp, Homo sapiens
agggctttaatgattattttct

SEQ ID NO: 9061602 - DNA, 22 bp, Homo sapiens
agggcttgtagggtggctgtag

SEQ ID NO: 9061603 - DNA, 22 bp, Homo sapiens
agggcttgtggtcgtggctgtg

SEQ ID NO: 9061604 - DNA, 22 bp, Homo sapiens
agggcttgttaacatagagatt

SEQ ID NO: 9061605 - DNA, 20 bp, Homo sapiens
agggtggggacgttctgact

SEQ ID NO: 9061606 - DNA, 20 bp, Homo sapiens
agggtggggacgttctgact

SEQ ID NO: 9061607 - DNA, 22 bp, Homo sapiens
agggtgggctagactcttcccc

SEQ ID NO: 9061608 - DNA, 22 bp, Homo sapiens
agggctggtatgtccatgaaag

SEQ ID NO: 9061609 - DNA, 22 bp, Homo sapiens
agggctggtatgtccatgaaag

SEQ ID NO: 9061610 - DNA, 22 bp, Homo sapiens
agggctgtttttggcacctggg

SEQ ID NO: 9061611 - DNA, 22 bp, Homo sapiens
actaaatagttttgacagaaca

SEQ ID NO: 9061612 - DNA, 22 bp, Homo sapiens
actaaatagttttgacagaaca

SEQ ID NO: 9061613 - DNA, 22 bp, Homo sapiens
actaaatagttttgacagaaca

SEQ ID NO: 9061614 - DNA, 22 bp, Homo sapiens
actaaagtcctgttgtagcata

SEQ ID NO: 9061615 - DNA, 22 bp, Homo sapiens
actaaagtcatcaaagaacttt

SEQ ID NO: 9061616 - DNA, 22 bp, Homo sapiens
actaaagtgttggagaatgagg

SEQ ID NO: 9061617 - DNA, 22 bp, Homo sapiens
actatgaatagccagatagtga

SEQ ID NO: 9061618 - DNA, 22 bp, Homo sapiens
actatatgtgaaggtagaattt

SEQ ID NO: 9061619 - DNA, 22 bp, Homo sapiens
actatagctcgggttataatgt

SEQ ID NO: 9061620 - DNA, 22 bp, Homo sapiens
actcaacagggaacaagatcag

SEQ ID NO: 9061621 - DNA, 22 bp, Homo sapiens
actcaaatttgtcaactgaagc

SEQ ID NO: 9061622 - DNA, 22 bp, Homo sapiens
actcaaatagctgcccctagtg

SEQ ID NO: 9061623 - DNA, 20 bp, Homo sapiens
actcaaatcacctgcctcaa

SEQ ID NO: 9061624 - DNA, 23 bp, Homo sapiens
actcaaatttcgcttggagttca

SEQ ID NO: 9061625 - DNA, 19 bp, Homo sapiens
actcaagtctaatgaaatc

SEQ ID NO: 9061626 - DNA, 22 bp, Homo sapiens
actatttactcaaatgaggttg

SEQ ID NO: 9061627 - DNA, 22 bp, Homo sapiens
actcaaatagcaacggtgagaa

SEQ ID NO: 9061628 - DNA, 22 bp, Homo sapiens
actattcacctttcatgcagga

SEQ ID NO: 9061629 - DNA, 22 bp, Homo sapiens
actattcacctttcatgcagga

SEQ ID NO: 9061630 - DNA, 22 bp, Homo sapiens
actattcaagtgctcattcaga

SEQ ID NO: 9061631 - DNA, 22 bp, Homo sapiens
actattcacagattcagtgttc

SEQ ID NO: 9061632 - DNA, 22 bp, Homo sapiens
actatttactcaaatgaggttg

SEQ ID NO: 9061633 - DNA, 22 bp, Homo sapiens
actattgcttagagcaatgggg

SEQ ID NO: 9061634 - DNA, 22 bp, Homo sapiens
actattgcaatacgtgtcagca

SEQ ID NO: 9061635 - DNA, 19 bp, Homo sapiens
actcagggaaaggagaatt

SEQ ID NO: 9061636 - DNA, 18 bp, Homo sapiens
actcacagcagaagaagg

SEQ ID NO: 9061637 - DNA, 22 bp, Homo sapiens
accttaaaactgacacatggag

SEQ ID NO: 9061638 - DNA, 22 bp, Homo sapiens
acctgtttacctgcacctgttt

SEQ ID NO: 9061639 - DNA, 22 bp, Homo sapiens
acctgttttcagaaaatgcaga

SEQ ID NO: 9061640 - DNA, 22 bp, Homo sapiens
acctgttttagtctttaatcat

SEQ ID NO: 9061641 - DNA, 22 bp, Homo sapiens
accttcaggtgagcacacagat

SEQ ID NO: 9061642 - DNA, 21 bp, Homo sapiens
accttcagtgttctcagctgc

SEQ ID NO: 9061643 - DNA, 22 bp, Homo sapiens
accttcacctccacaccttggg

SEQ ID NO: 9061644 - DNA, 22 bp, Homo sapiens
accttcagacatcaactatctc

SEQ ID NO: 9061645 - DNA, 22 bp, Homo sapiens
accttcaactcaaagtgtccca

SEQ ID NO: 9061646 - DNA, 22 bp, Homo sapiens
accttcaagtatgtgggctgaa

SEQ ID NO: 9061647 - DNA, 22 bp, Homo sapiens
accttcaagattgtgggtcaat

SEQ ID NO: 9061648 - DNA, 22 bp, Homo sapiens
accttcaagaaacatttccttg

SEQ ID NO: 9061649 - DNA, 21 bp, Homo sapiens
accttcaagccagaggtggtc

SEQ ID NO: 9061650 - DNA, 22 bp, Homo sapiens
actaaaaactactgccaatagc

SEQ ID NO: 9061651 - DNA, 22 bp, Homo sapiens
acgtttgctttctttggcctgg

SEQ ID NO: 9061652 - DNA, 22 bp, Homo sapiens
acgtttgctttctttggcctgg

SEQ ID NO: 9061653 - DNA, 22 bp, Homo sapiens
actaaactgaagcatgaaaagg

SEQ ID NO: 9061654 - DNA, 22 bp, Homo sapiens
actaaactgcacagatgggtca

SEQ ID NO: 9061655 - DNA, 22 bp, Homo sapiens
actaaagtcagactgcattgat

SEQ ID NO: 9061656 - DNA, 22 bp, Homo sapiens
actaaagtatggaagtgaataa

SEQ ID NO: 9061657 - DNA, 19 bp, Homo sapiens
actaaaaatgatgtttgag

SEQ ID NO: 9061658 - DNA, 19 bp, Homo sapiens
actaaaaatgatgtttgag

SEQ ID NO: 9061659 - DNA, 22 bp, Homo sapiens
actaaaacatagccagtcagtg

SEQ ID NO: 9061660 - DNA, 22 bp, Homo sapiens
actaaaacagtggctagtagac

SEQ ID NO: 9061661 - DNA, 22 bp, Homo sapiens
atggtttgtgtggcccagatga

SEQ ID NO: 9061662 - DNA, 20 bp, Homo sapiens
atgtaaaagacagggagtag

SEQ ID NO: 9061663 - DNA, 22 bp, Homo sapiens
atggtttgtaacccaatactcc

SEQ ID NO: 9061664 - DNA, 22 bp, Homo sapiens
atgggtggccccgtgtgcagtc

SEQ ID NO: 9061665 - DNA, 20 bp, Homo sapiens
atgtaaaattataaggctga

SEQ ID NO: 9061666 - DNA, 22 bp, Homo sapiens
atgtaaaagattattttcctgt

SEQ ID NO: 9061667 - DNA, 20 bp, Homo sapiens
atgtaaaagacagggagtag

SEQ ID NO: 9061668 - DNA, 22 bp, Homo sapiens
atgtaaaagattattttcctgt

SEQ ID NO: 9061669 - DNA, 22 bp, Homo sapiens
atgggaggaaggaggcccttga

SEQ ID NO: 9061670 - DNA, 22 bp, Homo sapiens
atgggaggatcacttgaggcca

SEQ ID NO: 9061671 - DNA, 22 bp, Homo sapiens
atgggaggatcacttgaggcca

SEQ ID NO: 9061672 - DNA, 22 bp, Homo sapiens
atgggaggatcacttgaggcca

SEQ ID NO: 9061673 - DNA, 22 bp, Homo sapiens
atgggaggatcacttgaggcca

SEQ ID NO: 9061674 - DNA, 22 bp, Homo sapiens
atgggaggaaggaggcccttga

SEQ ID NO: 9061675 - DNA, 22 bp, Homo sapiens
atgggaggaagagaagatgtct

SEQ ID NO: 9061676 - DNA, 22 bp, Homo sapiens
atgggaggaagagaagatgtct

SEQ ID NO: 9061677 - DNA, 22 bp, Homo sapiens
atgggaggaagagaagatgtct

SEQ ID NO: 9061678 - DNA, 22 bp, Homo sapiens
atgggaggcagcagagcccagc

SEQ ID NO: 9061679 - DNA, 22 bp, Homo sapiens
atgggaggcaggctcagaaccg

SEQ ID NO: 9061680 - DNA, 22 bp, Homo sapiens
atgggaggcagacactaagttc

SEQ ID NO: 9061681 - DNA, 22 bp, Homo sapiens
atgggaggcagacactaagttc

SEQ ID NO: 9061682 - DNA, 22 bp, Homo sapiens
atgggaggcagacactaagttc

SEQ ID NO: 9061683 - DNA, 22 bp, Homo sapiens
atgggaggcagcagagcccagc

SEQ ID NO: 9061684 - DNA, 22 bp, Homo sapiens
atgggaggcagcagagcccagc

SEQ ID NO: 9061685 - DNA, 22 bp, Homo sapiens
atgggaggcaaagatcgcagaa

SEQ ID NO: 9061686 - DNA, 22 bp, Homo sapiens
atgggaggcaaagatcgcagaa

SEQ ID NO: 9061687 - DNA, 22 bp, Homo sapiens
atgggaggcaaagatcgcagaa

SEQ ID NO: 9061688 - DNA, 22 bp, Homo sapiens
atgggaggcaaagatcgcagaa

SEQ ID NO: 9061689 - DNA, 22 bp, Homo sapiens
atgggaggatgctcgggtgctc

SEQ ID NO: 9061690 - DNA, 22 bp, Homo sapiens
atgggaggatgctcgggtgctc

SEQ ID NO: 9061691 - DNA, 22 bp, Homo sapiens
atgggaggatgctcgggtgctc

SEQ ID NO: 9061692 - DNA, 22 bp, Homo sapiens
atgtccaggaagtcttaactca

SEQ ID NO: 9061693 - DNA, 22 bp, Homo sapiens
atgtcccaagatacagctagag

SEQ ID NO: 9061694 - DNA, 22 bp, Homo sapiens
atgtacagccacttcacagtta

SEQ ID NO: 9061695 - DNA, 22 bp, Homo sapiens
atgtacaggatggtgctcatct

SEQ ID NO: 9061696 - DNA, 22 bp, Homo sapiens
atgtacagtttctagactcaaa

SEQ ID NO: 9061697 - DNA, 22 bp, Homo sapiens
atgtacagtggaaactaacaaa

SEQ ID NO: 9061698 - DNA, 22 bp, Homo sapiens
atgtacagtgataagagggcag

SEQ ID NO: 9061699 - DNA, 22 bp, Homo sapiens
atgtccaatttcagagtctcat

SEQ ID NO: 9061700 - DNA, 22 bp, Homo sapiens
atgtcaaatcagttttatcaga

SEQ ID NO: 9061701 - DNA, 22 bp, Homo sapiens
atgtcaaatcagttttatcaga

SEQ ID NO: 9061702 - DNA, 22 bp, Homo sapiens
atgtcaaatgctgcaaactcat

SEQ ID NO: 9061703 - DNA, 22 bp, Homo sapiens
atgtccagagtgtcctggaaag

SEQ ID NO: 9061704 - DNA, 22 bp, Homo sapiens
atggcagcagctttagctgtgg

SEQ ID NO: 9061705 - DNA, 22 bp, Homo sapiens
atggcagcatagtggcaagtta

SEQ ID NO: 9061706 - DNA, 22 bp, Homo sapiens
atggcagcaaatgtctggctgg

SEQ ID NO: 9061707 - DNA, 22 bp, Homo sapiens
atggctgggatttcctttgcgt

SEQ ID NO: 9061708 - DNA, 22 bp, Homo sapiens
atggctggtgatactggagtga

SEQ ID NO: 9061709 - DNA, 22 bp, Homo sapiens
atggctggtctcccatggaaaa

SEQ ID NO: 9061710 - DNA, 22 bp, Homo sapiens
atggctggtgatactggagtga

SEQ ID NO: 9061711 - DNA, 22 bp, Homo sapiens
atggagtttggggtcaaatact

SEQ ID NO: 9061712 - DNA, 22 bp, Homo sapiens
atggataaatacttggtggtat

SEQ ID NO: 9061713 - DNA, 22 bp, Homo sapiens
atggataatcatgaactttgag

SEQ ID NO: 9061714 - DNA, 22 bp, Homo sapiens
atggataagtcaaagagtatcc

SEQ ID NO: 9061715 - DNA, 22 bp, Homo sapiens
atggataagtcaaagagtatcc

SEQ ID NO: 9061716 - DNA, 22 bp, Homo sapiens
atggagttctgccagcgctgct

SEQ ID NO: 9061717 - DNA, 22 bp, Homo sapiens
atggagtggggactgcagtgga

SEQ ID NO: 9061718 - DNA, 22 bp, Homo sapiens
atggaaatatctttagagctta

SEQ ID NO: 9061719 - DNA, 22 bp, Homo sapiens
atggaaatatctttagagctta

SEQ ID NO: 9061720 - DNA, 22 bp, Homo sapiens
atggaaatccaagtcaccgtag

SEQ ID NO: 9061721 - DNA, 22 bp, Homo sapiens
agactccaggagggaggctgct

SEQ ID NO: 9061722 - DNA, 23 bp, Homo sapiens
agactctgagagtgtgctttgca

SEQ ID NO: 9061723 - DNA, 22 bp, Homo sapiens
agactctgagacatgaaccatc

SEQ ID NO: 9061724 - DNA, 22 bp, Homo sapiens
agactattacctaaaagataca

SEQ ID NO: 9061725 - DNA, 22 bp, Homo sapiens
agactattttgtgataactaat

SEQ ID NO: 9061726 - DNA, 20 bp, Homo sapiens
agactcagtttctatgctct

SEQ ID NO: 9061727 - DNA, 22 bp, Homo sapiens
agactacatatgccacatgaag

SEQ ID NO: 9061728 - DNA, 19 bp, Homo sapiens
atggaaaattgtactcaat

SEQ ID NO: 9061729 - DNA, 19 bp, Homo sapiens
atggaaaattgtactcaat

SEQ ID NO: 9061730 - DNA, 19 bp, Homo sapiens
atggaaaatgccagactga

SEQ ID NO: 9061731 - DNA, 19 bp, Homo sapiens
atggaaaatgccagactga

SEQ ID NO: 9061732 - DNA, 19 bp, Homo sapiens
atggaaaatgccagactga

SEQ ID NO: 9061733 - DNA, 22 bp, Homo sapiens
atggaaaaggctgatttcatta

SEQ ID NO: 9061734 - DNA, 22 bp, Homo sapiens
atggaaaagggtctttcatttc

SEQ ID NO: 9061735 - DNA, 22 bp, Homo sapiens
atggaaaagggtctttcatttc

SEQ ID NO: 9061736 - DNA, 22 bp, Homo sapiens
atggaaatacagccagagcaga

SEQ ID NO: 9061737 - DNA, 22 bp, Homo sapiens
atggaaagccagtgttccatca

SEQ ID NO: 9061738 - DNA, 22 bp, Homo sapiens
atgcagggattaaatgactgcc

SEQ ID NO: 9061739 - DNA, 22 bp, Homo sapiens
atgcttgcccatgtttctgaag

SEQ ID NO: 9061740 - DNA, 22 bp, Homo sapiens
atgcttgcccatgtttctgaag

SEQ ID NO: 9061741 - DNA, 22 bp, Homo sapiens
atgcttggatgctgccatggga

SEQ ID NO: 9061742 - DNA, 22 bp, Homo sapiens
atgcttggatgctgccatggga

SEQ ID NO: 9061743 - DNA, 21 bp, Homo sapiens
atgcaggctgctcagaagcaa

SEQ ID NO: 9061744 - DNA, 21 bp, Homo sapiens
atgcaggctgctcagaagcaa

SEQ ID NO: 9061745 - DNA, 22 bp, Homo sapiens
atgcaggcagacactgtgggca

SEQ ID NO: 9061746 - DNA, 22 bp, Homo sapiens
agacagtgatggacaggcagac

SEQ ID NO: 9061747 - DNA, 22 bp, Homo sapiens
agacaggcatgaggctggattg

SEQ ID NO: 9061748 - DNA, 22 bp, Homo sapiens
agacacaggtgtaatttctgct

SEQ ID NO: 9061749 - DNA, 22 bp, Homo sapiens
agacacagtacttgccctcatg

SEQ ID NO: 9061750 - DNA, 22 bp, Homo sapiens
agacacagtataagcacaacaa

SEQ ID NO: 9061751 - DNA, 22 bp, Homo sapiens
agacacagtctgtctggaggag

SEQ ID NO: 9061752 - DNA, 22 bp, Homo sapiens
agacacagtctgtctggaggag

SEQ ID NO: 9061753 - DNA, 22 bp, Homo sapiens
agacacagctgcaggaggtggg

SEQ ID NO: 9061754 - DNA, 22 bp, Homo sapiens
agacacagctaccataatacca

SEQ ID NO: 9061755 - DNA, 22 bp, Homo sapiens
agacacagctaccataatacca

SEQ ID NO: 9061756 - DNA, 22 bp, Homo sapiens
agacacagcagtgcctgcctca

SEQ ID NO: 9061757 - DNA, 22 bp, Homo sapiens
agacaggcagcagatggagtgt

SEQ ID NO: 9061758 - DNA, 22 bp, Homo sapiens
agacacagtttgggatgggttg

SEQ ID NO: 9061759 - DNA, 22 bp, Homo sapiens
agacacagtgctgggtgctgag

SEQ ID NO: 9061760 - DNA, 19 bp, Homo sapiens
agacacacttgatatgtgt

SEQ ID NO: 9061761 - DNA, 22 bp, Homo sapiens
agacacagaacacaaaagcata

SEQ ID NO: 9061762 - DNA, 22 bp, Homo sapiens
agacaatatataattttagttg

SEQ ID NO: 9061763 - DNA, 22 bp, Homo sapiens
agacaatttttggttttgcaag

SEQ ID NO: 9061764 - DNA, 22 bp, Homo sapiens
agacacagcaataactactgtt

SEQ ID NO: 9061765 - DNA, 21 bp, Homo sapiens
agaattaaattggatttgtgt

SEQ ID NO: 9061766 - DNA, 22 bp, Homo sapiens
agaatgataatgccatgatgga

SEQ ID NO: 9061767 - DNA, 20 bp, Homo sapiens
agaatcagagtggaaaggaa

SEQ ID NO: 9061768 - DNA, 22 bp, Homo sapiens
agaatcaggaagacagcctggc

SEQ ID NO: 9061769 - DNA, 22 bp, Homo sapiens
agaatcaggaagacagcctggc

SEQ ID NO: 9061770 - DNA, 22 bp, Homo sapiens
agaatgcatctaaaagcagaga

SEQ ID NO: 9061771 - DNA, 22 bp, Homo sapiens
agaatgtgttattagagaagga

SEQ ID NO: 9061772 - DNA, 22 bp, Homo sapiens
agaatgttttcatgagaatgaa

SEQ ID NO: 9061773 - DNA, 22 bp, Homo sapiens
agaatgttgatagcacctattt

SEQ ID NO: 9061774 - DNA, 22 bp, Homo sapiens
agaatgctcttcaaaatctagc

SEQ ID NO: 9061775 - DNA, 22 bp, Homo sapiens
agaatgtcaacagcctctcaag

SEQ ID NO: 9061776 - DNA, 22 bp, Homo sapiens
agaagagaaatagtgccactgt

SEQ ID NO: 9061777 - DNA, 22 bp, Homo sapiens
agaagacagagtctacattcta

SEQ ID NO: 9061778 - DNA, 22 bp, Homo sapiens
agaagaatttctctcatgattt

SEQ ID NO: 9061779 - DNA, 22 bp, Homo sapiens
agaagagaactgccaaacactt

SEQ ID NO: 9061780 - DNA, 22 bp, Homo sapiens
agaagaatacttgatgttcatg

SEQ ID NO: 9061781 - DNA, 22 bp, Homo sapiens
agaagaatacttgatgttcatg

SEQ ID NO: 9061782 - DNA, 22 bp, Homo sapiens
agaagaatacttgatgttcatg

SEQ ID NO: 9061783 - DNA, 22 bp, Homo sapiens
agaagaaatgtgaaggccactg

SEQ ID NO: 9061784 - DNA, 21 bp, Homo sapiens
agaagagaagcaggaccctct

SEQ ID NO: 9061785 - DNA, 22 bp, Homo sapiens
agaagagccactgttgacggca

SEQ ID NO: 9061786 - DNA, 22 bp, Homo sapiens
agaagagccctttaagggggaa

SEQ ID NO: 9061787 - DNA, 22 bp, Homo sapiens
agaagagcctggggaccatggc

SEQ ID NO: 9061788 - DNA, 22 bp, Homo sapiens
agaagagcctggggaccatggc

SEQ ID NO: 9061789 - DNA, 22 bp, Homo sapiens
agaagattattagagactttgt

SEQ ID NO: 9061790 - DNA, 22 bp, Homo sapiens
agaagatgttgcagttgatgcg

SEQ ID NO: 9061791 - DNA, 22 bp, Homo sapiens
agaagatgactttggagttgga

SEQ ID NO: 9061792 - DNA, 22 bp, Homo sapiens
agaagatgtcactgcagacagc

SEQ ID NO: 9061793 - DNA, 20 bp, Homo sapiens
agaagaggatacaaccaggc

SEQ ID NO: 9061794 - DNA, 20 bp, Homo sapiens
agaagaggatacaaccaggc

SEQ ID NO: 9061795 - DNA, 22 bp, Homo sapiens
atcttattgctgttgccagata

SEQ ID NO: 9061796 - DNA, 22 bp, Homo sapiens
agaagcacaccagtagacaggg

SEQ ID NO: 9061797 - DNA, 18 bp, Homo sapiens
agaagcacaagatgtctt

SEQ ID NO: 9061798 - DNA, 22 bp, Homo sapiens
agaagcacaggtaaagtgattt

SEQ ID NO: 9061799 - DNA, 22 bp, Homo sapiens
agaagcaaggtctgtcagtata

SEQ ID NO: 9061800 - DNA, 22 bp, Homo sapiens
agaagcaaggtctgtcagtata

SEQ ID NO: 9061801 - DNA, 23 bp, Homo sapiens
agaagcaatgctttttttcctct

SEQ ID NO: 9061802 - DNA, 22 bp, Homo sapiens
agaaggcatcagaagtgtgtag

SEQ ID NO: 9061803 - DNA, 22 bp, Homo sapiens
agaaggcatcagaagtgtgtag

SEQ ID NO: 9061804 - DNA, 20 bp, Homo sapiens
agaaggcattcctcattctt

SEQ ID NO: 9061805 - DNA, 20 bp, Homo sapiens
agaaggcattcctcattctt

SEQ ID NO: 9061806 - DNA, 20 bp, Homo sapiens
agaaggcattcctcattctt

SEQ ID NO: 9061807 - DNA, 22 bp, Homo sapiens
agaaggccaagaagaagcctat

SEQ ID NO: 9061808 - DNA, 22 bp, Homo sapiens
agaaggccaagaagaagcctat

SEQ ID NO: 9061809 - DNA, 22 bp, Homo sapiens
agaaggccaatagggtgcactg

SEQ ID NO: 9061810 - DNA, 22 bp, Homo sapiens
agaaggccaatagggtgcactg

SEQ ID NO: 9061811 - DNA, 22 bp, Homo sapiens
agaaggccagatggacggggct

SEQ ID NO: 9061812 - DNA, 22 bp, Homo sapiens
agaaggccagaaaattccttta

SEQ ID NO: 9061813 - DNA, 22 bp, Homo sapiens
agaaggctaaagaaacagattg

SEQ ID NO: 9061814 - DNA, 22 bp, Homo sapiens
agaaggctaaagaaacagattg

SEQ ID NO: 9061815 - DNA, 22 bp, Homo sapiens
agaaggctcactaagagtgact

SEQ ID NO: 9061816 - DNA, 22 bp, Homo sapiens
agaaggctcatccctcacccca

SEQ ID NO: 9061817 - DNA, 22 bp, Homo sapiens
agaaggccctgtgtggtctgag

SEQ ID NO: 9061818 - DNA, 22 bp, Homo sapiens
agaaggccagatggacggggct

SEQ ID NO: 9061819 - DNA, 22 bp, Homo sapiens
agaaggccatgtcttggtactt

SEQ ID NO: 9061820 - DNA, 22 bp, Homo sapiens
agaaggcctaacttgggggcaa

SEQ ID NO: 9061821 - DNA, 22 bp, Homo sapiens
agaaggccccatgaacactgca

SEQ ID NO: 9061822 - DNA, 22 bp, Homo sapiens
agaaggcctaacttgggggcaa

SEQ ID NO: 9061823 - DNA, 22 bp, Homo sapiens
agaaggcctaacttgggggcaa

SEQ ID NO: 9061824 - DNA, 22 bp, Homo sapiens
agaaggcctagagtaagacatt

SEQ ID NO: 9061825 - DNA, 21 bp, Homo sapiens
agaataatggtatcatttgct

SEQ ID NO: 9061826 - DNA, 22 bp, Homo sapiens
agaatacaattgttcagtaata

SEQ ID NO: 9061827 - DNA, 22 bp, Homo sapiens
agaatacagtatgcaaaaagat

SEQ ID NO: 9061828 - DNA, 23 bp, Homo sapiens
agaatacaggctttgtataggca

SEQ ID NO: 9061829 - DNA, 23 bp, Homo sapiens
agaatacaggctttgtataggca

SEQ ID NO: 9061830 - DNA, 22 bp, Homo sapiens
agaatacagtaggagcctgggc

SEQ ID NO: 9061831 - DNA, 22 bp, Homo sapiens
agaatacaattgttcagtaata

SEQ ID NO: 9061832 - DNA, 22 bp, Homo sapiens
agaatacaattgttcagtaata

SEQ ID NO: 9061833 - DNA, 22 bp, Homo sapiens
agaaggctcatttgactgcatt

SEQ ID NO: 9061834 - DNA, 22 bp, Homo sapiens
agaaggctcatttgactgcatt

SEQ ID NO: 9061835 - DNA, 19 bp, Homo sapiens
agaaggctcctgttggaga

SEQ ID NO: 9061836 - DNA, 22 bp, Homo sapiens
agaaggctggccatggtgccct

SEQ ID NO: 9061837 - DNA, 22 bp, Homo sapiens
atctttgtgctaatgtagttct

SEQ ID NO: 9061838 - DNA, 22 bp, Homo sapiens
atctttgtgctaatgtagttct

SEQ ID NO: 9061839 - DNA, 22 bp, Homo sapiens
agaatcaattcactgctgcagc

SEQ ID NO: 9061840 - DNA, 22 bp, Homo sapiens
atctttggtcttgagtgcatct

SEQ ID NO: 9061841 - DNA, 22 bp, Homo sapiens
agaatcagatgaagactcctgc

SEQ ID NO: 9061842 - DNA, 20 bp, Homo sapiens
atctttgtctctgtagttgt

SEQ ID NO: 9061843 - DNA, 20 bp, Homo sapiens
atctttgtctctgtagttgt

SEQ ID NO: 9061844 - DNA, 22 bp, Homo sapiens
atctttgtcactctactgtcta

SEQ ID NO: 9061845 - DNA, 22 bp, Homo sapiens
atctttggtcttgagtgcatct

SEQ ID NO: 9061846 - DNA, 22 bp, Homo sapiens
atctttggtactattcttatca

SEQ ID NO: 9061847 - DNA, 22 bp, Homo sapiens
agaatacatctagtgctgcatg

SEQ ID NO: 9061848 - DNA, 22 bp, Homo sapiens
agaatacatctagtgctgcatg

SEQ ID NO: 9061849 - DNA, 22 bp, Homo sapiens
agaatacagtatgcaaaaagat

SEQ ID NO: 9061850 - DNA, 22 bp, Homo sapiens
agaatacagttcagtaatggat

SEQ ID NO: 9061851 - DNA, 22 bp, Homo sapiens
agaatacagtatgcaaaaagat

SEQ ID NO: 9061852 - DNA, 22 bp, Homo sapiens
agaatataaagataattctgtt

SEQ ID NO: 9061853 - DNA, 22 bp, Homo sapiens
agaatacccatcccttcaactc

SEQ ID NO: 9061854 - DNA, 22 bp, Homo sapiens
agaataccataatatagaaaga

SEQ ID NO: 9061855 - DNA, 22 bp, Homo sapiens
atgtgtcttggagttttaatgt

SEQ ID NO: 9061856 - DNA, 22 bp, Homo sapiens
atgtgtgctcttgagccttcac

SEQ ID NO: 9061857 - DNA, 22 bp, Homo sapiens
atgtgtgtaaacaagtataatt

SEQ ID NO: 9061858 - DNA, 22 bp, Homo sapiens
atgtgtgtacacacgtgactct

SEQ ID NO: 9061859 - DNA, 22 bp, Homo sapiens
atgtgtgtaaacaagtataatt

SEQ ID NO: 9061860 - DNA, 20 bp, Homo sapiens
atgttaaatagcatttagag

SEQ ID NO: 9061861 - DNA, 22 bp, Homo sapiens
atgttaaatagccatttgtttg

SEQ ID NO: 9061862 - DNA, 22 bp, Homo sapiens
atgttaaatggtttattattaa

SEQ ID NO: 9061863 - DNA, 22 bp, Homo sapiens
atgtttctgaagtttacagata

SEQ ID NO: 9061864 - DNA, 22 bp, Homo sapiens
atgttacaattcaaaatgctgc

SEQ ID NO: 9061865 - DNA, 22 bp, Homo sapiens
atgttacaatccaacaaaatta

SEQ ID NO: 9061866 - DNA, 22 bp, Homo sapiens
atgttacaatccaacaaaatta

SEQ ID NO: 9061867 - DNA, 22 bp, Homo sapiens
atgttacaatccaacaaaatta

SEQ ID NO: 9061868 - DNA, 22 bp, Homo sapiens
atgtttctgagtgtatatacat

SEQ ID NO: 9061869 - DNA, 22 bp, Homo sapiens
atgtttctgaagtttacagata

SEQ ID NO: 9061870 - DNA, 22 bp, Homo sapiens
atgtttgctattgttctagtgg

SEQ ID NO: 9061871 - DNA, 23 bp, Homo sapiens
atgtttgcagtaacccatcctgg

SEQ ID NO: 9061872 - DNA, 22 bp, Homo sapiens
attagcattgctactctcaaga

SEQ ID NO: 9061873 - DNA, 20 bp, Homo sapiens
attagctcaggtgaggtcat

SEQ ID NO: 9061874 - DNA, 22 bp, Homo sapiens
attagctgacctctaaggagcc

SEQ ID NO: 9061875 - DNA, 22 bp, Homo sapiens
attagcaagttttccagctaat

SEQ ID NO: 9061876 - DNA, 22 bp, Homo sapiens
attagcaatcacgcagtcattt

SEQ ID NO: 9061877 - DNA, 22 bp, Homo sapiens
attagcaattgccctgtgcaat

SEQ ID NO: 9061878 - DNA, 22 bp, Homo sapiens
attagcaattgtgcatctagta

SEQ ID NO: 9061879 - DNA, 22 bp, Homo sapiens
attagcaaggcagcatcaggca

SEQ ID NO: 9061880 - DNA, 22 bp, Homo sapiens
attaaatactgcaggctaagca

SEQ ID NO: 9061881 - DNA, 22 bp, Homo sapiens
attaaatactgcaggctaagca

SEQ ID NO: 9061882 - DNA, 22 bp, Homo sapiens
atgtttgtaggtaagtgacact

SEQ ID NO: 9061883 - DNA, 22 bp, Homo sapiens
atgtttgtgtttcccattcagg

SEQ ID NO: 9061884 - DNA, 22 bp, Homo sapiens
atgtttgttgaacatctactgc

SEQ ID NO: 9061885 - DNA, 22 bp, Homo sapiens
attaaactgagcaaattaacat

SEQ ID NO: 9061886 - DNA, 22 bp, Homo sapiens
attaaagaaacccagcatgtga

SEQ ID NO: 9061887 - DNA, 22 bp, Homo sapiens
attaaagacagcagatggatgg

SEQ ID NO: 9061888 - DNA, 22 bp, Homo sapiens
atgttttaccctttgcacaaac

SEQ ID NO: 9061889 - DNA, 22 bp, Homo sapiens
attaaacaatgtaaagttcttg

SEQ ID NO: 9061890 - DNA, 22 bp, Homo sapiens
agagggtagaagacagggttgc

SEQ ID NO: 9061891 - DNA, 22 bp, Homo sapiens
agagggtgaatgagatagaaaa

SEQ ID NO: 9061892 - DNA, 22 bp, Homo sapiens
agagggtgagcaggtacacatg

SEQ ID NO: 9061893 - DNA, 23 bp, Homo sapiens
agagggtgcaacatggggatcta

SEQ ID NO: 9061894 - DNA, 22 bp, Homo sapiens
agagggtgggcacgtgatggat

SEQ ID NO: 9061895 - DNA, 22 bp, Homo sapiens
agagggtgctggagagacattg

SEQ ID NO: 9061896 - DNA, 22 bp, Homo sapiens
agagggagtgaaatggaataga

SEQ ID NO: 9061897 - DNA, 22 bp, Homo sapiens
agagggagtgaaatggaataga

SEQ ID NO: 9061898 - DNA, 22 bp, Homo sapiens
agagggatcaccctgtttctgg

SEQ ID NO: 9061899 - DNA, 22 bp, Homo sapiens
agagggcaagtgtagtccagta

SEQ ID NO: 9061900 - DNA, 22 bp, Homo sapiens
agagggagcccagtcatagctg

SEQ ID NO: 9061901 - DNA, 22 bp, Homo sapiens
agagggagcccagtcatagctg

SEQ ID NO: 9061902 - DNA, 22 bp, Homo sapiens
agagggagcccagtcatagctg

SEQ ID NO: 9061903 - DNA, 23 bp, Homo sapiens
agagggagatgtttttctcaaga

SEQ ID NO: 9061904 - DNA, 22 bp, Homo sapiens
agagggagctttatttttctgt

SEQ ID NO: 9061905 - DNA, 22 bp, Homo sapiens
agagggagtgaaatggaataga

SEQ ID NO: 9061906 - DNA, 22 bp, Homo sapiens
agagggagtgaaatggaataga

SEQ ID NO: 9061907 - DNA, 22 bp, Homo sapiens
attcagctgactttgattcatt

SEQ ID NO: 9061908 - DNA, 22 bp, Homo sapiens
attctctgtttccaagatgaaa

SEQ ID NO: 9061909 - DNA, 22 bp, Homo sapiens
attctctgtgtctgctttccca

SEQ ID NO: 9061910 - DNA, 22 bp, Homo sapiens
attctggacaaggcaagctcct

SEQ ID NO: 9061911 - DNA, 23 bp, Homo sapiens
agagggagatgtttttctcaaga

SEQ ID NO: 9061912 - DNA, 23 bp, Homo sapiens
agagggagatgtttttctcaaga

SEQ ID NO: 9061913 - DNA, 22 bp, Homo sapiens
attcagcatgcaattaggtaat

SEQ ID NO: 9061914 - DNA, 22 bp, Homo sapiens
attcagcataatcagtagcttg

SEQ ID NO: 9061915 - DNA, 22 bp, Homo sapiens
attcagcataatcagtagcttg

SEQ ID NO: 9061916 - DNA, 22 bp, Homo sapiens
attcagcataatcagtagcttg

SEQ ID NO: 9061917 - DNA, 22 bp, Homo sapiens
attcagcagttcctgcttcagt

SEQ ID NO: 9061918 - DNA, 22 bp, Homo sapiens
attcagcagttcctgcttcagt

SEQ ID NO: 9061919 - DNA, 22 bp, Homo sapiens
attcagcaatgagcttggattt

SEQ ID NO: 9061920 - DNA, 22 bp, Homo sapiens
attcagcaaacatttattgtgt

SEQ ID NO: 9061921 - DNA, 22 bp, Homo sapiens
attcagcaaacatttattgtgt

SEQ ID NO: 9061922 - DNA, 22 bp, Homo sapiens
attcagcaaacatttattgtgt

SEQ ID NO: 9061923 - DNA, 22 bp, Homo sapiens
attcagcaaacatttattatct

SEQ ID NO: 9061924 - DNA, 22 bp, Homo sapiens
attcagcaaacatttattatct

SEQ ID NO: 9061925 - DNA, 22 bp, Homo sapiens
attcagagtctgcacaacagca

SEQ ID NO: 9061926 - DNA, 22 bp, Homo sapiens
attataaacctttgagggtggg

SEQ ID NO: 9061927 - DNA, 22 bp, Homo sapiens
attatacattttgtgtagagat

SEQ ID NO: 9061928 - DNA, 22 bp, Homo sapiens
attatacattttgtgtagagat

SEQ ID NO: 9061929 - DNA, 22 bp, Homo sapiens
attcacaattagaagtagataa

SEQ ID NO: 9061930 - DNA, 22 bp, Homo sapiens
attcacaattagaagtagataa

SEQ ID NO: 9061931 - DNA, 22 bp, Homo sapiens
attcaaagcccagtaaacattg

SEQ ID NO: 9061932 - DNA, 22 bp, Homo sapiens
attcaaagcccagtaaacattg

SEQ ID NO: 9061933 - DNA, 22 bp, Homo sapiens
attcaaagagctgccagaactg

SEQ ID NO: 9061934 - DNA, 22 bp, Homo sapiens
attcaaagatcatgatctctac

SEQ ID NO: 9061935 - DNA, 22 bp, Homo sapiens
attcacactttacttctttcca

SEQ ID NO: 9061936 - DNA, 22 bp, Homo sapiens
attcacacatactcatgtgtga

SEQ ID NO: 9061937 - DNA, 22 bp, Homo sapiens
attcacacacatttagagcaga

SEQ ID NO: 9061938 - DNA, 22 bp, Homo sapiens
attcacactgtatacacaggat

SEQ ID NO: 9061939 - DNA, 22 bp, Homo sapiens
attcacacacatttagagcaga

SEQ ID NO: 9061940 - DNA, 22 bp, Homo sapiens
attcacactgtatacacaggat

SEQ ID NO: 9061941 - DNA, 22 bp, Homo sapiens
attcacactgtatacacaggat

SEQ ID NO: 9061942 - DNA, 17 bp, Homo sapiens
agcaaaagtatcaaagc

SEQ ID NO: 9061943 - DNA, 17 bp, Homo sapiens
agcaaaagtatcaaagc

SEQ ID NO: 9061944 - DNA, 22 bp, Homo sapiens
atttgctttcagccttaaggat

SEQ ID NO: 9061945 - DNA, 22 bp, Homo sapiens
agcaaacattcagcagattggc

SEQ ID NO: 9061946 - DNA, 22 bp, Homo sapiens
agcaaacattcagcagattggc

SEQ ID NO: 9061947 - DNA, 22 bp, Homo sapiens
agcaaacagtttctggggatct

SEQ ID NO: 9061948 - DNA, 22 bp, Homo sapiens
agcaaacagtgtgctaagaaat

SEQ ID NO: 9061949 - DNA, 22 bp, Homo sapiens
agcaaaataaggtaatttattg

SEQ ID NO: 9061950 - DNA, 20 bp, Homo sapiens
agcaaaatgcaagattttca

SEQ ID NO: 9061951 - DNA, 22 bp, Homo sapiens
agcaaacacaagaggtaatttc

SEQ ID NO: 9061952 - DNA, 22 bp, Homo sapiens
agatgtgagaatcaagtgacca

SEQ ID NO: 9061953 - DNA, 22 bp, Homo sapiens
agatgtgagaatcaagtgacca

SEQ ID NO: 9061954 - DNA, 22 bp, Homo sapiens
agatgtggaacactagactgct

SEQ ID NO: 9061955 - DNA, 22 bp, Homo sapiens
agatgtggaaagaagttagaag

SEQ ID NO: 9061956 - DNA, 22 bp, Homo sapiens
atttgctgatggcatttgagct

SEQ ID NO: 9061957 - DNA, 22 bp, Homo sapiens
atttgctgtgtgctttagagac

SEQ ID NO: 9061958 - DNA, 20 bp, Homo sapiens
atttgcttaccttgtttcta

SEQ ID NO: 9061959 - DNA, 22 bp, Homo sapiens
atttgctggtgaatgtatagct

SEQ ID NO: 9061960 - DNA, 22 bp, Homo sapiens
atttgcttcatagatctgtgga

SEQ ID NO: 9061961 - DNA, 22 bp, Homo sapiens
atttgcttctgctaaacaactt

SEQ ID NO: 9061962 - DNA, 22 bp, Homo sapiens
atttgcttgtaaatgtatgcct

SEQ ID NO: 9061963 - DNA, 22 bp, Homo sapiens
atttgcttgtgctatgaaagtt

SEQ ID NO: 9061964 - DNA, 22 bp, Homo sapiens
atttgcttgactatggcttgca

SEQ ID NO: 9061965 - DNA, 22 bp, Homo sapiens
atttgcttgtaaatgtatgcct

SEQ ID NO: 9061966 - DNA, 22 bp, Homo sapiens
agatgaagactcaggagcaggt

SEQ ID NO: 9061967 - DNA, 20 bp, Homo sapiens
agatggtgaaggccagggag

SEQ ID NO: 9061968 - DNA, 22 bp, Homo sapiens
agatggtgatagagctgggatt

SEQ ID NO: 9061969 - DNA, 19 bp, Homo sapiens
agatggggaagagtgtgag

SEQ ID NO: 9061970 - DNA, 22 bp, Homo sapiens
agatggtaatcacatttatctg

SEQ ID NO: 9061971 - DNA, 22 bp, Homo sapiens
agatggtagactatggaacgta

SEQ ID NO: 9061972 - DNA, 22 bp, Homo sapiens
agatgtaccaggtattacagga

SEQ ID NO: 9061973 - DNA, 22 bp, Homo sapiens
agatgtaaactctcatgtcatt

SEQ ID NO: 9061974 - DNA, 23 bp, Homo sapiens
agatgaaagcttcccatcacagt

SEQ ID NO: 9061975 - DNA, 22 bp, Homo sapiens
agatgaaatttgtgttgagttg

SEQ ID NO: 9061976 - DNA, 23 bp, Homo sapiens
agatgaaagcttcccatcacagt

SEQ ID NO: 9061977 - DNA, 22 bp, Homo sapiens
agatgaagactcaggagcaggt

SEQ ID NO: 9061978 - DNA, 22 bp, Homo sapiens
agatgaagactcaggagcaggt

SEQ ID NO: 9061979 - DNA, 22 bp, Homo sapiens
agatgaagactcaggagcaggt

SEQ ID NO: 9061980 - DNA, 22 bp, Homo sapiens
agatgaagatatctgcaggggc

SEQ ID NO: 9061981 - DNA, 22 bp, Homo sapiens
agatgaagatatctgcaggggc

SEQ ID NO: 9061982 - DNA, 22 bp, Homo sapiens
agatgaagatatctgcaggggc

SEQ ID NO: 9061983 - DNA, 22 bp, Homo sapiens
agatgacaaatcaggggacggg

SEQ ID NO: 9061984 - DNA, 22 bp, Homo sapiens
atttcattgaagttaattcttc

SEQ ID NO: 9061985 - DNA, 22 bp, Homo sapiens
agatgaatccacacatggcaaa

SEQ ID NO: 9061986 - DNA, 22 bp, Homo sapiens
agatgaagatgccactaagacc

SEQ ID NO: 9061987 - DNA, 22 bp, Homo sapiens
agatgaagatgccactaagacc

SEQ ID NO: 9061988 - DNA, 22 bp, Homo sapiens
agatgaagcctgtacttagtct

SEQ ID NO: 9061989 - DNA, 22 bp, Homo sapiens
agatgaaaagataagcagcaat

SEQ ID NO: 9061990 - DNA, 22 bp, Homo sapiens
agatgaaaagataagcagcaat

SEQ ID NO: 9061991 - DNA, 22 bp, Homo sapiens
agatgaaaagataagcagcaat

SEQ ID NO: 9061992 - DNA, 22 bp, Homo sapiens
atttattgaagcttattacgtt

SEQ ID NO: 9061993 - DNA, 22 bp, Homo sapiens
agatgaaagatttttatagaga

SEQ ID NO: 9061994 - DNA, 18 bp, Homo sapiens
agatgaaagcaaatgaca

SEQ ID NO: 9061995 - DNA, 22 bp, Homo sapiens
agatgaaagatttttatagaga

SEQ ID NO: 9061996 - DNA, 22 bp, Homo sapiens
agagggtgggcacgtgatggat

SEQ ID NO: 9061997 - DNA, 22 bp, Homo sapiens
agagggtggtgaggcctggttc

SEQ ID NO: 9061998 - DNA, 22 bp, Homo sapiens
agaggtaagcagtggcaagtgc

SEQ ID NO: 9061999 - DNA, 22 bp, Homo sapiens
attcttcatacagacaagtcct

SEQ ID NO: 9062000 - DNA, 22 bp, Homo sapiens
attcttcatcactaccttgtga

SEQ ID NO: 9062001 - DNA, 22 bp, Homo sapiens
agaggtatatattctccatatt

SEQ ID NO: 9062002 - DNA, 22 bp, Homo sapiens
attcttcattgttgattcatgt

SEQ ID NO: 9062003 - DNA, 22 bp, Homo sapiens
attcttcattgttgattcatgt

SEQ ID NO: 9062004 - DNA, 23 bp, Homo sapiens
attcttcattatcttctagaaaa

SEQ ID NO: 9062005 - DNA, 22 bp, Homo sapiens
attcttcattgttgattcatgt

SEQ ID NO: 9062006 - DNA, 22 bp, Homo sapiens
attcttcatgttgaagctgtca

SEQ ID NO: 9062007 - DNA, 22 bp, Homo sapiens
attcttcatcagagatgcacta

SEQ ID NO: 9062008 - DNA, 22 bp, Homo sapiens
agagtggcccgttggcctgaac

SEQ ID NO: 9062009 - DNA, 23 bp, Homo sapiens
agagtggcctactcacactcatt

SEQ ID NO: 9062010 - DNA, 18 bp, Homo sapiens
atttaatgaactgaaagc

SEQ ID NO: 9062011 - DNA, 22 bp, Homo sapiens
atttaagggatttggagaccaa

SEQ ID NO: 9062012 - DNA, 22 bp, Homo sapiens
atttaataccacttggtgcttt

SEQ ID NO: 9062013 - DNA, 22 bp, Homo sapiens
atttaacaagacagagaactgg

SEQ ID NO: 9062014 - DNA, 22 bp, Homo sapiens
atttagacatgtatctgatagc

SEQ ID NO: 9062015 - DNA, 22 bp, Homo sapiens
atttagacacaaaagtgccatg

SEQ ID NO: 9062016 - DNA, 22 bp, Homo sapiens
atttagacaccagcttgtaagg

SEQ ID NO: 9062017 - DNA, 22 bp, Homo sapiens
atttagactctcacctccacct

SEQ ID NO: 9062018 - DNA, 22 bp, Homo sapiens
atttagacttcttgcaggtaat

SEQ ID NO: 9062019 - DNA, 22 bp, Homo sapiens
atttagacttcccagcactgtg

SEQ ID NO: 9062020 - DNA, 22 bp, Homo sapiens
atttagacttcttgcaggtaat

SEQ ID NO: 9062021 - DNA, 22 bp, Homo sapiens
atttagacaacaagccttctcc

SEQ ID NO: 9062022 - DNA, 23 bp, Homo sapiens
atttacaggttaaatgaaatcag

SEQ ID NO: 9062023 - DNA, 22 bp, Homo sapiens
atttagcaaaaaatgatgaagc

SEQ ID NO: 9062024 - DNA, 22 bp, Homo sapiens
atttagcaagagtacaaaataa

SEQ ID NO: 9062025 - DNA, 22 bp, Homo sapiens
atttagcaagcaggcaaattca

SEQ ID NO: 9062026 - DNA, 22 bp, Homo sapiens
agagtgggacacgggcgctgtc

SEQ ID NO: 9062027 - DNA, 22 bp, Homo sapiens
agagtggcttgctcagctagca

SEQ ID NO: 9062028 - DNA, 22 bp, Homo sapiens
agagtggcttctttgacatgct

SEQ ID NO: 9062029 - DNA, 22 bp, Homo sapiens
agagtggcttctttgacatgct

SEQ ID NO: 9062030 - DNA, 22 bp, Homo sapiens
agagtgggcctctgagtcccag

SEQ ID NO: 9062031 - DNA, 22 bp, Homo sapiens
agagtgggcctctgagtcccag

SEQ ID NO: 9062032 - DNA, 22 bp, Homo sapiens
agagtggggaaggtgttgagaa

SEQ ID NO: 9062033 - DNA, 22 bp, Homo sapiens
atttagcacctccatctcaaca

SEQ ID NO: 9062034 - DNA, 22 bp, Homo sapiens
caccagggtacaatttcgcaga

SEQ ID NO: 9062035 - DNA, 22 bp, Homo sapiens
agcagtggctgaagatgttcct

SEQ ID NO: 9062036 - DNA, 22 bp, Homo sapiens
agcagtggcctggggctctgtg

SEQ ID NO: 9062037 - DNA, 22 bp, Homo sapiens
agcagttgtagtcatggaaaat

SEQ ID NO: 9062038 - DNA, 22 bp, Homo sapiens
agcagttatgttctataaagtc

SEQ ID NO: 9062039 - DNA, 22 bp, Homo sapiens
agcagttgtagtcatggaaaat

SEQ ID NO: 9062040 - DNA, 22 bp, Homo sapiens
caccagggacaatgctaggggt

SEQ ID NO: 9062041 - DNA, 22 bp, Homo sapiens
cactctggttctgaacaggatc

SEQ ID NO: 9062042 - DNA, 22 bp, Homo sapiens
cactctgattccacaaggctcc

SEQ ID NO: 9062043 - DNA, 22 bp, Homo sapiens
cactctgcagctgaagggctgg

SEQ ID NO: 9062044 - DNA, 22 bp, Homo sapiens
cactctgatggtttctgttcaa

SEQ ID NO: 9062045 - DNA, 20 bp, Homo sapiens
cactctgagggagtccatgt

SEQ ID NO: 9062046 - DNA, 22 bp, Homo sapiens
cactctgagccaaaactaattc

SEQ ID NO: 9062047 - DNA, 22 bp, Homo sapiens
cactctgagcccaagcaggctg

SEQ ID NO: 9062048 - DNA, 22 bp, Homo sapiens
agcataagttggtacagccact

SEQ ID NO: 9062049 - DNA, 22 bp, Homo sapiens
agcataagttggtacagccact

SEQ ID NO: 9062050 - DNA, 22 bp, Homo sapiens
agcataaaggcactagaaagag

SEQ ID NO: 9062051 - DNA, 22 bp, Homo sapiens
agcataaaggcactagaaagag

SEQ ID NO: 9062052 - DNA, 22 bp, Homo sapiens
agcagtttttataacactggaa

SEQ ID NO: 9062053 - DNA, 22 bp, Homo sapiens
agcagtttgaatcaatggccag

SEQ ID NO: 9062054 - DNA, 22 bp, Homo sapiens
agcagtttgaatcaatggccag

SEQ ID NO: 9062055 - DNA, 20 bp, Homo sapiens
agcagtttcctaactcagct

SEQ ID NO: 9062056 - DNA, 22 bp, Homo sapiens
agcagttttcctgagctcctca

SEQ ID NO: 9062057 - DNA, 22 bp, Homo sapiens
agcagttttagggagacacatt

SEQ ID NO: 9062058 - DNA, 22 bp, Homo sapiens
agcagttttagggagacacatt

SEQ ID NO: 9062059 - DNA, 22 bp, Homo sapiens
agcagtttggaaaatactagaa

SEQ ID NO: 9062060 - DNA, 22 bp, Homo sapiens
cacatccttcagctgagcccag

SEQ ID NO: 9062061 - DNA, 22 bp, Homo sapiens
cacatctgaaaagatgcacaag

SEQ ID NO: 9062062 - DNA, 23 bp, Homo sapiens
agcaggtaggttgaaattttcct

SEQ ID NO: 9062063 - DNA, 22 bp, Homo sapiens
cacatctgctctgggcagcact

SEQ ID NO: 9062064 - DNA, 22 bp, Homo sapiens
cacatctgacttccagtgcagg

SEQ ID NO: 9062065 - DNA, 22 bp, Homo sapiens
cacagtccagactcctggagtt

SEQ ID NO: 9062066 - DNA, 22 bp, Homo sapiens
cacagtcccattcgagagtaat

SEQ ID NO: 9062067 - DNA, 22 bp, Homo sapiens
agcagggcctctggcactggtc

SEQ ID NO: 9062068 - DNA, 22 bp, Homo sapiens
agcagggcctctggcactggtc

SEQ ID NO: 9062069 - DNA, 20 bp, Homo sapiens
cacagtattcttccttaaaa

SEQ ID NO: 9062070 - DNA, 16 bp, Homo sapiens
agcagggcgggaagga

SEQ ID NO: 9062071 - DNA, 22 bp, Homo sapiens
caatgaaattgagatccagaga

SEQ ID NO: 9062072 - DNA, 22 bp, Homo sapiens
caatgaaattgagatccagaga

SEQ ID NO: 9062073 - DNA, 22 bp, Homo sapiens
caatgacactctgcacagtgct

SEQ ID NO: 9062074 - DNA, 22 bp, Homo sapiens
caatgacaggttcatgactcct

SEQ ID NO: 9062075 - DNA, 22 bp, Homo sapiens
caatgacatctccctgctctaa

SEQ ID NO: 9062076 - DNA, 22 bp, Homo sapiens
caatgacatggataatcatatt

SEQ ID NO: 9062077 - DNA, 22 bp, Homo sapiens
caatgacatggataatcatatt

SEQ ID NO: 9062078 - DNA, 22 bp, Homo sapiens
agcagctgtactttcatctgtt

SEQ ID NO: 9062079 - DNA, 22 bp, Homo sapiens
agcagctgtactttcatctgtt

SEQ ID NO: 9062080 - DNA, 19 bp, Homo sapiens
agcagctgtagatagacac

SEQ ID NO: 9062081 - DNA, 22 bp, Homo sapiens
agcagctgtactttcatctgtt

SEQ ID NO: 9062082 - DNA, 22 bp, Homo sapiens
agcagctgtactttcatctgtt

SEQ ID NO: 9062083 - DNA, 22 bp, Homo sapiens
agcagctgggctcagagctggg

SEQ ID NO: 9062084 - DNA, 21 bp, Homo sapiens
agcagctgggcaacatggagg

SEQ ID NO: 9062085 - DNA, 18 bp, Homo sapiens
agcagctgtcagaatgcc

SEQ ID NO: 9062086 - DNA, 19 bp, Homo sapiens
agcagctgtagatagacac

SEQ ID NO: 9062087 - DNA, 19 bp, Homo sapiens
agcagctgtagatagacac

SEQ ID NO: 9062088 - DNA, 19 bp, Homo sapiens
agcagctgtagatagacac

SEQ ID NO: 9062089 - DNA, 18 bp, Homo sapiens
agcagctgtcagaatgcc

SEQ ID NO: 9062090 - DNA, 18 bp, Homo sapiens
agcagctgtcagaatgcc

SEQ ID NO: 9062091 - DNA, 22 bp, Homo sapiens
agcagctgtcccttaacatcag

SEQ ID NO: 9062092 - DNA, 22 bp, Homo sapiens
agcagctgtcccttaacatcag

SEQ ID NO: 9062093 - DNA, 18 bp, Homo sapiens
agcagctgtcagaatgcc

SEQ ID NO: 9062094 - DNA, 22 bp, Homo sapiens
agcagctgtcccttaacatcag

SEQ ID NO: 9062095 - DNA, 22 bp, Homo sapiens
agcagctgtcccttaacatcag

SEQ ID NO: 9062096 - DNA, 23 bp, Homo sapiens
agcagctgtggagttttgcattt

SEQ ID NO: 9062097 - DNA, 22 bp, Homo sapiens
agcagctgtggaaaagtaacta

SEQ ID NO: 9062098 - DNA, 22 bp, Homo sapiens
agcagctgtggaaaagtaacta

SEQ ID NO: 9062099 - DNA, 23 bp, Homo sapiens
agcagctgtggagttttgcattt

SEQ ID NO: 9062100 - DNA, 23 bp, Homo sapiens
agcagctgtggagttttgcattt

SEQ ID NO: 9062101 - DNA, 22 bp, Homo sapiens
agcagctgtgggcaatatgtaa

SEQ ID NO: 9062102 - DNA, 22 bp, Homo sapiens
agcagctgtggaaaagtaacta

SEQ ID NO: 9062103 - DNA, 18 bp, Homo sapiens
agcagctgtgccacactg

SEQ ID NO: 9062104 - DNA, 22 bp, Homo sapiens
agcagctgtggaaaagtaacta

SEQ ID NO: 9062105 - DNA, 18 bp, Homo sapiens
agcagctgtgccacactg

SEQ ID NO: 9062106 - DNA, 18 bp, Homo sapiens
agcagctgtgccacactg

SEQ ID NO: 9062107 - DNA, 18 bp, Homo sapiens
agcagctgtgccacactg

SEQ ID NO: 9062108 - DNA, 22 bp, Homo sapiens
cacaggagctgtggggcagtgt

SEQ ID NO: 9062109 - DNA, 22 bp, Homo sapiens
cacaggagctgtggggcagtgt

SEQ ID NO: 9062110 - DNA, 22 bp, Homo sapiens
cacaggagccctgaggcctccc

SEQ ID NO: 9062111 - DNA, 22 bp, Homo sapiens
agcagcttcctgctcttcgcct

SEQ ID NO: 9062112 - DNA, 22 bp, Homo sapiens
agcagcttatcttggagaggca

SEQ ID NO: 9062113 - DNA, 22 bp, Homo sapiens
agcagcttctttcactcctgga

SEQ ID NO: 9062114 - DNA, 22 bp, Homo sapiens
cacaggaagctgactgctggca

SEQ ID NO: 9062115 - DNA, 22 bp, Homo sapiens
agcagctgtggggacaagggta

SEQ ID NO: 9062116 - DNA, 22 bp, Homo sapiens
agcagctgtggggacaagggta

SEQ ID NO: 9062117 - DNA, 23 bp, Homo sapiens
agcagctgtggtttaccttagta

SEQ ID NO: 9062118 - DNA, 22 bp, Homo sapiens
agcagctgtggggacaagggta

SEQ ID NO: 9062119 - DNA, 20 bp, Homo sapiens
agcagctgtgttttcatcct

SEQ ID NO: 9062120 - DNA, 23 bp, Homo sapiens
agcagctgtggtttaccttagta

SEQ ID NO: 9062121 - DNA, 20 bp, Homo sapiens
agcagctgtgttttcatcct

SEQ ID NO: 9062122 - DNA, 20 bp, Homo sapiens
agcagctgtgttttcatcct

SEQ ID NO: 9062123 - DNA, 20 bp, Homo sapiens
agcagctgtgttttcatcct

SEQ ID NO: 9062124 - DNA, 22 bp, Homo sapiens
agcagctgttagaaacaggaag

SEQ ID NO: 9062125 - DNA, 22 bp, Homo sapiens
agcagctgttagaaacaggaag

SEQ ID NO: 9062126 - DNA, 22 bp, Homo sapiens
agcagctgttagaaacaggaag

SEQ ID NO: 9062127 - DNA, 22 bp, Homo sapiens
agcagctgtttgttgaattggt

SEQ ID NO: 9062128 - DNA, 22 bp, Homo sapiens
agcagctgtttgttgaattggt

SEQ ID NO: 9062129 - DNA, 22 bp, Homo sapiens
agcagctgtttgttgaattggt

SEQ ID NO: 9062130 - DNA, 22 bp, Homo sapiens
agcagctgtttgttgaattggt

SEQ ID NO: 9062131 - DNA, 19 bp, Homo sapiens
agcagcttaattttgtagc

SEQ ID NO: 9062132 - DNA, 22 bp, Homo sapiens
agcagcttatcttggagaggca

SEQ ID NO: 9062133 - DNA, 22 bp, Homo sapiens
cacagggcagtgattgtccaca

SEQ ID NO: 9062134 - DNA, 22 bp, Homo sapiens
cacaggctgcccgcagctggga

SEQ ID NO: 9062135 - DNA, 22 bp, Homo sapiens
cacagggcctggggcagctgct

SEQ ID NO: 9062136 - DNA, 22 bp, Homo sapiens
cacagggccactttcccagtaa

SEQ ID NO: 9062137 - DNA, 22 bp, Homo sapiens
cacagggcagtgctgcccactc

SEQ ID NO: 9062138 - DNA, 22 bp, Homo sapiens
cacagtatcttttgagtaagca

SEQ ID NO: 9062139 - DNA, 22 bp, Homo sapiens
cacagtacttaattctctaaat

SEQ ID NO: 9062140 - DNA, 22 bp, Homo sapiens
cacagtactgctttgggatgtg

SEQ ID NO: 9062141 - DNA, 22 bp, Homo sapiens
cacagtacgcacccgatacatg

SEQ ID NO: 9062142 - DNA, 22 bp, Homo sapiens
cacagtattcactgggcagatt

SEQ ID NO: 9062143 - DNA, 22 bp, Homo sapiens
cacagtattcactgggcagatt

SEQ ID NO: 9062144 - DNA, 22 bp, Homo sapiens
cacagtatgatctaaagtaagt

SEQ ID NO: 9062145 - DNA, 22 bp, Homo sapiens
cacagggctaaatgaagggttg

SEQ ID NO: 9062146 - DNA, 22 bp, Homo sapiens
cacagggctaaatgaagggttg

SEQ ID NO: 9062147 - DNA, 22 bp, Homo sapiens
cacagggccttgtgtgactgca

SEQ ID NO: 9062148 - DNA, 22 bp, Homo sapiens
cacagtacccagcactactgag

SEQ ID NO: 9062149 - DNA, 22 bp, Homo sapiens
cacaggagggagcgggcagcca

SEQ ID NO: 9062150 - DNA, 22 bp, Homo sapiens
cacaggagggagcgggcagcca

SEQ ID NO: 9062151 - DNA, 22 bp, Homo sapiens
cacaggagggagcgggcagcca

SEQ ID NO: 9062152 - DNA, 22 bp, Homo sapiens
cacaggaggaggccagagcgta

SEQ ID NO: 9062153 - DNA, 22 bp, Homo sapiens
cacaggaggaggccagagcgta

SEQ ID NO: 9062154 - DNA, 22 bp, Homo sapiens
cacaggctgcccgcagctggga

SEQ ID NO: 9062155 - DNA, 22 bp, Homo sapiens
agcaggagagcagtgcgtggtc

SEQ ID NO: 9062156 - DNA, 22 bp, Homo sapiens
caaggcaggcagttcacttgag

SEQ ID NO: 9062157 - DNA, 22 bp, Homo sapiens
caaggcaggaagcctgtcttat

SEQ ID NO: 9062158 - DNA, 22 bp, Homo sapiens
caaggcaggaagcctgtcttat

SEQ ID NO: 9062159 - DNA, 22 bp, Homo sapiens
agcagcagaaggtttgcaccca

SEQ ID NO: 9062160 - DNA, 22 bp, Homo sapiens
agcagcagaagggagacccagg

SEQ ID NO: 9062161 - DNA, 22 bp, Homo sapiens
agcagcagaagggagacccagg

SEQ ID NO: 9062162 - DNA, 22 bp, Homo sapiens
agcagcagaaagttgatggcag

SEQ ID NO: 9062163 - DNA, 22 bp, Homo sapiens
agcagcagaaagttgatggcag

SEQ ID NO: 9062164 - DNA, 22 bp, Homo sapiens
agcagcacgagtccacaaatcc

SEQ ID NO: 9062165 - DNA, 22 bp, Homo sapiens
agcagcacccagagccatgtct

SEQ ID NO: 9062166 - DNA, 22 bp, Homo sapiens
agcagcacctgtcctcgctgct

SEQ ID NO: 9062167 - DNA, 17 bp, Homo sapiens
caacttcacaaactgtc

SEQ ID NO: 9062168 - DNA, 21 bp, Homo sapiens
agcagagtgctttgactttgt

SEQ ID NO: 9062169 - DNA, 22 bp, Homo sapiens
agcagcaagcagtgcacgggtt

SEQ ID NO: 9062170 - DNA, 22 bp, Homo sapiens
agcagcaacttatttttcttat

SEQ ID NO: 9062171 - DNA, 22 bp, Homo sapiens
agcagcaaggaagcgaggatgg

SEQ ID NO: 9062172 - DNA, 22 bp, Homo sapiens
agcagcacacgggagaaagaca

SEQ ID NO: 9062173 - DNA, 22 bp, Homo sapiens
agcagcaattttcactgtcaat

SEQ ID NO: 9062174 - DNA, 18 bp, Homo sapiens
agcagcaatttgggatga

SEQ ID NO: 9062175 - DNA, 22 bp, Homo sapiens
agcagcaatggaaagcaacaca

SEQ ID NO: 9062176 - DNA, 22 bp, Homo sapiens
agcagcaatggaaagcaacaca

SEQ ID NO: 9062177 - DNA, 22 bp, Homo sapiens
agcagcaatggaaagcaacaca

SEQ ID NO: 9062178 - DNA, 22 bp, Homo sapiens
agcagcaaggaagcgaggatgg

SEQ ID NO: 9062179 - DNA, 22 bp, Homo sapiens
caactgaactgatatcaactat

SEQ ID NO: 9062180 - DNA, 22 bp, Homo sapiens
caactgatctatttcctaactg

SEQ ID NO: 9062181 - DNA, 22 bp, Homo sapiens
caactgctgggatggggtagag

SEQ ID NO: 9062182 - DNA, 22 bp, Homo sapiens
agcagacaccaggagtaaagaa

SEQ ID NO: 9062183 - DNA, 21 bp, Homo sapiens
agcagacacttgtgaccttcc

SEQ ID NO: 9062184 - DNA, 22 bp, Homo sapiens
agcagaatctgtccttggaaga

SEQ ID NO: 9062185 - DNA, 22 bp, Homo sapiens
agcagaatctgtccttggaaga

SEQ ID NO: 9062186 - DNA, 22 bp, Homo sapiens
agcagaatggggctgggaatag

SEQ ID NO: 9062187 - DNA, 22 bp, Homo sapiens
agcagaatgcttaaagctagtg

SEQ ID NO: 9062188 - DNA, 22 bp, Homo sapiens
agcagaagtgccttagcaatca

SEQ ID NO: 9062189 - DNA, 22 bp, Homo sapiens
agcagaatctgggagcagcagt

SEQ ID NO: 9062190 - DNA, 22 bp, Homo sapiens
agcagacaacccagatgaccca

SEQ ID NO: 9062191 - DNA, 22 bp, Homo sapiens
agcagacaacccagatgaccca

SEQ ID NO: 9062192 - DNA, 18 bp, Homo sapiens
agcagaattctagggttc

SEQ ID NO: 9062193 - DNA, 22 bp, Homo sapiens
agcagaattgaatatcgggttc

SEQ ID NO: 9062194 - DNA, 18 bp, Homo sapiens
agcagaattctagggttc

SEQ ID NO: 9062195 - DNA, 22 bp, Homo sapiens
agcagaatgtgtgtgacaagta

SEQ ID NO: 9062196 - DNA, 22 bp, Homo sapiens
agcagaattccatgtgagaggg

SEQ ID NO: 9062197 - DNA, 22 bp, Homo sapiens
caatgaaagcaactgcctataa

SEQ ID NO: 9062198 - DNA, 22 bp, Homo sapiens
caatgaaagcaactgcctataa

SEQ ID NO: 9062199 - DNA, 22 bp, Homo sapiens
caatgaaattgagatccagaga

SEQ ID NO: 9062200 - DNA, 22 bp, Homo sapiens
caatgaaattgagatccagaga

SEQ ID NO: 9062201 - DNA, 22 bp, Homo sapiens
caatgaaaatgaggactcctgt

SEQ ID NO: 9062202 - DNA, 22 bp, Homo sapiens
caatgaaaatttaagttgcagc

SEQ ID NO: 9062203 - DNA, 20 bp, Homo sapiens
agcagcattgttctagagca

SEQ ID NO: 9062204 - DNA, 22 bp, Homo sapiens
agcagcatcttctaagtaaggc

SEQ ID NO: 9062205 - DNA, 22 bp, Homo sapiens
agcagcatcttctgttctccgc

SEQ ID NO: 9062206 - DNA, 22 bp, Homo sapiens
agcagcatctggttctgatgtg

SEQ ID NO: 9062207 - DNA, 22 bp, Homo sapiens
agcagcatgatgacagagtctc

SEQ ID NO: 9062208 - DNA, 22 bp, Homo sapiens
agcagcatggctgactaaagac

SEQ ID NO: 9062209 - DNA, 22 bp, Homo sapiens
agcagcatggatgggcctcagc

SEQ ID NO: 9062210 - DNA, 22 bp, Homo sapiens
agcagcattatgatatatctta

SEQ ID NO: 9062211 - DNA, 22 bp, Homo sapiens
agcagcatgttcattacattat

SEQ ID NO: 9062212 - DNA, 22 bp, Homo sapiens
agcagcatgttgggatgtgaaa

SEQ ID NO: 9062213 - DNA, 22 bp, Homo sapiens
caaggcaggcagttcacttgag

SEQ ID NO: 9062214 - DNA, 22 bp, Homo sapiens
caaggcaggaagcctgtcttat

SEQ ID NO: 9062215 - DNA, 22 bp, Homo sapiens
caaggcaggccagtttcaaggc

SEQ ID NO: 9062216 - DNA, 22 bp, Homo sapiens
caaggcaggccagtttcaaggc

SEQ ID NO: 9062217 - DNA, 22 bp, Homo sapiens
caaggcaggccagtttcaaggc

SEQ ID NO: 9062218 - DNA, 22 bp, Homo sapiens
caaggcaggccagtttcaaggc

SEQ ID NO: 9062219 - DNA, 22 bp, Homo sapiens
caaggcaggtctgaggaggttg

SEQ ID NO: 9062220 - DNA, 22 bp, Homo sapiens
caaggcagttccccagagggct

SEQ ID NO: 9062221 - DNA, 22 bp, Homo sapiens
caaggcagttccccagagggct

SEQ ID NO: 9062222 - DNA, 22 bp, Homo sapiens
caaggcagttccccagagggct

SEQ ID NO: 9062223 - DNA, 22 bp, Homo sapiens
caaggcagttccccagagggct

SEQ ID NO: 9062224 - DNA, 22 bp, Homo sapiens
caaggcagttccccagagggct

SEQ ID NO: 9062225 - DNA, 22 bp, Homo sapiens
agcagcatagatgctatccgag

SEQ ID NO: 9062226 - DNA, 22 bp, Homo sapiens
agcagcagggtgtaattgggca

SEQ ID NO: 9062227 - DNA, 22 bp, Homo sapiens
agcagcatctcttattgcagtg

SEQ ID NO: 9062228 - DNA, 22 bp, Homo sapiens
agcagcatattgtgtcttcata

SEQ ID NO: 9062229 - DNA, 22 bp, Homo sapiens
agcagcatattgtgtcttcata

SEQ ID NO: 9062230 - DNA, 22 bp, Homo sapiens
agcagcatatcagagaaagtca

SEQ ID NO: 9062231 - DNA, 22 bp, Homo sapiens
caaatgcaggtcataacctgag

SEQ ID NO: 9062232 - DNA, 22 bp, Homo sapiens
caaatgcagtccctttgttgct

SEQ ID NO: 9062233 - DNA, 22 bp, Homo sapiens
caaatgcagtccctttgttgct

SEQ ID NO: 9062234 - DNA, 22 bp, Homo sapiens
caaatgttaagacaggatcaag

SEQ ID NO: 9062235 - DNA, 22 bp, Homo sapiens
caaatgttaagacaggatcaag

SEQ ID NO: 9062236 - DNA, 22 bp, Homo sapiens
caaatgcatagaaagatgaaac

SEQ ID NO: 9062237 - DNA, 22 bp, Homo sapiens
caaatgcatagaaagatgaaac

SEQ ID NO: 9062238 - DNA, 22 bp, Homo sapiens
caaatgttaaatgtgttaagac

SEQ ID NO: 9062239 - DNA, 22 bp, Homo sapiens
caaatgttaaatgtgttaagac

SEQ ID NO: 9062240 - DNA, 22 bp, Homo sapiens
caaatgcaggtcagcaggtgtc

SEQ ID NO: 9062241 - DNA, 22 bp, Homo sapiens
caaatgcaggtcagcaggtgtc

SEQ ID NO: 9062242 - DNA, 22 bp, Homo sapiens
caaatgcaaaatataaccctgt

SEQ ID NO: 9062243 - DNA, 22 bp, Homo sapiens
caaatgcaaaatataaccctgt

SEQ ID NO: 9062244 - DNA, 22 bp, Homo sapiens
caaatgcagattcaggagttct

SEQ ID NO: 9062245 - DNA, 22 bp, Homo sapiens
caaatattccaggtacatccct

SEQ ID NO: 9062246 - DNA, 22 bp, Homo sapiens
caaatgatccttgcaagctgtg

SEQ ID NO: 9062247 - DNA, 21 bp, Homo sapiens
agcacagcatatccaatgtca

SEQ ID NO: 9062248 - DNA, 20 bp, Homo sapiens
agcacagcgcggtgttcctt

SEQ ID NO: 9062249 - DNA, 22 bp, Homo sapiens
caaatgttgactaagagggttt

SEQ ID NO: 9062250 - DNA, 22 bp, Homo sapiens
caaatgttgctgtaatgtttgt

SEQ ID NO: 9062251 - DNA, 22 bp, Homo sapiens
caaatgttgctgtaatgtttgt

SEQ ID NO: 9062252 - DNA, 22 bp, Homo sapiens
caaatgtttcttatctattgtt

SEQ ID NO: 9062253 - DNA, 22 bp, Homo sapiens
caaatgtttcttatctattgtt

SEQ ID NO: 9062254 - DNA, 22 bp, Homo sapiens
caaatgtttcttatctattgtt

SEQ ID NO: 9062255 - DNA, 22 bp, Homo sapiens
caaatgttattcattcttgttt

SEQ ID NO: 9062256 - DNA, 22 bp, Homo sapiens
caaatgttattcattcttgttt

SEQ ID NO: 9062257 - DNA, 22 bp, Homo sapiens
caaatgttgactaagagggttt

SEQ ID NO: 9062258 - DNA, 22 bp, Homo sapiens
caaatgttattcattcttgttt

SEQ ID NO: 9062259 - DNA, 22 bp, Homo sapiens
caaatgttagtgcccatccctc

SEQ ID NO: 9062260 - DNA, 22 bp, Homo sapiens
caaatgttagtgcccatccctc

SEQ ID NO: 9062261 - DNA, 22 bp, Homo sapiens
caaatgtttttattctacaaca

SEQ ID NO: 9062262 - DNA, 22 bp, Homo sapiens
caaatgtttggtggcattttgt

SEQ ID NO: 9062263 - DNA, 22 bp, Homo sapiens
caaatgttttttagtataagta

SEQ ID NO: 9062264 - DNA, 22 bp, Homo sapiens
caaatgttttttagtataagta

SEQ ID NO: 9062265 - DNA, 22 bp, Homo sapiens
caaatgtttttattctacaaca

SEQ ID NO: 9062266 - DNA, 22 bp, Homo sapiens
caaatgtttgcatcacagggca

SEQ ID NO: 9062267 - DNA, 22 bp, Homo sapiens
caaatgtttggtggcattttgt

SEQ ID NO: 9062268 - DNA, 22 bp, Homo sapiens
caaatgtttggtggcattttgt

SEQ ID NO: 9062269 - DNA, 22 bp, Homo sapiens
caaatgtttgcatcacagggca

SEQ ID NO: 9062270 - DNA, 22 bp, Homo sapiens
caaatgtttcttgaacaccaac

SEQ ID NO: 9062271 - DNA, 22 bp, Homo sapiens
caaatgtttcttgaacaccaac

SEQ ID NO: 9062272 - DNA, 17 bp, Homo sapiens
agcagaagtcagaggga

SEQ ID NO: 9062273 - DNA, 17 bp, Homo sapiens
agcagaagtcagaggga

SEQ ID NO: 9062274 - DNA, 17 bp, Homo sapiens
agcagaagtcagaggga

SEQ ID NO: 9062275 - DNA, 17 bp, Homo sapiens
agcagaagtcagaggga

SEQ ID NO: 9062276 - DNA, 17 bp, Homo sapiens
agcagaagtcagaggga

SEQ ID NO: 9062277 - DNA, 17 bp, Homo sapiens
agcagaagtcagaggga

SEQ ID NO: 9062278 - DNA, 17 bp, Homo sapiens
agcagaagtcagaggga

SEQ ID NO: 9062279 - DNA, 22 bp, Homo sapiens
agcagaagaggtcttgttgctg

SEQ ID NO: 9062280 - DNA, 22 bp, Homo sapiens
agcactgttatgggatgactta

SEQ ID NO: 9062281 - DNA, 22 bp, Homo sapiens
agcacttaactgacagtactat

SEQ ID NO: 9062282 - DNA, 22 bp, Homo sapiens
agcagaagaaagccacatgact

SEQ ID NO: 9062283 - DNA, 22 bp, Homo sapiens
caaattaatgtgtctcaaaata

SEQ ID NO: 9062284 - DNA, 22 bp, Homo sapiens
caaattaatgtgtctcaaaata

SEQ ID NO: 9062285 - DNA, 22 bp, Homo sapiens
agcacagagaagatttcaatta

SEQ ID NO: 9062286 - DNA, 22 bp, Homo sapiens
agcacagagaaactaagacatt

SEQ ID NO: 9062287 - DNA, 22 bp, Homo sapiens
agcacagagattatttacaaga

SEQ ID NO: 9062288 - DNA, 22 bp, Homo sapiens
agcacagaggtggaagtgtata

SEQ ID NO: 9062289 - DNA, 22 bp, Homo sapiens
agcacagaggtggaagtgtata

SEQ ID NO: 9062290 - DNA, 22 bp, Homo sapiens
agcacagagctcggggaatgga

SEQ ID NO: 9062291 - DNA, 22 bp, Homo sapiens
agcacagagttgcagagagcgt

SEQ ID NO: 9062292 - DNA, 22 bp, Homo sapiens
agcacagataacatggagtgga

SEQ ID NO: 9062293 - DNA, 22 bp, Homo sapiens
agcacagatggatgtattcatt

SEQ ID NO: 9062294 - DNA, 22 bp, Homo sapiens
agcacagatttgtcaacataga

SEQ ID NO: 9062295 - DNA, 22 bp, Homo sapiens
agcacagattctgaagagtcct

SEQ ID NO: 9062296 - DNA, 22 bp, Homo sapiens
attttctgagtccagaatttac

SEQ ID NO: 9062297 - DNA, 23 bp, Homo sapiens
agcacagactagaaaggtctttc

SEQ ID NO: 9062298 - DNA, 19 bp, Homo sapiens
agcacagacaagaccagca

SEQ ID NO: 9062299 - DNA, 19 bp, Homo sapiens
agcacagacaagaccagca

SEQ ID NO: 9062300 - DNA, 22 bp, Homo sapiens
agcacagactggtcccaggtct

SEQ ID NO: 9062301 - DNA, 22 bp, Homo sapiens
agcaaacattcagcagattggc

SEQ ID NO: 9062302 - DNA, 22 bp, Homo sapiens
attttctatgttgtaattgtta

SEQ ID NO: 9062303 - DNA, 21 bp, Homo sapiens
attttctctggatgatggtca

SEQ ID NO: 9062304 - DNA, 22 bp, Homo sapiens
attttctctttgtatatgctag

SEQ ID NO: 9062305 - DNA, 22 bp, Homo sapiens
attttctctttgtatatgctag

SEQ ID NO: 9062306 - DNA, 22 bp, Homo sapiens
attttctcacaatcctatgggg

SEQ ID NO: 9062307 - DNA, 22 bp, Homo sapiens
attttctcacaatgcagaagga

SEQ ID NO: 9062308 - DNA, 22 bp, Homo sapiens
attttctctcaaaccttaaaat

SEQ ID NO: 9062309 - DNA, 22 bp, Homo sapiens
agccttgaaccaattgtttagc

SEQ ID NO: 9062310 - DNA, 22 bp, Homo sapiens
agccttgaatgcgctgcattgg

SEQ ID NO: 9062311 - DNA, 22 bp, Homo sapiens
agccttgagttcaagtgctggc

SEQ ID NO: 9062312 - DNA, 22 bp, Homo sapiens
agccttgacactggggaaactg

SEQ ID NO: 9062313 - DNA, 22 bp, Homo sapiens
agccttgagcagttcacttggt

SEQ ID NO: 9062314 - DNA, 22 bp, Homo sapiens
agccttgatcttggtaacagga

SEQ ID NO: 9062315 - DNA, 22 bp, Homo sapiens
agccttctaggatgtcatctgc

SEQ ID NO: 9062316 - DNA, 22 bp, Homo sapiens
agccttgaacactgactgaagg

SEQ ID NO: 9062317 - DNA, 22 bp, Homo sapiens
cagcaggacgtccaagtgctat

SEQ ID NO: 9062318 - DNA, 22 bp, Homo sapiens
cagcaggaggcatggcttccct

SEQ ID NO: 9062319 - DNA, 23 bp, Homo sapiens
cagcaggagggtgcctgggctgc

SEQ ID NO: 9062320 - DNA, 22 bp, Homo sapiens
cagcaggaggtgagtagcaggt

SEQ ID NO: 9062321 - DNA, 22 bp, Homo sapiens
agctcacagaaatcctgcagga

SEQ ID NO: 9062322 - DNA, 22 bp, Homo sapiens
agctcacagaaatcctgcagga

SEQ ID NO: 9062323 - DNA, 22 bp, Homo sapiens
agctcagaagcctatgcatagt

SEQ ID NO: 9062324 - DNA, 22 bp, Homo sapiens
agctcagaagcctatgcatagt

SEQ ID NO: 9062325 - DNA, 22 bp, Homo sapiens
agctcagaactgcagacatgtg

SEQ ID NO: 9062326 - DNA, 22 bp, Homo sapiens
agctcagaactgcagacatgtg

SEQ ID NO: 9062327 - DNA, 22 bp, Homo sapiens
agctcagaactgcagacatgtg

SEQ ID NO: 9062328 - DNA, 22 bp, Homo sapiens
agctcagaactgcagacatgtg

SEQ ID NO: 9062329 - DNA, 22 bp, Homo sapiens
agctcagaaatgccagtaggta

SEQ ID NO: 9062330 - DNA, 21 bp, Homo sapiens
agctcacagttctgtcctgtc

SEQ ID NO: 9062331 - DNA, 22 bp, Homo sapiens
agctcacagtgtccttcctcaa

SEQ ID NO: 9062332 - DNA, 22 bp, Homo sapiens
cagccctggccccaggtggtct

SEQ ID NO: 9062333 - DNA, 22 bp, Homo sapiens
cagccctggcctcttcgctttc

SEQ ID NO: 9062334 - DNA, 22 bp, Homo sapiens
cagccctggccccaggtggtct

SEQ ID NO: 9062335 - DNA, 22 bp, Homo sapiens
cagccctggcctcttcgctttc

SEQ ID NO: 9062336 - DNA, 22 bp, Homo sapiens
cagccctggcgcccccagatct

SEQ ID NO: 9062337 - DNA, 22 bp, Homo sapiens
agctcctcctgtgccaggccag

SEQ ID NO: 9062338 - DNA, 22 bp, Homo sapiens
cagccctggccccaggtggtct

SEQ ID NO: 9062339 - DNA, 22 bp, Homo sapiens
agctcctcctgagtgtctggga

SEQ ID NO: 9062340 - DNA, 22 bp, Homo sapiens
cagccctgggagttggggccga

SEQ ID NO: 9062341 - DNA, 22 bp, Homo sapiens
cagccctgggagttggggccga

SEQ ID NO: 9062342 - DNA, 22 bp, Homo sapiens
cagccctgggagttggggccga

SEQ ID NO: 9062343 - DNA, 22 bp, Homo sapiens
cagccctgggtccctgccctgg

SEQ ID NO: 9062344 - DNA, 22 bp, Homo sapiens
cagccctgggatcttagtgcct

SEQ ID NO: 9062345 - DNA, 22 bp, Homo sapiens
cagccctgggtccctgccctgg

SEQ ID NO: 9062346 - DNA, 22 bp, Homo sapiens
cagccctgggtccctgccctgg

SEQ ID NO: 9062347 - DNA, 22 bp, Homo sapiens
cagccctggctagggcgagggc

SEQ ID NO: 9062348 - DNA, 22 bp, Homo sapiens
cagccctgggagttggggccga

SEQ ID NO: 9062349 - DNA, 22 bp, Homo sapiens
cagccctggctagggcgagggc

SEQ ID NO: 9062350 - DNA, 22 bp, Homo sapiens
cagccctggctagggcgagggc

SEQ ID NO: 9062351 - DNA, 22 bp, Homo sapiens
cagccctggctagggcgagggc

SEQ ID NO: 9062352 - DNA, 22 bp, Homo sapiens
cagccctggcgcccccagatct

SEQ ID NO: 9062353 - DNA, 22 bp, Homo sapiens
cagccctggctagggcgagggc

SEQ ID NO: 9062354 - DNA, 22 bp, Homo sapiens
agctcagaagggaggaaatgag

SEQ ID NO: 9062355 - DNA, 22 bp, Homo sapiens
cagccagaggggccagagtcgg

SEQ ID NO: 9062356 - DNA, 22 bp, Homo sapiens
cagccagagaaagggcactgcc

SEQ ID NO: 9062357 - DNA, 22 bp, Homo sapiens
cagccagagaaagggcactgcc

SEQ ID NO: 9062358 - DNA, 22 bp, Homo sapiens
cagccagcctctcaaccatgca

SEQ ID NO: 9062359 - DNA, 22 bp, Homo sapiens
cagccagatcaaactcagatgt

SEQ ID NO: 9062360 - DNA, 22 bp, Homo sapiens
cagccagctgaatgtaccatga

SEQ ID NO: 9062361 - DNA, 22 bp, Homo sapiens
cagccagctgaatgtaccatga

SEQ ID NO: 9062362 - DNA, 22 bp, Homo sapiens
cagccagcctctcaaccatgca

SEQ ID NO: 9062363 - DNA, 22 bp, Homo sapiens
cagccagcctctcaaccatgca

SEQ ID NO: 9062364 - DNA, 22 bp, Homo sapiens
agctccctgagatgccacagca

SEQ ID NO: 9062365 - DNA, 22 bp, Homo sapiens
agctcccattatcttctgaaac

SEQ ID NO: 9062366 - DNA, 22 bp, Homo sapiens
agctcccattatcttctgaaac

SEQ ID NO: 9062367 - DNA, 22 bp, Homo sapiens
agctcccaggcagtcatgagga

SEQ ID NO: 9062368 - DNA, 22 bp, Homo sapiens
agctcccagggctgggcaagtt

SEQ ID NO: 9062369 - DNA, 22 bp, Homo sapiens
agctcccagggctgggcaagtt

SEQ ID NO: 9062370 - DNA, 22 bp, Homo sapiens
agctcccagtctcctctccatg

SEQ ID NO: 9062371 - DNA, 22 bp, Homo sapiens
agctcccagctcctttgagaga

SEQ ID NO: 9062372 - DNA, 22 bp, Homo sapiens
agctcccagctcctttgagaga

SEQ ID NO: 9062373 - DNA, 22 bp, Homo sapiens
agctcccagcagagctggccac

SEQ ID NO: 9062374 - DNA, 22 bp, Homo sapiens
agctcccagcagagctggccac

SEQ ID NO: 9062375 - DNA, 22 bp, Homo sapiens
agctcccagagtcctctgccca

SEQ ID NO: 9062376 - DNA, 22 bp, Homo sapiens
agctccagggaaagagtggatc

SEQ ID NO: 9062377 - DNA, 22 bp, Homo sapiens
agctccagggaaagagtggatc

SEQ ID NO: 9062378 - DNA, 22 bp, Homo sapiens
cagcagcagccccaggaaggtt

SEQ ID NO: 9062379 - DNA, 22 bp, Homo sapiens
cagcagcagccccaggaaggtt

SEQ ID NO: 9062380 - DNA, 22 bp, Homo sapiens
cagcagcagcttagtggtcccc

SEQ ID NO: 9062381 - DNA, 22 bp, Homo sapiens
cagcagcagccccaggaaggtt

SEQ ID NO: 9062382 - DNA, 22 bp, Homo sapiens
cagcagcagtggctgcagaaca

SEQ ID NO: 9062383 - DNA, 22 bp, Homo sapiens
cagcagcagtggctgcagaaca

SEQ ID NO: 9062384 - DNA, 22 bp, Homo sapiens
cagcagcagtggctgcagaaca

SEQ ID NO: 9062385 - DNA, 22 bp, Homo sapiens
cagcagcagcttagtggtcccc

SEQ ID NO: 9062386 - DNA, 22 bp, Homo sapiens
cagcagcagcttagtggtcccc

SEQ ID NO: 9062387 - DNA, 22 bp, Homo sapiens
cagcagcagtggctgcagaaca

SEQ ID NO: 9062388 - DNA, 22 bp, Homo sapiens
cagcagcaggcgcacggccgtc

SEQ ID NO: 9062389 - DNA, 22 bp, Homo sapiens
cagcagcatgaattcgagccac

SEQ ID NO: 9062390 - DNA, 22 bp, Homo sapiens
cagcagcatgaattcgagccac

SEQ ID NO: 9062391 - DNA, 22 bp, Homo sapiens
cagcagcatgaattcgagccac

SEQ ID NO: 9062392 - DNA, 22 bp, Homo sapiens
cagcagcatcaggtctgtggtt

SEQ ID NO: 9062393 - DNA, 22 bp, Homo sapiens
cagcagcatcaggtctgtggtt

SEQ ID NO: 9062394 - DNA, 22 bp, Homo sapiens
cagcagcagtgttctagaatct

SEQ ID NO: 9062395 - DNA, 22 bp, Homo sapiens
cagcagcagtgttctagaatct

SEQ ID NO: 9062396 - DNA, 22 bp, Homo sapiens
cagcagcagtgttctagaatct

SEQ ID NO: 9062397 - DNA, 22 bp, Homo sapiens
agcctgtccagaggacagggct

SEQ ID NO: 9062398 - DNA, 22 bp, Homo sapiens
agcctggtttaagcattttata

SEQ ID NO: 9062399 - DNA, 22 bp, Homo sapiens
agcctggtttaagcattttata

SEQ ID NO: 9062400 - DNA, 22 bp, Homo sapiens
agcctggtttaagcattttata

SEQ ID NO: 9062401 - DNA, 22 bp, Homo sapiens
cagcagagcttattaactaaaa

SEQ ID NO: 9062402 - DNA, 22 bp, Homo sapiens
cagcagaggcacgtctgtgaat

SEQ ID NO: 9062403 - DNA, 22 bp, Homo sapiens
cagcagaggcacgtctgtgaat

SEQ ID NO: 9062404 - DNA, 22 bp, Homo sapiens
agcctccatctcccatctgtga

SEQ ID NO: 9062405 - DNA, 22 bp, Homo sapiens
cagcagaaatggattttgagat

SEQ ID NO: 9062406 - DNA, 22 bp, Homo sapiens
cagcagagcttatgttgggtca

SEQ ID NO: 9062407 - DNA, 20 bp, Homo sapiens
cagcagaaatggggtgggaa

SEQ ID NO: 9062408 - DNA, 22 bp, Homo sapiens
agcctccaaatgtcaggtcccg

SEQ ID NO: 9062409 - DNA, 22 bp, Homo sapiens
agcctccaaatgtcaggtcccg

SEQ ID NO: 9062410 - DNA, 22 bp, Homo sapiens
cagaggctaagatgagtgggtg

SEQ ID NO: 9062411 - DNA, 22 bp, Homo sapiens
agccctccaaaggttgggggag

SEQ ID NO: 9062412 - DNA, 22 bp, Homo sapiens
agccctccatctgtgctcaggc

SEQ ID NO: 9062413 - DNA, 22 bp, Homo sapiens
cagaggctcagatggccctggc

SEQ ID NO: 9062414 - DNA, 22 bp, Homo sapiens
cagaggctcagatggccctggc

SEQ ID NO: 9062415 - DNA, 19 bp, Homo sapiens
cagcaagaatgaaggcata

SEQ ID NO: 9062416 - DNA, 22 bp, Homo sapiens
cagcacacagtgactcgcacct

SEQ ID NO: 9062417 - DNA, 22 bp, Homo sapiens
cagcacacagtgactcgcacct

SEQ ID NO: 9062418 - DNA, 23 bp, Homo sapiens
agcctcagccggtggcagaagtg

SEQ ID NO: 9062419 - DNA, 22 bp, Homo sapiens
agcctcagcacgcagctctgtg

SEQ ID NO: 9062420 - DNA, 22 bp, Homo sapiens
agcctcagcacgcagctctgtg

SEQ ID NO: 9062421 - DNA, 22 bp, Homo sapiens
agcctcagcacgcagctctgtg

SEQ ID NO: 9062422 - DNA, 21 bp, Homo sapiens
agcctcaggttgttggttctt

SEQ ID NO: 9062423 - DNA, 22 bp, Homo sapiens
cagcacagctgaggggctgtct

SEQ ID NO: 9062424 - DNA, 22 bp, Homo sapiens
cagcacagctggctctggaagc

SEQ ID NO: 9062425 - DNA, 22 bp, Homo sapiens
cagcacagggacaatagcagat

SEQ ID NO: 9062426 - DNA, 22 bp, Homo sapiens
cagcacagggcttgagaggtgt

SEQ ID NO: 9062427 - DNA, 22 bp, Homo sapiens
cagcacagggcttgagaggtgt

SEQ ID NO: 9062428 - DNA, 22 bp, Homo sapiens
cagcacagggacaatagcagat

SEQ ID NO: 9062429 - DNA, 22 bp, Homo sapiens
agccccttgctgccctctagag

SEQ ID NO: 9062430 - DNA, 22 bp, Homo sapiens
agccccttgcacttccccacgc

SEQ ID NO: 9062431 - DNA, 22 bp, Homo sapiens
agccccttgcacttccccacgc

SEQ ID NO: 9062432 - DNA, 19 bp, Homo sapiens
agccccttggtactgtcct

SEQ ID NO: 9062433 - DNA, 22 bp, Homo sapiens
agccccttgtgggcgcacagca

SEQ ID NO: 9062434 - DNA, 19 bp, Homo sapiens
agccccttggtactgtcct

SEQ ID NO: 9062435 - DNA, 22 bp, Homo sapiens
agcccggcttccccggttgcta

SEQ ID NO: 9062436 - DNA, 22 bp, Homo sapiens
agccctaaattatctttatttt

SEQ ID NO: 9062437 - DNA, 22 bp, Homo sapiens
cagagctggcctgtgatttttg

SEQ ID NO: 9062438 - DNA, 22 bp, Homo sapiens
cagagctggagggaaccctggc

SEQ ID NO: 9062439 - DNA, 23 bp, Homo sapiens
cagagctggctcagagctgcctg

SEQ ID NO: 9062440 - DNA, 23 bp, Homo sapiens
cagagctggctcagagctgcctg

SEQ ID NO: 9062441 - DNA, 17 bp, Homo sapiens
agcccccactcccaagt

SEQ ID NO: 9062442 - DNA, 23 bp, Homo sapiens
cagagctggctcagagctgcctg

SEQ ID NO: 9062443 - DNA, 19 bp, Homo sapiens
agcccccagacagcaggcc

SEQ ID NO: 9062444 - DNA, 19 bp, Homo sapiens
agcccccagacagcaggcc

SEQ ID NO: 9062445 - DNA, 22 bp, Homo sapiens
agccccttccagttctcagatc

SEQ ID NO: 9062446 - DNA, 22 bp, Homo sapiens
cagagctggagcttgaatggag

SEQ ID NO: 9062447 - DNA, 22 bp, Homo sapiens
cagagctgcttcccagtttgtg

SEQ ID NO: 9062448 - DNA, 22 bp, Homo sapiens
cagagctggagaagtggattta

SEQ ID NO: 9062449 - DNA, 22 bp, Homo sapiens
agcccaggagtccttaaggacc

SEQ ID NO: 9062450 - DNA, 22 bp, Homo sapiens
agcccaggagtttgaggctgtg

SEQ ID NO: 9062451 - DNA, 22 bp, Homo sapiens
agcccaggagtttgaggctgtg

SEQ ID NO: 9062452 - DNA, 22 bp, Homo sapiens
agcccagcctgattctacaccc

SEQ ID NO: 9062453 - DNA, 22 bp, Homo sapiens
agcccaggaagttgaggcttgc

SEQ ID NO: 9062454 - DNA, 22 bp, Homo sapiens
agcccaggaagttgaggcttgc

SEQ ID NO: 9062455 - DNA, 22 bp, Homo sapiens
agcccaggagcctttggagggt

SEQ ID NO: 9062456 - DNA, 22 bp, Homo sapiens
agcccaggagcctttggagggt

SEQ ID NO: 9062457 - DNA, 17 bp, Homo sapiens
cagacagatatcctggg

SEQ ID NO: 9062458 - DNA, 22 bp, Homo sapiens
cagacagagtcttcccatcagt

SEQ ID NO: 9062459 - DNA, 22 bp, Homo sapiens
cagacagacctgcaagggcaca

SEQ ID NO: 9062460 - DNA, 22 bp, Homo sapiens
cagacagacctgcaagggcaca

SEQ ID NO: 9062461 - DNA, 16 bp, Homo sapiens
cagacagagaacaggg

SEQ ID NO: 9062462 - DNA, 22 bp, Homo sapiens
cagacagaggctgtatgagggc

SEQ ID NO: 9062463 - DNA, 22 bp, Homo sapiens
agccaggtcagctcaccctgct

SEQ ID NO: 9062464 - DNA, 17 bp, Homo sapiens
agccaggtacaagtcca

SEQ ID NO: 9062465 - DNA, 20 bp, Homo sapiens
agccagggttctggatgcac

SEQ ID NO: 9062466 - DNA, 22 bp, Homo sapiens
cagagatgggtcgcagagatgg

SEQ ID NO: 9062467 - DNA, 22 bp, Homo sapiens
cagagatgtgatccagctgtct

SEQ ID NO: 9062468 - DNA, 22 bp, Homo sapiens
cagagatttttatgcacaccaa

SEQ ID NO: 9062469 - DNA, 22 bp, Homo sapiens
cagagcaacaccctttacatcg

SEQ ID NO: 9062470 - DNA, 22 bp, Homo sapiens
agcccagccggattcccagttc

SEQ ID NO: 9062471 - DNA, 22 bp, Homo sapiens
cagagataccattgctaaaatt

SEQ ID NO: 9062472 - DNA, 22 bp, Homo sapiens
cagagagggcggccctggcttc

SEQ ID NO: 9062473 - DNA, 22 bp, Homo sapiens
cagagagggcggccctggcttc

SEQ ID NO: 9062474 - DNA, 22 bp, Homo sapiens
cagagaggatggattccatagc

SEQ ID NO: 9062475 - DNA, 22 bp, Homo sapiens
cagaaatgacaaagtaagagga

SEQ ID NO: 9062476 - DNA, 23 bp, Homo sapiens
cagaaatgacagtaagcaccctg

SEQ ID NO: 9062477 - DNA, 22 bp, Homo sapiens
agccacagctccttggtggaga

SEQ ID NO: 9062478 - DNA, 22 bp, Homo sapiens
agccacagcgaacctctcttcc

SEQ ID NO: 9062479 - DNA, 22 bp, Homo sapiens
agccacagcgaacctctcttcc

SEQ ID NO: 9062480 - DNA, 22 bp, Homo sapiens
agccacagctccttggtggaga

SEQ ID NO: 9062481 - DNA, 22 bp, Homo sapiens
cagaactgggcagggagcagag

SEQ ID NO: 9062482 - DNA, 22 bp, Homo sapiens
cagaaccaggaactgatggaga

SEQ ID NO: 9062483 - DNA, 22 bp, Homo sapiens
agccacagcctgacttaactgt

SEQ ID NO: 9062484 - DNA, 22 bp, Homo sapiens
agccacagcccacaggactctt

SEQ ID NO: 9062485 - DNA, 22 bp, Homo sapiens
agccacagcccacaggactctt

SEQ ID NO: 9062486 - DNA, 22 bp, Homo sapiens
agccacagcccacaggactctt

SEQ ID NO: 9062487 - DNA, 23 bp, Homo sapiens
agccacagccagagctatctcca

SEQ ID NO: 9062488 - DNA, 23 bp, Homo sapiens
agccacagccagagctatctcca

SEQ ID NO: 9062489 - DNA, 22 bp, Homo sapiens
agccacagcatgtgtgtatgta

SEQ ID NO: 9062490 - DNA, 22 bp, Homo sapiens
agccacagcaacaagtgcaatt

SEQ ID NO: 9062491 - DNA, 22 bp, Homo sapiens
agccacagaggttgatgtggtt

SEQ ID NO: 9062492 - DNA, 22 bp, Homo sapiens
agccacagcaacaagtgcaatt

SEQ ID NO: 9062493 - DNA, 22 bp, Homo sapiens
agccacagcaacaagtgcaatt

SEQ ID NO: 9062494 - DNA, 22 bp, Homo sapiens
agccacagcaacaagtgcaatt

SEQ ID NO: 9062495 - DNA, 22 bp, Homo sapiens
agccacagcacattgtaagaaa

SEQ ID NO: 9062496 - DNA, 22 bp, Homo sapiens
agccacagcatgtgtgtatgta

SEQ ID NO: 9062497 - DNA, 22 bp, Homo sapiens
agccacagcacattgtaagaaa

SEQ ID NO: 9062498 - DNA, 22 bp, Homo sapiens
cactgaaaattagctttcctga

SEQ ID NO: 9062499 - DNA, 22 bp, Homo sapiens
cactgaaaggaaaccagagcat

SEQ ID NO: 9062500 - DNA, 22 bp, Homo sapiens
cactgaaatattaatatcttat

SEQ ID NO: 9062501 - DNA, 22 bp, Homo sapiens
agccaagctgatctcctgctga

SEQ ID NO: 9062502 - DNA, 22 bp, Homo sapiens
agccacagagagggagctgcaa

SEQ ID NO: 9062503 - DNA, 19 bp, Homo sapiens
agccacagaacttgcagga

SEQ ID NO: 9062504 - DNA, 22 bp, Homo sapiens
agccacagagcaggagaccttt

SEQ ID NO: 9062505 - DNA, 22 bp, Homo sapiens
agccacagagagggagctgcaa

SEQ ID NO: 9062506 - DNA, 22 bp, Homo sapiens
agccacagagagggagctgcaa

SEQ ID NO: 9062507 - DNA, 22 bp, Homo sapiens
agccacagaggttgatgtggtt

SEQ ID NO: 9062508 - DNA, 22 bp, Homo sapiens
agccacagagcaggagaccttt

SEQ ID NO: 9062509 - DNA, 22 bp, Homo sapiens
agccacagagcaggagaccttt

SEQ ID NO: 9062510 - DNA, 22 bp, Homo sapiens
agccacagagcaggagaccttt

SEQ ID NO: 9062511 - DNA, 22 bp, Homo sapiens
cagaagcattccagcaaatagt

SEQ ID NO: 9062512 - DNA, 22 bp, Homo sapiens
cagaagcagtgagagatgtgca

SEQ ID NO: 9062513 - DNA, 22 bp, Homo sapiens
cagaagcagtgagagatgtgca

SEQ ID NO: 9062514 - DNA, 22 bp, Homo sapiens
cagaagcagtgagagatgtgca

SEQ ID NO: 9062515 - DNA, 22 bp, Homo sapiens
cagaagcattgactccttgctc

SEQ ID NO: 9062516 - DNA, 22 bp, Homo sapiens
cagaagcattgactccttgctc

SEQ ID NO: 9062517 - DNA, 22 bp, Homo sapiens
cagaagcattgactccttgctc

SEQ ID NO: 9062518 - DNA, 22 bp, Homo sapiens
cagaagctgcagtgatctggga

SEQ ID NO: 9062519 - DNA, 22 bp, Homo sapiens
cagaagcctgcctcagatgcac

SEQ ID NO: 9062520 - DNA, 22 bp, Homo sapiens
cagaagcctgcctcagatgcac

SEQ ID NO: 9062521 - DNA, 22 bp, Homo sapiens
cagaagcctgcctcagatgcac

SEQ ID NO: 9062522 - DNA, 22 bp, Homo sapiens
cagaagcctaaatagtgcacca

SEQ ID NO: 9062523 - DNA, 22 bp, Homo sapiens
cagaagcctgcctcagatgcac

SEQ ID NO: 9062524 - DNA, 22 bp, Homo sapiens
cagaagaaatcattatctggac

SEQ ID NO: 9062525 - DNA, 22 bp, Homo sapiens
cagaagaaagtggggagacaag

SEQ ID NO: 9062526 - DNA, 22 bp, Homo sapiens
cagaagaaagtggggagacaag

SEQ ID NO: 9062527 - DNA, 22 bp, Homo sapiens
cagaagaaagtggggagacaag

SEQ ID NO: 9062528 - DNA, 22 bp, Homo sapiens
cagaagagatgaaatagtatta

SEQ ID NO: 9062529 - DNA, 22 bp, Homo sapiens
cagaagcagtgagagatgtgca

SEQ ID NO: 9062530 - DNA, 22 bp, Homo sapiens
cagaagaatggtgtctgagctc

SEQ ID NO: 9062531 - DNA, 22 bp, Homo sapiens
cagaagaatggtgtctgagctc

SEQ ID NO: 9062532 - DNA, 22 bp, Homo sapiens
cagaagaatggtgtctgagctc

SEQ ID NO: 9062533 - DNA, 22 bp, Homo sapiens
agccaggatggtctcgatcggc

SEQ ID NO: 9062534 - DNA, 22 bp, Homo sapiens
cagacagacagccgtggccacc

SEQ ID NO: 9062535 - DNA, 22 bp, Homo sapiens
cagacagaaggctccttgaggt

SEQ ID NO: 9062536 - DNA, 22 bp, Homo sapiens
cagacagacagccgtggccacc

SEQ ID NO: 9062537 - DNA, 22 bp, Homo sapiens
cagacagacagccgtggccacc

SEQ ID NO: 9062538 - DNA, 22 bp, Homo sapiens
cagacagacagccgtggccacc

SEQ ID NO: 9062539 - DNA, 22 bp, Homo sapiens
agccaggacgttgctcagctcc

SEQ ID NO: 9062540 - DNA, 22 bp, Homo sapiens
agccaggatggtctcgatcggc

SEQ ID NO: 9062541 - DNA, 22 bp, Homo sapiens
agccaggatggtctcgatcggc

SEQ ID NO: 9062542 - DNA, 22 bp, Homo sapiens
agccaggatggtctcgatcggc

SEQ ID NO: 9062543 - DNA, 17 bp, Homo sapiens
cagaaggaagcatggca

SEQ ID NO: 9062544 - DNA, 17 bp, Homo sapiens
cagaaggaagcatggca

SEQ ID NO: 9062545 - DNA, 22 bp, Homo sapiens
cagaagctttgctcataaccat

SEQ ID NO: 9062546 - DNA, 22 bp, Homo sapiens
gagcagtgactggagcatgaga

SEQ ID NO: 9062547 - DNA, 22 bp, Homo sapiens
gagcagtgactggagcatgaga

SEQ ID NO: 9062548 - DNA, 22 bp, Homo sapiens
gagccagccttcttctgaggtc

SEQ ID NO: 9062549 - DNA, 22 bp, Homo sapiens
atggccctgtttatggtaaggc

SEQ ID NO: 9062550 - DNA, 22 bp, Homo sapiens
atggccagtctgttggacagca

SEQ ID NO: 9062551 - DNA, 22 bp, Homo sapiens
atggccagtctgttggacagca

SEQ ID NO: 9062552 - DNA, 22 bp, Homo sapiens
atggcccaaactgcaattactt

SEQ ID NO: 9062553 - DNA, 22 bp, Homo sapiens
gagccaggcaccttctgtgttg

SEQ ID NO: 9062554 - DNA, 22 bp, Homo sapiens
gagccaggcccgtacttgctgt

SEQ ID NO: 9062555 - DNA, 22 bp, Homo sapiens
atggctgcatcatcctggttga

SEQ ID NO: 9062556 - DNA, 22 bp, Homo sapiens
atggctgcccacgttggtgctt

SEQ ID NO: 9062557 - DNA, 22 bp, Homo sapiens
atggctgcctgggcgctggccg

SEQ ID NO: 9062558 - DNA, 22 bp, Homo sapiens
atggctgctctggatggagtcc

SEQ ID NO: 9062559 - DNA, 22 bp, Homo sapiens
atggctgccccaaattgttgct

SEQ ID NO: 9062560 - DNA, 19 bp, Homo sapiens
atggctgctgattggggat

SEQ ID NO: 9062561 - DNA, 22 bp, Homo sapiens
atggctgctttcccttagcacc

SEQ ID NO: 9062562 - DNA, 22 bp, Homo sapiens
gagccaggagatacctaagggg

SEQ ID NO: 9062563 - DNA, 22 bp, Homo sapiens
gagccaggaggcagagactgca

SEQ ID NO: 9062564 - DNA, 22 bp, Homo sapiens
gagccagctacatggtctgcaa

SEQ ID NO: 9062565 - DNA, 22 bp, Homo sapiens
gagccagctatgtagcaagagg

SEQ ID NO: 9062566 - DNA, 22 bp, Homo sapiens
gagccagctatgtagcaagagg

SEQ ID NO: 9062567 - DNA, 22 bp, Homo sapiens
gagagctgtggtttgaccaggc

SEQ ID NO: 9062568 - DNA, 22 bp, Homo sapiens
gagagctgtggtttgaccaggc

SEQ ID NO: 9062569 - DNA, 22 bp, Homo sapiens
gagagctgtggtttgaccaggc

SEQ ID NO: 9062570 - DNA, 22 bp, Homo sapiens
gagagctgtgttcattctacca

SEQ ID NO: 9062571 - DNA, 22 bp, Homo sapiens
gagagctttcatgttgggaatg

SEQ ID NO: 9062572 - DNA, 22 bp, Homo sapiens
gagaggaaagaaccaatgaccc

SEQ ID NO: 9062573 - DNA, 22 bp, Homo sapiens
gagagctgtccggctgagcagc

SEQ ID NO: 9062574 - DNA, 22 bp, Homo sapiens
atggcatcgtcaccttttcagt

SEQ ID NO: 9062575 - DNA, 22 bp, Homo sapiens
atggcatcatctttcttcatta

SEQ ID NO: 9062576 - DNA, 22 bp, Homo sapiens
atggcagttgcccagccaatcc

SEQ ID NO: 9062577 - DNA, 22 bp, Homo sapiens
gagaggaactcccagtgcctgg

SEQ ID NO: 9062578 - DNA, 22 bp, Homo sapiens
gagaggaactcccagtgcctgg

SEQ ID NO: 9062579 - DNA, 22 bp, Homo sapiens
gagaggaactcccagtgcctgg

SEQ ID NO: 9062580 - DNA, 22 bp, Homo sapiens
gagaggaagccttctgtacttg

SEQ ID NO: 9062581 - DNA, 22 bp, Homo sapiens
gagaggaagccttctgtacttg

SEQ ID NO: 9062582 - DNA, 22 bp, Homo sapiens
gagaggaagccttctgtacttg

SEQ ID NO: 9062583 - DNA, 22 bp, Homo sapiens
atggcagctggcttgggcacct

SEQ ID NO: 9062584 - DNA, 22 bp, Homo sapiens
atggcaggatacccagtccggc

SEQ ID NO: 9062585 - DNA, 22 bp, Homo sapiens
atggcaggatacccagtccggc

SEQ ID NO: 9062586 - DNA, 22 bp, Homo sapiens
gagaacagatttttctgctgtc

SEQ ID NO: 9062587 - DNA, 22 bp, Homo sapiens
atggcagtagaatgggggaaaa

SEQ ID NO: 9062588 - DNA, 22 bp, Homo sapiens
atggcagtatttgtatcacaga

SEQ ID NO: 9062589 - DNA, 22 bp, Homo sapiens
atggcagggcccttggctccca

SEQ ID NO: 9062590 - DNA, 22 bp, Homo sapiens
atggcagtcagagacaggcaga

SEQ ID NO: 9062591 - DNA, 22 bp, Homo sapiens
atggcagggcccttggctccca

SEQ ID NO: 9062592 - DNA, 22 bp, Homo sapiens
atggcagggaccaagctgtcat

SEQ ID NO: 9062593 - DNA, 22 bp, Homo sapiens
atggcagggactgtggcccttg

SEQ ID NO: 9062594 - DNA, 22 bp, Homo sapiens
atggcagggactgtggcccttg

SEQ ID NO: 9062595 - DNA, 22 bp, Homo sapiens
gagaaatgctagcttaggaatc

SEQ ID NO: 9062596 - DNA, 22 bp, Homo sapiens
gagaaatgcatgcatgtcatca

SEQ ID NO: 9062597 - DNA, 22 bp, Homo sapiens
gagaaatgagtgattcactttt

SEQ ID NO: 9062598 - DNA, 22 bp, Homo sapiens
atggagagtgaaagtctctcta

SEQ ID NO: 9062599 - DNA, 20 bp, Homo sapiens
atggaggaagggcaagagaa

SEQ ID NO: 9062600 - DNA, 22 bp, Homo sapiens
atggagccattcctgaagactt

SEQ ID NO: 9062601 - DNA, 22 bp, Homo sapiens
atggagcagcagaaggggcttg

SEQ ID NO: 9062602 - DNA, 22 bp, Homo sapiens
atggaagaacgctcagggttac

SEQ ID NO: 9062603 - DNA, 22 bp, Homo sapiens
atggaagaaagagacaatttga

SEQ ID NO: 9062604 - DNA, 22 bp, Homo sapiens
atggaagactaacagaaacatg

SEQ ID NO: 9062605 - DNA, 22 bp, Homo sapiens
atggaagagtccccatggatga

SEQ ID NO: 9062606 - DNA, 22 bp, Homo sapiens
atggaagctgaaaaagacacgg

SEQ ID NO: 9062607 - DNA, 22 bp, Homo sapiens
atggaaggctttatgactcaaa

SEQ ID NO: 9062608 - DNA, 22 bp, Homo sapiens
atggaagtgcaacttgctcatc

SEQ ID NO: 9062609 - DNA, 23 bp, Homo sapiens
atggaagtcactgttttcttgtc

SEQ ID NO: 9062610 - DNA, 22 bp, Homo sapiens
atggaaggtcctacagagcgca

SEQ ID NO: 9062611 - DNA, 22 bp, Homo sapiens
atggaaggtcctacagagcgca

SEQ ID NO: 9062612 - DNA, 22 bp, Homo sapiens
atggaagggacagaagggcaag

SEQ ID NO: 9062613 - DNA, 22 bp, Homo sapiens
atggacttaagagtcagaagct

SEQ ID NO: 9062614 - DNA, 22 bp, Homo sapiens
atggacagtgtgaagcagatag

SEQ ID NO: 9062615 - DNA, 22 bp, Homo sapiens
atggaagttggaaccattcata

SEQ ID NO: 9062616 - DNA, 22 bp, Homo sapiens
atggaatatagtcttatatctc

SEQ ID NO: 9062617 - DNA, 22 bp, Homo sapiens
gacagcaacactcaattctgca

SEQ ID NO: 9062618 - DNA, 22 bp, Homo sapiens
gacagcaacacatgcttagtgc

SEQ ID NO: 9062619 - DNA, 22 bp, Homo sapiens
gacagcaacctcatgagaaact

SEQ ID NO: 9062620 - DNA, 22 bp, Homo sapiens
gacagcaaagcagagccaaggc

SEQ ID NO: 9062621 - DNA, 22 bp, Homo sapiens
gacagatgtgggtgacagcagc

SEQ ID NO: 9062622 - DNA, 22 bp, Homo sapiens
gacagcaaagcagagccaaggc

SEQ ID NO: 9062623 - DNA, 22 bp, Homo sapiens
gacagatggtcagtgttgaagt

SEQ ID NO: 9062624 - DNA, 22 bp, Homo sapiens
atgccactgcgctccagcctgg

SEQ ID NO: 9062625 - DNA, 22 bp, Homo sapiens
atgccactgcgctccagcctgg

SEQ ID NO: 9062626 - DNA, 22 bp, Homo sapiens
atgccactgcgctccagcctgg

SEQ ID NO: 9062627 - DNA, 22 bp, Homo sapiens
gacagaggcaagaccagaagcc

SEQ ID NO: 9062628 - DNA, 22 bp, Homo sapiens
gacagaggtgtccttgagtcca

SEQ ID NO: 9062629 - DNA, 22 bp, Homo sapiens
gacagaggtgtccttgagtcca

SEQ ID NO: 9062630 - DNA, 22 bp, Homo sapiens
gacagagggttccaaaattgat

SEQ ID NO: 9062631 - DNA, 22 bp, Homo sapiens
gacagaggctggagcacctcct

SEQ ID NO: 9062632 - DNA, 22 bp, Homo sapiens
gacagaggctggagcacctcct

SEQ ID NO: 9062633 - DNA, 22 bp, Homo sapiens
gacagagttgttgatgtatgct

SEQ ID NO: 9062634 - DNA, 22 bp, Homo sapiens
gacagagtgcagggctagaaga

SEQ ID NO: 9062635 - DNA, 22 bp, Homo sapiens
gacagagttgttgatgtatgct

SEQ ID NO: 9062636 - DNA, 22 bp, Homo sapiens
gacagatgagggagtattctca

SEQ ID NO: 9062637 - DNA, 23 bp, Homo sapiens
gacagagtgagaccttgtcttac

SEQ ID NO: 9062638 - DNA, 23 bp, Homo sapiens
gacagagtgagaccttgtcttac

SEQ ID NO: 9062639 - DNA, 22 bp, Homo sapiens
atggaaatcgatgtctaagtta

SEQ ID NO: 9062640 - DNA, 22 bp, Homo sapiens
atggaaaaggctgatttcatta

SEQ ID NO: 9062641 - DNA, 22 bp, Homo sapiens
atggaaaaggctgatttcatta

SEQ ID NO: 9062642 - DNA, 22 bp, Homo sapiens
atggaaaaggctgatttcatta

SEQ ID NO: 9062643 - DNA, 22 bp, Homo sapiens
atgccacttcattccagcctcg

SEQ ID NO: 9062644 - DNA, 22 bp, Homo sapiens
atggaaatgttaagtcagtccg

SEQ ID NO: 9062645 - DNA, 22 bp, Homo sapiens
atggaaatggagtgtgcttgct

SEQ ID NO: 9062646 - DNA, 22 bp, Homo sapiens
atggaaatgtaacttctgattc

SEQ ID NO: 9062647 - DNA, 21 bp, Homo sapiens
atggaaattggcaaatgctac

SEQ ID NO: 9062648 - DNA, 22 bp, Homo sapiens
atggaactgctaataatagttg

SEQ ID NO: 9062649 - DNA, 22 bp, Homo sapiens
atggaacaggctcagagatgct

SEQ ID NO: 9062650 - DNA, 22 bp, Homo sapiens
gaggagctgaggctgaggcctc

SEQ ID NO: 9062651 - DNA, 17 bp, Homo sapiens
gaggagctccagtaggt

SEQ ID NO: 9062652 - DNA, 22 bp, Homo sapiens
gaggagctctgctccatccttc

SEQ ID NO: 9062653 - DNA, 22 bp, Homo sapiens
atgtagaaagttattgtcactg

SEQ ID NO: 9062654 - DNA, 19 bp, Homo sapiens
atgtaccatttgaagttct

SEQ ID NO: 9062655 - DNA, 22 bp, Homo sapiens
atgtaccagatgtatgttctca

SEQ ID NO: 9062656 - DNA, 22 bp, Homo sapiens
gaggagctgggaccctgtcatc

SEQ ID NO: 9062657 - DNA, 22 bp, Homo sapiens
gaggagctggctgtcgggaggc

SEQ ID NO: 9062658 - DNA, 22 bp, Homo sapiens
gaggagctggcagcgtctccgc

SEQ ID NO: 9062659 - DNA, 22 bp, Homo sapiens
gaggagctggcagcgtctccgc

SEQ ID NO: 9062660 - DNA, 22 bp, Homo sapiens
gaggccaggagtgctgtaagtt

SEQ ID NO: 9062661 - DNA, 22 bp, Homo sapiens
gaggccagggtaccatcaacat

SEQ ID NO: 9062662 - DNA, 22 bp, Homo sapiens
gaggccaggggtcagcaattgg

SEQ ID NO: 9062663 - DNA, 22 bp, Homo sapiens
gaggccagggatgcaatgagag

SEQ ID NO: 9062664 - DNA, 22 bp, Homo sapiens
gaggccagggatgcaatgagag

SEQ ID NO: 9062665 - DNA, 22 bp, Homo sapiens
atgtacaattctccttggtagg

SEQ ID NO: 9062666 - DNA, 22 bp, Homo sapiens
atgtacaatttttgcttagggg

SEQ ID NO: 9062667 - DNA, 22 bp, Homo sapiens
atgtacaatctatcacaagaag

SEQ ID NO: 9062668 - DNA, 22 bp, Homo sapiens
atgtacaatctatcacaagaag

SEQ ID NO: 9062669 - DNA, 22 bp, Homo sapiens
gagctggggcagcttaggagtg

SEQ ID NO: 9062670 - DNA, 22 bp, Homo sapiens
gagctgggctggcttcctccct

SEQ ID NO: 9062671 - DNA, 21 bp, Homo sapiens
gagctgggcgaggctccgggg

SEQ ID NO: 9062672 - DNA, 21 bp, Homo sapiens
gagctgggcgaggctccgggg

SEQ ID NO: 9062673 - DNA, 22 bp, Homo sapiens
gagctgggcgagccggggaagt

SEQ ID NO: 9062674 - DNA, 23 bp, Homo sapiens
atggtcagaattttccagctgag

SEQ ID NO: 9062675 - DNA, 22 bp, Homo sapiens
atggtcagttgcagctaatgtt

SEQ ID NO: 9062676 - DNA, 22 bp, Homo sapiens
atggtccttatggccgtgatat

SEQ ID NO: 9062677 - DNA, 23 bp, Homo sapiens
atggtccagccagctgcacagga

SEQ ID NO: 9062678 - DNA, 22 bp, Homo sapiens
gagctgggcctcagaacacagt

SEQ ID NO: 9062679 - DNA, 22 bp, Homo sapiens
gagctgggcctgcgagtgctgc

SEQ ID NO: 9062680 - DNA, 22 bp, Homo sapiens
atggtcaagatcctctagttta

SEQ ID NO: 9062681 - DNA, 22 bp, Homo sapiens
atggtatacaattatggactgt

SEQ ID NO: 9062682 - DNA, 22 bp, Homo sapiens
atggtaggtacaacagcaggca

SEQ ID NO: 9062683 - DNA, 22 bp, Homo sapiens
atggtacaattttcatttgtgg

SEQ ID NO: 9062684 - DNA, 22 bp, Homo sapiens
atggtacaattttcatttgtgg

SEQ ID NO: 9062685 - DNA, 22 bp, Homo sapiens
atggtacagataatacatgctg

SEQ ID NO: 9062686 - DNA, 22 bp, Homo sapiens
atggtacagtgcactgaatgga

SEQ ID NO: 9062687 - DNA, 22 bp, Homo sapiens
atggtacatagtttaaataagg

SEQ ID NO: 9062688 - DNA, 22 bp, Homo sapiens
atggtacaaaatgtataaagtc

SEQ ID NO: 9062689 - DNA, 22 bp, Homo sapiens
atggtacaatgatggatagtgg

SEQ ID NO: 9062690 - DNA, 22 bp, Homo sapiens
atggctggatagttgaagctct

SEQ ID NO: 9062691 - DNA, 22 bp, Homo sapiens
atggctggaggccgggcttcct

SEQ ID NO: 9062692 - DNA, 22 bp, Homo sapiens
atggctggcactggcctgggtt

SEQ ID NO: 9062693 - DNA, 22 bp, Homo sapiens
atgggtttataggtggactttt

SEQ ID NO: 9062694 - DNA, 22 bp, Homo sapiens
atgggttcaagtgattctcctg

SEQ ID NO: 9062695 - DNA, 22 bp, Homo sapiens
atgggttcaagtgattctcctg

SEQ ID NO: 9062696 - DNA, 22 bp, Homo sapiens
atggggctgaaacatggaagag

SEQ ID NO: 9062697 - DNA, 22 bp, Homo sapiens
gaggggagacagggaaatcagt

SEQ ID NO: 9062698 - DNA, 22 bp, Homo sapiens
gaggggagaggcttatggatca

SEQ ID NO: 9062699 - DNA, 22 bp, Homo sapiens
gaggggagacagggaaatcagt

SEQ ID NO: 9062700 - DNA, 22 bp, Homo sapiens
gaggggagcccccatcctccag

SEQ ID NO: 9062701 - DNA, 16 bp, Homo sapiens
gaggggagcagtaggc

SEQ ID NO: 9062702 - DNA, 22 bp, Homo sapiens
atgtgtgtacacacgtgactct

SEQ ID NO: 9062703 - DNA, 22 bp, Homo sapiens
atgtgtgtatatatagtcattt

SEQ ID NO: 9062704 - DNA, 22 bp, Homo sapiens
atgtgtgtatgtgcctatatct

SEQ ID NO: 9062705 - DNA, 22 bp, Homo sapiens
atgtgtgtatatatagtcattt

SEQ ID NO: 9062706 - DNA, 22 bp, Homo sapiens
atgtgtgtgcatttctctccct

SEQ ID NO: 9062707 - DNA, 22 bp, Homo sapiens
atgtgtgtgcatttctctccct

SEQ ID NO: 9062708 - DNA, 22 bp, Homo sapiens
atgtgtgtgatgggcgccgcca

SEQ ID NO: 9062709 - DNA, 22 bp, Homo sapiens
atgtgtgtgatgggcgccgcca

SEQ ID NO: 9062710 - DNA, 22 bp, Homo sapiens
atgtgtgtatgtgcctatatct

SEQ ID NO: 9062711 - DNA, 22 bp, Homo sapiens
atgtgtccacaggtgtgagaga

SEQ ID NO: 9062712 - DNA, 22 bp, Homo sapiens
gaggctgctgttagccctgggc

SEQ ID NO: 9062713 - DNA, 22 bp, Homo sapiens
gaggctgctgttagccctgggc

SEQ ID NO: 9062714 - DNA, 22 bp, Homo sapiens
gaggctgctttgatgacaggag

SEQ ID NO: 9062715 - DNA, 22 bp, Homo sapiens
gaggctgctttcctcctatcct

SEQ ID NO: 9062716 - DNA, 22 bp, Homo sapiens
atgtgtatgtgtatacacacag

SEQ ID NO: 9062717 - DNA, 22 bp, Homo sapiens
atgtgtatgtcttattcaaaga

SEQ ID NO: 9062718 - DNA, 22 bp, Homo sapiens
atgtctttataaatgtataatg

SEQ ID NO: 9062719 - DNA, 22 bp, Homo sapiens
atgtctttattaatatcatgcc

SEQ ID NO: 9062720 - DNA, 22 bp, Homo sapiens
atgtctttctagttaagagcta

SEQ ID NO: 9062721 - DNA, 22 bp, Homo sapiens
atgtctttcgcatcagtagcta

SEQ ID NO: 9062722 - DNA, 22 bp, Homo sapiens
gaggcctgggagcctgtcctcc

SEQ ID NO: 9062723 - DNA, 22 bp, Homo sapiens
gaggcctgggcaagggggtctg

SEQ ID NO: 9062724 - DNA, 22 bp, Homo sapiens
atgtctgctttccttttaatca

SEQ ID NO: 9062725 - DNA, 22 bp, Homo sapiens
atgtctgctttccttttaatca

SEQ ID NO: 9062726 - DNA, 22 bp, Homo sapiens
gaggcctgggttacctactcgt

SEQ ID NO: 9062727 - DNA, 22 bp, Homo sapiens
gaggcctggctgggaggaggtg

SEQ ID NO: 9062728 - DNA, 22 bp, Homo sapiens
gaggcctggctgggaggaggtg

SEQ ID NO: 9062729 - DNA, 22 bp, Homo sapiens
gaggcctgggagaactgttttt

SEQ ID NO: 9062730 - DNA, 22 bp, Homo sapiens
gaggcctgggagaactgttttt

SEQ ID NO: 9062731 - DNA, 23 bp, Homo sapiens
gaggcctggccctgccacatctc

SEQ ID NO: 9062732 - DNA, 22 bp, Homo sapiens
gaggcctggagccgcctaggcg

SEQ ID NO: 9062733 - DNA, 22 bp, Homo sapiens
atgtctttctcatacaagccca

SEQ ID NO: 9062734 - DNA, 22 bp, Homo sapiens
atgtctttctcacagccagttc

SEQ ID NO: 9062735 - DNA, 22 bp, Homo sapiens
atgtctttctagttaagagcta

SEQ ID NO: 9062736 - DNA, 22 bp, Homo sapiens
atgtctttcttgtgtcccaaga

SEQ ID NO: 9062737 - DNA, 22 bp, Homo sapiens
atgtctttcttatggtctgttg

SEQ ID NO: 9062738 - DNA, 22 bp, Homo sapiens
atgtctttgccatagttcatat

SEQ ID NO: 9062739 - DNA, 22 bp, Homo sapiens
atgtctttgccatagttcatat

SEQ ID NO: 9062740 - DNA, 22 bp, Homo sapiens
atgtctttgccatagttcatat

SEQ ID NO: 9062741 - DNA, 22 bp, Homo sapiens
atgtcttttatggagatgtcat

SEQ ID NO: 9062742 - DNA, 22 bp, Homo sapiens
atgtcttttatggagatgtcat

SEQ ID NO: 9062743 - DNA, 22 bp, Homo sapiens
atgtgaaaaatttcttattaca

SEQ ID NO: 9062744 - DNA, 22 bp, Homo sapiens
atgtgaaaaatttcttattaca

SEQ ID NO: 9062745 - DNA, 20 bp, Homo sapiens
gaggctgcggactgctggac

SEQ ID NO: 9062746 - DNA, 20 bp, Homo sapiens
gaggctgcggactgctggac

SEQ ID NO: 9062747 - DNA, 22 bp, Homo sapiens
gaggctgccccttcctcagctg

SEQ ID NO: 9062748 - DNA, 22 bp, Homo sapiens
atgtgaaacctgtgagtagagt

SEQ ID NO: 9062749 - DNA, 22 bp, Homo sapiens
atgtgaaaatccaatggcagca

SEQ ID NO: 9062750 - DNA, 22 bp, Homo sapiens
gaggctgcggggaggagcctgc

SEQ ID NO: 9062751 - DNA, 22 bp, Homo sapiens
gaggctgctgagagccctgttt

SEQ ID NO: 9062752 - DNA, 22 bp, Homo sapiens
cttttactgtgaaaagaaactg

SEQ ID NO: 9062753 - DNA, 22 bp, Homo sapiens
cttttattttgaattaagggct

SEQ ID NO: 9062754 - DNA, 22 bp, Homo sapiens
cttttattttgaattaagggct

SEQ ID NO: 9062755 - DNA, 22 bp, Homo sapiens
cttttattttgaattaagggct

SEQ ID NO: 9062756 - DNA, 22 bp, Homo sapiens
atgaaatgtgaatgcttttcat

SEQ ID NO: 9062757 - DNA, 22 bp, Homo sapiens
atgaaattaatcaacacataca

SEQ ID NO: 9062758 - DNA, 22 bp, Homo sapiens
atgaaattaatcaacacataca

SEQ ID NO: 9062759 - DNA, 22 bp, Homo sapiens
cttttcatgagtctgttatggg

SEQ ID NO: 9062760 - DNA, 19 bp, Homo sapiens
cttttcaagccatcagttt

SEQ ID NO: 9062761 - DNA, 22 bp, Homo sapiens
cttttcaaacgctgatgtcagt

SEQ ID NO: 9062762 - DNA, 19 bp, Homo sapiens
cttttcatcaacagccaat

SEQ ID NO: 9062763 - DNA, 22 bp, Homo sapiens
cttttcagagctgagatcaccg

SEQ ID NO: 9062764 - DNA, 19 bp, Homo sapiens
cttttcaagccatcagttt

SEQ ID NO: 9062765 - DNA, 22 bp, Homo sapiens
atgaaatgtatgagtctgggtt

SEQ ID NO: 9062766 - DNA, 22 bp, Homo sapiens
atgaaatgtattcagatatgta

SEQ ID NO: 9062767 - DNA, 22 bp, Homo sapiens
atgaaatgctgagaggtgcttc

SEQ ID NO: 9062768 - DNA, 23 bp, Homo sapiens
atgaaatgctggctcagggaggt

SEQ ID NO: 9062769 - DNA, 22 bp, Homo sapiens
atgaaatgattgaaatctttac

SEQ ID NO: 9062770 - DNA, 23 bp, Homo sapiens
atgaaatgatactttattcactg

SEQ ID NO: 9062771 - DNA, 22 bp, Homo sapiens
atgaaatgctgagaggtgcttc

SEQ ID NO: 9062772 - DNA, 22 bp, Homo sapiens
atgaaatgctattttggctaga

SEQ ID NO: 9062773 - DNA, 22 bp, Homo sapiens
atgaaatatcttgaagaaattc

SEQ ID NO: 9062774 - DNA, 22 bp, Homo sapiens
atgaaatatcttgaagaaattc

SEQ ID NO: 9062775 - DNA, 22 bp, Homo sapiens
atgaaatgagtcaatgcgacta

SEQ ID NO: 9062776 - DNA, 22 bp, Homo sapiens
atgaaatgagtcaatgcgacta

SEQ ID NO: 9062777 - DNA, 22 bp, Homo sapiens
atgaaatgagtcaatgcgacta

SEQ ID NO: 9062778 - DNA, 22 bp, Homo sapiens
atgaaatatttcagagcagagt

SEQ ID NO: 9062779 - DNA, 22 bp, Homo sapiens
atgaaataaatacccacacata

SEQ ID NO: 9062780 - DNA, 22 bp, Homo sapiens
atgaaatatcttgaagaaattc

SEQ ID NO: 9062781 - DNA, 22 bp, Homo sapiens
atgaaacatgagaaatggagag

SEQ ID NO: 9062782 - DNA, 22 bp, Homo sapiens
atgaaagtttgcattcctcagt

SEQ ID NO: 9062783 - DNA, 22 bp, Homo sapiens
atgaaacagtgtgtatagcaaa

SEQ ID NO: 9062784 - DNA, 22 bp, Homo sapiens
cttgttgggtcgtgaattctgt

SEQ ID NO: 9062785 - DNA, 22 bp, Homo sapiens
cttgttgttatggctggtggag

SEQ ID NO: 9062786 - DNA, 22 bp, Homo sapiens
atgaaaagttcgatctagaagg

SEQ ID NO: 9062787 - DNA, 22 bp, Homo sapiens
cttgtggcccatggcttcctgc

SEQ ID NO: 9062788 - DNA, 22 bp, Homo sapiens
cttgtggcaggtggatggtgcc

SEQ ID NO: 9062789 - DNA, 17 bp, Homo sapiens
cttgtggccagttttta

SEQ ID NO: 9062790 - DNA, 22 bp, Homo sapiens
atcttttacattactgcccaga

SEQ ID NO: 9062791 - DNA, 22 bp, Homo sapiens
atctttgttttgatgcagatct

SEQ ID NO: 9062792 - DNA, 22 bp, Homo sapiens
atcttttatgagcgttctgaca

SEQ ID NO: 9062793 - DNA, 22 bp, Homo sapiens
atcttttactacaaatcaggtg

SEQ ID NO: 9062794 - DNA, 22 bp, Homo sapiens
atctttttatctgtttggaaca

SEQ ID NO: 9062795 - DNA, 22 bp, Homo sapiens
atctttttactaacactgctta

SEQ ID NO: 9062796 - DNA, 22 bp, Homo sapiens
atctttttactaacactgctta

SEQ ID NO: 9062797 - DNA, 22 bp, Homo sapiens
atcttttttgtcttggtcactg

SEQ ID NO: 9062798 - DNA, 22 bp, Homo sapiens
atgaaaacagcctcctgtgata

SEQ ID NO: 9062799 - DNA, 22 bp, Homo sapiens
atctttttgacatggtgatggt

SEQ ID NO: 9062800 - DNA, 22 bp, Homo sapiens
atgaaaactttagcctcattag

SEQ ID NO: 9062801 - DNA, 22 bp, Homo sapiens
atgaaaacggaccagagctatt

SEQ ID NO: 9062802 - DNA, 22 bp, Homo sapiens
cttgccttcagtgtccctttgc

SEQ ID NO: 9062803 - DNA, 22 bp, Homo sapiens
cttgcctttgtcttcaaaggct

SEQ ID NO: 9062804 - DNA, 22 bp, Homo sapiens
cttgcctttgtcttcaaaggct

SEQ ID NO: 9062805 - DNA, 22 bp, Homo sapiens
cttgcctttgtcttcaaaggct

SEQ ID NO: 9062806 - DNA, 22 bp, Homo sapiens
atctatgtgggaatcataatag

SEQ ID NO: 9062807 - DNA, 19 bp, Homo sapiens
cttgcctgttcctacagct

SEQ ID NO: 9062808 - DNA, 22 bp, Homo sapiens
cttgcctgtggctagttggctc

SEQ ID NO: 9062809 - DNA, 22 bp, Homo sapiens
cttgcctgtggctagttggctc

SEQ ID NO: 9062810 - DNA, 22 bp, Homo sapiens
cttgcctgggactgaggcattt

SEQ ID NO: 9062811 - DNA, 23 bp, Homo sapiens
cttgcctggcctctctgcccaga

SEQ ID NO: 9062812 - DNA, 22 bp, Homo sapiens
cttgatctacatagtgaaaccc

SEQ ID NO: 9062813 - DNA, 23 bp, Homo sapiens
atctagaaacctgatgactctgt

SEQ ID NO: 9062814 - DNA, 22 bp, Homo sapiens
atctagaaaaggtgactaaaat

SEQ ID NO: 9062815 - DNA, 22 bp, Homo sapiens
atctactcagtaactgcttagg

SEQ ID NO: 9062816 - DNA, 22 bp, Homo sapiens
atctactcctgaatatatctag

SEQ ID NO: 9062817 - DNA, 22 bp, Homo sapiens
atctacaggctgaggtgggagg

SEQ ID NO: 9062818 - DNA, 22 bp, Homo sapiens
atctacagtgcacaggacagcc

SEQ ID NO: 9062819 - DNA, 22 bp, Homo sapiens
atctacataaaacgaatacata

SEQ ID NO: 9062820 - DNA, 22 bp, Homo sapiens
atctacataaaacgaatacata

SEQ ID NO: 9062821 - DNA, 22 bp, Homo sapiens
atctacagctgtctgcacagta

SEQ ID NO: 9062822 - DNA, 22 bp, Homo sapiens
atctacaggatagtttaatatt

SEQ ID NO: 9062823 - DNA, 22 bp, Homo sapiens
atctacaggattttacagagtt

SEQ ID NO: 9062824 - DNA, 23 bp, Homo sapiens
atctagaaacctgatgactctgt

SEQ ID NO: 9062825 - DNA, 22 bp, Homo sapiens
atctagaagtggcatgaattac

SEQ ID NO: 9062826 - DNA, 22 bp, Homo sapiens
atctagaagcctgagccaagat

SEQ ID NO: 9062827 - DNA, 22 bp, Homo sapiens
atctagaagtggcatgaattac

SEQ ID NO: 9062828 - DNA, 22 bp, Homo sapiens
atctagaggagggctgctggat

SEQ ID NO: 9062829 - DNA, 22 bp, Homo sapiens
atctagattaggtataagagct

SEQ ID NO: 9062830 - DNA, 22 bp, Homo sapiens
atcttctactttgccaatcagg

SEQ ID NO: 9062831 - DNA, 22 bp, Homo sapiens
atcttctcatgtgtaatgaggt

SEQ ID NO: 9062832 - DNA, 22 bp, Homo sapiens
atcttgaatgaatgactcttta

SEQ ID NO: 9062833 - DNA, 22 bp, Homo sapiens
atcttgaaatactttctagaat

SEQ ID NO: 9062834 - DNA, 22 bp, Homo sapiens
cttggtcatttggggctgctat

SEQ ID NO: 9062835 - DNA, 22 bp, Homo sapiens
cttgtaaatgcagattctgatt

SEQ ID NO: 9062836 - DNA, 22 bp, Homo sapiens
cttggctccaatcccagctctg

SEQ ID NO: 9062837 - DNA, 22 bp, Homo sapiens
cttggcctgtggctcaagaatt

SEQ ID NO: 9062838 - DNA, 22 bp, Homo sapiens
cttggcctgggccgcagccact

SEQ ID NO: 9062839 - DNA, 22 bp, Homo sapiens
cttggcctgcccagccagaagg

SEQ ID NO: 9062840 - DNA, 22 bp, Homo sapiens
cttggcctgacatgtggcaggg

SEQ ID NO: 9062841 - DNA, 22 bp, Homo sapiens
cttggcctcttctcagggtggg

SEQ ID NO: 9062842 - DNA, 22 bp, Homo sapiens
cttggtcatttcttgtcctgtt

SEQ ID NO: 9062843 - DNA, 22 bp, Homo sapiens
cttggtcatgcaagatatcgat

SEQ ID NO: 9062844 - DNA, 22 bp, Homo sapiens
cttggtcatcgataattgaatc

SEQ ID NO: 9062845 - DNA, 22 bp, Homo sapiens
cttggtcagctcgagagtttgt

SEQ ID NO: 9062846 - DNA, 22 bp, Homo sapiens
cttggtcaggcttttgtaactg

SEQ ID NO: 9062847 - DNA, 22 bp, Homo sapiens
cttggtcacaggcttgtgtgct

SEQ ID NO: 9062848 - DNA, 22 bp, Homo sapiens
cttggtcacagttcccaacatt

SEQ ID NO: 9062849 - DNA, 22 bp, Homo sapiens
cttggtcagaggggctggcatg

SEQ ID NO: 9062850 - DNA, 22 bp, Homo sapiens
cttggtcaaatgcaggcttccc

SEQ ID NO: 9062851 - DNA, 22 bp, Homo sapiens
cttggcagtttcggaaggatga

SEQ ID NO: 9062852 - DNA, 22 bp, Homo sapiens
cttggcagctacacaggtaaga

SEQ ID NO: 9062853 - DNA, 20 bp, Homo sapiens
cttggcctacttagctttgt

SEQ ID NO: 9062854 - DNA, 22 bp, Homo sapiens
cttggcccagttgccaaggaaa

SEQ ID NO: 9062855 - DNA, 21 bp, Homo sapiens
atgaagcaagggtcacacgtg

SEQ ID NO: 9062856 - DNA, 22 bp, Homo sapiens
atgaagcagactcaggtggtgc

SEQ ID NO: 9062857 - DNA, 22 bp, Homo sapiens
atgaagcagaatttcccactct

SEQ ID NO: 9062858 - DNA, 22 bp, Homo sapiens
atgaagcaacagccctcctatt

SEQ ID NO: 9062859 - DNA, 19 bp, Homo sapiens
atgaagattggtaaattca

SEQ ID NO: 9062860 - DNA, 22 bp, Homo sapiens
atgaagagttctgttttggaca

SEQ ID NO: 9062861 - DNA, 22 bp, Homo sapiens
atgaagatgtgaaggctggatt

SEQ ID NO: 9062862 - DNA, 22 bp, Homo sapiens
atgaagcagcctcttccctctg

SEQ ID NO: 9062863 - DNA, 22 bp, Homo sapiens
atgaagcagcgttgtagagtga

SEQ ID NO: 9062864 - DNA, 22 bp, Homo sapiens
atgaagcagatttattactcac

SEQ ID NO: 9062865 - DNA, 19 bp, Homo sapiens
atgaggaactgaggctcag

SEQ ID NO: 9062866 - DNA, 22 bp, Homo sapiens
atgaagcagcgttgtagagtga

SEQ ID NO: 9062867 - DNA, 22 bp, Homo sapiens
atgagcttccagacaaaggcat

SEQ ID NO: 9062868 - DNA, 22 bp, Homo sapiens
atgaggcagcacatgggattgt

SEQ ID NO: 9062869 - DNA, 22 bp, Homo sapiens
atgaggcagatgttgcatgagg

SEQ ID NO: 9062870 - DNA, 22 bp, Homo sapiens
gaaagcaagttgactgcagaat

SEQ ID NO: 9062871 - DNA, 22 bp, Homo sapiens
gaaagcaatttgtgtaatctgt

SEQ ID NO: 9062872 - DNA, 22 bp, Homo sapiens
gaaagcacccaagatttccttc

SEQ ID NO: 9062873 - DNA, 22 bp, Homo sapiens
gaaagcacagttctgaccatgt

SEQ ID NO: 9062874 - DNA, 22 bp, Homo sapiens
atgaggcagctgacagctgttc

SEQ ID NO: 9062875 - DNA, 22 bp, Homo sapiens
atgaggcagctgctggagaacg

SEQ ID NO: 9062876 - DNA, 22 bp, Homo sapiens
atgaggcagctgctggagaacg

SEQ ID NO: 9062877 - DNA, 22 bp, Homo sapiens
atgaggcaggagtgcagtggca

SEQ ID NO: 9062878 - DNA, 22 bp, Homo sapiens
atgaggcagtacacacaaagcc

SEQ ID NO: 9062879 - DNA, 22 bp, Homo sapiens
atgaggcaggtggaggctgcca

SEQ ID NO: 9062880 - DNA, 22 bp, Homo sapiens
atgaggcagatgttgcatgagg

SEQ ID NO: 9062881 - DNA, 22 bp, Homo sapiens
atgaggcaggtggaggctgcca

SEQ ID NO: 9062882 - DNA, 22 bp, Homo sapiens
atgaggtatctcatttcctgaa

SEQ ID NO: 9062883 - DNA, 22 bp, Homo sapiens
atgaggtagtattagaaggaga

SEQ ID NO: 9062884 - DNA, 22 bp, Homo sapiens
atgaggtactagtatatacgta

SEQ ID NO: 9062885 - DNA, 22 bp, Homo sapiens
atgaggtaatactttcagtcct

SEQ ID NO: 9062886 - DNA, 22 bp, Homo sapiens
gaaagcagtaaatgggtcccat

SEQ ID NO: 9062887 - DNA, 22 bp, Homo sapiens
gaaagcagtaaatgggtcccat

SEQ ID NO: 9062888 - DNA, 22 bp, Homo sapiens
atgagggcagctatgtaagtgt

SEQ ID NO: 9062889 - DNA, 23 bp, Homo sapiens
atgaggtaaagatcagctttaaa

SEQ ID NO: 9062890 - DNA, 22 bp, Homo sapiens
gaaagcagatgaaattgcaaca

SEQ ID NO: 9062891 - DNA, 22 bp, Homo sapiens
atgaggtattcgtaatatttcc

SEQ ID NO: 9062892 - DNA, 22 bp, Homo sapiens
atgaggtgatggacatattaac

SEQ ID NO: 9062893 - DNA, 22 bp, Homo sapiens
atgaggttttactgccattttc

SEQ ID NO: 9062894 - DNA, 22 bp, Homo sapiens
atgaggtggtcttcagtaggtc

SEQ ID NO: 9062895 - DNA, 22 bp, Homo sapiens
atgaggttttgattggcacagg

SEQ ID NO: 9062896 - DNA, 22 bp, Homo sapiens
atgagtaaaacagtggtgttgc

SEQ ID NO: 9062897 - DNA, 22 bp, Homo sapiens
atgattcaagaaaataggatgg

SEQ ID NO: 9062898 - DNA, 22 bp, Homo sapiens
atgatacaagcaaaactaatca

SEQ ID NO: 9062899 - DNA, 22 bp, Homo sapiens
atgataagccatgtcgtggtca

SEQ ID NO: 9062900 - DNA, 22 bp, Homo sapiens
atgataagaacacagtatgggg

SEQ ID NO: 9062901 - DNA, 22 bp, Homo sapiens
atgagttcatactttcagtacc

SEQ ID NO: 9062902 - DNA, 22 bp, Homo sapiens
atgagttcattgcatttgacag

SEQ ID NO: 9062903 - DNA, 20 bp, Homo sapiens
atgattttgcactaacttca

SEQ ID NO: 9062904 - DNA, 20 bp, Homo sapiens
atgattttgcactaacttca

SEQ ID NO: 9062905 - DNA, 22 bp, Homo sapiens
atgattcagcccaatttttcta

SEQ ID NO: 9062906 - DNA, 22 bp, Homo sapiens
atgatttttcagcagaggatct

SEQ ID NO: 9062907 - DNA, 22 bp, Homo sapiens
atgattttttctaacacagtcg

SEQ ID NO: 9062908 - DNA, 20 bp, Homo sapiens
atgattttgcactaacttca

SEQ ID NO: 9062909 - DNA, 22 bp, Homo sapiens
atgatttttcagcagaggatct

SEQ ID NO: 9062910 - DNA, 22 bp, Homo sapiens
atgcatctatgacttagacatt

SEQ ID NO: 9062911 - DNA, 20 bp, Homo sapiens
atgcatctggtatctttcct

SEQ ID NO: 9062912 - DNA, 22 bp, Homo sapiens
atgcatctgtagtgttatatga

SEQ ID NO: 9062913 - DNA, 22 bp, Homo sapiens
atgcatatgcatggacactcag

SEQ ID NO: 9062914 - DNA, 22 bp, Homo sapiens
atgcatatgccgtagaataagt

SEQ ID NO: 9062915 - DNA, 22 bp, Homo sapiens
atgcatgatcctgagcaaccca

SEQ ID NO: 9062916 - DNA, 22 bp, Homo sapiens
atgcatcttttcaaggtatttc

SEQ ID NO: 9062917 - DNA, 22 bp, Homo sapiens
atgcatcttatcaaaaattata

SEQ ID NO: 9062918 - DNA, 22 bp, Homo sapiens
atgcagcagccccttgaggtgc

SEQ ID NO: 9062919 - DNA, 22 bp, Homo sapiens
atgcagcagtttacaaagcaat

SEQ ID NO: 9062920 - DNA, 22 bp, Homo sapiens
atgcagccccctggtgcccggg

SEQ ID NO: 9062921 - DNA, 22 bp, Homo sapiens
atgcagctagattttccagtgt

SEQ ID NO: 9062922 - DNA, 20 bp, Homo sapiens
atgcagcattgttgtggcaa

SEQ ID NO: 9062923 - DNA, 22 bp, Homo sapiens
atgcagctatttgagcatgtca

SEQ ID NO: 9062924 - DNA, 22 bp, Homo sapiens
atgcagctcatttgtttaaaag

SEQ ID NO: 9062925 - DNA, 22 bp, Homo sapiens
atgcagctgacattttcatgtt

SEQ ID NO: 9062926 - DNA, 22 bp, Homo sapiens
atgcagctgtgggcaagaaatg

SEQ ID NO: 9062927 - DNA, 22 bp, Homo sapiens
atgcagcttcaggattatgatg

SEQ ID NO: 9062928 - DNA, 22 bp, Homo sapiens
atgcattcagcggaatgcttag

SEQ ID NO: 9062929 - DNA, 21 bp, Homo sapiens
atgcatgttccataaagtggg

SEQ ID NO: 9062930 - DNA, 21 bp, Homo sapiens
atgcatgttccataaagtggg

SEQ ID NO: 9062931 - DNA, 22 bp, Homo sapiens
atgcatgtgcatggctctatct

SEQ ID NO: 9062932 - DNA, 22 bp, Homo sapiens
atgcattcattcattctttcta

SEQ ID NO: 9062933 - DNA, 22 bp, Homo sapiens
atgcattgtcaggcaatttcat

SEQ ID NO: 9062934 - DNA, 22 bp, Homo sapiens
atgcattgctgctttcaaaaca

SEQ ID NO: 9062935 - DNA, 22 bp, Homo sapiens
gacactgaccccaagctgtcct

SEQ ID NO: 9062936 - DNA, 22 bp, Homo sapiens
atgcatttgacgggatatattt

SEQ ID NO: 9062937 - DNA, 22 bp, Homo sapiens
atgcatttatgtgtgtacattg

SEQ ID NO: 9062938 - DNA, 22 bp, Homo sapiens
atgcatttatgtgtgtacattg

SEQ ID NO: 9062939 - DNA, 22 bp, Homo sapiens
atgcaaatcttaagtatgtgtg

SEQ ID NO: 9062940 - DNA, 22 bp, Homo sapiens
atgcaaatgaacatgttgctag

SEQ ID NO: 9062941 - DNA, 22 bp, Homo sapiens
atgcaaataagtgcaggcgtgg

SEQ ID NO: 9062942 - DNA, 22 bp, Homo sapiens
atgcaaataagtgcaggcgtgg

SEQ ID NO: 9062943 - DNA, 22 bp, Homo sapiens
atgcaaagcaccacactaagat

SEQ ID NO: 9062944 - DNA, 22 bp, Homo sapiens
atgcaaagcaccacactaagat

SEQ ID NO: 9062945 - DNA, 22 bp, Homo sapiens
atgcaaagcacacacagaatcc

SEQ ID NO: 9062946 - DNA, 22 bp, Homo sapiens
atgcaaaattaccattctgttc

SEQ ID NO: 9062947 - DNA, 22 bp, Homo sapiens
atgcaaaagtaattgcaatttt

SEQ ID NO: 9062948 - DNA, 22 bp, Homo sapiens
atgcaaaagtaattgcaatttt

SEQ ID NO: 9062949 - DNA, 22 bp, Homo sapiens
atgcaaaagtagttgcagtttt

SEQ ID NO: 9062950 - DNA, 22 bp, Homo sapiens
atgcagaattgctaagtatctg

SEQ ID NO: 9062951 - DNA, 22 bp, Homo sapiens
atgcagaattgctaagtatctg

SEQ ID NO: 9062952 - DNA, 22 bp, Homo sapiens
atgcagaattgctaagtatctg

SEQ ID NO: 9062953 - DNA, 22 bp, Homo sapiens
atgcagagacagatgtggcatg

SEQ ID NO: 9062954 - DNA, 22 bp, Homo sapiens
atgcagagacagatgtggcatg

SEQ ID NO: 9062955 - DNA, 22 bp, Homo sapiens
atgcagcagccccttgaggtgc

SEQ ID NO: 9062956 - DNA, 22 bp, Homo sapiens
atgcagcactgatctttagcca

SEQ ID NO: 9062957 - DNA, 22 bp, Homo sapiens
atgcagatggtggatggagaaa

SEQ ID NO: 9062958 - DNA, 22 bp, Homo sapiens
atgcagaagaaaccatggcttc

SEQ ID NO: 9062959 - DNA, 22 bp, Homo sapiens
atgcagaagcagaacttacaca

SEQ ID NO: 9062960 - DNA, 22 bp, Homo sapiens
atgcagaatgagttcacgatct

SEQ ID NO: 9062961 - DNA, 22 bp, Homo sapiens
atgcagaatcttgagaaaaatt

SEQ ID NO: 9062962 - DNA, 22 bp, Homo sapiens
atgcagaacgtttgtgaaactt

SEQ ID NO: 9062963 - DNA, 22 bp, Homo sapiens
atgcactttgtaatctgttcaa

SEQ ID NO: 9062964 - DNA, 22 bp, Homo sapiens
atgcagaaagcggcaaacaggt

SEQ ID NO: 9062965 - DNA, 22 bp, Homo sapiens
atgcagaaagagaatgtaatgt

SEQ ID NO: 9062966 - DNA, 22 bp, Homo sapiens
atgcacagtatgtagggtctat

SEQ ID NO: 9062967 - DNA, 22 bp, Homo sapiens
atgcacagtatgtagggtctat

SEQ ID NO: 9062968 - DNA, 22 bp, Homo sapiens
atgcactttctagagattctga

SEQ ID NO: 9062969 - DNA, 22 bp, Homo sapiens
atgcacttcaagcatctctctg

SEQ ID NO: 9062970 - DNA, 21 bp, Homo sapiens
atttacaaaacagtcccttcc

SEQ ID NO: 9062971 - DNA, 21 bp, Homo sapiens
atttacaaaacagtcccttcc

SEQ ID NO: 9062972 - DNA, 21 bp, Homo sapiens
atttacaaaacagtcccttcc

SEQ ID NO: 9062973 - DNA, 21 bp, Homo sapiens
atttacaaaacagtcccttcc

SEQ ID NO: 9062974 - DNA, 21 bp, Homo sapiens
atttacaaaacagtcccttcc

SEQ ID NO: 9062975 - DNA, 22 bp, Homo sapiens
attggcaatagagaataaattg

SEQ ID NO: 9062976 - DNA, 22 bp, Homo sapiens
attggcaagtgaatttaacagc

SEQ ID NO: 9062977 - DNA, 22 bp, Homo sapiens
attggcaatgtcccggctgctg

SEQ ID NO: 9062978 - DNA, 22 bp, Homo sapiens
attggcaaggctgcggtgtctg

SEQ ID NO: 9062979 - DNA, 22 bp, Homo sapiens
atttaatgtcgagctattgtag

SEQ ID NO: 9062980 - DNA, 22 bp, Homo sapiens
atttaaattttctgatggagag

SEQ ID NO: 9062981 - DNA, 22 bp, Homo sapiens
attggaaatacagtagaaaaat

SEQ ID NO: 9062982 - DNA, 22 bp, Homo sapiens
attgcttttcagacaatgaggc

SEQ ID NO: 9062983 - DNA, 22 bp, Homo sapiens
attgcttttccttaacacatgc

SEQ ID NO: 9062984 - DNA, 18 bp, Homo sapiens
attgcttttgtaccaacc

SEQ ID NO: 9062985 - DNA, 22 bp, Homo sapiens
attgcttttgagctagaatttt

SEQ ID NO: 9062986 - DNA, 22 bp, Homo sapiens
attgcttttaagcaccacctaa

SEQ ID NO: 9062987 - DNA, 22 bp, Homo sapiens
attgctttgtacatgcctagca

SEQ ID NO: 9062988 - DNA, 22 bp, Homo sapiens
attgctttctttggggaactgt

SEQ ID NO: 9062989 - DNA, 22 bp, Homo sapiens
attgcttttagtgaaattatat

SEQ ID NO: 9062990 - DNA, 22 bp, Homo sapiens
attgctttagaaagaaaaatat

SEQ ID NO: 9062991 - DNA, 22 bp, Homo sapiens
attgctttagaaagaaaaatat

SEQ ID NO: 9062992 - DNA, 22 bp, Homo sapiens
atttagaaattccaaaagtatt

SEQ ID NO: 9062993 - DNA, 22 bp, Homo sapiens
atttagaactttgtttgccaat

SEQ ID NO: 9062994 - DNA, 22 bp, Homo sapiens
atttagaagctaatttttcaga

SEQ ID NO: 9062995 - DNA, 22 bp, Homo sapiens
atttagaaattccaaaagtatt

SEQ ID NO: 9062996 - DNA, 22 bp, Homo sapiens
atttactagggctgtttaagta

SEQ ID NO: 9062997 - DNA, 22 bp, Homo sapiens
gccaggagtgtgtggctatgtt

SEQ ID NO: 9062998 - DNA, 22 bp, Homo sapiens
gccaggaggggagagtgtgtca

SEQ ID NO: 9062999 - DNA, 22 bp, Homo sapiens
atttacagaagcatgtaatagc

SEQ ID NO: 9063000 - DNA, 22 bp, Homo sapiens
atttacagaagcatgtaatagc

SEQ ID NO: 9063001 - DNA, 22 bp, Homo sapiens
gccaggaggcttaactggacag

SEQ ID NO: 9063002 - DNA, 22 bp, Homo sapiens
gccagctggctgcaggtcccag

SEQ ID NO: 9063003 - DNA, 22 bp, Homo sapiens
gccagctggagtgagagtgggc

SEQ ID NO: 9063004 - DNA, 19 bp, Homo sapiens
gccaggagggctctggctg

SEQ ID NO: 9063005 - DNA, 22 bp, Homo sapiens
atttacagaaacttaatcatag

SEQ ID NO: 9063006 - DNA, 22 bp, Homo sapiens
atttacacttggtttactagag

SEQ ID NO: 9063007 - DNA, 21 bp, Homo sapiens
atttacaaaacagtcccttcc

SEQ ID NO: 9063008 - DNA, 21 bp, Homo sapiens
atttacaaaacagtcccttcc

SEQ ID NO: 9063009 - DNA, 22 bp, Homo sapiens
gccaggcattattccgatccct

SEQ ID NO: 9063010 - DNA, 22 bp, Homo sapiens
atttattgagacttaacaaccc

SEQ ID NO: 9063011 - DNA, 22 bp, Homo sapiens
atttattgagacttaacaaccc

SEQ ID NO: 9063012 - DNA, 19 bp, Homo sapiens
gccaggcctggacctgcag

SEQ ID NO: 9063013 - DNA, 19 bp, Homo sapiens
gccaggcctggacctgcag

SEQ ID NO: 9063014 - DNA, 22 bp, Homo sapiens
atttcaagtgttgagctcataa

SEQ ID NO: 9063015 - DNA, 22 bp, Homo sapiens
gccaggccctgggcacttcgtg

SEQ ID NO: 9063016 - DNA, 22 bp, Homo sapiens
gccaggccactcccgggtcctg

SEQ ID NO: 9063017 - DNA, 22 bp, Homo sapiens
atttcagactgtgttggaaaat

SEQ ID NO: 9063018 - DNA, 22 bp, Homo sapiens
atttcagaatgtcctaatttag

SEQ ID NO: 9063019 - DNA, 22 bp, Homo sapiens
atttcagaatgtcctaatttag

SEQ ID NO: 9063020 - DNA, 21 bp, Homo sapiens
atttcagagcacacaagtaaa

SEQ ID NO: 9063021 - DNA, 21 bp, Homo sapiens
atttcagagcacacaagtaaa

SEQ ID NO: 9063022 - DNA, 22 bp, Homo sapiens
atttcagattcagaaatgtagg

SEQ ID NO: 9063023 - DNA, 22 bp, Homo sapiens
atttcagatgaccaaatggaaa

SEQ ID NO: 9063024 - DNA, 22 bp, Homo sapiens
atttcagatgaccaaatggaaa

SEQ ID NO: 9063025 - DNA, 22 bp, Homo sapiens
atttcagagctttgcagctaat

SEQ ID NO: 9063026 - DNA, 22 bp, Homo sapiens
atttcagagtagatcgttattt

SEQ ID NO: 9063027 - DNA, 22 bp, Homo sapiens
atttctataggaggacagtatt

SEQ ID NO: 9063028 - DNA, 22 bp, Homo sapiens
atttctataggaggacagtatt

SEQ ID NO: 9063029 - DNA, 22 bp, Homo sapiens
atttcctttgcaaagactgtgc

SEQ ID NO: 9063030 - DNA, 22 bp, Homo sapiens
atttctaaagagggtggtttgg

SEQ ID NO: 9063031 - DNA, 18 bp, Homo sapiens
atttctactactataaag

SEQ ID NO: 9063032 - DNA, 18 bp, Homo sapiens
atttctactactataaag

SEQ ID NO: 9063033 - DNA, 22 bp, Homo sapiens
atttctacattgagttttagca

SEQ ID NO: 9063034 - DNA, 22 bp, Homo sapiens
atttctacagtacacatgcatt

SEQ ID NO: 9063035 - DNA, 22 bp, Homo sapiens
atttccttgcaagtttctgtaa

SEQ ID NO: 9063036 - DNA, 22 bp, Homo sapiens
atttccttgcaacttaggcatg

SEQ ID NO: 9063037 - DNA, 22 bp, Homo sapiens
atttccttgcaacttaggcatg

SEQ ID NO: 9063038 - DNA, 22 bp, Homo sapiens
atttccttgcaagtttctgtaa

SEQ ID NO: 9063039 - DNA, 16 bp, Homo sapiens
atttccttgtgagttt

SEQ ID NO: 9063040 - DNA, 22 bp, Homo sapiens
atttcctttgcaaagactgtgc

SEQ ID NO: 9063041 - DNA, 22 bp, Homo sapiens
atttccttcggacagtttgggt

SEQ ID NO: 9063042 - DNA, 22 bp, Homo sapiens
atttccttcccagatttggttc

SEQ ID NO: 9063043 - DNA, 22 bp, Homo sapiens
atttcatgtgaagaagagataa

SEQ ID NO: 9063044 - DNA, 22 bp, Homo sapiens
atttcatgtaaatggaatgata

SEQ ID NO: 9063045 - DNA, 21 bp, Homo sapiens
atttcatggtgcttttaagaa

SEQ ID NO: 9063046 - DNA, 22 bp, Homo sapiens
atttcagattcgagaggaagtg

SEQ ID NO: 9063047 - DNA, 22 bp, Homo sapiens
atttcagattcagaaatgtagg

SEQ ID NO: 9063048 - DNA, 22 bp, Homo sapiens
atttcagcagcccatgtttgga

SEQ ID NO: 9063049 - DNA, 22 bp, Homo sapiens
atttcagcagcccatgtttgga

SEQ ID NO: 9063050 - DNA, 22 bp, Homo sapiens
atttcaggaatctgtatgaaag

SEQ ID NO: 9063051 - DNA, 22 bp, Homo sapiens
atttcagcccagtatgagcccc

SEQ ID NO: 9063052 - DNA, 22 bp, Homo sapiens
atttcagcccagtatgagcccc

SEQ ID NO: 9063053 - DNA, 22 bp, Homo sapiens
atttcagggagtcatttacaca

SEQ ID NO: 9063054 - DNA, 22 bp, Homo sapiens
atttcagggatgtctgtaaatt

SEQ ID NO: 9063055 - DNA, 22 bp, Homo sapiens
atttcaggatggaaagaggcca

SEQ ID NO: 9063056 - DNA, 22 bp, Homo sapiens
atttcaggccaccagatgtctt

SEQ ID NO: 9063057 - DNA, 22 bp, Homo sapiens
atttcaggagcagtttcagtgg

SEQ ID NO: 9063058 - DNA, 22 bp, Homo sapiens
atttcaggatagcctagttttg

SEQ ID NO: 9063059 - DNA, 22 bp, Homo sapiens
atttcagtattatacaactgct

SEQ ID NO: 9063060 - DNA, 20 bp, Homo sapiens
atttcaggttgtgttctgtt

SEQ ID NO: 9063061 - DNA, 22 bp, Homo sapiens
atttcaggtacctgtgggatcc

SEQ ID NO: 9063062 - DNA, 22 bp, Homo sapiens
atttcagggtaaaaagtgttca

SEQ ID NO: 9063063 - DNA, 22 bp, Homo sapiens
atttcagggtgtcttccaactg

SEQ ID NO: 9063064 - DNA, 22 bp, Homo sapiens
atttcatatgtatcacctagcc

SEQ ID NO: 9063065 - DNA, 16 bp, Homo sapiens
atttcatgggcagtga

SEQ ID NO: 9063066 - DNA, 22 bp, Homo sapiens
atttcatggtacatcgtgactt

SEQ ID NO: 9063067 - DNA, 22 bp, Homo sapiens
atttcatgcagaaggaagttgg

SEQ ID NO: 9063068 - DNA, 22 bp, Homo sapiens
atttcatggcagactttaaccc

SEQ ID NO: 9063069 - DNA, 22 bp, Homo sapiens
atttcatggacatctttggagg

SEQ ID NO: 9063070 - DNA, 22 bp, Homo sapiens
atttcatgagttattatagtgg

SEQ ID NO: 9063071 - DNA, 22 bp, Homo sapiens
atttcatgaatgctgctgttga

SEQ ID NO: 9063072 - DNA, 22 bp, Homo sapiens
atttcatgaattccagaagctt

SEQ ID NO: 9063073 - DNA, 22 bp, Homo sapiens
atttcatgagctaatggatctc

SEQ ID NO: 9063074 - DNA, 22 bp, Homo sapiens
atttcatgaaacattccccttg

SEQ ID NO: 9063075 - DNA, 21 bp, Homo sapiens
gcctctccaaatcctgccttc

SEQ ID NO: 9063076 - DNA, 19 bp, Homo sapiens
gcctcggatggagagcagg

SEQ ID NO: 9063077 - DNA, 21 bp, Homo sapiens
gcctctccaaatcctgccttc

SEQ ID NO: 9063078 - DNA, 22 bp, Homo sapiens
gcctctccgagccactgcctct

SEQ ID NO: 9063079 - DNA, 22 bp, Homo sapiens
gcctctccgagccactgcctct

SEQ ID NO: 9063080 - DNA, 22 bp, Homo sapiens
gcctctctccttggcttgcagt

SEQ ID NO: 9063081 - DNA, 22 bp, Homo sapiens
gcctcctgttatgccatgtgcc

SEQ ID NO: 9063082 - DNA, 22 bp, Homo sapiens
gcctccccaagcagcagggatt

SEQ ID NO: 9063083 - DNA, 22 bp, Homo sapiens
gcctccccaagcagcagggatt

SEQ ID NO: 9063084 - DNA, 22 bp, Homo sapiens
gcctccccaaagtgctgacagc

SEQ ID NO: 9063085 - DNA, 22 bp, Homo sapiens
gcctccccaaagtgctgacagc

SEQ ID NO: 9063086 - DNA, 22 bp, Homo sapiens
gcctccagggtagaggaggaag

SEQ ID NO: 9063087 - DNA, 22 bp, Homo sapiens
gcctccagtttttttctgaact

SEQ ID NO: 9063088 - DNA, 22 bp, Homo sapiens
gcctccagctggggcatttcag

SEQ ID NO: 9063089 - DNA, 22 bp, Homo sapiens
atttctcactgagcagataaaa

SEQ ID NO: 9063090 - DNA, 22 bp, Homo sapiens
atttctcagtgaaatgacaggc

SEQ ID NO: 9063091 - DNA, 22 bp, Homo sapiens
atttctcagtgaaatgacaggc

SEQ ID NO: 9063092 - DNA, 22 bp, Homo sapiens
atttctcagtaggtgcacagtg

SEQ ID NO: 9063093 - DNA, 22 bp, Homo sapiens
gcctcactgcagccccaggaag

SEQ ID NO: 9063094 - DNA, 22 bp, Homo sapiens
gcctgggagagggatagtgcag

SEQ ID NO: 9063095 - DNA, 22 bp, Homo sapiens
gcctggagctctccacttgggg

SEQ ID NO: 9063096 - DNA, 22 bp, Homo sapiens
gcctgggagcacatcggggtcc

SEQ ID NO: 9063097 - DNA, 22 bp, Homo sapiens
gcctgggagattaattaggaag

SEQ ID NO: 9063098 - DNA, 22 bp, Homo sapiens
gcctgggagagggatagtgcag

SEQ ID NO: 9063099 - DNA, 22 bp, Homo sapiens
gcctggagctcggctgagggcg

SEQ ID NO: 9063100 - DNA, 22 bp, Homo sapiens
gcctggagctcggctgagggcg

SEQ ID NO: 9063101 - DNA, 22 bp, Homo sapiens
gcctggagctcggctgagggcg

SEQ ID NO: 9063102 - DNA, 22 bp, Homo sapiens
gcctggagctcatgtgggcatt

SEQ ID NO: 9063103 - DNA, 22 bp, Homo sapiens
gcctggagctcatgtgggcatt

SEQ ID NO: 9063104 - DNA, 22 bp, Homo sapiens
gcctggagctcatgtgggcatt

SEQ ID NO: 9063105 - DNA, 22 bp, Homo sapiens
gcctggagcctcagcaaggagg

SEQ ID NO: 9063106 - DNA, 22 bp, Homo sapiens
gcctggagctactggacactga

SEQ ID NO: 9063107 - DNA, 22 bp, Homo sapiens
gcctggagctactggacactga

SEQ ID NO: 9063108 - DNA, 22 bp, Homo sapiens
gcctggagctactggacactga

SEQ ID NO: 9063109 - DNA, 22 bp, Homo sapiens
gcctggagctcatgtgggcatt

SEQ ID NO: 9063110 - DNA, 18 bp, Homo sapiens
gcctgctctgctctcccc

SEQ ID NO: 9063111 - DNA, 22 bp, Homo sapiens
gcctgctctggaatccatgtaa

SEQ ID NO: 9063112 - DNA, 18 bp, Homo sapiens
gcctgctctgctctcccc

SEQ ID NO: 9063113 - DNA, 18 bp, Homo sapiens
gcctgctctgctctcccc

SEQ ID NO: 9063114 - DNA, 18 bp, Homo sapiens
gcctgcctagagcttgcc

SEQ ID NO: 9063115 - DNA, 18 bp, Homo sapiens
gcctgcctagagcttgcc

SEQ ID NO: 9063116 - DNA, 22 bp, Homo sapiens
gcctctctctacccagtatgat

SEQ ID NO: 9063117 - DNA, 22 bp, Homo sapiens
gcctctctcgggcttgtagcgg

SEQ ID NO: 9063118 - DNA, 22 bp, Homo sapiens
caaaccttgttccagtcaactc

SEQ ID NO: 9063119 - DNA, 22 bp, Homo sapiens
caaactctcccactcactctga

SEQ ID NO: 9063120 - DNA, 22 bp, Homo sapiens
caaactattgttcacaagacaa

SEQ ID NO: 9063121 - DNA, 22 bp, Homo sapiens
caaactgccaatggtttttata

SEQ ID NO: 9063122 - DNA, 22 bp, Homo sapiens
caaactggctatgggaatcttg

SEQ ID NO: 9063123 - DNA, 22 bp, Homo sapiens
caaactgcaacatgaagtgtcc

SEQ ID NO: 9063124 - DNA, 22 bp, Homo sapiens
gcgcagagtagcagagtgctga

SEQ ID NO: 9063125 - DNA, 22 bp, Homo sapiens
caaacattccgcttctcccagg

SEQ ID NO: 9063126 - DNA, 22 bp, Homo sapiens
caaacattgcactttctgctat

SEQ ID NO: 9063127 - DNA, 19 bp, Homo sapiens
gcgaggaagtcactgtggt

SEQ ID NO: 9063128 - DNA, 22 bp, Homo sapiens
gcgagggcacgcggttgaaggc

SEQ ID NO: 9063129 - DNA, 22 bp, Homo sapiens
gcgagggcacgcggttgaaggc

SEQ ID NO: 9063130 - DNA, 22 bp, Homo sapiens
gcgagtgccgagagggcagggc

SEQ ID NO: 9063131 - DNA, 22 bp, Homo sapiens
caaacttactgtgtttaaagag

SEQ ID NO: 9063132 - DNA, 22 bp, Homo sapiens
gctcaggaaatagtttagtgtt

SEQ ID NO: 9063133 - DNA, 22 bp, Homo sapiens
gctcaggaaacagcagggcttg

SEQ ID NO: 9063134 - DNA, 22 bp, Homo sapiens
gctcaggcaaatttctggtgaa

SEQ ID NO: 9063135 - DNA, 22 bp, Homo sapiens
caaaggcaacatatacttgttt

SEQ ID NO: 9063136 - DNA, 22 bp, Homo sapiens
attttttagaacctggcctgat

SEQ ID NO: 9063137 - DNA, 22 bp, Homo sapiens
caaaaaacacctgtgtgagtat

SEQ ID NO: 9063138 - DNA, 22 bp, Homo sapiens
caaaacattcagagagctcact

SEQ ID NO: 9063139 - DNA, 22 bp, Homo sapiens
caaaacattcagagagctcact

SEQ ID NO: 9063140 - DNA, 22 bp, Homo sapiens
caaaagaagctcttggggctag

SEQ ID NO: 9063141 - DNA, 22 bp, Homo sapiens
gcgagcctctggagtcctctgg

SEQ ID NO: 9063142 - DNA, 22 bp, Homo sapiens
gcgagcctctggagtcctctgg

SEQ ID NO: 9063143 - DNA, 19 bp, Homo sapiens
gcgaggaagtcactgtggc

SEQ ID NO: 9063144 - DNA, 22 bp, Homo sapiens
gcgagcctctggagtcctctgg

SEQ ID NO: 9063145 - DNA, 22 bp, Homo sapiens
caaaactatcaggctcaaagct

SEQ ID NO: 9063146 - DNA, 22 bp, Homo sapiens
caaaacattctctgcagcaggg

SEQ ID NO: 9063147 - DNA, 22 bp, Homo sapiens
gcctgtctcttggaacttggta

SEQ ID NO: 9063148 - DNA, 22 bp, Homo sapiens
gcctgtctgcagggctgtcatt

SEQ ID NO: 9063149 - DNA, 22 bp, Homo sapiens
gcctgtccttgtgaggtcccag

SEQ ID NO: 9063150 - DNA, 20 bp, Homo sapiens
gcctgtcctgagtgtcatgg

SEQ ID NO: 9063151 - DNA, 22 bp, Homo sapiens
gcctgtcctggatgctctgcaa

SEQ ID NO: 9063152 - DNA, 22 bp, Homo sapiens
gcctgtgcatagcagcggactc

SEQ ID NO: 9063153 - DNA, 22 bp, Homo sapiens
gcctgtgcatagcagcggactc

SEQ ID NO: 9063154 - DNA, 23 bp, Homo sapiens
gcctgtgcctatgcccagctctg

SEQ ID NO: 9063155 - DNA, 22 bp, Homo sapiens
gcctgtgacccagggcccagga

SEQ ID NO: 9063156 - DNA, 22 bp, Homo sapiens
gcctgtctgcgtcacgcttatt

SEQ ID NO: 9063157 - DNA, 22 bp, Homo sapiens
gcctgtcctatacaggcggctg

SEQ ID NO: 9063158 - DNA, 22 bp, Homo sapiens
gcctgtccactaaacagccaag

SEQ ID NO: 9063159 - DNA, 22 bp, Homo sapiens
gcctgtcaattttgtgtacaat

SEQ ID NO: 9063160 - DNA, 23 bp, Homo sapiens
gcctgggagttgcgatctgcccg

SEQ ID NO: 9063161 - DNA, 22 bp, Homo sapiens
gcctgggagtgcacagtgaggt

SEQ ID NO: 9063162 - DNA, 22 bp, Homo sapiens
gcctgggagggcagcagtgtgg

SEQ ID NO: 9063163 - DNA, 18 bp, Homo sapiens
gcctgggaggaggaaatg

SEQ ID NO: 9063164 - DNA, 22 bp, Homo sapiens
gcctgggagtgcacagtgaggt

SEQ ID NO: 9063165 - DNA, 22 bp, Homo sapiens
gcctgggagtgcacagtgaggt

SEQ ID NO: 9063166 - DNA, 22 bp, Homo sapiens
gcagagcttctgtccttcagga

SEQ ID NO: 9063167 - DNA, 22 bp, Homo sapiens
gcagagcttctgtccttcagga

SEQ ID NO: 9063168 - DNA, 22 bp, Homo sapiens
attcctcaaaggtagcccatta

SEQ ID NO: 9063169 - DNA, 19 bp, Homo sapiens
attcctcaaggacagaaat

SEQ ID NO: 9063170 - DNA, 22 bp, Homo sapiens
attcctcaaaggtagcccatta

SEQ ID NO: 9063171 - DNA, 22 bp, Homo sapiens
attcctaaagtaatacactaga

SEQ ID NO: 9063172 - DNA, 22 bp, Homo sapiens
attcctcattatttactgagga

SEQ ID NO: 9063173 - DNA, 19 bp, Homo sapiens
attcctcaaggacagaaat

SEQ ID NO: 9063174 - DNA, 22 bp, Homo sapiens
attcctcagcaggccttttgtt

SEQ ID NO: 9063175 - DNA, 20 bp, Homo sapiens
attcctcagccccagcctca

SEQ ID NO: 9063176 - DNA, 22 bp, Homo sapiens
attcctcatttgttgagaacca

SEQ ID NO: 9063177 - DNA, 22 bp, Homo sapiens
attcctcatttgttgagaacca

SEQ ID NO: 9063178 - DNA, 22 bp, Homo sapiens
gcagcaggcttttcataccttg

SEQ ID NO: 9063179 - DNA, 22 bp, Homo sapiens
gcagcagggtgccagctttgca

SEQ ID NO: 9063180 - DNA, 22 bp, Homo sapiens
attctacacaaagcaagaagac

SEQ ID NO: 9063181 - DNA, 22 bp, Homo sapiens
attccttgtttcactgaaaagg

SEQ ID NO: 9063182 - DNA, 22 bp, Homo sapiens
attcctttggactcctccttgc

SEQ ID NO: 9063183 - DNA, 22 bp, Homo sapiens
attctagaacagaggtttctaa

SEQ ID NO: 9063184 - DNA, 22 bp, Homo sapiens
attctacatttggagtgatgtc

SEQ ID NO: 9063185 - DNA, 22 bp, Homo sapiens
attctacacctctctcatttag

SEQ ID NO: 9063186 - DNA, 22 bp, Homo sapiens
attctacacaacatgatgatgg

SEQ ID NO: 9063187 - DNA, 22 bp, Homo sapiens
gcagagctgtctaagtcacttc

SEQ ID NO: 9063188 - DNA, 20 bp, Homo sapiens
gcagagctgttctgtgggga

SEQ ID NO: 9063189 - DNA, 22 bp, Homo sapiens
gcagagctgttaatggagctga

SEQ ID NO: 9063190 - DNA, 22 bp, Homo sapiens
gcagagctgttaatggagctga

SEQ ID NO: 9063191 - DNA, 22 bp, Homo sapiens
gcagagctgggtctgtatccaa

SEQ ID NO: 9063192 - DNA, 23 bp, Homo sapiens
gcagagctgccctattgccttgg

SEQ ID NO: 9063193 - DNA, 21 bp, Homo sapiens
gcagagctggaaccaggaccc

SEQ ID NO: 9063194 - DNA, 21 bp, Homo sapiens
attcagagtaattcatcttta

SEQ ID NO: 9063195 - DNA, 22 bp, Homo sapiens
attcagtcaaaaatgatggaga

SEQ ID NO: 9063196 - DNA, 22 bp, Homo sapiens
attcagtcaaaccactggtcat

SEQ ID NO: 9063197 - DNA, 22 bp, Homo sapiens
attatttagaaatcgattgaaa

SEQ ID NO: 9063198 - DNA, 22 bp, Homo sapiens
attcagactgtctaaatggttt

SEQ ID NO: 9063199 - DNA, 21 bp, Homo sapiens
attcagagtaattcatcttta

SEQ ID NO: 9063200 - DNA, 22 bp, Homo sapiens
attcagagattgttattcagac

SEQ ID NO: 9063201 - DNA, 22 bp, Homo sapiens
attcagagattgttattcagac

SEQ ID NO: 9063202 - DNA, 22 bp, Homo sapiens
attatttacagtgtgctcgaag

SEQ ID NO: 9063203 - DNA, 22 bp, Homo sapiens
attattgttttaatagtagaga

SEQ ID NO: 9063204 - DNA, 22 bp, Homo sapiens
attattgttttaatagtagaga

SEQ ID NO: 9063205 - DNA, 22 bp, Homo sapiens
attattgttgcggctgttaccg

SEQ ID NO: 9063206 - DNA, 22 bp, Homo sapiens
attattgttagtgacagggtga

SEQ ID NO: 9063207 - DNA, 22 bp, Homo sapiens
attattgttagtgacagggtga

SEQ ID NO: 9063208 - DNA, 22 bp, Homo sapiens
attattgttgcggctgttaccg

SEQ ID NO: 9063209 - DNA, 22 bp, Homo sapiens
attattgttgcggctgttaccg

SEQ ID NO: 9063210 - DNA, 22 bp, Homo sapiens
attattgtgataggtgtcagtg

SEQ ID NO: 9063211 - DNA, 22 bp, Homo sapiens
attattgtgtaaaatgaggctt

SEQ ID NO: 9063212 - DNA, 22 bp, Homo sapiens
attattgtgataggtgtcagtg

SEQ ID NO: 9063213 - DNA, 22 bp, Homo sapiens
attattgtactttcaataaggt

SEQ ID NO: 9063214 - DNA, 22 bp, Homo sapiens
attattgtactttcaataaggt

SEQ ID NO: 9063215 - DNA, 22 bp, Homo sapiens
attattgctgacatggtgttga

SEQ ID NO: 9063216 - DNA, 22 bp, Homo sapiens
attattggacacttcttctgca

SEQ ID NO: 9063217 - DNA, 22 bp, Homo sapiens
attctcagatcttagaggaata

SEQ ID NO: 9063218 - DNA, 22 bp, Homo sapiens
attctcaaacaagtggtttgat

SEQ ID NO: 9063219 - DNA, 22 bp, Homo sapiens
attctcaatggctactttcata

SEQ ID NO: 9063220 - DNA, 22 bp, Homo sapiens
attctgtctttttaaaataata

SEQ ID NO: 9063221 - DNA, 22 bp, Homo sapiens
attctcagggagtattttctat

SEQ ID NO: 9063222 - DNA, 22 bp, Homo sapiens
attctattttttaagaagtagt

SEQ ID NO: 9063223 - DNA, 22 bp, Homo sapiens
attctatagacagaaggtcaat

SEQ ID NO: 9063224 - DNA, 22 bp, Homo sapiens
attctagtgtttccattacaag

SEQ ID NO: 9063225 - DNA, 22 bp, Homo sapiens
attctatagacagaaggtcaat

SEQ ID NO: 9063226 - DNA, 22 bp, Homo sapiens
attcttattatagtaaaacagt

SEQ ID NO: 9063227 - DNA, 22 bp, Homo sapiens
attcttaattgccatgctgtat

SEQ ID NO: 9063228 - DNA, 22 bp, Homo sapiens
attcttacaaagcagagtctgt

SEQ ID NO: 9063229 - DNA, 22 bp, Homo sapiens
attctgttacttggtgatcttc

SEQ ID NO: 9063230 - DNA, 22 bp, Homo sapiens
attctgttacttggtgatcttc

SEQ ID NO: 9063231 - DNA, 22 bp, Homo sapiens
attcttaattccaaagactgag

SEQ ID NO: 9063232 - DNA, 22 bp, Homo sapiens
attcttaattccaaagactgag

SEQ ID NO: 9063233 - DNA, 22 bp, Homo sapiens
attcttaattccaaagactgag

SEQ ID NO: 9063234 - DNA, 22 bp, Homo sapiens
attcttcaaagagtgtcaaagt

SEQ ID NO: 9063235 - DNA, 22 bp, Homo sapiens
attcttcacaaatatatagaag

SEQ ID NO: 9063236 - DNA, 22 bp, Homo sapiens
attcttcactgtttcagaatga

SEQ ID NO: 9063237 - DNA, 22 bp, Homo sapiens
attcttcaccatggataatttg

SEQ ID NO: 9063238 - DNA, 22 bp, Homo sapiens
attcttcacatggataggatct

SEQ ID NO: 9063239 - DNA, 22 bp, Homo sapiens
attgaagatcagggaaagattc

SEQ ID NO: 9063240 - DNA, 22 bp, Homo sapiens
attgaagatcagggaaagattc

SEQ ID NO: 9063241 - DNA, 22 bp, Homo sapiens
attgaagagaagctaaatagag

SEQ ID NO: 9063242 - DNA, 22 bp, Homo sapiens
attgaagagaagctaaatagag

SEQ ID NO: 9063243 - DNA, 22 bp, Homo sapiens
attgaagaaacccaaataatgg

SEQ ID NO: 9063244 - DNA, 22 bp, Homo sapiens
attgaactgttggagaggtttt

SEQ ID NO: 9063245 - DNA, 22 bp, Homo sapiens
attgaacttaacagtaagtggc

SEQ ID NO: 9063246 - DNA, 22 bp, Homo sapiens
attgaagggcattagtcatcag

SEQ ID NO: 9063247 - DNA, 22 bp, Homo sapiens
attgaatagctgcttgttgtat

SEQ ID NO: 9063248 - DNA, 22 bp, Homo sapiens
attgaatagatgcattatacta

SEQ ID NO: 9063249 - DNA, 22 bp, Homo sapiens
attgaatgcttgctaacacttt

SEQ ID NO: 9063250 - DNA, 22 bp, Homo sapiens
attgaaaaatgactattgctta

SEQ ID NO: 9063251 - DNA, 22 bp, Homo sapiens
attgaaaaatgactattgctta

SEQ ID NO: 9063252 - DNA, 22 bp, Homo sapiens
attgaaaaatgactattgctta

SEQ ID NO: 9063253 - DNA, 22 bp, Homo sapiens
attgaaattgatgaaattcttg

SEQ ID NO: 9063254 - DNA, 22 bp, Homo sapiens
attcttcagcaggggacactat

SEQ ID NO: 9063255 - DNA, 23 bp, Homo sapiens
attgaacagagagaaaaacatcc

SEQ ID NO: 9063256 - DNA, 22 bp, Homo sapiens
attgaacagaaaccatcagagt

SEQ ID NO: 9063257 - DNA, 20 bp, Homo sapiens
attgaaatttttctgagatt

SEQ ID NO: 9063258 - DNA, 22 bp, Homo sapiens
attgaacagaaaaactcagaga

SEQ ID NO: 9063259 - DNA, 22 bp, Homo sapiens
attgaacagaaaaactcagaga

SEQ ID NO: 9063260 - DNA, 20 bp, Homo sapiens
attgaaatttttctgagatt

SEQ ID NO: 9063261 - DNA, 23 bp, Homo sapiens
attgaacagagagaaaaacatcc

SEQ ID NO: 9063262 - DNA, 22 bp, Homo sapiens
attgaactaaataagcagtcat

SEQ ID NO: 9063263 - DNA, 22 bp, Homo sapiens
attgaacatacatatccacacc

SEQ ID NO: 9063264 - DNA, 22 bp, Homo sapiens
attgaactctgcaggagctgcc

SEQ ID NO: 9063265 - DNA, 22 bp, Homo sapiens
attgaactgaatcctggattgc

SEQ ID NO: 9063266 - DNA, 22 bp, Homo sapiens
attgcacttcagcctgggtgac

SEQ ID NO: 9063267 - DNA, 22 bp, Homo sapiens
attgcacttcagcctgggtgac

SEQ ID NO: 9063268 - DNA, 20 bp, Homo sapiens
attgacagaaagtgttcacc

SEQ ID NO: 9063269 - DNA, 22 bp, Homo sapiens
attgacagaaaattggatggca

SEQ ID NO: 9063270 - DNA, 22 bp, Homo sapiens
attgacaattctatgcagagca

SEQ ID NO: 9063271 - DNA, 22 bp, Homo sapiens
attgacaattctatgcagagca

SEQ ID NO: 9063272 - DNA, 22 bp, Homo sapiens
attgacaaccctggtatgagca

SEQ ID NO: 9063273 - DNA, 22 bp, Homo sapiens
attgacaaccctggtatgagca

SEQ ID NO: 9063274 - DNA, 22 bp, Homo sapiens
attgacaagaaagatattttta

SEQ ID NO: 9063275 - DNA, 22 bp, Homo sapiens
attgacaagaaagatattttta

SEQ ID NO: 9063276 - DNA, 22 bp, Homo sapiens
attattgcaatttgacattcag

SEQ ID NO: 9063277 - DNA, 22 bp, Homo sapiens
attattgccagctattacaaca

SEQ ID NO: 9063278 - DNA, 22 bp, Homo sapiens
attattgcaagcagtgaaggga

SEQ ID NO: 9063279 - DNA, 22 bp, Homo sapiens
attattcttgaggtgtttattg

SEQ ID NO: 9063280 - DNA, 22 bp, Homo sapiens
attagagaaatgttgccaagat

SEQ ID NO: 9063281 - DNA, 22 bp, Homo sapiens
attagacatcatatgattcagc

SEQ ID NO: 9063282 - DNA, 22 bp, Homo sapiens
attattcaacacttgagaaatt

SEQ ID NO: 9063283 - DNA, 22 bp, Homo sapiens
attattcaatcatattaaaagt

SEQ ID NO: 9063284 - DNA, 22 bp, Homo sapiens
gcaagtttagctaactggccca

SEQ ID NO: 9063285 - DNA, 22 bp, Homo sapiens
gcaataaaatgtaatgattggg

SEQ ID NO: 9063286 - DNA, 22 bp, Homo sapiens
attagaagaggctgacgaatgt

SEQ ID NO: 9063287 - DNA, 22 bp, Homo sapiens
attagaattatgcttgctaatg

SEQ ID NO: 9063288 - DNA, 22 bp, Homo sapiens
attagaatgaagtataggattt

SEQ ID NO: 9063289 - DNA, 22 bp, Homo sapiens
attagaatgacagaaatgaggc

SEQ ID NO: 9063290 - DNA, 22 bp, Homo sapiens
attagacatcatatgattcagc

SEQ ID NO: 9063291 - DNA, 23 bp, Homo sapiens
attagacactttgggttgtcttc

SEQ ID NO: 9063292 - DNA, 20 bp, Homo sapiens
gcaagtgaaaactatgggtg

SEQ ID NO: 9063293 - DNA, 17 bp, Homo sapiens
gcaagggatgggagatt

SEQ ID NO: 9063294 - DNA, 17 bp, Homo sapiens
gcaagggatgggagatt

SEQ ID NO: 9063295 - DNA, 22 bp, Homo sapiens
gcaaggctgttgctgctgcaag

SEQ ID NO: 9063296 - DNA, 22 bp, Homo sapiens
gcaaggctgttgctgctgcaag

SEQ ID NO: 9063297 - DNA, 17 bp, Homo sapiens
gcaagggatgggagatt

SEQ ID NO: 9063298 - DNA, 22 bp, Homo sapiens
gcaaggctttgtgaattttaaa

SEQ ID NO: 9063299 - DNA, 21 bp, Homo sapiens
gcaaggcttttgtgtttccca

SEQ ID NO: 9063300 - DNA, 22 bp, Homo sapiens
attacaaaagaagggagaaggt

SEQ ID NO: 9063301 - DNA, 22 bp, Homo sapiens
attacaaaagaagggagaaggt

SEQ ID NO: 9063302 - DNA, 22 bp, Homo sapiens
attacaaaagaagggagaaggt

SEQ ID NO: 9063303 - DNA, 22 bp, Homo sapiens
attacaacaagaaaagggtaag

SEQ ID NO: 9063304 - DNA, 22 bp, Homo sapiens
attacaactacataatctcaga

SEQ ID NO: 9063305 - DNA, 22 bp, Homo sapiens
attacaactatgtgctctgcaa

SEQ ID NO: 9063306 - DNA, 22 bp, Homo sapiens
attacaactgttcccactgtct

SEQ ID NO: 9063307 - DNA, 22 bp, Homo sapiens
attacaactggaatggtgctgg

SEQ ID NO: 9063308 - DNA, 22 bp, Homo sapiens
attacaataaggtttatttgta

SEQ ID NO: 9063309 - DNA, 22 bp, Homo sapiens
attacaataaggtttatttgta

SEQ ID NO: 9063310 - DNA, 22 bp, Homo sapiens
attacaagggtctgactggagg

SEQ ID NO: 9063311 - DNA, 22 bp, Homo sapiens
gcaactttagaaaaatctataa

SEQ ID NO: 9063312 - DNA, 22 bp, Homo sapiens
attacaataatacatgctcatt

SEQ ID NO: 9063313 - DNA, 22 bp, Homo sapiens
attacaataaggtttatttgta

SEQ ID NO: 9063314 - DNA, 22 bp, Homo sapiens
attacaataatacatgctcatt

SEQ ID NO: 9063315 - DNA, 22 bp, Homo sapiens
attacaataatacatgctcatt

SEQ ID NO: 9063316 - DNA, 22 bp, Homo sapiens
gcaaggctgacctctctagact

SEQ ID NO: 9063317 - DNA, 22 bp, Homo sapiens
gcaaggctgacctctctagact

SEQ ID NO: 9063318 - DNA, 22 bp, Homo sapiens
gcaaggctgacctctctagact

SEQ ID NO: 9063319 - DNA, 22 bp, Homo sapiens
gcaaggctgagcacatttgcat

SEQ ID NO: 9063320 - DNA, 22 bp, Homo sapiens
gcaaggctgagcacatttgcat

SEQ ID NO: 9063321 - DNA, 22 bp, Homo sapiens
gcaaggctgtgcactttgcatt

SEQ ID NO: 9063322 - DNA, 22 bp, Homo sapiens
gcaaggctgggagatgaggcct

SEQ ID NO: 9063323 - DNA, 22 bp, Homo sapiens
gcaaggctggtggtggtgaagt

SEQ ID NO: 9063324 - DNA, 22 bp, Homo sapiens
gcaaggctgctgccacccatct

SEQ ID NO: 9063325 - DNA, 22 bp, Homo sapiens
attaatcatttctgcattatct

SEQ ID NO: 9063326 - DNA, 22 bp, Homo sapiens
attaatgtgtagccaacttaat

SEQ ID NO: 9063327 - DNA, 22 bp, Homo sapiens
attaattttacctttgtaaaca

SEQ ID NO: 9063328 - DNA, 22 bp, Homo sapiens
attaattttacctttgtaaaca

SEQ ID NO: 9063329 - DNA, 22 bp, Homo sapiens
gatgatctgcaagaactacatg

SEQ ID NO: 9063330 - DNA, 22 bp, Homo sapiens
attaagatcattgtagaagatt

SEQ ID NO: 9063331 - DNA, 22 bp, Homo sapiens
gatgatgagataaggataactt

SEQ ID NO: 9063332 - DNA, 22 bp, Homo sapiens
gatgatgaggccatgaggcagg

SEQ ID NO: 9063333 - DNA, 22 bp, Homo sapiens
attaatatacactgttagcatg

SEQ ID NO: 9063334 - DNA, 22 bp, Homo sapiens
attaatatgagaaagtggcaga

SEQ ID NO: 9063335 - DNA, 22 bp, Homo sapiens
atgttttatgttccactcaagg

SEQ ID NO: 9063336 - DNA, 22 bp, Homo sapiens
atgttttatgcttcagatgagg

SEQ ID NO: 9063337 - DNA, 22 bp, Homo sapiens
atgttttatattttgcagcagt

SEQ ID NO: 9063338 - DNA, 22 bp, Homo sapiens
atgttttctagagtttaaaatc

SEQ ID NO: 9063339 - DNA, 22 bp, Homo sapiens
atgttttccccaaatgatcttc

SEQ ID NO: 9063340 - DNA, 22 bp, Homo sapiens
atgttttattaccaacttgtac

SEQ ID NO: 9063341 - DNA, 22 bp, Homo sapiens
atgtgttcacgtgcacatgtgc

SEQ ID NO: 9063342 - DNA, 22 bp, Homo sapiens
atgtgttagtttgtgattatac

SEQ ID NO: 9063343 - DNA, 22 bp, Homo sapiens
atgtgttaatgtcaaccagaaa

SEQ ID NO: 9063344 - DNA, 22 bp, Homo sapiens
atgtgttaatgagcaatgacct

SEQ ID NO: 9063345 - DNA, 22 bp, Homo sapiens
atgtgtgtgtttaatcctcaaa

SEQ ID NO: 9063346 - DNA, 22 bp, Homo sapiens
atgtgtgtgtttaatcctcaaa

SEQ ID NO: 9063347 - DNA, 22 bp, Homo sapiens
atgtgtgtgtgcgcgcgcagga

SEQ ID NO: 9063348 - DNA, 22 bp, Homo sapiens
atgtgtgtgtgcgcgcgcagga

SEQ ID NO: 9063349 - DNA, 22 bp, Homo sapiens
atgtgtgtgtatatacacacat

SEQ ID NO: 9063350 - DNA, 22 bp, Homo sapiens
atgtgtgtgtatatacacacat

SEQ ID NO: 9063351 - DNA, 22 bp, Homo sapiens
atgtgtttgtacctttaaatat

SEQ ID NO: 9063352 - DNA, 22 bp, Homo sapiens
atgttaaaaaccagtacagttg

SEQ ID NO: 9063353 - DNA, 23 bp, Homo sapiens
gatgaggacctacaggtggccag

SEQ ID NO: 9063354 - DNA, 22 bp, Homo sapiens
attaaattagcaaactgtgaaa

SEQ ID NO: 9063355 - DNA, 22 bp, Homo sapiens
attaaattagcaaactgtgaaa

SEQ ID NO: 9063356 - DNA, 22 bp, Homo sapiens
attaaatgttggcatattttgt

SEQ ID NO: 9063357 - DNA, 22 bp, Homo sapiens
attaaatgttggcatattttgt

SEQ ID NO: 9063358 - DNA, 22 bp, Homo sapiens
attaaattaagtggctaattta

SEQ ID NO: 9063359 - DNA, 22 bp, Homo sapiens
attaaatgttccttaaattata

SEQ ID NO: 9063360 - DNA, 22 bp, Homo sapiens
attaaatgttccttaaattata

SEQ ID NO: 9063361 - DNA, 22 bp, Homo sapiens
attaaatgttccttaaattata

SEQ ID NO: 9063362 - DNA, 18 bp, Homo sapiens
gatgaggctgtctgagaa

SEQ ID NO: 9063363 - DNA, 22 bp, Homo sapiens
gatgaggctgtgtctgcacaag

SEQ ID NO: 9063364 - DNA, 22 bp, Homo sapiens
gatgagggcctggtggctgtgc

SEQ ID NO: 9063365 - DNA, 22 bp, Homo sapiens
gatgaggcataaacacagtcac

SEQ ID NO: 9063366 - DNA, 22 bp, Homo sapiens
gatgaggctagagacatgtgta

SEQ ID NO: 9063367 - DNA, 22 bp, Homo sapiens
attaaaactaaaatgcctgatt

SEQ ID NO: 9063368 - DNA, 22 bp, Homo sapiens
atgtttttggcttcaagtttct

SEQ ID NO: 9063369 - DNA, 22 bp, Homo sapiens
atgtttttggcttcaagtttct

SEQ ID NO: 9063370 - DNA, 22 bp, Homo sapiens
atgtttttgagatacaaacaga

SEQ ID NO: 9063371 - DNA, 22 bp, Homo sapiens
atgtttttgagatacaaacaga

SEQ ID NO: 9063372 - DNA, 22 bp, Homo sapiens
atgtttttaaatagacttacag

SEQ ID NO: 9063373 - DNA, 22 bp, Homo sapiens
atgtttttcataccagtgttgg

SEQ ID NO: 9063374 - DNA, 22 bp, Homo sapiens
atgtttttcataccagtgttgg

SEQ ID NO: 9063375 - DNA, 22 bp, Homo sapiens
attaaatgatggcatgtcttat

SEQ ID NO: 9063376 - DNA, 22 bp, Homo sapiens
attaaatggtggtcattcattt

SEQ ID NO: 9063377 - DNA, 22 bp, Homo sapiens
attaaatggtggtcattcattt

SEQ ID NO: 9063378 - DNA, 20 bp, Homo sapiens
caccctcccagcacctatgc

SEQ ID NO: 9063379 - DNA, 22 bp, Homo sapiens
cacccccacctgtgggctcctg

SEQ ID NO: 9063380 - DNA, 22 bp, Homo sapiens
cactctgagaagtacaagctcc

SEQ ID NO: 9063381 - DNA, 22 bp, Homo sapiens
cactctgagaagtacaagctcc

SEQ ID NO: 9063382 - DNA, 22 bp, Homo sapiens
cactctgagaaacactaaacca

SEQ ID NO: 9063383 - DNA, 22 bp, Homo sapiens
caccctggctggaggtgcagtg

SEQ ID NO: 9063384 - DNA, 22 bp, Homo sapiens
caccctggaaagaaggtctggg

SEQ ID NO: 9063385 - DNA, 22 bp, Homo sapiens
caccccagtctaaaaccagcct

SEQ ID NO: 9063386 - DNA, 22 bp, Homo sapiens
caccccagtctaaaaccagcct

SEQ ID NO: 9063387 - DNA, 22 bp, Homo sapiens
caccccagcttctcaggataga

SEQ ID NO: 9063388 - DNA, 22 bp, Homo sapiens
cacccaggttggagtgcagtgg

SEQ ID NO: 9063389 - DNA, 22 bp, Homo sapiens
cacccaggttggagtgcagtgg

SEQ ID NO: 9063390 - DNA, 22 bp, Homo sapiens
cacccagtgaaggagcaagagg

SEQ ID NO: 9063391 - DNA, 22 bp, Homo sapiens
cacccagttgactacaaagggg

SEQ ID NO: 9063392 - DNA, 22 bp, Homo sapiens
ggcagtttcatcaggagaaaag

SEQ ID NO: 9063393 - DNA, 22 bp, Homo sapiens
ggcagtttctcaggcaggggta

SEQ ID NO: 9063394 - DNA, 22 bp, Homo sapiens
ggcagtttggcaggatggaggg

SEQ ID NO: 9063395 - DNA, 22 bp, Homo sapiens
ggcagtttcatcaggagaaaag

SEQ ID NO: 9063396 - DNA, 22 bp, Homo sapiens
ggcagtttctcaggcaggggta

SEQ ID NO: 9063397 - DNA, 22 bp, Homo sapiens
ggcagttttaacagaggtagta

SEQ ID NO: 9063398 - DNA, 22 bp, Homo sapiens
ggcatagatttctttaggttta

SEQ ID NO: 9063399 - DNA, 22 bp, Homo sapiens
cacccaggctggaatgcagtgg

SEQ ID NO: 9063400 - DNA, 22 bp, Homo sapiens
cacccaggctggaatgcaatgg

SEQ ID NO: 9063401 - DNA, 22 bp, Homo sapiens
cacccaggctagagtgcagtgg

SEQ ID NO: 9063402 - DNA, 22 bp, Homo sapiens
ggcatattcccagacctcatct

SEQ ID NO: 9063403 - DNA, 22 bp, Homo sapiens
ggcatcagcccggtcctgggct

SEQ ID NO: 9063404 - DNA, 22 bp, Homo sapiens
ggcatagcggctcagcgtccag

SEQ ID NO: 9063405 - DNA, 22 bp, Homo sapiens
ggcagccagagggcagctggat

SEQ ID NO: 9063406 - DNA, 22 bp, Homo sapiens
ggcagccagagggcagctggat

SEQ ID NO: 9063407 - DNA, 21 bp, Homo sapiens
ggcagctgaccgcgcggtgca

SEQ ID NO: 9063408 - DNA, 21 bp, Homo sapiens
ggcagctgaccgcgcggtgca

SEQ ID NO: 9063409 - DNA, 21 bp, Homo sapiens
ggcagctgaccgcgcggtgca

SEQ ID NO: 9063410 - DNA, 22 bp, Homo sapiens
ggcagctgaagaggaactttgg

SEQ ID NO: 9063411 - DNA, 22 bp, Homo sapiens
ggcagctgagatcatgctgttg

SEQ ID NO: 9063412 - DNA, 22 bp, Homo sapiens
ggcagctgagatcatgctgttg

SEQ ID NO: 9063413 - DNA, 22 bp, Homo sapiens
ggcagctgagatcatgctgttg

SEQ ID NO: 9063414 - DNA, 22 bp, Homo sapiens
ggcagctgagatcatgctgttg

SEQ ID NO: 9063415 - DNA, 22 bp, Homo sapiens
ggcagctgacctagcaccatcc

SEQ ID NO: 9063416 - DNA, 22 bp, Homo sapiens
ggcagctgacctagcaccatcc

SEQ ID NO: 9063417 - DNA, 22 bp, Homo sapiens
ggcagctgacctagcaccatcc

SEQ ID NO: 9063418 - DNA, 22 bp, Homo sapiens
ggcagctgacctagcaccatcc

SEQ ID NO: 9063419 - DNA, 22 bp, Homo sapiens
caccagtctttattttgttatt

SEQ ID NO: 9063420 - DNA, 16 bp, Homo sapiens
caccagtccttcctgc

SEQ ID NO: 9063421 - DNA, 20 bp, Homo sapiens
caccagtcatgagtcaatac

SEQ ID NO: 9063422 - DNA, 22 bp, Homo sapiens
caccataaccaacatgtcagtt

SEQ ID NO: 9063423 - DNA, 22 bp, Homo sapiens
ggcagctgattagcatcaagga

SEQ ID NO: 9063424 - DNA, 22 bp, Homo sapiens
caccaggctggagtgcagtggc

SEQ ID NO: 9063425 - DNA, 22 bp, Homo sapiens
caccaggctggagtgcagtggc

SEQ ID NO: 9063426 - DNA, 22 bp, Homo sapiens
ggcagctgagcatggctacctt

SEQ ID NO: 9063427 - DNA, 22 bp, Homo sapiens
ggcagctgagcatggctacctt

SEQ ID NO: 9063428 - DNA, 22 bp, Homo sapiens
ggcagctgagcatggctacctt

SEQ ID NO: 9063429 - DNA, 22 bp, Homo sapiens
ggcagctgagcatggctacctt

SEQ ID NO: 9063430 - DNA, 22 bp, Homo sapiens
ggcagctgattagcatcaagga

SEQ ID NO: 9063431 - DNA, 22 bp, Homo sapiens
ggcagctgattagcatcaagga

SEQ ID NO: 9063432 - DNA, 22 bp, Homo sapiens
ggcagctgattagcatcaagga

SEQ ID NO: 9063433 - DNA, 22 bp, Homo sapiens
ggcagctgagcatggctacctt

SEQ ID NO: 9063434 - DNA, 22 bp, Homo sapiens
caccattccaggccttaagaag

SEQ ID NO: 9063435 - DNA, 22 bp, Homo sapiens
caccattctgaggagagtggat

SEQ ID NO: 9063436 - DNA, 22 bp, Homo sapiens
caccattttctaaaaatatgac

SEQ ID NO: 9063437 - DNA, 22 bp, Homo sapiens
caccatttaagaaagccaaatt

SEQ ID NO: 9063438 - DNA, 22 bp, Homo sapiens
caccattttctaaaaatatgac

SEQ ID NO: 9063439 - DNA, 22 bp, Homo sapiens
caccatgcctggctaatttttt

SEQ ID NO: 9063440 - DNA, 22 bp, Homo sapiens
caccatgcccggctaattttgg

SEQ ID NO: 9063441 - DNA, 22 bp, Homo sapiens
caccatctggtaggcattagtg

SEQ ID NO: 9063442 - DNA, 22 bp, Homo sapiens
caccatctagcagagagatgga

SEQ ID NO: 9063443 - DNA, 22 bp, Homo sapiens
cacccacatggaaattcacagt

SEQ ID NO: 9063444 - DNA, 22 bp, Homo sapiens
cacccagacatgtggtcccaga

SEQ ID NO: 9063445 - DNA, 22 bp, Homo sapiens
ggcagttgcgtgcatcagtggt

SEQ ID NO: 9063446 - DNA, 22 bp, Homo sapiens
ggcagtgtggcataacatgtag

SEQ ID NO: 9063447 - DNA, 22 bp, Homo sapiens
ggcagtgtgcatctgtgtggcc

SEQ ID NO: 9063448 - DNA, 22 bp, Homo sapiens
ggcagtgttctggttgtcagga

SEQ ID NO: 9063449 - DNA, 22 bp, Homo sapiens
ggcagtgtccagcttcctggag

SEQ ID NO: 9063450 - DNA, 22 bp, Homo sapiens
ggcagtgtccttgcagctctac

SEQ ID NO: 9063451 - DNA, 22 bp, Homo sapiens
ggcagtggttagaaacatgagc

SEQ ID NO: 9063452 - DNA, 22 bp, Homo sapiens
cactgcactccatcctgggaaa

SEQ ID NO: 9063453 - DNA, 22 bp, Homo sapiens
cactgcaggtctgagatggggg

SEQ ID NO: 9063454 - DNA, 21 bp, Homo sapiens
cactgcagccttgacctgggc

SEQ ID NO: 9063455 - DNA, 23 bp, Homo sapiens
cactgcagcgtggtctggcagga

SEQ ID NO: 9063456 - DNA, 22 bp, Homo sapiens
ggcctcgcggcttctggtggct

SEQ ID NO: 9063457 - DNA, 22 bp, Homo sapiens
ggcctcgcggcttctggtggct

SEQ ID NO: 9063458 - DNA, 22 bp, Homo sapiens
ggcctcgcggcttctggtggct

SEQ ID NO: 9063459 - DNA, 22 bp, Homo sapiens
ggcctcggcccactgctgcggt

SEQ ID NO: 9063460 - DNA, 23 bp, Homo sapiens
ggcctctcaccagggtcctttca

SEQ ID NO: 9063461 - DNA, 22 bp, Homo sapiens
cactgagaccagagtccctgac

SEQ ID NO: 9063462 - DNA, 22 bp, Homo sapiens
cactgagaccagagtccctgac

SEQ ID NO: 9063463 - DNA, 22 bp, Homo sapiens
cactgaaggaaggactactgca

SEQ ID NO: 9063464 - DNA, 22 bp, Homo sapiens
cactgaagcctgggagtaagac

SEQ ID NO: 9063465 - DNA, 22 bp, Homo sapiens
cactgaagatgcgactagtgct

SEQ ID NO: 9063466 - DNA, 22 bp, Homo sapiens
cactgaaggctaggattagatg

SEQ ID NO: 9063467 - DNA, 22 bp, Homo sapiens
ggcctcctgttggctagtgtga

SEQ ID NO: 9063468 - DNA, 22 bp, Homo sapiens
ggcctcctgttggctagtgtga

SEQ ID NO: 9063469 - DNA, 22 bp, Homo sapiens
ggcctcctcaccctgctcaggc

SEQ ID NO: 9063470 - DNA, 22 bp, Homo sapiens
ggcctcctcaccctgctcaggc

SEQ ID NO: 9063471 - DNA, 21 bp, Homo sapiens
cactgaggaggaaaaggagct

SEQ ID NO: 9063472 - DNA, 22 bp, Homo sapiens
ggcctcctcaccctgctcaggc

SEQ ID NO: 9063473 - DNA, 22 bp, Homo sapiens
cactgcatggctgtgaggcagc

SEQ ID NO: 9063474 - DNA, 22 bp, Homo sapiens
cactgcatggatgatggctgta

SEQ ID NO: 9063475 - DNA, 20 bp, Homo sapiens
cactgccagaatacactgtc

SEQ ID NO: 9063476 - DNA, 20 bp, Homo sapiens
cactgcattgatggaaacag

SEQ ID NO: 9063477 - DNA, 21 bp, Homo sapiens
cactgcattaagtctgtaggt

SEQ ID NO: 9063478 - DNA, 22 bp, Homo sapiens
cactgcagttccccagtgcgca

SEQ ID NO: 9063479 - DNA, 22 bp, Homo sapiens
cactgcagtaactctaggactg

SEQ ID NO: 9063480 - DNA, 22 bp, Homo sapiens
ggctagggagacagagggcatg

SEQ ID NO: 9063481 - DNA, 22 bp, Homo sapiens
ggctagggagacagagggcatg

SEQ ID NO: 9063482 - DNA, 22 bp, Homo sapiens
cactgccatgttgatagatgtg

SEQ ID NO: 9063483 - DNA, 22 bp, Homo sapiens
ggctagggatctagaccaggac

SEQ ID NO: 9063484 - DNA, 22 bp, Homo sapiens
ggctagggatctagaccaggac

SEQ ID NO: 9063485 - DNA, 22 bp, Homo sapiens
ggctaggggaataatctgtggt

SEQ ID NO: 9063486 - DNA, 22 bp, Homo sapiens
ggctatatcctcacaagatgga

SEQ ID NO: 9063487 - DNA, 22 bp, Homo sapiens
ggctcaagcagtctgcctgcct

SEQ ID NO: 9063488 - DNA, 22 bp, Homo sapiens
cactgcctggaaggagagacat

SEQ ID NO: 9063489 - DNA, 22 bp, Homo sapiens
cactggaatggatagagcagag

SEQ ID NO: 9063490 - DNA, 22 bp, Homo sapiens
cactggaagagcatctgagcca

SEQ ID NO: 9063491 - DNA, 22 bp, Homo sapiens
cactggaaccatccacatagtg

SEQ ID NO: 9063492 - DNA, 18 bp, Homo sapiens
cactggacctcatgagag

SEQ ID NO: 9063493 - DNA, 22 bp, Homo sapiens
cactggacagagtggggttccc

SEQ ID NO: 9063494 - DNA, 22 bp, Homo sapiens
cactggaatgttgaggagacaa

SEQ ID NO: 9063495 - DNA, 22 bp, Homo sapiens
cactggaggtcagtggagcact

SEQ ID NO: 9063496 - DNA, 22 bp, Homo sapiens
cacagcttgggctctgacaata

SEQ ID NO: 9063497 - DNA, 22 bp, Homo sapiens
cacagcttgtttagtgactcac

SEQ ID NO: 9063498 - DNA, 22 bp, Homo sapiens
ggaggccttgaggccaggagct

SEQ ID NO: 9063499 - DNA, 22 bp, Homo sapiens
cacagcttctccttgatatcgc

SEQ ID NO: 9063500 - DNA, 22 bp, Homo sapiens
cacagcttctccccgctgcggc

SEQ ID NO: 9063501 - DNA, 22 bp, Homo sapiens
cacagcttctgagtgaggattt

SEQ ID NO: 9063502 - DNA, 22 bp, Homo sapiens
cacagcttctgagtgaggattt

SEQ ID NO: 9063503 - DNA, 22 bp, Homo sapiens
cacagcttctgtctgacccatg

SEQ ID NO: 9063504 - DNA, 22 bp, Homo sapiens
cacagcttcttccattccactc

SEQ ID NO: 9063505 - DNA, 20 bp, Homo sapiens
cacagcttgccttttatgac

SEQ ID NO: 9063506 - DNA, 20 bp, Homo sapiens
cacagcttgccttttatgac

SEQ ID NO: 9063507 - DNA, 22 bp, Homo sapiens
cacagcttgggctctgacaata

SEQ ID NO: 9063508 - DNA, 22 bp, Homo sapiens
ggaggcggagcttgcagtgagc

SEQ ID NO: 9063509 - DNA, 22 bp, Homo sapiens
ggaggcggaagttgcagtgagc

SEQ ID NO: 9063510 - DNA, 22 bp, Homo sapiens
cacagctggtgcactagctctg

SEQ ID NO: 9063511 - DNA, 22 bp, Homo sapiens
cacactgataggcttgacaggc

SEQ ID NO: 9063512 - DNA, 22 bp, Homo sapiens
cacagcttagaaaagaagccat

SEQ ID NO: 9063513 - DNA, 22 bp, Homo sapiens
cacagcttatgccactgattgg

SEQ ID NO: 9063514 - DNA, 22 bp, Homo sapiens
cacagcttcagtttctgacttg

SEQ ID NO: 9063515 - DNA, 22 bp, Homo sapiens
cacagcttatgccactgattgg

SEQ ID NO: 9063516 - DNA, 22 bp, Homo sapiens
cacagcttcccaaagtggacct

SEQ ID NO: 9063517 - DNA, 22 bp, Homo sapiens
cacagcttcccgtgcatggaga

SEQ ID NO: 9063518 - DNA, 22 bp, Homo sapiens
cacagcttccattagaatgaga

SEQ ID NO: 9063519 - DNA, 22 bp, Homo sapiens
cacagcttccattagaatgaga

SEQ ID NO: 9063520 - DNA, 22 bp, Homo sapiens
cacagctggtgcactagctctg

SEQ ID NO: 9063521 - DNA, 22 bp, Homo sapiens
ggagggagggctagaccaaaga

SEQ ID NO: 9063522 - DNA, 22 bp, Homo sapiens
ggagggaggttagattcaagct

SEQ ID NO: 9063523 - DNA, 22 bp, Homo sapiens
ggagggagggctagaccaaaga

SEQ ID NO: 9063524 - DNA, 22 bp, Homo sapiens
ggaggcggaggctgcagtgagc

SEQ ID NO: 9063525 - DNA, 22 bp, Homo sapiens
ggagggagcagagaacccaacc

SEQ ID NO: 9063526 - DNA, 22 bp, Homo sapiens
ggagggagcatccccttgctga

SEQ ID NO: 9063527 - DNA, 22 bp, Homo sapiens
ggagggaggttagattcaagct

SEQ ID NO: 9063528 - DNA, 22 bp, Homo sapiens
ggagggagtcagctgattagaa

SEQ ID NO: 9063529 - DNA, 22 bp, Homo sapiens
ggagggagtttcattcctgccc

SEQ ID NO: 9063530 - DNA, 22 bp, Homo sapiens
ggatctgggctctgccaatcag

SEQ ID NO: 9063531 - DNA, 22 bp, Homo sapiens
ggatgtgaatctgggctgagac

SEQ ID NO: 9063532 - DNA, 22 bp, Homo sapiens
ggatgtagtgcaaggagtgaat

SEQ ID NO: 9063533 - DNA, 22 bp, Homo sapiens
ggatgggctgaaaggtagcccc

SEQ ID NO: 9063534 - DNA, 22 bp, Homo sapiens
ggatgggcccgggacggcgctg

SEQ ID NO: 9063535 - DNA, 22 bp, Homo sapiens
ggatgggcagacaggacggcac

SEQ ID NO: 9063536 - DNA, 22 bp, Homo sapiens
cacagggcaccagttggccatc

SEQ ID NO: 9063537 - DNA, 22 bp, Homo sapiens
cacagggcaccagttggccatc

SEQ ID NO: 9063538 - DNA, 23 bp, Homo sapiens
cacagggagggaaactctttcag

SEQ ID NO: 9063539 - DNA, 22 bp, Homo sapiens
cacagggaggcggtcactggct

SEQ ID NO: 9063540 - DNA, 22 bp, Homo sapiens
cacagggaggcagccatgctcc

SEQ ID NO: 9063541 - DNA, 22 bp, Homo sapiens
ggatgttctggggttctcttgt

SEQ ID NO: 9063542 - DNA, 22 bp, Homo sapiens
cacagggagaggaacagcgcag

SEQ ID NO: 9063543 - DNA, 22 bp, Homo sapiens
cacagtggctttgctggtctcg

SEQ ID NO: 9063544 - DNA, 22 bp, Homo sapiens
cacagtggcaaaggggcttggg

SEQ ID NO: 9063545 - DNA, 22 bp, Homo sapiens
cacagtggcaaaggggcttggg

SEQ ID NO: 9063546 - DNA, 22 bp, Homo sapiens
cacagtgctttatgagagatct

SEQ ID NO: 9063547 - DNA, 22 bp, Homo sapiens
cacagtggaagtccaggatccc

SEQ ID NO: 9063548 - DNA, 22 bp, Homo sapiens
cacagtgctttacatgttttct

SEQ ID NO: 9063549 - DNA, 22 bp, Homo sapiens
cacagtgctgtttgtaaagaga

SEQ ID NO: 9063550 - DNA, 16 bp, Homo sapiens
cacagtgctgctgctc

SEQ ID NO: 9063551 - DNA, 22 bp, Homo sapiens
cacagtgctcgggttttatgtc

SEQ ID NO: 9063552 - DNA, 22 bp, Homo sapiens
cacagtgctcaaacacaagtgc

SEQ ID NO: 9063553 - DNA, 22 bp, Homo sapiens
cacagtgctcaaacacaagtgc

SEQ ID NO: 9063554 - DNA, 17 bp, Homo sapiens
ggcagagctgacagggc

SEQ ID NO: 9063555 - DNA, 22 bp, Homo sapiens
ggcagagcgcatgcgtcgcaga

SEQ ID NO: 9063556 - DNA, 22 bp, Homo sapiens
ggcagatggaagaggctgggtc

SEQ ID NO: 9063557 - DNA, 22 bp, Homo sapiens
ggcagatggaagaggctgggtc

SEQ ID NO: 9063558 - DNA, 22 bp, Homo sapiens
ggcagcagtggctgctattgtc

SEQ ID NO: 9063559 - DNA, 22 bp, Homo sapiens
ggcagcagtggctgctattgtc

SEQ ID NO: 9063560 - DNA, 22 bp, Homo sapiens
ggcagcagttacaaatgtgcag

SEQ ID NO: 9063561 - DNA, 22 bp, Homo sapiens
ggcagcagtggctgctattgtc

SEQ ID NO: 9063562 - DNA, 22 bp, Homo sapiens
ggcagcatcttgatattggttt

SEQ ID NO: 9063563 - DNA, 22 bp, Homo sapiens
ggcagcatgggtgcctttgtga

SEQ ID NO: 9063564 - DNA, 22 bp, Homo sapiens
ggcagcatgtgtggtccgctgg

SEQ ID NO: 9063565 - DNA, 22 bp, Homo sapiens
ggcagcatgggtgcctttgtga

SEQ ID NO: 9063566 - DNA, 22 bp, Homo sapiens
ggcagccaccctgggaggcaga

SEQ ID NO: 9063567 - DNA, 20 bp, Homo sapiens
ggcagccaatcagcgtgccg

SEQ ID NO: 9063568 - DNA, 22 bp, Homo sapiens
ggcagcatatattcagtgggca

SEQ ID NO: 9063569 - DNA, 22 bp, Homo sapiens
ggcagcatctcatatcttcagg

SEQ ID NO: 9063570 - DNA, 22 bp, Homo sapiens
ggcacagggtgatgttgcagtt

SEQ ID NO: 9063571 - DNA, 22 bp, Homo sapiens
ggcacagggtgatgttgcagtt

SEQ ID NO: 9063572 - DNA, 22 bp, Homo sapiens
ggcacagggggctgaggactag

SEQ ID NO: 9063573 - DNA, 22 bp, Homo sapiens
ggcacagggaggccctggtgtg

SEQ ID NO: 9063574 - DNA, 22 bp, Homo sapiens
ggcacagggagccgcagttgca

SEQ ID NO: 9063575 - DNA, 22 bp, Homo sapiens
ggcacagggagccgcagttgca

SEQ ID NO: 9063576 - DNA, 22 bp, Homo sapiens
cacagggcaggccccaggcctc

SEQ ID NO: 9063577 - DNA, 22 bp, Homo sapiens
cacagggcaggccccaggcctc

SEQ ID NO: 9063578 - DNA, 22 bp, Homo sapiens
cacagggcagagacctgggtgc

SEQ ID NO: 9063579 - DNA, 22 bp, Homo sapiens
ggcacagggagccgcagttgca

SEQ ID NO: 9063580 - DNA, 22 bp, Homo sapiens
ggcacacaaaggcagcatttga

SEQ ID NO: 9063581 - DNA, 22 bp, Homo sapiens
ggcacaggagtcacagcatttc

SEQ ID NO: 9063582 - DNA, 22 bp, Homo sapiens
ggcacaggagtcacagcatttc

SEQ ID NO: 9063583 - DNA, 22 bp, Homo sapiens
ggcacaggagtcacagcatttc

SEQ ID NO: 9063584 - DNA, 22 bp, Homo sapiens
ggcactgggcaccggctgaggg

SEQ ID NO: 9063585 - DNA, 22 bp, Homo sapiens
ggcactgggcaccggctgaggg

SEQ ID NO: 9063586 - DNA, 22 bp, Homo sapiens
ggcactgggaatgcagtgatga

SEQ ID NO: 9063587 - DNA, 22 bp, Homo sapiens
ggcactgggagaggtgagacgg

SEQ ID NO: 9063588 - DNA, 22 bp, Homo sapiens
ggcactgggagaggtgagacgg

SEQ ID NO: 9063589 - DNA, 22 bp, Homo sapiens
ggcagagatgtgggtcagaatc

SEQ ID NO: 9063590 - DNA, 22 bp, Homo sapiens
ggcactggagactgttatgaga

SEQ ID NO: 9063591 - DNA, 22 bp, Homo sapiens
ggcactggaagtcccattgtct

SEQ ID NO: 9063592 - DNA, 22 bp, Homo sapiens
ggcactggaaggatcatgtgag

SEQ ID NO: 9063593 - DNA, 22 bp, Homo sapiens
ggcactggaaggatcatgtgag

SEQ ID NO: 9063594 - DNA, 16 bp, Homo sapiens
ggcactggcaggtcct

SEQ ID NO: 9063595 - DNA, 22 bp, Homo sapiens
ggcactggcaaagcaaagtctg

SEQ ID NO: 9063596 - DNA, 22 bp, Homo sapiens
ggcactggcaaagcaaagtctg

SEQ ID NO: 9063597 - DNA, 22 bp, Homo sapiens
ggcactggcctggggccaagag

SEQ ID NO: 9063598 - DNA, 20 bp, Homo sapiens
ggcactggaagcacacagga

SEQ ID NO: 9063599 - DNA, 20 bp, Homo sapiens
ggcactggaagcacacagga

SEQ ID NO: 9063600 - DNA, 20 bp, Homo sapiens
ggcactggaagcacacagga

SEQ ID NO: 9063601 - DNA, 22 bp, Homo sapiens
gctgtctgagaacatggtggaa

SEQ ID NO: 9063602 - DNA, 20 bp, Homo sapiens
gctgtctgacagttcccaga

SEQ ID NO: 9063603 - DNA, 22 bp, Homo sapiens
gctgtctgcatctctagagctt

SEQ ID NO: 9063604 - DNA, 22 bp, Homo sapiens
gctgtctgcatctctagagctt

SEQ ID NO: 9063605 - DNA, 22 bp, Homo sapiens
gctgtgcttttggtagatccca

SEQ ID NO: 9063606 - DNA, 22 bp, Homo sapiens
gctgtgcttgggaagaatctct

SEQ ID NO: 9063607 - DNA, 22 bp, Homo sapiens
gctgtgcttgcatgagtgtctg

SEQ ID NO: 9063608 - DNA, 22 bp, Homo sapiens
gctgtgctgcgggaggattccg

SEQ ID NO: 9063609 - DNA, 22 bp, Homo sapiens
gctgtgctgcgggaggattccg

SEQ ID NO: 9063610 - DNA, 22 bp, Homo sapiens
gctgtgctgattcattccctgc

SEQ ID NO: 9063611 - DNA, 22 bp, Homo sapiens
gctgtctgccgcaggctgccac

SEQ ID NO: 9063612 - DNA, 20 bp, Homo sapiens
gctgtggcaagtgctcactg

SEQ ID NO: 9063613 - DNA, 22 bp, Homo sapiens
caaggcagcgttcctttctgga

SEQ ID NO: 9063614 - DNA, 22 bp, Homo sapiens
caaggcagctattgtctccata

SEQ ID NO: 9063615 - DNA, 22 bp, Homo sapiens
caaggcagctattgtctccata

SEQ ID NO: 9063616 - DNA, 22 bp, Homo sapiens
caaggcagctattgtctccata

SEQ ID NO: 9063617 - DNA, 22 bp, Homo sapiens
caaggcagctattgtctccata

SEQ ID NO: 9063618 - DNA, 21 bp, Homo sapiens
gctgtctcctccttgcaccag

SEQ ID NO: 9063619 - DNA, 22 bp, Homo sapiens
gctgtctccatagctgtgtgtc

SEQ ID NO: 9063620 - DNA, 20 bp, Homo sapiens
caaggcagaccagagtgagt

SEQ ID NO: 9063621 - DNA, 20 bp, Homo sapiens
caaggcagaccagagtgagt

SEQ ID NO: 9063622 - DNA, 22 bp, Homo sapiens
caaggcagaattcagactcagg

SEQ ID NO: 9063623 - DNA, 22 bp, Homo sapiens
caaggcagcccgctgaaccaca

SEQ ID NO: 9063624 - DNA, 22 bp, Homo sapiens
caaggcagcccgctgaaccaca

SEQ ID NO: 9063625 - DNA, 22 bp, Homo sapiens
caaggcagcccgctgaaccaca

SEQ ID NO: 9063626 - DNA, 20 bp, Homo sapiens
caaggcagaccagagtgagt

SEQ ID NO: 9063627 - DNA, 22 bp, Homo sapiens
caaggcaagtcatatgggcaag

SEQ ID NO: 9063628 - DNA, 22 bp, Homo sapiens
caatttctcgaactctaatcca

SEQ ID NO: 9063629 - DNA, 22 bp, Homo sapiens
caatttctcgaactctaatcca

SEQ ID NO: 9063630 - DNA, 22 bp, Homo sapiens
cacaaaagtaggaggcaggcgg

SEQ ID NO: 9063631 - DNA, 22 bp, Homo sapiens
gcttggctggagaaagttacct

SEQ ID NO: 9063632 - DNA, 22 bp, Homo sapiens
gcttggctgtgagctttgctgt

SEQ ID NO: 9063633 - DNA, 22 bp, Homo sapiens
gcttctcttcgcctaggtcctt

SEQ ID NO: 9063634 - DNA, 22 bp, Homo sapiens
gcttggcattggtttctctaag

SEQ ID NO: 9063635 - DNA, 22 bp, Homo sapiens
gcttggccagcagccgggatgc

SEQ ID NO: 9063636 - DNA, 22 bp, Homo sapiens
gcttggctggaaataggttgag

SEQ ID NO: 9063637 - DNA, 22 bp, Homo sapiens
gcttggctggaaataggttgag

SEQ ID NO: 9063638 - DNA, 22 bp, Homo sapiens
gcttggctgcctttggatgttg

SEQ ID NO: 9063639 - DNA, 22 bp, Homo sapiens
gcttggctctaagacacctatt

SEQ ID NO: 9063640 - DNA, 22 bp, Homo sapiens
gcttggctcctggctcacaggt

SEQ ID NO: 9063641 - DNA, 18 bp, Homo sapiens
gcttctcatttctaagca

SEQ ID NO: 9063642 - DNA, 18 bp, Homo sapiens
gcttctcatttctaagca

SEQ ID NO: 9063643 - DNA, 20 bp, Homo sapiens
gcttctcagggcttctctga

SEQ ID NO: 9063644 - DNA, 20 bp, Homo sapiens
gcttctcagggcttctctga

SEQ ID NO: 9063645 - DNA, 22 bp, Homo sapiens
gcttccaggtcattctcaccct

SEQ ID NO: 9063646 - DNA, 22 bp, Homo sapiens
gcttccaggtcattctcaccct

SEQ ID NO: 9063647 - DNA, 18 bp, Homo sapiens
gcttctcatttctaagca

SEQ ID NO: 9063648 - DNA, 22 bp, Homo sapiens
gcttctctggctggtctgccac

SEQ ID NO: 9063649 - DNA, 22 bp, Homo sapiens
gcttctctggctggtctgccac

SEQ ID NO: 9063650 - DNA, 22 bp, Homo sapiens
gcttctctcaggagcatcagcc

SEQ ID NO: 9063651 - DNA, 18 bp, Homo sapiens
cacaatttacagatgaca

SEQ ID NO: 9063652 - DNA, 22 bp, Homo sapiens
cacaatttccaagtcatgttat

SEQ ID NO: 9063653 - DNA, 22 bp, Homo sapiens
cacaattagcagctctttattt

SEQ ID NO: 9063654 - DNA, 19 bp, Homo sapiens
cacaattatgagacactta

SEQ ID NO: 9063655 - DNA, 22 bp, Homo sapiens
cacaattccatggcattctttg

SEQ ID NO: 9063656 - DNA, 22 bp, Homo sapiens
cacaatttgttttatcagtatt

SEQ ID NO: 9063657 - DNA, 22 bp, Homo sapiens
cacacagtgggaaaacctgaag

SEQ ID NO: 9063658 - DNA, 22 bp, Homo sapiens
cacacattaatatcaaaggctc

SEQ ID NO: 9063659 - DNA, 22 bp, Homo sapiens
cacaatttggtgctaaagaaag

SEQ ID NO: 9063660 - DNA, 22 bp, Homo sapiens
cacaatttggacttcactggtt

SEQ ID NO: 9063661 - DNA, 22 bp, Homo sapiens
cacaatttccttgcttcacttt

SEQ ID NO: 9063662 - DNA, 22 bp, Homo sapiens
cacacatttcagatgctacaat

SEQ ID NO: 9063663 - DNA, 22 bp, Homo sapiens
cacacattggttttactccttt

SEQ ID NO: 9063664 - DNA, 22 bp, Homo sapiens
cacacattgagcagctgtttgt

SEQ ID NO: 9063665 - DNA, 22 bp, Homo sapiens
cacacattgaattcattcttgt

SEQ ID NO: 9063666 - DNA, 23 bp, Homo sapiens
cacaccaggagccgtctgggcca

SEQ ID NO: 9063667 - DNA, 23 bp, Homo sapiens
cacacctgttaagaagagtgcct

SEQ ID NO: 9063668 - DNA, 22 bp, Homo sapiens
cacacctgtaataccagctact

SEQ ID NO: 9063669 - DNA, 22 bp, Homo sapiens
ggaaaagaattgcagtgaagta

SEQ ID NO: 9063670 - DNA, 17 bp, Homo sapiens
ggaaaagaagagtagga

SEQ ID NO: 9063671 - DNA, 22 bp, Homo sapiens
ggaaaagaattgcagtgaagta

SEQ ID NO: 9063672 - DNA, 22 bp, Homo sapiens
ggaaaagacagaattctagaat

SEQ ID NO: 9063673 - DNA, 17 bp, Homo sapiens
ggaaaagaagagtagga

SEQ ID NO: 9063674 - DNA, 17 bp, Homo sapiens
ggaaaagaagagtagga

SEQ ID NO: 9063675 - DNA, 22 bp, Homo sapiens
ggaaaagaaagggactgattgg

SEQ ID NO: 9063676 - DNA, 22 bp, Homo sapiens
ggaaaactgtatttgaataact

SEQ ID NO: 9063677 - DNA, 21 bp, Homo sapiens
ggaaaactttccttgtctgaa

SEQ ID NO: 9063678 - DNA, 21 bp, Homo sapiens
ggaaaactttccttgtctgaa

SEQ ID NO: 9063679 - DNA, 22 bp, Homo sapiens
cacaaagtgggtggaaaactaa

SEQ ID NO: 9063680 - DNA, 22 bp, Homo sapiens
cacaaaatctttctcgattatt

SEQ ID NO: 9063681 - DNA, 22 bp, Homo sapiens
cacaaaatatcaagcactttta

SEQ ID NO: 9063682 - DNA, 22 bp, Homo sapiens
cacaaacatcaatcctgttttc

SEQ ID NO: 9063683 - DNA, 22 bp, Homo sapiens
cacaaaccttctgcagcctgta

SEQ ID NO: 9063684 - DNA, 22 bp, Homo sapiens
cacaaacctgccagccctgccc

SEQ ID NO: 9063685 - DNA, 22 bp, Homo sapiens
cacaaaggagaatgtcagcata

SEQ ID NO: 9063686 - DNA, 22 bp, Homo sapiens
cacaactttaggaaccacattc

SEQ ID NO: 9063687 - DNA, 19 bp, Homo sapiens
cacaacttcgcttgattcc

SEQ ID NO: 9063688 - DNA, 22 bp, Homo sapiens
ggaaaatgggaacctgaagcca

SEQ ID NO: 9063689 - DNA, 22 bp, Homo sapiens
ggaaaatactgattcatgccat

SEQ ID NO: 9063690 - DNA, 22 bp, Homo sapiens
ggaaaagacagaattctagaat

SEQ ID NO: 9063691 - DNA, 22 bp, Homo sapiens
cacaatgtctggtaggccactt

SEQ ID NO: 9063692 - DNA, 22 bp, Homo sapiens
cacaatgtatatgtatatcaaa

SEQ ID NO: 9063693 - DNA, 22 bp, Homo sapiens
cacaatgtatatgtatatcaaa

SEQ ID NO: 9063694 - DNA, 22 bp, Homo sapiens
cacaatgtaagagtttgttcat

SEQ ID NO: 9063695 - DNA, 22 bp, Homo sapiens
cacaatgcgtacatatatcaaa

SEQ ID NO: 9063696 - DNA, 22 bp, Homo sapiens
cacaatgtgttgggttaagttt

SEQ ID NO: 9063697 - DNA, 22 bp, Homo sapiens
cacaatgtgttgggttaagttt

SEQ ID NO: 9063698 - DNA, 21 bp, Homo sapiens
cacaatgttggccaggttggt

SEQ ID NO: 9063699 - DNA, 22 bp, Homo sapiens
cacaatgtggtttgtcatcttt

SEQ ID NO: 9063700 - DNA, 22 bp, Homo sapiens
cacaatgtggtttgtcatcttt

SEQ ID NO: 9063701 - DNA, 22 bp, Homo sapiens
cacaatgatttggttcaaaaat

SEQ ID NO: 9063702 - DNA, 18 bp, Homo sapiens
cacaatagacaccgataa

SEQ ID NO: 9063703 - DNA, 22 bp, Homo sapiens
caagacaagatctaagcatgct

SEQ ID NO: 9063704 - DNA, 22 bp, Homo sapiens
caagacaagatctaagcatgct

SEQ ID NO: 9063705 - DNA, 22 bp, Homo sapiens
caagagctgcaaatagcgtgac

SEQ ID NO: 9063706 - DNA, 22 bp, Homo sapiens
caagagctgcaaatagcgtgac

SEQ ID NO: 9063707 - DNA, 22 bp, Homo sapiens
caagagctgaggctggagaggt

SEQ ID NO: 9063708 - DNA, 22 bp, Homo sapiens
caagagctgaggctggagaggt

SEQ ID NO: 9063709 - DNA, 22 bp, Homo sapiens
caagagctcaccggagagcatt

SEQ ID NO: 9063710 - DNA, 22 bp, Homo sapiens
caagagctcaccggagagcatt

SEQ ID NO: 9063711 - DNA, 22 bp, Homo sapiens
gctgctggatgcgcttgatggt

SEQ ID NO: 9063712 - DNA, 22 bp, Homo sapiens
gctgctggagctttgcagaagg

SEQ ID NO: 9063713 - DNA, 22 bp, Homo sapiens
gctgctggcactggagtgagcc

SEQ ID NO: 9063714 - DNA, 22 bp, Homo sapiens
gctgctggcactggagtgagcc

SEQ ID NO: 9063715 - DNA, 22 bp, Homo sapiens
gctgccttttgctcctcccacc

SEQ ID NO: 9063716 - DNA, 22 bp, Homo sapiens
gctgctggagagcgagactgtt

SEQ ID NO: 9063717 - DNA, 22 bp, Homo sapiens
gctgccttcccaggcctttgct

SEQ ID NO: 9063718 - DNA, 22 bp, Homo sapiens
gctgccttcccaggcctttgct

SEQ ID NO: 9063719 - DNA, 20 bp, Homo sapiens
gctgccttgtcctgcttggt

SEQ ID NO: 9063720 - DNA, 22 bp, Homo sapiens
caacctctatcggtcaggaagc

SEQ ID NO: 9063721 - DNA, 22 bp, Homo sapiens
caaccccactacacgttggaga

SEQ ID NO: 9063722 - DNA, 22 bp, Homo sapiens
caaccccactacacgttggaga

SEQ ID NO: 9063723 - DNA, 22 bp, Homo sapiens
gctgcctgccttgcctggagga

SEQ ID NO: 9063724 - DNA, 22 bp, Homo sapiens
caaggagataaaatgttgagct

SEQ ID NO: 9063725 - DNA, 22 bp, Homo sapiens
caaggagataaaatgttgagct

SEQ ID NO: 9063726 - DNA, 22 bp, Homo sapiens
caaggagagtaattgaatgaga

SEQ ID NO: 9063727 - DNA, 22 bp, Homo sapiens
caaggagaaaacggcttctgaa

SEQ ID NO: 9063728 - DNA, 22 bp, Homo sapiens
caaggacactgatgttcatcct

SEQ ID NO: 9063729 - DNA, 22 bp, Homo sapiens
caaggaatatttaagaacgtca

SEQ ID NO: 9063730 - DNA, 22 bp, Homo sapiens
caaggaatcccatttctaactc

SEQ ID NO: 9063731 - DNA, 22 bp, Homo sapiens
caagatggagaagcagcaaggg

SEQ ID NO: 9063732 - DNA, 22 bp, Homo sapiens
caagatgcccctggtagggatc

SEQ ID NO: 9063733 - DNA, 22 bp, Homo sapiens
caagctgccaccagaagagcat

SEQ ID NO: 9063734 - DNA, 22 bp, Homo sapiens
caagatgtgcctaatcagacct

SEQ ID NO: 9063735 - DNA, 22 bp, Homo sapiens
caagatgtggtgggctgagttt

SEQ ID NO: 9063736 - DNA, 22 bp, Homo sapiens
caagatgtggtgggctgagttt

SEQ ID NO: 9063737 - DNA, 22 bp, Homo sapiens
caagatgtggtgggctgagttt

SEQ ID NO: 9063738 - DNA, 22 bp, Homo sapiens
caagatgacaaggctggaggct

SEQ ID NO: 9063739 - DNA, 22 bp, Homo sapiens
caagatgacaaggctggaggct

SEQ ID NO: 9063740 - DNA, 22 bp, Homo sapiens
caagatgatccctgaaggcagc

SEQ ID NO: 9063741 - DNA, 22 bp, Homo sapiens
caagatcttcctcaatagacct

SEQ ID NO: 9063742 - DNA, 22 bp, Homo sapiens
caagatgaaactacagggagga

SEQ ID NO: 9063743 - DNA, 22 bp, Homo sapiens
caagatatgtcctgttactaag

SEQ ID NO: 9063744 - DNA, 22 bp, Homo sapiens
caagatatcaatgacatagtat

SEQ ID NO: 9063745 - DNA, 22 bp, Homo sapiens
caagatcaaggtgtcagcaggt

SEQ ID NO: 9063746 - DNA, 22 bp, Homo sapiens
caagatcaaggtatcagcagat

SEQ ID NO: 9063747 - DNA, 22 bp, Homo sapiens
caagagttgagggatgtcagtt

SEQ ID NO: 9063748 - DNA, 22 bp, Homo sapiens
caagaggctaaactgggctatt

SEQ ID NO: 9063749 - DNA, 22 bp, Homo sapiens
caagaggcaaattgtctagaag

SEQ ID NO: 9063750 - DNA, 22 bp, Homo sapiens
caagagctggagaggcagtcta

SEQ ID NO: 9063751 - DNA, 22 bp, Homo sapiens
caagagcttctgctcttcatgg

SEQ ID NO: 9063752 - DNA, 22 bp, Homo sapiens
caagagctttagaaatgctcat

SEQ ID NO: 9063753 - DNA, 22 bp, Homo sapiens
caagaggagcaggcaggtgtgc

SEQ ID NO: 9063754 - DNA, 22 bp, Homo sapiens
caagaggagcaggcaggtgtgc

SEQ ID NO: 9063755 - DNA, 22 bp, Homo sapiens
caagaggagcaggcaggtgtgc

SEQ ID NO: 9063756 - DNA, 22 bp, Homo sapiens
caacatttgtgatgagcaaact

SEQ ID NO: 9063757 - DNA, 22 bp, Homo sapiens
caacatttcaaggtctttagga

SEQ ID NO: 9063758 - DNA, 22 bp, Homo sapiens
caacatttgagtaaagaaatgg

SEQ ID NO: 9063759 - DNA, 22 bp, Homo sapiens
caacatctttgtgtatgtgaga

SEQ ID NO: 9063760 - DNA, 22 bp, Homo sapiens
caacatgtgttagacaatagac

SEQ ID NO: 9063761 - DNA, 22 bp, Homo sapiens
caacattcaaccaacatttatg

SEQ ID NO: 9063762 - DNA, 22 bp, Homo sapiens
caacattcttatcactataagc

SEQ ID NO: 9063763 - DNA, 22 bp, Homo sapiens
caacattcttatcactataagc

SEQ ID NO: 9063764 - DNA, 22 bp, Homo sapiens
caacattcaaccaacatttatg

SEQ ID NO: 9063765 - DNA, 22 bp, Homo sapiens
caacattatatagccacatgcc

SEQ ID NO: 9063766 - DNA, 22 bp, Homo sapiens
caacatatttttatgtaggtca

SEQ ID NO: 9063767 - DNA, 22 bp, Homo sapiens
caacatatgattttgtatataa

SEQ ID NO: 9063768 - DNA, 22 bp, Homo sapiens
caacagttcctccatcctctct

SEQ ID NO: 9063769 - DNA, 22 bp, Homo sapiens
caacagtgttgcaatctgaaaa

SEQ ID NO: 9063770 - DNA, 22 bp, Homo sapiens
caacagtttatagtgttatctt

SEQ ID NO: 9063771 - DNA, 17 bp, Homo sapiens
gctgcagcggtaggcag

SEQ ID NO: 9063772 - DNA, 22 bp, Homo sapiens
gctgcagtgagccaagatcgtg

SEQ ID NO: 9063773 - DNA, 22 bp, Homo sapiens
gctgcagtgagccaagatcgtg

SEQ ID NO: 9063774 - DNA, 22 bp, Homo sapiens
caacagtctctatagctccttg

SEQ ID NO: 9063775 - DNA, 22 bp, Homo sapiens
caacagtcagaatgaagctgag

SEQ ID NO: 9063776 - DNA, 22 bp, Homo sapiens
gctgccaccgtggagatgagtg

SEQ ID NO: 9063777 - DNA, 22 bp, Homo sapiens
caacactgattatggctgagct

SEQ ID NO: 9063778 - DNA, 22 bp, Homo sapiens
gctgccaatccagctgtgggag

SEQ ID NO: 9063779 - DNA, 22 bp, Homo sapiens
gctgcattgctataaaatacaa

SEQ ID NO: 9063780 - DNA, 22 bp, Homo sapiens
gctgccacattttcaggactaa

SEQ ID NO: 9063781 - DNA, 21 bp, Homo sapiens
gctgccaccgcgtgctccagg

SEQ ID NO: 9063782 - DNA, 22 bp, Homo sapiens
caaagtatatttcatagtctca

SEQ ID NO: 9063783 - DNA, 22 bp, Homo sapiens
caaagtatcaactcccacactg

SEQ ID NO: 9063784 - DNA, 22 bp, Homo sapiens
caaagtatgaaccagtttctct

SEQ ID NO: 9063785 - DNA, 22 bp, Homo sapiens
gctcctcttctcccactgaatg

SEQ ID NO: 9063786 - DNA, 22 bp, Homo sapiens
gctcctgaaggctctgcagggt

SEQ ID NO: 9063787 - DNA, 22 bp, Homo sapiens
gctcctgaaggctctgcagggt

SEQ ID NO: 9063788 - DNA, 22 bp, Homo sapiens
caaagtaatttggagatatata

SEQ ID NO: 9063789 - DNA, 22 bp, Homo sapiens
caaagtacagtgcttcctggga

SEQ ID NO: 9063790 - DNA, 19 bp, Homo sapiens
caaagtacctggcacagtg

SEQ ID NO: 9063791 - DNA, 19 bp, Homo sapiens
caaagtacctggcacagtg

SEQ ID NO: 9063792 - DNA, 22 bp, Homo sapiens
caaagtatagtgtaggatggca

SEQ ID NO: 9063793 - DNA, 22 bp, Homo sapiens
caaagtatattggattgaatgg

SEQ ID NO: 9063794 - DNA, 22 bp, Homo sapiens
caaagtaatatggtcccagtga

SEQ ID NO: 9063795 - DNA, 19 bp, Homo sapiens
gctgcagaggtgaagaaga

SEQ ID NO: 9063796 - DNA, 22 bp, Homo sapiens
gctgcagagggtcttagagagg

SEQ ID NO: 9063797 - DNA, 22 bp, Homo sapiens
gctgcagcagaagttctcagag

SEQ ID NO: 9063798 - DNA, 22 bp, Homo sapiens
gctgcagccaaattcattgtca

SEQ ID NO: 9063799 - DNA, 22 bp, Homo sapiens
gggcacaccttgtctgagcaca

SEQ ID NO: 9063800 - DNA, 22 bp, Homo sapiens
gggcacagaagtctaagacatc

SEQ ID NO: 9063801 - DNA, 20 bp, Homo sapiens
gggcaaggaaacagccccca

SEQ ID NO: 9063802 - DNA, 22 bp, Homo sapiens
gggcaaggcagaagagttggag

SEQ ID NO: 9063803 - DNA, 22 bp, Homo sapiens
gggcaaggcagaagagttggag

SEQ ID NO: 9063804 - DNA, 18 bp, Homo sapiens
gggcaagcggctgtcacc

SEQ ID NO: 9063805 - DNA, 18 bp, Homo sapiens
gggcaagcggctgtcacc

SEQ ID NO: 9063806 - DNA, 22 bp, Homo sapiens
gggcaagctcttcagaagctct

SEQ ID NO: 9063807 - DNA, 22 bp, Homo sapiens
gggcaagctcttcagaagctct

SEQ ID NO: 9063808 - DNA, 22 bp, Homo sapiens
gggcaagctttgaacatcagca

SEQ ID NO: 9063809 - DNA, 17 bp, Homo sapiens
cagacaggctgtcaccc

SEQ ID NO: 9063810 - DNA, 17 bp, Homo sapiens
cagacaggctgtcaccc

SEQ ID NO: 9063811 - DNA, 17 bp, Homo sapiens
cagacaggctgtcaccc

SEQ ID NO: 9063812 - DNA, 22 bp, Homo sapiens
cagacagggacctcgctccaga

SEQ ID NO: 9063813 - DNA, 22 bp, Homo sapiens
cagacagggccctgtgatggta

SEQ ID NO: 9063814 - DNA, 22 bp, Homo sapiens
cagacagggacctcgctccaga

SEQ ID NO: 9063815 - DNA, 22 bp, Homo sapiens
cagacagggacctcgctccaga

SEQ ID NO: 9063816 - DNA, 22 bp, Homo sapiens
cagacagggacctcgctccaga

SEQ ID NO: 9063817 - DNA, 22 bp, Homo sapiens
gggatgagagtagggtgtgaaa

SEQ ID NO: 9063818 - DNA, 20 bp, Homo sapiens
gggatgagagtcctagctct

SEQ ID NO: 9063819 - DNA, 22 bp, Homo sapiens
gggaggggttgcatgtttgagt

SEQ ID NO: 9063820 - DNA, 22 bp, Homo sapiens
gggagggcttggacccagatgt

SEQ ID NO: 9063821 - DNA, 22 bp, Homo sapiens
gggagggccagtgctctctaga

SEQ ID NO: 9063822 - DNA, 20 bp, Homo sapiens
gggaggccagcctcagagaa

SEQ ID NO: 9063823 - DNA, 20 bp, Homo sapiens
gggaggccccagagtccagg

SEQ ID NO: 9063824 - DNA, 22 bp, Homo sapiens
gggagggtctgagagctgcacc

SEQ ID NO: 9063825 - DNA, 22 bp, Homo sapiens
gggagggtctgagagctgcacc

SEQ ID NO: 9063826 - DNA, 22 bp, Homo sapiens
cagacaggctagccagactcac

SEQ ID NO: 9063827 - DNA, 22 bp, Homo sapiens
gggagcaggacataatagcaat

SEQ ID NO: 9063828 - DNA, 22 bp, Homo sapiens
gggagcaggagcctgcctgcca

SEQ ID NO: 9063829 - DNA, 22 bp, Homo sapiens
gggagcaggagcctgcctgcca

SEQ ID NO: 9063830 - DNA, 19 bp, Homo sapiens
gggagcaggaaagctgtgg

SEQ ID NO: 9063831 - DNA, 19 bp, Homo sapiens
gggagcaggaaagctgtgg

SEQ ID NO: 9063832 - DNA, 19 bp, Homo sapiens
gggagcaggaaagctgtgg

SEQ ID NO: 9063833 - DNA, 22 bp, Homo sapiens
gggagcagcctgcctcccacct

SEQ ID NO: 9063834 - DNA, 22 bp, Homo sapiens
cagacaggctagccagactcac

SEQ ID NO: 9063835 - DNA, 22 bp, Homo sapiens
cagacaggcaggtgctgctttg

SEQ ID NO: 9063836 - DNA, 22 bp, Homo sapiens
cagacaggcaggtgagagctcc

SEQ ID NO: 9063837 - DNA, 22 bp, Homo sapiens
cagacaggcaggtgagagctcc

SEQ ID NO: 9063838 - DNA, 22 bp, Homo sapiens
cagacaggcaggtgagagctcc

SEQ ID NO: 9063839 - DNA, 22 bp, Homo sapiens
cagacaggcaggtgagagctcc

SEQ ID NO: 9063840 - DNA, 22 bp, Homo sapiens
cagacaggagactggatcatgg

SEQ ID NO: 9063841 - DNA, 22 bp, Homo sapiens
gggacttaatgcagagagggac

SEQ ID NO: 9063842 - DNA, 22 bp, Homo sapiens
gggacttaatgcagagagggac

SEQ ID NO: 9063843 - DNA, 22 bp, Homo sapiens
cagaagtgatgttgagctagtc

SEQ ID NO: 9063844 - DNA, 22 bp, Homo sapiens
cagaagtgatgttgagctagtc

SEQ ID NO: 9063845 - DNA, 22 bp, Homo sapiens
cagaagtggcctcagagggagt

SEQ ID NO: 9063846 - DNA, 22 bp, Homo sapiens
cagaagttagacttcaactaat

SEQ ID NO: 9063847 - DNA, 22 bp, Homo sapiens
cagaagttggagctttccatca

SEQ ID NO: 9063848 - DNA, 22 bp, Homo sapiens
cagacaggaattctggcgtggt

SEQ ID NO: 9063849 - DNA, 22 bp, Homo sapiens
cagacaggaagttcagaagaaa

SEQ ID NO: 9063850 - DNA, 22 bp, Homo sapiens
cagacaggaagttcagaagaaa

SEQ ID NO: 9063851 - DNA, 22 bp, Homo sapiens
cagacagaaggctccttgaggt

SEQ ID NO: 9063852 - DNA, 22 bp, Homo sapiens
cagacagaaggctccttgaggt

SEQ ID NO: 9063853 - DNA, 22 bp, Homo sapiens
gggaaggaaagttattagcaga

SEQ ID NO: 9063854 - DNA, 23 bp, Homo sapiens
gggaagctccatggaggtgctgg

SEQ ID NO: 9063855 - DNA, 22 bp, Homo sapiens
gggaagctgaagctagagaaaa

SEQ ID NO: 9063856 - DNA, 22 bp, Homo sapiens
gggaaggacacagccatgactg

SEQ ID NO: 9063857 - DNA, 22 bp, Homo sapiens
gggaaggaaagttattagcaga

SEQ ID NO: 9063858 - DNA, 22 bp, Homo sapiens
gggaaggacacagccatgactg

SEQ ID NO: 9063859 - DNA, 22 bp, Homo sapiens
gggaaggaggtggacctgcccc

SEQ ID NO: 9063860 - DNA, 22 bp, Homo sapiens
gggacaatggaggcctctctcc

SEQ ID NO: 9063861 - DNA, 22 bp, Homo sapiens
gggacaatggaggcctctctcc

SEQ ID NO: 9063862 - DNA, 22 bp, Homo sapiens
gggacacagagaaactggagaa

SEQ ID NO: 9063863 - DNA, 22 bp, Homo sapiens
gggacaatggaggcctctctcc

SEQ ID NO: 9063864 - DNA, 22 bp, Homo sapiens
gggaaggaggtggcttgaagtg

SEQ ID NO: 9063865 - DNA, 22 bp, Homo sapiens
gggaatgtggcaggcagcagtt

SEQ ID NO: 9063866 - DNA, 22 bp, Homo sapiens
gggaatgttgactgagagcagg

SEQ ID NO: 9063867 - DNA, 22 bp, Homo sapiens
gggaatgtgtctgatggaaaga

SEQ ID NO: 9063868 - DNA, 22 bp, Homo sapiens
gggacagacccatgggccaggt

SEQ ID NO: 9063869 - DNA, 22 bp, Homo sapiens
gggacacaggtatctcaaatga

SEQ ID NO: 9063870 - DNA, 22 bp, Homo sapiens
gggactggcacagggctgggag

SEQ ID NO: 9063871 - DNA, 22 bp, Homo sapiens
gggaaaaataatgcacagatat

SEQ ID NO: 9063872 - DNA, 22 bp, Homo sapiens
gggaaaaataatgcacagatat

SEQ ID NO: 9063873 - DNA, 22 bp, Homo sapiens
gggaaaaataatgcacagatat

SEQ ID NO: 9063874 - DNA, 22 bp, Homo sapiens
cagaagtctttctgtttcacct

SEQ ID NO: 9063875 - DNA, 22 bp, Homo sapiens
cagaagtcaccctcagaataac

SEQ ID NO: 9063876 - DNA, 22 bp, Homo sapiens
cagaagtaagattactgtgaga

SEQ ID NO: 9063877 - DNA, 22 bp, Homo sapiens
cagaagtaagattactgtgagt

SEQ ID NO: 9063878 - DNA, 22 bp, Homo sapiens
cagaagggcagcactgggaagg

SEQ ID NO: 9063879 - DNA, 22 bp, Homo sapiens
cagaaggctggcagattgagat

SEQ ID NO: 9063880 - DNA, 22 bp, Homo sapiens
gggaaagagtgcttgtccagag

SEQ ID NO: 9063881 - DNA, 22 bp, Homo sapiens
gggaaagagaggtggacgcagg

SEQ ID NO: 9063882 - DNA, 22 bp, Homo sapiens
gggaaagaccctgagtcttatt

SEQ ID NO: 9063883 - DNA, 22 bp, Homo sapiens
gggaaagaccctgagtcttatt

SEQ ID NO: 9063884 - DNA, 22 bp, Homo sapiens
gggaaagaccttcctggggtgt

SEQ ID NO: 9063885 - DNA, 22 bp, Homo sapiens
gggaaagaagatctagatactg

SEQ ID NO: 9063886 - DNA, 22 bp, Homo sapiens
gggaaagaagaagagccatttt

SEQ ID NO: 9063887 - DNA, 22 bp, Homo sapiens
cagaaggcagcaaatgaaaacc

SEQ ID NO: 9063888 - DNA, 22 bp, Homo sapiens
cagaaggcaaggcctgccacgc

SEQ ID NO: 9063889 - DNA, 22 bp, Homo sapiens
cagaaggcaaggcctgccacgc

SEQ ID NO: 9063890 - DNA, 22 bp, Homo sapiens
cagaaggcagcaaatgaaaacc

SEQ ID NO: 9063891 - DNA, 22 bp, Homo sapiens
cagaaggcaaacaaaaggattt

SEQ ID NO: 9063892 - DNA, 22 bp, Homo sapiens
cagaagcagtgagagatgtgca

SEQ ID NO: 9063893 - DNA, 22 bp, Homo sapiens
cagaaggcctgaatctttgttc

SEQ ID NO: 9063894 - DNA, 22 bp, Homo sapiens
cagaaggctgcaggtttgctgt

SEQ ID NO: 9063895 - DNA, 22 bp, Homo sapiens
cagaaggcatagatgaaggcct

SEQ ID NO: 9063896 - DNA, 22 bp, Homo sapiens
cagaagggcagcactgggaagg

SEQ ID NO: 9063897 - DNA, 22 bp, Homo sapiens
cagaaggctttgtggagtagac

SEQ ID NO: 9063898 - DNA, 22 bp, Homo sapiens
cactggcctaagcgcctcagcc

SEQ ID NO: 9063899 - DNA, 22 bp, Homo sapiens
cactggcttgatgggtaatgcc

SEQ ID NO: 9063900 - DNA, 22 bp, Homo sapiens
cactggctatgagggagatggg

SEQ ID NO: 9063901 - DNA, 22 bp, Homo sapiens
cactggctgagcttctctaggg

SEQ ID NO: 9063902 - DNA, 22 bp, Homo sapiens
cagaggccagggggctcacaaa

SEQ ID NO: 9063903 - DNA, 22 bp, Homo sapiens
cagaggccagtggacaagggcc

SEQ ID NO: 9063904 - DNA, 22 bp, Homo sapiens
cagaggccaggctgcctgactg

SEQ ID NO: 9063905 - DNA, 22 bp, Homo sapiens
cagaggccaggctgcctgactg

SEQ ID NO: 9063906 - DNA, 19 bp, Homo sapiens
cagaggccagaagcacagg

SEQ ID NO: 9063907 - DNA, 19 bp, Homo sapiens
cagaggccagaagcacagg

SEQ ID NO: 9063908 - DNA, 22 bp, Homo sapiens
cagaggccacctgtggccactg

SEQ ID NO: 9063909 - DNA, 21 bp, Homo sapiens
cagaggcctatcacagactcc

SEQ ID NO: 9063910 - DNA, 21 bp, Homo sapiens
cagaggcctatcacagactcc

SEQ ID NO: 9063911 - DNA, 22 bp, Homo sapiens
cagaggccccagaactagctct

SEQ ID NO: 9063912 - DNA, 22 bp, Homo sapiens
cagaggccccagaactagctct

SEQ ID NO: 9063913 - DNA, 22 bp, Homo sapiens
cagaggcccagtgagagggctg

SEQ ID NO: 9063914 - DNA, 22 bp, Homo sapiens
cagaggcctatccagtgtccat

SEQ ID NO: 9063915 - DNA, 22 bp, Homo sapiens
cagaggcctcacttccagccag

SEQ ID NO: 9063916 - DNA, 22 bp, Homo sapiens
cagagctggtgtgtcctggcat

SEQ ID NO: 9063917 - DNA, 22 bp, Homo sapiens
cagagctggtgtgtcctggcat

SEQ ID NO: 9063918 - DNA, 22 bp, Homo sapiens
cagagctggtaagtggtagagg

SEQ ID NO: 9063919 - DNA, 20 bp, Homo sapiens
ggggaagaaaaggatgtgat

SEQ ID NO: 9063920 - DNA, 20 bp, Homo sapiens
ggggaagaaaaggatgtgat

SEQ ID NO: 9063921 - DNA, 20 bp, Homo sapiens
ggggaagaaaaggatgtgat

SEQ ID NO: 9063922 - DNA, 22 bp, Homo sapiens
cagagctggtgttacaagtcca

SEQ ID NO: 9063923 - DNA, 22 bp, Homo sapiens
cagagctgtcatttgccagtga

SEQ ID NO: 9063924 - DNA, 22 bp, Homo sapiens
cagagctggtgttacaagtcca

SEQ ID NO: 9063925 - DNA, 20 bp, Homo sapiens
cagaggcattttcagactct

SEQ ID NO: 9063926 - DNA, 20 bp, Homo sapiens
cagaggcattttcagactct

SEQ ID NO: 9063927 - DNA, 22 bp, Homo sapiens
cagaggcaggataagaactgcg

SEQ ID NO: 9063928 - DNA, 22 bp, Homo sapiens
cagagctgtcatttgccagtga

SEQ ID NO: 9063929 - DNA, 22 bp, Homo sapiens
gggtgccacagagcttccactt

SEQ ID NO: 9063930 - DNA, 22 bp, Homo sapiens
gggtgctgaggaagacagcagg

SEQ ID NO: 9063931 - DNA, 22 bp, Homo sapiens
gggtgctgactggggcctgaaa

SEQ ID NO: 9063932 - DNA, 23 bp, Homo sapiens
gggtgctgcctgtagtcatgctg

SEQ ID NO: 9063933 - DNA, 22 bp, Homo sapiens
cagaggctgctctgggtggcat

SEQ ID NO: 9063934 - DNA, 22 bp, Homo sapiens
gggtcgcttggagaggcttcct

SEQ ID NO: 9063935 - DNA, 20 bp, Homo sapiens
gggtcgctctgagcccatcc

SEQ ID NO: 9063936 - DNA, 22 bp, Homo sapiens
gggtcgctgccgctgctggacc

SEQ ID NO: 9063937 - DNA, 22 bp, Homo sapiens
cagaggcctggcttggacacct

SEQ ID NO: 9063938 - DNA, 22 bp, Homo sapiens
cagaggtgtacagagggaggcc

SEQ ID NO: 9063939 - DNA, 22 bp, Homo sapiens
cagaggtgtacagagggaggcc

SEQ ID NO: 9063940 - DNA, 21 bp, Homo sapiens
cagaggtggcctgacctctga

SEQ ID NO: 9063941 - DNA, 22 bp, Homo sapiens
cagaggtagggagctatgttat

SEQ ID NO: 9063942 - DNA, 22 bp, Homo sapiens
cagagtaaacctgtcatcaaga

SEQ ID NO: 9063943 - DNA, 22 bp, Homo sapiens
cagaggtttgatcgagtaggtc

SEQ ID NO: 9063944 - DNA, 22 bp, Homo sapiens
cagaggttgagcaaaaatgata

SEQ ID NO: 9063945 - DNA, 22 bp, Homo sapiens
cagagtaaacctgtcatcaaga

SEQ ID NO: 9063946 - DNA, 23 bp, Homo sapiens
cagaggtgtcagtgcccagtgtc

SEQ ID NO: 9063947 - DNA, 22 bp, Homo sapiens
cagaggttacctagagcaagaa

SEQ ID NO: 9063948 - DNA, 22 bp, Homo sapiens
cagaggctgggacctcaggcat

SEQ ID NO: 9063949 - DNA, 22 bp, Homo sapiens
cagaggctgggacctcaggcat

SEQ ID NO: 9063950 - DNA, 22 bp, Homo sapiens
cagaggctgggacctcaggcat

SEQ ID NO: 9063951 - DNA, 22 bp, Homo sapiens
cagaggtagccgagtgcaatcg

SEQ ID NO: 9063952 - DNA, 22 bp, Homo sapiens
cagaggctgtgtaggcagactg

SEQ ID NO: 9063953 - DNA, 22 bp, Homo sapiens
gggcgagggcgaaagcgagagc

SEQ ID NO: 9063954 - DNA, 22 bp, Homo sapiens
gggcgagggcgaaagcgagagc

SEQ ID NO: 9063955 - DNA, 21 bp, Homo sapiens
gggcgaggcctgatgtggctc

SEQ ID NO: 9063956 - DNA, 22 bp, Homo sapiens
gggccttggcgaagtgtggtgg

SEQ ID NO: 9063957 - DNA, 22 bp, Homo sapiens
gggccttgatcccctatatggc

SEQ ID NO: 9063958 - DNA, 21 bp, Homo sapiens
gggccttgagtgtgcggtggg

SEQ ID NO: 9063959 - DNA, 22 bp, Homo sapiens
gggccttgccatggagcctgag

SEQ ID NO: 9063960 - DNA, 23 bp, Homo sapiens
gggccttggatttgtggagttca

SEQ ID NO: 9063961 - DNA, 22 bp, Homo sapiens
cagagccctagtcctgatggcc

SEQ ID NO: 9063962 - DNA, 22 bp, Homo sapiens
cagagccctagtcctgatggcc

SEQ ID NO: 9063963 - DNA, 22 bp, Homo sapiens
cagagccctgcatgctccatct

SEQ ID NO: 9063964 - DNA, 22 bp, Homo sapiens
cagagccctgggcacatggtag

SEQ ID NO: 9063965 - DNA, 22 bp, Homo sapiens
cagagccccccttctgatcaca

SEQ ID NO: 9063966 - DNA, 22 bp, Homo sapiens
cagagcccctgggttgggagct

SEQ ID NO: 9063967 - DNA, 22 bp, Homo sapiens
cagagcccatggcacatgtgga

SEQ ID NO: 9063968 - DNA, 22 bp, Homo sapiens
cagagcccatcctatactctcc

SEQ ID NO: 9063969 - DNA, 22 bp, Homo sapiens
cagagccagctgtccttggcat

SEQ ID NO: 9063970 - DNA, 22 bp, Homo sapiens
gggcagagaaatggacagttgg

SEQ ID NO: 9063971 - DNA, 22 bp, Homo sapiens
cagagccagcccactgttcccg

SEQ ID NO: 9063972 - DNA, 19 bp, Homo sapiens
gggcagaatggcatctcag

SEQ ID NO: 9063973 - DNA, 22 bp, Homo sapiens
gggcagactggttatacacggg

SEQ ID NO: 9063974 - DNA, 22 bp, Homo sapiens
gggcacagagaaggttttagtg

SEQ ID NO: 9063975 - DNA, 22 bp, Homo sapiens
gggcacagaagtctaagacatc

SEQ ID NO: 9063976 - DNA, 22 bp, Homo sapiens
gggcactgtgctaggtgctgag

SEQ ID NO: 9063977 - DNA, 22 bp, Homo sapiens
gggcacagagggtcttgaagaa

SEQ ID NO: 9063978 - DNA, 22 bp, Homo sapiens
gggcacagagggtcttgaagaa

SEQ ID NO: 9063979 - DNA, 22 bp, Homo sapiens
gggcacagagggtcttgaagaa

SEQ ID NO: 9063980 - DNA, 22 bp, Homo sapiens
gggcactgtggggcccatgctg

SEQ ID NO: 9063981 - DNA, 22 bp, Homo sapiens
gggcactgtggggcccatgctg

SEQ ID NO: 9063982 - DNA, 19 bp, Homo sapiens
cagagctgctggcctcgtc

SEQ ID NO: 9063983 - DNA, 19 bp, Homo sapiens
cagagctgctggcctcgtc

SEQ ID NO: 9063984 - DNA, 22 bp, Homo sapiens
cagagctgctcatggtggccag

SEQ ID NO: 9063985 - DNA, 22 bp, Homo sapiens
cagagctgcagattgaaggcat

SEQ ID NO: 9063986 - DNA, 22 bp, Homo sapiens
ggggaaaggccatggcaagaac

SEQ ID NO: 9063987 - DNA, 22 bp, Homo sapiens
ggggaaagtgaattgtgtagtg

SEQ ID NO: 9063988 - DNA, 22 bp, Homo sapiens
ggggaacaccgggcagaggcgc

SEQ ID NO: 9063989 - DNA, 22 bp, Homo sapiens
ggggaaagccagccctgcttcc

SEQ ID NO: 9063990 - DNA, 23 bp, Homo sapiens
ggggaaagaccatgcttgaggac

SEQ ID NO: 9063991 - DNA, 22 bp, Homo sapiens
cagagctgcacattctatgatg

SEQ ID NO: 9063992 - DNA, 22 bp, Homo sapiens
cagagctgcagattgaaggcat

SEQ ID NO: 9063993 - DNA, 22 bp, Homo sapiens
cagagctgcaaatgcccctccg

SEQ ID NO: 9063994 - DNA, 22 bp, Homo sapiens
cagagctgagtcttcaaggttg

SEQ ID NO: 9063995 - DNA, 22 bp, Homo sapiens
cagagctgattggatccagaga

SEQ ID NO: 9063996 - DNA, 22 bp, Homo sapiens
cagagctgacccaaggattgaa

SEQ ID NO: 9063997 - DNA, 22 bp, Homo sapiens
cagagctgacccaaggattgaa

SEQ ID NO: 9063998 - DNA, 22 bp, Homo sapiens
cagagctgagaatgttgatgct

SEQ ID NO: 9063999 - DNA, 21 bp, Homo sapiens
cagagctgaagggtgtagtgt

SEQ ID NO: 9064000 - DNA, 22 bp, Homo sapiens
gggcgcagccaatcctggccct

SEQ ID NO: 9064001 - DNA, 22 bp, Homo sapiens
gtatcttttggtggaaaaataa

SEQ ID NO: 9064002 - DNA, 22 bp, Homo sapiens
cagcagcctccactcgccccac

SEQ ID NO: 9064003 - DNA, 22 bp, Homo sapiens
gtatgcatcgactcaagtctga

SEQ ID NO: 9064004 - DNA, 22 bp, Homo sapiens
cagcagctaaggcatgttcctg

SEQ ID NO: 9064005 - DNA, 22 bp, Homo sapiens
cagcagcctggcccctcctcgg

SEQ ID NO: 9064006 - DNA, 22 bp, Homo sapiens
cagcagcctggcccctcctcgg

SEQ ID NO: 9064007 - DNA, 22 bp, Homo sapiens
cagcagcctgccttgggagctt

SEQ ID NO: 9064008 - DNA, 22 bp, Homo sapiens
cagcagcctggagggggccacg

SEQ ID NO: 9064009 - DNA, 22 bp, Homo sapiens
cagcagcctggagggggccacg

SEQ ID NO: 9064010 - DNA, 22 bp, Homo sapiens
cagcaggacatggaggagtaaa

SEQ ID NO: 9064011 - DNA, 22 bp, Homo sapiens
cagcagctacttggagcagcag

SEQ ID NO: 9064012 - DNA, 22 bp, Homo sapiens
cagcagctacctgctcttgtgg

SEQ ID NO: 9064013 - DNA, 22 bp, Homo sapiens
gtatttctagaaaatgcagatt

SEQ ID NO: 9064014 - DNA, 22 bp, Homo sapiens
cagcaggcggcccgcgggcccg

SEQ ID NO: 9064015 - DNA, 22 bp, Homo sapiens
cagcaggcccaggtgctggtga

SEQ ID NO: 9064016 - DNA, 22 bp, Homo sapiens
cagcaggcccaggtgctggtga

SEQ ID NO: 9064017 - DNA, 22 bp, Homo sapiens
cagcaggcccaggtgctggtga

SEQ ID NO: 9064018 - DNA, 22 bp, Homo sapiens
cagcaggcccagagtttcatgg

SEQ ID NO: 9064019 - DNA, 22 bp, Homo sapiens
cagcaggccatgctgcttttca

SEQ ID NO: 9064020 - DNA, 22 bp, Homo sapiens
cagcaggcaggtgggccaagtc

SEQ ID NO: 9064021 - DNA, 22 bp, Homo sapiens
cagcaggattggatacatctca

SEQ ID NO: 9064022 - DNA, 22 bp, Homo sapiens
cagcaggatatggtggagagag

SEQ ID NO: 9064023 - DNA, 22 bp, Homo sapiens
cagcaggcagccatttcactgt

SEQ ID NO: 9064024 - DNA, 22 bp, Homo sapiens
cagcagcaaatctagaagagga

SEQ ID NO: 9064025 - DNA, 22 bp, Homo sapiens
cagcagcaaatctagaagagga

SEQ ID NO: 9064026 - DNA, 22 bp, Homo sapiens
cagcagcaaatctagaagagga

SEQ ID NO: 9064027 - DNA, 22 bp, Homo sapiens
cagcagcaaatctagaagagga

SEQ ID NO: 9064028 - DNA, 22 bp, Homo sapiens
cagcagcaacaacggaagcctt

SEQ ID NO: 9064029 - DNA, 22 bp, Homo sapiens
cagcagcaacaacggaagcctt

SEQ ID NO: 9064030 - DNA, 22 bp, Homo sapiens
cagcagcaacaacggaagcctt

SEQ ID NO: 9064031 - DNA, 22 bp, Homo sapiens
cagcagcaacaacggaagcctt

SEQ ID NO: 9064032 - DNA, 22 bp, Homo sapiens
cagcagcaaggtgagggtggag

SEQ ID NO: 9064033 - DNA, 22 bp, Homo sapiens
cagcagcaaggtgagggtggag

SEQ ID NO: 9064034 - DNA, 22 bp, Homo sapiens
cagcagcaacaatagcggtcac

SEQ ID NO: 9064035 - DNA, 22 bp, Homo sapiens
cagcagcaacaatagcggtcac

SEQ ID NO: 9064036 - DNA, 22 bp, Homo sapiens
cagcagagtaattctcacctct

SEQ ID NO: 9064037 - DNA, 22 bp, Homo sapiens
cagcagagtatggcactcaact

SEQ ID NO: 9064038 - DNA, 19 bp, Homo sapiens
gtatatttatatggctgta

SEQ ID NO: 9064039 - DNA, 22 bp, Homo sapiens
gtatatgtatgcgtatacacac

SEQ ID NO: 9064040 - DNA, 22 bp, Homo sapiens
gtatattttgatcaccctctat

SEQ ID NO: 9064041 - DNA, 22 bp, Homo sapiens
gtatctatgatcctttatatct

SEQ ID NO: 9064042 - DNA, 22 bp, Homo sapiens
gtatctgtagctagagggagag

SEQ ID NO: 9064043 - DNA, 22 bp, Homo sapiens
gtatcacttttgagagtgagaa

SEQ ID NO: 9064044 - DNA, 22 bp, Homo sapiens
gtatccatgggggattggttcc

SEQ ID NO: 9064045 - DNA, 22 bp, Homo sapiens
gtatcctcagcaatcaacaaca

SEQ ID NO: 9064046 - DNA, 22 bp, Homo sapiens
gtatcctcacctatacaatgga

SEQ ID NO: 9064047 - DNA, 22 bp, Homo sapiens
gtatcctcactaattaggaggg

SEQ ID NO: 9064048 - DNA, 22 bp, Homo sapiens
cagcagcaaggtgagggtggag

SEQ ID NO: 9064049 - DNA, 22 bp, Homo sapiens
cagcagcaaggtgagggtggag

SEQ ID NO: 9064050 - DNA, 22 bp, Homo sapiens
cagcagcaaggtgagggtggag

SEQ ID NO: 9064051 - DNA, 22 bp, Homo sapiens
cagcagcacctattatagtgtt

SEQ ID NO: 9064052 - DNA, 22 bp, Homo sapiens
cagcagcactctgcgggtcccc

SEQ ID NO: 9064053 - DNA, 22 bp, Homo sapiens
cagcagcactctgcgggtcccc

SEQ ID NO: 9064054 - DNA, 22 bp, Homo sapiens
cagcagcactctgcgggtcccc

SEQ ID NO: 9064055 - DNA, 22 bp, Homo sapiens
cagcagcagagatactggtttc

SEQ ID NO: 9064056 - DNA, 22 bp, Homo sapiens
cagcagcagagatactggtttc

SEQ ID NO: 9064057 - DNA, 22 bp, Homo sapiens
cagcagcagattcagcgtctgg

SEQ ID NO: 9064058 - DNA, 22 bp, Homo sapiens
cagcagcagacatttgatcttc

SEQ ID NO: 9064059 - DNA, 22 bp, Homo sapiens
cagcagcagagatactggtttc

SEQ ID NO: 9064060 - DNA, 22 bp, Homo sapiens
gggtgggagaaatgagtatcta

SEQ ID NO: 9064061 - DNA, 19 bp, Homo sapiens
cagagtacaccagatagga

SEQ ID NO: 9064062 - DNA, 22 bp, Homo sapiens
cagagtactgggagaacagaag

SEQ ID NO: 9064063 - DNA, 22 bp, Homo sapiens
cagagtcagagctccatggagt

SEQ ID NO: 9064064 - DNA, 22 bp, Homo sapiens
cagagtcaatgtccaagaagct

SEQ ID NO: 9064065 - DNA, 22 bp, Homo sapiens
cagagtcagagcacctgggatt

SEQ ID NO: 9064066 - DNA, 22 bp, Homo sapiens
ggtgggggagacttggtcaaga

SEQ ID NO: 9064067 - DNA, 22 bp, Homo sapiens
ggtggggtcacgacagagggaa

SEQ ID NO: 9064068 - DNA, 22 bp, Homo sapiens
cagcaaggcattctgtggatta

SEQ ID NO: 9064069 - DNA, 22 bp, Homo sapiens
cagcaaggccattggatgcagt

SEQ ID NO: 9064070 - DNA, 22 bp, Homo sapiens
cagcaaggccattggatgcagt

SEQ ID NO: 9064071 - DNA, 22 bp, Homo sapiens
cagcaaggccattggatgcagt

SEQ ID NO: 9064072 - DNA, 22 bp, Homo sapiens
cagcaagggataaacaaggacg

SEQ ID NO: 9064073 - DNA, 22 bp, Homo sapiens
cagcaagggataaacaaggacg

SEQ ID NO: 9064074 - DNA, 22 bp, Homo sapiens
cagcaagggataaagagttact

SEQ ID NO: 9064075 - DNA, 22 bp, Homo sapiens
cagcaagggataaagagttact

SEQ ID NO: 9064076 - DNA, 22 bp, Homo sapiens
cagcaagggttatatcaaagat

SEQ ID NO: 9064077 - DNA, 22 bp, Homo sapiens
cagcaaggtctgtcaatagtgg

SEQ ID NO: 9064078 - DNA, 22 bp, Homo sapiens
ggttccagagtatttcatttca

SEQ ID NO: 9064079 - DNA, 19 bp, Homo sapiens
ggttcctcacgctaagggc

SEQ ID NO: 9064080 - DNA, 22 bp, Homo sapiens
ggttcctgatagattccttttg

SEQ ID NO: 9064081 - DNA, 23 bp, Homo sapiens
ggttcctgagcagggatctggaa

SEQ ID NO: 9064082 - DNA, 22 bp, Homo sapiens
ggttcctgtgcctctagctggc

SEQ ID NO: 9064083 - DNA, 22 bp, Homo sapiens
ggttcctgtgtactgtggctta

SEQ ID NO: 9064084 - DNA, 22 bp, Homo sapiens
ggttcctgtgcccatgtcatgg

SEQ ID NO: 9064085 - DNA, 22 bp, Homo sapiens
ggttcctgtacttagctatgta

SEQ ID NO: 9064086 - DNA, 22 bp, Homo sapiens
ggttcctggcagatgtagggct

SEQ ID NO: 9064087 - DNA, 22 bp, Homo sapiens
ggttcctgatcgttgtctctct

SEQ ID NO: 9064088 - DNA, 23 bp, Homo sapiens
ggttcctgagcagggatctggaa

SEQ ID NO: 9064089 - DNA, 22 bp, Homo sapiens
ggttctctaactttgactggag

SEQ ID NO: 9064090 - DNA, 22 bp, Homo sapiens
ggttctcttcctcctgactgag

SEQ ID NO: 9064091 - DNA, 22 bp, Homo sapiens
ggttctgacaagctgggatggt

SEQ ID NO: 9064092 - DNA, 22 bp, Homo sapiens
cagcaataatgtctacaaatct

SEQ ID NO: 9064093 - DNA, 22 bp, Homo sapiens
cagcaaggtctgtcaatagtgg

SEQ ID NO: 9064094 - DNA, 22 bp, Homo sapiens
cagcaagtcatccaggatgatg

SEQ ID NO: 9064095 - DNA, 22 bp, Homo sapiens
cagcaatccaagctttctttaa

SEQ ID NO: 9064096 - DNA, 22 bp, Homo sapiens
cagcaatggcaggcggagagtg

SEQ ID NO: 9064097 - DNA, 22 bp, Homo sapiens
ggtgtgcctggggcttagctgc

SEQ ID NO: 9064098 - DNA, 22 bp, Homo sapiens
gtaaaattctagcatctgaaag

SEQ ID NO: 9064099 - DNA, 22 bp, Homo sapiens
gtaaaattgcaattacttttgc

SEQ ID NO: 9064100 - DNA, 22 bp, Homo sapiens
gtaaacaaactctcaggccagt

SEQ ID NO: 9064101 - DNA, 22 bp, Homo sapiens
gtaaacaacacaaatcatttga

SEQ ID NO: 9064102 - DNA, 22 bp, Homo sapiens
gtaaacaatagcattgcctgat

SEQ ID NO: 9064103 - DNA, 22 bp, Homo sapiens
gtaaacaagtctaccattagaa

SEQ ID NO: 9064104 - DNA, 20 bp, Homo sapiens
gtaaaatatggtctttgggt

SEQ ID NO: 9064105 - DNA, 22 bp, Homo sapiens
cagcccagcagggtctggccct

SEQ ID NO: 9064106 - DNA, 22 bp, Homo sapiens
cagcccagcagtcttagcctgc

SEQ ID NO: 9064107 - DNA, 22 bp, Homo sapiens
cagcccagcagggtctggccct

SEQ ID NO: 9064108 - DNA, 22 bp, Homo sapiens
cagcccagagccagttcccgct

SEQ ID NO: 9064109 - DNA, 21 bp, Homo sapiens
cagcccagcccattgacagtg

SEQ ID NO: 9064110 - DNA, 22 bp, Homo sapiens
cagccaagaaagcagtgctcca

SEQ ID NO: 9064111 - DNA, 22 bp, Homo sapiens
cagcattttcttaatgtaggtg

SEQ ID NO: 9064112 - DNA, 22 bp, Homo sapiens
cagccaccatacagcagaagct

SEQ ID NO: 9064113 - DNA, 22 bp, Homo sapiens
cagccactctcagacagtccca

SEQ ID NO: 9064114 - DNA, 21 bp, Homo sapiens
cagcccagagcagtggggcca

SEQ ID NO: 9064115 - DNA, 21 bp, Homo sapiens
cagcccagagcagtggggcca

SEQ ID NO: 9064116 - DNA, 22 bp, Homo sapiens
cagccacttcgagcttcctgat

SEQ ID NO: 9064117 - DNA, 22 bp, Homo sapiens
cagccaggttcaagtccttata

SEQ ID NO: 9064118 - DNA, 22 bp, Homo sapiens
cagccactggtgccaggctgtt

SEQ ID NO: 9064119 - DNA, 22 bp, Homo sapiens
cagccactggtgccaggctgtt

SEQ ID NO: 9064120 - DNA, 22 bp, Homo sapiens
cagccactgtggtctagctgca

SEQ ID NO: 9064121 - DNA, 22 bp, Homo sapiens
gtattttactgctcaaagctct

SEQ ID NO: 9064122 - DNA, 22 bp, Homo sapiens
gtattttactgctcaaagctct

SEQ ID NO: 9064123 - DNA, 22 bp, Homo sapiens
gtattttactgctcaaagctct

SEQ ID NO: 9064124 - DNA, 22 bp, Homo sapiens
gtatttgtagtagcatagaatt

SEQ ID NO: 9064125 - DNA, 22 bp, Homo sapiens
gtatttgtcttgttggtctcca

SEQ ID NO: 9064126 - DNA, 22 bp, Homo sapiens
cagcatttaatgcagtgcttcc

SEQ ID NO: 9064127 - DNA, 22 bp, Homo sapiens
cagcattgtaagaatgaagacc

SEQ ID NO: 9064128 - DNA, 22 bp, Homo sapiens
cagcattgatcccaggctgtgg

SEQ ID NO: 9064129 - DNA, 22 bp, Homo sapiens
cagcatttggaggagaggcttt

SEQ ID NO: 9064130 - DNA, 22 bp, Homo sapiens
cagcatttggtgatcatcttaa

SEQ ID NO: 9064131 - DNA, 22 bp, Homo sapiens
cagcatttcaggaggctgaggt

SEQ ID NO: 9064132 - DNA, 22 bp, Homo sapiens
cagcatttcaggaggctgaggt

SEQ ID NO: 9064133 - DNA, 22 bp, Homo sapiens
cagcatttatcttgtagcagga

SEQ ID NO: 9064134 - DNA, 22 bp, Homo sapiens
agggaatgctccgtataaatct

SEQ ID NO: 9064135 - DNA, 22 bp, Homo sapiens
agggagaggttgaaacctcagt

SEQ ID NO: 9064136 - DNA, 22 bp, Homo sapiens
agggagaggttgaaacctcagt

SEQ ID NO: 9064137 - DNA, 22 bp, Homo sapiens
agggaagggcagggtctatgca

SEQ ID NO: 9064138 - DNA, 22 bp, Homo sapiens
agggaagggcagggtctatgca

SEQ ID NO: 9064139 - DNA, 23 bp, Homo sapiens
agggaagggggcttattccacag

SEQ ID NO: 9064140 - DNA, 22 bp, Homo sapiens
agggaagtgatggagttcgatc

SEQ ID NO: 9064141 - DNA, 22 bp, Homo sapiens
agggaagtgaatgacagatatc

SEQ ID NO: 9064142 - DNA, 22 bp, Homo sapiens
agggaagtggtctgggaacttg

SEQ ID NO: 9064143 - DNA, 22 bp, Homo sapiens
agggaaggtagaggtcaccggc

SEQ ID NO: 9064144 - DNA, 22 bp, Homo sapiens
agggaaggaggccatgtgtccc

SEQ ID NO: 9064145 - DNA, 22 bp, Homo sapiens
agggaaggaggccatgtgtccc

SEQ ID NO: 9064146 - DNA, 22 bp, Homo sapiens
agggaaggaggttagaacccac

SEQ ID NO: 9064147 - DNA, 22 bp, Homo sapiens
agggaaggaggttagaacccac

SEQ ID NO: 9064148 - DNA, 19 bp, Homo sapiens
agggaaggattctgtcatt

SEQ ID NO: 9064149 - DNA, 19 bp, Homo sapiens
agggaaggattctgtcatt

SEQ ID NO: 9064150 - DNA, 22 bp, Homo sapiens
agggaaggcttttgacatttcc

SEQ ID NO: 9064151 - DNA, 22 bp, Homo sapiens
agggaaggaaaagctgtcgctt

SEQ ID NO: 9064152 - DNA, 22 bp, Homo sapiens
agggaagcttgttactgagaag

SEQ ID NO: 9064153 - DNA, 22 bp, Homo sapiens
agggaagcttgttactgagaag

SEQ ID NO: 9064154 - DNA, 22 bp, Homo sapiens
aggcttatagcttatatttaag

SEQ ID NO: 9064155 - DNA, 22 bp, Homo sapiens
agggagctttttcatgtgtcta

SEQ ID NO: 9064156 - DNA, 22 bp, Homo sapiens
agggaggaaggaactccttcta

SEQ ID NO: 9064157 - DNA, 22 bp, Homo sapiens
ccccatgaagtagggtctctga

SEQ ID NO: 9064158 - DNA, 22 bp, Homo sapiens
ccccatgaagtagggtctctga

SEQ ID NO: 9064159 - DNA, 22 bp, Homo sapiens
ccccatgaagtagggtctctga

SEQ ID NO: 9064160 - DNA, 22 bp, Homo sapiens
ccccatgctgggatctgacacc

SEQ ID NO: 9064161 - DNA, 22 bp, Homo sapiens
ccccagggactggtttcatgga

SEQ ID NO: 9064162 - DNA, 22 bp, Homo sapiens
ccccagcacttggagtggggag

SEQ ID NO: 9064163 - DNA, 22 bp, Homo sapiens
ccccagcacttggagtggggag

SEQ ID NO: 9064164 - DNA, 19 bp, Homo sapiens
ccccagggtaggctagggg

SEQ ID NO: 9064165 - DNA, 19 bp, Homo sapiens
ccccagggtaggctagggg

SEQ ID NO: 9064166 - DNA, 22 bp, Homo sapiens
ccccagggtcagtgtgtggagg

SEQ ID NO: 9064167 - DNA, 22 bp, Homo sapiens
ccccaggtggatggctcgcata

SEQ ID NO: 9064168 - DNA, 22 bp, Homo sapiens
agggagccagagttgggagctc

SEQ ID NO: 9064169 - DNA, 22 bp, Homo sapiens
agggagccaggaacgcaggtcg

SEQ ID NO: 9064170 - DNA, 22 bp, Homo sapiens
agggagccaggaacgcaggtcg

SEQ ID NO: 9064171 - DNA, 22 bp, Homo sapiens
agggagccaggggccagctatt

SEQ ID NO: 9064172 - DNA, 22 bp, Homo sapiens
agggagccaggggccagctatt

SEQ ID NO: 9064173 - DNA, 21 bp, Homo sapiens
agggagcatgttagctttcga

SEQ ID NO: 9064174 - DNA, 22 bp, Homo sapiens
agggagcatgggtgaagcaggc

SEQ ID NO: 9064175 - DNA, 22 bp, Homo sapiens
agggagcatgggtgaagcaggc

SEQ ID NO: 9064176 - DNA, 22 bp, Homo sapiens
agggagcatgggtgaagcaggc

SEQ ID NO: 9064177 - DNA, 22 bp, Homo sapiens
agggagagtttgatgtttcctc

SEQ ID NO: 9064178 - DNA, 22 bp, Homo sapiens
agggagagtttgatgtttcctc

SEQ ID NO: 9064179 - DNA, 18 bp, Homo sapiens
agggagcatctggttgcc

SEQ ID NO: 9064180 - DNA, 22 bp, Homo sapiens
agggagcagggctcctttgggt

SEQ ID NO: 9064181 - DNA, 22 bp, Homo sapiens
agggagcagcagccacaggatg

SEQ ID NO: 9064182 - DNA, 22 bp, Homo sapiens
cccagctctaggagtggtggca

SEQ ID NO: 9064183 - DNA, 22 bp, Homo sapiens
cccagctctcgcacttactagc

SEQ ID NO: 9064184 - DNA, 22 bp, Homo sapiens
cccagctctctgctcttagcct

SEQ ID NO: 9064185 - DNA, 22 bp, Homo sapiens
cccagctctctcagttctgctt

SEQ ID NO: 9064186 - DNA, 22 bp, Homo sapiens
cccagctctgccatctacccac

SEQ ID NO: 9064187 - DNA, 22 bp, Homo sapiens
cccagctctggaaggtggggga

SEQ ID NO: 9064188 - DNA, 22 bp, Homo sapiens
cccagctctgcagacctgccct

SEQ ID NO: 9064189 - DNA, 22 bp, Homo sapiens
aggctgtgtggtcatggtggct

SEQ ID NO: 9064190 - DNA, 22 bp, Homo sapiens
aggctgtgtttaagtggtaatg

SEQ ID NO: 9064191 - DNA, 22 bp, Homo sapiens
aggctgtgtttcccctggagct

SEQ ID NO: 9064192 - DNA, 22 bp, Homo sapiens
aggctgttttgtataaactgga

SEQ ID NO: 9064193 - DNA, 22 bp, Homo sapiens
cccagctccttggatgggcagg

SEQ ID NO: 9064194 - DNA, 22 bp, Homo sapiens
cccagctccttggatgggcagg

SEQ ID NO: 9064195 - DNA, 22 bp, Homo sapiens
cccagctccttggatgggcagg

SEQ ID NO: 9064196 - DNA, 22 bp, Homo sapiens
cccagctccttacagggccgaa

SEQ ID NO: 9064197 - DNA, 22 bp, Homo sapiens
cccagctccttgtttgcatctc

SEQ ID NO: 9064198 - DNA, 22 bp, Homo sapiens
cccagctcgccgccgatgtgcg

SEQ ID NO: 9064199 - DNA, 22 bp, Homo sapiens
cccagctctaggagtggtggca

SEQ ID NO: 9064200 - DNA, 22 bp, Homo sapiens
cccagcctgatctcggccagct

SEQ ID NO: 9064201 - DNA, 22 bp, Homo sapiens
cccagcctgatctcggccagct

SEQ ID NO: 9064202 - DNA, 22 bp, Homo sapiens
cccagcctgatctcggccagct

SEQ ID NO: 9064203 - DNA, 22 bp, Homo sapiens
cccagcctgatctcggccagct

SEQ ID NO: 9064204 - DNA, 22 bp, Homo sapiens
cccagcctgatctcggccagct

SEQ ID NO: 9064205 - DNA, 22 bp, Homo sapiens
cccagcctgatctcggccagct

SEQ ID NO: 9064206 - DNA, 22 bp, Homo sapiens
cccagcctctgtttgctcctct

SEQ ID NO: 9064207 - DNA, 22 bp, Homo sapiens
cccagcctctgtttgctcctct

SEQ ID NO: 9064208 - DNA, 22 bp, Homo sapiens
cccagcctctgtttgctcctct

SEQ ID NO: 9064209 - DNA, 22 bp, Homo sapiens
cccagcctctgtttgctcctct

SEQ ID NO: 9064210 - DNA, 22 bp, Homo sapiens
cccagcctctgtttgctcctct

SEQ ID NO: 9064211 - DNA, 22 bp, Homo sapiens
cccagcctctgtttgctcctct

SEQ ID NO: 9064212 - DNA, 22 bp, Homo sapiens
cccagcctctgtttgctcctct

SEQ ID NO: 9064213 - DNA, 22 bp, Homo sapiens
cccagcctctgggttctgccgg

SEQ ID NO: 9064214 - DNA, 22 bp, Homo sapiens
cccagcctctgggttctgccgg

SEQ ID NO: 9064215 - DNA, 22 bp, Homo sapiens
cccagcctctgggttctgccgg

SEQ ID NO: 9064216 - DNA, 22 bp, Homo sapiens
cccagcctctgggctcacccaa

SEQ ID NO: 9064217 - DNA, 22 bp, Homo sapiens
cccagcctctgggctcacccaa

SEQ ID NO: 9064218 - DNA, 22 bp, Homo sapiens
cccagcctctgggctcacccaa

SEQ ID NO: 9064219 - DNA, 22 bp, Homo sapiens
cccagcctctgggctcacccaa

SEQ ID NO: 9064220 - DNA, 22 bp, Homo sapiens
cccagcctctggattctgccct

SEQ ID NO: 9064221 - DNA, 22 bp, Homo sapiens
cccagcctctggattctgccct

SEQ ID NO: 9064222 - DNA, 22 bp, Homo sapiens
cccagcctctggattctgccct

SEQ ID NO: 9064223 - DNA, 18 bp, Homo sapiens
cccagcctctcctttcta

SEQ ID NO: 9064224 - DNA, 18 bp, Homo sapiens
cccagcctctcctttcta

SEQ ID NO: 9064225 - DNA, 18 bp, Homo sapiens
cccagcctctcctttcta

SEQ ID NO: 9064226 - DNA, 22 bp, Homo sapiens
cccagcagttgttggtgcacat

SEQ ID NO: 9064227 - DNA, 22 bp, Homo sapiens
cccagcagttgttggtgcacat

SEQ ID NO: 9064228 - DNA, 22 bp, Homo sapiens
cccagcagtttgcttagagtga

SEQ ID NO: 9064229 - DNA, 22 bp, Homo sapiens
cccagcagttgttggtgcacat

SEQ ID NO: 9064230 - DNA, 22 bp, Homo sapiens
cccagcctcagctttacttcca

SEQ ID NO: 9064231 - DNA, 22 bp, Homo sapiens
cccagcctcagctttacttcca

SEQ ID NO: 9064232 - DNA, 22 bp, Homo sapiens
cccagcctcagctttacttcca

SEQ ID NO: 9064233 - DNA, 22 bp, Homo sapiens
cccagcctcagctttacttcca

SEQ ID NO: 9064234 - DNA, 22 bp, Homo sapiens
cccagcatcctcagggagcggg

SEQ ID NO: 9064235 - DNA, 22 bp, Homo sapiens
cccagcctactctgccatagca

SEQ ID NO: 9064236 - DNA, 22 bp, Homo sapiens
cccagcctcagctttacttcca

SEQ ID NO: 9064237 - DNA, 22 bp, Homo sapiens
cccagcatcccagtgggcagca

SEQ ID NO: 9064238 - DNA, 22 bp, Homo sapiens
cccagcatcctcagggagcggg

SEQ ID NO: 9064239 - DNA, 22 bp, Homo sapiens
cccagcatcccagtgggcagca

SEQ ID NO: 9064240 - DNA, 22 bp, Homo sapiens
cccagcatcccagtgggcagca

SEQ ID NO: 9064241 - DNA, 22 bp, Homo sapiens
cccagcagtgacccagtgatac

SEQ ID NO: 9064242 - DNA, 22 bp, Homo sapiens
cccagcagtgacccagtgatac

SEQ ID NO: 9064243 - DNA, 22 bp, Homo sapiens
cccagcagtagagctcatatgg

SEQ ID NO: 9064244 - DNA, 22 bp, Homo sapiens
cccagcacaggcaattccatac

SEQ ID NO: 9064245 - DNA, 22 bp, Homo sapiens
cccagcactcagcaggctcata

SEQ ID NO: 9064246 - DNA, 22 bp, Homo sapiens
cccagcagtacccaagcccttg

SEQ ID NO: 9064247 - DNA, 22 bp, Homo sapiens
cccagcagtacccaagcccttg

SEQ ID NO: 9064248 - DNA, 22 bp, Homo sapiens
ccatctccaaataccatcacat

SEQ ID NO: 9064249 - DNA, 22 bp, Homo sapiens
ccatcctgtctgtggcctcagg

SEQ ID NO: 9064250 - DNA, 22 bp, Homo sapiens
ccataatctggctttgagagag

SEQ ID NO: 9064251 - DNA, 22 bp, Homo sapiens
ccataatcgtgtgttaaataat

SEQ ID NO: 9064252 - DNA, 22 bp, Homo sapiens
ccatctgactgccacccaggcc

SEQ ID NO: 9064253 - DNA, 22 bp, Homo sapiens
ccatctgtctcctgatctagct

SEQ ID NO: 9064254 - DNA, 22 bp, Homo sapiens
ccatcttgggtcactgcccccc

SEQ ID NO: 9064255 - DNA, 22 bp, Homo sapiens
ccatgaattcactccatgctag

SEQ ID NO: 9064256 - DNA, 22 bp, Homo sapiens
ccatgaattcactccatgctag

SEQ ID NO: 9064257 - DNA, 22 bp, Homo sapiens
ccatgacccctggcatccaggg

SEQ ID NO: 9064258 - DNA, 22 bp, Homo sapiens
ccatgattcctctaagacctct

SEQ ID NO: 9064259 - DNA, 22 bp, Homo sapiens
ccatgattggaatgtcttttca

SEQ ID NO: 9064260 - DNA, 22 bp, Homo sapiens
ccatgatttcccctgctgcaca

SEQ ID NO: 9064261 - DNA, 22 bp, Homo sapiens
ccatgatttgagctacttactg

SEQ ID NO: 9064262 - DNA, 22 bp, Homo sapiens
ccatgatggctgctggtaaaat

SEQ ID NO: 9064263 - DNA, 22 bp, Homo sapiens
agggcagatggaacttccccga

SEQ ID NO: 9064264 - DNA, 22 bp, Homo sapiens
agggcagccattgagggattct

SEQ ID NO: 9064265 - DNA, 22 bp, Homo sapiens
agggaggagaatggactccttc

SEQ ID NO: 9064266 - DNA, 22 bp, Homo sapiens
agggcagagggtgcctcacctg

SEQ ID NO: 9064267 - DNA, 22 bp, Homo sapiens
agggcagcctctcagcctaggt

SEQ ID NO: 9064268 - DNA, 22 bp, Homo sapiens
agggcagcctgagtgctggccc

SEQ ID NO: 9064269 - DNA, 22 bp, Homo sapiens
agggcagctaaggtgctgactg

SEQ ID NO: 9064270 - DNA, 22 bp, Homo sapiens
agggcagcctgagtgctggccc

SEQ ID NO: 9064271 - DNA, 22 bp, Homo sapiens
agggcagctctcacctctggcc

SEQ ID NO: 9064272 - DNA, 22 bp, Homo sapiens
agggcagctctcacctctggcc

SEQ ID NO: 9064273 - DNA, 22 bp, Homo sapiens
agggcagctggaaggtggcttc

SEQ ID NO: 9064274 - DNA, 22 bp, Homo sapiens
agggccagccccaccctctctg

SEQ ID NO: 9064275 - DNA, 22 bp, Homo sapiens
agggccagccccaccctctctg

SEQ ID NO: 9064276 - DNA, 21 bp, Homo sapiens
agggccagatcaccaaggagc

SEQ ID NO: 9064277 - DNA, 22 bp, Homo sapiens
agggccagggaaacgatcagca

SEQ ID NO: 9064278 - DNA, 22 bp, Homo sapiens
agggccagggaagctgtatttt

SEQ ID NO: 9064279 - DNA, 22 bp, Homo sapiens
ccctggcccctcactccgaggc

SEQ ID NO: 9064280 - DNA, 22 bp, Homo sapiens
ccctgggcaagccctattttcc

SEQ ID NO: 9064281 - DNA, 22 bp, Homo sapiens
ccctgggcaagccctattttcc

SEQ ID NO: 9064282 - DNA, 22 bp, Homo sapiens
ccctgggcaccaggcctggtaa

SEQ ID NO: 9064283 - DNA, 22 bp, Homo sapiens
ccctgggcagtctgcacttcag

SEQ ID NO: 9064284 - DNA, 22 bp, Homo sapiens
ccctgggcagtctgcacttcag

SEQ ID NO: 9064285 - DNA, 22 bp, Homo sapiens
ccctgggctcagagcaggtagc

SEQ ID NO: 9064286 - DNA, 22 bp, Homo sapiens
agggccagctagagccctcgcc

SEQ ID NO: 9064287 - DNA, 22 bp, Homo sapiens
agggccagccgacttccagcct

SEQ ID NO: 9064288 - DNA, 22 bp, Homo sapiens
agggccagctgcagaattagca

SEQ ID NO: 9064289 - DNA, 22 bp, Homo sapiens
agggccaggaacacctgaaggg

SEQ ID NO: 9064290 - DNA, 18 bp, Homo sapiens
agggccagctgtgagtag

SEQ ID NO: 9064291 - DNA, 22 bp, Homo sapiens
agggccaggatcacagccaaga

SEQ ID NO: 9064292 - DNA, 22 bp, Homo sapiens
ccctgggttctggctgggctgc

SEQ ID NO: 9064293 - DNA, 21 bp, Homo sapiens
ccctgtgttccacagcagaca

SEQ ID NO: 9064294 - DNA, 22 bp, Homo sapiens
ccctgttttaagttgatattga

SEQ ID NO: 9064295 - DNA, 21 bp, Homo sapiens
cctcaaagatgatggggtttc

SEQ ID NO: 9064296 - DNA, 22 bp, Homo sapiens
cctcaaagcggtatgcagacgg

SEQ ID NO: 9064297 - DNA, 22 bp, Homo sapiens
cctcaaatagcccccagtctag

SEQ ID NO: 9064298 - DNA, 22 bp, Homo sapiens
cctcaaataagttttatttatc

SEQ ID NO: 9064299 - DNA, 20 bp, Homo sapiens
cctcaaataagtgccagcat

SEQ ID NO: 9064300 - DNA, 22 bp, Homo sapiens
cctcaaagtagagggagatgag

SEQ ID NO: 9064301 - DNA, 22 bp, Homo sapiens
cctcaaaggcctggcaccagaa

SEQ ID NO: 9064302 - DNA, 22 bp, Homo sapiens
cctcaaaggcctggcaccagaa

SEQ ID NO: 9064303 - DNA, 22 bp, Homo sapiens
cccttcaagctctctgggtttt

SEQ ID NO: 9064304 - DNA, 22 bp, Homo sapiens
cccttcagctgagtgggacagc

SEQ ID NO: 9064305 - DNA, 22 bp, Homo sapiens
cccttcagggttaagtagaggg

SEQ ID NO: 9064306 - DNA, 20 bp, Homo sapiens
cctcaagcagactgacagct

SEQ ID NO: 9064307 - DNA, 18 bp, Homo sapiens
cctcacagacttccatgt

SEQ ID NO: 9064308 - DNA, 22 bp, Homo sapiens
cctcaaattggcattaattaag

SEQ ID NO: 9064309 - DNA, 22 bp, Homo sapiens
cctcaaattgtcaaataagaat

SEQ ID NO: 9064310 - DNA, 22 bp, Homo sapiens
cctcaagaacaatccaccatta

SEQ ID NO: 9064311 - DNA, 22 bp, Homo sapiens
cctcaagaacaatccaccatta

SEQ ID NO: 9064312 - DNA, 22 bp, Homo sapiens
cctcaaattgtcaaataagaat

SEQ ID NO: 9064313 - DNA, 23 bp, Homo sapiens
cctcaaatgtagcctttttccca

SEQ ID NO: 9064314 - DNA, 22 bp, Homo sapiens
cctcaaatctttagagttattt

SEQ ID NO: 9064315 - DNA, 22 bp, Homo sapiens
cctcaaattgctcagcgtctag

SEQ ID NO: 9064316 - DNA, 22 bp, Homo sapiens
cctcagaatagtcctcagatca

SEQ ID NO: 9064317 - DNA, 22 bp, Homo sapiens
cctcagagacagtaactggaat

SEQ ID NO: 9064318 - DNA, 22 bp, Homo sapiens
cctcagagaaatgtctattcaa

SEQ ID NO: 9064319 - DNA, 22 bp, Homo sapiens
cctcgcggcactcgggccggat

SEQ ID NO: 9064320 - DNA, 22 bp, Homo sapiens
cctccccacccacggctggtgg

SEQ ID NO: 9064321 - DNA, 22 bp, Homo sapiens
cctccccacccacggctggtgg

SEQ ID NO: 9064322 - DNA, 22 bp, Homo sapiens
cctctctccaattttcacctca

SEQ ID NO: 9064323 - DNA, 22 bp, Homo sapiens
cctccccacagcccaggagact

SEQ ID NO: 9064324 - DNA, 22 bp, Homo sapiens
cctcccatggagctctgtccat

SEQ ID NO: 9064325 - DNA, 23 bp, Homo sapiens
cctccccaccagactctaacata

SEQ ID NO: 9064326 - DNA, 23 bp, Homo sapiens
cctccccaccagactctaacata

SEQ ID NO: 9064327 - DNA, 22 bp, Homo sapiens
cctccccacagcccaggagact

SEQ ID NO: 9064328 - DNA, 22 bp, Homo sapiens
cctcccagtgccggggccggct

SEQ ID NO: 9064329 - DNA, 22 bp, Homo sapiens
cctcccatccctgcaagagagc

SEQ ID NO: 9064330 - DNA, 22 bp, Homo sapiens
cctcccagtgcctccagagcag

SEQ ID NO: 9064331 - DNA, 22 bp, Homo sapiens
cctcagtgacctattgcattca

SEQ ID NO: 9064332 - DNA, 22 bp, Homo sapiens
cctcagtgagatgctcagcgaa

SEQ ID NO: 9064333 - DNA, 22 bp, Homo sapiens
cctccagctgcctcagtctctt

SEQ ID NO: 9064334 - DNA, 22 bp, Homo sapiens
cctcagtctgtctgatctgcca

SEQ ID NO: 9064335 - DNA, 20 bp, Homo sapiens
cctccaggcacacccatgtg

SEQ ID NO: 9064336 - DNA, 22 bp, Homo sapiens
aggccacaagaaaatgcttcat

SEQ ID NO: 9064337 - DNA, 22 bp, Homo sapiens
aggccagatgtcgggctagaag

SEQ ID NO: 9064338 - DNA, 22 bp, Homo sapiens
aggccagcctcaggcagggacc

SEQ ID NO: 9064339 - DNA, 22 bp, Homo sapiens
aggccagcaagaaagagagtct

SEQ ID NO: 9064340 - DNA, 22 bp, Homo sapiens
aggccagctatgactctgctcc

SEQ ID NO: 9064341 - DNA, 22 bp, Homo sapiens
aggccagctatgactctgctcc

SEQ ID NO: 9064342 - DNA, 22 bp, Homo sapiens
aggccagcgctgctagctcccg

SEQ ID NO: 9064343 - DNA, 23 bp, Homo sapiens
aggccagcgcagacaccgagcac

SEQ ID NO: 9064344 - DNA, 22 bp, Homo sapiens
aggccagccttgtaaatgcctc

SEQ ID NO: 9064345 - DNA, 22 bp, Homo sapiens
aggccagctcaccctggctcct

SEQ ID NO: 9064346 - DNA, 22 bp, Homo sapiens
aggccagctcaccctggctcct

SEQ ID NO: 9064347 - DNA, 22 bp, Homo sapiens
aggccagctctacccttggact

SEQ ID NO: 9064348 - DNA, 22 bp, Homo sapiens
aggccagctctacccttggact

SEQ ID NO: 9064349 - DNA, 22 bp, Homo sapiens
aggccagctctacccttggact

SEQ ID NO: 9064350 - DNA, 22 bp, Homo sapiens
aggccagctgttactagagcca

SEQ ID NO: 9064351 - DNA, 22 bp, Homo sapiens
aggccagctgttactagagcca

SEQ ID NO: 9064352 - DNA, 22 bp, Homo sapiens
aggccagctgttactagagcca

SEQ ID NO: 9064353 - DNA, 22 bp, Homo sapiens
aggccagctgccacccggtccg

SEQ ID NO: 9064354 - DNA, 22 bp, Homo sapiens
aggccagctgccacccggtccg

SEQ ID NO: 9064355 - DNA, 22 bp, Homo sapiens
aggcatttttgttaatctttgg

SEQ ID NO: 9064356 - DNA, 22 bp, Homo sapiens
aggccaaagcaagaccctgtaa

SEQ ID NO: 9064357 - DNA, 22 bp, Homo sapiens
aggccaagctcccagagaagct

SEQ ID NO: 9064358 - DNA, 22 bp, Homo sapiens
aggccaaattgatcatctttag

SEQ ID NO: 9064359 - DNA, 22 bp, Homo sapiens
aggccaaagctcacctgcagct

SEQ ID NO: 9064360 - DNA, 20 bp, Homo sapiens
aggccaaacccagcgcgccc

SEQ ID NO: 9064361 - DNA, 22 bp, Homo sapiens
aggccaaagctcacctgcagct

SEQ ID NO: 9064362 - DNA, 22 bp, Homo sapiens
aggccaagtgaacaatgctagt

SEQ ID NO: 9064363 - DNA, 22 bp, Homo sapiens
aggccaagctcccagagaagct

SEQ ID NO: 9064364 - DNA, 22 bp, Homo sapiens
aggccaagggcaaagcggagag

SEQ ID NO: 9064365 - DNA, 22 bp, Homo sapiens
aggccaagggcaaagcggagag

SEQ ID NO: 9064366 - DNA, 22 bp, Homo sapiens
aggccaagtagctagcattgaa

SEQ ID NO: 9064367 - DNA, 22 bp, Homo sapiens
aggcccagtgtggcttcctgga

SEQ ID NO: 9064368 - DNA, 22 bp, Homo sapiens
aggcccagtgtggcttcctgga

SEQ ID NO: 9064369 - DNA, 22 bp, Homo sapiens
aggcccagttatcctacttgtt

SEQ ID NO: 9064370 - DNA, 22 bp, Homo sapiens
aggcccatagtagctctgggca

SEQ ID NO: 9064371 - DNA, 22 bp, Homo sapiens
aggcccagttatcctacttgtt

SEQ ID NO: 9064372 - DNA, 22 bp, Homo sapiens
aggcccagttatcctacttgtt

SEQ ID NO: 9064373 - DNA, 20 bp, Homo sapiens
aggccccaggaaactctcag

SEQ ID NO: 9064374 - DNA, 20 bp, Homo sapiens
aggccccaggaaactctcag

SEQ ID NO: 9064375 - DNA, 22 bp, Homo sapiens
aggccccaaagcagtgcaagta

SEQ ID NO: 9064376 - DNA, 22 bp, Homo sapiens
aggcccatgttcacttgctcag

SEQ ID NO: 9064377 - DNA, 22 bp, Homo sapiens
aggccccaaagcagtgcaagta

SEQ ID NO: 9064378 - DNA, 22 bp, Homo sapiens
aggcccccacaggcttgaggca

SEQ ID NO: 9064379 - DNA, 22 bp, Homo sapiens
aggcccgaggttcgtgtgcacc

SEQ ID NO: 9064380 - DNA, 20 bp, Homo sapiens
aggccccaggtggacactag

SEQ ID NO: 9064381 - DNA, 22 bp, Homo sapiens
aggccccatcaggaaggaggcc

SEQ ID NO: 9064382 - DNA, 22 bp, Homo sapiens
aggccctgaagtcggcccctca

SEQ ID NO: 9064383 - DNA, 22 bp, Homo sapiens
aggccctctcattccagaggca

SEQ ID NO: 9064384 - DNA, 20 bp, Homo sapiens
aggccctccccactgttgct

SEQ ID NO: 9064385 - DNA, 22 bp, Homo sapiens
aggccctattcaatggggccca

SEQ ID NO: 9064386 - DNA, 22 bp, Homo sapiens
aggccctaatccaacatgactg

SEQ ID NO: 9064387 - DNA, 22 bp, Homo sapiens
aggccctcacagtctattgtga

SEQ ID NO: 9064388 - DNA, 19 bp, Homo sapiens
aggccctcaagtaacatta

SEQ ID NO: 9064389 - DNA, 22 bp, Homo sapiens
aggccctgaagtcggcccctca

SEQ ID NO: 9064390 - DNA, 22 bp, Homo sapiens
aggcccagtagtgctgccttta

SEQ ID NO: 9064391 - DNA, 22 bp, Homo sapiens
aggcccagtagtgctgccttta

SEQ ID NO: 9064392 - DNA, 22 bp, Homo sapiens
aggcccagtagtcgacggcgct

SEQ ID NO: 9064393 - DNA, 22 bp, Homo sapiens
aggccaggatagcatggatcag

SEQ ID NO: 9064394 - DNA, 22 bp, Homo sapiens
aggccagcttccagaggggcag

SEQ ID NO: 9064395 - DNA, 22 bp, Homo sapiens
aggccagcttccagaggggcag

SEQ ID NO: 9064396 - DNA, 22 bp, Homo sapiens
aggccagcttctaccctctgtt

SEQ ID NO: 9064397 - DNA, 22 bp, Homo sapiens
aggccagcttctaccctctgtt

SEQ ID NO: 9064398 - DNA, 20 bp, Homo sapiens
aggccaggaaatgtagttct

SEQ ID NO: 9064399 - DNA, 20 bp, Homo sapiens
aggccaggaaatgtagttct

SEQ ID NO: 9064400 - DNA, 20 bp, Homo sapiens
aggccaggaaatgtagttct

SEQ ID NO: 9064401 - DNA, 22 bp, Homo sapiens
aggcaggtttcccggctgtcaa

SEQ ID NO: 9064402 - DNA, 22 bp, Homo sapiens
aggcagtcagccctgctagggt

SEQ ID NO: 9064403 - DNA, 22 bp, Homo sapiens
aggcagtcagccctgctagggt

SEQ ID NO: 9064404 - DNA, 22 bp, Homo sapiens
aggcagtcagccctgctagggt

SEQ ID NO: 9064405 - DNA, 22 bp, Homo sapiens
aggcagtctagtccccaggcaa

SEQ ID NO: 9064406 - DNA, 22 bp, Homo sapiens
aggcagtctatctctggagcct

SEQ ID NO: 9064407 - DNA, 22 bp, Homo sapiens
aggcagtctatctctggagcct

SEQ ID NO: 9064408 - DNA, 19 bp, Homo sapiens
aggcagtcattggaatata

SEQ ID NO: 9064409 - DNA, 22 bp, Homo sapiens
aggcagtctagtccccaggcaa

SEQ ID NO: 9064410 - DNA, 22 bp, Homo sapiens
aggcagtccccaggggtgttgc

SEQ ID NO: 9064411 - DNA, 22 bp, Homo sapiens
aggcagcctggtttgaatggaa

SEQ ID NO: 9064412 - DNA, 22 bp, Homo sapiens
aggcagcctatggggagctcag

SEQ ID NO: 9064413 - DNA, 22 bp, Homo sapiens
aggcagcctggtttgaatggaa

SEQ ID NO: 9064414 - DNA, 22 bp, Homo sapiens
aggcaggttggtgagaagactg

SEQ ID NO: 9064415 - DNA, 22 bp, Homo sapiens
aggcagcccacaggacacagga

SEQ ID NO: 9064416 - DNA, 22 bp, Homo sapiens
aggcagccctgtgctggatgct

SEQ ID NO: 9064417 - DNA, 22 bp, Homo sapiens
aggcagcctatggggagctcag

SEQ ID NO: 9064418 - DNA, 22 bp, Homo sapiens
aggcagccctgtgctggatgct

SEQ ID NO: 9064419 - DNA, 22 bp, Homo sapiens
aggcagccatccaggaggctca

SEQ ID NO: 9064420 - DNA, 22 bp, Homo sapiens
aggcagccatccaggaggctca

SEQ ID NO: 9064421 - DNA, 22 bp, Homo sapiens
aggcagccattaccaagggcat

SEQ ID NO: 9064422 - DNA, 22 bp, Homo sapiens
aggcagccatctgcaggaagga

SEQ ID NO: 9064423 - DNA, 22 bp, Homo sapiens
aggcagccatctgcaggaagga

SEQ ID NO: 9064424 - DNA, 22 bp, Homo sapiens
aggcagtggagaaggtttgtga

SEQ ID NO: 9064425 - DNA, 22 bp, Homo sapiens
aggcagtggagctggaataggc

SEQ ID NO: 9064426 - DNA, 22 bp, Homo sapiens
aggcagtgctgtgccctgaacc

SEQ ID NO: 9064427 - DNA, 22 bp, Homo sapiens
aggcagtgctgtgccctgaacc

SEQ ID NO: 9064428 - DNA, 22 bp, Homo sapiens
aggcagtggaaggagaaagcaa

SEQ ID NO: 9064429 - DNA, 22 bp, Homo sapiens
aggcagtggaaggagaaagcaa

SEQ ID NO: 9064430 - DNA, 22 bp, Homo sapiens
aggcagtggatgtcaggaatgg

SEQ ID NO: 9064431 - DNA, 22 bp, Homo sapiens
aggcagtggagctggaataggc

SEQ ID NO: 9064432 - DNA, 22 bp, Homo sapiens
aggcagtggatgtcaggaatgg

SEQ ID NO: 9064433 - DNA, 22 bp, Homo sapiens
aggcagtggatgtcaggaatgg

SEQ ID NO: 9064434 - DNA, 22 bp, Homo sapiens
aggcagtgagaaatagcaagat

SEQ ID NO: 9064435 - DNA, 22 bp, Homo sapiens
aggcagtgagaaatagcaagat

SEQ ID NO: 9064436 - DNA, 22 bp, Homo sapiens
aggcagtgagaaatagcaagat

SEQ ID NO: 9064437 - DNA, 22 bp, Homo sapiens
aggcagtgcagagtcctcttct

SEQ ID NO: 9064438 - DNA, 22 bp, Homo sapiens
aggcagtgatgagtcatgaata

SEQ ID NO: 9064439 - DNA, 22 bp, Homo sapiens
aggcagtgagtgtgacttcaca

SEQ ID NO: 9064440 - DNA, 22 bp, Homo sapiens
aggcagtgagtgtgacttcaca

SEQ ID NO: 9064441 - DNA, 22 bp, Homo sapiens
aggcagtgagcagggtgtcatg

SEQ ID NO: 9064442 - DNA, 22 bp, Homo sapiens
aggcagtgagcagggtgtcatg

SEQ ID NO: 9064443 - DNA, 22 bp, Homo sapiens
aggcagtgcagagtcctcttct

SEQ ID NO: 9064444 - DNA, 22 bp, Homo sapiens
aggcagtgcagagtcctcttct

SEQ ID NO: 9064445 - DNA, 22 bp, Homo sapiens
aggcagtgcatgcaaaggtcgg

SEQ ID NO: 9064446 - DNA, 22 bp, Homo sapiens
aggcagtgcatgcaaaggtcgg

SEQ ID NO: 9064447 - DNA, 22 bp, Homo sapiens
aggcagtgcatgcaaaggtcgg

SEQ ID NO: 9064448 - DNA, 22 bp, Homo sapiens
aggcagtgcctggaccccagct

SEQ ID NO: 9064449 - DNA, 22 bp, Homo sapiens
aggcagtgcctggaccccagct

SEQ ID NO: 9064450 - DNA, 22 bp, Homo sapiens
aggcagtgcctggaccccagct

SEQ ID NO: 9064451 - DNA, 22 bp, Homo sapiens
aggcagtgcctggaccccagct

SEQ ID NO: 9064452 - DNA, 22 bp, Homo sapiens
aggcagtgctcaagacagcagc

SEQ ID NO: 9064453 - DNA, 22 bp, Homo sapiens
aggcagtgctcaagacagcagc

SEQ ID NO: 9064454 - DNA, 22 bp, Homo sapiens
aggcatttgagtccatgggtga

SEQ ID NO: 9064455 - DNA, 22 bp, Homo sapiens
aggcattacatctaaatattta

SEQ ID NO: 9064456 - DNA, 22 bp, Homo sapiens
aggcattagttgtaaagtattg

SEQ ID NO: 9064457 - DNA, 22 bp, Homo sapiens
aggcatggcatggggcagatgt

SEQ ID NO: 9064458 - DNA, 22 bp, Homo sapiens
ccactggcttttcctaggtctc

SEQ ID NO: 9064459 - DNA, 22 bp, Homo sapiens
ccactgctctgccaggagctgg

SEQ ID NO: 9064460 - DNA, 22 bp, Homo sapiens
ccactggcagttggctagcctt

SEQ ID NO: 9064461 - DNA, 22 bp, Homo sapiens
aggcagtggctgagaccagggg

SEQ ID NO: 9064462 - DNA, 22 bp, Homo sapiens
aggcagtggctgagaccagggg

SEQ ID NO: 9064463 - DNA, 22 bp, Homo sapiens
aggcagtggctgagaccagggg

SEQ ID NO: 9064464 - DNA, 22 bp, Homo sapiens
aggcagtggcttttgttgtgtt

SEQ ID NO: 9064465 - DNA, 23 bp, Homo sapiens
aggcagtggtggtaacatgtcaa

SEQ ID NO: 9064466 - DNA, 23 bp, Homo sapiens
aggcagtgggggccactttgctt

SEQ ID NO: 9064467 - DNA, 23 bp, Homo sapiens
aggcagtgggggccactttgctt

SEQ ID NO: 9064468 - DNA, 22 bp, Homo sapiens
aggcagtttaggcagcgattta

SEQ ID NO: 9064469 - DNA, 22 bp, Homo sapiens
aggcagtttaggcagcgattta

SEQ ID NO: 9064470 - DNA, 22 bp, Homo sapiens
aggcagtttatccccagagcct

SEQ ID NO: 9064471 - DNA, 22 bp, Homo sapiens
aggcagttgttgctgagcagct

SEQ ID NO: 9064472 - DNA, 21 bp, Homo sapiens
aggcatgagccctgcatggac

SEQ ID NO: 9064473 - DNA, 23 bp, Homo sapiens
aggcatcttctgagttaagagca

SEQ ID NO: 9064474 - DNA, 22 bp, Homo sapiens
aggcatgatgtgcagtggcaaa

SEQ ID NO: 9064475 - DNA, 22 bp, Homo sapiens
aggcatgatgtgcagtggcaaa

SEQ ID NO: 9064476 - DNA, 17 bp, Homo sapiens
aggcatgaggcatcact

SEQ ID NO: 9064477 - DNA, 22 bp, Homo sapiens
aggcatctatacattatgttca

SEQ ID NO: 9064478 - DNA, 21 bp, Homo sapiens
aggcatctaaagagagtagac

SEQ ID NO: 9064479 - DNA, 22 bp, Homo sapiens
aggcatctaacagagatcttta

SEQ ID NO: 9064480 - DNA, 22 bp, Homo sapiens
aggcatctaacagagatcttta

SEQ ID NO: 9064481 - DNA, 22 bp, Homo sapiens
aggcatctgagtttgcaagctt

SEQ ID NO: 9064482 - DNA, 22 bp, Homo sapiens
aggcatctgagtttgcaagctt

SEQ ID NO: 9064483 - DNA, 22 bp, Homo sapiens
aggcatctgagtttgcaagctt

SEQ ID NO: 9064484 - DNA, 22 bp, Homo sapiens
aggcatctgcagagcttggtga

SEQ ID NO: 9064485 - DNA, 22 bp, Homo sapiens
aggcatctctctgcttctgagc

SEQ ID NO: 9064486 - DNA, 22 bp, Homo sapiens
aggcatctgagtttgcaagctt

SEQ ID NO: 9064487 - DNA, 22 bp, Homo sapiens
aggcatctgcctcctctacccc

SEQ ID NO: 9064488 - DNA, 22 bp, Homo sapiens
aggctgagccacggggctggct

SEQ ID NO: 9064489 - DNA, 22 bp, Homo sapiens
aggctgagccacggggctggct

SEQ ID NO: 9064490 - DNA, 22 bp, Homo sapiens
aggctgagataggtggatcatt

SEQ ID NO: 9064491 - DNA, 22 bp, Homo sapiens
aggctctgccaattccttcctc

SEQ ID NO: 9064492 - DNA, 20 bp, Homo sapiens
aggctctgccattgtccctg

SEQ ID NO: 9064493 - DNA, 22 bp, Homo sapiens
aggctctgagtagagctgccag

SEQ ID NO: 9064494 - DNA, 22 bp, Homo sapiens
aggctctgatcaggtggctgtg

SEQ ID NO: 9064495 - DNA, 22 bp, Homo sapiens
aggctctgatgcaagcccaggg

SEQ ID NO: 9064496 - DNA, 22 bp, Homo sapiens
ccagtctgctgtggtaggaaga

SEQ ID NO: 9064497 - DNA, 22 bp, Homo sapiens
ccagtctgtactttgctctgtt

SEQ ID NO: 9064498 - DNA, 22 bp, Homo sapiens
ccagtctgtactttgctctgtt

SEQ ID NO: 9064499 - DNA, 22 bp, Homo sapiens
ccagtcactctgtgagagctac

SEQ ID NO: 9064500 - DNA, 23 bp, Homo sapiens
aggctgagctctcccagcttcag

SEQ ID NO: 9064501 - DNA, 22 bp, Homo sapiens
ccagtgcacagccaggcaggtg

SEQ ID NO: 9064502 - DNA, 22 bp, Homo sapiens
ccagtgcacagccaggcaggtg

SEQ ID NO: 9064503 - DNA, 22 bp, Homo sapiens
ccagtgcacaatggaacaactc

SEQ ID NO: 9064504 - DNA, 19 bp, Homo sapiens
ccagtgcaaggtaagatag

SEQ ID NO: 9064505 - DNA, 22 bp, Homo sapiens
ccagtctgtgtgccagcctgcg

SEQ ID NO: 9064506 - DNA, 22 bp, Homo sapiens
ccagtctgtgtgccagcctgcg

SEQ ID NO: 9064507 - DNA, 22 bp, Homo sapiens
ccagtctgtgtgccagcctgcg

SEQ ID NO: 9064508 - DNA, 22 bp, Homo sapiens
ccagtgcaccatttccctctgt

SEQ ID NO: 9064509 - DNA, 22 bp, Homo sapiens
ccagtgcaccatttccctctgt

SEQ ID NO: 9064510 - DNA, 22 bp, Homo sapiens
ccagtgcaccaagaggcctaga

SEQ ID NO: 9064511 - DNA, 22 bp, Homo sapiens
aggctgaggcaggtggatcact

SEQ ID NO: 9064512 - DNA, 22 bp, Homo sapiens
aggctgaggcgggaggatcact

SEQ ID NO: 9064513 - DNA, 22 bp, Homo sapiens
aggctgaggcaggtggatcatt

SEQ ID NO: 9064514 - DNA, 22 bp, Homo sapiens
aggctgaggcgggaggatcact

SEQ ID NO: 9064515 - DNA, 22 bp, Homo sapiens
aggctgaggcgggaggatcact

SEQ ID NO: 9064516 - DNA, 22 bp, Homo sapiens
ccagttccagtgctcacatcca

SEQ ID NO: 9064517 - DNA, 22 bp, Homo sapiens
ccagttcttcttgacacgaaag

SEQ ID NO: 9064518 - DNA, 22 bp, Homo sapiens
ccagtttaggtactaggctcta

SEQ ID NO: 9064519 - DNA, 22 bp, Homo sapiens
ccagtttataagaaagaaaacc

SEQ ID NO: 9064520 - DNA, 22 bp, Homo sapiens
aggcctcagcctgccaggcctg

SEQ ID NO: 9064521 - DNA, 22 bp, Homo sapiens
aggcctcagctcagtgtgacag

SEQ ID NO: 9064522 - DNA, 22 bp, Homo sapiens
aggcctcagtttccccagttgt

SEQ ID NO: 9064523 - DNA, 22 bp, Homo sapiens
aggcctcagttcttgccaggtg

SEQ ID NO: 9064524 - DNA, 22 bp, Homo sapiens
aggcctcacattgggcttcaag

SEQ ID NO: 9064525 - DNA, 22 bp, Homo sapiens
aggcctcacattgggcttcaag

SEQ ID NO: 9064526 - DNA, 22 bp, Homo sapiens
aggcctagaggaatggccaggg

SEQ ID NO: 9064527 - DNA, 22 bp, Homo sapiens
aggcctcagtttgtcatctgta

SEQ ID NO: 9064528 - DNA, 22 bp, Homo sapiens
aggcctcctgcagggatgagtg

SEQ ID NO: 9064529 - DNA, 17 bp, Homo sapiens
aggcctccctccaggcc

SEQ ID NO: 9064530 - DNA, 22 bp, Homo sapiens
ccaggcagggctcaaggaacct

SEQ ID NO: 9064531 - DNA, 22 bp, Homo sapiens
ccaggcagggctcaaggaacct

SEQ ID NO: 9064532 - DNA, 22 bp, Homo sapiens
ccaggcagggagctgtttggcc

SEQ ID NO: 9064533 - DNA, 23 bp, Homo sapiens
ccaggcagtagctattgaagtga

SEQ ID NO: 9064534 - DNA, 22 bp, Homo sapiens
aggcctctgagcagcactcatg

SEQ ID NO: 9064535 - DNA, 22 bp, Homo sapiens
aggcctcctggctccaggcctt

SEQ ID NO: 9064536 - DNA, 22 bp, Homo sapiens
ccaggccaaattcagtcagcag

SEQ ID NO: 9064537 - DNA, 22 bp, Homo sapiens
ccaggcatggggagagccagat

SEQ ID NO: 9064538 - DNA, 22 bp, Homo sapiens
ccaggcatccattgcttcctct

SEQ ID NO: 9064539 - DNA, 22 bp, Homo sapiens
ccaggcatccattgcttcctct

SEQ ID NO: 9064540 - DNA, 22 bp, Homo sapiens
ccaggcatcacgggcatgtggc

SEQ ID NO: 9064541 - DNA, 22 bp, Homo sapiens
aggctccacggcaggatgctgt

SEQ ID NO: 9064542 - DNA, 22 bp, Homo sapiens
ccaggcctagcccctgagggta

SEQ ID NO: 9064543 - DNA, 22 bp, Homo sapiens
ccaggcctcacctgcccaccta

SEQ ID NO: 9064544 - DNA, 22 bp, Homo sapiens
aggctccatgcaaaggctgttt

SEQ ID NO: 9064545 - DNA, 22 bp, Homo sapiens
aggctccattcatgtgaaggca

SEQ ID NO: 9064546 - DNA, 22 bp, Homo sapiens
aggctccatgcaaaggctgttt

SEQ ID NO: 9064547 - DNA, 22 bp, Homo sapiens
aggctccataccatctccggag

SEQ ID NO: 9064548 - DNA, 22 bp, Homo sapiens
ccaggcctagcccctgagggta

SEQ ID NO: 9064549 - DNA, 22 bp, Homo sapiens
ccaggcctagcccctgagggta

SEQ ID NO: 9064550 - DNA, 22 bp, Homo sapiens
ccaggcctagcccctgagggta

SEQ ID NO: 9064551 - DNA, 22 bp, Homo sapiens
ccaggcccgttcccttctccag

SEQ ID NO: 9064552 - DNA, 22 bp, Homo sapiens
ccaggccctgctcctcacacca

SEQ ID NO: 9064553 - DNA, 22 bp, Homo sapiens
ccaggccctgctcctcacacca

SEQ ID NO: 9064554 - DNA, 22 bp, Homo sapiens
ccaggctctgccaggcccttga

SEQ ID NO: 9064555 - DNA, 22 bp, Homo sapiens
aggctccttgctcacaggctca

SEQ ID NO: 9064556 - DNA, 22 bp, Homo sapiens
aggctccttgctcacaggctca

SEQ ID NO: 9064557 - DNA, 22 bp, Homo sapiens
aggctccttgctcacaggctca

SEQ ID NO: 9064558 - DNA, 22 bp, Homo sapiens
ccaggctctgcaaaatcaggct

SEQ ID NO: 9064559 - DNA, 22 bp, Homo sapiens
ccaggctctgcaaaatcaggct

SEQ ID NO: 9064560 - DNA, 22 bp, Homo sapiens
ccaggctctgccaggcccttga

SEQ ID NO: 9064561 - DNA, 22 bp, Homo sapiens
ccaggctctgacatagatggga

SEQ ID NO: 9064562 - DNA, 22 bp, Homo sapiens
ccaggctctgcaaaatcaggct

SEQ ID NO: 9064563 - DNA, 22 bp, Homo sapiens
ccaggctctgagcctcactctt

SEQ ID NO: 9064564 - DNA, 22 bp, Homo sapiens
aggctccattccaggagctaga

SEQ ID NO: 9064565 - DNA, 22 bp, Homo sapiens
aggctccattttcctgcagctg

SEQ ID NO: 9064566 - DNA, 22 bp, Homo sapiens
aggctccattttcctgcagctg

SEQ ID NO: 9064567 - DNA, 21 bp, Homo sapiens
aggctcccagaaatgggcatc

SEQ ID NO: 9064568 - DNA, 22 bp, Homo sapiens
agcttcttttacagctcatgct

SEQ ID NO: 9064569 - DNA, 22 bp, Homo sapiens
agcttcttaagttcctgcagca

SEQ ID NO: 9064570 - DNA, 22 bp, Homo sapiens
agcttgaaccacatgaaattgc

SEQ ID NO: 9064571 - DNA, 22 bp, Homo sapiens
agcttgacagacagatggtagc

SEQ ID NO: 9064572 - DNA, 22 bp, Homo sapiens
agcttgacagacagatggtagc

SEQ ID NO: 9064573 - DNA, 22 bp, Homo sapiens
agcttaaactctttgaagttat

SEQ ID NO: 9064574 - DNA, 22 bp, Homo sapiens
agctgttttttcctcaccactt

SEQ ID NO: 9064575 - DNA, 22 bp, Homo sapiens
agctgtttttgtgggcatgtga

SEQ ID NO: 9064576 - DNA, 22 bp, Homo sapiens
agctgtttttgtctgctgatcc

SEQ ID NO: 9064577 - DNA, 22 bp, Homo sapiens
agctgttttcttgccgtcctag

SEQ ID NO: 9064578 - DNA, 22 bp, Homo sapiens
agctgtttttccagtctctgga

SEQ ID NO: 9064579 - DNA, 22 bp, Homo sapiens
agcttaacgctcctaccagatg

SEQ ID NO: 9064580 - DNA, 23 bp, Homo sapiens
agcttgcttttcccagtactgca

SEQ ID NO: 9064581 - DNA, 22 bp, Homo sapiens
agcttgcctcttaatcacctca

SEQ ID NO: 9064582 - DNA, 22 bp, Homo sapiens
agcttgcctccccctcttagga

SEQ ID NO: 9064583 - DNA, 22 bp, Homo sapiens
agcttgagttttggatgaagtg

SEQ ID NO: 9064584 - DNA, 18 bp, Homo sapiens
agcttgcctcaagctttt

SEQ ID NO: 9064585 - DNA, 22 bp, Homo sapiens
agcttgccagttgaagatcttc

SEQ ID NO: 9064586 - DNA, 22 bp, Homo sapiens
agcttgggcaacacagcaagac

SEQ ID NO: 9064587 - DNA, 22 bp, Homo sapiens
agcttgggtgtgcctgcgagct

SEQ ID NO: 9064588 - DNA, 22 bp, Homo sapiens
agcttggtggccctcctggctg

SEQ ID NO: 9064589 - DNA, 22 bp, Homo sapiens
agcttggtgttgcctgcttgag

SEQ ID NO: 9064590 - DNA, 22 bp, Homo sapiens
agctgttccctcactgcagtca

SEQ ID NO: 9064591 - DNA, 22 bp, Homo sapiens
agctgttagttattgaagatgt

SEQ ID NO: 9064592 - DNA, 22 bp, Homo sapiens
agctgtgttctggttgattcac

SEQ ID NO: 9064593 - DNA, 22 bp, Homo sapiens
agctgttgctgggaggagagaa

SEQ ID NO: 9064594 - DNA, 22 bp, Homo sapiens
agctgtgtgtttccactgagct

SEQ ID NO: 9064595 - DNA, 22 bp, Homo sapiens
agctgtgtggtgtctgacagct

SEQ ID NO: 9064596 - DNA, 23 bp, Homo sapiens
agctgtgtggccttgggcaagtt

SEQ ID NO: 9064597 - DNA, 22 bp, Homo sapiens
agctgtgtggtgtctgacagct

SEQ ID NO: 9064598 - DNA, 22 bp, Homo sapiens
agctgtgtgccaggggagatgt

SEQ ID NO: 9064599 - DNA, 20 bp, Homo sapiens
agctgtttacatggatttct

SEQ ID NO: 9064600 - DNA, 22 bp, Homo sapiens
agctgtttaaatgacttacttt

SEQ ID NO: 9064601 - DNA, 22 bp, Homo sapiens
agctgtttaataaatgtctgtt

SEQ ID NO: 9064602 - DNA, 22 bp, Homo sapiens
agctgttgtctgcaggagaagc

SEQ ID NO: 9064603 - DNA, 22 bp, Homo sapiens
agctgtttccattcttgagtag

SEQ ID NO: 9064604 - DNA, 22 bp, Homo sapiens
agctgtttccataaatgagaca

SEQ ID NO: 9064605 - DNA, 23 bp, Homo sapiens
agctgtttcattattacaacacc

SEQ ID NO: 9064606 - DNA, 22 bp, Homo sapiens
agctgtttatgcactcctgcct

SEQ ID NO: 9064607 - DNA, 20 bp, Homo sapiens
agctgtttacatggatttct

SEQ ID NO: 9064608 - DNA, 22 bp, Homo sapiens
agctgttttactcagaaacata

SEQ ID NO: 9064609 - DNA, 22 bp, Homo sapiens
agctgtttgtacttagatagta

SEQ ID NO: 9064610 - DNA, 22 bp, Homo sapiens
agctgtttgtacttagatagta

SEQ ID NO: 9064611 - DNA, 23 bp, Homo sapiens
agctgtttcttgtgagttgagtg

SEQ ID NO: 9064612 - DNA, 21 bp, Homo sapiens
agctgtttgaagctatattgg

SEQ ID NO: 9064613 - DNA, 22 bp, Homo sapiens
agctgttttactggttgtataa

SEQ ID NO: 9064614 - DNA, 22 bp, Homo sapiens
agctgttttcttctaggaagac

SEQ ID NO: 9064615 - DNA, 22 bp, Homo sapiens
agctgttttcttctaggaagac

SEQ ID NO: 9064616 - DNA, 22 bp, Homo sapiens
agctgttttctaatgcatttga

SEQ ID NO: 9064617 - DNA, 22 bp, Homo sapiens
agctgttttcctggttagagac

SEQ ID NO: 9064618 - DNA, 22 bp, Homo sapiens
caggcctggctgcagctcgcct

SEQ ID NO: 9064619 - DNA, 22 bp, Homo sapiens
caggcctggctgcagctcgcct

SEQ ID NO: 9064620 - DNA, 22 bp, Homo sapiens
caggcctggctgcagctcgcct

SEQ ID NO: 9064621 - DNA, 22 bp, Homo sapiens
caggcctggagtgcaatggcac

SEQ ID NO: 9064622 - DNA, 22 bp, Homo sapiens
caggcctggagtgcaatggcac

SEQ ID NO: 9064623 - DNA, 22 bp, Homo sapiens
caggcctggagtgcaatggcac

SEQ ID NO: 9064624 - DNA, 22 bp, Homo sapiens
caggcctggcccccggcacacc

SEQ ID NO: 9064625 - DNA, 22 bp, Homo sapiens
caggcctcccggtgcacactga

SEQ ID NO: 9064626 - DNA, 22 bp, Homo sapiens
caggcctcccggtgcacactga

SEQ ID NO: 9064627 - DNA, 22 bp, Homo sapiens
caggcctggggctggcttccag

SEQ ID NO: 9064628 - DNA, 22 bp, Homo sapiens
caggcctggggctggcttccag

SEQ ID NO: 9064629 - DNA, 22 bp, Homo sapiens
caggcctggttgagccctgaga

SEQ ID NO: 9064630 - DNA, 22 bp, Homo sapiens
caggcctggttgagccctgaga

SEQ ID NO: 9064631 - DNA, 22 bp, Homo sapiens
agctgtgtagggaatcagagaa

SEQ ID NO: 9064632 - DNA, 22 bp, Homo sapiens
agctgtggcagcagccgtggca

SEQ ID NO: 9064633 - DNA, 22 bp, Homo sapiens
caggcctcaggggctcaggctg

SEQ ID NO: 9064634 - DNA, 22 bp, Homo sapiens
caggcctcaggggctcaggctg

SEQ ID NO: 9064635 - DNA, 22 bp, Homo sapiens
caggcctccactccacgcagac

SEQ ID NO: 9064636 - DNA, 22 bp, Homo sapiens
caggcctccactccacgcagac

SEQ ID NO: 9064637 - DNA, 22 bp, Homo sapiens
caggcctcatggtgtgtccttc

SEQ ID NO: 9064638 - DNA, 21 bp, Homo sapiens
caggccgggtgagcaggcagc

SEQ ID NO: 9064639 - DNA, 22 bp, Homo sapiens
caggcctcaccagcggagctgc

SEQ ID NO: 9064640 - DNA, 22 bp, Homo sapiens
caggcctcagagagtggcgggg

SEQ ID NO: 9064641 - DNA, 22 bp, Homo sapiens
agctggcttttgtgaaggtttt

SEQ ID NO: 9064642 - DNA, 22 bp, Homo sapiens
agctggctttgagctgggaggt

SEQ ID NO: 9064643 - DNA, 22 bp, Homo sapiens
agctggcttttgtgaaggtttt

SEQ ID NO: 9064644 - DNA, 23 bp, Homo sapiens
agctgggaattttctgaagcttt

SEQ ID NO: 9064645 - DNA, 23 bp, Homo sapiens
agctgggaattttctgaagcttt

SEQ ID NO: 9064646 - DNA, 21 bp, Homo sapiens
caggccccaggcctggggtgc

SEQ ID NO: 9064647 - DNA, 21 bp, Homo sapiens
caggccccaggcctggggtgc

SEQ ID NO: 9064648 - DNA, 22 bp, Homo sapiens
agctttagagagccaagactca

SEQ ID NO: 9064649 - DNA, 22 bp, Homo sapiens
agctttacatcgaagttcagtc

SEQ ID NO: 9064650 - DNA, 22 bp, Homo sapiens
agctttacctgaaatttgatcc

SEQ ID NO: 9064651 - DNA, 21 bp, Homo sapiens
agcttgtgtgtatcacagtgt

SEQ ID NO: 9064652 - DNA, 18 bp, Homo sapiens
aggaaagacgaagagggc

SEQ ID NO: 9064653 - DNA, 22 bp, Homo sapiens
aggaaagaagtacattctcatg

SEQ ID NO: 9064654 - DNA, 18 bp, Homo sapiens
aggaaagacgaagagggc

SEQ ID NO: 9064655 - DNA, 18 bp, Homo sapiens
aggaaagacgaagagggc

SEQ ID NO: 9064656 - DNA, 18 bp, Homo sapiens
aggaaagacgaagagggc

SEQ ID NO: 9064657 - DNA, 22 bp, Homo sapiens
aggaaagcaatggctgagaaca

SEQ ID NO: 9064658 - DNA, 22 bp, Homo sapiens
aggaaagcaatggctgagaaca

SEQ ID NO: 9064659 - DNA, 22 bp, Homo sapiens
aggaaagatggaaggaggataa

SEQ ID NO: 9064660 - DNA, 22 bp, Homo sapiens
aggaaagatggaaggaggataa

SEQ ID NO: 9064661 - DNA, 22 bp, Homo sapiens
aggaaagatggaaggaggataa

SEQ ID NO: 9064662 - DNA, 22 bp, Homo sapiens
aggaaagactggggccccagaa

SEQ ID NO: 9064663 - DNA, 22 bp, Homo sapiens
aggaaagatggaaggaggataa

SEQ ID NO: 9064664 - DNA, 22 bp, Homo sapiens
aggaaagatggaaggaggataa

SEQ ID NO: 9064665 - DNA, 21 bp, Homo sapiens
aggaaaggaagtccccagggt

SEQ ID NO: 9064666 - DNA, 22 bp, Homo sapiens
cagggccactgtagatgaggag

SEQ ID NO: 9064667 - DNA, 21 bp, Homo sapiens
aggaaaggaagtccccagggt

SEQ ID NO: 9064668 - DNA, 22 bp, Homo sapiens
aggaaagctcccagtagggctc

SEQ ID NO: 9064669 - DNA, 20 bp, Homo sapiens
aggaaagcctgtgtgagtct

SEQ ID NO: 9064670 - DNA, 22 bp, Homo sapiens
aggaaccagacagaactgaatg

SEQ ID NO: 9064671 - DNA, 22 bp, Homo sapiens
aggaacagaagagcaatgcagg

SEQ ID NO: 9064672 - DNA, 23 bp, Homo sapiens
aggaactgaggcctagggaggta

SEQ ID NO: 9064673 - DNA, 22 bp, Homo sapiens
aggaagctcattttgacatatc

SEQ ID NO: 9064674 - DNA, 22 bp, Homo sapiens
aggaagctcattttgacatatc

SEQ ID NO: 9064675 - DNA, 22 bp, Homo sapiens
aggaagctcagagaagtctttt

SEQ ID NO: 9064676 - DNA, 22 bp, Homo sapiens
aggaagctcaaagccatgatgt

SEQ ID NO: 9064677 - DNA, 22 bp, Homo sapiens
aggaagctccatgaaggcagag

SEQ ID NO: 9064678 - DNA, 22 bp, Homo sapiens
aggaagctcctggagagccagt

SEQ ID NO: 9064679 - DNA, 22 bp, Homo sapiens
aggaagctcctggagagccagt

SEQ ID NO: 9064680 - DNA, 22 bp, Homo sapiens
aggaagctcggagagggcaaat

SEQ ID NO: 9064681 - DNA, 22 bp, Homo sapiens
aggaagctcggagagggcaaat

SEQ ID NO: 9064682 - DNA, 22 bp, Homo sapiens
aggaagctcggagagggcaaat

SEQ ID NO: 9064683 - DNA, 22 bp, Homo sapiens
aggaagctcaaagccatgatgt

SEQ ID NO: 9064684 - DNA, 18 bp, Homo sapiens
aggaagcaggaggaaggc

SEQ ID NO: 9064685 - DNA, 22 bp, Homo sapiens
aggaagcactggaaggggttgg

SEQ ID NO: 9064686 - DNA, 18 bp, Homo sapiens
aggaagcaggaggaaggc

SEQ ID NO: 9064687 - DNA, 22 bp, Homo sapiens
aggaacaactgattcagtcaac

SEQ ID NO: 9064688 - DNA, 22 bp, Homo sapiens
aggaacaactgattcagtcaac

SEQ ID NO: 9064689 - DNA, 22 bp, Homo sapiens
aggaacaattgataaactcaca

SEQ ID NO: 9064690 - DNA, 22 bp, Homo sapiens
aggaaatgtacaaatgaagatg

SEQ ID NO: 9064691 - DNA, 22 bp, Homo sapiens
aggaaatgtagtcctcatctcc

SEQ ID NO: 9064692 - DNA, 22 bp, Homo sapiens
aggaaatgtagtcctcatctcc

SEQ ID NO: 9064693 - DNA, 22 bp, Homo sapiens
aggaaatgctgatgctcctgga

SEQ ID NO: 9064694 - DNA, 22 bp, Homo sapiens
aggaaatgctgatgctcctgga

SEQ ID NO: 9064695 - DNA, 22 bp, Homo sapiens
aggaaatgccgcggctctcttt

SEQ ID NO: 9064696 - DNA, 22 bp, Homo sapiens
aggaaatgcaggcaaatactct

SEQ ID NO: 9064697 - DNA, 22 bp, Homo sapiens
aggaaataggaccagacaaagc

SEQ ID NO: 9064698 - DNA, 22 bp, Homo sapiens
aggaaataggaccagacaaagc

SEQ ID NO: 9064699 - DNA, 22 bp, Homo sapiens
cagctctgaagaaaggtgtcta

SEQ ID NO: 9064700 - DNA, 22 bp, Homo sapiens
cagctctctaaggtcttgcttt

SEQ ID NO: 9064701 - DNA, 22 bp, Homo sapiens
cagctctctaaggtcttgcttt

SEQ ID NO: 9064702 - DNA, 22 bp, Homo sapiens
cagctgttgtcacctcacatcc

SEQ ID NO: 9064703 - DNA, 22 bp, Homo sapiens
cagctgttgtctctcacatatt

SEQ ID NO: 9064704 - DNA, 22 bp, Homo sapiens
cagctctcacacttagcttcta

SEQ ID NO: 9064705 - DNA, 22 bp, Homo sapiens
cagctctccaccctcctggttc

SEQ ID NO: 9064706 - DNA, 22 bp, Homo sapiens
cagctctcacaccctcctccca

SEQ ID NO: 9064707 - DNA, 22 bp, Homo sapiens
cagctcctgttggtcttgagga

SEQ ID NO: 9064708 - DNA, 22 bp, Homo sapiens
cagcttcttagtctttccttgt

SEQ ID NO: 9064709 - DNA, 22 bp, Homo sapiens
cagcttctgtttctagcccctg

SEQ ID NO: 9064710 - DNA, 22 bp, Homo sapiens
cagcttctgtttctagcccctg

SEQ ID NO: 9064711 - DNA, 22 bp, Homo sapiens
cagcttcttacgagctggtact

SEQ ID NO: 9064712 - DNA, 22 bp, Homo sapiens
cagcttcttcagtcctggagct

SEQ ID NO: 9064713 - DNA, 22 bp, Homo sapiens
cagcttcttcagtcctggagct

SEQ ID NO: 9064714 - DNA, 22 bp, Homo sapiens
cagcttctgctcatggaggggt

SEQ ID NO: 9064715 - DNA, 22 bp, Homo sapiens
cagcttctgctcatggaggggt

SEQ ID NO: 9064716 - DNA, 22 bp, Homo sapiens
cagcttctgtttattgtgtgcc

SEQ ID NO: 9064717 - DNA, 22 bp, Homo sapiens
cagcttctgtcctagaaactgg

SEQ ID NO: 9064718 - DNA, 22 bp, Homo sapiens
agctctcttccagatccacttg

SEQ ID NO: 9064719 - DNA, 22 bp, Homo sapiens
agctcctgtgtgaagcctccct

SEQ ID NO: 9064720 - DNA, 22 bp, Homo sapiens
agctctgactgaagagatgcaa

SEQ ID NO: 9064721 - DNA, 22 bp, Homo sapiens
agctctgagaaagttagaaagt

SEQ ID NO: 9064722 - DNA, 22 bp, Homo sapiens
cagctcctgcctgggcagctgt

SEQ ID NO: 9064723 - DNA, 22 bp, Homo sapiens
cagctcctgcctgggcagctgt

SEQ ID NO: 9064724 - DNA, 22 bp, Homo sapiens
cagctcctgcctgggcagctgt

SEQ ID NO: 9064725 - DNA, 23 bp, Homo sapiens
agctctgctcgggcatgccctgc

SEQ ID NO: 9064726 - DNA, 22 bp, Homo sapiens
agctctggaactcccggctgct

SEQ ID NO: 9064727 - DNA, 22 bp, Homo sapiens
agctctgcctaggttccacgat

SEQ ID NO: 9064728 - DNA, 22 bp, Homo sapiens
agctctgcaggcacagctgagg

SEQ ID NO: 9064729 - DNA, 22 bp, Homo sapiens
agctctgccgcctttcaggctg

SEQ ID NO: 9064730 - DNA, 22 bp, Homo sapiens
agctctgcagcccagcaggtgg

SEQ ID NO: 9064731 - DNA, 22 bp, Homo sapiens
agctgcagtaaagctctccagg

SEQ ID NO: 9064732 - DNA, 22 bp, Homo sapiens
agctgcagtcaagctgggccac

SEQ ID NO: 9064733 - DNA, 22 bp, Homo sapiens
agctgcagtcaagctgggccac

SEQ ID NO: 9064734 - DNA, 22 bp, Homo sapiens
cagcttttaggactgtgagaaa

SEQ ID NO: 9064735 - DNA, 22 bp, Homo sapiens
cagctttgcaggctggtcagtg

SEQ ID NO: 9064736 - DNA, 22 bp, Homo sapiens
cagctttgtcatttgatttggg

SEQ ID NO: 9064737 - DNA, 22 bp, Homo sapiens
agctgaggccacgagtgaaggg

SEQ ID NO: 9064738 - DNA, 22 bp, Homo sapiens
agctgaggcatggacaggctgc

SEQ ID NO: 9064739 - DNA, 22 bp, Homo sapiens
agctgaggcatggacaggctgc

SEQ ID NO: 9064740 - DNA, 22 bp, Homo sapiens
cagcttgaaatattaggagatg

SEQ ID NO: 9064741 - DNA, 22 bp, Homo sapiens
agctgcaggcctctcctgggga

SEQ ID NO: 9064742 - DNA, 22 bp, Homo sapiens
agctgcagccctcctgcatggc

SEQ ID NO: 9064743 - DNA, 22 bp, Homo sapiens
agctggcagtatgactggtgac

SEQ ID NO: 9064744 - DNA, 22 bp, Homo sapiens
agctggcatactttgctaggaa

SEQ ID NO: 9064745 - DNA, 22 bp, Homo sapiens
caggacagagcccagactgtgt

SEQ ID NO: 9064746 - DNA, 22 bp, Homo sapiens
caggacagagcccagactgtgt

SEQ ID NO: 9064747 - DNA, 22 bp, Homo sapiens
caggacagagcccagactgtgt

SEQ ID NO: 9064748 - DNA, 22 bp, Homo sapiens
caggacagagcccagactgtgt

SEQ ID NO: 9064749 - DNA, 23 bp, Homo sapiens
agctggaggctgtctactcccaa

SEQ ID NO: 9064750 - DNA, 22 bp, Homo sapiens
agctggaggataactcacttct

SEQ ID NO: 9064751 - DNA, 22 bp, Homo sapiens
caggacagaccaagatcgtgct

SEQ ID NO: 9064752 - DNA, 22 bp, Homo sapiens
caggacagaccaagatcgtgct

SEQ ID NO: 9064753 - DNA, 22 bp, Homo sapiens
caggacagaccaagatcgtgct

SEQ ID NO: 9064754 - DNA, 22 bp, Homo sapiens
caggacagaaataaggaatata

SEQ ID NO: 9064755 - DNA, 22 bp, Homo sapiens
caggacacttgttcttctctgc

SEQ ID NO: 9064756 - DNA, 22 bp, Homo sapiens
agctgctgagccaggctgatgt

SEQ ID NO: 9064757 - DNA, 22 bp, Homo sapiens
agctgctctcactggacgcctg

SEQ ID NO: 9064758 - DNA, 22 bp, Homo sapiens
agctgctcctttcctgcaggcg

SEQ ID NO: 9064759 - DNA, 22 bp, Homo sapiens
agctgctcctttcctgcaggcg

SEQ ID NO: 9064760 - DNA, 22 bp, Homo sapiens
agctgctgaatgacactgcaag

SEQ ID NO: 9064761 - DNA, 21 bp, Homo sapiens
agctgctccagggagctcagg

SEQ ID NO: 9064762 - DNA, 22 bp, Homo sapiens
agctgcctggccggagccactg

SEQ ID NO: 9064763 - DNA, 22 bp, Homo sapiens
agctgcctggccggagccactg

SEQ ID NO: 9064764 - DNA, 22 bp, Homo sapiens
agctggctttgagctgggaggt

SEQ ID NO: 9064765 - DNA, 22 bp, Homo sapiens
agctggctttgagctgggaggt

SEQ ID NO: 9064766 - DNA, 22 bp, Homo sapiens
agctggcttgcatgctaaggag

SEQ ID NO: 9064767 - DNA, 22 bp, Homo sapiens
agctggcttgcatgctaaggag

SEQ ID NO: 9064768 - DNA, 22 bp, Homo sapiens
agctggctttatggttggctaa

SEQ ID NO: 9064769 - DNA, 22 bp, Homo sapiens
agctggcttctctgcagacatt

SEQ ID NO: 9064770 - DNA, 22 bp, Homo sapiens
agctggcttctctgcagacatt

SEQ ID NO: 9064771 - DNA, 22 bp, Homo sapiens
agctggcttctctgcagacatt

SEQ ID NO: 9064772 - DNA, 22 bp, Homo sapiens
agctggcttcacaggcagtgtg

SEQ ID NO: 9064773 - DNA, 22 bp, Homo sapiens
agctggctgggtgccagtctcc

SEQ ID NO: 9064774 - DNA, 22 bp, Homo sapiens
agctggcttcacaggcagtgtg

SEQ ID NO: 9064775 - DNA, 21 bp, Homo sapiens
agctggcctggtttgagctcc

SEQ ID NO: 9064776 - DNA, 22 bp, Homo sapiens
agctggctgccttctccttagg

SEQ ID NO: 9064777 - DNA, 22 bp, Homo sapiens
agctggctgccttctccttagg

SEQ ID NO: 9064778 - DNA, 22 bp, Homo sapiens
agctggctggccccttcctgcc

SEQ ID NO: 9064779 - DNA, 22 bp, Homo sapiens
agctggctgccttctccttagg

SEQ ID NO: 9064780 - DNA, 22 bp, Homo sapiens
agctggcctccgggtgcctggg

SEQ ID NO: 9064781 - DNA, 22 bp, Homo sapiens
caggagtcctgaaatctgatga

SEQ ID NO: 9064782 - DNA, 22 bp, Homo sapiens
agctggcatactttgctaggaa

SEQ ID NO: 9064783 - DNA, 22 bp, Homo sapiens
agctggccagatgtcccaaaga

SEQ ID NO: 9064784 - DNA, 22 bp, Homo sapiens
agctggccagcacctccaggtc

SEQ ID NO: 9064785 - DNA, 22 bp, Homo sapiens
agctggcattgcagggagctgc

SEQ ID NO: 9064786 - DNA, 20 bp, Homo sapiens
agctggccaattctattact

SEQ ID NO: 9064787 - DNA, 22 bp, Homo sapiens
caggaggtgacttccaggggtt

SEQ ID NO: 9064788 - DNA, 22 bp, Homo sapiens
caggaggtgaaggagaaccagt

SEQ ID NO: 9064789 - DNA, 22 bp, Homo sapiens
caggaggtacatagattcagat

SEQ ID NO: 9064790 - DNA, 22 bp, Homo sapiens
caggaggttgagggtgcagtga

SEQ ID NO: 9064791 - DNA, 22 bp, Homo sapiens
caggaggttgagggtgcagtga

SEQ ID NO: 9064792 - DNA, 22 bp, Homo sapiens
caggaggtggagctcaagtggt

SEQ ID NO: 9064793 - DNA, 22 bp, Homo sapiens
caggaggttgtaagagcaggcc

SEQ ID NO: 9064794 - DNA, 22 bp, Homo sapiens
caggaggttggtagcagtagat

SEQ ID NO: 9064795 - DNA, 22 bp, Homo sapiens
caggaggttggtagcagtagat

SEQ ID NO: 9064796 - DNA, 22 bp, Homo sapiens
caggaggttggtagcagtagat

SEQ ID NO: 9064797 - DNA, 22 bp, Homo sapiens
caggaggttgtaagagcaggcc

SEQ ID NO: 9064798 - DNA, 22 bp, Homo sapiens
aggagctcatgtggctgcctgt

SEQ ID NO: 9064799 - DNA, 22 bp, Homo sapiens
aggagcgtctgtctgtgtctct

SEQ ID NO: 9064800 - DNA, 22 bp, Homo sapiens
aggagctaattcataagccact

SEQ ID NO: 9064801 - DNA, 18 bp, Homo sapiens
aggagcctttgcactgga

SEQ ID NO: 9064802 - DNA, 19 bp, Homo sapiens
aggagccttgagcagtgag

SEQ ID NO: 9064803 - DNA, 19 bp, Homo sapiens
aggagccttgagcagtgag

SEQ ID NO: 9064804 - DNA, 22 bp, Homo sapiens
aggagcctgtgcctggcactcc

SEQ ID NO: 9064805 - DNA, 22 bp, Homo sapiens
aggagaggtctcccttccccag

SEQ ID NO: 9064806 - DNA, 22 bp, Homo sapiens
aggagaggtctcccttccccag

SEQ ID NO: 9064807 - DNA, 22 bp, Homo sapiens
aggagagggtggcattaagttt

SEQ ID NO: 9064808 - DNA, 22 bp, Homo sapiens
aggagataagaggctggtgtgg

SEQ ID NO: 9064809 - DNA, 22 bp, Homo sapiens
aggagaggcatcaagaaaatcg

SEQ ID NO: 9064810 - DNA, 22 bp, Homo sapiens
aggagaggctctaactctgtgt

SEQ ID NO: 9064811 - DNA, 22 bp, Homo sapiens
aggagaggctctaactctgtgt

SEQ ID NO: 9064812 - DNA, 22 bp, Homo sapiens
aggagaggggtaggattaattt

SEQ ID NO: 9064813 - DNA, 22 bp, Homo sapiens
aggagagggtggcattaagttt

SEQ ID NO: 9064814 - DNA, 22 bp, Homo sapiens
aggagaggggtaggattaattt

SEQ ID NO: 9064815 - DNA, 22 bp, Homo sapiens
aggagaggggtaggattaattt

SEQ ID NO: 9064816 - DNA, 22 bp, Homo sapiens
aggagaggcatcaagaaaatcg

SEQ ID NO: 9064817 - DNA, 22 bp, Homo sapiens
aggagaggcatcaagaaaatcg

SEQ ID NO: 9064818 - DNA, 22 bp, Homo sapiens
aggagaggcatcaagaaaatcg

SEQ ID NO: 9064819 - DNA, 22 bp, Homo sapiens
aggagaggcatcaagaaaatcg

SEQ ID NO: 9064820 - DNA, 22 bp, Homo sapiens
aggagaggaatcattattacaa

SEQ ID NO: 9064821 - DNA, 22 bp, Homo sapiens
aggagaggaatcattattacaa

SEQ ID NO: 9064822 - DNA, 22 bp, Homo sapiens
aggagagaatgttccaggcttg

SEQ ID NO: 9064823 - DNA, 22 bp, Homo sapiens
aggagagaatgttccaggcttg

SEQ ID NO: 9064824 - DNA, 22 bp, Homo sapiens
aggagagaatgttccaggcttg

SEQ ID NO: 9064825 - DNA, 22 bp, Homo sapiens
aggagagagaacacttgggtcc

SEQ ID NO: 9064826 - DNA, 22 bp, Homo sapiens
aggagagagctgagctttgctg

SEQ ID NO: 9064827 - DNA, 22 bp, Homo sapiens
aggagagagctgagctttgctg

SEQ ID NO: 9064828 - DNA, 20 bp, Homo sapiens
aggaggcaatgtagataagc

SEQ ID NO: 9064829 - DNA, 22 bp, Homo sapiens
aggaggaggtgggacacagtga

SEQ ID NO: 9064830 - DNA, 22 bp, Homo sapiens
aggaggaggtaagaaaagcata

SEQ ID NO: 9064831 - DNA, 22 bp, Homo sapiens
aggaggaggtaagaaaagcata

SEQ ID NO: 9064832 - DNA, 22 bp, Homo sapiens
aggaggaatacaatccagcagc

SEQ ID NO: 9064833 - DNA, 22 bp, Homo sapiens
aggaggaggctggagtacaccc

SEQ ID NO: 9064834 - DNA, 22 bp, Homo sapiens
aggagctctcccatgctgcaga

SEQ ID NO: 9064835 - DNA, 22 bp, Homo sapiens
aggagctctgggcagggcctcc

SEQ ID NO: 9064836 - DNA, 22 bp, Homo sapiens
aggagctctgggcagggcctcc

SEQ ID NO: 9064837 - DNA, 22 bp, Homo sapiens
aggagctctgggcagggcctcc

SEQ ID NO: 9064838 - DNA, 22 bp, Homo sapiens
aggagctgaagtctctgcactc

SEQ ID NO: 9064839 - DNA, 22 bp, Homo sapiens
aggagctgaaacttctcatatg

SEQ ID NO: 9064840 - DNA, 22 bp, Homo sapiens
aggagctgaaacttctcatatg

SEQ ID NO: 9064841 - DNA, 22 bp, Homo sapiens
aggagctcttgatgcttgaggg

SEQ ID NO: 9064842 - DNA, 20 bp, Homo sapiens
aggagctgaattagagggtt

SEQ ID NO: 9064843 - DNA, 22 bp, Homo sapiens
aggagctgagggagcgcccttg

SEQ ID NO: 9064844 - DNA, 22 bp, Homo sapiens
aggagctgagggagcgcccttg

SEQ ID NO: 9064845 - DNA, 22 bp, Homo sapiens
aggagctgagtcagcccgacag

SEQ ID NO: 9064846 - DNA, 22 bp, Homo sapiens
aggagctgagtcagcccgacag

SEQ ID NO: 9064847 - DNA, 22 bp, Homo sapiens
aggagctgagtcagcccgacag

SEQ ID NO: 9064848 - DNA, 22 bp, Homo sapiens
aggagctgataaaagggggtca

SEQ ID NO: 9064849 - DNA, 22 bp, Homo sapiens
aggagctgtgaatgggaggggt

SEQ ID NO: 9064850 - DNA, 19 bp, Homo sapiens
aggagaagactctctcccc

SEQ ID NO: 9064851 - DNA, 22 bp, Homo sapiens
cagtctctcttgtagtgcagct

SEQ ID NO: 9064852 - DNA, 22 bp, Homo sapiens
cagtctctctccttgcaggcgt

SEQ ID NO: 9064853 - DNA, 22 bp, Homo sapiens
aggagacagaatttaaatttgg

SEQ ID NO: 9064854 - DNA, 22 bp, Homo sapiens
cagtctctgtgccagatcctgg

SEQ ID NO: 9064855 - DNA, 22 bp, Homo sapiens
cagtctctttatccaccaagcc

SEQ ID NO: 9064856 - DNA, 22 bp, Homo sapiens
cagtctctggtgagttgacagt

SEQ ID NO: 9064857 - DNA, 22 bp, Homo sapiens
aggacagcccccaacagcaaca

SEQ ID NO: 9064858 - DNA, 22 bp, Homo sapiens
aggacagcattttcagcatctc

SEQ ID NO: 9064859 - DNA, 22 bp, Homo sapiens
aggacagcagtgctggcacttg

SEQ ID NO: 9064860 - DNA, 22 bp, Homo sapiens
aggacagcccttgagagcacat

SEQ ID NO: 9064861 - DNA, 21 bp, Homo sapiens
aggagaaacacaggtcagccc

SEQ ID NO: 9064862 - DNA, 22 bp, Homo sapiens
aggagaaatccatcgagaatgg

SEQ ID NO: 9064863 - DNA, 22 bp, Homo sapiens
aggagaaagactggacagccaa

SEQ ID NO: 9064864 - DNA, 22 bp, Homo sapiens
aggagaaagactggacagccaa

SEQ ID NO: 9064865 - DNA, 18 bp, Homo sapiens
aggagaaagggaccaggg

SEQ ID NO: 9064866 - DNA, 22 bp, Homo sapiens
aggaagctggggtgttcttcat

SEQ ID NO: 9064867 - DNA, 22 bp, Homo sapiens
aggaagctggtgtgaggatgaa

SEQ ID NO: 9064868 - DNA, 22 bp, Homo sapiens
aggaagctggtgtgaggatgaa

SEQ ID NO: 9064869 - DNA, 22 bp, Homo sapiens
aggaagctggttacgaagggat

SEQ ID NO: 9064870 - DNA, 22 bp, Homo sapiens
aggaagcttagatttccagatc

SEQ ID NO: 9064871 - DNA, 22 bp, Homo sapiens
aggaagcttagtgaaaggacca

SEQ ID NO: 9064872 - DNA, 23 bp, Homo sapiens
aggaagcttggcaataaggtttg

SEQ ID NO: 9064873 - DNA, 22 bp, Homo sapiens
aggaagcttggggcagggctac

SEQ ID NO: 9064874 - DNA, 22 bp, Homo sapiens
aggaagcttggggcagggctac

SEQ ID NO: 9064875 - DNA, 22 bp, Homo sapiens
aggaagctgctaagaaacaatg

SEQ ID NO: 9064876 - DNA, 22 bp, Homo sapiens
aggaagctgctaagaaacaatg

SEQ ID NO: 9064877 - DNA, 22 bp, Homo sapiens
aggaagctgggaaactgacatt

SEQ ID NO: 9064878 - DNA, 22 bp, Homo sapiens
aggaagctgggaaactgacatt

SEQ ID NO: 9064879 - DNA, 22 bp, Homo sapiens
aggaagctgctggagtagtgtg

SEQ ID NO: 9064880 - DNA, 20 bp, Homo sapiens
aggaagctgagatgtagagg

SEQ ID NO: 9064881 - DNA, 22 bp, Homo sapiens
aggaagctctctgcttttaaga

SEQ ID NO: 9064882 - DNA, 20 bp, Homo sapiens
aggaagctgagatgtagagg

SEQ ID NO: 9064883 - DNA, 20 bp, Homo sapiens
aggaagctgagatgtagagg

SEQ ID NO: 9064884 - DNA, 22 bp, Homo sapiens
aggaagctgcctgggatgggaa

SEQ ID NO: 9064885 - DNA, 22 bp, Homo sapiens
aggaagctgcctgggatgggaa

SEQ ID NO: 9064886 - DNA, 21 bp, Homo sapiens
aggaagctgcccagatagtag

SEQ ID NO: 9064887 - DNA, 22 bp, Homo sapiens
aggaaggaagagacaccatttg

SEQ ID NO: 9064888 - DNA, 19 bp, Homo sapiens
aggaaggaacctgagtctg

SEQ ID NO: 9064889 - DNA, 19 bp, Homo sapiens
aggaaggaacctgagtctg

SEQ ID NO: 9064890 - DNA, 19 bp, Homo sapiens
aggaaggaacctgagtctg

SEQ ID NO: 9064891 - DNA, 19 bp, Homo sapiens
aggaaggaacctgagtctg

SEQ ID NO: 9064892 - DNA, 22 bp, Homo sapiens
aggaagctttatgaccagctaa

SEQ ID NO: 9064893 - DNA, 22 bp, Homo sapiens
aggaagcttggggcagggctac

SEQ ID NO: 9064894 - DNA, 22 bp, Homo sapiens
aggaagcttgtgtgtattggtc

SEQ ID NO: 9064895 - DNA, 22 bp, Homo sapiens
aggaaggactgcagcatttggt

SEQ ID NO: 9064896 - DNA, 22 bp, Homo sapiens
aggaaggactccatggtccgtc

SEQ ID NO: 9064897 - DNA, 20 bp, Homo sapiens
aggaaggaagtttgcatgga

SEQ ID NO: 9064898 - DNA, 22 bp, Homo sapiens
cagtcctgggcacagccctggg

SEQ ID NO: 9064899 - DNA, 22 bp, Homo sapiens
aggacagcagccattggcagtc

SEQ ID NO: 9064900 - DNA, 20 bp, Homo sapiens
aggacagcagctgccacttg

SEQ ID NO: 9064901 - DNA, 20 bp, Homo sapiens
cagtcctgccccttggggac

SEQ ID NO: 9064902 - DNA, 20 bp, Homo sapiens
cagtcctgccccttggggac

SEQ ID NO: 9064903 - DNA, 22 bp, Homo sapiens
cagtcctgcccaggctgacaga

SEQ ID NO: 9064904 - DNA, 22 bp, Homo sapiens
cagtcctgctagtgtgaaaagc

SEQ ID NO: 9064905 - DNA, 20 bp, Homo sapiens
cagtcctgccccttggggac

SEQ ID NO: 9064906 - DNA, 22 bp, Homo sapiens
cagtcctggagcccttcttggc

SEQ ID NO: 9064907 - DNA, 22 bp, Homo sapiens
cagtcctgggagacttacccag

SEQ ID NO: 9064908 - DNA, 22 bp, Homo sapiens
cagtcctgggagacttacccag

SEQ ID NO: 9064909 - DNA, 22 bp, Homo sapiens
cagtcctgctggccttccctgg

SEQ ID NO: 9064910 - DNA, 22 bp, Homo sapiens
cagtcctgctggccttccctgg

SEQ ID NO: 9064911 - DNA, 22 bp, Homo sapiens
cagtcctgctggccttccctgg

SEQ ID NO: 9064912 - DNA, 22 bp, Homo sapiens
cagtcctgagccaatcatgatg

SEQ ID NO: 9064913 - DNA, 22 bp, Homo sapiens
cagtcctgaatactggacggtg

SEQ ID NO: 9064914 - DNA, 22 bp, Homo sapiens
cagtcctgaatactggacggtg

SEQ ID NO: 9064915 - DNA, 22 bp, Homo sapiens
cagtcctgaatactggacggtg

SEQ ID NO: 9064916 - DNA, 17 bp, Homo sapiens
cagtcctctgctctaag

SEQ ID NO: 9064917 - DNA, 22 bp, Homo sapiens
cagtcctgagctcctgggctga

SEQ ID NO: 9064918 - DNA, 22 bp, Homo sapiens
cagtcctgagctcctgggctga

SEQ ID NO: 9064919 - DNA, 22 bp, Homo sapiens
cagtcctgaggaagagctgctg

SEQ ID NO: 9064920 - DNA, 22 bp, Homo sapiens
cagtcctgaggaagagctgctg

SEQ ID NO: 9064921 - DNA, 20 bp, Homo sapiens
cagtcctgcaggcgggagaa

SEQ ID NO: 9064922 - DNA, 21 bp, Homo sapiens
cagtcctgcaaataattcttt

SEQ ID NO: 9064923 - DNA, 20 bp, Homo sapiens
cagtcctgcaggcgggagaa

SEQ ID NO: 9064924 - DNA, 22 bp, Homo sapiens
aggaggcactcactctcagggt

SEQ ID NO: 9064925 - DNA, 17 bp, Homo sapiens
catctttaaaatcctga

SEQ ID NO: 9064926 - DNA, 22 bp, Homo sapiens
aggaggcactcactctcagggt

SEQ ID NO: 9064927 - DNA, 22 bp, Homo sapiens
catgaaaatgtcaagttctgct

SEQ ID NO: 9064928 - DNA, 22 bp, Homo sapiens
catgaaagcaggaatggtttta

SEQ ID NO: 9064929 - DNA, 22 bp, Homo sapiens
catgaaatattagtaactgttt

SEQ ID NO: 9064930 - DNA, 22 bp, Homo sapiens
catgaaatgtgttaatctcttg

SEQ ID NO: 9064931 - DNA, 22 bp, Homo sapiens
catgcacagagcttggtcattg

SEQ ID NO: 9064932 - DNA, 22 bp, Homo sapiens
catgcacactgcaacaaggact

SEQ ID NO: 9064933 - DNA, 22 bp, Homo sapiens
catgagtgagtatctcaagata

SEQ ID NO: 9064934 - DNA, 22 bp, Homo sapiens
catgagtatgattatacccagt

SEQ ID NO: 9064935 - DNA, 22 bp, Homo sapiens
catggccagggagagagaatgt

SEQ ID NO: 9064936 - DNA, 22 bp, Homo sapiens
catggccagggcagatggcagg

SEQ ID NO: 9064937 - DNA, 22 bp, Homo sapiens
catggccaggccaagagagtac

SEQ ID NO: 9064938 - DNA, 22 bp, Homo sapiens
catggccaggcccagggcccag

SEQ ID NO: 9064939 - DNA, 22 bp, Homo sapiens
aggcacaggaggtggtaagaag

SEQ ID NO: 9064940 - DNA, 22 bp, Homo sapiens
aggcacaggaatgtcatccagt

SEQ ID NO: 9064941 - DNA, 22 bp, Homo sapiens
aggcacaggaatgtcatccagt

SEQ ID NO: 9064942 - DNA, 22 bp, Homo sapiens
aggcacaggaatgtcatccagt

SEQ ID NO: 9064943 - DNA, 22 bp, Homo sapiens
aggcaatgcagatagatgaatg

SEQ ID NO: 9064944 - DNA, 22 bp, Homo sapiens
catgcctgtatttctgatctat

SEQ ID NO: 9064945 - DNA, 22 bp, Homo sapiens
catgcctgtatttctgatctat

SEQ ID NO: 9064946 - DNA, 22 bp, Homo sapiens
aggcacaaaagcagggtgacca

SEQ ID NO: 9064947 - DNA, 22 bp, Homo sapiens
aggcacaggaacaggaaaagag

SEQ ID NO: 9064948 - DNA, 22 bp, Homo sapiens
aggcacaggaacaggaaaagag

SEQ ID NO: 9064949 - DNA, 22 bp, Homo sapiens
catgcagcctgtgaacagtgtc

SEQ ID NO: 9064950 - DNA, 22 bp, Homo sapiens
catgcagcggcgtttggtttaa

SEQ ID NO: 9064951 - DNA, 22 bp, Homo sapiens
catgcagatatttttattgtgg

SEQ ID NO: 9064952 - DNA, 22 bp, Homo sapiens
catgcagatgtcatgaggcatg

SEQ ID NO: 9064953 - DNA, 22 bp, Homo sapiens
catgcagataattatattgtgt

SEQ ID NO: 9064954 - DNA, 22 bp, Homo sapiens
catgcagagtttattaccatct

SEQ ID NO: 9064955 - DNA, 22 bp, Homo sapiens
catgcagcaggatctcattccc

SEQ ID NO: 9064956 - DNA, 22 bp, Homo sapiens
catgcagcagaataatgactat

SEQ ID NO: 9064957 - DNA, 22 bp, Homo sapiens
catgcagatgtcatgaggcatg

SEQ ID NO: 9064958 - DNA, 22 bp, Homo sapiens
catgccatttcttctctttatg

SEQ ID NO: 9064959 - DNA, 22 bp, Homo sapiens
catgccatttcttctctttatg

SEQ ID NO: 9064960 - DNA, 22 bp, Homo sapiens
catgccatttttctagattgag

SEQ ID NO: 9064961 - DNA, 22 bp, Homo sapiens
catgccatttggtggattgaga

SEQ ID NO: 9064962 - DNA, 22 bp, Homo sapiens
catgcctgcctggtgggcgtgg

SEQ ID NO: 9064963 - DNA, 20 bp, Homo sapiens
catgcctgctggtatctggc

SEQ ID NO: 9064964 - DNA, 22 bp, Homo sapiens
catgcctgtaatcccagctctt

SEQ ID NO: 9064965 - DNA, 22 bp, Homo sapiens
catgccatttacttggaggaga

SEQ ID NO: 9064966 - DNA, 22 bp, Homo sapiens
catgccattaacattagctagc

SEQ ID NO: 9064967 - DNA, 20 bp, Homo sapiens
catgccatgtctactgaggc

SEQ ID NO: 9064968 - DNA, 22 bp, Homo sapiens
catgccagttttgagatgcacc

SEQ ID NO: 9064969 - DNA, 22 bp, Homo sapiens
catgccaggtttgagtatcttg

SEQ ID NO: 9064970 - DNA, 22 bp, Homo sapiens
aggcagcatttgaatccaggtc

SEQ ID NO: 9064971 - DNA, 22 bp, Homo sapiens
aggcagcatttgaatccaggtc

SEQ ID NO: 9064972 - DNA, 22 bp, Homo sapiens
aggcagccaatcagaggctgac

SEQ ID NO: 9064973 - DNA, 22 bp, Homo sapiens
aggcagccaatcagaggctgac

SEQ ID NO: 9064974 - DNA, 22 bp, Homo sapiens
aggcagccacatgagctcctga

SEQ ID NO: 9064975 - DNA, 22 bp, Homo sapiens
aggcagccagatggcagcctgc

SEQ ID NO: 9064976 - DNA, 22 bp, Homo sapiens
aggcagccagttcaggtttctt

SEQ ID NO: 9064977 - DNA, 22 bp, Homo sapiens
aggcagcatttgaatccaggtc

SEQ ID NO: 9064978 - DNA, 19 bp, Homo sapiens
aggcagcattctggggctt

SEQ ID NO: 9064979 - DNA, 22 bp, Homo sapiens
aggcagcagtcatgaggaaaga

SEQ ID NO: 9064980 - DNA, 22 bp, Homo sapiens
aggcagcagtcatgaggaaaga

SEQ ID NO: 9064981 - DNA, 22 bp, Homo sapiens
aggcagcatttctgcttatcca

SEQ ID NO: 9064982 - DNA, 22 bp, Homo sapiens
aggcagcatttctgcttatcca

SEQ ID NO: 9064983 - DNA, 22 bp, Homo sapiens
aggcagcatttctgcttatcca

SEQ ID NO: 9064984 - DNA, 19 bp, Homo sapiens
aggcagcattctggggctt

SEQ ID NO: 9064985 - DNA, 19 bp, Homo sapiens
aggcagcattctggggctt

SEQ ID NO: 9064986 - DNA, 19 bp, Homo sapiens
aggcagcattctggggctt

SEQ ID NO: 9064987 - DNA, 19 bp, Homo sapiens
aggcagcattctggggctt

SEQ ID NO: 9064988 - DNA, 22 bp, Homo sapiens
catttacatttaaggttaatat

SEQ ID NO: 9064989 - DNA, 21 bp, Homo sapiens
catttacatgacagattggtt

SEQ ID NO: 9064990 - DNA, 21 bp, Homo sapiens
catttacatgacagattggtt

SEQ ID NO: 9064991 - DNA, 21 bp, Homo sapiens
catttacatgacagattggtt

SEQ ID NO: 9064992 - DNA, 22 bp, Homo sapiens
catttacatttaaggttaatat

SEQ ID NO: 9064993 - DNA, 22 bp, Homo sapiens
catttacatttaaggttaatat

SEQ ID NO: 9064994 - DNA, 22 bp, Homo sapiens
catttacagtgagagtttttac

SEQ ID NO: 9064995 - DNA, 22 bp, Homo sapiens
catttacagcagactgatgaaa

SEQ ID NO: 9064996 - DNA, 22 bp, Homo sapiens
catttacagcagactgatgaaa

SEQ ID NO: 9064997 - DNA, 22 bp, Homo sapiens
catttacagcagactgatgaaa

SEQ ID NO: 9064998 - DNA, 21 bp, Homo sapiens
aggcagcaggatccagggaca

SEQ ID NO: 9064999 - DNA, 22 bp, Homo sapiens
aggcagcagcttgctggttgcc

SEQ ID NO: 9065000 - DNA, 22 bp, Homo sapiens
catttacataacagtaacgctg

SEQ ID NO: 9065001 - DNA, 22 bp, Homo sapiens
catttacataacagtaacgctg

SEQ ID NO: 9065002 - DNA, 22 bp, Homo sapiens
catttacagtgagagtttttac

SEQ ID NO: 9065003 - DNA, 22 bp, Homo sapiens
catttacagtgagagtttttac

SEQ ID NO: 9065004 - DNA, 22 bp, Homo sapiens
catttacataacagtaacgctg

SEQ ID NO: 9065005 - DNA, 21 bp, Homo sapiens
catttacatgacagattggtt

SEQ ID NO: 9065006 - DNA, 22 bp, Homo sapiens
aggcagcagaaaacaaatggtt

SEQ ID NO: 9065007 - DNA, 19 bp, Homo sapiens
aggcagcacccagtccttg

SEQ ID NO: 9065008 - DNA, 22 bp, Homo sapiens
aggcagcagaaaacaaatggtt

SEQ ID NO: 9065009 - DNA, 22 bp, Homo sapiens
aggcagcagactgttaatcaga

SEQ ID NO: 9065010 - DNA, 22 bp, Homo sapiens
aggcagcagactgttaatcaga

SEQ ID NO: 9065011 - DNA, 22 bp, Homo sapiens
aggcagcagaggttgaggaaag

SEQ ID NO: 9065012 - DNA, 22 bp, Homo sapiens
aggcagcagaggttgaggaaag

SEQ ID NO: 9065013 - DNA, 18 bp, Homo sapiens
aggcagcagcatcttctc

SEQ ID NO: 9065014 - DNA, 22 bp, Homo sapiens
aggcagcagcttgctggttgcc

SEQ ID NO: 9065015 - DNA, 22 bp, Homo sapiens
aggcagcagccacaaggcctga

SEQ ID NO: 9065016 - DNA, 22 bp, Homo sapiens
aggcagcagccacaaggcctga

SEQ ID NO: 9065017 - DNA, 22 bp, Homo sapiens
aggcagcagccacaaggcctga

SEQ ID NO: 9065018 - DNA, 18 bp, Homo sapiens
aggcagcagcatcttctc

SEQ ID NO: 9065019 - DNA, 22 bp, Homo sapiens
cattattgatgcaacagccctt

SEQ ID NO: 9065020 - DNA, 22 bp, Homo sapiens
cattattgccagccatactgaa

SEQ ID NO: 9065021 - DNA, 22 bp, Homo sapiens
cattatgttcagtagcttaaaa

SEQ ID NO: 9065022 - DNA, 22 bp, Homo sapiens
cattatggaagtgaagagctct

SEQ ID NO: 9065023 - DNA, 22 bp, Homo sapiens
cattatggaagacagtgtggtg

SEQ ID NO: 9065024 - DNA, 22 bp, Homo sapiens
cattatggcagccaggatattg

SEQ ID NO: 9065025 - DNA, 20 bp, Homo sapiens
cattatggttgggcacagtg

SEQ ID NO: 9065026 - DNA, 22 bp, Homo sapiens
cattatgtgcgtacatgtatct

SEQ ID NO: 9065027 - DNA, 22 bp, Homo sapiens
catggctcacaggatgggctag

SEQ ID NO: 9065028 - DNA, 22 bp, Homo sapiens
cattaagatttttttctactgg

SEQ ID NO: 9065029 - DNA, 22 bp, Homo sapiens
cattaagatgcaaacctaacta

SEQ ID NO: 9065030 - DNA, 22 bp, Homo sapiens
catggccttgagtgactgcact

SEQ ID NO: 9065031 - DNA, 22 bp, Homo sapiens
catggccctcttctggagcaat

SEQ ID NO: 9065032 - DNA, 22 bp, Homo sapiens
catggccctcttctggagcaat

SEQ ID NO: 9065033 - DNA, 22 bp, Homo sapiens
catggcctcaaaggactgcaga

SEQ ID NO: 9065034 - DNA, 19 bp, Homo sapiens
aggcagcacccagtccttg

SEQ ID NO: 9065035 - DNA, 19 bp, Homo sapiens
aggcagcacccagtccttg

SEQ ID NO: 9065036 - DNA, 19 bp, Homo sapiens
aggcagcacccagtccttg

SEQ ID NO: 9065037 - DNA, 19 bp, Homo sapiens
aggcagaggcttggctagc

SEQ ID NO: 9065038 - DNA, 23 bp, Homo sapiens
cattcctgatatggccacaagag

SEQ ID NO: 9065039 - DNA, 20 bp, Homo sapiens
cattcctgaggaattcatgt

SEQ ID NO: 9065040 - DNA, 22 bp, Homo sapiens
cattcctggacaaacatcaaaa

SEQ ID NO: 9065041 - DNA, 22 bp, Homo sapiens
cattccttaacgtggggagtct

SEQ ID NO: 9065042 - DNA, 22 bp, Homo sapiens
cattcctacatgataagaatta

SEQ ID NO: 9065043 - DNA, 22 bp, Homo sapiens
cattccagctctcatactctgg

SEQ ID NO: 9065044 - DNA, 22 bp, Homo sapiens
cattccagagctgcctctgcta

SEQ ID NO: 9065045 - DNA, 22 bp, Homo sapiens
cattccaagtatatacatgata

SEQ ID NO: 9065046 - DNA, 22 bp, Homo sapiens
cattccaaggccaagtctaaga

SEQ ID NO: 9065047 - DNA, 22 bp, Homo sapiens
cattccaaggccaagtctaaga

SEQ ID NO: 9065048 - DNA, 22 bp, Homo sapiens
cattcaaaagctccatgtttgt

SEQ ID NO: 9065049 - DNA, 22 bp, Homo sapiens
cattcaaaagctccatgtttgt

SEQ ID NO: 9065050 - DNA, 22 bp, Homo sapiens
cattcaaaagctccatgtttgt

SEQ ID NO: 9065051 - DNA, 22 bp, Homo sapiens
cattcaaaatgggctgacctgt

SEQ ID NO: 9065052 - DNA, 22 bp, Homo sapiens
cattcaaaatgggctgacctgt

SEQ ID NO: 9065053 - DNA, 22 bp, Homo sapiens
cattcaaaagctccatgtttgt

SEQ ID NO: 9065054 - DNA, 22 bp, Homo sapiens
cattcaaaagctccatgtttgt

SEQ ID NO: 9065055 - DNA, 22 bp, Homo sapiens
cattattgccagccatactgaa

SEQ ID NO: 9065056 - DNA, 20 bp, Homo sapiens
cattattgtaatcagctgta

SEQ ID NO: 9065057 - DNA, 22 bp, Homo sapiens
cattcaaagcaggaaaggcctt

SEQ ID NO: 9065058 - DNA, 22 bp, Homo sapiens
cattcaaacattaatttattca

SEQ ID NO: 9065059 - DNA, 22 bp, Homo sapiens
cattcaaacattaatttattca

SEQ ID NO: 9065060 - DNA, 22 bp, Homo sapiens
cattcaaagcaggaaaggcctt

SEQ ID NO: 9065061 - DNA, 22 bp, Homo sapiens
cattcaaacattaatttattca

SEQ ID NO: 9065062 - DNA, 22 bp, Homo sapiens
cattcaaacattaatttattca

SEQ ID NO: 9065063 - DNA, 22 bp, Homo sapiens
agtatatggggaattgcataat

SEQ ID NO: 9065064 - DNA, 22 bp, Homo sapiens
agtatattggtgttattcctca

SEQ ID NO: 9065065 - DNA, 22 bp, Homo sapiens
agtatatttgttaagattattc

SEQ ID NO: 9065066 - DNA, 22 bp, Homo sapiens
cggctcactgcagctccgcctc

SEQ ID NO: 9065067 - DNA, 22 bp, Homo sapiens
cggctcactgcagctccgcctc

SEQ ID NO: 9065068 - DNA, 22 bp, Homo sapiens
cggccttggtcggcccacagct

SEQ ID NO: 9065069 - DNA, 22 bp, Homo sapiens
cggccttctccctgggcatcac

SEQ ID NO: 9065070 - DNA, 22 bp, Homo sapiens
cggccttgacaagcttagcagc

SEQ ID NO: 9065071 - DNA, 22 bp, Homo sapiens
cggccttgcgcggagcagaggg

SEQ ID NO: 9065072 - DNA, 22 bp, Homo sapiens
cggccgcagcagtgtcggccca

SEQ ID NO: 9065073 - DNA, 19 bp, Homo sapiens
cggcccctcctctcgcgcc

SEQ ID NO: 9065074 - DNA, 22 bp, Homo sapiens
cggagaggtgggggcagcatct

SEQ ID NO: 9065075 - DNA, 22 bp, Homo sapiens
cggagctgcgccgggacacggg

SEQ ID NO: 9065076 - DNA, 22 bp, Homo sapiens
cggagctgcgccgggacacggg

SEQ ID NO: 9065077 - DNA, 22 bp, Homo sapiens
cggagctgcctgccaagcctgc

SEQ ID NO: 9065078 - DNA, 22 bp, Homo sapiens
cggagctgcctgccaagcctgc

SEQ ID NO: 9065079 - DNA, 21 bp, Homo sapiens
cggagctgggcagggcatccc

SEQ ID NO: 9065080 - DNA, 22 bp, Homo sapiens
cctttattcaattagtcctaat

SEQ ID NO: 9065081 - DNA, 22 bp, Homo sapiens
cctttggtggttttcagagatc

SEQ ID NO: 9065082 - DNA, 22 bp, Homo sapiens
cctttgtgaatatgcagaaaat

SEQ ID NO: 9065083 - DNA, 22 bp, Homo sapiens
cctttgtgaggtcctgtggggg

SEQ ID NO: 9065084 - DNA, 22 bp, Homo sapiens
cctttgtatacagttcttgtga

SEQ ID NO: 9065085 - DNA, 22 bp, Homo sapiens
cctttgtatttacctagtctca

SEQ ID NO: 9065086 - DNA, 22 bp, Homo sapiens
cctttgtaccttaaatcctgtg

SEQ ID NO: 9065087 - DNA, 22 bp, Homo sapiens
cctttgtactctggtccaaact

SEQ ID NO: 9065088 - DNA, 22 bp, Homo sapiens
cctttgtaagatgtgaagactg

SEQ ID NO: 9065089 - DNA, 22 bp, Homo sapiens
cctttgttctgtgtatctttgt

SEQ ID NO: 9065090 - DNA, 22 bp, Homo sapiens
cctttgtggtggcccagtgtgg

SEQ ID NO: 9065091 - DNA, 22 bp, Homo sapiens
cctttgtggggcggtgggtaat

SEQ ID NO: 9065092 - DNA, 22 bp, Homo sapiens
aggtgggggctgtgtccttgac

SEQ ID NO: 9065093 - DNA, 22 bp, Homo sapiens
aggtgggggctgtgtccttgac

SEQ ID NO: 9065094 - DNA, 22 bp, Homo sapiens
cgaggaagaagtttgagtcaag

SEQ ID NO: 9065095 - DNA, 22 bp, Homo sapiens
cgaggaagaagtttgagtcaag

SEQ ID NO: 9065096 - DNA, 22 bp, Homo sapiens
cgaggcaggcaggcggaggata

SEQ ID NO: 9065097 - DNA, 22 bp, Homo sapiens
cgaggcaggcaggcggaggata

SEQ ID NO: 9065098 - DNA, 22 bp, Homo sapiens
cgaggcagaggctgaaacggct

SEQ ID NO: 9065099 - DNA, 22 bp, Homo sapiens
cgaggcagacaaaagttggaag

SEQ ID NO: 9065100 - DNA, 22 bp, Homo sapiens
cgaggcagacaaaagttggaag

SEQ ID NO: 9065101 - DNA, 22 bp, Homo sapiens
aggtgctggagtagaagaaaaa

SEQ ID NO: 9065102 - DNA, 17 bp, Homo sapiens
aggtgctggagcatcag

SEQ ID NO: 9065103 - DNA, 17 bp, Homo sapiens
aggtgctggagcatcag

SEQ ID NO: 9065104 - DNA, 22 bp, Homo sapiens
aggtgctgaactggtgaggtct

SEQ ID NO: 9065105 - DNA, 22 bp, Homo sapiens
aggtgctggcgccccaggagac

SEQ ID NO: 9065106 - DNA, 22 bp, Homo sapiens
aggtgctgggcagcagtcattg

SEQ ID NO: 9065107 - DNA, 21 bp, Homo sapiens
aggtgctggcgccccaggaga

SEQ ID NO: 9065108 - DNA, 22 bp, Homo sapiens
aggtgctggagtctgggcagga

SEQ ID NO: 9065109 - DNA, 22 bp, Homo sapiens
aggtgctggagtctgggcagga

SEQ ID NO: 9065110 - DNA, 22 bp, Homo sapiens
aggtggcagttgtggaaccatc

SEQ ID NO: 9065111 - DNA, 22 bp, Homo sapiens
aggtgctgtttgtcagcagttt

SEQ ID NO: 9065112 - DNA, 22 bp, Homo sapiens
aggtgctgtttgtcagcagttt

SEQ ID NO: 9065113 - DNA, 22 bp, Homo sapiens
aggtgctgttggcagcgggcag

SEQ ID NO: 9065114 - DNA, 19 bp, Homo sapiens
aggtgctggtgagggtgtt

SEQ ID NO: 9065115 - DNA, 22 bp, Homo sapiens
aggtgctgggcagcagtcattg

SEQ ID NO: 9065116 - DNA, 22 bp, Homo sapiens
aggtgcctatctggtctctgca

SEQ ID NO: 9065117 - DNA, 22 bp, Homo sapiens
aggtgcctatctggtctctgca

SEQ ID NO: 9065118 - DNA, 22 bp, Homo sapiens
aggtgcctgggagctccctgag

SEQ ID NO: 9065119 - DNA, 22 bp, Homo sapiens
aggtgcctgtcgtctctggtta

SEQ ID NO: 9065120 - DNA, 22 bp, Homo sapiens
aggtgccagctctcaggcagga

SEQ ID NO: 9065121 - DNA, 22 bp, Homo sapiens
aggtgccagctctcaggcagga

SEQ ID NO: 9065122 - DNA, 22 bp, Homo sapiens
aggtgccagtgctgtggtcccc

SEQ ID NO: 9065123 - DNA, 22 bp, Homo sapiens
cctgggagaactgctgggttgg

SEQ ID NO: 9065124 - DNA, 22 bp, Homo sapiens
cctgggagaactgctgggttgg

SEQ ID NO: 9065125 - DNA, 22 bp, Homo sapiens
cctgggactcggccaggacaga

SEQ ID NO: 9065126 - DNA, 22 bp, Homo sapiens
ccttggctgaggagggagctga

SEQ ID NO: 9065127 - DNA, 22 bp, Homo sapiens
aggtggggctgggaaagattcc

SEQ ID NO: 9065128 - DNA, 22 bp, Homo sapiens
ccttggattttgtgcccacgcc

SEQ ID NO: 9065129 - DNA, 22 bp, Homo sapiens
ccttggcatcctctgaagaaat

SEQ ID NO: 9065130 - DNA, 22 bp, Homo sapiens
ccttgctctcccaagcccgcag

SEQ ID NO: 9065131 - DNA, 22 bp, Homo sapiens
ccttgctcaagctagtgacggg

SEQ ID NO: 9065132 - DNA, 22 bp, Homo sapiens
ccttgctcaagctagtgacggg

SEQ ID NO: 9065133 - DNA, 19 bp, Homo sapiens
ccttggagttccaggtgga

SEQ ID NO: 9065134 - DNA, 22 bp, Homo sapiens
ccttgctgttagcctacattat

SEQ ID NO: 9065135 - DNA, 22 bp, Homo sapiens
aggtggcttctggccaggtgtg

SEQ ID NO: 9065136 - DNA, 22 bp, Homo sapiens
aggtgggaacccagcagggccc

SEQ ID NO: 9065137 - DNA, 22 bp, Homo sapiens
aggtgggacccgtggggtgcga

SEQ ID NO: 9065138 - DNA, 22 bp, Homo sapiens
aggtggctggtccaggctgcag

SEQ ID NO: 9065139 - DNA, 22 bp, Homo sapiens
aggtggctgtattcagctgtaa

SEQ ID NO: 9065140 - DNA, 22 bp, Homo sapiens
aggtggctggtccaggctgcag

SEQ ID NO: 9065141 - DNA, 22 bp, Homo sapiens
aggtggctgaagagtgggtgag

SEQ ID NO: 9065142 - DNA, 21 bp, Homo sapiens
aggtggctgcatcctcagaag

SEQ ID NO: 9065143 - DNA, 21 bp, Homo sapiens
aggtggctgcatcctcagaag

SEQ ID NO: 9065144 - DNA, 22 bp, Homo sapiens
cctctgcacttcaccttagctc

SEQ ID NO: 9065145 - DNA, 22 bp, Homo sapiens
cctctgcacttcaccttagctc

SEQ ID NO: 9065146 - DNA, 22 bp, Homo sapiens
cctctgccacctcccacgaggc

SEQ ID NO: 9065147 - DNA, 22 bp, Homo sapiens
cctctgagtgctttgagggaga

SEQ ID NO: 9065148 - DNA, 22 bp, Homo sapiens
cctgcccccgtcagaggtgatg

SEQ ID NO: 9065149 - DNA, 22 bp, Homo sapiens
cctgcccctcaaggcctggtgc

SEQ ID NO: 9065150 - DNA, 22 bp, Homo sapiens
cctgcccatactgacctctaat

SEQ ID NO: 9065151 - DNA, 22 bp, Homo sapiens
cctgccctatgaccagcttcac

SEQ ID NO: 9065152 - DNA, 22 bp, Homo sapiens
cctgccctatgaccagcttcac

SEQ ID NO: 9065153 - DNA, 22 bp, Homo sapiens
cctgccctagagatgacacaat

SEQ ID NO: 9065154 - DNA, 22 bp, Homo sapiens
cctgccctagagatgacacaat

SEQ ID NO: 9065155 - DNA, 22 bp, Homo sapiens
cctgccctagagatgacacaat

SEQ ID NO: 9065156 - DNA, 22 bp, Homo sapiens
cctgccctaatccagagactag

SEQ ID NO: 9065157 - DNA, 22 bp, Homo sapiens
cctgccctaatccagagactag

SEQ ID NO: 9065158 - DNA, 22 bp, Homo sapiens
cctgccaggacattgcttgaag

SEQ ID NO: 9065159 - DNA, 19 bp, Homo sapiens
cctctgccagcccgcctct

SEQ ID NO: 9065160 - DNA, 23 bp, Homo sapiens
cctgcccaggaatccggcggcgt

SEQ ID NO: 9065161 - DNA, 22 bp, Homo sapiens
cctgcccagggtcaccacagag

SEQ ID NO: 9065162 - DNA, 22 bp, Homo sapiens
agggtcctgagcctggggcgca

SEQ ID NO: 9065163 - DNA, 22 bp, Homo sapiens
agggtcctgagcctggggcgca

SEQ ID NO: 9065164 - DNA, 21 bp, Homo sapiens
agggtcctacagggctcagga

SEQ ID NO: 9065165 - DNA, 21 bp, Homo sapiens
agggtcctacagggctcagga

SEQ ID NO: 9065166 - DNA, 22 bp, Homo sapiens
agggtccttctgttcctgagca

SEQ ID NO: 9065167 - DNA, 22 bp, Homo sapiens
agggtcctgggtgcagttgctt

SEQ ID NO: 9065168 - DNA, 22 bp, Homo sapiens
agggtcagagatcggccatgtg

SEQ ID NO: 9065169 - DNA, 20 bp, Homo sapiens
agggtcagagagcgtgagtg

SEQ ID NO: 9065170 - DNA, 21 bp, Homo sapiens
agggtcaggaaccagggtacc

SEQ ID NO: 9065171 - DNA, 22 bp, Homo sapiens
agggtgaatctcacaactctta

SEQ ID NO: 9065172 - DNA, 23 bp, Homo sapiens
agggtgagcaagctatggagacc

SEQ ID NO: 9065173 - DNA, 22 bp, Homo sapiens
agggtgaatctcacaactctta

SEQ ID NO: 9065174 - DNA, 22 bp, Homo sapiens
agggtgaatctcacaactctta

SEQ ID NO: 9065175 - DNA, 22 bp, Homo sapiens
agggtgaatctcacaactctta

SEQ ID NO: 9065176 - DNA, 22 bp, Homo sapiens
agggtctttcctgggagccagc

SEQ ID NO: 9065177 - DNA, 22 bp, Homo sapiens
agggtctgttgtttgttctgga

SEQ ID NO: 9065178 - DNA, 22 bp, Homo sapiens
agggtctgtggatgcatctggg

SEQ ID NO: 9065179 - DNA, 22 bp, Homo sapiens
agggtctgtggatgcatctggg

SEQ ID NO: 9065180 - DNA, 22 bp, Homo sapiens
agggtctgtatttctggcaagc

SEQ ID NO: 9065181 - DNA, 22 bp, Homo sapiens
agggtctgtatttctggcaagc

SEQ ID NO: 9065182 - DNA, 22 bp, Homo sapiens
agggtctgaccaccagtaggga

SEQ ID NO: 9065183 - DNA, 22 bp, Homo sapiens
agggtctgacaatgtgacttag

SEQ ID NO: 9065184 - DNA, 22 bp, Homo sapiens
agggtctcttgccatgcctcag

SEQ ID NO: 9065185 - DNA, 22 bp, Homo sapiens
agggtctgaccaccagtaggga

SEQ ID NO: 9065186 - DNA, 22 bp, Homo sapiens
agggtctgaccaccagtaggga

SEQ ID NO: 9065187 - DNA, 22 bp, Homo sapiens
agggtctgactcctctggcaag

SEQ ID NO: 9065188 - DNA, 20 bp, Homo sapiens
agggtctgatgtggtggccc

SEQ ID NO: 9065189 - DNA, 20 bp, Homo sapiens
agggtctgatgtggtggccc

SEQ ID NO: 9065190 - DNA, 22 bp, Homo sapiens
agggtctgactcctctggcaag

SEQ ID NO: 9065191 - DNA, 22 bp, Homo sapiens
cctggccacccagccttggcca

SEQ ID NO: 9065192 - DNA, 22 bp, Homo sapiens
cctggccactcaggtgtggggc

SEQ ID NO: 9065193 - DNA, 19 bp, Homo sapiens
cctggccagacttctgccc

SEQ ID NO: 9065194 - DNA, 22 bp, Homo sapiens
cctggccacagggctctgcatt

SEQ ID NO: 9065195 - DNA, 22 bp, Homo sapiens
cctggccacagggctctgcatt

SEQ ID NO: 9065196 - DNA, 21 bp, Homo sapiens
cctggccaatctgatagggtt

SEQ ID NO: 9065197 - DNA, 22 bp, Homo sapiens
cctggcagctcctccccggcgg

SEQ ID NO: 9065198 - DNA, 22 bp, Homo sapiens
cctggcagctgtttggcttggc

SEQ ID NO: 9065199 - DNA, 22 bp, Homo sapiens
cctggccaatctagggctgtta

SEQ ID NO: 9065200 - DNA, 22 bp, Homo sapiens
cctggctggtggcagcgacaag

SEQ ID NO: 9065201 - DNA, 22 bp, Homo sapiens
cctgggaagtcagccaaggacg

SEQ ID NO: 9065202 - DNA, 22 bp, Homo sapiens
cctgggaagtcagccaaggacg

SEQ ID NO: 9065203 - DNA, 23 bp, Homo sapiens
cctggctggattctctgcattca

SEQ ID NO: 9065204 - DNA, 22 bp, Homo sapiens
cctggctgcttcctctgccatg

SEQ ID NO: 9065205 - DNA, 22 bp, Homo sapiens
cctggctgctttcactatggag

SEQ ID NO: 9065206 - DNA, 22 bp, Homo sapiens
cctggctctgtcctcgcgcaaa

SEQ ID NO: 9065207 - DNA, 22 bp, Homo sapiens
cctggctcttcagaggttccta

SEQ ID NO: 9065208 - DNA, 22 bp, Homo sapiens
cctggaccaaacactggcctgg

SEQ ID NO: 9065209 - DNA, 22 bp, Homo sapiens
cctggaagtcattcctcgttcc

SEQ ID NO: 9065210 - DNA, 22 bp, Homo sapiens
cctggcagcgtgccgagctgcg

SEQ ID NO: 9065211 - DNA, 22 bp, Homo sapiens
cctggaaatgcaaaagccatga

SEQ ID NO: 9065212 - DNA, 22 bp, Homo sapiens
cctggaaagcggttcattttgt

SEQ ID NO: 9065213 - DNA, 22 bp, Homo sapiens
cctggaaagaggaaggaagcct

SEQ ID NO: 9065214 - DNA, 22 bp, Homo sapiens
cctgctgctatgaaggtgacag

SEQ ID NO: 9065215 - DNA, 22 bp, Homo sapiens
cctgctcttatagctgtttcca

SEQ ID NO: 9065216 - DNA, 22 bp, Homo sapiens
cctgctcttatagctgtttcca

SEQ ID NO: 9065217 - DNA, 22 bp, Homo sapiens
cctgcctggcttccagaagaga

SEQ ID NO: 9065218 - DNA, 22 bp, Homo sapiens
cctgcctggcttccagaagaga

SEQ ID NO: 9065219 - DNA, 22 bp, Homo sapiens
cctgctctaaatctcatggaac

SEQ ID NO: 9065220 - DNA, 22 bp, Homo sapiens
cctgctctggtttagtcagtct

SEQ ID NO: 9065221 - DNA, 22 bp, Homo sapiens
cctgctctgccaagtcctcttt

SEQ ID NO: 9065222 - DNA, 22 bp, Homo sapiens
ctcttagtaatgccatgaagca

SEQ ID NO: 9065223 - DNA, 22 bp, Homo sapiens
ctcttagctgctgttctttgag

SEQ ID NO: 9065224 - DNA, 21 bp, Homo sapiens
ctcttgctgatgtctccttta

SEQ ID NO: 9065225 - DNA, 22 bp, Homo sapiens
ctcttgaactttctagtttcat

SEQ ID NO: 9065226 - DNA, 22 bp, Homo sapiens
ctcttgaaaattggaacacaga

SEQ ID NO: 9065227 - DNA, 22 bp, Homo sapiens
agtggtggagccaggaaatgtg

SEQ ID NO: 9065228 - DNA, 22 bp, Homo sapiens
agtgtaaagctgtatatgtgcc

SEQ ID NO: 9065229 - DNA, 22 bp, Homo sapiens
agtgtaaacttaagagaatatc

SEQ ID NO: 9065230 - DNA, 22 bp, Homo sapiens
agtggtgctgcgcgcggagctc

SEQ ID NO: 9065231 - DNA, 22 bp, Homo sapiens
agtggtgaggggcatgtgtgat

SEQ ID NO: 9065232 - DNA, 22 bp, Homo sapiens
ctctgtgaacccctcctttctt

SEQ ID NO: 9065233 - DNA, 22 bp, Homo sapiens
ctctgtctatcccattctgtgc

SEQ ID NO: 9065234 - DNA, 22 bp, Homo sapiens
ctctgtccttgcacagttccta

SEQ ID NO: 9065235 - DNA, 22 bp, Homo sapiens
ctctgtgattctcatgtaccac

SEQ ID NO: 9065236 - DNA, 18 bp, Homo sapiens
ctctgtcataagtgtcat

SEQ ID NO: 9065237 - DNA, 22 bp, Homo sapiens
ctctgtcccagacccacctctc

SEQ ID NO: 9065238 - DNA, 22 bp, Homo sapiens
ctctgtcccagacccacctctc

SEQ ID NO: 9065239 - DNA, 22 bp, Homo sapiens
ctctgtcctccacctgctttca

SEQ ID NO: 9065240 - DNA, 22 bp, Homo sapiens
ctctgtcctggtttatactggc

SEQ ID NO: 9065241 - DNA, 22 bp, Homo sapiens
ctctgtcctatgcttgatagaa

SEQ ID NO: 9065242 - DNA, 22 bp, Homo sapiens
agtggctgtcttccaaaatctg

SEQ ID NO: 9065243 - DNA, 23 bp, Homo sapiens
ctctggagatcctctgcctgggt

SEQ ID NO: 9065244 - DNA, 22 bp, Homo sapiens
ctctggagaacgctatggatct

SEQ ID NO: 9065245 - DNA, 22 bp, Homo sapiens
ctctggagaacgctatggatct

SEQ ID NO: 9065246 - DNA, 22 bp, Homo sapiens
ctctggagaactccttgtgtct

SEQ ID NO: 9065247 - DNA, 22 bp, Homo sapiens
ctctgctgcaggaaggcgtgca

SEQ ID NO: 9065248 - DNA, 22 bp, Homo sapiens
ctctgctgcaggaaggcgtgca

SEQ ID NO: 9065249 - DNA, 19 bp, Homo sapiens
ctctggagaacaatagtgc

SEQ ID NO: 9065250 - DNA, 22 bp, Homo sapiens
ctctggacagcaggtgctgtgg

SEQ ID NO: 9065251 - DNA, 22 bp, Homo sapiens
agtgggagaatgaataagggcc

SEQ ID NO: 9065252 - DNA, 22 bp, Homo sapiens
ctctggggttagatctgatgct

SEQ ID NO: 9065253 - DNA, 22 bp, Homo sapiens
ctctgtagaaagagcccaggtg

SEQ ID NO: 9065254 - DNA, 22 bp, Homo sapiens
ctctgtagaaacagggcagaag

SEQ ID NO: 9065255 - DNA, 22 bp, Homo sapiens
ctctgtaccttaaaagggcttt

SEQ ID NO: 9065256 - DNA, 22 bp, Homo sapiens
agtggcttggctgcactacagg

SEQ ID NO: 9065257 - DNA, 22 bp, Homo sapiens
agtggctttttagtggcagatg

SEQ ID NO: 9065258 - DNA, 22 bp, Homo sapiens
agtggctgtttataggtgggta

SEQ ID NO: 9065259 - DNA, 22 bp, Homo sapiens
agtggctgtttataggtgggta

SEQ ID NO: 9065260 - DNA, 22 bp, Homo sapiens
agtggctgtgaaatacatggga

SEQ ID NO: 9065261 - DNA, 22 bp, Homo sapiens
agtggctgttcattttacacaa

SEQ ID NO: 9065262 - DNA, 22 bp, Homo sapiens
agtggctgttccaggtgaggac

SEQ ID NO: 9065263 - DNA, 22 bp, Homo sapiens
agtggctgttccaggtgaggac

SEQ ID NO: 9065264 - DNA, 22 bp, Homo sapiens
ctcgcatgccctgcctcatcca

SEQ ID NO: 9065265 - DNA, 22 bp, Homo sapiens
ctcggagggcaacagaagtgct

SEQ ID NO: 9065266 - DNA, 22 bp, Homo sapiens
ctcggaatggaacaacagcggt

SEQ ID NO: 9065267 - DNA, 18 bp, Homo sapiens
ctccttggagaagaggcc

SEQ ID NO: 9065268 - DNA, 22 bp, Homo sapiens
ctcctttgatcccaaatgaccc

SEQ ID NO: 9065269 - DNA, 18 bp, Homo sapiens
ctcctttccctacacctc

SEQ ID NO: 9065270 - DNA, 22 bp, Homo sapiens
ctccttggtgtagtactgagca

SEQ ID NO: 9065271 - DNA, 22 bp, Homo sapiens
ctccttctgggcctggcagtgg

SEQ ID NO: 9065272 - DNA, 22 bp, Homo sapiens
ctcctgcatgctcacatatgcc

SEQ ID NO: 9065273 - DNA, 17 bp, Homo sapiens
ctcctgagtgaaaggga

SEQ ID NO: 9065274 - DNA, 22 bp, Homo sapiens
ctcctgagtagtagcattgtca

SEQ ID NO: 9065275 - DNA, 22 bp, Homo sapiens
ctcctgagtagtagcattgtca

SEQ ID NO: 9065276 - DNA, 22 bp, Homo sapiens
agtgctggagggaggcaggttc

SEQ ID NO: 9065277 - DNA, 22 bp, Homo sapiens
agtgctggattacaggcgtgag

SEQ ID NO: 9065278 - DNA, 22 bp, Homo sapiens
agtgctggattacaggcgtgag

SEQ ID NO: 9065279 - DNA, 22 bp, Homo sapiens
agtgctggattacaggcgtgag

SEQ ID NO: 9065280 - DNA, 22 bp, Homo sapiens
ctcctgaggaaaagcttggtca

SEQ ID NO: 9065281 - DNA, 22 bp, Homo sapiens
ctcctgaggaaaagcttggtca

SEQ ID NO: 9065282 - DNA, 22 bp, Homo sapiens
ctcctgagggatgcttaggctt

SEQ ID NO: 9065283 - DNA, 22 bp, Homo sapiens
agtgctggaaagggacggagga

SEQ ID NO: 9065284 - DNA, 22 bp, Homo sapiens
agtgctggaaagggacggagga

SEQ ID NO: 9065285 - DNA, 22 bp, Homo sapiens
agtgctggagggaggcaggttc

SEQ ID NO: 9065286 - DNA, 22 bp, Homo sapiens
agtgctggaaagggacggagga

SEQ ID NO: 9065287 - DNA, 22 bp, Homo sapiens
ctccagagagtccagctctggg

SEQ ID NO: 9065288 - DNA, 22 bp, Homo sapiens
ctccagagagtccagctctggg

SEQ ID NO: 9065289 - DNA, 22 bp, Homo sapiens
agtgctatcgagttctaatgct

SEQ ID NO: 9065290 - DNA, 22 bp, Homo sapiens
ctctcccagtcaggctcaggat

SEQ ID NO: 9065291 - DNA, 20 bp, Homo sapiens
ctctcccagcacagcttcct

SEQ ID NO: 9065292 - DNA, 20 bp, Homo sapiens
ctctcccagcacagcttcct

SEQ ID NO: 9065293 - DNA, 22 bp, Homo sapiens
ctctccccacaccctctgcatg

SEQ ID NO: 9065294 - DNA, 22 bp, Homo sapiens
ctctccccacaccctctgcatg

SEQ ID NO: 9065295 - DNA, 22 bp, Homo sapiens
ctctccttgaggcttggacttc

SEQ ID NO: 9065296 - DNA, 22 bp, Homo sapiens
agtgctgggctatctactgcta

SEQ ID NO: 9065297 - DNA, 22 bp, Homo sapiens
ctcgggcttgaggctgtttacc

SEQ ID NO: 9065298 - DNA, 22 bp, Homo sapiens
agtgctggcccatagctgctgg

SEQ ID NO: 9065299 - DNA, 22 bp, Homo sapiens
agtgctggcccatagctgctgg

SEQ ID NO: 9065300 - DNA, 22 bp, Homo sapiens
ctcgggcaccctggttctggtg

SEQ ID NO: 9065301 - DNA, 22 bp, Homo sapiens
agtgctgggattgcaggcatga

SEQ ID NO: 9065302 - DNA, 22 bp, Homo sapiens
agtgctgggattacaggcataa

SEQ ID NO: 9065303 - DNA, 22 bp, Homo sapiens
ctcaaaatggttaattttaata

SEQ ID NO: 9065304 - DNA, 21 bp, Homo sapiens
ctcaaagaccaaaagtgtaga

SEQ ID NO: 9065305 - DNA, 22 bp, Homo sapiens
ctcaaagagccaggtaatcacc

SEQ ID NO: 9065306 - DNA, 22 bp, Homo sapiens
ctcaaatagaactgatctataa

SEQ ID NO: 9065307 - DNA, 22 bp, Homo sapiens
ctcaaatagaactgatctataa

SEQ ID NO: 9065308 - DNA, 22 bp, Homo sapiens
ctcaaatagaactgatctataa

SEQ ID NO: 9065309 - DNA, 22 bp, Homo sapiens
ctcaaatataagctaaatgtgg

SEQ ID NO: 9065310 - DNA, 22 bp, Homo sapiens
ctcaaatataagctaaatgtgg

SEQ ID NO: 9065311 - DNA, 22 bp, Homo sapiens
ctcaaatatgtggtcagaaagc

SEQ ID NO: 9065312 - DNA, 21 bp, Homo sapiens
ctcaaatgccagttttattta

SEQ ID NO: 9065313 - DNA, 22 bp, Homo sapiens
ctcaaatatgtggtcagaaagc

SEQ ID NO: 9065314 - DNA, 22 bp, Homo sapiens
ctcaaatatgtggtcagaaagc

SEQ ID NO: 9065315 - DNA, 22 bp, Homo sapiens
ctcaaatatgtggtcagaaagc

SEQ ID NO: 9065316 - DNA, 22 bp, Homo sapiens
ctcaaatgtttccacttctgct

SEQ ID NO: 9065317 - DNA, 22 bp, Homo sapiens
ctcaaatgtttccacttctgct

SEQ ID NO: 9065318 - DNA, 22 bp, Homo sapiens
ctcaacatttaacagtgaaaaa

SEQ ID NO: 9065319 - DNA, 22 bp, Homo sapiens
ctcaacatgcctactcagtctg

SEQ ID NO: 9065320 - DNA, 22 bp, Homo sapiens
ctcaagaagagggagacctaca

SEQ ID NO: 9065321 - DNA, 22 bp, Homo sapiens
ctcaagaaggatgagctattgc

SEQ ID NO: 9065322 - DNA, 22 bp, Homo sapiens
ctcaagaaggatgagctattgc

SEQ ID NO: 9065323 - DNA, 22 bp, Homo sapiens
ctcaagaatctagggaggattc

SEQ ID NO: 9065324 - DNA, 22 bp, Homo sapiens
agtcccagactccagttttctg

SEQ ID NO: 9065325 - DNA, 22 bp, Homo sapiens
agtatgaagaatacatagatga

SEQ ID NO: 9065326 - DNA, 22 bp, Homo sapiens
agtatctttacttaaatagtca

SEQ ID NO: 9065327 - DNA, 22 bp, Homo sapiens
agtatctcaaagtggtttatgg

SEQ ID NO: 9065328 - DNA, 21 bp, Homo sapiens
agtatcataatgaatagttct

SEQ ID NO: 9065329 - DNA, 22 bp, Homo sapiens
cggggttcatccatgctgtggc

SEQ ID NO: 9065330 - DNA, 22 bp, Homo sapiens
cggggttcatccatgctgtggc

SEQ ID NO: 9065331 - DNA, 22 bp, Homo sapiens
cggggttcatccatgctgtggc

SEQ ID NO: 9065332 - DNA, 22 bp, Homo sapiens
cgggttcacgccattctcctgc

SEQ ID NO: 9065333 - DNA, 22 bp, Homo sapiens
cgggttcacgccattctcctgc

SEQ ID NO: 9065334 - DNA, 22 bp, Homo sapiens
ctcagaagaacaaaggctctac

SEQ ID NO: 9065335 - DNA, 22 bp, Homo sapiens
ctcagacacagccccacgaagt

SEQ ID NO: 9065336 - DNA, 22 bp, Homo sapiens
ctcagaatctgccaagttcagg

SEQ ID NO: 9065337 - DNA, 22 bp, Homo sapiens
ctcagaataatgtttctaaagg

SEQ ID NO: 9065338 - DNA, 22 bp, Homo sapiens
agtcccagatgacccagctact

SEQ ID NO: 9065339 - DNA, 22 bp, Homo sapiens
agtcccagatctacaggaggga

SEQ ID NO: 9065340 - DNA, 22 bp, Homo sapiens
agtcccagatctacaggaggga

SEQ ID NO: 9065341 - DNA, 22 bp, Homo sapiens
agtcccagagaggtcggggcca

SEQ ID NO: 9065342 - DNA, 22 bp, Homo sapiens
agtcccagcctaggctgtgctg

SEQ ID NO: 9065343 - DNA, 22 bp, Homo sapiens
ctcaccaggaacagctgcggag

SEQ ID NO: 9065344 - DNA, 22 bp, Homo sapiens
agtcccagatgacccagctact

SEQ ID NO: 9065345 - DNA, 22 bp, Homo sapiens
agtcccagcccagtcctgtaag

SEQ ID NO: 9065346 - DNA, 22 bp, Homo sapiens
agtcccagcctaggctgtgctg

SEQ ID NO: 9065347 - DNA, 22 bp, Homo sapiens
agtcccagcctaggctgtgctg

SEQ ID NO: 9065348 - DNA, 22 bp, Homo sapiens
ctcagacccccagagctgctaa

SEQ ID NO: 9065349 - DNA, 22 bp, Homo sapiens
ctcagaggtcaagagcagagct

SEQ ID NO: 9065350 - DNA, 22 bp, Homo sapiens
ctcagagggtctcctccagaat

SEQ ID NO: 9065351 - DNA, 22 bp, Homo sapiens
ctcagagggtctcctccagaat

SEQ ID NO: 9065352 - DNA, 22 bp, Homo sapiens
ctcagagggtacaggtgaaccc

SEQ ID NO: 9065353 - DNA, 22 bp, Homo sapiens
ctcagagggtacaggtgaaccc

SEQ ID NO: 9065354 - DNA, 22 bp, Homo sapiens
ctcagcaagacccccaccgtgt

SEQ ID NO: 9065355 - DNA, 22 bp, Homo sapiens
ctcagcaacccacacacggtct

SEQ ID NO: 9065356 - DNA, 22 bp, Homo sapiens
ctcagcaagattaagcagcttg

SEQ ID NO: 9065357 - DNA, 22 bp, Homo sapiens
ctcagcaagattaagcagcttg

SEQ ID NO: 9065358 - DNA, 22 bp, Homo sapiens
ctcagcaacagcgacttaaggg

SEQ ID NO: 9065359 - DNA, 23 bp, Homo sapiens
ctcagaggtgtttttcacttact

SEQ ID NO: 9065360 - DNA, 23 bp, Homo sapiens
ctcagaggtgtttttcacttact

SEQ ID NO: 9065361 - DNA, 22 bp, Homo sapiens
ctcagaggtcaagagcagagct

SEQ ID NO: 9065362 - DNA, 22 bp, Homo sapiens
ctcagaggtcaagagcagagct

SEQ ID NO: 9065363 - DNA, 22 bp, Homo sapiens
ctcagagttctcctgggaggtg

SEQ ID NO: 9065364 - DNA, 22 bp, Homo sapiens
ctcagataatctttgagtcttc

SEQ ID NO: 9065365 - DNA, 22 bp, Homo sapiens
ctcagagtccccacatctgggt

SEQ ID NO: 9065366 - DNA, 20 bp, Homo sapiens
ctcagtgtattctgggtgct

SEQ ID NO: 9065367 - DNA, 22 bp, Homo sapiens
ctcagtgtcacgttttgcctta

SEQ ID NO: 9065368 - DNA, 22 bp, Homo sapiens
ctcagtgctttggatcctggat

SEQ ID NO: 9065369 - DNA, 22 bp, Homo sapiens
ctcagggagtagcacatgtgga

SEQ ID NO: 9065370 - DNA, 20 bp, Homo sapiens
ctcagtgtggcctgagtgtt

SEQ ID NO: 9065371 - DNA, 22 bp, Homo sapiens
ctcagtgtgagtgagaagtgca

SEQ ID NO: 9065372 - DNA, 22 bp, Homo sapiens
ctcagtgtcttattgtacacat

SEQ ID NO: 9065373 - DNA, 22 bp, Homo sapiens
ctcagtgttaaatataaggtat

SEQ ID NO: 9065374 - DNA, 22 bp, Homo sapiens
agtgaattctccacccagtagg

SEQ ID NO: 9065375 - DNA, 22 bp, Homo sapiens
agtgaatttaaaacactgagga

SEQ ID NO: 9065376 - DNA, 22 bp, Homo sapiens
agtgacacggagagacagcatg

SEQ ID NO: 9065377 - DNA, 22 bp, Homo sapiens
agtgacaaggtagttagttgga

SEQ ID NO: 9065378 - DNA, 22 bp, Homo sapiens
agtgacaacaagttgactagaa

SEQ ID NO: 9065379 - DNA, 22 bp, Homo sapiens
agtgacaggggaggcaggtgtg

SEQ ID NO: 9065380 - DNA, 22 bp, Homo sapiens
agtgacagggaaggataggatt

SEQ ID NO: 9065381 - DNA, 22 bp, Homo sapiens
agtgacaggaccaggtctggaa

SEQ ID NO: 9065382 - DNA, 22 bp, Homo sapiens
agtgacagggaaggataggatt

SEQ ID NO: 9065383 - DNA, 22 bp, Homo sapiens
agtgacagaggcaggcctgtgg

SEQ ID NO: 9065384 - DNA, 22 bp, Homo sapiens
agtgacagctgggaaggtgaaa

SEQ ID NO: 9065385 - DNA, 22 bp, Homo sapiens
agtgacagctgggaaggtgaaa

SEQ ID NO: 9065386 - DNA, 21 bp, Homo sapiens
agtgacagaggaaggtgcata

SEQ ID NO: 9065387 - DNA, 21 bp, Homo sapiens
agtgacagaggaaggtgcata

SEQ ID NO: 9065388 - DNA, 21 bp, Homo sapiens
agtgacagaggaaggtgcata

SEQ ID NO: 9065389 - DNA, 19 bp, Homo sapiens
ctccagaatacatgttcct

SEQ ID NO: 9065390 - DNA, 22 bp, Homo sapiens
ctccagaactgggagagaataa

SEQ ID NO: 9065391 - DNA, 22 bp, Homo sapiens
ctccagaaattcaacagcaaat

SEQ ID NO: 9065392 - DNA, 22 bp, Homo sapiens
ctccagaaatttggatgcagca

SEQ ID NO: 9065393 - DNA, 22 bp, Homo sapiens
ctccagaaatttggatgcagca

SEQ ID NO: 9065394 - DNA, 22 bp, Homo sapiens
ctccagaattgtccattggaaa

SEQ ID NO: 9065395 - DNA, 23 bp, Homo sapiens
agtctcagctggaaacatgtgtc

SEQ ID NO: 9065396 - DNA, 22 bp, Homo sapiens
agtctcaggcagaggaaggcta

SEQ ID NO: 9065397 - DNA, 19 bp, Homo sapiens
agtctcagtgtacagaggc

SEQ ID NO: 9065398 - DNA, 22 bp, Homo sapiens
agtctccacaacagccctgata

SEQ ID NO: 9065399 - DNA, 22 bp, Homo sapiens
agtctccacttgacatcagcag

SEQ ID NO: 9065400 - DNA, 22 bp, Homo sapiens
agtctccacactggcagatgcc

SEQ ID NO: 9065401 - DNA, 22 bp, Homo sapiens
ctcagggaattgaatctccttg

SEQ ID NO: 9065402 - DNA, 21 bp, Homo sapiens
ctcaggcatttgaggagagtc

SEQ ID NO: 9065403 - DNA, 22 bp, Homo sapiens
ctcagggacgttagaggacagg

SEQ ID NO: 9065404 - DNA, 22 bp, Homo sapiens
ctcagggacgttagaggacagg

SEQ ID NO: 9065405 - DNA, 22 bp, Homo sapiens
ctcagggacttggatcctggcc

SEQ ID NO: 9065406 - DNA, 22 bp, Homo sapiens
ctcagggacggcatctcatttc

SEQ ID NO: 9065407 - DNA, 22 bp, Homo sapiens
ctcagggagagccaagagttcc

SEQ ID NO: 9065408 - DNA, 22 bp, Homo sapiens
ctcagggaggagcttctgggcc

SEQ ID NO: 9065409 - DNA, 22 bp, Homo sapiens
ctcagggaggccctgggaccct

SEQ ID NO: 9065410 - DNA, 22 bp, Homo sapiens
ctcagctctgacaggaggcatc

SEQ ID NO: 9065411 - DNA, 22 bp, Homo sapiens
ctcagctccaggtgtgcatctt

SEQ ID NO: 9065412 - DNA, 22 bp, Homo sapiens
agtctcagctacttgggaggct

SEQ ID NO: 9065413 - DNA, 22 bp, Homo sapiens
agtctcagctacttgggaggct

SEQ ID NO: 9065414 - DNA, 18 bp, Homo sapiens
agtctcagcggaggagta

SEQ ID NO: 9065415 - DNA, 22 bp, Homo sapiens
agtctcagcaagcatggctagt

SEQ ID NO: 9065416 - DNA, 22 bp, Homo sapiens
agtctcagagtacctgagggac

SEQ ID NO: 9065417 - DNA, 22 bp, Homo sapiens
ctcagctgcagcctggctggca

SEQ ID NO: 9065418 - DNA, 22 bp, Homo sapiens
ctcagctccagccctcagcagc

SEQ ID NO: 9065419 - DNA, 22 bp, Homo sapiens
ctcagctcaaaattcacctttg

SEQ ID NO: 9065420 - DNA, 22 bp, Homo sapiens
ctcagcacactcccatctaatt

SEQ ID NO: 9065421 - DNA, 22 bp, Homo sapiens
ctcagccccaatttgccctctt

SEQ ID NO: 9065422 - DNA, 22 bp, Homo sapiens
ctcagccccagcccagatagca

SEQ ID NO: 9065423 - DNA, 22 bp, Homo sapiens
ctcagccccagcccagatagca

SEQ ID NO: 9065424 - DNA, 22 bp, Homo sapiens
ctcagcccggtgctcgtgccac

SEQ ID NO: 9065425 - DNA, 22 bp, Homo sapiens
ctcagcctgtgaagagcagagg

SEQ ID NO: 9065426 - DNA, 18 bp, Homo sapiens
ctgcttgggagacgtcag

SEQ ID NO: 9065427 - DNA, 20 bp, Homo sapiens
ctgcttgggacactgccaga

SEQ ID NO: 9065428 - DNA, 22 bp, Homo sapiens
ctgcttgacctgttgttctcac

SEQ ID NO: 9065429 - DNA, 22 bp, Homo sapiens
ctgcttggagtcctccagcacc

SEQ ID NO: 9065430 - DNA, 22 bp, Homo sapiens
ataatatcgctcctttttttga

SEQ ID NO: 9065431 - DNA, 22 bp, Homo sapiens
ataatatttgcattactgtgat

SEQ ID NO: 9065432 - DNA, 22 bp, Homo sapiens
ataatatttgcattactgtgat

SEQ ID NO: 9065433 - DNA, 22 bp, Homo sapiens
ataatatttggataggacagta

SEQ ID NO: 9065434 - DNA, 22 bp, Homo sapiens
ataatatttggataggacagta

SEQ ID NO: 9065435 - DNA, 22 bp, Homo sapiens
ataatcaaagtcctatgacatc

SEQ ID NO: 9065436 - DNA, 22 bp, Homo sapiens
ataatcaaagtcctatgacatc

SEQ ID NO: 9065437 - DNA, 22 bp, Homo sapiens
ctgctttaatggaaagtgtttt

SEQ ID NO: 9065438 - DNA, 18 bp, Homo sapiens
atacaagctctgttactt

SEQ ID NO: 9065439 - DNA, 18 bp, Homo sapiens
atacaagatcaagtgttc

SEQ ID NO: 9065440 - DNA, 19 bp, Homo sapiens
atacaagagagcagttgag

SEQ ID NO: 9065441 - DNA, 19 bp, Homo sapiens
atacaagactagcatttac

SEQ ID NO: 9065442 - DNA, 22 bp, Homo sapiens
atacaagactcagcacagacgg

SEQ ID NO: 9065443 - DNA, 22 bp, Homo sapiens
atacaagactcagcacagacgg

SEQ ID NO: 9065444 - DNA, 20 bp, Homo sapiens
ctgctctgctttgcaggtgg

SEQ ID NO: 9065445 - DNA, 22 bp, Homo sapiens
ctgctctgctgatcagtgtctc

SEQ ID NO: 9065446 - DNA, 20 bp, Homo sapiens
ctgctctgctttgcaggtgg

SEQ ID NO: 9065447 - DNA, 22 bp, Homo sapiens
ctgctctgctgatcagtgtctc

SEQ ID NO: 9065448 - DNA, 22 bp, Homo sapiens
ctgctctgcagcttggactccc

SEQ ID NO: 9065449 - DNA, 22 bp, Homo sapiens
ctgctctgcagcttggactccc

SEQ ID NO: 9065450 - DNA, 22 bp, Homo sapiens
ctgctcatcagccgagcagggc

SEQ ID NO: 9065451 - DNA, 22 bp, Homo sapiens
ctgctctgagaggctcttccta

SEQ ID NO: 9065452 - DNA, 22 bp, Homo sapiens
ctgctctgagtattaacggagg

SEQ ID NO: 9065453 - DNA, 22 bp, Homo sapiens
ctgctctgcaaggcacagtgat

SEQ ID NO: 9065454 - DNA, 22 bp, Homo sapiens
ataatacatggttgatcttttc

SEQ ID NO: 9065455 - DNA, 22 bp, Homo sapiens
ataatacatggttaacctcttt

SEQ ID NO: 9065456 - DNA, 22 bp, Homo sapiens
ctgctctgtatatgagcaggaa

SEQ ID NO: 9065457 - DNA, 22 bp, Homo sapiens
ctgctctggtctcttcatgttt

SEQ ID NO: 9065458 - DNA, 22 bp, Homo sapiens
ctgctctggtctcttcatgttt

SEQ ID NO: 9065459 - DNA, 21 bp, Homo sapiens
ctgctctggggaccggctgtg

SEQ ID NO: 9065460 - DNA, 22 bp, Homo sapiens
ctgctctggggaagccagatgt

SEQ ID NO: 9065461 - DNA, 22 bp, Homo sapiens
ctgctctggcgtactcggcatc

SEQ ID NO: 9065462 - DNA, 22 bp, Homo sapiens
ctgctctggctgtgtacttcag

SEQ ID NO: 9065463 - DNA, 22 bp, Homo sapiens
ctgctctggcgtactcggcatc

SEQ ID NO: 9065464 - DNA, 22 bp, Homo sapiens
ctgctctggctgtgtacttcag

SEQ ID NO: 9065465 - DNA, 22 bp, Homo sapiens
ctgcccagaatcactcactcga

SEQ ID NO: 9065466 - DNA, 22 bp, Homo sapiens
ctgcccagaatcactcactcga

SEQ ID NO: 9065467 - DNA, 22 bp, Homo sapiens
ctgcccagaatcactcactcga

SEQ ID NO: 9065468 - DNA, 22 bp, Homo sapiens
ctgcccagaatcactcactcga

SEQ ID NO: 9065469 - DNA, 19 bp, Homo sapiens
ctgctcaggtcagtctgtc

SEQ ID NO: 9065470 - DNA, 22 bp, Homo sapiens
ctgcccagaagccagatgggca

SEQ ID NO: 9065471 - DNA, 22 bp, Homo sapiens
ctgcccagaagcttagagctta

SEQ ID NO: 9065472 - DNA, 22 bp, Homo sapiens
ctgcccagaatcactcactcga

SEQ ID NO: 9065473 - DNA, 22 bp, Homo sapiens
ctgcccagaagcttagagctta

SEQ ID NO: 9065474 - DNA, 22 bp, Homo sapiens
ctggagggatgtagggtgtatt

SEQ ID NO: 9065475 - DNA, 22 bp, Homo sapiens
ctggagggctgcagcgaggctg

SEQ ID NO: 9065476 - DNA, 22 bp, Homo sapiens
ctggagtcttaggttatggtga

SEQ ID NO: 9065477 - DNA, 21 bp, Homo sapiens
ctggagtctgggggtggcagt

SEQ ID NO: 9065478 - DNA, 21 bp, Homo sapiens
ctggagtctgggggtggcagt

SEQ ID NO: 9065479 - DNA, 22 bp, Homo sapiens
atacttatactaagaatgtact

SEQ ID NO: 9065480 - DNA, 22 bp, Homo sapiens
atacttatgataaataattgct

SEQ ID NO: 9065481 - DNA, 22 bp, Homo sapiens
ctggagtgatactcagaatgtg

SEQ ID NO: 9065482 - DNA, 22 bp, Homo sapiens
ctggagtgatactcagaatgtg

SEQ ID NO: 9065483 - DNA, 22 bp, Homo sapiens
ctggagtgcaatgaacaaggtc

SEQ ID NO: 9065484 - DNA, 22 bp, Homo sapiens
atacttgaggttgtataaatat

SEQ ID NO: 9065485 - DNA, 22 bp, Homo sapiens
ctggcagcggtttgcagcctgg

SEQ ID NO: 9065486 - DNA, 19 bp, Homo sapiens
ctggcagcctgtctgtgtc

SEQ ID NO: 9065487 - DNA, 22 bp, Homo sapiens
ctggcagctctactcagagcct

SEQ ID NO: 9065488 - DNA, 22 bp, Homo sapiens
ctggcagcgtgagcagcatcca

SEQ ID NO: 9065489 - DNA, 22 bp, Homo sapiens
ctggagccccagacagggagag

SEQ ID NO: 9065490 - DNA, 22 bp, Homo sapiens
atacagaagttttccacttatt

SEQ ID NO: 9065491 - DNA, 22 bp, Homo sapiens
ctggagccatgtcttgactgct

SEQ ID NO: 9065492 - DNA, 22 bp, Homo sapiens
ctggagcccaggcctggtgtct

SEQ ID NO: 9065493 - DNA, 22 bp, Homo sapiens
ctggagccactgggtcttgtat

SEQ ID NO: 9065494 - DNA, 17 bp, Homo sapiens
ctggagccaagagggcc

SEQ ID NO: 9065495 - DNA, 22 bp, Homo sapiens
ctggagcattttctgcttctgc

SEQ ID NO: 9065496 - DNA, 22 bp, Homo sapiens
ctggagccagccagggccctct

SEQ ID NO: 9065497 - DNA, 22 bp, Homo sapiens
atacagaatttgcccttttcat

SEQ ID NO: 9065498 - DNA, 22 bp, Homo sapiens
atacagaattcactacagtttc

SEQ ID NO: 9065499 - DNA, 22 bp, Homo sapiens
atacagatgagatcaggcataa

SEQ ID NO: 9065500 - DNA, 22 bp, Homo sapiens
ctggagggagattcaaaggagg

SEQ ID NO: 9065501 - DNA, 22 bp, Homo sapiens
ctggagggaggaggctgctatt

SEQ ID NO: 9065502 - DNA, 22 bp, Homo sapiens
ctggaggaaaacaactgcagac

SEQ ID NO: 9065503 - DNA, 22 bp, Homo sapiens
ctggaggaaaacaactgcagac

SEQ ID NO: 9065504 - DNA, 22 bp, Homo sapiens
atacagatgcttgctcgtgact

SEQ ID NO: 9065505 - DNA, 21 bp, Homo sapiens
ctctttgggatctttggaaag

SEQ ID NO: 9065506 - DNA, 22 bp, Homo sapiens
agttcttcataaccttactgtg

SEQ ID NO: 9065507 - DNA, 22 bp, Homo sapiens
ctctttggggctggaagcctag

SEQ ID NO: 9065508 - DNA, 22 bp, Homo sapiens
agttcttcccttttctatggag

SEQ ID NO: 9065509 - DNA, 19 bp, Homo sapiens
agttcttgtcctgtctgtt

SEQ ID NO: 9065510 - DNA, 22 bp, Homo sapiens
agttgggtttgtgtcagttgca

SEQ ID NO: 9065511 - DNA, 22 bp, Homo sapiens
agttgggtttgtgtcagttgca

SEQ ID NO: 9065512 - DNA, 22 bp, Homo sapiens
agttggagtgaacatgagattg

SEQ ID NO: 9065513 - DNA, 22 bp, Homo sapiens
agttggagaagaggtcgggaat

SEQ ID NO: 9065514 - DNA, 22 bp, Homo sapiens
agttggagtgaacatgagattg

SEQ ID NO: 9065515 - DNA, 18 bp, Homo sapiens
agttgcttattctgtgca

SEQ ID NO: 9065516 - DNA, 22 bp, Homo sapiens
ctgaggcaggggcagctggaga

SEQ ID NO: 9065517 - DNA, 22 bp, Homo sapiens
ctgaggcaggggcagctggaga

SEQ ID NO: 9065518 - DNA, 22 bp, Homo sapiens
ctgaggcatgaatgtgggcttt

SEQ ID NO: 9065519 - DNA, 22 bp, Homo sapiens
ctgaggcatgaatgtgggcttt

SEQ ID NO: 9065520 - DNA, 22 bp, Homo sapiens
ctgaggcctaagacatgaatga

SEQ ID NO: 9065521 - DNA, 21 bp, Homo sapiens
ctgaggcagcacagctagtca

SEQ ID NO: 9065522 - DNA, 21 bp, Homo sapiens
ctgaggcagcacagctagtca

SEQ ID NO: 9065523 - DNA, 22 bp, Homo sapiens
agttggtcttcttggatctcag

SEQ ID NO: 9065524 - DNA, 22 bp, Homo sapiens
ctgaggcaggatggcctggctg

SEQ ID NO: 9065525 - DNA, 22 bp, Homo sapiens
ctgaggcaggatggcctggctg

SEQ ID NO: 9065526 - DNA, 22 bp, Homo sapiens
ctgaggcaggagagttgcttga

SEQ ID NO: 9065527 - DNA, 22 bp, Homo sapiens
ctgaggcttggaggggtctggt

SEQ ID NO: 9065528 - DNA, 22 bp, Homo sapiens
ctgaggcttggaggggtctggt

SEQ ID NO: 9065529 - DNA, 22 bp, Homo sapiens
ctgaggcttctctagttcagct

SEQ ID NO: 9065530 - DNA, 22 bp, Homo sapiens
ctgaggcttggaggggtctggt

SEQ ID NO: 9065531 - DNA, 22 bp, Homo sapiens
ctgaggcttgtcctctcagctt

SEQ ID NO: 9065532 - DNA, 22 bp, Homo sapiens
ctgaggcttgtcctctcagctt

SEQ ID NO: 9065533 - DNA, 22 bp, Homo sapiens
ctgaggcttgtcctctcagctt

SEQ ID NO: 9065534 - DNA, 22 bp, Homo sapiens
ctgaggctggggaagggaagtg

SEQ ID NO: 9065535 - DNA, 22 bp, Homo sapiens
ctgaggctggggaagggaagtg

SEQ ID NO: 9065536 - DNA, 22 bp, Homo sapiens
ctgaggctgggcttgccttctt

SEQ ID NO: 9065537 - DNA, 18 bp, Homo sapiens
ctgaggcttagagaggtt

SEQ ID NO: 9065538 - DNA, 22 bp, Homo sapiens
ctgaggctggggaagggaagtg

SEQ ID NO: 9065539 - DNA, 18 bp, Homo sapiens
ctgaggcttagagaggtt

SEQ ID NO: 9065540 - DNA, 22 bp, Homo sapiens
ctgaggcctctccttggcttgt

SEQ ID NO: 9065541 - DNA, 22 bp, Homo sapiens
ctgaggcctctctcctgggctt

SEQ ID NO: 9065542 - DNA, 22 bp, Homo sapiens
ctgaggcctctctcctgggctt

SEQ ID NO: 9065543 - DNA, 22 bp, Homo sapiens
ctgaggcctctgttcaccagaa

SEQ ID NO: 9065544 - DNA, 22 bp, Homo sapiens
ctgaggcctctgttcaccagaa

SEQ ID NO: 9065545 - DNA, 23 bp, Homo sapiens
ctgaggcctgctgcgttcaggtt

SEQ ID NO: 9065546 - DNA, 22 bp, Homo sapiens
ctgaggctgggctgagggtata

SEQ ID NO: 9065547 - DNA, 22 bp, Homo sapiens
ctgaggctgggctgagggtata

SEQ ID NO: 9065548 - DNA, 22 bp, Homo sapiens
ctgaggctttgtgtgcatgcct

SEQ ID NO: 9065549 - DNA, 22 bp, Homo sapiens
ctgaggctttgtgtgcatgcct

SEQ ID NO: 9065550 - DNA, 22 bp, Homo sapiens
ctgaggggtatccaaggggtaa

SEQ ID NO: 9065551 - DNA, 17 bp, Homo sapiens
ctgaggggagtgctgtg

SEQ ID NO: 9065552 - DNA, 22 bp, Homo sapiens
ctgaggtcaattaatcaacaac

SEQ ID NO: 9065553 - DNA, 22 bp, Homo sapiens
ctgcagctcctctctgtgcccc

SEQ ID NO: 9065554 - DNA, 22 bp, Homo sapiens
ctgcagctccttctggcatgtg

SEQ ID NO: 9065555 - DNA, 22 bp, Homo sapiens
ctgcagctatattttcccacag

SEQ ID NO: 9065556 - DNA, 22 bp, Homo sapiens
ctgcagcctcctggggtacatg

SEQ ID NO: 9065557 - DNA, 22 bp, Homo sapiens
ctgcagcctcctggggtacatg

SEQ ID NO: 9065558 - DNA, 22 bp, Homo sapiens
ctgcagcctccaccttttgggt

SEQ ID NO: 9065559 - DNA, 22 bp, Homo sapiens
ctgcagagcaagttctctgttg

SEQ ID NO: 9065560 - DNA, 22 bp, Homo sapiens
agtttaactttggaaaactata

SEQ ID NO: 9065561 - DNA, 22 bp, Homo sapiens
agtttaactttgtaaacgtgag

SEQ ID NO: 9065562 - DNA, 20 bp, Homo sapiens
agtttaagaaaaagctccag

SEQ ID NO: 9065563 - DNA, 22 bp, Homo sapiens
agttgtcacctctattcaaatc

SEQ ID NO: 9065564 - DNA, 22 bp, Homo sapiens
agttgttcgtggtggattcgct

SEQ ID NO: 9065565 - DNA, 22 bp, Homo sapiens
agttgttctaaagagattttaa

SEQ ID NO: 9065566 - DNA, 22 bp, Homo sapiens
agtttaaatcatgttttgtaac

SEQ ID NO: 9065567 - DNA, 22 bp, Homo sapiens
agtttaaatcatgttttgtaac

SEQ ID NO: 9065568 - DNA, 22 bp, Homo sapiens
ctgcagctgccagtgatttcag

SEQ ID NO: 9065569 - DNA, 22 bp, Homo sapiens
ctgcagctgcagttctgagaga

SEQ ID NO: 9065570 - DNA, 22 bp, Homo sapiens
ctgcagctggagcatcttctca

SEQ ID NO: 9065571 - DNA, 22 bp, Homo sapiens
ctgcagctgctcatgttacttg

SEQ ID NO: 9065572 - DNA, 23 bp, Homo sapiens
agtttgtaaagaaatatttgcac

SEQ ID NO: 9065573 - DNA, 22 bp, Homo sapiens
agtttgtaaacttgagctagcc

SEQ ID NO: 9065574 - DNA, 22 bp, Homo sapiens
agtttgggttctggagaaattt

SEQ ID NO: 9065575 - DNA, 22 bp, Homo sapiens
agtttgtactgaattcaattta

SEQ ID NO: 9065576 - DNA, 22 bp, Homo sapiens
agtttggaagagaaaaatattt

SEQ ID NO: 9065577 - DNA, 22 bp, Homo sapiens
agtttggggcaagaggacagat

SEQ ID NO: 9065578 - DNA, 22 bp, Homo sapiens
agtttggaagaatttggtctgt

SEQ ID NO: 9065579 - DNA, 22 bp, Homo sapiens
agtttgcagattatattagtgt

SEQ ID NO: 9065580 - DNA, 22 bp, Homo sapiens
ataaaagtaggaccaacttaca

SEQ ID NO: 9065581 - DNA, 22 bp, Homo sapiens
ctgccaaaaggtgcacctgctg

SEQ ID NO: 9065582 - DNA, 22 bp, Homo sapiens
ctgcatttcacatttaaacttt

SEQ ID NO: 9065583 - DNA, 22 bp, Homo sapiens
ctgcatttcacatttaaacttt

SEQ ID NO: 9065584 - DNA, 21 bp, Homo sapiens
ctgccaggatagcatgcaggc

SEQ ID NO: 9065585 - DNA, 22 bp, Homo sapiens
ctgccaggactgacgtcttcag

SEQ ID NO: 9065586 - DNA, 22 bp, Homo sapiens
ctgccaggactgacgtcttcag

SEQ ID NO: 9065587 - DNA, 22 bp, Homo sapiens
ctgccaggcactgggctctgca

SEQ ID NO: 9065588 - DNA, 22 bp, Homo sapiens
ctgccaggcactgggctctgca

SEQ ID NO: 9065589 - DNA, 22 bp, Homo sapiens
ctgccaggcactgggctctgca

SEQ ID NO: 9065590 - DNA, 22 bp, Homo sapiens
ataaaggctggctgctgtgagc

SEQ ID NO: 9065591 - DNA, 22 bp, Homo sapiens
ataaaggcagagtagggaggaa

SEQ ID NO: 9065592 - DNA, 22 bp, Homo sapiens
ataaaggcagattttggacctc

SEQ ID NO: 9065593 - DNA, 22 bp, Homo sapiens
ataaaggccaaaatttgcattt

SEQ ID NO: 9065594 - DNA, 17 bp, Homo sapiens
ataaaggcaagtattat

SEQ ID NO: 9065595 - DNA, 22 bp, Homo sapiens
ataaaggcaacaccagggtatg

SEQ ID NO: 9065596 - DNA, 22 bp, Homo sapiens
ataaatagtgctgccatgagta

SEQ ID NO: 9065597 - DNA, 22 bp, Homo sapiens
ataaatatcactgttgtccctc

SEQ ID NO: 9065598 - DNA, 22 bp, Homo sapiens
ataaatatcactgttgtccctc

SEQ ID NO: 9065599 - DNA, 22 bp, Homo sapiens
ataaatagtgtgtcataaagtc

SEQ ID NO: 9065600 - DNA, 22 bp, Homo sapiens
ataaatagtgtgtcataaagtc

SEQ ID NO: 9065601 - DNA, 20 bp, Homo sapiens
ataaaataactgccacaaga

SEQ ID NO: 9065602 - DNA, 20 bp, Homo sapiens
ataaaataactgccacaaga

SEQ ID NO: 9065603 - DNA, 20 bp, Homo sapiens
ataaaataactgccacaaga

SEQ ID NO: 9065604 - DNA, 20 bp, Homo sapiens
ataaaataactgccacaaga

SEQ ID NO: 9065605 - DNA, 22 bp, Homo sapiens
atcacagtggcagggatttggg

SEQ ID NO: 9065606 - DNA, 22 bp, Homo sapiens
ctgtcctccggccacctacagt

SEQ ID NO: 9065607 - DNA, 22 bp, Homo sapiens
ctgtcctccggccacctacagt

SEQ ID NO: 9065608 - DNA, 22 bp, Homo sapiens
ctgtcctccagacgacagtccc

SEQ ID NO: 9065609 - DNA, 22 bp, Homo sapiens
ctgtcctctgtcctcagcagga

SEQ ID NO: 9065610 - DNA, 22 bp, Homo sapiens
atcacagctcccttatacacag

SEQ ID NO: 9065611 - DNA, 22 bp, Homo sapiens
ctgtcctcaacccatccttctc

SEQ ID NO: 9065612 - DNA, 22 bp, Homo sapiens
ctgtcctcaccttggcaggggg

SEQ ID NO: 9065613 - DNA, 22 bp, Homo sapiens
ctgtcctcatctgccccaaggg

SEQ ID NO: 9065614 - DNA, 21 bp, Homo sapiens
ctgtcctcagatgtggacgag

SEQ ID NO: 9065615 - DNA, 21 bp, Homo sapiens
ctgtcctcagatgtggacgag

SEQ ID NO: 9065616 - DNA, 22 bp, Homo sapiens
ctgggtcccctcagtgacactg

SEQ ID NO: 9065617 - DNA, 22 bp, Homo sapiens
ctgggtcccctcagtgacactg

SEQ ID NO: 9065618 - DNA, 22 bp, Homo sapiens
ctgggtcccggcttctatccac

SEQ ID NO: 9065619 - DNA, 22 bp, Homo sapiens
ctgggtctaaaaattctcagat

SEQ ID NO: 9065620 - DNA, 22 bp, Homo sapiens
ctgggtctcaggagttctgagg

SEQ ID NO: 9065621 - DNA, 22 bp, Homo sapiens
ctgtcctatgagtactcactag

SEQ ID NO: 9065622 - DNA, 22 bp, Homo sapiens
ctgtcccttcccaagcccagcc

SEQ ID NO: 9065623 - DNA, 22 bp, Homo sapiens
ctgtccagtctttagcaagctg

SEQ ID NO: 9065624 - DNA, 22 bp, Homo sapiens
ctgggtcccacagcctgctggg

SEQ ID NO: 9065625 - DNA, 22 bp, Homo sapiens
ctgggtataggaaacagttaag

SEQ ID NO: 9065626 - DNA, 22 bp, Homo sapiens
ctgggtacctcaccgctgctgc

SEQ ID NO: 9065627 - DNA, 22 bp, Homo sapiens
ctgggtagaagattcctcagga

SEQ ID NO: 9065628 - DNA, 22 bp, Homo sapiens
atatttgtcaattcactgttca

SEQ ID NO: 9065629 - DNA, 22 bp, Homo sapiens
atatttgtatttcgtgtgtgta

SEQ ID NO: 9065630 - DNA, 22 bp, Homo sapiens
atatttgtggtttttggctcct

SEQ ID NO: 9065631 - DNA, 22 bp, Homo sapiens
atatttgtggtaaaggtaagaa

SEQ ID NO: 9065632 - DNA, 22 bp, Homo sapiens
atatttgtggtaaaggtaagaa

SEQ ID NO: 9065633 - DNA, 22 bp, Homo sapiens
atatttgtcatctgccttagtt

SEQ ID NO: 9065634 - DNA, 22 bp, Homo sapiens
atcatgttaaatatttcaatct

SEQ ID NO: 9065635 - DNA, 22 bp, Homo sapiens
atcatcatgctacaatcagcaa

SEQ ID NO: 9065636 - DNA, 22 bp, Homo sapiens
atcatgcattgtattgagttga

SEQ ID NO: 9065637 - DNA, 22 bp, Homo sapiens
atcatgcaggtttctcctttct

SEQ ID NO: 9065638 - DNA, 22 bp, Homo sapiens
atcatgcagctaatccaattca

SEQ ID NO: 9065639 - DNA, 22 bp, Homo sapiens
atcatgcatggtactcttgtgc

SEQ ID NO: 9065640 - DNA, 22 bp, Homo sapiens
atcatgcagagtctgggcttca

SEQ ID NO: 9065641 - DNA, 22 bp, Homo sapiens
atcatgcaataaggtgaggcct

SEQ ID NO: 9065642 - DNA, 22 bp, Homo sapiens
atcatgcagcaacaagcaaggc

SEQ ID NO: 9065643 - DNA, 22 bp, Homo sapiens
ctgtgatggtcaggccctatct

SEQ ID NO: 9065644 - DNA, 22 bp, Homo sapiens
ctgtgcacttctctttatttgt

SEQ ID NO: 9065645 - DNA, 22 bp, Homo sapiens
ctgtgcagcttggcttcaggcc

SEQ ID NO: 9065646 - DNA, 22 bp, Homo sapiens
ctgtgcagcttggcttcaggcc

SEQ ID NO: 9065647 - DNA, 22 bp, Homo sapiens
atcacatggaatgattttagac

SEQ ID NO: 9065648 - DNA, 22 bp, Homo sapiens
ctgtctctgtcttaactcccag

SEQ ID NO: 9065649 - DNA, 22 bp, Homo sapiens
atcacattatgtagtgaaaagg

SEQ ID NO: 9065650 - DNA, 22 bp, Homo sapiens
ctgtctgtttctgattcaacct

SEQ ID NO: 9065651 - DNA, 22 bp, Homo sapiens
ctgtctctgtcttaactcccag

SEQ ID NO: 9065652 - DNA, 22 bp, Homo sapiens
ctgtctgttttgtatacaggcc

SEQ ID NO: 9065653 - DNA, 22 bp, Homo sapiens
ctgtctgttttaccttctccag

SEQ ID NO: 9065654 - DNA, 22 bp, Homo sapiens
ctgtctttttagagagtaggat

SEQ ID NO: 9065655 - DNA, 18 bp, Homo sapiens
ctgtcttttttctctcca

SEQ ID NO: 9065656 - DNA, 22 bp, Homo sapiens
ctgtgatgacaggcagggccaa

SEQ ID NO: 9065657 - DNA, 22 bp, Homo sapiens
ctgtcttttcttctcattgatg

SEQ ID NO: 9065658 - DNA, 22 bp, Homo sapiens
ctgtcttttcatactttccctc

SEQ ID NO: 9065659 - DNA, 22 bp, Homo sapiens
ctgtcttttactatcatttact

SEQ ID NO: 9065660 - DNA, 22 bp, Homo sapiens
atcctacaaagcagggctatgg

SEQ ID NO: 9065661 - DNA, 20 bp, Homo sapiens
atcctcaccctcagtcctag

SEQ ID NO: 9065662 - DNA, 20 bp, Homo sapiens
atccctggtcagtaccaaag

SEQ ID NO: 9065663 - DNA, 22 bp, Homo sapiens
atccctggccacgaagctgccc

SEQ ID NO: 9065664 - DNA, 20 bp, Homo sapiens
atccctggccttaaggagtg

SEQ ID NO: 9065665 - DNA, 22 bp, Homo sapiens
atccctgggcctcaccacctga

SEQ ID NO: 9065666 - DNA, 22 bp, Homo sapiens
atccctggctaattttttgtgt

SEQ ID NO: 9065667 - DNA, 22 bp, Homo sapiens
atccctggacggcgcctcccca

SEQ ID NO: 9065668 - DNA, 22 bp, Homo sapiens
atccctggacggcgcctcccca

SEQ ID NO: 9065669 - DNA, 22 bp, Homo sapiens
atccctggaagcaatgtttatt

SEQ ID NO: 9065670 - DNA, 22 bp, Homo sapiens
atcctttataagacttgtattc

SEQ ID NO: 9065671 - DNA, 22 bp, Homo sapiens
atcctttagtcctacaactcga

SEQ ID NO: 9065672 - DNA, 22 bp, Homo sapiens
atctaattttcactcatttgct

SEQ ID NO: 9065673 - DNA, 22 bp, Homo sapiens
atccccagactttagatttctc

SEQ ID NO: 9065674 - DNA, 17 bp, Homo sapiens
atccccagcatctagaa

SEQ ID NO: 9065675 - DNA, 22 bp, Homo sapiens
atccaccctgtggtggctttct

SEQ ID NO: 9065676 - DNA, 22 bp, Homo sapiens
atccatttgccgtgctatgtgc

SEQ ID NO: 9065677 - DNA, 23 bp, Homo sapiens
atccacattacagtatcatacaa

SEQ ID NO: 9065678 - DNA, 22 bp, Homo sapiens
atccccctcttggatggcggca

SEQ ID NO: 9065679 - DNA, 22 bp, Homo sapiens
atccccaggggcattcaagctt

SEQ ID NO: 9065680 - DNA, 22 bp, Homo sapiens
atccccagggagtgagctgtct

SEQ ID NO: 9065681 - DNA, 22 bp, Homo sapiens
atccccttcacaccctctgcat

SEQ ID NO: 9065682 - DNA, 22 bp, Homo sapiens
atccctctctgcatgactgtgt

SEQ ID NO: 9065683 - DNA, 22 bp, Homo sapiens
atccctgccctcatggagctta

SEQ ID NO: 9065684 - DNA, 20 bp, Homo sapiens
atccctcttcctagagtccc

SEQ ID NO: 9065685 - DNA, 20 bp, Homo sapiens
atccctcttcctagagtccc

SEQ ID NO: 9065686 - DNA, 22 bp, Homo sapiens
atccacaagaccccttttcact

SEQ ID NO: 9065687 - DNA, 22 bp, Homo sapiens
atccaacaggacaaagaaagga

SEQ ID NO: 9065688 - DNA, 22 bp, Homo sapiens
atccaacacgtatttgctggcc

SEQ ID NO: 9065689 - DNA, 22 bp, Homo sapiens
atccaacaggacaaagaaagga

SEQ ID NO: 9065690 - DNA, 22 bp, Homo sapiens
atccaaagtagattaagtcaca

SEQ ID NO: 9065691 - DNA, 22 bp, Homo sapiens
atccaaaggtgacacagaatac

SEQ ID NO: 9065692 - DNA, 22 bp, Homo sapiens
atccaaaggtgacacagaatac

SEQ ID NO: 9065693 - DNA, 22 bp, Homo sapiens
atcatttttaagagactcttct

SEQ ID NO: 9065694 - DNA, 18 bp, Homo sapiens
atccaaaaagatggaagt

SEQ ID NO: 9065695 - DNA, 22 bp, Homo sapiens
atccaaaaccagtgcattttcc

SEQ ID NO: 9065696 - DNA, 22 bp, Homo sapiens
atccaaaatttactgtagcatt

SEQ ID NO: 9065697 - DNA, 22 bp, Homo sapiens
atcattttatggctgagaggac

SEQ ID NO: 9065698 - DNA, 22 bp, Homo sapiens
atcattttgtgacaatgcctgt

SEQ ID NO: 9065699 - DNA, 22 bp, Homo sapiens
atcatgttcatcgtatttaggc

SEQ ID NO: 9065700 - DNA, 22 bp, Homo sapiens
atcatgttgctcaaaattaaac

SEQ ID NO: 9065701 - DNA, 22 bp, Homo sapiens
atcatgttttaattagcaaact

SEQ ID NO: 9065702 - DNA, 22 bp, Homo sapiens
atcatgttggctctgacaaaaa

SEQ ID NO: 9065703 - DNA, 22 bp, Homo sapiens
atcatgtttagttttaagggct

SEQ ID NO: 9065704 - DNA, 22 bp, Homo sapiens
ctgtggagcttgtggcagtggg

SEQ ID NO: 9065705 - DNA, 23 bp, Homo sapiens
ctgtggagccctttgttgggaga

SEQ ID NO: 9065706 - DNA, 22 bp, Homo sapiens
ctgtggagcagggcagggtcac

SEQ ID NO: 9065707 - DNA, 22 bp, Homo sapiens
ctgtggagcagggcagggtcac

SEQ ID NO: 9065708 - DNA, 22 bp, Homo sapiens
ctgtggagcagggcagggtcac

SEQ ID NO: 9065709 - DNA, 22 bp, Homo sapiens
ctgtggagatgcagaccaggcc

SEQ ID NO: 9065710 - DNA, 22 bp, Homo sapiens
ctgtggagatgcagaccaggcc

SEQ ID NO: 9065711 - DNA, 22 bp, Homo sapiens
ctgtggaggtaggagcaggaca

SEQ ID NO: 9065712 - DNA, 22 bp, Homo sapiens
ctgtggagtcctggggaatgga

SEQ ID NO: 9065713 - DNA, 22 bp, Homo sapiens
ctgtggagtcctggggaatgga

SEQ ID NO: 9065714 - DNA, 22 bp, Homo sapiens
ctgtggagcttgtggcagtggg

SEQ ID NO: 9065715 - DNA, 22 bp, Homo sapiens
ctgtggagcttgtggcagtggg

SEQ ID NO: 9065716 - DNA, 22 bp, Homo sapiens
ctgtggagcttgtggcagtggg

SEQ ID NO: 9065717 - DNA, 22 bp, Homo sapiens
ctgtggagcttgtggcagtggg

SEQ ID NO: 9065718 - DNA, 22 bp, Homo sapiens
ctgtggagtgcttggctcagtg

SEQ ID NO: 9065719 - DNA, 22 bp, Homo sapiens
ctgtggagtgcttggctcagtg

SEQ ID NO: 9065720 - DNA, 22 bp, Homo sapiens
ctgtggagtgcttggctcagtg

SEQ ID NO: 9065721 - DNA, 22 bp, Homo sapiens
ctgtggagtggggagtactggt

SEQ ID NO: 9065722 - DNA, 22 bp, Homo sapiens
ctgtggagtgcttggctcagtg

SEQ ID NO: 9065723 - DNA, 22 bp, Homo sapiens
ctgtggagtggggagtactggt

SEQ ID NO: 9065724 - DNA, 22 bp, Homo sapiens
atatggtaagagtatatttact

SEQ ID NO: 9065725 - DNA, 23 bp, Homo sapiens
atatggctgttgtgtgttaacat

SEQ ID NO: 9065726 - DNA, 22 bp, Homo sapiens
atatgtactgaaactgcttttc

SEQ ID NO: 9065727 - DNA, 22 bp, Homo sapiens
atatgtatgtacgcacatattc

SEQ ID NO: 9065728 - DNA, 23 bp, Homo sapiens
atatgtcatgcaccagcacttta

SEQ ID NO: 9065729 - DNA, 23 bp, Homo sapiens
atatgtcatgcaccagcacttta

SEQ ID NO: 9065730 - DNA, 23 bp, Homo sapiens
atatgtcatgcaccagcacttta

SEQ ID NO: 9065731 - DNA, 22 bp, Homo sapiens
atatttggaaagaaaatcattg

SEQ ID NO: 9065732 - DNA, 22 bp, Homo sapiens
atatttgtagtgggtaagaagt

SEQ ID NO: 9065733 - DNA, 22 bp, Homo sapiens
atatttgtagtgggtaagaagt

SEQ ID NO: 9065734 - DNA, 22 bp, Homo sapiens
atatttgtaaaattctgtgtct

SEQ ID NO: 9065735 - DNA, 22 bp, Homo sapiens
atatttcttgagcacctggtat

SEQ ID NO: 9065736 - DNA, 22 bp, Homo sapiens
atatttctctcagacatggaag

SEQ ID NO: 9065737 - DNA, 20 bp, Homo sapiens
atatttcttaagaactttca

SEQ ID NO: 9065738 - DNA, 22 bp, Homo sapiens
atatttctgggggtgtgtttct

SEQ ID NO: 9065739 - DNA, 22 bp, Homo sapiens
atatgttactctttcaagcaga

SEQ ID NO: 9065740 - DNA, 22 bp, Homo sapiens
atatgttactctttcaagcaga

SEQ ID NO: 9065741 - DNA, 22 bp, Homo sapiens
atatgtttcagtattcaagtca

SEQ ID NO: 9065742 - DNA, 22 bp, Homo sapiens
atatttagctcatttccagtgc

SEQ ID NO: 9065743 - DNA, 22 bp, Homo sapiens
atatgtttttcacaggtttaag

SEQ ID NO: 9065744 - DNA, 22 bp, Homo sapiens
atatttactgctgtggtgaagg

SEQ ID NO: 9065745 - DNA, 22 bp, Homo sapiens
atatgaagttacaggtaagaaa

SEQ ID NO: 9065746 - DNA, 22 bp, Homo sapiens
atatgacagcggattcacatat

SEQ ID NO: 9065747 - DNA, 22 bp, Homo sapiens
atatgacataaaatcatttttg

SEQ ID NO: 9065748 - DNA, 22 bp, Homo sapiens
atatgagagaggaaagatttta

SEQ ID NO: 9065749 - DNA, 22 bp, Homo sapiens
atatgacagcggattcacatat

SEQ ID NO: 9065750 - DNA, 22 bp, Homo sapiens
atatgagaattggaaaatatca

SEQ ID NO: 9065751 - DNA, 22 bp, Homo sapiens
atatatattgcccaggctggtt

SEQ ID NO: 9065752 - DNA, 22 bp, Homo sapiens
atatatggtcaccttaaacata

SEQ ID NO: 9065753 - DNA, 22 bp, Homo sapiens
atatatggttaggaatctatga

SEQ ID NO: 9065754 - DNA, 18 bp, Homo sapiens
atatccaataatgaacac

SEQ ID NO: 9065755 - DNA, 18 bp, Homo sapiens
atatccaataatgaacac

SEQ ID NO: 9065756 - DNA, 22 bp, Homo sapiens
atatccaagaaacaattaattc

SEQ ID NO: 9065757 - DNA, 22 bp, Homo sapiens
atatcattctgatgtatatctt

SEQ ID NO: 9065758 - DNA, 22 bp, Homo sapiens
ctgggcaggagggctctatgga

SEQ ID NO: 9065759 - DNA, 22 bp, Homo sapiens
atatgattccactattgtatgg

SEQ ID NO: 9065760 - DNA, 22 bp, Homo sapiens
atatgattgtccttagcaaatt

SEQ ID NO: 9065761 - DNA, 20 bp, Homo sapiens
ctgggcaggtgtttgatctc

SEQ ID NO: 9065762 - DNA, 22 bp, Homo sapiens
ctgggcaggatacttcatggga

SEQ ID NO: 9065763 - DNA, 22 bp, Homo sapiens
ctgggcaggatacttcatggga

SEQ ID NO: 9065764 - DNA, 22 bp, Homo sapiens
ctgggcaggatacttcatggga

SEQ ID NO: 9065765 - DNA, 22 bp, Homo sapiens
atatggcaaaggggaattaagg

SEQ ID NO: 9065766 - DNA, 22 bp, Homo sapiens
atatggcagaccaattagaagc

SEQ ID NO: 9065767 - DNA, 22 bp, Homo sapiens
ctgggcagtggtggcccttccc

SEQ ID NO: 9065768 - DNA, 22 bp, Homo sapiens
ctgggcagtggtggcccttccc

SEQ ID NO: 9065769 - DNA, 22 bp, Homo sapiens
ctgggcagtggtggcatctttg

SEQ ID NO: 9065770 - DNA, 22 bp, Homo sapiens
ctgggcagtggtggcatctttg

SEQ ID NO: 9065771 - DNA, 22 bp, Homo sapiens
ctgggcagtggtggcatctttg

SEQ ID NO: 9065772 - DNA, 22 bp, Homo sapiens
ctgggcagtggtggcatctttg

SEQ ID NO: 9065773 - DNA, 22 bp, Homo sapiens
ctgggactttaccctgtggccc

SEQ ID NO: 9065774 - DNA, 22 bp, Homo sapiens
ctgggagagaagcgaagctggg

SEQ ID NO: 9065775 - DNA, 22 bp, Homo sapiens
ctgggagagcctttcctgagtc

SEQ ID NO: 9065776 - DNA, 22 bp, Homo sapiens
ctgggagacgcagctggggatc

SEQ ID NO: 9065777 - DNA, 19 bp, Homo sapiens
ctgggaggtgttcagagaa

SEQ ID NO: 9065778 - DNA, 19 bp, Homo sapiens
ctgggaggtgttcagagaa

SEQ ID NO: 9065779 - DNA, 19 bp, Homo sapiens
ctgggaggtgttcagagaa

SEQ ID NO: 9065780 - DNA, 19 bp, Homo sapiens
ctgggaggtgttcagagaa

SEQ ID NO: 9065781 - DNA, 22 bp, Homo sapiens
ctgggcaatatgctgggcctgg

SEQ ID NO: 9065782 - DNA, 22 bp, Homo sapiens
ctgggcacaagtggccctggat

SEQ ID NO: 9065783 - DNA, 22 bp, Homo sapiens
ctgggcacacagtgactctgca

SEQ ID NO: 9065784 - DNA, 22 bp, Homo sapiens
ctgggcacagcgttgggctctt

SEQ ID NO: 9065785 - DNA, 22 bp, Homo sapiens
ctgggcacaggggagcagagtc

SEQ ID NO: 9065786 - DNA, 22 bp, Homo sapiens
ctgggcacaggggagcagagtc

SEQ ID NO: 9065787 - DNA, 22 bp, Homo sapiens
ctgggcacattttgactagtgt

SEQ ID NO: 9065788 - DNA, 22 bp, Homo sapiens
atatatatcgagttcatgtctc

SEQ ID NO: 9065789 - DNA, 22 bp, Homo sapiens
atatatatgctgatggctgcca

SEQ ID NO: 9065790 - DNA, 22 bp, Homo sapiens
ctgggaaggggaaggtcctctc

SEQ ID NO: 9065791 - DNA, 22 bp, Homo sapiens
ctgggaaggggaaggtcctctc

SEQ ID NO: 9065792 - DNA, 22 bp, Homo sapiens
ctgggaagtggtgagggcctga

SEQ ID NO: 9065793 - DNA, 22 bp, Homo sapiens
ctgggaagggacgccagtgcct

SEQ ID NO: 9065794 - DNA, 22 bp, Homo sapiens
ctgggaagtagaatcagatgag

SEQ ID NO: 9065795 - DNA, 22 bp, Homo sapiens
ctgggaagtagaatcagatgag

SEQ ID NO: 9065796 - DNA, 22 bp, Homo sapiens
ctgggaagcttcgagcaggaaa

SEQ ID NO: 9065797 - DNA, 22 bp, Homo sapiens
ctgggaagcttcgagcaggaaa

SEQ ID NO: 9065798 - DNA, 22 bp, Homo sapiens
ctgggaagccatgtttctagga

SEQ ID NO: 9065799 - DNA, 22 bp, Homo sapiens
ctgggaagccatgtttctagga

SEQ ID NO: 9065800 - DNA, 22 bp, Homo sapiens
ctgggaaggagggttgcgaagg

SEQ ID NO: 9065801 - DNA, 22 bp, Homo sapiens
ctgggaagcttcgagcaggaaa

SEQ ID NO: 9065802 - DNA, 22 bp, Homo sapiens
ctgggaagggagtcaagatact

SEQ ID NO: 9065803 - DNA, 22 bp, Homo sapiens
ctgggaagggagtcaagatact

SEQ ID NO: 9065804 - DNA, 22 bp, Homo sapiens
ctgggaagggagtcaagatact

SEQ ID NO: 9065805 - DNA, 22 bp, Homo sapiens
ctgggaagccacagggtgtggg

SEQ ID NO: 9065806 - DNA, 22 bp, Homo sapiens
ctggcttgaagttatgcaccag

SEQ ID NO: 9065807 - DNA, 22 bp, Homo sapiens
ctgggaagcatggtgatggtat

SEQ ID NO: 9065808 - DNA, 22 bp, Homo sapiens
ctggcagctggaggctagaggc

SEQ ID NO: 9065809 - DNA, 22 bp, Homo sapiens
ctgggacacccaaggaaagagc

SEQ ID NO: 9065810 - DNA, 22 bp, Homo sapiens
atataacatacatacagaaaag

SEQ ID NO: 9065811 - DNA, 22 bp, Homo sapiens
atatataacctggataaggctt

SEQ ID NO: 9065812 - DNA, 22 bp, Homo sapiens
atataatacaacctgctaagtg

SEQ ID NO: 9065813 - DNA, 22 bp, Homo sapiens
atataatacaacctgctaagtg

SEQ ID NO: 9065814 - DNA, 22 bp, Homo sapiens
catgtacatgcctactatcaat

SEQ ID NO: 9065815 - DNA, 22 bp, Homo sapiens
catgtacatgcctactatcaat

SEQ ID NO: 9065816 - DNA, 22 bp, Homo sapiens
catgtacatgcctactatcaat

SEQ ID NO: 9065817 - DNA, 18 bp, Homo sapiens
catgtctgcgccacaagg

SEQ ID NO: 9065818 - DNA, 22 bp, Homo sapiens
catgtcttaggaaagcagagga

SEQ ID NO: 9065819 - DNA, 20 bp, Homo sapiens
tccagcccagcagcctgaca

SEQ ID NO: 9065820 - DNA, 18 bp, Homo sapiens
tccagcccacattttctg

SEQ ID NO: 9065821 - DNA, 20 bp, Homo sapiens
tccagcccagcagcctgaca

SEQ ID NO: 9065822 - DNA, 22 bp, Homo sapiens
tccagccacttgcacagttaaa

SEQ ID NO: 9065823 - DNA, 20 bp, Homo sapiens
tccagccacttccgctggtc

SEQ ID NO: 9065824 - DNA, 22 bp, Homo sapiens
catggcttttagccctacatga

SEQ ID NO: 9065825 - DNA, 22 bp, Homo sapiens
tccagccaggatggcccaggga

SEQ ID NO: 9065826 - DNA, 22 bp, Homo sapiens
tccagccaggatggcccaggga

SEQ ID NO: 9065827 - DNA, 21 bp, Homo sapiens
tccagccagtaaatgctcagc

SEQ ID NO: 9065828 - DNA, 22 bp, Homo sapiens
tccagccatgcatgacaatcac

SEQ ID NO: 9065829 - DNA, 22 bp, Homo sapiens
tccagccatgactcggacagtg

SEQ ID NO: 9065830 - DNA, 22 bp, Homo sapiens
tccagccatgactcggacagtg

SEQ ID NO: 9065831 - DNA, 22 bp, Homo sapiens
tccagcccacacctgaagctgg

SEQ ID NO: 9065832 - DNA, 22 bp, Homo sapiens
tccagcccacacctgaagctgg

SEQ ID NO: 9065833 - DNA, 22 bp, Homo sapiens
tccagccatgcatgacaatcac

SEQ ID NO: 9065834 - DNA, 19 bp, Homo sapiens
catgtgcatgagcacagga

SEQ ID NO: 9065835 - DNA, 19 bp, Homo sapiens
catgtgcatgagcacagga

SEQ ID NO: 9065836 - DNA, 22 bp, Homo sapiens
tccaggcaaagtgctgggctgc

SEQ ID NO: 9065837 - DNA, 22 bp, Homo sapiens
catgtgcagacggtgggctgga

SEQ ID NO: 9065838 - DNA, 22 bp, Homo sapiens
catgtgattacactaagaaggt

SEQ ID NO: 9065839 - DNA, 22 bp, Homo sapiens
catgtgcatccttaatctccct

SEQ ID NO: 9065840 - DNA, 22 bp, Homo sapiens
catgtctttctcatcacatcta

SEQ ID NO: 9065841 - DNA, 22 bp, Homo sapiens
catgtgaattccaaagctaggt

SEQ ID NO: 9065842 - DNA, 22 bp, Homo sapiens
catgtgaattccaaagctaggt

SEQ ID NO: 9065843 - DNA, 22 bp, Homo sapiens
tcattttcacacataaatagca

SEQ ID NO: 9065844 - DNA, 22 bp, Homo sapiens
tcattttggggtttgtcatctt

SEQ ID NO: 9065845 - DNA, 22 bp, Homo sapiens
tcattttgcctgccatttgagt

SEQ ID NO: 9065846 - DNA, 22 bp, Homo sapiens
catgcaaatggtggctaaatgg

SEQ ID NO: 9065847 - DNA, 23 bp, Homo sapiens
catgcaaacactattgcatttgg

SEQ ID NO: 9065848 - DNA, 22 bp, Homo sapiens
catgcaaagcgttttgaccagc

SEQ ID NO: 9065849 - DNA, 22 bp, Homo sapiens
catgcaaaatgtattttattag

SEQ ID NO: 9065850 - DNA, 22 bp, Homo sapiens
catgcaaacacgtaaacattca

SEQ ID NO: 9065851 - DNA, 22 bp, Homo sapiens
tcatttttagcgcgcaaaagtt

SEQ ID NO: 9065852 - DNA, 22 bp, Homo sapiens
catggcttactttcagggagta

SEQ ID NO: 9065853 - DNA, 22 bp, Homo sapiens
catggccaggcacgcgcatagc

SEQ ID NO: 9065854 - DNA, 22 bp, Homo sapiens
catggctgcctgtggacactgc

SEQ ID NO: 9065855 - DNA, 22 bp, Homo sapiens
catggccagccctgaggttcag

SEQ ID NO: 9065856 - DNA, 22 bp, Homo sapiens
catgattgatccttctaaatgc

SEQ ID NO: 9065857 - DNA, 22 bp, Homo sapiens
tcatggctttttcactgttcgc

SEQ ID NO: 9065858 - DNA, 22 bp, Homo sapiens
tcatggggccacagctgccagc

SEQ ID NO: 9065859 - DNA, 22 bp, Homo sapiens
tcatggggctcttcaagtggag

SEQ ID NO: 9065860 - DNA, 22 bp, Homo sapiens
tcatggttggagattgagggca

SEQ ID NO: 9065861 - DNA, 22 bp, Homo sapiens
tcatgtaaatgtggatgcttcc

SEQ ID NO: 9065862 - DNA, 22 bp, Homo sapiens
tcatgtacatgtaagtcagaaa

SEQ ID NO: 9065863 - DNA, 21 bp, Homo sapiens
tcatgtaatgcatgaagtaaa

SEQ ID NO: 9065864 - DNA, 22 bp, Homo sapiens
tcatgtcagtttcttctataaa

SEQ ID NO: 9065865 - DNA, 22 bp, Homo sapiens
tcatttgttgaactttagtgcg

SEQ ID NO: 9065866 - DNA, 22 bp, Homo sapiens
tcatttgttgctgttacctgag

SEQ ID NO: 9065867 - DNA, 18 bp, Homo sapiens
tcatttgttttgcatgaa

SEQ ID NO: 9065868 - DNA, 21 bp, Homo sapiens
catgatctcattcaactaggg

SEQ ID NO: 9065869 - DNA, 22 bp, Homo sapiens
catgatctggtcctactgtggg

SEQ ID NO: 9065870 - DNA, 22 bp, Homo sapiens
catgatgttatcaagcacaaag

SEQ ID NO: 9065871 - DNA, 22 bp, Homo sapiens
catgattatattaatggcttca

SEQ ID NO: 9065872 - DNA, 22 bp, Homo sapiens
catgatgttatctaaatctggt

SEQ ID NO: 9065873 - DNA, 22 bp, Homo sapiens
catgatgtcacagagaagcaca

SEQ ID NO: 9065874 - DNA, 22 bp, Homo sapiens
catgatgtcacagagaagcaca

SEQ ID NO: 9065875 - DNA, 22 bp, Homo sapiens
catgagaaggttttggcatata

SEQ ID NO: 9065876 - DNA, 22 bp, Homo sapiens
catgagaagtggccttcaaaaa

SEQ ID NO: 9065877 - DNA, 22 bp, Homo sapiens
tcagtttcacagtctgtgcaga

SEQ ID NO: 9065878 - DNA, 22 bp, Homo sapiens
catgagtgtcatctcagcagct

SEQ ID NO: 9065879 - DNA, 22 bp, Homo sapiens
catcttaacaggtctctgaggg

SEQ ID NO: 9065880 - DNA, 22 bp, Homo sapiens
catcttaaattaaagcttaagg

SEQ ID NO: 9065881 - DNA, 22 bp, Homo sapiens
catcttaaccctcagcctccca

SEQ ID NO: 9065882 - DNA, 22 bp, Homo sapiens
catctttaaaatgggaacaaca

SEQ ID NO: 9065883 - DNA, 22 bp, Homo sapiens
catctttaacaatttacaatgt

SEQ ID NO: 9065884 - DNA, 22 bp, Homo sapiens
catctttaacaatttacaatgt

SEQ ID NO: 9065885 - DNA, 22 bp, Homo sapiens
tcaggtgggacctgctaggaca

SEQ ID NO: 9065886 - DNA, 22 bp, Homo sapiens
catccctgacttctaggtgaca

SEQ ID NO: 9065887 - DNA, 22 bp, Homo sapiens
catccctgattcctagtacagt

SEQ ID NO: 9065888 - DNA, 22 bp, Homo sapiens
catccccagagcagttccacta

SEQ ID NO: 9065889 - DNA, 22 bp, Homo sapiens
catccattaactcatttgtttc

SEQ ID NO: 9065890 - DNA, 22 bp, Homo sapiens
catccctgctggtggaaggggt

SEQ ID NO: 9065891 - DNA, 22 bp, Homo sapiens
catccctgggcgggacactctt

SEQ ID NO: 9065892 - DNA, 22 bp, Homo sapiens
catccctgccctcatgcctata

SEQ ID NO: 9065893 - DNA, 22 bp, Homo sapiens
catccctggttcctgtgtttaa

SEQ ID NO: 9065894 - DNA, 22 bp, Homo sapiens
catctttagttattgaatatag

SEQ ID NO: 9065895 - DNA, 22 bp, Homo sapiens
catctttagttattgaatatag

SEQ ID NO: 9065896 - DNA, 22 bp, Homo sapiens
catctttagggaccattattct

SEQ ID NO: 9065897 - DNA, 22 bp, Homo sapiens
catctttagggaccattattct

SEQ ID NO: 9065898 - DNA, 22 bp, Homo sapiens
catctttatttatatagacagg

SEQ ID NO: 9065899 - DNA, 22 bp, Homo sapiens
catctttgaactctgtataaac

SEQ ID NO: 9065900 - DNA, 22 bp, Homo sapiens
catctttgaactctgtataaac

SEQ ID NO: 9065901 - DNA, 22 bp, Homo sapiens
tcagttctggctgctgctgtca

SEQ ID NO: 9065902 - DNA, 22 bp, Homo sapiens
tcagttctgaagttctgcctcc

SEQ ID NO: 9065903 - DNA, 21 bp, Homo sapiens
tcagttctctgcctgtgcttg

SEQ ID NO: 9065904 - DNA, 22 bp, Homo sapiens
catctttgcaccctcaaaacct

SEQ ID NO: 9065905 - DNA, 22 bp, Homo sapiens
catcacagtggctgtttattta

SEQ ID NO: 9065906 - DNA, 22 bp, Homo sapiens
catcacagtggctgtttattta

SEQ ID NO: 9065907 - DNA, 22 bp, Homo sapiens
catcacagtttgtcagaaatca

SEQ ID NO: 9065908 - DNA, 22 bp, Homo sapiens
catcacaggcattttgagtgtc

SEQ ID NO: 9065909 - DNA, 21 bp, Homo sapiens
catcacattactcaaagtcct

SEQ ID NO: 9065910 - DNA, 22 bp, Homo sapiens
catcatctctcccccaggcctg

SEQ ID NO: 9065911 - DNA, 22 bp, Homo sapiens
catcacatgtaggcagcatcac

SEQ ID NO: 9065912 - DNA, 22 bp, Homo sapiens
catccaggctgaagtgcagtgg

SEQ ID NO: 9065913 - DNA, 22 bp, Homo sapiens
catcacagaaataaacatacct

SEQ ID NO: 9065914 - DNA, 21 bp, Homo sapiens
catcacaggatgattttttca

SEQ ID NO: 9065915 - DNA, 22 bp, Homo sapiens
catcacaaatgtaataatgtct

SEQ ID NO: 9065916 - DNA, 22 bp, Homo sapiens
tcagggccacgcggaggtgacg

SEQ ID NO: 9065917 - DNA, 22 bp, Homo sapiens
tcagggccaggactaggatgag

SEQ ID NO: 9065918 - DNA, 22 bp, Homo sapiens
tcagggccatcttttgcctcaa

SEQ ID NO: 9065919 - DNA, 22 bp, Homo sapiens
tcagggattgcaaaattcatcc

SEQ ID NO: 9065920 - DNA, 20 bp, Homo sapiens
catatggaaagatattgttc

SEQ ID NO: 9065921 - DNA, 22 bp, Homo sapiens
catatggacaagaacatttatg

SEQ ID NO: 9065922 - DNA, 22 bp, Homo sapiens
catatacacttccacctctgtg

SEQ ID NO: 9065923 - DNA, 22 bp, Homo sapiens
tcaggaagtggtaaaggatgtt

SEQ ID NO: 9065924 - DNA, 22 bp, Homo sapiens
tcaggaagtggtaaaggatgtt

SEQ ID NO: 9065925 - DNA, 22 bp, Homo sapiens
tcaggaagtgctgaggctgctt

SEQ ID NO: 9065926 - DNA, 22 bp, Homo sapiens
tcaggaagttgaggcgtagaga

SEQ ID NO: 9065927 - DNA, 22 bp, Homo sapiens
tcaggaagtggtaaaggatgtt

SEQ ID NO: 9065928 - DNA, 22 bp, Homo sapiens
tcaggaagtggtaaaggatgtt

SEQ ID NO: 9065929 - DNA, 22 bp, Homo sapiens
tcaggaagtctcaattagctac

SEQ ID NO: 9065930 - DNA, 22 bp, Homo sapiens
tcaggaagtctcaattagctac

SEQ ID NO: 9065931 - DNA, 22 bp, Homo sapiens
tcaggaagtgcctaggctggcc

SEQ ID NO: 9065932 - DNA, 22 bp, Homo sapiens
tcaggaagtgcctaggctggcc

SEQ ID NO: 9065933 - DNA, 22 bp, Homo sapiens
catatattctggttttcactgg

SEQ ID NO: 9065934 - DNA, 22 bp, Homo sapiens
catatattctggttttcactgg

SEQ ID NO: 9065935 - DNA, 22 bp, Homo sapiens
catatatgtgcagaccacttga

SEQ ID NO: 9065936 - DNA, 22 bp, Homo sapiens
catatatgtagatgtatgtgaa

SEQ ID NO: 9065937 - DNA, 22 bp, Homo sapiens
catatattatggactgcagaat

SEQ ID NO: 9065938 - DNA, 22 bp, Homo sapiens
catatacacttccacctctgtg

SEQ ID NO: 9065939 - DNA, 23 bp, Homo sapiens
catatgaattttagaggcagttt

SEQ ID NO: 9065940 - DNA, 22 bp, Homo sapiens
tcagccctgggcttcctcatgg

SEQ ID NO: 9065941 - DNA, 22 bp, Homo sapiens
tcagccctgggcttcctcatgg

SEQ ID NO: 9065942 - DNA, 22 bp, Homo sapiens
tcagccctgggcttcctcatgg

SEQ ID NO: 9065943 - DNA, 22 bp, Homo sapiens
tcagctcttaaccctctggcct

SEQ ID NO: 9065944 - DNA, 22 bp, Homo sapiens
tcagctgagttctagagcactc

SEQ ID NO: 9065945 - DNA, 22 bp, Homo sapiens
tcagctgaagtggagaagcaga

SEQ ID NO: 9065946 - DNA, 22 bp, Homo sapiens
tcagctgagctccagctcatag

SEQ ID NO: 9065947 - DNA, 22 bp, Homo sapiens
tcagccctagcctcagtccagg

SEQ ID NO: 9065948 - DNA, 22 bp, Homo sapiens
tcagccctagcctcagtccagg

SEQ ID NO: 9065949 - DNA, 22 bp, Homo sapiens
tcagccctagaaagtctaagca

SEQ ID NO: 9065950 - DNA, 22 bp, Homo sapiens
tcagccctggcactgtctccca

SEQ ID NO: 9065951 - DNA, 20 bp, Homo sapiens
tcagccctgagtccaggctg

SEQ ID NO: 9065952 - DNA, 22 bp, Homo sapiens
tcagccctggcactgtctccca

SEQ ID NO: 9065953 - DNA, 22 bp, Homo sapiens
tcagccctgggacccagggatg

SEQ ID NO: 9065954 - DNA, 22 bp, Homo sapiens
tcagccctacattaggtaagcc

SEQ ID NO: 9065955 - DNA, 22 bp, Homo sapiens
catacattgaatttgcacgtgt

SEQ ID NO: 9065956 - DNA, 22 bp, Homo sapiens
catacattgctcattcagtatc

SEQ ID NO: 9065957 - DNA, 22 bp, Homo sapiens
catacattgctcattcagtatc

SEQ ID NO: 9065958 - DNA, 22 bp, Homo sapiens
catacatttatacacatctatg

SEQ ID NO: 9065959 - DNA, 22 bp, Homo sapiens
cataatttttttaagtcagaac

SEQ ID NO: 9065960 - DNA, 22 bp, Homo sapiens
tcagctgcagcaggcaccattt

SEQ ID NO: 9065961 - DNA, 22 bp, Homo sapiens
catagaaaagagtaggtaatgt

SEQ ID NO: 9065962 - DNA, 22 bp, Homo sapiens
catagaaaagagtaggtaatgt

SEQ ID NO: 9065963 - DNA, 21 bp, Homo sapiens
cataccattctctaagcaaaa

SEQ ID NO: 9065964 - DNA, 22 bp, Homo sapiens
catacccatttgtttcaggagc

SEQ ID NO: 9065965 - DNA, 22 bp, Homo sapiens
catacattttgcatatttacca

SEQ ID NO: 9065966 - DNA, 22 bp, Homo sapiens
catacttactgtgtaccaggtg

SEQ ID NO: 9065967 - DNA, 22 bp, Homo sapiens
catactttctttttcacgcata

SEQ ID NO: 9065968 - DNA, 22 bp, Homo sapiens
catactgtcagagcctgaaggg

SEQ ID NO: 9065969 - DNA, 22 bp, Homo sapiens
cagtttgtatttattactcata

SEQ ID NO: 9065970 - DNA, 22 bp, Homo sapiens
cagtttctttccattgttacct

SEQ ID NO: 9065971 - DNA, 22 bp, Homo sapiens
tcagcccagggacagaggcccc

SEQ ID NO: 9065972 - DNA, 20 bp, Homo sapiens
tcagcccagggtgagcatct

SEQ ID NO: 9065973 - DNA, 22 bp, Homo sapiens
tcagcagtggctctcatgcagt

SEQ ID NO: 9065974 - DNA, 22 bp, Homo sapiens
tcagcagtgggtcctgagggtg

SEQ ID NO: 9065975 - DNA, 22 bp, Homo sapiens
cagtttcttagtgacacaaatc

SEQ ID NO: 9065976 - DNA, 22 bp, Homo sapiens
tcagaagtccccagtcaaggag

SEQ ID NO: 9065977 - DNA, 22 bp, Homo sapiens
tcagaagtattatgctaaagga

SEQ ID NO: 9065978 - DNA, 22 bp, Homo sapiens
tcagaagtcacttaggaaaggg

SEQ ID NO: 9065979 - DNA, 22 bp, Homo sapiens
tcagaagtccaataccatggga

SEQ ID NO: 9065980 - DNA, 22 bp, Homo sapiens
tcagaagggaaacacaagtgac

SEQ ID NO: 9065981 - DNA, 22 bp, Homo sapiens
cagtttctgtggtctcttttca

SEQ ID NO: 9065982 - DNA, 22 bp, Homo sapiens
cagtttatatgagggtatcaag

SEQ ID NO: 9065983 - DNA, 22 bp, Homo sapiens
cagtgctgagagcctggccagg

SEQ ID NO: 9065984 - DNA, 22 bp, Homo sapiens
cagtgctgcatctccatgccag

SEQ ID NO: 9065985 - DNA, 22 bp, Homo sapiens
cagtgctgcaggcgcctgcggt

SEQ ID NO: 9065986 - DNA, 22 bp, Homo sapiens
cagtgctgccaaagggaccttg

SEQ ID NO: 9065987 - DNA, 22 bp, Homo sapiens
cagtgctgacagggaggaacct

SEQ ID NO: 9065988 - DNA, 22 bp, Homo sapiens
cagtgctggaggctggagggaa

SEQ ID NO: 9065989 - DNA, 22 bp, Homo sapiens
cagtgctggaggggtgcttgca

SEQ ID NO: 9065990 - DNA, 22 bp, Homo sapiens
cagtgctggaggggtgcttgca

SEQ ID NO: 9065991 - DNA, 22 bp, Homo sapiens
cagtgctggagatgggtggaac

SEQ ID NO: 9065992 - DNA, 21 bp, Homo sapiens
cagtgctgcctaatagggagt

SEQ ID NO: 9065993 - DNA, 22 bp, Homo sapiens
cagtgctgggcagaggagagcg

SEQ ID NO: 9065994 - DNA, 22 bp, Homo sapiens
cagtgctggctgttaggacagt

SEQ ID NO: 9065995 - DNA, 22 bp, Homo sapiens
cagtgctgtgctggaagctgtt

SEQ ID NO: 9065996 - DNA, 22 bp, Homo sapiens
cagtgctgtgtttgctgcctgg

SEQ ID NO: 9065997 - DNA, 23 bp, Homo sapiens
cagtgctggttctgcctgtgggg

SEQ ID NO: 9065998 - DNA, 22 bp, Homo sapiens
cagtgctgtgctggaagctgtt

SEQ ID NO: 9065999 - DNA, 19 bp, Homo sapiens
cagtgctgttcattcagtg

SEQ ID NO: 9066000 - DNA, 18 bp, Homo sapiens
cagtgctgttaacagtga

SEQ ID NO: 9066001 - DNA, 22 bp, Homo sapiens
tcaccattggcaattataaaac

SEQ ID NO: 9066002 - DNA, 22 bp, Homo sapiens
tcaccagggctccagccagcct

SEQ ID NO: 9066003 - DNA, 22 bp, Homo sapiens
tcaccaggctagagtgcagtgg

SEQ ID NO: 9066004 - DNA, 22 bp, Homo sapiens
tcaccaggctggagtgcagtgg

SEQ ID NO: 9066005 - DNA, 22 bp, Homo sapiens
tcaccaggctggaatgcagtgg

SEQ ID NO: 9066006 - DNA, 22 bp, Homo sapiens
tcagaaatagtctttaaaatga

SEQ ID NO: 9066007 - DNA, 22 bp, Homo sapiens
tcagaagctggtgtcctttgaa

SEQ ID NO: 9066008 - DNA, 22 bp, Homo sapiens
tcagaaggaaacgatgccagct

SEQ ID NO: 9066009 - DNA, 22 bp, Homo sapiens
tcagaaggaagttagagtatgg

SEQ ID NO: 9066010 - DNA, 22 bp, Homo sapiens
tcagaaggaaacgatgccagct

SEQ ID NO: 9066011 - DNA, 22 bp, Homo sapiens
tcagaaggcccgttgctaagag

SEQ ID NO: 9066012 - DNA, 22 bp, Homo sapiens
tcagaaggcccgttgctaagag

SEQ ID NO: 9066013 - DNA, 22 bp, Homo sapiens
tcactcaatatcccagtggggc

SEQ ID NO: 9066014 - DNA, 22 bp, Homo sapiens
tcactcagcctgcctggttcct

SEQ ID NO: 9066015 - DNA, 22 bp, Homo sapiens
tcactcagctagcttcaggagc

SEQ ID NO: 9066016 - DNA, 22 bp, Homo sapiens
tcacccaagaccatcggaagtg

SEQ ID NO: 9066017 - DNA, 22 bp, Homo sapiens
tcacccagacagcttgcactga

SEQ ID NO: 9066018 - DNA, 22 bp, Homo sapiens
tcactcagtttttggcctctgc

SEQ ID NO: 9066019 - DNA, 22 bp, Homo sapiens
tcacttcccagacggggtggca

SEQ ID NO: 9066020 - DNA, 22 bp, Homo sapiens
tcacttcccagacggggtggca

SEQ ID NO: 9066021 - DNA, 22 bp, Homo sapiens
cagtcctgtgtcccttggtggg

SEQ ID NO: 9066022 - DNA, 22 bp, Homo sapiens
cagtcctgtctttatgacttca

SEQ ID NO: 9066023 - DNA, 22 bp, Homo sapiens
cagtcctgtctttatgacttca

SEQ ID NO: 9066024 - DNA, 22 bp, Homo sapiens
cagtcctgtgtcccttggtggg

SEQ ID NO: 9066025 - DNA, 22 bp, Homo sapiens
cagtcctgttcctggagtagtt

SEQ ID NO: 9066026 - DNA, 18 bp, Homo sapiens
cagtcctgtttctacagg

SEQ ID NO: 9066027 - DNA, 22 bp, Homo sapiens
cagtcctgttcctggagtagtt

SEQ ID NO: 9066028 - DNA, 22 bp, Homo sapiens
cagtcctgttcctggagtagtt

SEQ ID NO: 9066029 - DNA, 22 bp, Homo sapiens
cagtcctgttcctggagtagtt

SEQ ID NO: 9066030 - DNA, 22 bp, Homo sapiens
cagtcctctcactcaggccttt

SEQ ID NO: 9066031 - DNA, 22 bp, Homo sapiens
cagtcctgggcacagccctggg

SEQ ID NO: 9066032 - DNA, 22 bp, Homo sapiens
cagtcctgggcacagccctggg

SEQ ID NO: 9066033 - DNA, 22 bp, Homo sapiens
cagtcctgggcaggtcaggcca

SEQ ID NO: 9066034 - DNA, 22 bp, Homo sapiens
cagtcctggggaccaggctgag

SEQ ID NO: 9066035 - DNA, 22 bp, Homo sapiens
cagtcctggggaccaggctgag

SEQ ID NO: 9066036 - DNA, 22 bp, Homo sapiens
cagtcctggggaccaggctgag

SEQ ID NO: 9066037 - DNA, 22 bp, Homo sapiens
cagtcctggggaccaggctgag

SEQ ID NO: 9066038 - DNA, 22 bp, Homo sapiens
cagtcctggggaccaggctgag

SEQ ID NO: 9066039 - DNA, 22 bp, Homo sapiens
cagtcctgggtgcagcaggaaa

SEQ ID NO: 9066040 - DNA, 20 bp, Homo sapiens
cagtcctgtccctgctgccc

SEQ ID NO: 9066041 - DNA, 22 bp, Homo sapiens
cagtcctgggtgcagcaggaaa

SEQ ID NO: 9066042 - DNA, 20 bp, Homo sapiens
tatttagattcaagtatgga

SEQ ID NO: 9066043 - DNA, 20 bp, Homo sapiens
tatttagattcaagtatgga

SEQ ID NO: 9066044 - DNA, 22 bp, Homo sapiens
tatttagttatctttcataaaa

SEQ ID NO: 9066045 - DNA, 20 bp, Homo sapiens
tattggatctaagaaatggg

SEQ ID NO: 9066046 - DNA, 22 bp, Homo sapiens
tattggatgaagaaaggaagga

SEQ ID NO: 9066047 - DNA, 20 bp, Homo sapiens
tatttacaacttagagcctc

SEQ ID NO: 9066048 - DNA, 20 bp, Homo sapiens
tatttacaacttagagcctc

SEQ ID NO: 9066049 - DNA, 20 bp, Homo sapiens
tatttacaacttagagcctc

SEQ ID NO: 9066050 - DNA, 21 bp, Homo sapiens
tattggccattaaagggaaaa

SEQ ID NO: 9066051 - DNA, 22 bp, Homo sapiens
tattggatttctgaaagatgag

SEQ ID NO: 9066052 - DNA, 22 bp, Homo sapiens
cagtgcagacgtggagggggca

SEQ ID NO: 9066053 - DNA, 22 bp, Homo sapiens
cagtgcagacgtggagggggca

SEQ ID NO: 9066054 - DNA, 22 bp, Homo sapiens
cagtgcaacttttgcctcccgg

SEQ ID NO: 9066055 - DNA, 20 bp, Homo sapiens
cagtgcaactgaagaactga

SEQ ID NO: 9066056 - DNA, 22 bp, Homo sapiens
cagtgcaagctgatactgaggt

SEQ ID NO: 9066057 - DNA, 22 bp, Homo sapiens
cagtgcaagggtgctgggggca

SEQ ID NO: 9066058 - DNA, 22 bp, Homo sapiens
cagtgcaatattcaaagtggag

SEQ ID NO: 9066059 - DNA, 22 bp, Homo sapiens
cagtgcaagtgactgatcaagg

SEQ ID NO: 9066060 - DNA, 22 bp, Homo sapiens
cagtgcaattacaagctaattc

SEQ ID NO: 9066061 - DNA, 22 bp, Homo sapiens
cagtgcaattagaacttattta

SEQ ID NO: 9066062 - DNA, 21 bp, Homo sapiens
cagtgcaattgattttttaga

SEQ ID NO: 9066063 - DNA, 22 bp, Homo sapiens
cagtgcaatgcagatgacacca

SEQ ID NO: 9066064 - DNA, 22 bp, Homo sapiens
cagtgcaatgttaaataggaaa

SEQ ID NO: 9066065 - DNA, 22 bp, Homo sapiens
cagtgcaaactccctgaggtgg

SEQ ID NO: 9066066 - DNA, 22 bp, Homo sapiens
cagtgcaacagattcgagaagc

SEQ ID NO: 9066067 - DNA, 22 bp, Homo sapiens
cagtgcaacgttgtgcattcaa

SEQ ID NO: 9066068 - DNA, 22 bp, Homo sapiens
cagtgattcacgcccttgggcc

SEQ ID NO: 9066069 - DNA, 22 bp, Homo sapiens
cagtgatgatcattgtaacatc

SEQ ID NO: 9066070 - DNA, 17 bp, Homo sapiens
cagtgatcattacatta

SEQ ID NO: 9066071 - DNA, 22 bp, Homo sapiens
cagtgatggatatggagaagtc

SEQ ID NO: 9066072 - DNA, 22 bp, Homo sapiens
cagtctcaccctggaggcccca

SEQ ID NO: 9066073 - DNA, 22 bp, Homo sapiens
cagtctaagttaatttccacaa

SEQ ID NO: 9066074 - DNA, 22 bp, Homo sapiens
cagtctaagactcacgccaaga

SEQ ID NO: 9066075 - DNA, 22 bp, Homo sapiens
cagtctaatctgttactcatta

SEQ ID NO: 9066076 - DNA, 22 bp, Homo sapiens
cagtctcagaggtgggagtggg

SEQ ID NO: 9066077 - DNA, 22 bp, Homo sapiens
cagtctccaaatcagtctgaat

SEQ ID NO: 9066078 - DNA, 22 bp, Homo sapiens
cagtgagtaagtagacagctta

SEQ ID NO: 9066079 - DNA, 22 bp, Homo sapiens
tataatatgaggcaggagtgat

SEQ ID NO: 9066080 - DNA, 22 bp, Homo sapiens
tataatatgaggcaggagtgat

SEQ ID NO: 9066081 - DNA, 22 bp, Homo sapiens
tataagcacatccttgactgat

SEQ ID NO: 9066082 - DNA, 22 bp, Homo sapiens
tataagaaattgccaacctgtt

SEQ ID NO: 9066083 - DNA, 22 bp, Homo sapiens
tataagaagtgaagaagagtta

SEQ ID NO: 9066084 - DNA, 22 bp, Homo sapiens
tataagaagtgaagaagagtta

SEQ ID NO: 9066085 - DNA, 22 bp, Homo sapiens
tataagaagtgaagaagagtta

SEQ ID NO: 9066086 - DNA, 22 bp, Homo sapiens
tagttttagtcccattttacag

SEQ ID NO: 9066087 - DNA, 22 bp, Homo sapiens
tacatgtggtagggagggcagt

SEQ ID NO: 9066088 - DNA, 22 bp, Homo sapiens
caggggccaggctgtctgctgt

SEQ ID NO: 9066089 - DNA, 22 bp, Homo sapiens
caggggccaggctgtctgctgt

SEQ ID NO: 9066090 - DNA, 22 bp, Homo sapiens
caggggccaggctgtctgctgt

SEQ ID NO: 9066091 - DNA, 22 bp, Homo sapiens
caggggccaagggtccagacct

SEQ ID NO: 9066092 - DNA, 22 bp, Homo sapiens
caggggccaagggtccagacct

SEQ ID NO: 9066093 - DNA, 22 bp, Homo sapiens
caggggccggctgtccgtgccc

SEQ ID NO: 9066094 - DNA, 22 bp, Homo sapiens
caggggccaggctgtctgctgt

SEQ ID NO: 9066095 - DNA, 22 bp, Homo sapiens
caggggcaagaatgctgtcagc

SEQ ID NO: 9066096 - DNA, 22 bp, Homo sapiens
caggggcagtctgtgtgcgtgg

SEQ ID NO: 9066097 - DNA, 22 bp, Homo sapiens
cagggtcttataaggccaattt

SEQ ID NO: 9066098 - DNA, 22 bp, Homo sapiens
caggggcctggctgtctaggaa

SEQ ID NO: 9066099 - DNA, 22 bp, Homo sapiens
caggggcctggctgtctaggaa

SEQ ID NO: 9066100 - DNA, 22 bp, Homo sapiens
cagggtggaaaagctagttgga

SEQ ID NO: 9066101 - DNA, 22 bp, Homo sapiens
cagggtggaagctgtagagtgg

SEQ ID NO: 9066102 - DNA, 22 bp, Homo sapiens
cagggtggaagctgtagagtgg

SEQ ID NO: 9066103 - DNA, 22 bp, Homo sapiens
cagggtggaatggaatgctggc

SEQ ID NO: 9066104 - DNA, 22 bp, Homo sapiens
tatacagatggaaagatacaca

SEQ ID NO: 9066105 - DNA, 22 bp, Homo sapiens
tatacagatggaaagatacaca

SEQ ID NO: 9066106 - DNA, 22 bp, Homo sapiens
tatacagatatctaagatgtaa

SEQ ID NO: 9066107 - DNA, 22 bp, Homo sapiens
tatacagtcttttgctatattc

SEQ ID NO: 9066108 - DNA, 22 bp, Homo sapiens
tatacagtgcctcttccattag

SEQ ID NO: 9066109 - DNA, 22 bp, Homo sapiens
tatacagtcttttgctatattc

SEQ ID NO: 9066110 - DNA, 22 bp, Homo sapiens
tatacagattaacagatttaaa

SEQ ID NO: 9066111 - DNA, 22 bp, Homo sapiens
tatacagattaacagatttaaa

SEQ ID NO: 9066112 - DNA, 22 bp, Homo sapiens
tatacagtatcttttgaaggca

SEQ ID NO: 9066113 - DNA, 22 bp, Homo sapiens
tatacaggaactgttggctccc

SEQ ID NO: 9066114 - DNA, 22 bp, Homo sapiens
tatacaggaaattttggaacag

SEQ ID NO: 9066115 - DNA, 22 bp, Homo sapiens
tatacagctatggcaagacaaa

SEQ ID NO: 9066116 - DNA, 22 bp, Homo sapiens
tatacagctatggcaagacaaa

SEQ ID NO: 9066117 - DNA, 21 bp, Homo sapiens
tatacagcaaagtctggagca

SEQ ID NO: 9066118 - DNA, 17 bp, Homo sapiens
caggtctgaggccaggc

SEQ ID NO: 9066119 - DNA, 17 bp, Homo sapiens
caggtctgaggccaggc

SEQ ID NO: 9066120 - DNA, 22 bp, Homo sapiens
caggtctgagtcacatgttcat

SEQ ID NO: 9066121 - DNA, 22 bp, Homo sapiens
caggtctgagtcacatgttcat

SEQ ID NO: 9066122 - DNA, 22 bp, Homo sapiens
caggtctgcagacagggccatg

SEQ ID NO: 9066123 - DNA, 22 bp, Homo sapiens
caggtctgcagacagggccatg

SEQ ID NO: 9066124 - DNA, 22 bp, Homo sapiens
caggtctgggttgatggcctgg

SEQ ID NO: 9066125 - DNA, 22 bp, Homo sapiens
caggtctggcatcagctgtgtg

SEQ ID NO: 9066126 - DNA, 22 bp, Homo sapiens
caggtctggcatcagctgtgtg

SEQ ID NO: 9066127 - DNA, 22 bp, Homo sapiens
tatacagttaagtttcttcagt

SEQ ID NO: 9066128 - DNA, 22 bp, Homo sapiens
tatacagttaagtttcttcagt

SEQ ID NO: 9066129 - DNA, 22 bp, Homo sapiens
caggtctgaagagtcacatgcc

SEQ ID NO: 9066130 - DNA, 17 bp, Homo sapiens
caggtctgaggccaggc

SEQ ID NO: 9066131 - DNA, 22 bp, Homo sapiens
tatgtacatgttaaagggcaaa

SEQ ID NO: 9066132 - DNA, 22 bp, Homo sapiens
caggtgaaaaagcaaccatatt

SEQ ID NO: 9066133 - DNA, 22 bp, Homo sapiens
caggtcttttctactggtggag

SEQ ID NO: 9066134 - DNA, 22 bp, Homo sapiens
caggtctttgttgcagcatgga

SEQ ID NO: 9066135 - DNA, 22 bp, Homo sapiens
caggtcttcttcagcacttgga

SEQ ID NO: 9066136 - DNA, 20 bp, Homo sapiens
caggtcttcatgtggctgtc

SEQ ID NO: 9066137 - DNA, 18 bp, Homo sapiens
caggtctgtctgcctccc

SEQ ID NO: 9066138 - DNA, 22 bp, Homo sapiens
caggtctgtgtgccatttccaa

SEQ ID NO: 9066139 - DNA, 18 bp, Homo sapiens
caggtctgtctgcctccc

SEQ ID NO: 9066140 - DNA, 22 bp, Homo sapiens
caggtctgtttccatcagtgct

SEQ ID NO: 9066141 - DNA, 23 bp, Homo sapiens
tatggcttacagtgctttaggta

SEQ ID NO: 9066142 - DNA, 17 bp, Homo sapiens
tatggctgtgtttgtgc

SEQ ID NO: 9066143 - DNA, 22 bp, Homo sapiens
caggtctggtgagagaacagtt

SEQ ID NO: 9066144 - DNA, 22 bp, Homo sapiens
tatggcttctgctttcttgact

SEQ ID NO: 9066145 - DNA, 21 bp, Homo sapiens
caggtctggtgaacactctca

SEQ ID NO: 9066146 - DNA, 22 bp, Homo sapiens
tatggcaaaactctttatccaa

SEQ ID NO: 9066147 - DNA, 22 bp, Homo sapiens
tatggcaagagaatcaactgaa

SEQ ID NO: 9066148 - DNA, 22 bp, Homo sapiens
tatggcaatatgtatcaagatc

SEQ ID NO: 9066149 - DNA, 22 bp, Homo sapiens
tatggcaattgtctaagtttta

SEQ ID NO: 9066150 - DNA, 22 bp, Homo sapiens
tatggcagttacccttgatgat

SEQ ID NO: 9066151 - DNA, 22 bp, Homo sapiens
tatggataggtttcaagaatgc

SEQ ID NO: 9066152 - DNA, 22 bp, Homo sapiens
tatctcttgcatgctttttaga

SEQ ID NO: 9066153 - DNA, 17 bp, Homo sapiens
tatctctgcttcatggt

SEQ ID NO: 9066154 - DNA, 22 bp, Homo sapiens
tatctccatctggagagcaaaa

SEQ ID NO: 9066155 - DNA, 22 bp, Homo sapiens
tatctccagtttctgagcctca

SEQ ID NO: 9066156 - DNA, 22 bp, Homo sapiens
tatctgaacaacctttattact

SEQ ID NO: 9066157 - DNA, 22 bp, Homo sapiens
tatctgaacaacctttattact

SEQ ID NO: 9066158 - DNA, 22 bp, Homo sapiens
tatgtttgttatcacaactagg

SEQ ID NO: 9066159 - DNA, 22 bp, Homo sapiens
tatgttttaggaattaattgtt

SEQ ID NO: 9066160 - DNA, 22 bp, Homo sapiens
tatgttttaggaattaattgtt

SEQ ID NO: 9066161 - DNA, 22 bp, Homo sapiens
tatgtttttaagagaatgcatt

SEQ ID NO: 9066162 - DNA, 19 bp, Homo sapiens
tatgtgtatatgtatctgt

SEQ ID NO: 9066163 - DNA, 22 bp, Homo sapiens
tatgtgcatatgcatacacaca

SEQ ID NO: 9066164 - DNA, 23 bp, Homo sapiens
tatgtgcatatgtgtaagaatac

SEQ ID NO: 9066165 - DNA, 22 bp, Homo sapiens
tatgtgcattatctagttcatt

SEQ ID NO: 9066166 - DNA, 22 bp, Homo sapiens
tatgtgcatgctgacttgagga

SEQ ID NO: 9066167 - DNA, 23 bp, Homo sapiens
tatgtgcatatgtgtaagaatac

SEQ ID NO: 9066168 - DNA, 22 bp, Homo sapiens
tatgtgcattattaccagtgga

SEQ ID NO: 9066169 - DNA, 22 bp, Homo sapiens
tatgtgtaatcatatctgatac

SEQ ID NO: 9066170 - DNA, 22 bp, Homo sapiens
tatgtttttcaagtgcacacta

SEQ ID NO: 9066171 - DNA, 22 bp, Homo sapiens
tattaaatatatctgttagttg

SEQ ID NO: 9066172 - DNA, 20 bp, Homo sapiens
tattgcctaaataccagaat

SEQ ID NO: 9066173 - DNA, 22 bp, Homo sapiens
tattgcctgagtgtttcataat

SEQ ID NO: 9066174 - DNA, 22 bp, Homo sapiens
tattgcttttatttctatggac

SEQ ID NO: 9066175 - DNA, 22 bp, Homo sapiens
tattgcttattcttgagagtca

SEQ ID NO: 9066176 - DNA, 22 bp, Homo sapiens
tattgcttcataattgttgcca

SEQ ID NO: 9066177 - DNA, 22 bp, Homo sapiens
tattgctttcagttgctttgag

SEQ ID NO: 9066178 - DNA, 22 bp, Homo sapiens
tattgcttataatttgttgcaa

SEQ ID NO: 9066179 - DNA, 22 bp, Homo sapiens
tattgcttaaaaaatatgtgag

SEQ ID NO: 9066180 - DNA, 22 bp, Homo sapiens
ccactgccgatgttccatcttg

SEQ ID NO: 9066181 - DNA, 22 bp, Homo sapiens
ccagaaaaggagctgcaggatg

SEQ ID NO: 9066182 - DNA, 22 bp, Homo sapiens
ccagaaaaggagctgcaggatg

SEQ ID NO: 9066183 - DNA, 22 bp, Homo sapiens
ccagaaaaggagctgcaggatg

SEQ ID NO: 9066184 - DNA, 22 bp, Homo sapiens
ccagaaaagcatctggttcttt

SEQ ID NO: 9066185 - DNA, 22 bp, Homo sapiens
ccactgatcctgactttggagc

SEQ ID NO: 9066186 - DNA, 22 bp, Homo sapiens
ccactgagtgagcagagcaggg

SEQ ID NO: 9066187 - DNA, 22 bp, Homo sapiens
ccagaagaggacacagtgtgga

SEQ ID NO: 9066188 - DNA, 22 bp, Homo sapiens
ccagaagcaaaacagacagttt

SEQ ID NO: 9066189 - DNA, 22 bp, Homo sapiens
ccagaagcaaaacagacagttt

SEQ ID NO: 9066190 - DNA, 22 bp, Homo sapiens
ccagaatccaaaacgttttgag

SEQ ID NO: 9066191 - DNA, 22 bp, Homo sapiens
ccagaagtcaggaatgagtctt

SEQ ID NO: 9066192 - DNA, 22 bp, Homo sapiens
ccagaagtggctttctcaggga

SEQ ID NO: 9066193 - DNA, 22 bp, Homo sapiens
ccagaagtcaggaatgagtctt

SEQ ID NO: 9066194 - DNA, 22 bp, Homo sapiens
ccagaagtcaatgcagatgtga

SEQ ID NO: 9066195 - DNA, 22 bp, Homo sapiens
ccagaagggctattgcagtgac

SEQ ID NO: 9066196 - DNA, 22 bp, Homo sapiens
ccacagtccgggctggcaggac

SEQ ID NO: 9066197 - DNA, 22 bp, Homo sapiens
ccacagtaggaacaagttgtcg

SEQ ID NO: 9066198 - DNA, 22 bp, Homo sapiens
ccacagtagcatccaaacagta

SEQ ID NO: 9066199 - DNA, 22 bp, Homo sapiens
ccacagtacaggaaatcttgtt

SEQ ID NO: 9066200 - DNA, 22 bp, Homo sapiens
ccacagtaagagatagtttatg

SEQ ID NO: 9066201 - DNA, 22 bp, Homo sapiens
ccacagtagaattcatctccct

SEQ ID NO: 9066202 - DNA, 16 bp, Homo sapiens
ccacctgcagctctca

SEQ ID NO: 9066203 - DNA, 22 bp, Homo sapiens
ccacctgctggttttgctctcc

SEQ ID NO: 9066204 - DNA, 22 bp, Homo sapiens
ccacagtgacacgggctggccc

SEQ ID NO: 9066205 - DNA, 22 bp, Homo sapiens
tcctggggagggttctggctcc

SEQ ID NO: 9066206 - DNA, 22 bp, Homo sapiens
tcctggggagggttctggctcc

SEQ ID NO: 9066207 - DNA, 22 bp, Homo sapiens
tcctggggagggttctggctcc

SEQ ID NO: 9066208 - DNA, 22 bp, Homo sapiens
tcctggtgctgacacccatagc

SEQ ID NO: 9066209 - DNA, 22 bp, Homo sapiens
ccacagtaactgttttgtaccg

SEQ ID NO: 9066210 - DNA, 16 bp, Homo sapiens
ccacagtaagaaatac

SEQ ID NO: 9066211 - DNA, 22 bp, Homo sapiens
ccacagtaaatggattcagacc

SEQ ID NO: 9066212 - DNA, 22 bp, Homo sapiens
ccacagtaaagaaacaacttcg

SEQ ID NO: 9066213 - DNA, 22 bp, Homo sapiens
tctctacataacctcaatactc

SEQ ID NO: 9066214 - DNA, 22 bp, Homo sapiens
tctctacagacactgttgactt

SEQ ID NO: 9066215 - DNA, 21 bp, Homo sapiens
tctctacactttcactaggct

SEQ ID NO: 9066216 - DNA, 21 bp, Homo sapiens
tctctacaaattatgttaggt

SEQ ID NO: 9066217 - DNA, 19 bp, Homo sapiens
ccagaggactgttaatgaa

SEQ ID NO: 9066218 - DNA, 22 bp, Homo sapiens
ccagaggagcaggctggctcca

SEQ ID NO: 9066219 - DNA, 22 bp, Homo sapiens
ccagaggagcaggctggctcca

SEQ ID NO: 9066220 - DNA, 22 bp, Homo sapiens
ccagaggagcaggctggctcca

SEQ ID NO: 9066221 - DNA, 22 bp, Homo sapiens
ccagaggagcaggctggctcca

SEQ ID NO: 9066222 - DNA, 22 bp, Homo sapiens
ccagaggagcatggccttgaga

SEQ ID NO: 9066223 - DNA, 22 bp, Homo sapiens
ccagaggaggggggtctttctg

SEQ ID NO: 9066224 - DNA, 22 bp, Homo sapiens
ccagaggagggctctgatgagg

SEQ ID NO: 9066225 - DNA, 22 bp, Homo sapiens
ccagaggagggctctgatgagg

SEQ ID NO: 9066226 - DNA, 22 bp, Homo sapiens
ccagaggagggctctgatgagg

SEQ ID NO: 9066227 - DNA, 22 bp, Homo sapiens
ccagaggagttgaggctttggg

SEQ ID NO: 9066228 - DNA, 22 bp, Homo sapiens
ccagaggtgagggggattcttg

SEQ ID NO: 9066229 - DNA, 22 bp, Homo sapiens
ccagaggacttgggggctgaat

SEQ ID NO: 9066230 - DNA, 22 bp, Homo sapiens
ccagaggacttgggggctgaat

SEQ ID NO: 9066231 - DNA, 19 bp, Homo sapiens
ccagaggactgttaatgaa

SEQ ID NO: 9066232 - DNA, 22 bp, Homo sapiens
ccagaggagatgcctcctctgt

SEQ ID NO: 9066233 - DNA, 22 bp, Homo sapiens
ccagaggtgctgggagaggtct

SEQ ID NO: 9066234 - DNA, 22 bp, Homo sapiens
ccagaggtgctctttggaagtg

SEQ ID NO: 9066235 - DNA, 22 bp, Homo sapiens
ccagatcactcaaccagagctc

SEQ ID NO: 9066236 - DNA, 19 bp, Homo sapiens
ccagatgagcagctgagat

SEQ ID NO: 9066237 - DNA, 22 bp, Homo sapiens
ccagatctaagtccaaagtact

SEQ ID NO: 9066238 - DNA, 22 bp, Homo sapiens
ccagatggtatagtagggagag

SEQ ID NO: 9066239 - DNA, 17 bp, Homo sapiens
ccagatgccctgtctcc

SEQ ID NO: 9066240 - DNA, 17 bp, Homo sapiens
ccagatgccctgtctcc

SEQ ID NO: 9066241 - DNA, 22 bp, Homo sapiens
ccagagcctgctgagccccatt

SEQ ID NO: 9066242 - DNA, 22 bp, Homo sapiens
ccagacaggaacacacatctcc

SEQ ID NO: 9066243 - DNA, 20 bp, Homo sapiens
ccagacagcacctgcctggt

SEQ ID NO: 9066244 - DNA, 20 bp, Homo sapiens
ccagacagcacctgcctggt

SEQ ID NO: 9066245 - DNA, 20 bp, Homo sapiens
ccagacagcacctgcctggt

SEQ ID NO: 9066246 - DNA, 18 bp, Homo sapiens
ccagagctggctcctcgc

SEQ ID NO: 9066247 - DNA, 18 bp, Homo sapiens
ccagagctggctcctcgc

SEQ ID NO: 9066248 - DNA, 22 bp, Homo sapiens
ccagagcttcggggcggctgta

SEQ ID NO: 9066249 - DNA, 22 bp, Homo sapiens
ccagagctgattcctgggactt

SEQ ID NO: 9066250 - DNA, 22 bp, Homo sapiens
ccagagctgcatccagcaggtt

SEQ ID NO: 9066251 - DNA, 22 bp, Homo sapiens
tctccataggcagttcataaca

SEQ ID NO: 9066252 - DNA, 22 bp, Homo sapiens
tctcccaacatgtggaggtcag

SEQ ID NO: 9066253 - DNA, 22 bp, Homo sapiens
tctcccaaggcacagaaagagt

SEQ ID NO: 9066254 - DNA, 21 bp, Homo sapiens
tctcccaaggaggtcctgagg

SEQ ID NO: 9066255 - DNA, 22 bp, Homo sapiens
tctccagtgaatctcctcctgg

SEQ ID NO: 9066256 - DNA, 22 bp, Homo sapiens
ccagaggaattgggaaacatgt

SEQ ID NO: 9066257 - DNA, 22 bp, Homo sapiens
ccagaggaaaaatatctcccta

SEQ ID NO: 9066258 - DNA, 22 bp, Homo sapiens
ccagaggaaaaatatctcccta

SEQ ID NO: 9066259 - DNA, 22 bp, Homo sapiens
tctcccaagggcacattcaagg

SEQ ID NO: 9066260 - DNA, 22 bp, Homo sapiens
tctcccaagtgaccaggaaaga

SEQ ID NO: 9066261 - DNA, 22 bp, Homo sapiens
tctcccacagccgtgcttcaag

SEQ ID NO: 9066262 - DNA, 22 bp, Homo sapiens
tctcccacagtctcccatggct

SEQ ID NO: 9066263 - DNA, 22 bp, Homo sapiens
tctctaaagatatttatggcaa

SEQ ID NO: 9066264 - DNA, 22 bp, Homo sapiens
tctctaaatacagatgtcatgg

SEQ ID NO: 9066265 - DNA, 22 bp, Homo sapiens
tctctaaataacacttattgaa

SEQ ID NO: 9066266 - DNA, 22 bp, Homo sapiens
tctctaaagtagaaaagacccc

SEQ ID NO: 9066267 - DNA, 22 bp, Homo sapiens
tctctaaagcctggaagaggag

SEQ ID NO: 9066268 - DNA, 22 bp, Homo sapiens
tctctaaagtagaaaagacccc

SEQ ID NO: 9066269 - DNA, 22 bp, Homo sapiens
tctctaaagtagaaaagacccc

SEQ ID NO: 9066270 - DNA, 22 bp, Homo sapiens
tctctaaagcctggaagaggag

SEQ ID NO: 9066271 - DNA, 22 bp, Homo sapiens
tctctaaagcactttaaccaca

SEQ ID NO: 9066272 - DNA, 22 bp, Homo sapiens
tctctaaagcctggaagaggag

SEQ ID NO: 9066273 - DNA, 22 bp, Homo sapiens
tctctaaagcactttaaccaca

SEQ ID NO: 9066274 - DNA, 20 bp, Homo sapiens
tctctaaagcacctggacta

SEQ ID NO: 9066275 - DNA, 22 bp, Homo sapiens
tctctaaatgattgtgtactcc

SEQ ID NO: 9066276 - DNA, 22 bp, Homo sapiens
tctctaaatctggttcacttgc

SEQ ID NO: 9066277 - DNA, 22 bp, Homo sapiens
tctctaaatgttgggggaaatg

SEQ ID NO: 9066278 - DNA, 19 bp, Homo sapiens
tctctaaatggtctttcac

SEQ ID NO: 9066279 - DNA, 22 bp, Homo sapiens
tctctaaatgctctcccatccc

SEQ ID NO: 9066280 - DNA, 22 bp, Homo sapiens
catttatgatagtaatatgaaa

SEQ ID NO: 9066281 - DNA, 22 bp, Homo sapiens
catttatataaaatgtccagaa

SEQ ID NO: 9066282 - DNA, 22 bp, Homo sapiens
tcccagggcagctgtccagaag

SEQ ID NO: 9066283 - DNA, 22 bp, Homo sapiens
tcccagggcactcaccctccct

SEQ ID NO: 9066284 - DNA, 21 bp, Homo sapiens
tcccagggccaggtgccatca

SEQ ID NO: 9066285 - DNA, 21 bp, Homo sapiens
tcccagggccaggtgccatca

SEQ ID NO: 9066286 - DNA, 22 bp, Homo sapiens
tcccagggtcagtggtgaggcc

SEQ ID NO: 9066287 - DNA, 22 bp, Homo sapiens
tcccagggtcagtggtgaggcc

SEQ ID NO: 9066288 - DNA, 22 bp, Homo sapiens
tcccagggtatcctgtagtaaa

SEQ ID NO: 9066289 - DNA, 22 bp, Homo sapiens
tcccagggggatgaacactgcc

SEQ ID NO: 9066290 - DNA, 22 bp, Homo sapiens
tcccagggctctagagtgctgg

SEQ ID NO: 9066291 - DNA, 22 bp, Homo sapiens
tcccagggctctagagtgctgg

SEQ ID NO: 9066292 - DNA, 22 bp, Homo sapiens
tcccagggccgcaaacgagttt

SEQ ID NO: 9066293 - DNA, 22 bp, Homo sapiens
tcccagggcttttctcatgctt

SEQ ID NO: 9066294 - DNA, 19 bp, Homo sapiens
catttagaagtacatatta

SEQ ID NO: 9066295 - DNA, 22 bp, Homo sapiens
catttagagagtaaaaattagc

SEQ ID NO: 9066296 - DNA, 22 bp, Homo sapiens
catttacagcagactgatgaaa

SEQ ID NO: 9066297 - DNA, 22 bp, Homo sapiens
catttacagcagactgatgaaa

SEQ ID NO: 9066298 - DNA, 22 bp, Homo sapiens
catttacacttctaaccacaag

SEQ ID NO: 9066299 - DNA, 20 bp, Homo sapiens
tccaggcagacagctatggg

SEQ ID NO: 9066300 - DNA, 22 bp, Homo sapiens
catttgaactaataactgtgct

SEQ ID NO: 9066301 - DNA, 22 bp, Homo sapiens
catttgaagacttagaagagga

SEQ ID NO: 9066302 - DNA, 22 bp, Homo sapiens
catttgcatatgaagaagtaag

SEQ ID NO: 9066303 - DNA, 22 bp, Homo sapiens
catttgcatatgaagaagtaag

SEQ ID NO: 9066304 - DNA, 22 bp, Homo sapiens
catttgcaaaccaacaagatga

SEQ ID NO: 9066305 - DNA, 22 bp, Homo sapiens
catttgcagagggtgacactct

SEQ ID NO: 9066306 - DNA, 22 bp, Homo sapiens
ccaaagtgctaggattacaggt

SEQ ID NO: 9066307 - DNA, 22 bp, Homo sapiens
ccaaagtgctgagattacaggt

SEQ ID NO: 9066308 - DNA, 22 bp, Homo sapiens
ccaaagtgctgggattacaggc

SEQ ID NO: 9066309 - DNA, 22 bp, Homo sapiens
ccaaagtgctgggattacaggt

SEQ ID NO: 9066310 - DNA, 22 bp, Homo sapiens
ccaaagtgctaggattacaggc

SEQ ID NO: 9066311 - DNA, 21 bp, Homo sapiens
tccctgctttctggcccagtc

SEQ ID NO: 9066312 - DNA, 21 bp, Homo sapiens
tccctgctttctggcccagtc

SEQ ID NO: 9066313 - DNA, 22 bp, Homo sapiens
tccctgcttggaatgaccctta

SEQ ID NO: 9066314 - DNA, 22 bp, Homo sapiens
tccctgctcagctcacctggca

SEQ ID NO: 9066315 - DNA, 22 bp, Homo sapiens
tccctgctcagctcacctggca

SEQ ID NO: 9066316 - DNA, 17 bp, Homo sapiens
ccacagcctggcacttg

SEQ ID NO: 9066317 - DNA, 17 bp, Homo sapiens
ccacagcctggcacttg

SEQ ID NO: 9066318 - DNA, 17 bp, Homo sapiens
ccacagcctggcacttg

SEQ ID NO: 9066319 - DNA, 17 bp, Homo sapiens
ccacagcctggcacttg

SEQ ID NO: 9066320 - DNA, 19 bp, Homo sapiens
ccacagcctgctgtcttcc

SEQ ID NO: 9066321 - DNA, 22 bp, Homo sapiens
ccacagccattccagggaggct

SEQ ID NO: 9066322 - DNA, 22 bp, Homo sapiens
ccacagctgaaagcagaggctc

SEQ ID NO: 9066323 - DNA, 23 bp, Homo sapiens
ccacagctatagggtagtgcagt

SEQ ID NO: 9066324 - DNA, 22 bp, Homo sapiens
ccacagcatgcaggcctgacac

SEQ ID NO: 9066325 - DNA, 22 bp, Homo sapiens
ccacagcatgcaggcctgacac

SEQ ID NO: 9066326 - DNA, 22 bp, Homo sapiens
ccacagcaggactggagccgcc

SEQ ID NO: 9066327 - DNA, 22 bp, Homo sapiens
ccacagcaggactggagccgcc

SEQ ID NO: 9066328 - DNA, 22 bp, Homo sapiens
ccacagcacctgcagccagttg

SEQ ID NO: 9066329 - DNA, 22 bp, Homo sapiens
ccacagcaccgctgccagtccc

SEQ ID NO: 9066330 - DNA, 22 bp, Homo sapiens
ccacagagttgatgcaataaga

SEQ ID NO: 9066331 - DNA, 22 bp, Homo sapiens
ccacagagttacaaaacagtca

SEQ ID NO: 9066332 - DNA, 22 bp, Homo sapiens
ccacagagttacaaaacagtca

SEQ ID NO: 9066333 - DNA, 22 bp, Homo sapiens
tcctgccatctgctgttgatct

SEQ ID NO: 9066334 - DNA, 22 bp, Homo sapiens
tcctgccatttgctttttctcc

SEQ ID NO: 9066335 - DNA, 23 bp, Homo sapiens
tcctgccagatgactcctttctt

SEQ ID NO: 9066336 - DNA, 20 bp, Homo sapiens
tcctgcagttcctaggaggg

SEQ ID NO: 9066337 - DNA, 20 bp, Homo sapiens
tcctgcagttcctaggaggg

SEQ ID NO: 9066338 - DNA, 22 bp, Homo sapiens
ccacagagtccgcatttgaggc

SEQ ID NO: 9066339 - DNA, 20 bp, Homo sapiens
ccacagaggacagggctgtg

SEQ ID NO: 9066340 - DNA, 22 bp, Homo sapiens
ccacagaggacaactgcctggc

SEQ ID NO: 9066341 - DNA, 20 bp, Homo sapiens
ccacagaggacagggctgtg

SEQ ID NO: 9066342 - DNA, 22 bp, Homo sapiens
ccacagaatcgctagtggagca

SEQ ID NO: 9066343 - DNA, 22 bp, Homo sapiens
ccacagaagatggggagagtgg

SEQ ID NO: 9066344 - DNA, 23 bp, Homo sapiens
ccacagagctgccaattcctgtg

SEQ ID NO: 9066345 - DNA, 22 bp, Homo sapiens
ccacagaggacaactgcctggc

SEQ ID NO: 9066346 - DNA, 22 bp, Homo sapiens
tcctccccaaagcccagcctgg

SEQ ID NO: 9066347 - DNA, 20 bp, Homo sapiens
tcctcccccacctttgcagc

SEQ ID NO: 9066348 - DNA, 22 bp, Homo sapiens
tcctcccaacttttccatctca

SEQ ID NO: 9066349 - DNA, 22 bp, Homo sapiens
tcctcccaacttttccatctca

SEQ ID NO: 9066350 - DNA, 22 bp, Homo sapiens
tcctcccacataggacaatggg

SEQ ID NO: 9066351 - DNA, 22 bp, Homo sapiens
tcctcccacataggacaatggg

SEQ ID NO: 9066352 - DNA, 22 bp, Homo sapiens
tcctcccacataggacaatggg

SEQ ID NO: 9066353 - DNA, 22 bp, Homo sapiens
ccaaagtgctggggttacaggc

SEQ ID NO: 9066354 - DNA, 22 bp, Homo sapiens
ccaaatagtctttcattgaatt

SEQ ID NO: 9066355 - DNA, 22 bp, Homo sapiens
ccaaatattaacaaagtaattt

SEQ ID NO: 9066356 - DNA, 22 bp, Homo sapiens
ccaaatcaccagcacgatcatt

SEQ ID NO: 9066357 - DNA, 23 bp, Homo sapiens
tcctcccaaatttcagcctcatt

SEQ ID NO: 9066358 - DNA, 23 bp, Homo sapiens
tcctcccaaatttcagcctcatt

SEQ ID NO: 9066359 - DNA, 23 bp, Homo sapiens
tcctcccaaatttcagcctcatt

SEQ ID NO: 9066360 - DNA, 22 bp, Homo sapiens
ccaaatgctccactgactttgg

SEQ ID NO: 9066361 - DNA, 22 bp, Homo sapiens
ccacaagatgcaaactctaaca

SEQ ID NO: 9066362 - DNA, 22 bp, Homo sapiens
ccacaagtttcagcacccagag

SEQ ID NO: 9066363 - DNA, 22 bp, Homo sapiens
tcctgcagtgtgtctcctgcac

SEQ ID NO: 9066364 - DNA, 22 bp, Homo sapiens
ccacacagggggatgagttatt

SEQ ID NO: 9066365 - DNA, 22 bp, Homo sapiens
ccacacagataagtgttttcta

SEQ ID NO: 9066366 - DNA, 22 bp, Homo sapiens
tcctgcagtgtgtctcctgcac

SEQ ID NO: 9066367 - DNA, 23 bp, Homo sapiens
ccaattcatggcagatttgaaga

SEQ ID NO: 9066368 - DNA, 22 bp, Homo sapiens
ccaattcatcctctggggcttc

SEQ ID NO: 9066369 - DNA, 22 bp, Homo sapiens
ccaattcacctcctatgcacat

SEQ ID NO: 9066370 - DNA, 22 bp, Homo sapiens
ccaatgcagataagacaaacac

SEQ ID NO: 9066371 - DNA, 22 bp, Homo sapiens
ccacaaagaatgggggaagcat

SEQ ID NO: 9066372 - DNA, 22 bp, Homo sapiens
ccacaagactctgtcagcataa

SEQ ID NO: 9066373 - DNA, 22 bp, Homo sapiens
tctgcctgaaccactcttggag

SEQ ID NO: 9066374 - DNA, 22 bp, Homo sapiens
tctgcctgaaccactcttggag

SEQ ID NO: 9066375 - DNA, 22 bp, Homo sapiens
tctgccttggcaaccacagctt

SEQ ID NO: 9066376 - DNA, 22 bp, Homo sapiens
tctgcctctttcaggcctggca

SEQ ID NO: 9066377 - DNA, 22 bp, Homo sapiens
ccagctgggattaagggaaaat

SEQ ID NO: 9066378 - DNA, 22 bp, Homo sapiens
ccagctgctttttgtcacatgg

SEQ ID NO: 9066379 - DNA, 22 bp, Homo sapiens
ccagctggtaagtgatggagcc

SEQ ID NO: 9066380 - DNA, 22 bp, Homo sapiens
ccagctggtaagtgatggagcc

SEQ ID NO: 9066381 - DNA, 22 bp, Homo sapiens
ccagctgggtccctgctggggc

SEQ ID NO: 9066382 - DNA, 22 bp, Homo sapiens
ccagctggggaagtggggcata

SEQ ID NO: 9066383 - DNA, 22 bp, Homo sapiens
ccagctggtctgtgctcatgtt

SEQ ID NO: 9066384 - DNA, 22 bp, Homo sapiens
ccagctggtaagtgatggagcc

SEQ ID NO: 9066385 - DNA, 22 bp, Homo sapiens
ccagctggtctgtgctcatgtt

SEQ ID NO: 9066386 - DNA, 22 bp, Homo sapiens
ccagctggtgggtctttctctg

SEQ ID NO: 9066387 - DNA, 22 bp, Homo sapiens
ccagctggtgggtctttctctg

SEQ ID NO: 9066388 - DNA, 22 bp, Homo sapiens
ccagctggtgacatccccaacc

SEQ ID NO: 9066389 - DNA, 22 bp, Homo sapiens
ccagctggttaaaatagagaaa

SEQ ID NO: 9066390 - DNA, 22 bp, Homo sapiens
tctggagccttggatgggaaag

SEQ ID NO: 9066391 - DNA, 22 bp, Homo sapiens
ccagctggtgttccttaggacc

SEQ ID NO: 9066392 - DNA, 22 bp, Homo sapiens
ccagctggtgttccttaggacc

SEQ ID NO: 9066393 - DNA, 22 bp, Homo sapiens
ccagctggttaaaatagagaaa

SEQ ID NO: 9066394 - DNA, 22 bp, Homo sapiens
ccagctggttaaaatagagaaa

SEQ ID NO: 9066395 - DNA, 22 bp, Homo sapiens
ccagcttcatgggcatgcacca

SEQ ID NO: 9066396 - DNA, 21 bp, Homo sapiens
ccagctgttcctcgtccgatg

SEQ ID NO: 9066397 - DNA, 22 bp, Homo sapiens
ccagctgtgccgtgtggatagc

SEQ ID NO: 9066398 - DNA, 22 bp, Homo sapiens
ccagctgtctggttccagagcc

SEQ ID NO: 9066399 - DNA, 22 bp, Homo sapiens
ccagctgtctggttccagagcc

SEQ ID NO: 9066400 - DNA, 18 bp, Homo sapiens
ccagctgtgcagcatctg

SEQ ID NO: 9066401 - DNA, 22 bp, Homo sapiens
ccagctgtcttgagaggaggca

SEQ ID NO: 9066402 - DNA, 22 bp, Homo sapiens
tctggcttgagcttcgaccagt

SEQ ID NO: 9066403 - DNA, 22 bp, Homo sapiens
tctggcttgctggcttggtccc

SEQ ID NO: 9066404 - DNA, 22 bp, Homo sapiens
tctggcttggctggcatctctg

SEQ ID NO: 9066405 - DNA, 22 bp, Homo sapiens
tctggcttggcgctgccctctg

SEQ ID NO: 9066406 - DNA, 22 bp, Homo sapiens
tctggctttattccttcactga

SEQ ID NO: 9066407 - DNA, 22 bp, Homo sapiens
tctggagctgggggcttagtat

SEQ ID NO: 9066408 - DNA, 22 bp, Homo sapiens
tctggagctggagggcaaggca

SEQ ID NO: 9066409 - DNA, 22 bp, Homo sapiens
tctggaggcaggctgccaggat

SEQ ID NO: 9066410 - DNA, 22 bp, Homo sapiens
tctggagcttgaagctttggtt

SEQ ID NO: 9066411 - DNA, 22 bp, Homo sapiens
tctggagcttgaagctttggtt

SEQ ID NO: 9066412 - DNA, 22 bp, Homo sapiens
tctggctgttaggcctgacctt

SEQ ID NO: 9066413 - DNA, 22 bp, Homo sapiens
tctggcttcaagtcccagctct

SEQ ID NO: 9066414 - DNA, 22 bp, Homo sapiens
tctggctgttttagatgagctc

SEQ ID NO: 9066415 - DNA, 22 bp, Homo sapiens
tctggcttccctctgttctggg

SEQ ID NO: 9066416 - DNA, 22 bp, Homo sapiens
tctggcttcccactctgccggg

SEQ ID NO: 9066417 - DNA, 22 bp, Homo sapiens
tctggcttcagtagggttcact

SEQ ID NO: 9066418 - DNA, 23 bp, Homo sapiens
tctggcttccagtgggttcaacc

SEQ ID NO: 9066419 - DNA, 22 bp, Homo sapiens
ccaggaagcggtgagggctgcc

SEQ ID NO: 9066420 - DNA, 22 bp, Homo sapiens
ccaggaagcggtgagggctgcc

SEQ ID NO: 9066421 - DNA, 22 bp, Homo sapiens
ccaggaagcggtgagggctgcc

SEQ ID NO: 9066422 - DNA, 22 bp, Homo sapiens
ccaggaagcggtgagggctgcc

SEQ ID NO: 9066423 - DNA, 22 bp, Homo sapiens
ccaggaagctctgctccacggg

SEQ ID NO: 9066424 - DNA, 22 bp, Homo sapiens
ccaggaggcagaagttgcagtg

SEQ ID NO: 9066425 - DNA, 22 bp, Homo sapiens
ccaggaggcagaagttgcagtg

SEQ ID NO: 9066426 - DNA, 22 bp, Homo sapiens
ccaggaggcagaagttgcagtg

SEQ ID NO: 9066427 - DNA, 22 bp, Homo sapiens
ccaggaggatggttgttaggtg

SEQ ID NO: 9066428 - DNA, 22 bp, Homo sapiens
ccaggagcctgggccaggctgg

SEQ ID NO: 9066429 - DNA, 21 bp, Homo sapiens
ccaggaaggactgagctccct

SEQ ID NO: 9066430 - DNA, 22 bp, Homo sapiens
ccagcttctccttatgtcctca

SEQ ID NO: 9066431 - DNA, 22 bp, Homo sapiens
ccaggaaaaagagaaacatggt

SEQ ID NO: 9066432 - DNA, 22 bp, Homo sapiens
ccagcttcggcaagcagacttt

SEQ ID NO: 9066433 - DNA, 22 bp, Homo sapiens
ccaggaaatagtgctgtgatct

SEQ ID NO: 9066434 - DNA, 22 bp, Homo sapiens
ccaggaaaataccaagctttaa

SEQ ID NO: 9066435 - DNA, 22 bp, Homo sapiens
ccaggaaagaggaagaacgcat

SEQ ID NO: 9066436 - DNA, 22 bp, Homo sapiens
ccaggaaatggcttgcttcttt

SEQ ID NO: 9066437 - DNA, 22 bp, Homo sapiens
ccaggaagaaacagtctttata

SEQ ID NO: 9066438 - DNA, 22 bp, Homo sapiens
ccaggaagacacatgctcatcc

SEQ ID NO: 9066439 - DNA, 22 bp, Homo sapiens
ccaggaagcctcagatgctgag

SEQ ID NO: 9066440 - DNA, 22 bp, Homo sapiens
ccaggaagcctcagatgctgag

SEQ ID NO: 9066441 - DNA, 22 bp, Homo sapiens
ccaggaagcataatgtagtggg

SEQ ID NO: 9066442 - DNA, 22 bp, Homo sapiens
ccaggaagcctgtgtctctgga

SEQ ID NO: 9066443 - DNA, 23 bp, Homo sapiens
ccaggaagaggccatccacagtc

SEQ ID NO: 9066444 - DNA, 23 bp, Homo sapiens
ccaggaagaggccatccacagtc

SEQ ID NO: 9066445 - DNA, 22 bp, Homo sapiens
ccaggaagcataatgtagtggg

SEQ ID NO: 9066446 - DNA, 22 bp, Homo sapiens
tctgtctgtagttttacatgat

SEQ ID NO: 9066447 - DNA, 18 bp, Homo sapiens
tctgtctgtacaagtatc

SEQ ID NO: 9066448 - DNA, 22 bp, Homo sapiens
tctgtctgtccagggcccccgc

SEQ ID NO: 9066449 - DNA, 17 bp, Homo sapiens
tctgtctgtggtccact

SEQ ID NO: 9066450 - DNA, 23 bp, Homo sapiens
tctgtctgtgtatgtgcagaaag

SEQ ID NO: 9066451 - DNA, 22 bp, Homo sapiens
tctgtcttagccatctcaggct

SEQ ID NO: 9066452 - DNA, 22 bp, Homo sapiens
tctgtcttagccatctcaggct

SEQ ID NO: 9066453 - DNA, 22 bp, Homo sapiens
tctgtcttcatcagcatgtgat

SEQ ID NO: 9066454 - DNA, 21 bp, Homo sapiens
tctgtcttcctcagcctaagg

SEQ ID NO: 9066455 - DNA, 22 bp, Homo sapiens
tctgtcttggccagccatctgg

SEQ ID NO: 9066456 - DNA, 23 bp, Homo sapiens
tctgtcttgtttaggccactgtt

SEQ ID NO: 9066457 - DNA, 17 bp, Homo sapiens
tctgtcttgactgtcac

SEQ ID NO: 9066458 - DNA, 22 bp, Homo sapiens
tctgtggcacgattgcactgca

SEQ ID NO: 9066459 - DNA, 22 bp, Homo sapiens
ccaggaggcagaggttgtagtg

SEQ ID NO: 9066460 - DNA, 22 bp, Homo sapiens
ccaggaggcagaggttgtagtg

SEQ ID NO: 9066461 - DNA, 22 bp, Homo sapiens
ccaggaggcggaaggtacagtg

SEQ ID NO: 9066462 - DNA, 22 bp, Homo sapiens
ccaggaggcagaggttacagtg

SEQ ID NO: 9066463 - DNA, 22 bp, Homo sapiens
ccaggaggcagaagttgcagtg

SEQ ID NO: 9066464 - DNA, 22 bp, Homo sapiens
ccaggaggcggaggttgcagcg

SEQ ID NO: 9066465 - DNA, 22 bp, Homo sapiens
ccaggaggcggaaggtacagtg

SEQ ID NO: 9066466 - DNA, 22 bp, Homo sapiens
ccaggaggcggaggttgcagcg

SEQ ID NO: 9066467 - DNA, 22 bp, Homo sapiens
ccaggaggcggaggttgcagcg

SEQ ID NO: 9066468 - DNA, 22 bp, Homo sapiens
ccaggaggcggaaggtacagtg

SEQ ID NO: 9066469 - DNA, 22 bp, Homo sapiens
ccaggaggcggaaggtacagtg

SEQ ID NO: 9066470 - DNA, 22 bp, Homo sapiens
tctgtcacttattaagatggat

SEQ ID NO: 9066471 - DNA, 23 bp, Homo sapiens
tctgtcactttctgctgtggagt

SEQ ID NO: 9066472 - DNA, 19 bp, Homo sapiens
tctgtcactgggggtattc

SEQ ID NO: 9066473 - DNA, 22 bp, Homo sapiens
tctgtcacttttatttactgaa

SEQ ID NO: 9066474 - DNA, 22 bp, Homo sapiens
tctgtcactgagctcaggattc

SEQ ID NO: 9066475 - DNA, 22 bp, Homo sapiens
tctgtcactctagagatggcag

SEQ ID NO: 9066476 - DNA, 22 bp, Homo sapiens
tctgtcactccctgatgatgaa

SEQ ID NO: 9066477 - DNA, 22 bp, Homo sapiens
tctgtcactattggccagaaca

SEQ ID NO: 9066478 - DNA, 23 bp, Homo sapiens
tctgtcacctatggctgctcttc

SEQ ID NO: 9066479 - DNA, 22 bp, Homo sapiens
tctgtcacccgagcaggcgaga

SEQ ID NO: 9066480 - DNA, 22 bp, Homo sapiens
tctgtcaccgagggcatccaaa

SEQ ID NO: 9066481 - DNA, 22 bp, Homo sapiens
tctgagatccttgtgttgtttt

SEQ ID NO: 9066482 - DNA, 22 bp, Homo sapiens
ccagccctacagtatcacctgt

SEQ ID NO: 9066483 - DNA, 22 bp, Homo sapiens
ccagccctcactgaggcctctc

SEQ ID NO: 9066484 - DNA, 22 bp, Homo sapiens
tctgaggcaaacagaggagtgt

SEQ ID NO: 9066485 - DNA, 22 bp, Homo sapiens
tctgaggcagcttgccactcta

SEQ ID NO: 9066486 - DNA, 22 bp, Homo sapiens
tctgaggcccagttcaactctt

SEQ ID NO: 9066487 - DNA, 22 bp, Homo sapiens
tctgaggcataacctgttctgc

SEQ ID NO: 9066488 - DNA, 22 bp, Homo sapiens
tctgaggcatacccaggccccc

SEQ ID NO: 9066489 - DNA, 22 bp, Homo sapiens
tctgaggcatacccaggccccc

SEQ ID NO: 9066490 - DNA, 22 bp, Homo sapiens
tctgaggcccctgggcaggatg

SEQ ID NO: 9066491 - DNA, 22 bp, Homo sapiens
tctgaggcccctgggcaggatg

SEQ ID NO: 9066492 - DNA, 22 bp, Homo sapiens
tctgaggcccctgggcaggatg

SEQ ID NO: 9066493 - DNA, 22 bp, Homo sapiens
ccagcccctatcctcgctccac

SEQ ID NO: 9066494 - DNA, 22 bp, Homo sapiens
ccagccctacagtatcacctgt

SEQ ID NO: 9066495 - DNA, 22 bp, Homo sapiens
ccagccccgggaacctggccgt

SEQ ID NO: 9066496 - DNA, 22 bp, Homo sapiens
ccagccccgggaacctggccgt

SEQ ID NO: 9066497 - DNA, 19 bp, Homo sapiens
ccagcccatagtccatcac

SEQ ID NO: 9066498 - DNA, 19 bp, Homo sapiens
ccagcccatagtccatcac

SEQ ID NO: 9066499 - DNA, 19 bp, Homo sapiens
ccagcccatagtccatcac

SEQ ID NO: 9066500 - DNA, 22 bp, Homo sapiens
ccagcccatgcccttatagcat

SEQ ID NO: 9066501 - DNA, 22 bp, Homo sapiens
ccagccccgggaacctggccgt

SEQ ID NO: 9066502 - DNA, 22 bp, Homo sapiens
ccagcccatgcccttatagcat

SEQ ID NO: 9066503 - DNA, 21 bp, Homo sapiens
ccagcccagctgtgtcccagc

SEQ ID NO: 9066504 - DNA, 21 bp, Homo sapiens
ccagcccagctgtgtcccagc

SEQ ID NO: 9066505 - DNA, 21 bp, Homo sapiens
ccagcccagcctccttctctt

SEQ ID NO: 9066506 - DNA, 21 bp, Homo sapiens
ccagcccagcctccttctctt

SEQ ID NO: 9066507 - DNA, 19 bp, Homo sapiens
ccagcccacagtgactttc

SEQ ID NO: 9066508 - DNA, 21 bp, Homo sapiens
ccagcccagcctccttctctt

SEQ ID NO: 9066509 - DNA, 22 bp, Homo sapiens
ccagccatgggccacctagctg

SEQ ID NO: 9066510 - DNA, 22 bp, Homo sapiens
ccagccatgcacaaaccatgag

SEQ ID NO: 9066511 - DNA, 22 bp, Homo sapiens
ccagcccaaagtcaccccggga

SEQ ID NO: 9066512 - DNA, 22 bp, Homo sapiens
ccagcccaaacaagccgccttc

SEQ ID NO: 9066513 - DNA, 22 bp, Homo sapiens
ccagcccaaacaagccgccttc

SEQ ID NO: 9066514 - DNA, 22 bp, Homo sapiens
ccagcccaaacaagccgccttc

SEQ ID NO: 9066515 - DNA, 22 bp, Homo sapiens
tctcttgggaggaaagagagaa

SEQ ID NO: 9066516 - DNA, 22 bp, Homo sapiens
ccagccagtcccgcatgaccgc

SEQ ID NO: 9066517 - DNA, 22 bp, Homo sapiens
ccagccagtcccgcatgaccgc

SEQ ID NO: 9066518 - DNA, 22 bp, Homo sapiens
ccagccagtccagcattggtgt

SEQ ID NO: 9066519 - DNA, 22 bp, Homo sapiens
ccagccagtatattccaaagcc

SEQ ID NO: 9066520 - DNA, 22 bp, Homo sapiens
ccagccagtcccgcatgaccgc

SEQ ID NO: 9066521 - DNA, 22 bp, Homo sapiens
tctgaaatctgtaagcactagc

SEQ ID NO: 9066522 - DNA, 22 bp, Homo sapiens
ccagccacgaagctcccttcat

SEQ ID NO: 9066523 - DNA, 22 bp, Homo sapiens
tctcttgatatattacatagag

SEQ ID NO: 9066524 - DNA, 22 bp, Homo sapiens
tctcttgggaggaaagagagaa

SEQ ID NO: 9066525 - DNA, 18 bp, Homo sapiens
tctcttgcatcttctgta

SEQ ID NO: 9066526 - DNA, 22 bp, Homo sapiens
tctctcttgaagtattagctag

SEQ ID NO: 9066527 - DNA, 22 bp, Homo sapiens
ccagctctagccccatgtggct

SEQ ID NO: 9066528 - DNA, 22 bp, Homo sapiens
ccagctctagccccatgtggct

SEQ ID NO: 9066529 - DNA, 22 bp, Homo sapiens
ccagctctcaaggctccctggg

SEQ ID NO: 9066530 - DNA, 22 bp, Homo sapiens
ccagctctaaacggctctgtgg

SEQ ID NO: 9066531 - DNA, 22 bp, Homo sapiens
ccagctctaaacggctctgtgg

SEQ ID NO: 9066532 - DNA, 22 bp, Homo sapiens
ccagctctaaacggctctgtgg

SEQ ID NO: 9066533 - DNA, 22 bp, Homo sapiens
ccagctctaaacggctctgtgg

SEQ ID NO: 9066534 - DNA, 22 bp, Homo sapiens
ccagctccttctgtctgtggag

SEQ ID NO: 9066535 - DNA, 22 bp, Homo sapiens
ccagctccttctgtctgtggag

SEQ ID NO: 9066536 - DNA, 22 bp, Homo sapiens
ccagctccttctgtctgtggag

SEQ ID NO: 9066537 - DNA, 22 bp, Homo sapiens
ccagctcctgggtcttagtcag

SEQ ID NO: 9066538 - DNA, 22 bp, Homo sapiens
ccagctcctgggtcttagtcag

SEQ ID NO: 9066539 - DNA, 22 bp, Homo sapiens
ccagctcctgggtcttagtcag

SEQ ID NO: 9066540 - DNA, 22 bp, Homo sapiens
ccagctcctcttcccagtgtca

SEQ ID NO: 9066541 - DNA, 22 bp, Homo sapiens
ccagctcctcttgtctctagca

SEQ ID NO: 9066542 - DNA, 22 bp, Homo sapiens
ccagctcctcttgtctctagca

SEQ ID NO: 9066543 - DNA, 22 bp, Homo sapiens
ccagctccaggactgggagctg

SEQ ID NO: 9066544 - DNA, 21 bp, Homo sapiens
ccagctccaggaccttggatc

SEQ ID NO: 9066545 - DNA, 21 bp, Homo sapiens
ccagctccaggaccttggatc

SEQ ID NO: 9066546 - DNA, 21 bp, Homo sapiens
ccagctccaggaccttggatc

SEQ ID NO: 9066547 - DNA, 22 bp, Homo sapiens
ccagctccaggactgggagctg

SEQ ID NO: 9066548 - DNA, 23 bp, Homo sapiens
ccagctccgtgagcctcgggctc

SEQ ID NO: 9066549 - DNA, 22 bp, Homo sapiens
ccagctccaggactgggagctg

SEQ ID NO: 9066550 - DNA, 22 bp, Homo sapiens
tctgcctatgctgtacctttgt

SEQ ID NO: 9066551 - DNA, 22 bp, Homo sapiens
tctgcctatgctgtacctttgt

SEQ ID NO: 9066552 - DNA, 22 bp, Homo sapiens
tctgccagccctgtgagtcttg

SEQ ID NO: 9066553 - DNA, 22 bp, Homo sapiens
tctgccagaagttctgagagta

SEQ ID NO: 9066554 - DNA, 22 bp, Homo sapiens
tctgccagaagccagggtctgg

SEQ ID NO: 9066555 - DNA, 22 bp, Homo sapiens
ccagcctggagggcagtggtgg

SEQ ID NO: 9066556 - DNA, 22 bp, Homo sapiens
ccagcctggagggcagtggtgg

SEQ ID NO: 9066557 - DNA, 22 bp, Homo sapiens
ccagcctggagggcagtggtgg

SEQ ID NO: 9066558 - DNA, 22 bp, Homo sapiens
ccagcctggggaggcagcttct

SEQ ID NO: 9066559 - DNA, 22 bp, Homo sapiens
ccagcctggggaggcagcttct

SEQ ID NO: 9066560 - DNA, 22 bp, Homo sapiens
ccagcctggagggcagtggtgg

SEQ ID NO: 9066561 - DNA, 22 bp, Homo sapiens
ccagcctggagggcagtggtgg

SEQ ID NO: 9066562 - DNA, 21 bp, Homo sapiens
ccagcctcagatcagggagct

SEQ ID NO: 9066563 - DNA, 22 bp, Homo sapiens
ccagcctggactgggtcttgtg

SEQ ID NO: 9066564 - DNA, 22 bp, Homo sapiens
ccagcctggactgggtcttgtg

SEQ ID NO: 9066565 - DNA, 22 bp, Homo sapiens
ccagcctggactgggtcttgtg

SEQ ID NO: 9066566 - DNA, 22 bp, Homo sapiens
tctgagtttaggaccaggctga

SEQ ID NO: 9066567 - DNA, 22 bp, Homo sapiens
tctgagttcataccaggctacc

SEQ ID NO: 9066568 - DNA, 22 bp, Homo sapiens
ccagccttcacctgctctggtc

SEQ ID NO: 9066569 - DNA, 22 bp, Homo sapiens
ccagccttctgagctgcctgga

SEQ ID NO: 9066570 - DNA, 22 bp, Homo sapiens
ccagcctggggaggcagcttct

SEQ ID NO: 9066571 - DNA, 22 bp, Homo sapiens
ccagcctgggtgttagaagaca

SEQ ID NO: 9066572 - DNA, 22 bp, Homo sapiens
ccagcctggttcagaattggct

SEQ ID NO: 9066573 - DNA, 22 bp, Homo sapiens
ccagcctgggtgttagaagaca

SEQ ID NO: 9066574 - DNA, 19 bp, Homo sapiens
ccagcctttccagtgattg

SEQ ID NO: 9066575 - DNA, 22 bp, Homo sapiens
ccagcctttgcatcccccatct

SEQ ID NO: 9066576 - DNA, 22 bp, Homo sapiens
ccagcctttgcatcccccatct

SEQ ID NO: 9066577 - DNA, 23 bp, Homo sapiens
ccagcgctcactcagagcatgtt

SEQ ID NO: 9066578 - DNA, 22 bp, Homo sapiens
ccagccttgcaccgagccagcc

SEQ ID NO: 9066579 - DNA, 22 bp, Homo sapiens
ccagccttgactgccccagcac

SEQ ID NO: 9066580 - DNA, 22 bp, Homo sapiens
ccagccttctgggactctcatc

SEQ ID NO: 9066581 - DNA, 23 bp, Homo sapiens
ccagcgctcactcagagcatgtt

SEQ ID NO: 9066582 - DNA, 22 bp, Homo sapiens
ccagcgcttcccatcagggagg

SEQ ID NO: 9066583 - DNA, 22 bp, Homo sapiens
ccagctaggcttgcactcttgt

SEQ ID NO: 9066584 - DNA, 22 bp, Homo sapiens
ccagctagtaagcacctgcatc

SEQ ID NO: 9066585 - DNA, 22 bp, Homo sapiens
ccagctccaagtttgggcatca

SEQ ID NO: 9066586 - DNA, 22 bp, Homo sapiens
ccagctccagcatagccaccat

SEQ ID NO: 9066587 - DNA, 22 bp, Homo sapiens
ccagctccagcatagccaccat

SEQ ID NO: 9066588 - DNA, 22 bp, Homo sapiens
ccagctccaagtttgggcatca

SEQ ID NO: 9066589 - DNA, 22 bp, Homo sapiens
ccagctccaagtttgggcatca

SEQ ID NO: 9066590 - DNA, 20 bp, Homo sapiens
gtgtctggagtactagagag

SEQ ID NO: 9066591 - DNA, 22 bp, Homo sapiens
gtgtctgctttcagctagtagg

SEQ ID NO: 9066592 - DNA, 22 bp, Homo sapiens
gtgtctgcttggtcatctttca

SEQ ID NO: 9066593 - DNA, 22 bp, Homo sapiens
gtgtctgcttgctgagcattta

SEQ ID NO: 9066594 - DNA, 22 bp, Homo sapiens
gtgtctgcttgctgagcattta

SEQ ID NO: 9066595 - DNA, 22 bp, Homo sapiens
gtgtctgctgcaccctcacacc

SEQ ID NO: 9066596 - DNA, 22 bp, Homo sapiens
gtgtctgctcagcttgctagaa

SEQ ID NO: 9066597 - DNA, 19 bp, Homo sapiens
gtgtctgcctttgtgccac

SEQ ID NO: 9066598 - DNA, 19 bp, Homo sapiens
gtgtctgcctttgtgccac

SEQ ID NO: 9066599 - DNA, 22 bp, Homo sapiens
gtgtctgcaagatagccaagtc

SEQ ID NO: 9066600 - DNA, 22 bp, Homo sapiens
gtgtctgcacataggatctcaa

SEQ ID NO: 9066601 - DNA, 22 bp, Homo sapiens
gtgtattagtgagaaggaagat

SEQ ID NO: 9066602 - DNA, 22 bp, Homo sapiens
gtgtctgcctttggactaactg

SEQ ID NO: 9066603 - DNA, 22 bp, Homo sapiens
gtgtctgcatattcaaacttgt

SEQ ID NO: 9066604 - DNA, 22 bp, Homo sapiens
gtgtctgcacataggatctcaa

SEQ ID NO: 9066605 - DNA, 20 bp, Homo sapiens
gtgtctgcatatagcaggtg

SEQ ID NO: 9066606 - DNA, 22 bp, Homo sapiens
gtgtgaaagttcctaagactat

SEQ ID NO: 9066607 - DNA, 17 bp, Homo sapiens
gtgtctttgctgttgtg

SEQ ID NO: 9066608 - DNA, 22 bp, Homo sapiens
gtgtgagagaagctgccatgga

SEQ ID NO: 9066609 - DNA, 22 bp, Homo sapiens
gtgtgactttatttggaaatag

SEQ ID NO: 9066610 - DNA, 22 bp, Homo sapiens
gtgtatccttattcacacacat

SEQ ID NO: 9066611 - DNA, 22 bp, Homo sapiens
gtggtacagctgaaaggcttgc

SEQ ID NO: 9066612 - DNA, 22 bp, Homo sapiens
gtgtggccgtgtatccatggct

SEQ ID NO: 9066613 - DNA, 22 bp, Homo sapiens
cagctggctggtcagtgcacaa

SEQ ID NO: 9066614 - DNA, 22 bp, Homo sapiens
cagctggctggtcagtgcacaa

SEQ ID NO: 9066615 - DNA, 22 bp, Homo sapiens
cagctggctggtcagtgcacaa

SEQ ID NO: 9066616 - DNA, 22 bp, Homo sapiens
cagctggctggtcagtgcacaa

SEQ ID NO: 9066617 - DNA, 22 bp, Homo sapiens
cagctggcttgtttgttcttga

SEQ ID NO: 9066618 - DNA, 22 bp, Homo sapiens
cagctggcttgtttgttcttga

SEQ ID NO: 9066619 - DNA, 22 bp, Homo sapiens
cagctggctgcggtgaggggac

SEQ ID NO: 9066620 - DNA, 20 bp, Homo sapiens
gtgtggccaggagctgcgct

SEQ ID NO: 9066621 - DNA, 22 bp, Homo sapiens
gtgtggccctgcgtcctgagtc

SEQ ID NO: 9066622 - DNA, 21 bp, Homo sapiens
gtgtggatatgtgacaggtgg

SEQ ID NO: 9066623 - DNA, 22 bp, Homo sapiens
gtgtgctgagtgactgtcatca

SEQ ID NO: 9066624 - DNA, 22 bp, Homo sapiens
gtgtgctgcccaactcgcagat

SEQ ID NO: 9066625 - DNA, 22 bp, Homo sapiens
gtgtgctgcccaactcgcagat

SEQ ID NO: 9066626 - DNA, 22 bp, Homo sapiens
gtgtgctgttgttcaggtagaa

SEQ ID NO: 9066627 - DNA, 22 bp, Homo sapiens
cagctgtctgaagcaggagtcc

SEQ ID NO: 9066628 - DNA, 22 bp, Homo sapiens
cagctgtctaagttgagcagga

SEQ ID NO: 9066629 - DNA, 22 bp, Homo sapiens
cagctgtctgaagcaggagtcc

SEQ ID NO: 9066630 - DNA, 22 bp, Homo sapiens
cagctgtctgctgaaggaagct

SEQ ID NO: 9066631 - DNA, 22 bp, Homo sapiens
cagctgtctaagttgagcagga

SEQ ID NO: 9066632 - DNA, 22 bp, Homo sapiens
cagctgggtgatcttgggcagg

SEQ ID NO: 9066633 - DNA, 22 bp, Homo sapiens
cagctgtgaattgtcttatcta

SEQ ID NO: 9066634 - DNA, 22 bp, Homo sapiens
cagctgtgacagccagttgatg

SEQ ID NO: 9066635 - DNA, 22 bp, Homo sapiens
cagctgtgagagtgcattgaag

SEQ ID NO: 9066636 - DNA, 22 bp, Homo sapiens
cagctgtgagagtgcattgaag

SEQ ID NO: 9066637 - DNA, 17 bp, Homo sapiens
cagctgtgagagcctta

SEQ ID NO: 9066638 - DNA, 17 bp, Homo sapiens
cagctgtgagagcctta

SEQ ID NO: 9066639 - DNA, 22 bp, Homo sapiens
cagctggggcagccacgtgcgg

SEQ ID NO: 9066640 - DNA, 22 bp, Homo sapiens
cagctggggcagccacgtgcgg

SEQ ID NO: 9066641 - DNA, 22 bp, Homo sapiens
cagctggggcagccacgtgcgg

SEQ ID NO: 9066642 - DNA, 22 bp, Homo sapiens
cagctgggagctccattagata

SEQ ID NO: 9066643 - DNA, 22 bp, Homo sapiens
cagctgggcctcctgagccctg

SEQ ID NO: 9066644 - DNA, 22 bp, Homo sapiens
gtggggagtgttctgtgattgg

SEQ ID NO: 9066645 - DNA, 22 bp, Homo sapiens
gtggggagtgttctgtgattgg

SEQ ID NO: 9066646 - DNA, 22 bp, Homo sapiens
gtggggcagtggcctgggagca

SEQ ID NO: 9066647 - DNA, 22 bp, Homo sapiens
cagctgcaggaacaaaaatgtg

SEQ ID NO: 9066648 - DNA, 22 bp, Homo sapiens
cagctgcccctccagggctggg

SEQ ID NO: 9066649 - DNA, 22 bp, Homo sapiens
cagctgcccctccagggctggg

SEQ ID NO: 9066650 - DNA, 22 bp, Homo sapiens
cagctgccctgccttgccctta

SEQ ID NO: 9066651 - DNA, 22 bp, Homo sapiens
cagctgcctatgacctagcctc

SEQ ID NO: 9066652 - DNA, 22 bp, Homo sapiens
cagctgcctatgacctagcctc

SEQ ID NO: 9066653 - DNA, 22 bp, Homo sapiens
cagctgcctgcaacacaagctt

SEQ ID NO: 9066654 - DNA, 22 bp, Homo sapiens
cagctgcctgtattgtcctcat

SEQ ID NO: 9066655 - DNA, 22 bp, Homo sapiens
cagctgcctgtattgtcctcat

SEQ ID NO: 9066656 - DNA, 20 bp, Homo sapiens
cagctgcctggctctgggat

SEQ ID NO: 9066657 - DNA, 22 bp, Homo sapiens
cagctgccacacctctttctct

SEQ ID NO: 9066658 - DNA, 22 bp, Homo sapiens
cagctgccacacctctttctct

SEQ ID NO: 9066659 - DNA, 22 bp, Homo sapiens
cagctgccacaggactttctga

SEQ ID NO: 9066660 - DNA, 22 bp, Homo sapiens
cagctgccacaggactttctga

SEQ ID NO: 9066661 - DNA, 22 bp, Homo sapiens
cagctgccacttgctctcggct

SEQ ID NO: 9066662 - DNA, 22 bp, Homo sapiens
cagctgccaagaatcttttcta

SEQ ID NO: 9066663 - DNA, 22 bp, Homo sapiens
cagctgccaagaatcttttcta

SEQ ID NO: 9066664 - DNA, 19 bp, Homo sapiens
cagctgccttttctttgca

SEQ ID NO: 9066665 - DNA, 22 bp, Homo sapiens
cagctgccttctgcgggaagtc

SEQ ID NO: 9066666 - DNA, 22 bp, Homo sapiens
cagctgcctgtctggaggcaat

SEQ ID NO: 9066667 - DNA, 22 bp, Homo sapiens
cagctgcctgtctggaggcaat

SEQ ID NO: 9066668 - DNA, 22 bp, Homo sapiens
cagctgctcttctggcctgtca

SEQ ID NO: 9066669 - DNA, 22 bp, Homo sapiens
cagctgctgatggcctgacaga

SEQ ID NO: 9066670 - DNA, 22 bp, Homo sapiens
cagctgctgttcagttttgttt

SEQ ID NO: 9066671 - DNA, 22 bp, Homo sapiens
cagctgctgttcagttttgttt

SEQ ID NO: 9066672 - DNA, 22 bp, Homo sapiens
cagctgctgttcagttttgttt

SEQ ID NO: 9066673 - DNA, 22 bp, Homo sapiens
cagctgcttctcctccagagct

SEQ ID NO: 9066674 - DNA, 22 bp, Homo sapiens
cagctgctgcccttggctgcag

SEQ ID NO: 9066675 - DNA, 22 bp, Homo sapiens
cagctgctggctccgggctaag

SEQ ID NO: 9066676 - DNA, 22 bp, Homo sapiens
cagctgctgtaacagaatactt

SEQ ID NO: 9066677 - DNA, 22 bp, Homo sapiens
cagctggccaatcagggcgccc

SEQ ID NO: 9066678 - DNA, 22 bp, Homo sapiens
cagctggccccacagtagaggc

SEQ ID NO: 9066679 - DNA, 22 bp, Homo sapiens
cagctggccccacagtagaggc

SEQ ID NO: 9066680 - DNA, 22 bp, Homo sapiens
cagctggccccacagtagaggc

SEQ ID NO: 9066681 - DNA, 22 bp, Homo sapiens
cagctggcctgatccctgtggc

SEQ ID NO: 9066682 - DNA, 22 bp, Homo sapiens
cagctggccctttggtagcctt

SEQ ID NO: 9066683 - DNA, 22 bp, Homo sapiens
cagctggcctgagcggtggcgg

SEQ ID NO: 9066684 - DNA, 22 bp, Homo sapiens
cagctggcgactctcctcgatg

SEQ ID NO: 9066685 - DNA, 22 bp, Homo sapiens
cagctggcgactctcctcgatg

SEQ ID NO: 9066686 - DNA, 22 bp, Homo sapiens
cagctggcgcctggggaccaga

SEQ ID NO: 9066687 - DNA, 22 bp, Homo sapiens
cagctggcgtggagtgattgca

SEQ ID NO: 9066688 - DNA, 22 bp, Homo sapiens
cagctggcgggcagagccgcca

SEQ ID NO: 9066689 - DNA, 22 bp, Homo sapiens
cagctggcgtggagtgattgca

SEQ ID NO: 9066690 - DNA, 22 bp, Homo sapiens
cagctggctgcatgatgccaaa

SEQ ID NO: 9066691 - DNA, 22 bp, Homo sapiens
cagctggctccacctctgggct

SEQ ID NO: 9066692 - DNA, 22 bp, Homo sapiens
cagctggcgtggagtgattgca

SEQ ID NO: 9066693 - DNA, 22 bp, Homo sapiens
gtgggtggatcacctgaggtca

SEQ ID NO: 9066694 - DNA, 22 bp, Homo sapiens
gtggcagagaacaaggagaggt

SEQ ID NO: 9066695 - DNA, 22 bp, Homo sapiens
gtggcagagcaggagacaggac

SEQ ID NO: 9066696 - DNA, 22 bp, Homo sapiens
gtggcagagcaggagacaggac

SEQ ID NO: 9066697 - DNA, 22 bp, Homo sapiens
gtggcagaaactggcagaggag

SEQ ID NO: 9066698 - DNA, 22 bp, Homo sapiens
gtggcagaaactggcagaggag

SEQ ID NO: 9066699 - DNA, 22 bp, Homo sapiens
gtggcagaaactggcagaggag

SEQ ID NO: 9066700 - DNA, 22 bp, Homo sapiens
gtggcagggtgctcatcatgca

SEQ ID NO: 9066701 - DNA, 22 bp, Homo sapiens
gtggcagagccaaggctggagc

SEQ ID NO: 9066702 - DNA, 22 bp, Homo sapiens
gtggcagagccaaggctggagc

SEQ ID NO: 9066703 - DNA, 22 bp, Homo sapiens
gtggcaggtcccattggagcag

SEQ ID NO: 9066704 - DNA, 21 bp, Homo sapiens
cagcccagcccattgacagtg

SEQ ID NO: 9066705 - DNA, 22 bp, Homo sapiens
cagcccagccgagggcctggct

SEQ ID NO: 9066706 - DNA, 22 bp, Homo sapiens
cagcccagccttgtctctttat

SEQ ID NO: 9066707 - DNA, 22 bp, Homo sapiens
cagcccagcgcaaacaactggc

SEQ ID NO: 9066708 - DNA, 22 bp, Homo sapiens
cagcccaggccgacagttcctc

SEQ ID NO: 9066709 - DNA, 22 bp, Homo sapiens
cagcccaggccgacagttcctc

SEQ ID NO: 9066710 - DNA, 22 bp, Homo sapiens
cagcccaggactgcaggtgttt

SEQ ID NO: 9066711 - DNA, 22 bp, Homo sapiens
gtggcactgatagtttcactct

SEQ ID NO: 9066712 - DNA, 22 bp, Homo sapiens
gtggagccctgccttgctcatg

SEQ ID NO: 9066713 - DNA, 22 bp, Homo sapiens
cagctctggcgtcagggagcga

SEQ ID NO: 9066714 - DNA, 22 bp, Homo sapiens
cagctctggcagagcccaaccc

SEQ ID NO: 9066715 - DNA, 22 bp, Homo sapiens
cagctctgctgggaggatgcag

SEQ ID NO: 9066716 - DNA, 20 bp, Homo sapiens
cagctctgggaaagaggcca

SEQ ID NO: 9066717 - DNA, 22 bp, Homo sapiens
cagctctggctattgaggacca

SEQ ID NO: 9066718 - DNA, 22 bp, Homo sapiens
cagctctggctttggggagctt

SEQ ID NO: 9066719 - DNA, 22 bp, Homo sapiens
cagctctgtgcaggcctgggga

SEQ ID NO: 9066720 - DNA, 22 bp, Homo sapiens
cagctctgtgcaggcctgggga

SEQ ID NO: 9066721 - DNA, 22 bp, Homo sapiens
cagctctgtgcaggcctgggga

SEQ ID NO: 9066722 - DNA, 22 bp, Homo sapiens
cagctctgtgcaggcctgggga

SEQ ID NO: 9066723 - DNA, 22 bp, Homo sapiens
cagctctgtgcaggcctgggga

SEQ ID NO: 9066724 - DNA, 22 bp, Homo sapiens
gtggcagtcatcaaggacagat

SEQ ID NO: 9066725 - DNA, 22 bp, Homo sapiens
gtggcagtagacagtgcatcta

SEQ ID NO: 9066726 - DNA, 22 bp, Homo sapiens
gtggccaggcgtccgcgcggct

SEQ ID NO: 9066727 - DNA, 22 bp, Homo sapiens
gtggccaggccgactgccaggc

SEQ ID NO: 9066728 - DNA, 22 bp, Homo sapiens
gtggccagtggtgggcgccctg

SEQ ID NO: 9066729 - DNA, 19 bp, Homo sapiens
gtggccagggcaggggctg

SEQ ID NO: 9066730 - DNA, 22 bp, Homo sapiens
gtggccaggtcagggacttgtg

SEQ ID NO: 9066731 - DNA, 22 bp, Homo sapiens
gtggccagtcccgatgcttgtt

SEQ ID NO: 9066732 - DNA, 23 bp, Homo sapiens
cagctgaagcagcctgggctgga

SEQ ID NO: 9066733 - DNA, 22 bp, Homo sapiens
cagctgaagaaagagtggttag

SEQ ID NO: 9066734 - DNA, 22 bp, Homo sapiens
cagctgagctcccaggccatca

SEQ ID NO: 9066735 - DNA, 22 bp, Homo sapiens
cagctgagctcccaggccatca

SEQ ID NO: 9066736 - DNA, 22 bp, Homo sapiens
cagctgaggtcaaagaagcagg

SEQ ID NO: 9066737 - DNA, 22 bp, Homo sapiens
cagctgaggtcaaagaagcagg

SEQ ID NO: 9066738 - DNA, 22 bp, Homo sapiens
cagctgaggtcaaagaagcagg

SEQ ID NO: 9066739 - DNA, 22 bp, Homo sapiens
cagctgagtatgcattcaagca

SEQ ID NO: 9066740 - DNA, 22 bp, Homo sapiens
cagctgagtctgaggttctttg

SEQ ID NO: 9066741 - DNA, 22 bp, Homo sapiens
cagctgaggaatactagatgta

SEQ ID NO: 9066742 - DNA, 22 bp, Homo sapiens
cagctgagctgccagactactg

SEQ ID NO: 9066743 - DNA, 22 bp, Homo sapiens
cagctgagtgttggcatgttca

SEQ ID NO: 9066744 - DNA, 22 bp, Homo sapiens
cagctgagtggaccctagaggc

SEQ ID NO: 9066745 - DNA, 22 bp, Homo sapiens
cagctgagtggaccctagaggc

SEQ ID NO: 9066746 - DNA, 22 bp, Homo sapiens
cagctgagtttccaagtctgcc

SEQ ID NO: 9066747 - DNA, 22 bp, Homo sapiens
cagctgagttactctgaggtct

SEQ ID NO: 9066748 - DNA, 22 bp, Homo sapiens
cagctgagttactctgaggtct

SEQ ID NO: 9066749 - DNA, 22 bp, Homo sapiens
cagctgagttactctgaggtct

SEQ ID NO: 9066750 - DNA, 22 bp, Homo sapiens
gtggcctgtcagaagccgtggg

SEQ ID NO: 9066751 - DNA, 20 bp, Homo sapiens
gtggcctgtcctgttgtggg

SEQ ID NO: 9066752 - DNA, 22 bp, Homo sapiens
gtggccttaagaaacaaacaac

SEQ ID NO: 9066753 - DNA, 22 bp, Homo sapiens
gtggccttataagaagagacat

SEQ ID NO: 9066754 - DNA, 22 bp, Homo sapiens
gtggccttaggacacgtttatt

SEQ ID NO: 9066755 - DNA, 22 bp, Homo sapiens
cagctctgttgccctggaaacg

SEQ ID NO: 9066756 - DNA, 22 bp, Homo sapiens
cagctctgttgccaaagtgggc

SEQ ID NO: 9066757 - DNA, 22 bp, Homo sapiens
cagctctgttcatagatggtgc

SEQ ID NO: 9066758 - DNA, 22 bp, Homo sapiens
cagctcttccatttccttcagc

SEQ ID NO: 9066759 - DNA, 22 bp, Homo sapiens
cagctgaacatgtagagcatct

SEQ ID NO: 9066760 - DNA, 22 bp, Homo sapiens
cagctgaacatgtagagcatct

SEQ ID NO: 9066761 - DNA, 22 bp, Homo sapiens
cagctgaaagaaggaagtgtca

SEQ ID NO: 9066762 - DNA, 22 bp, Homo sapiens
cagctgaaagaaggaagtgtca

SEQ ID NO: 9066763 - DNA, 22 bp, Homo sapiens
gtgggaagtctctcggaggaag

SEQ ID NO: 9066764 - DNA, 22 bp, Homo sapiens
gtgggaagagccaattggggta

SEQ ID NO: 9066765 - DNA, 22 bp, Homo sapiens
gtggcttgaccatccctgctac

SEQ ID NO: 9066766 - DNA, 22 bp, Homo sapiens
gtggcttcttcttgggagctgc

SEQ ID NO: 9066767 - DNA, 22 bp, Homo sapiens
gtggcttcttcttgggagctgc

SEQ ID NO: 9066768 - DNA, 22 bp, Homo sapiens
gtggcttggaccagtcacagtg

SEQ ID NO: 9066769 - DNA, 22 bp, Homo sapiens
gtggctttataggaagaggaac

SEQ ID NO: 9066770 - DNA, 22 bp, Homo sapiens
gtggctttggaattgtagactc

SEQ ID NO: 9066771 - DNA, 22 bp, Homo sapiens
gtggctttcatttcaggatgtg

SEQ ID NO: 9066772 - DNA, 22 bp, Homo sapiens
gtggcttctgcggtgtgcgcag

SEQ ID NO: 9066773 - DNA, 22 bp, Homo sapiens
gtggcctttcttgggctacaga

SEQ ID NO: 9066774 - DNA, 22 bp, Homo sapiens
gtggcctttgtccaggcgaaac

SEQ ID NO: 9066775 - DNA, 22 bp, Homo sapiens
gtggcctttatcttaggtatcc

SEQ ID NO: 9066776 - DNA, 22 bp, Homo sapiens
gtggccttattatgtacaaaat

SEQ ID NO: 9066777 - DNA, 22 bp, Homo sapiens
gtggcctttcctgaagaaatga

SEQ ID NO: 9066778 - DNA, 15 bp, Homo sapiens
gtggctaatggggca

SEQ ID NO: 9066779 - DNA, 22 bp, Homo sapiens
gtggctaaaagatatgctgtga

SEQ ID NO: 9066780 - DNA, 22 bp, Homo sapiens
gtggcgaggggaggtcctggcg

SEQ ID NO: 9066781 - DNA, 22 bp, Homo sapiens
gtggccttttagaataaactct

SEQ ID NO: 9066782 - DNA, 22 bp, Homo sapiens
gtggccttttcaagtagggtat

SEQ ID NO: 9066783 - DNA, 22 bp, Homo sapiens
gtgggcaggccccaaagcaggg

SEQ ID NO: 9066784 - DNA, 22 bp, Homo sapiens
gtgggactcttctttggcagtg

SEQ ID NO: 9066785 - DNA, 22 bp, Homo sapiens
gtggggagggagatgctgaagt

SEQ ID NO: 9066786 - DNA, 22 bp, Homo sapiens
gtgggcagtgcctgacggatga

SEQ ID NO: 9066787 - DNA, 22 bp, Homo sapiens
gtttcctgtgggaactcggctg

SEQ ID NO: 9066788 - DNA, 22 bp, Homo sapiens
gtttcctgtggccacagaataa

SEQ ID NO: 9066789 - DNA, 19 bp, Homo sapiens
gtttccttgggtgtaggga

SEQ ID NO: 9066790 - DNA, 19 bp, Homo sapiens
gtttccttgggtgtaggga

SEQ ID NO: 9066791 - DNA, 22 bp, Homo sapiens
gtttcctgtttctcagcagccc

SEQ ID NO: 9066792 - DNA, 22 bp, Homo sapiens
gtttcctgtttctcagcagccc

SEQ ID NO: 9066793 - DNA, 22 bp, Homo sapiens
gtttcctgggccccaacccaga

SEQ ID NO: 9066794 - DNA, 22 bp, Homo sapiens
gtttgccttttagataggaatg

SEQ ID NO: 9066795 - DNA, 22 bp, Homo sapiens
gtttgcctgccgacgctctcat

SEQ ID NO: 9066796 - DNA, 22 bp, Homo sapiens
gtttgcctgtgatgtacatttc

SEQ ID NO: 9066797 - DNA, 22 bp, Homo sapiens
gtttgcctgccgacgctctcat

SEQ ID NO: 9066798 - DNA, 22 bp, Homo sapiens
gtttcctttctattgccttgat

SEQ ID NO: 9066799 - DNA, 22 bp, Homo sapiens
gtttcctttaatagtgatattg

SEQ ID NO: 9066800 - DNA, 22 bp, Homo sapiens
gtttcctctgctggttttcatt

SEQ ID NO: 9066801 - DNA, 22 bp, Homo sapiens
gtttcctgaaatagagtactgg

SEQ ID NO: 9066802 - DNA, 22 bp, Homo sapiens
gtttcctgcgtgtgccactcat

SEQ ID NO: 9066803 - DNA, 22 bp, Homo sapiens
gtttcctggaaacattaggaga

SEQ ID NO: 9066804 - DNA, 22 bp, Homo sapiens
gtttcctgatgtgggagatctt

SEQ ID NO: 9066805 - DNA, 18 bp, Homo sapiens
gtttcctgaggtgaaggg

SEQ ID NO: 9066806 - DNA, 22 bp, Homo sapiens
gtttcctgaccctggcccagca

SEQ ID NO: 9066807 - DNA, 22 bp, Homo sapiens
gtttcctgactgtggaattata

SEQ ID NO: 9066808 - DNA, 22 bp, Homo sapiens
gtttattattcaacttcatgtt

SEQ ID NO: 9066809 - DNA, 22 bp, Homo sapiens
gtttacatgcatgcaagaatga

SEQ ID NO: 9066810 - DNA, 22 bp, Homo sapiens
gtttacatgtaatgtgttattg

SEQ ID NO: 9066811 - DNA, 22 bp, Homo sapiens
gtttacatgcagaaaatcaatg

SEQ ID NO: 9066812 - DNA, 22 bp, Homo sapiens
gtttacatgtaatgtgttattg

SEQ ID NO: 9066813 - DNA, 22 bp, Homo sapiens
gtttacatgtttttctcttaca

SEQ ID NO: 9066814 - DNA, 22 bp, Homo sapiens
gtttacatgtactcattatact

SEQ ID NO: 9066815 - DNA, 21 bp, Homo sapiens
gtttacaaggctttgctcctg

SEQ ID NO: 9066816 - DNA, 22 bp, Homo sapiens
gtttacaacatgccaactgggc

SEQ ID NO: 9066817 - DNA, 22 bp, Homo sapiens
gtttacaacatgccaactgggc

SEQ ID NO: 9066818 - DNA, 22 bp, Homo sapiens
gtttacaacatgccaactgggc

SEQ ID NO: 9066819 - DNA, 21 bp, Homo sapiens
gtttacaaggctttgctcctg

SEQ ID NO: 9066820 - DNA, 21 bp, Homo sapiens
gtttacaaggctttgctcctg

SEQ ID NO: 9066821 - DNA, 21 bp, Homo sapiens
gtttacaaggctttgctcctg

SEQ ID NO: 9066822 - DNA, 22 bp, Homo sapiens
gtttacaacatcttgtccttca

SEQ ID NO: 9066823 - DNA, 22 bp, Homo sapiens
gtttacaacatcttgtccttca

SEQ ID NO: 9066824 - DNA, 22 bp, Homo sapiens
gtttacaacatcttgtccttca

SEQ ID NO: 9066825 - DNA, 22 bp, Homo sapiens
gtttacaacatcttgtccttca

SEQ ID NO: 9066826 - DNA, 22 bp, Homo sapiens
gtttacaacatgccaactgggc

SEQ ID NO: 9066827 - DNA, 22 bp, Homo sapiens
caggaagattgtggaggtggtt

SEQ ID NO: 9066828 - DNA, 22 bp, Homo sapiens
caggaagcaagtgattttcttg

SEQ ID NO: 9066829 - DNA, 22 bp, Homo sapiens
caggaagattagaccaagagct

SEQ ID NO: 9066830 - DNA, 22 bp, Homo sapiens
caggaagaggtggggctaaagt

SEQ ID NO: 9066831 - DNA, 22 bp, Homo sapiens
caggaagaggtggggctaaagt

SEQ ID NO: 9066832 - DNA, 19 bp, Homo sapiens
caggaacatggagggaggg

SEQ ID NO: 9066833 - DNA, 22 bp, Homo sapiens
caggaacatgttggaaagaaat

SEQ ID NO: 9066834 - DNA, 22 bp, Homo sapiens
caggaacatgttggaaagaaat

SEQ ID NO: 9066835 - DNA, 22 bp, Homo sapiens
caggaacatgttggaaagaaat

SEQ ID NO: 9066836 - DNA, 22 bp, Homo sapiens
caggaagagaacatggaggctg

SEQ ID NO: 9066837 - DNA, 22 bp, Homo sapiens
caggaacattgtagaattgaaa

SEQ ID NO: 9066838 - DNA, 22 bp, Homo sapiens
caggaacattgtagaattgaaa

SEQ ID NO: 9066839 - DNA, 22 bp, Homo sapiens
caggaagagaacatggaggctg

SEQ ID NO: 9066840 - DNA, 22 bp, Homo sapiens
caggaagaggtatcaccgagca

SEQ ID NO: 9066841 - DNA, 22 bp, Homo sapiens
caggaagaggacaggcttcccc

SEQ ID NO: 9066842 - DNA, 19 bp, Homo sapiens
caggaacatggagggaggg

SEQ ID NO: 9066843 - DNA, 22 bp, Homo sapiens
caggaacagggtgtcctggcag

SEQ ID NO: 9066844 - DNA, 22 bp, Homo sapiens
caggaacagcaccaggagctag

SEQ ID NO: 9066845 - DNA, 22 bp, Homo sapiens
caggaacaatgtaagtctcatt

SEQ ID NO: 9066846 - DNA, 22 bp, Homo sapiens
caggaacacaatgagtctcaaa

SEQ ID NO: 9066847 - DNA, 22 bp, Homo sapiens
caggaaattttgtgatctgttc

SEQ ID NO: 9066848 - DNA, 22 bp, Homo sapiens
caggaaattctttttaacagaa

SEQ ID NO: 9066849 - DNA, 22 bp, Homo sapiens
caggaaattgcaacagtctgag

SEQ ID NO: 9066850 - DNA, 22 bp, Homo sapiens
caggaaatttatgttctactta

SEQ ID NO: 9066851 - DNA, 22 bp, Homo sapiens
caggaaatttatgttctactta

SEQ ID NO: 9066852 - DNA, 22 bp, Homo sapiens
caggaaatttaagagtgtacaa

SEQ ID NO: 9066853 - DNA, 22 bp, Homo sapiens
caggaaatttaagagtgtacaa

SEQ ID NO: 9066854 - DNA, 22 bp, Homo sapiens
caggaaattggctatttgggat

SEQ ID NO: 9066855 - DNA, 22 bp, Homo sapiens
caggaaattcaagagaggctgc

SEQ ID NO: 9066856 - DNA, 22 bp, Homo sapiens
caggaaattagtctctctgttg

SEQ ID NO: 9066857 - DNA, 22 bp, Homo sapiens
caggaaatgtataattttataa

SEQ ID NO: 9066858 - DNA, 23 bp, Homo sapiens
caggaaatgttcttgaagcctga

SEQ ID NO: 9066859 - DNA, 22 bp, Homo sapiens
caggaaattcaagagaggctgc

SEQ ID NO: 9066860 - DNA, 22 bp, Homo sapiens
caggaaattcttttgtttgtgc

SEQ ID NO: 9066861 - DNA, 22 bp, Homo sapiens
caggaaattcttttgtttgtgc

SEQ ID NO: 9066862 - DNA, 22 bp, Homo sapiens
caggaaattcccagaaggactg

SEQ ID NO: 9066863 - DNA, 22 bp, Homo sapiens
caggaaatggggtttagttatt

SEQ ID NO: 9066864 - DNA, 22 bp, Homo sapiens
caggaaatgggtcgttttataa

SEQ ID NO: 9066865 - DNA, 22 bp, Homo sapiens
caggaaatgtataattttataa

SEQ ID NO: 9066866 - DNA, 22 bp, Homo sapiens
caggaaatgggtcgttttataa

SEQ ID NO: 9066867 - DNA, 22 bp, Homo sapiens
caggaaatgtataattttataa

SEQ ID NO: 9066868 - DNA, 22 bp, Homo sapiens
caggaaataaaaagtatcttct

SEQ ID NO: 9066869 - DNA, 22 bp, Homo sapiens
caggaaataaaaagtatcttct

SEQ ID NO: 9066870 - DNA, 22 bp, Homo sapiens
caggaaataaatggtaatgcat

SEQ ID NO: 9066871 - DNA, 22 bp, Homo sapiens
caggaaataaaaagtatcttct

SEQ ID NO: 9066872 - DNA, 22 bp, Homo sapiens
caggaaatagacactgtatgat

SEQ ID NO: 9066873 - DNA, 22 bp, Homo sapiens
caggaaatagttcagtcaaact

SEQ ID NO: 9066874 - DNA, 22 bp, Homo sapiens
caggaaatggctgaataaattc

SEQ ID NO: 9066875 - DNA, 22 bp, Homo sapiens
gttggctatgagagctttagtg

SEQ ID NO: 9066876 - DNA, 22 bp, Homo sapiens
gttgggaacatgacctaatggt

SEQ ID NO: 9066877 - DNA, 22 bp, Homo sapiens
gttggctttgctctctgtccta

SEQ ID NO: 9066878 - DNA, 22 bp, Homo sapiens
gttggctatgagagctttagtg

SEQ ID NO: 9066879 - DNA, 22 bp, Homo sapiens
gttggccattaattggaggaca

SEQ ID NO: 9066880 - DNA, 22 bp, Homo sapiens
gttggcagagagaagcctagca

SEQ ID NO: 9066881 - DNA, 22 bp, Homo sapiens
gttggaaatggtttctatccct

SEQ ID NO: 9066882 - DNA, 22 bp, Homo sapiens
gttggaaatgcagagtctcaga

SEQ ID NO: 9066883 - DNA, 22 bp, Homo sapiens
caggaaagccgagtgccatagg

SEQ ID NO: 9066884 - DNA, 22 bp, Homo sapiens
caggaaaggtagtcacaatgta

SEQ ID NO: 9066885 - DNA, 22 bp, Homo sapiens
caggaaaggtagtcacaatgta

SEQ ID NO: 9066886 - DNA, 22 bp, Homo sapiens
caggaaaggtagtcacaatgta

SEQ ID NO: 9066887 - DNA, 22 bp, Homo sapiens
caggaaaggtgtgtcatgatgg

SEQ ID NO: 9066888 - DNA, 22 bp, Homo sapiens
caggaaaggtgtgtcatgatgg

SEQ ID NO: 9066889 - DNA, 22 bp, Homo sapiens
caggaaaggtgtgtcatgatgg

SEQ ID NO: 9066890 - DNA, 22 bp, Homo sapiens
gttcttcagaggggaaagaacc

SEQ ID NO: 9066891 - DNA, 22 bp, Homo sapiens
gttcttcagcattagaagtcat

SEQ ID NO: 9066892 - DNA, 22 bp, Homo sapiens
gttcttcaggctgagcagagag

SEQ ID NO: 9066893 - DNA, 22 bp, Homo sapiens
gttgcttttctccatcacatgg

SEQ ID NO: 9066894 - DNA, 22 bp, Homo sapiens
gttgcttttttgataggtggaa

SEQ ID NO: 9066895 - DNA, 20 bp, Homo sapiens
gttggaaagttcactctgct

SEQ ID NO: 9066896 - DNA, 22 bp, Homo sapiens
gttgctttacagctggtgacag

SEQ ID NO: 9066897 - DNA, 20 bp, Homo sapiens
gttgctttagtctggtttgg

SEQ ID NO: 9066898 - DNA, 21 bp, Homo sapiens
gttcttagttatattctcaat

SEQ ID NO: 9066899 - DNA, 19 bp, Homo sapiens
gttctgtgtcctggaggaa

SEQ ID NO: 9066900 - DNA, 22 bp, Homo sapiens
gttcttcaccaaggtcagaggc

SEQ ID NO: 9066901 - DNA, 22 bp, Homo sapiens
gttcttcaccaaggtcagaggc

SEQ ID NO: 9066902 - DNA, 22 bp, Homo sapiens
gttcttcacattttggggtcac

SEQ ID NO: 9066903 - DNA, 22 bp, Homo sapiens
gttctgtagtcatagagcaatt

SEQ ID NO: 9066904 - DNA, 22 bp, Homo sapiens
gttctgggagatcttgagcttc

SEQ ID NO: 9066905 - DNA, 22 bp, Homo sapiens
gttcctaaccagcagagaaaca

SEQ ID NO: 9066906 - DNA, 22 bp, Homo sapiens
gttcctcaaaaaggagagcccc

SEQ ID NO: 9066907 - DNA, 22 bp, Homo sapiens
gttcctcacgtggacagatgat

SEQ ID NO: 9066908 - DNA, 22 bp, Homo sapiens
gttcctgaagggactggtgcag

SEQ ID NO: 9066909 - DNA, 22 bp, Homo sapiens
gttcctgaaagatgagtaatta

SEQ ID NO: 9066910 - DNA, 22 bp, Homo sapiens
gttcctgaagggactggtgcag

SEQ ID NO: 9066911 - DNA, 22 bp, Homo sapiens
gttcctgaaagatgagtaatta

SEQ ID NO: 9066912 - DNA, 22 bp, Homo sapiens
gttcctcagcccttacttagcc

SEQ ID NO: 9066913 - DNA, 22 bp, Homo sapiens
gttcctcagttgtaaaaaatgt

SEQ ID NO: 9066914 - DNA, 22 bp, Homo sapiens
gttcctcatccagtcatgacta

SEQ ID NO: 9066915 - DNA, 22 bp, Homo sapiens
gttcctcatgagtaccccttaa

SEQ ID NO: 9066916 - DNA, 22 bp, Homo sapiens
gttcctgactgtggagtttggt

SEQ ID NO: 9066917 - DNA, 22 bp, Homo sapiens
gttcctgactgtggagtttggt

SEQ ID NO: 9066918 - DNA, 22 bp, Homo sapiens
gttcctgagaaataaagagaga

SEQ ID NO: 9066919 - DNA, 22 bp, Homo sapiens
gttcctgatgctttgaaattca

SEQ ID NO: 9066920 - DNA, 22 bp, Homo sapiens
gttctgggaaggtggacctgtt

SEQ ID NO: 9066921 - DNA, 22 bp, Homo sapiens
gttcacagtgttttctttgcat

SEQ ID NO: 9066922 - DNA, 22 bp, Homo sapiens
gttcacagtgttttctttgcat

SEQ ID NO: 9066923 - DNA, 22 bp, Homo sapiens
gttcccaggccctgggctctcc

SEQ ID NO: 9066924 - DNA, 22 bp, Homo sapiens
cagcttgggagtttggttttat

SEQ ID NO: 9066925 - DNA, 22 bp, Homo sapiens
cagcttgggggcgctggcctca

SEQ ID NO: 9066926 - DNA, 22 bp, Homo sapiens
cagcttgggggcgctggcctca

SEQ ID NO: 9066927 - DNA, 22 bp, Homo sapiens
cagcttgggtcaggtgcctgct

SEQ ID NO: 9066928 - DNA, 22 bp, Homo sapiens
cagcttgggtcaggtgcctgct

SEQ ID NO: 9066929 - DNA, 22 bp, Homo sapiens
cagcttggcgaatgtaggtatg

SEQ ID NO: 9066930 - DNA, 22 bp, Homo sapiens
cagcttggcttcacattctgta

SEQ ID NO: 9066931 - DNA, 22 bp, Homo sapiens
cagcttggattttggcacgtgt

SEQ ID NO: 9066932 - DNA, 22 bp, Homo sapiens
cagcttggcttccgctttactg

SEQ ID NO: 9066933 - DNA, 22 bp, Homo sapiens
cagcttggcttccgctttactg

SEQ ID NO: 9066934 - DNA, 22 bp, Homo sapiens
cagcttgggagtttggttttat

SEQ ID NO: 9066935 - DNA, 20 bp, Homo sapiens
cagcttggatgagaggctga

SEQ ID NO: 9066936 - DNA, 20 bp, Homo sapiens
cagcttggatgagaggctga

SEQ ID NO: 9066937 - DNA, 20 bp, Homo sapiens
cagcttggatgagaggctga

SEQ ID NO: 9066938 - DNA, 22 bp, Homo sapiens
cagcttctgctatcgaacatct

SEQ ID NO: 9066939 - DNA, 22 bp, Homo sapiens
cagcttggaggaggatctaaga

SEQ ID NO: 9066940 - DNA, 22 bp, Homo sapiens
cagcttggaggaggatctaaga

SEQ ID NO: 9066941 - DNA, 22 bp, Homo sapiens
cagcttctccagatgaccctca

SEQ ID NO: 9066942 - DNA, 22 bp, Homo sapiens
cagcttctcagaaagctgaggt

SEQ ID NO: 9066943 - DNA, 22 bp, Homo sapiens
cagcttctcagaaagctgaggt

SEQ ID NO: 9066944 - DNA, 22 bp, Homo sapiens
cagcttctcagaaagctgaggt

SEQ ID NO: 9066945 - DNA, 22 bp, Homo sapiens
cagcttctatttatctttgtgt

SEQ ID NO: 9066946 - DNA, 22 bp, Homo sapiens
cagcttctagcatcggctttga

SEQ ID NO: 9066947 - DNA, 22 bp, Homo sapiens
cagcttctaccatcaggaaatt

SEQ ID NO: 9066948 - DNA, 22 bp, Homo sapiens
cagcttctaccatcaggaaatt

SEQ ID NO: 9066949 - DNA, 22 bp, Homo sapiens
cagcttctccggcctggtgcgg

SEQ ID NO: 9066950 - DNA, 22 bp, Homo sapiens
cagcttctccattcttctggct

SEQ ID NO: 9066951 - DNA, 21 bp, Homo sapiens
cagcttctgaaggtgtaggaa

SEQ ID NO: 9066952 - DNA, 22 bp, Homo sapiens
cagcttctgagcaagccagggg

SEQ ID NO: 9066953 - DNA, 22 bp, Homo sapiens
cagcttctgagcaagccagggg

SEQ ID NO: 9066954 - DNA, 22 bp, Homo sapiens
gttattctaccactatgtacag

SEQ ID NO: 9066955 - DNA, 22 bp, Homo sapiens
gttattctttgtatggtacatc

SEQ ID NO: 9066956 - DNA, 22 bp, Homo sapiens
gttattgacatgtattaagcac

SEQ ID NO: 9066957 - DNA, 22 bp, Homo sapiens
gttattcttttatagcaataca

SEQ ID NO: 9066958 - DNA, 22 bp, Homo sapiens
gttattgactctcttgtggctt

SEQ ID NO: 9066959 - DNA, 22 bp, Homo sapiens
gttatgtattgggaaatccaag

SEQ ID NO: 9066960 - DNA, 22 bp, Homo sapiens
gttattaaagtatttgatgtta

SEQ ID NO: 9066961 - DNA, 22 bp, Homo sapiens
gttactactgaggatatgaggg

SEQ ID NO: 9066962 - DNA, 22 bp, Homo sapiens
gttacatttggtgatttggtgc

SEQ ID NO: 9066963 - DNA, 22 bp, Homo sapiens
gttacatttattagaggtctct

SEQ ID NO: 9066964 - DNA, 22 bp, Homo sapiens
gttacattaaaaacattcactg

SEQ ID NO: 9066965 - DNA, 22 bp, Homo sapiens
gttacattacttgtgcagttgt

SEQ ID NO: 9066966 - DNA, 22 bp, Homo sapiens
gttacattaggataatttgctg

SEQ ID NO: 9066967 - DNA, 22 bp, Homo sapiens
cagctttccccgtgcctcagcc

SEQ ID NO: 9066968 - DNA, 22 bp, Homo sapiens
cagctttcatcagtgacactca

SEQ ID NO: 9066969 - DNA, 22 bp, Homo sapiens
cagctttcttccttctgtctgt

SEQ ID NO: 9066970 - DNA, 22 bp, Homo sapiens
cagctttgaaacatggctctag

SEQ ID NO: 9066971 - DNA, 22 bp, Homo sapiens
cagctttctgtctcatgactga

SEQ ID NO: 9066972 - DNA, 22 bp, Homo sapiens
cagctttccccgtgcctcagcc

SEQ ID NO: 9066973 - DNA, 22 bp, Homo sapiens
cagctttgagagttgcatttta

SEQ ID NO: 9066974 - DNA, 22 bp, Homo sapiens
caggaaaatggaatcacctgta

SEQ ID NO: 9066975 - DNA, 22 bp, Homo sapiens
cagcttgggtcaggtgcctgct

SEQ ID NO: 9066976 - DNA, 22 bp, Homo sapiens
cagcttgttaccgagggagggt

SEQ ID NO: 9066977 - DNA, 22 bp, Homo sapiens
cagctttagagaaaacatattt

SEQ ID NO: 9066978 - DNA, 22 bp, Homo sapiens
cagctttagtaacccactgctc

SEQ ID NO: 9066979 - DNA, 22 bp, Homo sapiens
gttcacaatttttactgattgg

SEQ ID NO: 9066980 - DNA, 22 bp, Homo sapiens
gttcacacttttgatatgtgaa

SEQ ID NO: 9066981 - DNA, 22 bp, Homo sapiens
gttcacaatggctttacctaag

SEQ ID NO: 9066982 - DNA, 22 bp, Homo sapiens
caggaaagagctgccaggcagg

SEQ ID NO: 9066983 - DNA, 22 bp, Homo sapiens
caggaaagagctgccaggcagg

SEQ ID NO: 9066984 - DNA, 22 bp, Homo sapiens
caggaaagaaatgagaacacca

SEQ ID NO: 9066985 - DNA, 22 bp, Homo sapiens
caggaaagagctgccaggcagg

SEQ ID NO: 9066986 - DNA, 22 bp, Homo sapiens
caggaaagaaatgagaacacca

SEQ ID NO: 9066987 - DNA, 21 bp, Homo sapiens
caggaaactgaggccatgggg

SEQ ID NO: 9066988 - DNA, 22 bp, Homo sapiens
caggaaactgtgggcttaaatc

SEQ ID NO: 9066989 - DNA, 21 bp, Homo sapiens
caggaaagaaaacgtacatat

SEQ ID NO: 9066990 - DNA, 16 bp, Homo sapiens
caggaaacttaaagac

SEQ ID NO: 9066991 - DNA, 19 bp, Homo sapiens
caggaaacacctactgcta

SEQ ID NO: 9066992 - DNA, 22 bp, Homo sapiens
caggaaacaaagccttgctcat

SEQ ID NO: 9066993 - DNA, 22 bp, Homo sapiens
caggaaaccgcatcccagtggg

SEQ ID NO: 9066994 - DNA, 22 bp, Homo sapiens
caggaaacggctattcttttgt

SEQ ID NO: 9066995 - DNA, 22 bp, Homo sapiens
caggaaacatatgtgcttgagg

SEQ ID NO: 9066996 - DNA, 22 bp, Homo sapiens
caggaaacattcccataacaca

SEQ ID NO: 9066997 - DNA, 22 bp, Homo sapiens
caggaaacattcttggtaagga

SEQ ID NO: 9066998 - DNA, 22 bp, Homo sapiens
cagcttccatctccactgccct

SEQ ID NO: 9066999 - DNA, 22 bp, Homo sapiens
cagcttccatctccactgccct

SEQ ID NO: 9067000 - DNA, 22 bp, Homo sapiens
cagcttcccagctcactcataa

SEQ ID NO: 9067001 - DNA, 22 bp, Homo sapiens
cagcttccatctccactgccct

SEQ ID NO: 9067002 - DNA, 22 bp, Homo sapiens
cagcttcccttggctgagcaga

SEQ ID NO: 9067003 - DNA, 22 bp, Homo sapiens
cagcttcccttggctgagcaga

SEQ ID NO: 9067004 - DNA, 22 bp, Homo sapiens
cagcttccccccgggcttgaga

SEQ ID NO: 9067005 - DNA, 22 bp, Homo sapiens
cagcttcattgcctgatgtctt

SEQ ID NO: 9067006 - DNA, 22 bp, Homo sapiens
cagcttcatgtccaggtactgt

SEQ ID NO: 9067007 - DNA, 22 bp, Homo sapiens
cagcttccataagagatggaga

SEQ ID NO: 9067008 - DNA, 22 bp, Homo sapiens
cagcttccataagagatggaga

SEQ ID NO: 9067009 - DNA, 22 bp, Homo sapiens
cagcttccacagacttggctcg

SEQ ID NO: 9067010 - DNA, 22 bp, Homo sapiens
cagcttccgaccgggggctgca

SEQ ID NO: 9067011 - DNA, 22 bp, Homo sapiens
cagcttcaataatggctgatgg

SEQ ID NO: 9067012 - DNA, 22 bp, Homo sapiens
cagcttcaactgcacagtcaac

SEQ ID NO: 9067013 - DNA, 20 bp, Homo sapiens
cagcttcaatgtcagcttga

SEQ ID NO: 9067014 - DNA, 22 bp, Homo sapiens
cagcttcatgacaaacagtttt

SEQ ID NO: 9067015 - DNA, 22 bp, Homo sapiens
cagcttcagcgtgacaccagtg

SEQ ID NO: 9067016 - DNA, 22 bp, Homo sapiens
cagcttcagaccctgggctgca

SEQ ID NO: 9067017 - DNA, 22 bp, Homo sapiens
cagcttcagaagaagccgtgag

SEQ ID NO: 9067018 - DNA, 22 bp, Homo sapiens
cagcttcagaccctgggctgca

SEQ ID NO: 9067019 - DNA, 22 bp, Homo sapiens
cagctgtttcagtagcgttact

SEQ ID NO: 9067020 - DNA, 22 bp, Homo sapiens
cagctgttgttatgtctgcagg

SEQ ID NO: 9067021 - DNA, 22 bp, Homo sapiens
cagctgtttgggcatggccaga

SEQ ID NO: 9067022 - DNA, 22 bp, Homo sapiens
cagctgttgtgtatcaggcaga

SEQ ID NO: 9067023 - DNA, 22 bp, Homo sapiens
cagctgttgtgatttccaggag

SEQ ID NO: 9067024 - DNA, 22 bp, Homo sapiens
cagctgttgtgatccatttacg

SEQ ID NO: 9067025 - DNA, 22 bp, Homo sapiens
cagctgttgtgctgggcagtta

SEQ ID NO: 9067026 - DNA, 22 bp, Homo sapiens
cagctgtgtatgagagcatgct

SEQ ID NO: 9067027 - DNA, 22 bp, Homo sapiens
cagctgtgctgtattaagctct

SEQ ID NO: 9067028 - DNA, 22 bp, Homo sapiens
cagctgtgctgtattaagctct

SEQ ID NO: 9067029 - DNA, 22 bp, Homo sapiens
cagctgtggagggaggaaatgc

SEQ ID NO: 9067030 - DNA, 22 bp, Homo sapiens
cagctgtggagggaggaaatgc

SEQ ID NO: 9067031 - DNA, 22 bp, Homo sapiens
cagctgtgctgattgctcagta

SEQ ID NO: 9067032 - DNA, 22 bp, Homo sapiens
cagctgtgctgattgctcagta

SEQ ID NO: 9067033 - DNA, 22 bp, Homo sapiens
cagctgtgctgattgctcagta

SEQ ID NO: 9067034 - DNA, 22 bp, Homo sapiens
cagctgtgctgattgctcagta

SEQ ID NO: 9067035 - DNA, 22 bp, Homo sapiens
cagctgtgctgattgctcagta

SEQ ID NO: 9067036 - DNA, 22 bp, Homo sapiens
cagctgtgctgattgctcagta

SEQ ID NO: 9067037 - DNA, 22 bp, Homo sapiens
cagctgtgattcctgctgtcca

SEQ ID NO: 9067038 - DNA, 18 bp, Homo sapiens
cagctgtgccctgtttgg

SEQ ID NO: 9067039 - DNA, 22 bp, Homo sapiens
cagctgtgatatgcctgcctga

SEQ ID NO: 9067040 - DNA, 22 bp, Homo sapiens
cagctgtgagcagccagttgcc

SEQ ID NO: 9067041 - DNA, 22 bp, Homo sapiens
cagctgtgattcctgctgtcca

SEQ ID NO: 9067042 - DNA, 22 bp, Homo sapiens
cagctgtgatatgcctgcctga

SEQ ID NO: 9067043 - DNA, 22 bp, Homo sapiens
cagctgtgatatgcctgcctga

SEQ ID NO: 9067044 - DNA, 22 bp, Homo sapiens
cagctgtggggagcttgggcca

SEQ ID NO: 9067045 - DNA, 22 bp, Homo sapiens
cagctgtgggcctgacgtggca

SEQ ID NO: 9067046 - DNA, 22 bp, Homo sapiens
cagctgtgggcctgacgtggca

SEQ ID NO: 9067047 - DNA, 22 bp, Homo sapiens
cagctgtggctgccactgctcc

SEQ ID NO: 9067048 - DNA, 22 bp, Homo sapiens
cagctgtggctgccactgctcc

SEQ ID NO: 9067049 - DNA, 22 bp, Homo sapiens
cagctgtggagggaggaaatgc

SEQ ID NO: 9067050 - DNA, 22 bp, Homo sapiens
cagctgtggctgccactgctcc

SEQ ID NO: 9067051 - DNA, 22 bp, Homo sapiens
cagctgtgtagatgcagggtca

SEQ ID NO: 9067052 - DNA, 22 bp, Homo sapiens
cagctgtgtagatgcagggtca

SEQ ID NO: 9067053 - DNA, 22 bp, Homo sapiens
cagctgtgtaaacacatgtgta

SEQ ID NO: 9067054 - DNA, 22 bp, Homo sapiens
cagctgtggggagcttgggcca

SEQ ID NO: 9067055 - DNA, 22 bp, Homo sapiens
gtgtttggtcagacgtccgggg

SEQ ID NO: 9067056 - DNA, 22 bp, Homo sapiens
gtgtgtgtatatatacacacac

SEQ ID NO: 9067057 - DNA, 22 bp, Homo sapiens
gtgtgtgtatatatacacacac

SEQ ID NO: 9067058 - DNA, 22 bp, Homo sapiens
gtgtgtgtactctgtatataaa

SEQ ID NO: 9067059 - DNA, 22 bp, Homo sapiens
gtgtgtgtactctgtatataaa

SEQ ID NO: 9067060 - DNA, 22 bp, Homo sapiens
gttacaaatgtaaattctgggg

SEQ ID NO: 9067061 - DNA, 22 bp, Homo sapiens
gttacaaatgccaaagctgaga

SEQ ID NO: 9067062 - DNA, 22 bp, Homo sapiens
gttacaaatgccaaagctgaga

SEQ ID NO: 9067063 - DNA, 22 bp, Homo sapiens
gttacaaatgccaaagctgaga

SEQ ID NO: 9067064 - DNA, 22 bp, Homo sapiens
gttacaactccctgaacctcgg

SEQ ID NO: 9067065 - DNA, 22 bp, Homo sapiens
gttacaatgtccttacatgaaa

SEQ ID NO: 9067066 - DNA, 22 bp, Homo sapiens
gttacaaatgtaaattctgggg

SEQ ID NO: 9067067 - DNA, 22 bp, Homo sapiens
gttacagtcaggagatattttg

SEQ ID NO: 9067068 - DNA, 22 bp, Homo sapiens
gttacaatgtccttacatgaaa

SEQ ID NO: 9067069 - DNA, 22 bp, Homo sapiens
gttacaatgttcttcagttctg

SEQ ID NO: 9067070 - DNA, 20 bp, Homo sapiens
gttaaaagagtaatttgagg

SEQ ID NO: 9067071 - DNA, 22 bp, Homo sapiens
gttaaaagaacaactcggaggt

SEQ ID NO: 9067072 - DNA, 22 bp, Homo sapiens
gttaaagaagaatagttccttt

SEQ ID NO: 9067073 - DNA, 22 bp, Homo sapiens
gttaaataacctcatgtccgtt

SEQ ID NO: 9067074 - DNA, 22 bp, Homo sapiens
gttacaaatgccaaagctgaga

SEQ ID NO: 9067075 - DNA, 22 bp, Homo sapiens
gttacaaatgccaaagctgaga

SEQ ID NO: 9067076 - DNA, 22 bp, Homo sapiens
taacattaggtagacataagcc

SEQ ID NO: 9067077 - DNA, 22 bp, Homo sapiens
taacattaggtagacataagcc

SEQ ID NO: 9067078 - DNA, 22 bp, Homo sapiens
taacattatacagagaggacag

SEQ ID NO: 9067079 - DNA, 22 bp, Homo sapiens
taacattcttaacttagaaaca

SEQ ID NO: 9067080 - DNA, 22 bp, Homo sapiens
taacattccatggatctgcaga

SEQ ID NO: 9067081 - DNA, 22 bp, Homo sapiens
taacagaaaggggacagaaata

SEQ ID NO: 9067082 - DNA, 22 bp, Homo sapiens
taacagaaaggggacagaaata

SEQ ID NO: 9067083 - DNA, 22 bp, Homo sapiens
taacagaaaggggacagaaata

SEQ ID NO: 9067084 - DNA, 22 bp, Homo sapiens
taacagaagatgaaacttcttt

SEQ ID NO: 9067085 - DNA, 19 bp, Homo sapiens
taacaaagtctgaagtcag

SEQ ID NO: 9067086 - DNA, 19 bp, Homo sapiens
taacaaagtctgaagtcag

SEQ ID NO: 9067087 - DNA, 23 bp, Homo sapiens
taacaagaacctcatgtgacttt

SEQ ID NO: 9067088 - DNA, 22 bp, Homo sapiens
taacaagatgtcactcctgtcc

SEQ ID NO: 9067089 - DNA, 19 bp, Homo sapiens
taacaagcactctgcattc

SEQ ID NO: 9067090 - DNA, 22 bp, Homo sapiens
taacactttggattaaaattct

SEQ ID NO: 9067091 - DNA, 22 bp, Homo sapiens
taacactgtgtctgccatatcc

SEQ ID NO: 9067092 - DNA, 22 bp, Homo sapiens
taacaatacccattctaattac

SEQ ID NO: 9067093 - DNA, 22 bp, Homo sapiens
taagaaacatttttatgacagt

SEQ ID NO: 9067094 - DNA, 22 bp, Homo sapiens
taactttggggacacttctctt

SEQ ID NO: 9067095 - DNA, 22 bp, Homo sapiens
taactttgaagggaattttact

SEQ ID NO: 9067096 - DNA, 22 bp, Homo sapiens
taactttagtgtatgaggtaag

SEQ ID NO: 9067097 - DNA, 22 bp, Homo sapiens
taactttcacatcacactgact

SEQ ID NO: 9067098 - DNA, 22 bp, Homo sapiens
taacatttcggtgacagtggga

SEQ ID NO: 9067099 - DNA, 22 bp, Homo sapiens
taacatttaaatttttcacata

SEQ ID NO: 9067100 - DNA, 22 bp, Homo sapiens
taacttctttggtttaaagaga

SEQ ID NO: 9067101 - DNA, 22 bp, Homo sapiens
taacttctttggtttaaagaga

SEQ ID NO: 9067102 - DNA, 16 bp, Homo sapiens
taacatttttaaaagg

SEQ ID NO: 9067103 - DNA, 22 bp, Homo sapiens
taacttgataagtattctctgc

SEQ ID NO: 9067104 - DNA, 22 bp, Homo sapiens
caggatcctggctgcatggacg

SEQ ID NO: 9067105 - DNA, 22 bp, Homo sapiens
caggatccctggcctccgccca

SEQ ID NO: 9067106 - DNA, 22 bp, Homo sapiens
caggatgagaggcccagggaag

SEQ ID NO: 9067107 - DNA, 22 bp, Homo sapiens
caggatgaggtagaggcagata

SEQ ID NO: 9067108 - DNA, 18 bp, Homo sapiens
caggatgagtgatgggga

SEQ ID NO: 9067109 - DNA, 22 bp, Homo sapiens
caggatggtggcatgatcagaa

SEQ ID NO: 9067110 - DNA, 20 bp, Homo sapiens
caggatgattggacacgatg

SEQ ID NO: 9067111 - DNA, 22 bp, Homo sapiens
taagcaaagtttataaggctct

SEQ ID NO: 9067112 - DNA, 22 bp, Homo sapiens
taagcaaaagtcgagtgtgagc

SEQ ID NO: 9067113 - DNA, 22 bp, Homo sapiens
taagatgtctaagaggagatgc

SEQ ID NO: 9067114 - DNA, 22 bp, Homo sapiens
taagatgtacaaccacttctct

SEQ ID NO: 9067115 - DNA, 22 bp, Homo sapiens
taagacacgggctgatctaaag

SEQ ID NO: 9067116 - DNA, 22 bp, Homo sapiens
taagatgtaagatcagagcttg

SEQ ID NO: 9067117 - DNA, 22 bp, Homo sapiens
taagacacctctctgcccttca

SEQ ID NO: 9067118 - DNA, 23 bp, Homo sapiens
taagacacccgactccagagatg

SEQ ID NO: 9067119 - DNA, 22 bp, Homo sapiens
taagacacattcatatctgtct

SEQ ID NO: 9067120 - DNA, 22 bp, Homo sapiens
taagacacattgagaaacacaa

SEQ ID NO: 9067121 - DNA, 22 bp, Homo sapiens
taagacacattggagtagatga

SEQ ID NO: 9067122 - DNA, 22 bp, Homo sapiens
taagacacagtccgcactctct

SEQ ID NO: 9067123 - DNA, 22 bp, Homo sapiens
taagacacatgcgtacaagata

SEQ ID NO: 9067124 - DNA, 22 bp, Homo sapiens
taagcaaatagctagatcagag

SEQ ID NO: 9067125 - DNA, 22 bp, Homo sapiens
taagcaaatagctagatcagag

SEQ ID NO: 9067126 - DNA, 22 bp, Homo sapiens
taagcaaataatgcatcaaggg

SEQ ID NO: 9067127 - DNA, 22 bp, Homo sapiens
taagcaaataatgcatcaaggg

SEQ ID NO: 9067128 - DNA, 22 bp, Homo sapiens
taagcaaataatgcatcaaggg

SEQ ID NO: 9067129 - DNA, 22 bp, Homo sapiens
taaggcaatggcattcttgaca

SEQ ID NO: 9067130 - DNA, 22 bp, Homo sapiens
taaggcacacagttgctgcatg

SEQ ID NO: 9067131 - DNA, 22 bp, Homo sapiens
taaggcagaaatatgagcaggg

SEQ ID NO: 9067132 - DNA, 22 bp, Homo sapiens
taaggcacccttctgagtagag

SEQ ID NO: 9067133 - DNA, 22 bp, Homo sapiens
caggcactcagtctggatccct

SEQ ID NO: 9067134 - DNA, 22 bp, Homo sapiens
caggcactagcagaatgaggct

SEQ ID NO: 9067135 - DNA, 22 bp, Homo sapiens
caggcactagcagaatgaggct

SEQ ID NO: 9067136 - DNA, 22 bp, Homo sapiens
taaggcagccgctcagagaggt

SEQ ID NO: 9067137 - DNA, 22 bp, Homo sapiens
taaggcagatgtggaatcaatt

SEQ ID NO: 9067138 - DNA, 19 bp, Homo sapiens
taaggcagcagtgacaggc

SEQ ID NO: 9067139 - DNA, 22 bp, Homo sapiens
taaggcagcataattaggccac

SEQ ID NO: 9067140 - DNA, 22 bp, Homo sapiens
taaggcagcataattaggccac

SEQ ID NO: 9067141 - DNA, 22 bp, Homo sapiens
taaggcagaaatatgagcaggg

SEQ ID NO: 9067142 - DNA, 22 bp, Homo sapiens
taaggcagaggtaccactaggc

SEQ ID NO: 9067143 - DNA, 22 bp, Homo sapiens
caggcaagatccagaggctgct

SEQ ID NO: 9067144 - DNA, 22 bp, Homo sapiens
caggcaagatccagaggctgct

SEQ ID NO: 9067145 - DNA, 22 bp, Homo sapiens
caggcaagatccagaggctgct

SEQ ID NO: 9067146 - DNA, 22 bp, Homo sapiens
caggcaagattagagatgagca

SEQ ID NO: 9067147 - DNA, 22 bp, Homo sapiens
caggcaagatccagaggctgct

SEQ ID NO: 9067148 - DNA, 22 bp, Homo sapiens
caggatggtggcatgatcagaa

SEQ ID NO: 9067149 - DNA, 22 bp, Homo sapiens
caggatgtgaggaggccatttg

SEQ ID NO: 9067150 - DNA, 22 bp, Homo sapiens
caggcaagattagagatgagca

SEQ ID NO: 9067151 - DNA, 22 bp, Homo sapiens
caggcaagattagagatgagca

SEQ ID NO: 9067152 - DNA, 22 bp, Homo sapiens
caggcaagcaaggggtcttgaa

SEQ ID NO: 9067153 - DNA, 22 bp, Homo sapiens
caggcaaggagctggctcaagt

SEQ ID NO: 9067154 - DNA, 22 bp, Homo sapiens
caggcaagcaaggggtcttgaa

SEQ ID NO: 9067155 - DNA, 22 bp, Homo sapiens
caggcaaggaggcactgaggga

SEQ ID NO: 9067156 - DNA, 22 bp, Homo sapiens
caggcaaggaggcactgaggga

SEQ ID NO: 9067157 - DNA, 22 bp, Homo sapiens
caggcaaggaggcactgaggga

SEQ ID NO: 9067158 - DNA, 22 bp, Homo sapiens
caggcaaggaggcactgaggga

SEQ ID NO: 9067159 - DNA, 22 bp, Homo sapiens
caggcaataaagggttggttgg

SEQ ID NO: 9067160 - DNA, 19 bp, Homo sapiens
taagacacaaatgcaagcc

SEQ ID NO: 9067161 - DNA, 22 bp, Homo sapiens
taagacacaaatatcttttaca

SEQ ID NO: 9067162 - DNA, 22 bp, Homo sapiens
caggcacatgggagctcatcat

SEQ ID NO: 9067163 - DNA, 22 bp, Homo sapiens
caggcacatgggagctcatcat

SEQ ID NO: 9067164 - DNA, 22 bp, Homo sapiens
caggcacagtgttgctgttcaa

SEQ ID NO: 9067165 - DNA, 22 bp, Homo sapiens
caggcacagtgttgctgttcaa

SEQ ID NO: 9067166 - DNA, 17 bp, Homo sapiens
caggcacatgaagccag

SEQ ID NO: 9067167 - DNA, 17 bp, Homo sapiens
caggcacatgaagccag

SEQ ID NO: 9067168 - DNA, 22 bp, Homo sapiens
caggcacaaatttctagataag

SEQ ID NO: 9067169 - DNA, 22 bp, Homo sapiens
caggcaaggaggcactgaggga

SEQ ID NO: 9067170 - DNA, 22 bp, Homo sapiens
caggcacactgtctacactgag

SEQ ID NO: 9067171 - DNA, 22 bp, Homo sapiens
caggcacaatgagcgccatctt

SEQ ID NO: 9067172 - DNA, 22 bp, Homo sapiens
caggcacaagatcggctagata

SEQ ID NO: 9067173 - DNA, 22 bp, Homo sapiens
caggcacaagatcggctagata

SEQ ID NO: 9067174 - DNA, 22 bp, Homo sapiens
caggcacagctaagactggcca

SEQ ID NO: 9067175 - DNA, 22 bp, Homo sapiens
taatttacagagatacagtcag

SEQ ID NO: 9067176 - DNA, 22 bp, Homo sapiens
taatttacagagatacagtcag

SEQ ID NO: 9067177 - DNA, 22 bp, Homo sapiens
taatttactcagatgttcaatc

SEQ ID NO: 9067178 - DNA, 22 bp, Homo sapiens
taatttacttgcaaataacaat

SEQ ID NO: 9067179 - DNA, 22 bp, Homo sapiens
taatttacttgcaaataacaat

SEQ ID NO: 9067180 - DNA, 22 bp, Homo sapiens
taatttactcagatgttcaatc

SEQ ID NO: 9067181 - DNA, 22 bp, Homo sapiens
taatttactcagatgttcaatc

SEQ ID NO: 9067182 - DNA, 22 bp, Homo sapiens
taatttacagttcgccatgtct

SEQ ID NO: 9067183 - DNA, 22 bp, Homo sapiens
taattggtgagagagctgagtc

SEQ ID NO: 9067184 - DNA, 22 bp, Homo sapiens
taattggtagctggtataatgc

SEQ ID NO: 9067185 - DNA, 22 bp, Homo sapiens
taatgttgctgtagaaagtcaa

SEQ ID NO: 9067186 - DNA, 22 bp, Homo sapiens
caggcagagcaactggtccaga

SEQ ID NO: 9067187 - DNA, 22 bp, Homo sapiens
caggcagagcaactggtccaga

SEQ ID NO: 9067188 - DNA, 17 bp, Homo sapiens
caggcagacatgtaagc

SEQ ID NO: 9067189 - DNA, 17 bp, Homo sapiens
caggcagacatgtaagc

SEQ ID NO: 9067190 - DNA, 22 bp, Homo sapiens
caggcagacatttttgacatag

SEQ ID NO: 9067191 - DNA, 22 bp, Homo sapiens
caggcagactttgagaatgatg

SEQ ID NO: 9067192 - DNA, 22 bp, Homo sapiens
caggcagactttgagaatgatg

SEQ ID NO: 9067193 - DNA, 22 bp, Homo sapiens
caggcagactttgagaatgatg

SEQ ID NO: 9067194 - DNA, 22 bp, Homo sapiens
caggcagagaactcatccgtga

SEQ ID NO: 9067195 - DNA, 22 bp, Homo sapiens
caggcagagacgtcagtgtagg

SEQ ID NO: 9067196 - DNA, 22 bp, Homo sapiens
caggcagagacgtcagtgtagg

SEQ ID NO: 9067197 - DNA, 22 bp, Homo sapiens
caggcagagaccctctcctaaa

SEQ ID NO: 9067198 - DNA, 22 bp, Homo sapiens
caggcagaagaagtggaaggac

SEQ ID NO: 9067199 - DNA, 22 bp, Homo sapiens
caggcagaagaagtggaaggac

SEQ ID NO: 9067200 - DNA, 22 bp, Homo sapiens
caggcagaagaagtggaaggac

SEQ ID NO: 9067201 - DNA, 22 bp, Homo sapiens
caggcagaagaagtggaaggac

SEQ ID NO: 9067202 - DNA, 22 bp, Homo sapiens
caggcagaaggaagtaccaggc

SEQ ID NO: 9067203 - DNA, 22 bp, Homo sapiens
caggcagaaggaagtaccaggc

SEQ ID NO: 9067204 - DNA, 23 bp, Homo sapiens
caggcaggatgaggactacactc

SEQ ID NO: 9067205 - DNA, 23 bp, Homo sapiens
caggcaggatgaggactacactc

SEQ ID NO: 9067206 - DNA, 23 bp, Homo sapiens
caggcaggatgaggactacactc

SEQ ID NO: 9067207 - DNA, 22 bp, Homo sapiens
caggcagggagccactgtataa

SEQ ID NO: 9067208 - DNA, 22 bp, Homo sapiens
caggcaggagccagggattcca

SEQ ID NO: 9067209 - DNA, 22 bp, Homo sapiens
caggcaggagccagggattcca

SEQ ID NO: 9067210 - DNA, 22 bp, Homo sapiens
caggcaggagaggaggatttct

SEQ ID NO: 9067211 - DNA, 22 bp, Homo sapiens
caggcagctgctgggttcagcc

SEQ ID NO: 9067212 - DNA, 22 bp, Homo sapiens
caggcagctgcgacaagagagc

SEQ ID NO: 9067213 - DNA, 22 bp, Homo sapiens
caggcagctgctgggttcagcc

SEQ ID NO: 9067214 - DNA, 22 bp, Homo sapiens
caggcagctgctgggttcagcc

SEQ ID NO: 9067215 - DNA, 22 bp, Homo sapiens
caggcagctgctgggttcagcc

SEQ ID NO: 9067216 - DNA, 22 bp, Homo sapiens
caggcagctgggtcaccgtccc

SEQ ID NO: 9067217 - DNA, 22 bp, Homo sapiens
caggcagctgggtcaccgtccc

SEQ ID NO: 9067218 - DNA, 22 bp, Homo sapiens
caggcagctgggtcaccgtccc

SEQ ID NO: 9067219 - DNA, 22 bp, Homo sapiens
caggcagctgcgacaagagagc

SEQ ID NO: 9067220 - DNA, 22 bp, Homo sapiens
caggcagctgcgacaagagagc

SEQ ID NO: 9067221 - DNA, 22 bp, Homo sapiens
caggcagctgaggactttgcta

SEQ ID NO: 9067222 - DNA, 22 bp, Homo sapiens
caggcagctgcgacaagagagc

SEQ ID NO: 9067223 - DNA, 22 bp, Homo sapiens
caggcagctgaggactttgcta

SEQ ID NO: 9067224 - DNA, 22 bp, Homo sapiens
caggcagctgaggactttgcta

SEQ ID NO: 9067225 - DNA, 22 bp, Homo sapiens
caggcagctgaggactttgcta

SEQ ID NO: 9067226 - DNA, 22 bp, Homo sapiens
caggcagccaggggacctgtcc

SEQ ID NO: 9067227 - DNA, 22 bp, Homo sapiens
caggcagccaggggacctgtcc

SEQ ID NO: 9067228 - DNA, 22 bp, Homo sapiens
caggcagccaggggacctgtcc

SEQ ID NO: 9067229 - DNA, 22 bp, Homo sapiens
caggcagccaggggacctgtcc

SEQ ID NO: 9067230 - DNA, 22 bp, Homo sapiens
caggcagccctgcaccaagtgt

SEQ ID NO: 9067231 - DNA, 22 bp, Homo sapiens
caggcagccctgcaccaagtgt

SEQ ID NO: 9067232 - DNA, 22 bp, Homo sapiens
caggcagcctgagggatctggg

SEQ ID NO: 9067233 - DNA, 22 bp, Homo sapiens
caggcagcctgagggatctggg

SEQ ID NO: 9067234 - DNA, 22 bp, Homo sapiens
caggcagcctgagggatctggg

SEQ ID NO: 9067235 - DNA, 22 bp, Homo sapiens
caggcagctcgatgccttgttg

SEQ ID NO: 9067236 - DNA, 22 bp, Homo sapiens
caggcagctcgatgccttgttg

SEQ ID NO: 9067237 - DNA, 22 bp, Homo sapiens
caggcagctctaatggaaagtg

SEQ ID NO: 9067238 - DNA, 22 bp, Homo sapiens
caggcagctctgcttttcctaa

SEQ ID NO: 9067239 - DNA, 22 bp, Homo sapiens
caggcagctctaatggaaagtg

SEQ ID NO: 9067240 - DNA, 22 bp, Homo sapiens
caggcagctctaatggaaagtg

SEQ ID NO: 9067241 - DNA, 22 bp, Homo sapiens
caggcagctcgatgccttgttg

SEQ ID NO: 9067242 - DNA, 22 bp, Homo sapiens
caggcagctgactgtcagatat

SEQ ID NO: 9067243 - DNA, 22 bp, Homo sapiens
caggcagctgactgtcagatat

SEQ ID NO: 9067244 - DNA, 22 bp, Homo sapiens
caggcagctgactgtcagatat

SEQ ID NO: 9067245 - DNA, 22 bp, Homo sapiens
caggcagctctgcttttcctaa

SEQ ID NO: 9067246 - DNA, 22 bp, Homo sapiens
caggcagcagccactctggtat

SEQ ID NO: 9067247 - DNA, 22 bp, Homo sapiens
caggcagcagccactctggtat

SEQ ID NO: 9067248 - DNA, 22 bp, Homo sapiens
caggcagcagccactctggtat

SEQ ID NO: 9067249 - DNA, 22 bp, Homo sapiens
caggcagcagccactctggtat

SEQ ID NO: 9067250 - DNA, 22 bp, Homo sapiens
caggcagcaggagccctgctcg

SEQ ID NO: 9067251 - DNA, 22 bp, Homo sapiens
caggcagcaggagccctgctcg

SEQ ID NO: 9067252 - DNA, 22 bp, Homo sapiens
caggcagcaggagccctgctcg

SEQ ID NO: 9067253 - DNA, 22 bp, Homo sapiens
caggcagcatcagtctgctgta

SEQ ID NO: 9067254 - DNA, 22 bp, Homo sapiens
caggcagcatcagtctgctgta

SEQ ID NO: 9067255 - DNA, 22 bp, Homo sapiens
caggcagcatcagtctgctgta

SEQ ID NO: 9067256 - DNA, 22 bp, Homo sapiens
caggcagcatttactctgatga

SEQ ID NO: 9067257 - DNA, 22 bp, Homo sapiens
caggcagcatttactctgatga

SEQ ID NO: 9067258 - DNA, 22 bp, Homo sapiens
caggcagcatttactctgatga

SEQ ID NO: 9067259 - DNA, 22 bp, Homo sapiens
caggcagcatttactctgatga

SEQ ID NO: 9067260 - DNA, 20 bp, Homo sapiens
tacatattatatcagctgca

SEQ ID NO: 9067261 - DNA, 22 bp, Homo sapiens
tacatatgaactttataacttg

SEQ ID NO: 9067262 - DNA, 22 bp, Homo sapiens
tacatatttgtctttgtactgt

SEQ ID NO: 9067263 - DNA, 22 bp, Homo sapiens
tacatatttgtctttgtactgt

SEQ ID NO: 9067264 - DNA, 22 bp, Homo sapiens
tacatatttgtctttgtactgt

SEQ ID NO: 9067265 - DNA, 22 bp, Homo sapiens
tacatatttgtctttgtactgt

SEQ ID NO: 9067266 - DNA, 22 bp, Homo sapiens
tacatatttgtctttgtactgt

SEQ ID NO: 9067267 - DNA, 22 bp, Homo sapiens
tacatattcaacgttcagtatt

SEQ ID NO: 9067268 - DNA, 22 bp, Homo sapiens
tacatattcaacgttcagtatt

SEQ ID NO: 9067269 - DNA, 22 bp, Homo sapiens
tacatcataataatacttagaa

SEQ ID NO: 9067270 - DNA, 21 bp, Homo sapiens
tacatcatgctacttctctga

SEQ ID NO: 9067271 - DNA, 21 bp, Homo sapiens
tacatcatgctacttctctga

SEQ ID NO: 9067272 - DNA, 22 bp, Homo sapiens
tacagtaacatgttgtacaagc

SEQ ID NO: 9067273 - DNA, 22 bp, Homo sapiens
tacaggttacacttttaaaagt

SEQ ID NO: 9067274 - DNA, 22 bp, Homo sapiens
tacagtaacatgttgtacaagc

SEQ ID NO: 9067275 - DNA, 22 bp, Homo sapiens
tacagtaaatgtggtagaaact

SEQ ID NO: 9067276 - DNA, 22 bp, Homo sapiens
caggccctttcctgggcatagg

SEQ ID NO: 9067277 - DNA, 22 bp, Homo sapiens
caggccctgggcaggcacagag

SEQ ID NO: 9067278 - DNA, 22 bp, Homo sapiens
caggccctgggcaggcacagag

SEQ ID NO: 9067279 - DNA, 18 bp, Homo sapiens
caggccctgtctggcctc

SEQ ID NO: 9067280 - DNA, 18 bp, Homo sapiens
caggccctgtctggcctc

SEQ ID NO: 9067281 - DNA, 22 bp, Homo sapiens
caggccctgggcaggcacagag

SEQ ID NO: 9067282 - DNA, 22 bp, Homo sapiens
caggccctgggcaggatcagcc

SEQ ID NO: 9067283 - DNA, 22 bp, Homo sapiens
caggccctggcagggctgagtc

SEQ ID NO: 9067284 - DNA, 22 bp, Homo sapiens
caggccctggcagggctgagtc

SEQ ID NO: 9067285 - DNA, 22 bp, Homo sapiens
tacaaatgcctgacacacagat

SEQ ID NO: 9067286 - DNA, 22 bp, Homo sapiens
tacaaatgtattttattttggt

SEQ ID NO: 9067287 - DNA, 20 bp, Homo sapiens
tacaaattttccatgtttcc

SEQ ID NO: 9067288 - DNA, 22 bp, Homo sapiens
tacaaatgaccatagccactta

SEQ ID NO: 9067289 - DNA, 22 bp, Homo sapiens
tacaaatgagttgtatgaacca

SEQ ID NO: 9067290 - DNA, 20 bp, Homo sapiens
tacaaacctccacactggtg

SEQ ID NO: 9067291 - DNA, 22 bp, Homo sapiens
tacaagtatgttttaaaatgtt

SEQ ID NO: 9067292 - DNA, 19 bp, Homo sapiens
tacaagtaggcgttttctc

SEQ ID NO: 9067293 - DNA, 22 bp, Homo sapiens
tacaagtactgtggctttgaat

SEQ ID NO: 9067294 - DNA, 22 bp, Homo sapiens
tacaaggcttcagctcagctat

SEQ ID NO: 9067295 - DNA, 22 bp, Homo sapiens
tacaagtcacttcctttctaaa

SEQ ID NO: 9067296 - DNA, 20 bp, Homo sapiens
tacaatacacatgcatatga

SEQ ID NO: 9067297 - DNA, 22 bp, Homo sapiens
tacaatacttaacctattttgc

SEQ ID NO: 9067298 - DNA, 20 bp, Homo sapiens
tacaatacacatgcatatga

SEQ ID NO: 9067299 - DNA, 22 bp, Homo sapiens
tacagcttaaaaaagccaactt

SEQ ID NO: 9067300 - DNA, 22 bp, Homo sapiens
tacagggattcctgccgctcgc

SEQ ID NO: 9067301 - DNA, 22 bp, Homo sapiens
tacagggtattcaagggtagtt

SEQ ID NO: 9067302 - DNA, 18 bp, Homo sapiens
gtttggcataactgatgc

SEQ ID NO: 9067303 - DNA, 22 bp, Homo sapiens
gtttggggtctgcagagcggcg

SEQ ID NO: 9067304 - DNA, 22 bp, Homo sapiens
gtttggctctgggtgcctgtgc

SEQ ID NO: 9067305 - DNA, 22 bp, Homo sapiens
gtttggctatttattctcagtg

SEQ ID NO: 9067306 - DNA, 22 bp, Homo sapiens
gtttggctttctctctatcctg

SEQ ID NO: 9067307 - DNA, 22 bp, Homo sapiens
gtttggaatagcagtaaacatt

SEQ ID NO: 9067308 - DNA, 22 bp, Homo sapiens
gtttggagccccgtgggaagga

SEQ ID NO: 9067309 - DNA, 22 bp, Homo sapiens
gtttggatagtgagagatactt

SEQ ID NO: 9067310 - DNA, 22 bp, Homo sapiens
gtttggaatagcagtaaacatt

SEQ ID NO: 9067311 - DNA, 22 bp, Homo sapiens
caggaagccacaggacaggtag

SEQ ID NO: 9067312 - DNA, 22 bp, Homo sapiens
caggaagccacaggacaggtag

SEQ ID NO: 9067313 - DNA, 22 bp, Homo sapiens
caggaagccttccttgtctgct

SEQ ID NO: 9067314 - DNA, 22 bp, Homo sapiens
caggaagctcttagcagtcacc

SEQ ID NO: 9067315 - DNA, 22 bp, Homo sapiens
caggaagctcttagcagtcacc

SEQ ID NO: 9067316 - DNA, 23 bp, Homo sapiens
caggaagcagatggggtagaaga

SEQ ID NO: 9067317 - DNA, 22 bp, Homo sapiens
caggaagcagtagaacttttcc

SEQ ID NO: 9067318 - DNA, 23 bp, Homo sapiens
caggaagcagatggggtagaaga

SEQ ID NO: 9067319 - DNA, 22 bp, Homo sapiens
gtttgtatgaatgttttatgct

SEQ ID NO: 9067320 - DNA, 22 bp, Homo sapiens
gtttgtatgaatgttttatgct

SEQ ID NO: 9067321 - DNA, 22 bp, Homo sapiens
caggaagctgagctgcactgca

SEQ ID NO: 9067322 - DNA, 22 bp, Homo sapiens
caggaagctgagctgcactgca

SEQ ID NO: 9067323 - DNA, 22 bp, Homo sapiens
caggaagctgagctgcactgca

SEQ ID NO: 9067324 - DNA, 22 bp, Homo sapiens
caggaagctggtcagatcctgt

SEQ ID NO: 9067325 - DNA, 22 bp, Homo sapiens
caggaagctggtcagatcctgt

SEQ ID NO: 9067326 - DNA, 22 bp, Homo sapiens
caggaagctgggtttccataca

SEQ ID NO: 9067327 - DNA, 22 bp, Homo sapiens
caggaagctgtgaaggagacgg

SEQ ID NO: 9067328 - DNA, 22 bp, Homo sapiens
caggaagctgtgaaggagacgg

SEQ ID NO: 9067329 - DNA, 22 bp, Homo sapiens
caggaagggggatccttggaag

SEQ ID NO: 9067330 - DNA, 22 bp, Homo sapiens
caggaaggaaagggtgtggaga

SEQ ID NO: 9067331 - DNA, 22 bp, Homo sapiens
caggaatgactgcagatggggc

SEQ ID NO: 9067332 - DNA, 22 bp, Homo sapiens
caggaatgacccaacagtttca

SEQ ID NO: 9067333 - DNA, 22 bp, Homo sapiens
caggaatgtttgtgctccttta

SEQ ID NO: 9067334 - DNA, 22 bp, Homo sapiens
caggaatgtgagggttccctgc

SEQ ID NO: 9067335 - DNA, 22 bp, Homo sapiens
caggaatgtccttgtcatttca

SEQ ID NO: 9067336 - DNA, 22 bp, Homo sapiens
caggaatgtcccatccccttca

SEQ ID NO: 9067337 - DNA, 22 bp, Homo sapiens
caggaatgttgcatgtgatctt

SEQ ID NO: 9067338 - DNA, 22 bp, Homo sapiens
caggaatgtttgtgctccttta

SEQ ID NO: 9067339 - DNA, 22 bp, Homo sapiens
caggacacagaataaggcagtt

SEQ ID NO: 9067340 - DNA, 22 bp, Homo sapiens
caggacactaaaaagccaagct

SEQ ID NO: 9067341 - DNA, 22 bp, Homo sapiens
caggaatgggtgacagtcagct

SEQ ID NO: 9067342 - DNA, 18 bp, Homo sapiens
caggaatggatgggattt

SEQ ID NO: 9067343 - DNA, 22 bp, Homo sapiens
caggaatggaggcatttatgaa

SEQ ID NO: 9067344 - DNA, 22 bp, Homo sapiens
caggaatgccttcttcagccat

SEQ ID NO: 9067345 - DNA, 22 bp, Homo sapiens
caggaatgtatgatacagtggt

SEQ ID NO: 9067346 - DNA, 22 bp, Homo sapiens
caggaatggttgggactatgtt

SEQ ID NO: 9067347 - DNA, 22 bp, Homo sapiens
caggaatggttaatctaaagtg

SEQ ID NO: 9067348 - DNA, 22 bp, Homo sapiens
caggaatggttaatctaaagtg

SEQ ID NO: 9067349 - DNA, 22 bp, Homo sapiens
caggaatgagttctggtgctct

SEQ ID NO: 9067350 - DNA, 22 bp, Homo sapiens
caggaatgagttctggtgctct

SEQ ID NO: 9067351 - DNA, 22 bp, Homo sapiens
caggaatgatattcgaggagat

SEQ ID NO: 9067352 - DNA, 22 bp, Homo sapiens
caggaatgccaaccagtgcatg

SEQ ID NO: 9067353 - DNA, 22 bp, Homo sapiens
caggacaggtgttctagatcag

SEQ ID NO: 9067354 - DNA, 22 bp, Homo sapiens
caggacaggccctgtggggtct

SEQ ID NO: 9067355 - DNA, 22 bp, Homo sapiens
caggacagtataggctttagga

SEQ ID NO: 9067356 - DNA, 22 bp, Homo sapiens
caggacagtataggctttagga

SEQ ID NO: 9067357 - DNA, 22 bp, Homo sapiens
caggacagctcaacacctcctc

SEQ ID NO: 9067358 - DNA, 22 bp, Homo sapiens
caggacagctgggccaccacca

SEQ ID NO: 9067359 - DNA, 22 bp, Homo sapiens
caggagaaggtttggagtgcag

SEQ ID NO: 9067360 - DNA, 23 bp, Homo sapiens
caggacatgggaggaagtatggc

SEQ ID NO: 9067361 - DNA, 22 bp, Homo sapiens
caggacatcgtcatcatgggga

SEQ ID NO: 9067362 - DNA, 22 bp, Homo sapiens
caggacagtttgctttgccctg

SEQ ID NO: 9067363 - DNA, 22 bp, Homo sapiens
caggacagtttgctttgccctg

SEQ ID NO: 9067364 - DNA, 19 bp, Homo sapiens
caggacagtttgccaagaa

SEQ ID NO: 9067365 - DNA, 19 bp, Homo sapiens
caggacagtttgccaagaa

SEQ ID NO: 9067366 - DNA, 22 bp, Homo sapiens
taaaccaagtgtccatattagt

SEQ ID NO: 9067367 - DNA, 22 bp, Homo sapiens
taaacatttgttattcttgttt

SEQ ID NO: 9067368 - DNA, 22 bp, Homo sapiens
taaacatttgttattcttgttt

SEQ ID NO: 9067369 - DNA, 22 bp, Homo sapiens
taaacatttgttattcttgttt

SEQ ID NO: 9067370 - DNA, 22 bp, Homo sapiens
caggacagtgcaggtccatcct

SEQ ID NO: 9067371 - DNA, 22 bp, Homo sapiens
caggacagtgcaggtccatcct

SEQ ID NO: 9067372 - DNA, 22 bp, Homo sapiens
caggacagtgcaggtccatcct

SEQ ID NO: 9067373 - DNA, 22 bp, Homo sapiens
caggacagtgcaggtccatcct

SEQ ID NO: 9067374 - DNA, 22 bp, Homo sapiens
caggacagttggcatctgctgc

SEQ ID NO: 9067375 - DNA, 22 bp, Homo sapiens
taaactatctgtgtttgaagtt

SEQ ID NO: 9067376 - DNA, 22 bp, Homo sapiens
taaaccttggtagcatcttgct

SEQ ID NO: 9067377 - DNA, 22 bp, Homo sapiens
taaactacccatgacagtttca

SEQ ID NO: 9067378 - DNA, 22 bp, Homo sapiens
taaactactaggatgaattttt

SEQ ID NO: 9067379 - DNA, 22 bp, Homo sapiens
taaaatcaccaaaagcaggtgg

SEQ ID NO: 9067380 - DNA, 22 bp, Homo sapiens
taaaatcaccaaaagcaggtgg

SEQ ID NO: 9067381 - DNA, 22 bp, Homo sapiens
taaaatgacttcctccaacatc

SEQ ID NO: 9067382 - DNA, 22 bp, Homo sapiens
taaaatgacttcctccaacatc

SEQ ID NO: 9067383 - DNA, 22 bp, Homo sapiens
taaaatagcatgtgcagtgaaa

SEQ ID NO: 9067384 - DNA, 22 bp, Homo sapiens
taaaatagcatgtgcagtgaaa

SEQ ID NO: 9067385 - DNA, 22 bp, Homo sapiens
taaaaatcttatgaatggcaag

SEQ ID NO: 9067386 - DNA, 22 bp, Homo sapiens
taaaaatcttatgaatggcaag

SEQ ID NO: 9067387 - DNA, 22 bp, Homo sapiens
taaaaagtagtgagaatggcgc

SEQ ID NO: 9067388 - DNA, 22 bp, Homo sapiens
taaaaatcttatgaatggcaag

SEQ ID NO: 9067389 - DNA, 22 bp, Homo sapiens
taaaaagttgaaaggacttatc

SEQ ID NO: 9067390 - DNA, 22 bp, Homo sapiens
taaaaagtagtgagaatggcgc

SEQ ID NO: 9067391 - DNA, 22 bp, Homo sapiens
taaaaagttgaaaggacttatc

SEQ ID NO: 9067392 - DNA, 22 bp, Homo sapiens
gttttctcatctcctcaatggt

SEQ ID NO: 9067393 - DNA, 22 bp, Homo sapiens
gttttctctgagatgcctttct

SEQ ID NO: 9067394 - DNA, 22 bp, Homo sapiens
gttttcctgttgagtagtattc

SEQ ID NO: 9067395 - DNA, 22 bp, Homo sapiens
gttttcctgagcccagagatgc

SEQ ID NO: 9067396 - DNA, 22 bp, Homo sapiens
taaaaagcagctgagattttct

SEQ ID NO: 9067397 - DNA, 22 bp, Homo sapiens
taaaaagtagtgagaatggcgc

SEQ ID NO: 9067398 - DNA, 19 bp, Homo sapiens
taaaaactgaaggaagcag

SEQ ID NO: 9067399 - DNA, 22 bp, Homo sapiens
taacaaagtaccatagattggg

SEQ ID NO: 9067400 - DNA, 22 bp, Homo sapiens
taacaaagtattgtttgtgtat

SEQ ID NO: 9067401 - DNA, 22 bp, Homo sapiens
taacaaagtaccatagattggg

SEQ ID NO: 9067402 - DNA, 22 bp, Homo sapiens
taacaaaggttgccaaactaag

SEQ ID NO: 9067403 - DNA, 22 bp, Homo sapiens
taacaaagtaccatagactgga

SEQ ID NO: 9067404 - DNA, 22 bp, Homo sapiens
taacaaaggttgccaaactaag

SEQ ID NO: 9067405 - DNA, 22 bp, Homo sapiens
caggagtgcaggtggtgaggca

SEQ ID NO: 9067406 - DNA, 22 bp, Homo sapiens
caggagtggtgtgagggactcc

SEQ ID NO: 9067407 - DNA, 22 bp, Homo sapiens
caggagtgtcgggtcactaggt

SEQ ID NO: 9067408 - DNA, 22 bp, Homo sapiens
caggagtgtctccacacagcaa

SEQ ID NO: 9067409 - DNA, 22 bp, Homo sapiens
caggaggctcctagggctctgt

SEQ ID NO: 9067410 - DNA, 22 bp, Homo sapiens
caggaggcatcatggagcggac

SEQ ID NO: 9067411 - DNA, 22 bp, Homo sapiens
caggaggccaactgtgggactt

SEQ ID NO: 9067412 - DNA, 22 bp, Homo sapiens
caggaggcccaaagggcgcaga

SEQ ID NO: 9067413 - DNA, 22 bp, Homo sapiens
caggaggcccacaggcccctgc

SEQ ID NO: 9067414 - DNA, 22 bp, Homo sapiens
caggaggcccacaggcccctgc

SEQ ID NO: 9067415 - DNA, 22 bp, Homo sapiens
taaatgtaccttctgccttact

SEQ ID NO: 9067416 - DNA, 22 bp, Homo sapiens
taaatgtaccttctgccttact

SEQ ID NO: 9067417 - DNA, 22 bp, Homo sapiens
taaatggcaacccctagagctg

SEQ ID NO: 9067418 - DNA, 22 bp, Homo sapiens
caggagctgggtctggaagcag

SEQ ID NO: 9067419 - DNA, 22 bp, Homo sapiens
caggagctggatctccttgcgg

SEQ ID NO: 9067420 - DNA, 22 bp, Homo sapiens
caggagctggatctccttgcgg

SEQ ID NO: 9067421 - DNA, 22 bp, Homo sapiens
taaatgtgcacaggttagaagg

SEQ ID NO: 9067422 - DNA, 22 bp, Homo sapiens
caggagctgggtctggaagcag

SEQ ID NO: 9067423 - DNA, 22 bp, Homo sapiens
caggaggaaactggattcactt

SEQ ID NO: 9067424 - DNA, 22 bp, Homo sapiens
caggagcttctgcccatggcca

SEQ ID NO: 9067425 - DNA, 22 bp, Homo sapiens
caggagcttctgcccatggcca

SEQ ID NO: 9067426 - DNA, 22 bp, Homo sapiens
caggagcttctgcccatggcca

SEQ ID NO: 9067427 - DNA, 22 bp, Homo sapiens
caggaggcagcgctctcaggac

SEQ ID NO: 9067428 - DNA, 22 bp, Homo sapiens
caggaggcagtttcagaagtca

SEQ ID NO: 9067429 - DNA, 22 bp, Homo sapiens
caggaggaaatgtgaccctgct

SEQ ID NO: 9067430 - DNA, 22 bp, Homo sapiens
caggaggaaatgtgaccctgct

SEQ ID NO: 9067431 - DNA, 22 bp, Homo sapiens
caggaggaaatgtgaccctgct

SEQ ID NO: 9067432 - DNA, 22 bp, Homo sapiens
caggaggaacaagaggttctgg

SEQ ID NO: 9067433 - DNA, 22 bp, Homo sapiens
caggaggattgcttgaggccag

SEQ ID NO: 9067434 - DNA, 22 bp, Homo sapiens
caggagagatatgagtccccac

SEQ ID NO: 9067435 - DNA, 19 bp, Homo sapiens
caggagagcatgcactttg

SEQ ID NO: 9067436 - DNA, 22 bp, Homo sapiens
caggagagatatgagtccccac

SEQ ID NO: 9067437 - DNA, 22 bp, Homo sapiens
caggagagcccgggtccgggct

SEQ ID NO: 9067438 - DNA, 22 bp, Homo sapiens
caggagagcccgggtccgggct

SEQ ID NO: 9067439 - DNA, 22 bp, Homo sapiens
caggagaggaggctacttctta

SEQ ID NO: 9067440 - DNA, 15 bp, Homo sapiens
caggagaggaaggtt

SEQ ID NO: 9067441 - DNA, 22 bp, Homo sapiens
caggagaggaggctacttctta

SEQ ID NO: 9067442 - DNA, 19 bp, Homo sapiens
caggagagcatgcactttg

SEQ ID NO: 9067443 - DNA, 22 bp, Homo sapiens
caggagatgacagggaagaacc

SEQ ID NO: 9067444 - DNA, 22 bp, Homo sapiens
caggagaggctgtacgtttctc

SEQ ID NO: 9067445 - DNA, 22 bp, Homo sapiens
caggagctggataggaccacaa

SEQ ID NO: 9067446 - DNA, 22 bp, Homo sapiens
caggagctggataggaccacaa

SEQ ID NO: 9067447 - DNA, 22 bp, Homo sapiens
caggagctcttaaggatgtgat

SEQ ID NO: 9067448 - DNA, 22 bp, Homo sapiens
caggagctctcatcgtcagggc

SEQ ID NO: 9067449 - DNA, 22 bp, Homo sapiens
caggagctcttaaggatgtgat

SEQ ID NO: 9067450 - DNA, 22 bp, Homo sapiens
taaagcagtgtggttgtgtccc

SEQ ID NO: 9067451 - DNA, 22 bp, Homo sapiens
taaagcagtgtggttgtgtccc

SEQ ID NO: 9067452 - DNA, 22 bp, Homo sapiens
taaagcagtggttctcaaactt

SEQ ID NO: 9067453 - DNA, 22 bp, Homo sapiens
caggagctcagatgacatctca

SEQ ID NO: 9067454 - DNA, 22 bp, Homo sapiens
caggagctcacagtctttgggt

SEQ ID NO: 9067455 - DNA, 22 bp, Homo sapiens
caggagctactcaggttgggtt

SEQ ID NO: 9067456 - DNA, 22 bp, Homo sapiens
caggagctactcaggttgggtt

SEQ ID NO: 9067457 - DNA, 22 bp, Homo sapiens
caggagctcaagaccaccctgg

SEQ ID NO: 9067458 - DNA, 22 bp, Homo sapiens
caggagccctggtgggtggaca

SEQ ID NO: 9067459 - DNA, 22 bp, Homo sapiens
caggagccctggtgggtggaca

SEQ ID NO: 9067460 - DNA, 22 bp, Homo sapiens
caggagccctggtgggtggaca

SEQ ID NO: 9067461 - DNA, 22 bp, Homo sapiens
caggagccgccaggcacgttgg

SEQ ID NO: 9067462 - DNA, 22 bp, Homo sapiens
taaatagagaatcagcttggag

SEQ ID NO: 9067463 - DNA, 18 bp, Homo sapiens
taaatatatttccccctt

SEQ ID NO: 9067464 - DNA, 18 bp, Homo sapiens
taaatatatttccccctt

SEQ ID NO: 9067465 - DNA, 22 bp, Homo sapiens
taaagtgcagactcccggaaac

SEQ ID NO: 9067466 - DNA, 22 bp, Homo sapiens
taaagtgagtacaaaatgaggg

SEQ ID NO: 9067467 - DNA, 22 bp, Homo sapiens
taaagtgcagattgtgattcag

SEQ ID NO: 9067468 - DNA, 22 bp, Homo sapiens
taaagtgcaggctactcagaag

SEQ ID NO: 9067469 - DNA, 22 bp, Homo sapiens
taaagtgcccagggaaagcggg

SEQ ID NO: 9067470 - DNA, 22 bp, Homo sapiens
taaatagaatctaaactgctca

SEQ ID NO: 9067471 - DNA, 22 bp, Homo sapiens
taaagtgcatgcggggccagat

SEQ ID NO: 9067472 - DNA, 22 bp, Homo sapiens
taaatatgcatgtatccttatc

SEQ ID NO: 9067473 - DNA, 22 bp, Homo sapiens
taaatatcacctggaattgtta

SEQ ID NO: 9067474 - DNA, 22 bp, Homo sapiens
taaatcaagaatatcagcttgt

SEQ ID NO: 9067475 - DNA, 22 bp, Homo sapiens
taaatgcttagattcatagaaa

SEQ ID NO: 9067476 - DNA, 22 bp, Homo sapiens
taaagcatgtttcagtaaggtt

SEQ ID NO: 9067477 - DNA, 22 bp, Homo sapiens
taaagcatgtgttagaagtgca

SEQ ID NO: 9067478 - DNA, 22 bp, Homo sapiens
taaagcatgtactgtgtgctag

SEQ ID NO: 9067479 - DNA, 22 bp, Homo sapiens
taaagcatgtactgtgtgctag

SEQ ID NO: 9067480 - DNA, 22 bp, Homo sapiens
taaagccaatatacctagcata

SEQ ID NO: 9067481 - DNA, 22 bp, Homo sapiens
taaagccaacactttactgctc

SEQ ID NO: 9067482 - DNA, 22 bp, Homo sapiens
taaagccacttcattctagtct

SEQ ID NO: 9067483 - DNA, 22 bp, Homo sapiens
taaagccacgctggaaatcagg

SEQ ID NO: 9067484 - DNA, 17 bp, Homo sapiens
taaagccagtcaagtca

SEQ ID NO: 9067485 - DNA, 17 bp, Homo sapiens
taaagccagtcaagtca

SEQ ID NO: 9067486 - DNA, 22 bp, Homo sapiens
taaagccctctgatcacactgg

SEQ ID NO: 9067487 - DNA, 22 bp, Homo sapiens
taaagtcaaggtactgtttcac

SEQ ID NO: 9067488 - DNA, 22 bp, Homo sapiens
taaagtcatctttacatctttg

SEQ ID NO: 9067489 - DNA, 22 bp, Homo sapiens
taaagtgaaggtcataatgatt

SEQ ID NO: 9067490 - DNA, 22 bp, Homo sapiens
taaagtgaagttcagaatggct

SEQ ID NO: 9067491 - DNA, 22 bp, Homo sapiens
taaagtgaaggtcataatgatt

SEQ ID NO: 9067492 - DNA, 19 bp, Homo sapiens
ctctccagctccagtagct

SEQ ID NO: 9067493 - DNA, 22 bp, Homo sapiens
ctctccagttacctaggtctga

SEQ ID NO: 9067494 - DNA, 22 bp, Homo sapiens
tttcagttcatctgtgaagatt

SEQ ID NO: 9067495 - DNA, 23 bp, Homo sapiens
ctctccccctttgatgttagctc

SEQ ID NO: 9067496 - DNA, 23 bp, Homo sapiens
ctctccccctttgatgttagctc

SEQ ID NO: 9067497 - DNA, 22 bp, Homo sapiens
ctctccccggtacgagcggccg

SEQ ID NO: 9067498 - DNA, 22 bp, Homo sapiens
ctctcccccacagcagccttct

SEQ ID NO: 9067499 - DNA, 22 bp, Homo sapiens
ctctcccccacagcagccttct

SEQ ID NO: 9067500 - DNA, 22 bp, Homo sapiens
ctctcccccacagcagccttct

SEQ ID NO: 9067501 - DNA, 22 bp, Homo sapiens
ctctcccccacagcagccttct

SEQ ID NO: 9067502 - DNA, 22 bp, Homo sapiens
ctctcccccacagcagccttct

SEQ ID NO: 9067503 - DNA, 22 bp, Homo sapiens
ctctccctatgcctcccaggag

SEQ ID NO: 9067504 - DNA, 22 bp, Homo sapiens
ctctccctggccagctgtgcag

SEQ ID NO: 9067505 - DNA, 22 bp, Homo sapiens
ctctcctcagaacaggccctct

SEQ ID NO: 9067506 - DNA, 22 bp, Homo sapiens
ctctcctcagaacaggccctct

SEQ ID NO: 9067507 - DNA, 22 bp, Homo sapiens
ctcctgggagctgtggcagagc

SEQ ID NO: 9067508 - DNA, 22 bp, Homo sapiens
ctcctgggaggatgcggacccg

SEQ ID NO: 9067509 - DNA, 22 bp, Homo sapiens
ctcctgggaggatgcggacccg

SEQ ID NO: 9067510 - DNA, 22 bp, Homo sapiens
ctcctgggagctgtggcagagc

SEQ ID NO: 9067511 - DNA, 22 bp, Homo sapiens
ctcctgggagcagggatggatg

SEQ ID NO: 9067512 - DNA, 22 bp, Homo sapiens
ctcctgggagcagggatggatg

SEQ ID NO: 9067513 - DNA, 22 bp, Homo sapiens
ctcctggctatgactacatttc

SEQ ID NO: 9067514 - DNA, 22 bp, Homo sapiens
ctcctgggagcagggatggatg

SEQ ID NO: 9067515 - DNA, 21 bp, Homo sapiens
ctcctgggctaagatatagtg

SEQ ID NO: 9067516 - DNA, 22 bp, Homo sapiens
ctcctgggatgactctttcttt

SEQ ID NO: 9067517 - DNA, 21 bp, Homo sapiens
ctcctgggctaagatatagtg

SEQ ID NO: 9067518 - DNA, 22 bp, Homo sapiens
ctcctgggctatgtctgcttgg

SEQ ID NO: 9067519 - DNA, 22 bp, Homo sapiens
ctcctgggctcaagtgatcctc

SEQ ID NO: 9067520 - DNA, 22 bp, Homo sapiens
ctcctgggctcaagtgatcctc

SEQ ID NO: 9067521 - DNA, 22 bp, Homo sapiens
ctctcagaagcttccagtatgg

SEQ ID NO: 9067522 - DNA, 22 bp, Homo sapiens
ctctccactcagcgtcatgtcc

SEQ ID NO: 9067523 - DNA, 18 bp, Homo sapiens
ctcctgggctgcagatgc

SEQ ID NO: 9067524 - DNA, 22 bp, Homo sapiens
ctcctgggctgggaactcagcc

SEQ ID NO: 9067525 - DNA, 22 bp, Homo sapiens
ctcctgggctgggaactcagcc

SEQ ID NO: 9067526 - DNA, 22 bp, Homo sapiens
ctctccagccaggggcttcctg

SEQ ID NO: 9067527 - DNA, 22 bp, Homo sapiens
ctctccagcctttagcccacgc

SEQ ID NO: 9067528 - DNA, 22 bp, Homo sapiens
ctctccagcctttagcccacgc

SEQ ID NO: 9067529 - DNA, 22 bp, Homo sapiens
ctctccagagcccttccggccc

SEQ ID NO: 9067530 - DNA, 22 bp, Homo sapiens
ctctccagatctgctgagccag

SEQ ID NO: 9067531 - DNA, 22 bp, Homo sapiens
tttaaatttgtgtttagagggt

SEQ ID NO: 9067532 - DNA, 22 bp, Homo sapiens
tttaaatttgtgtttagagggt

SEQ ID NO: 9067533 - DNA, 22 bp, Homo sapiens
tttaacagatagtttcttctgt

SEQ ID NO: 9067534 - DNA, 22 bp, Homo sapiens
tttaacactagtttctttaact

SEQ ID NO: 9067535 - DNA, 22 bp, Homo sapiens
tttaaattctgtctgccgctta

SEQ ID NO: 9067536 - DNA, 22 bp, Homo sapiens
tttaaattctgtctgccgctta

SEQ ID NO: 9067537 - DNA, 22 bp, Homo sapiens
tttaaatttagaagaaacactg

SEQ ID NO: 9067538 - DNA, 22 bp, Homo sapiens
tttaaatttagaagaaacactg

SEQ ID NO: 9067539 - DNA, 22 bp, Homo sapiens
tttaaatttagaagaaacactg

SEQ ID NO: 9067540 - DNA, 22 bp, Homo sapiens
tttaaaaggggtattaagtcca

SEQ ID NO: 9067541 - DNA, 22 bp, Homo sapiens
tttaaaaccaaagaaagcctct

SEQ ID NO: 9067542 - DNA, 22 bp, Homo sapiens
tttaaaaaactagtctgagtct

SEQ ID NO: 9067543 - DNA, 22 bp, Homo sapiens
tttacatgagtagcagatgttc

SEQ ID NO: 9067544 - DNA, 22 bp, Homo sapiens
tttacatgagtagcagatgttc

SEQ ID NO: 9067545 - DNA, 22 bp, Homo sapiens
tttacatggaatattgtcttgt

SEQ ID NO: 9067546 - DNA, 22 bp, Homo sapiens
tttacatgtaatgttatacaaa

SEQ ID NO: 9067547 - DNA, 22 bp, Homo sapiens
tttacatgtaatgttatacaaa

SEQ ID NO: 9067548 - DNA, 22 bp, Homo sapiens
tttacatttccctctgtcagtt

SEQ ID NO: 9067549 - DNA, 22 bp, Homo sapiens
tttacagtgtcttgttgactgt

SEQ ID NO: 9067550 - DNA, 22 bp, Homo sapiens
tttacagttaagaaatgttacc

SEQ ID NO: 9067551 - DNA, 22 bp, Homo sapiens
tttacagttaagaaatgttacc

SEQ ID NO: 9067552 - DNA, 22 bp, Homo sapiens
tttacacatacctctttaaagt

SEQ ID NO: 9067553 - DNA, 22 bp, Homo sapiens
tttacagttccatgtgataggc

SEQ ID NO: 9067554 - DNA, 22 bp, Homo sapiens
tttacatagtgctttcccacta

SEQ ID NO: 9067555 - DNA, 22 bp, Homo sapiens
tttacagttccatgtgataggc

SEQ ID NO: 9067556 - DNA, 22 bp, Homo sapiens
ctcctctggaaattcctctgcc

SEQ ID NO: 9067557 - DNA, 22 bp, Homo sapiens
ctcctctggcttcctggaggca

SEQ ID NO: 9067558 - DNA, 22 bp, Homo sapiens
ctcctctggcttcctggaggca

SEQ ID NO: 9067559 - DNA, 22 bp, Homo sapiens
ctcctcccaattgccaagtgct

SEQ ID NO: 9067560 - DNA, 22 bp, Homo sapiens
tttagacaagatccttctgaat

SEQ ID NO: 9067561 - DNA, 22 bp, Homo sapiens
tttagacaagatccttctgaat

SEQ ID NO: 9067562 - DNA, 22 bp, Homo sapiens
tttagacacactttgtatattt

SEQ ID NO: 9067563 - DNA, 22 bp, Homo sapiens
tttagacacactttgtatattt

SEQ ID NO: 9067564 - DNA, 22 bp, Homo sapiens
tttagacacactttgtatattt

SEQ ID NO: 9067565 - DNA, 22 bp, Homo sapiens
tttagacagcggctctgaacca

SEQ ID NO: 9067566 - DNA, 22 bp, Homo sapiens
tttagacactagggatgcagtg

SEQ ID NO: 9067567 - DNA, 22 bp, Homo sapiens
tttagacagcatctggtgactt

SEQ ID NO: 9067568 - DNA, 22 bp, Homo sapiens
tttagacagcatctggtgactt

SEQ ID NO: 9067569 - DNA, 22 bp, Homo sapiens
tttagacagatgtgaggtgggt

SEQ ID NO: 9067570 - DNA, 22 bp, Homo sapiens
tttagacactagggatgcagtg

SEQ ID NO: 9067571 - DNA, 22 bp, Homo sapiens
tttagacatctataattgctaa

SEQ ID NO: 9067572 - DNA, 22 bp, Homo sapiens
tttagacatagctgaaatcatt

SEQ ID NO: 9067573 - DNA, 22 bp, Homo sapiens
tttagacatagctgaaatcatt

SEQ ID NO: 9067574 - DNA, 22 bp, Homo sapiens
tttagacaggggcaaaataagg

SEQ ID NO: 9067575 - DNA, 22 bp, Homo sapiens
ctcctgagaggatctctgttgt

SEQ ID NO: 9067576 - DNA, 22 bp, Homo sapiens
ctcctgagaattttcagttgga

SEQ ID NO: 9067577 - DNA, 22 bp, Homo sapiens
ctcctctgggtcctggtggcca

SEQ ID NO: 9067578 - DNA, 22 bp, Homo sapiens
ctcctctgggtcctggtggcca

SEQ ID NO: 9067579 - DNA, 22 bp, Homo sapiens
ctcctctggcttcctggaggca

SEQ ID NO: 9067580 - DNA, 22 bp, Homo sapiens
ctcctctggcttcctggaggca

SEQ ID NO: 9067581 - DNA, 22 bp, Homo sapiens
ctcctctgtctggccctgagcc

SEQ ID NO: 9067582 - DNA, 22 bp, Homo sapiens
ctcctctgtctggccctgagcc

SEQ ID NO: 9067583 - DNA, 22 bp, Homo sapiens
ctcctctgtctaccacgagggt

SEQ ID NO: 9067584 - DNA, 22 bp, Homo sapiens
ctcctctgtctaccacgagggt

SEQ ID NO: 9067585 - DNA, 22 bp, Homo sapiens
ctcctctgtctaccacgagggt

SEQ ID NO: 9067586 - DNA, 22 bp, Homo sapiens
ctcctctgtctaccacgagggt

SEQ ID NO: 9067587 - DNA, 22 bp, Homo sapiens
ctccagggagctgtggaggttt

SEQ ID NO: 9067588 - DNA, 22 bp, Homo sapiens
ttggtcaaggacattacagttt

SEQ ID NO: 9067589 - DNA, 22 bp, Homo sapiens
ttggtacattacagtttgattg

SEQ ID NO: 9067590 - DNA, 22 bp, Homo sapiens
ttggtacatgttaaggaagagt

SEQ ID NO: 9067591 - DNA, 22 bp, Homo sapiens
ttgggttttgatacatgtctaa

SEQ ID NO: 9067592 - DNA, 22 bp, Homo sapiens
ttggtacatgcagatatttagt

SEQ ID NO: 9067593 - DNA, 22 bp, Homo sapiens
ttggtacagatgaggtattctc

SEQ ID NO: 9067594 - DNA, 22 bp, Homo sapiens
ttggtacaatgtgctaggtagg

SEQ ID NO: 9067595 - DNA, 22 bp, Homo sapiens
ttggtacaaaaccatgaaagaa

SEQ ID NO: 9067596 - DNA, 22 bp, Homo sapiens
ttggtacaaaagtaactgtggt

SEQ ID NO: 9067597 - DNA, 22 bp, Homo sapiens
ttgggtaggagaaagaacagat

SEQ ID NO: 9067598 - DNA, 22 bp, Homo sapiens
ttgggtaggattcagcagtgtg

SEQ ID NO: 9067599 - DNA, 22 bp, Homo sapiens
ttgggtcctaaccccagagtct

SEQ ID NO: 9067600 - DNA, 22 bp, Homo sapiens
ttgggtctgtttagctgagaag

SEQ ID NO: 9067601 - DNA, 22 bp, Homo sapiens
ttgggtcttatggctggagtag

SEQ ID NO: 9067602 - DNA, 22 bp, Homo sapiens
ttgtatttgattgtcatatcgt

SEQ ID NO: 9067603 - DNA, 22 bp, Homo sapiens
ctccagggggcatccacacagc

SEQ ID NO: 9067604 - DNA, 22 bp, Homo sapiens
ttgtatttgattgtcatatcgt

SEQ ID NO: 9067605 - DNA, 22 bp, Homo sapiens
ttgtatttgattgtcatatcgt

SEQ ID NO: 9067606 - DNA, 22 bp, Homo sapiens
ttgtattttgttatgctactgc

SEQ ID NO: 9067607 - DNA, 22 bp, Homo sapiens
ttgttaaaatattggagaaagg

SEQ ID NO: 9067608 - DNA, 22 bp, Homo sapiens
ttgttaaaatgaggtcattctg

SEQ ID NO: 9067609 - DNA, 22 bp, Homo sapiens
ttgttaaaattggagccgagag

SEQ ID NO: 9067610 - DNA, 22 bp, Homo sapiens
ttgttaaaatgcatattctggt

SEQ ID NO: 9067611 - DNA, 22 bp, Homo sapiens
ttgttaaaatgcatattctggt

SEQ ID NO: 9067612 - DNA, 22 bp, Homo sapiens
ctccagggttccccgatccact

SEQ ID NO: 9067613 - DNA, 22 bp, Homo sapiens
ttgttacacataataacatttt

SEQ ID NO: 9067614 - DNA, 22 bp, Homo sapiens
ttgttaaaggcaaaacaagcac

SEQ ID NO: 9067615 - DNA, 22 bp, Homo sapiens
ttgttaaatggatgcagaataa

SEQ ID NO: 9067616 - DNA, 22 bp, Homo sapiens
ctccagtgagcgcggggcatgg

SEQ ID NO: 9067617 - DNA, 22 bp, Homo sapiens
ctccagtgagtgagcaggcgac

SEQ ID NO: 9067618 - DNA, 22 bp, Homo sapiens
ctccagtgagtgagcaggcgac

SEQ ID NO: 9067619 - DNA, 22 bp, Homo sapiens
ctccaggttttacaaggtctat

SEQ ID NO: 9067620 - DNA, 22 bp, Homo sapiens
ctccaggtgcagaaggactcag

SEQ ID NO: 9067621 - DNA, 22 bp, Homo sapiens
tttaaaaaactagtctgagtct

SEQ ID NO: 9067622 - DNA, 22 bp, Homo sapiens
tttaaaaaactagtctgagtct

SEQ ID NO: 9067623 - DNA, 22 bp, Homo sapiens
tttaaaaaactagtctgagtct

SEQ ID NO: 9067624 - DNA, 22 bp, Homo sapiens
tttaaaaaactagtctgagtct

SEQ ID NO: 9067625 - DNA, 22 bp, Homo sapiens
tttaaaaaactagtctgagtct

SEQ ID NO: 9067626 - DNA, 22 bp, Homo sapiens
ctcatacatatgccattcctgc

SEQ ID NO: 9067627 - DNA, 22 bp, Homo sapiens
ctcatattgctggtggtctaag

SEQ ID NO: 9067628 - DNA, 22 bp, Homo sapiens
ctcatcagaaatacctgacaaa

SEQ ID NO: 9067629 - DNA, 22 bp, Homo sapiens
ctcatcataaccctgtgaggat

SEQ ID NO: 9067630 - DNA, 22 bp, Homo sapiens
ctcataagccttgctcaggtct

SEQ ID NO: 9067631 - DNA, 22 bp, Homo sapiens
ttggccagaatcttcctagtga

SEQ ID NO: 9067632 - DNA, 22 bp, Homo sapiens
ttggccacaatccaagccttgg

SEQ ID NO: 9067633 - DNA, 22 bp, Homo sapiens
ttggccacactcactagagccc

SEQ ID NO: 9067634 - DNA, 22 bp, Homo sapiens
ttggccagactgaggtgctggg

SEQ ID NO: 9067635 - DNA, 22 bp, Homo sapiens
ttggccagagaccagagcaggg

SEQ ID NO: 9067636 - DNA, 22 bp, Homo sapiens
ttggccagaggtttctctcatg

SEQ ID NO: 9067637 - DNA, 22 bp, Homo sapiens
ttggccaaacagagttcaacag

SEQ ID NO: 9067638 - DNA, 22 bp, Homo sapiens
ttggccaagggctctttaggct

SEQ ID NO: 9067639 - DNA, 23 bp, Homo sapiens
ttgggcaaatcactaacgtctcc

SEQ ID NO: 9067640 - DNA, 22 bp, Homo sapiens
ttgggcaaagtgtttctggagc

SEQ ID NO: 9067641 - DNA, 22 bp, Homo sapiens
ttgggaggtcataaatctgttc

SEQ ID NO: 9067642 - DNA, 22 bp, Homo sapiens
ttgggataagacagggacaggg

SEQ ID NO: 9067643 - DNA, 22 bp, Homo sapiens
ttgggagtaataaaaaattcca

SEQ ID NO: 9067644 - DNA, 22 bp, Homo sapiens
ttgggaggtcataaatctgttc

SEQ ID NO: 9067645 - DNA, 22 bp, Homo sapiens
ttgggaggtcataaatctgttc

SEQ ID NO: 9067646 - DNA, 22 bp, Homo sapiens
ttgggaggtaatggagccaagt

SEQ ID NO: 9067647 - DNA, 22 bp, Homo sapiens
ttgggaggtaatggagccaagt

SEQ ID NO: 9067648 - DNA, 22 bp, Homo sapiens
ttgggaggtaatggagccaagt

SEQ ID NO: 9067649 - DNA, 22 bp, Homo sapiens
ttggctgctgaaatatgttctg

SEQ ID NO: 9067650 - DNA, 22 bp, Homo sapiens
ttgggcaggcacatagagttta

SEQ ID NO: 9067651 - DNA, 22 bp, Homo sapiens
ttgggcagcattgcagttccct

SEQ ID NO: 9067652 - DNA, 22 bp, Homo sapiens
ttgggcagatgtttcctgtgga

SEQ ID NO: 9067653 - DNA, 22 bp, Homo sapiens
ttgcttttgggaaaacatgcct

SEQ ID NO: 9067654 - DNA, 22 bp, Homo sapiens
ttgcttttgtgtgctctctgga

SEQ ID NO: 9067655 - DNA, 22 bp, Homo sapiens
ttgcttttaattaatcattgct

SEQ ID NO: 9067656 - DNA, 22 bp, Homo sapiens
ttgcttttaattaatcattgct

SEQ ID NO: 9067657 - DNA, 22 bp, Homo sapiens
ttgcttttccctgtctctgatt

SEQ ID NO: 9067658 - DNA, 22 bp, Homo sapiens
ttgctttgtttaaaagtggtat

SEQ ID NO: 9067659 - DNA, 22 bp, Homo sapiens
ttgctttgttactgcagtttcc

SEQ ID NO: 9067660 - DNA, 18 bp, Homo sapiens
ttgctttgtaagcttgca

SEQ ID NO: 9067661 - DNA, 22 bp, Homo sapiens
ttgctttggtagcagctataga

SEQ ID NO: 9067662 - DNA, 22 bp, Homo sapiens
ttggatgagagggtgtggtaca

SEQ ID NO: 9067663 - DNA, 22 bp, Homo sapiens
ttggaaaacttacacagagctg

SEQ ID NO: 9067664 - DNA, 22 bp, Homo sapiens
ttggaaaagcgttctctgtagc

SEQ ID NO: 9067665 - DNA, 22 bp, Homo sapiens
ttggatcttatgaaggtggcat

SEQ ID NO: 9067666 - DNA, 22 bp, Homo sapiens
ttggaaaaacacgatagtggtt

SEQ ID NO: 9067667 - DNA, 22 bp, Homo sapiens
ttggaaaacttacacagagctg

SEQ ID NO: 9067668 - DNA, 22 bp, Homo sapiens
ttgctttttaattaggaggcag

SEQ ID NO: 9067669 - DNA, 22 bp, Homo sapiens
ttgatatctctgctgtgttagg

SEQ ID NO: 9067670 - DNA, 22 bp, Homo sapiens
ttgatacaggctctatttcatc

SEQ ID NO: 9067671 - DNA, 22 bp, Homo sapiens
ctcagtgcttctagcttgatga

SEQ ID NO: 9067672 - DNA, 22 bp, Homo sapiens
ctcagttttgaaaaggtaagct

SEQ ID NO: 9067673 - DNA, 22 bp, Homo sapiens
ttgctttgccaccagaagtcta

SEQ ID NO: 9067674 - DNA, 22 bp, Homo sapiens
ttcacatggcaatagagaggga

SEQ ID NO: 9067675 - DNA, 22 bp, Homo sapiens
cgctgggggaacagcgagggtg

SEQ ID NO: 9067676 - DNA, 22 bp, Homo sapiens
cgctgggggaacttcagccaat

SEQ ID NO: 9067677 - DNA, 22 bp, Homo sapiens
cggacaggctcctggagctcct

SEQ ID NO: 9067678 - DNA, 22 bp, Homo sapiens
cggcagtgggcgccaggtctcc

SEQ ID NO: 9067679 - DNA, 22 bp, Homo sapiens
cgctgtgcctggcacccagtgt

SEQ ID NO: 9067680 - DNA, 22 bp, Homo sapiens
cctgggtggctgcctgcctttc

SEQ ID NO: 9067681 - DNA, 22 bp, Homo sapiens
ttcacagacattgcagactgaa

SEQ ID NO: 9067682 - DNA, 22 bp, Homo sapiens
ttcacagtggcttaggctatgg

SEQ ID NO: 9067683 - DNA, 22 bp, Homo sapiens
ttcacagtggtagtgcatttag

SEQ ID NO: 9067684 - DNA, 22 bp, Homo sapiens
ttcacagtgtgatctatgggca

SEQ ID NO: 9067685 - DNA, 22 bp, Homo sapiens
ttcacataggagcatggttttt

SEQ ID NO: 9067686 - DNA, 22 bp, Homo sapiens
ttcacataatctgcagcaagcg

SEQ ID NO: 9067687 - DNA, 22 bp, Homo sapiens
ttcacatctataacttagataa

SEQ ID NO: 9067688 - DNA, 22 bp, Homo sapiens
ttcacatgaaagtaggaaagga

SEQ ID NO: 9067689 - DNA, 22 bp, Homo sapiens
ttcacagtttaatggcaaggat

SEQ ID NO: 9067690 - DNA, 22 bp, Homo sapiens
ttcacagtttgctgggacagga

SEQ ID NO: 9067691 - DNA, 22 bp, Homo sapiens
ttcacataaatagatcacatca

SEQ ID NO: 9067692 - DNA, 22 bp, Homo sapiens
ttcacataaatagatcacatca

SEQ ID NO: 9067693 - DNA, 22 bp, Homo sapiens
ttccaaaatgccttgatatgat

SEQ ID NO: 9067694 - DNA, 22 bp, Homo sapiens
ttccaaaatgccttgatatgat

SEQ ID NO: 9067695 - DNA, 22 bp, Homo sapiens
ttcagaaaggctgtgccagcca

SEQ ID NO: 9067696 - DNA, 21 bp, Homo sapiens
ttcatgagataaccagctgta

SEQ ID NO: 9067697 - DNA, 23 bp, Homo sapiens
ttcatgagattatctgcatgtgt

SEQ ID NO: 9067698 - DNA, 20 bp, Homo sapiens
ttcattcattccacaacttc

SEQ ID NO: 9067699 - DNA, 23 bp, Homo sapiens
ttcatgagttggacaagactggg

SEQ ID NO: 9067700 - DNA, 22 bp, Homo sapiens
ttcattccttccctaagcaact

SEQ ID NO: 9067701 - DNA, 22 bp, Homo sapiens
ttcattccttctgtaccttgcc

SEQ ID NO: 9067702 - DNA, 22 bp, Homo sapiens
ttcattcccttatattagcatt

SEQ ID NO: 9067703 - DNA, 22 bp, Homo sapiens
ttcacttaacatttaccaagga

SEQ ID NO: 9067704 - DNA, 22 bp, Homo sapiens
ttcacttaacatcatatcatga

SEQ ID NO: 9067705 - DNA, 22 bp, Homo sapiens
ttcagaaaaaacttcaataagt

SEQ ID NO: 9067706 - DNA, 22 bp, Homo sapiens
ttcagaaacatcagtggatgga

SEQ ID NO: 9067707 - DNA, 22 bp, Homo sapiens
cggctgagcagtgctgatggaa

SEQ ID NO: 9067708 - DNA, 22 bp, Homo sapiens
ttcccacattctttacattcat

SEQ ID NO: 9067709 - DNA, 22 bp, Homo sapiens
ttcccacattctttacattcat

SEQ ID NO: 9067710 - DNA, 22 bp, Homo sapiens
ttcccacagagattacattgaa

SEQ ID NO: 9067711 - DNA, 22 bp, Homo sapiens
ttccctggttaaccattttctg

SEQ ID NO: 9067712 - DNA, 22 bp, Homo sapiens
ttcccttaaattatggcatcta

SEQ ID NO: 9067713 - DNA, 22 bp, Homo sapiens
ttccggaaggttctctagaatt

SEQ ID NO: 9067714 - DNA, 22 bp, Homo sapiens
ctaacttttacagtcatgttgc

SEQ ID NO: 9067715 - DNA, 22 bp, Homo sapiens
ctaactttttgattcttgggga

SEQ ID NO: 9067716 - DNA, 22 bp, Homo sapiens
ttccctttgttaaattggaaga

SEQ ID NO: 9067717 - DNA, 22 bp, Homo sapiens
ttccaaagctgctttatttagt

SEQ ID NO: 9067718 - DNA, 22 bp, Homo sapiens
ttccaaactgccaattcagaag

SEQ ID NO: 9067719 - DNA, 22 bp, Homo sapiens
ttccaaagtcatgttgctgata

SEQ ID NO: 9067720 - DNA, 22 bp, Homo sapiens
ttccaaagtcatgttgctgata

SEQ ID NO: 9067721 - DNA, 22 bp, Homo sapiens
ttccaaagttattcaagcagta

SEQ ID NO: 9067722 - DNA, 22 bp, Homo sapiens
ttccaaagttagttattagaaa

SEQ ID NO: 9067723 - DNA, 22 bp, Homo sapiens
ttccaggatgggctgtcctact

SEQ ID NO: 9067724 - DNA, 21 bp, Homo sapiens
ttccaggattgcttattttta

SEQ ID NO: 9067725 - DNA, 22 bp, Homo sapiens
ttccaggatgggctgtcctact

SEQ ID NO: 9067726 - DNA, 22 bp, Homo sapiens
ttccatttattcttgtccagat

SEQ ID NO: 9067727 - DNA, 22 bp, Homo sapiens
ttcccaaaatataacagttaac

SEQ ID NO: 9067728 - DNA, 22 bp, Homo sapiens
ttcccaaagctttgtctgtgaa

SEQ ID NO: 9067729 - DNA, 22 bp, Homo sapiens
ctaattctgaaacagtgtcaat

SEQ ID NO: 9067730 - DNA, 22 bp, Homo sapiens
ctaatttaatgaatgagtctta

SEQ ID NO: 9067731 - DNA, 22 bp, Homo sapiens
ctaatttttgttctgcattgaa

SEQ ID NO: 9067732 - DNA, 22 bp, Homo sapiens
ctaatttaatgaatgagtctta

SEQ ID NO: 9067733 - DNA, 22 bp, Homo sapiens
ctacaaaagtaattgtggtttt

SEQ ID NO: 9067734 - DNA, 22 bp, Homo sapiens
ctaatgtaatgatatgttgaat

SEQ ID NO: 9067735 - DNA, 22 bp, Homo sapiens
ctaatcacctcatccctcagcg

SEQ ID NO: 9067736 - DNA, 22 bp, Homo sapiens
ctaatgaagctgctttctatga

SEQ ID NO: 9067737 - DNA, 22 bp, Homo sapiens
ctaatcatctttctcttaaagc

SEQ ID NO: 9067738 - DNA, 22 bp, Homo sapiens
ctaataccctgtattcacattt

SEQ ID NO: 9067739 - DNA, 22 bp, Homo sapiens
ctaatatttttagaaatcacga

SEQ ID NO: 9067740 - DNA, 22 bp, Homo sapiens
ctaataacatgaactactttct

SEQ ID NO: 9067741 - DNA, 22 bp, Homo sapiens
ctaaggcaggtccattccagga

SEQ ID NO: 9067742 - DNA, 22 bp, Homo sapiens
ctaaggcaccgaggcaggagcg

SEQ ID NO: 9067743 - DNA, 19 bp, Homo sapiens
ctaaggcaagaaactggac

SEQ ID NO: 9067744 - DNA, 22 bp, Homo sapiens
ctaaggcaccgaggcaggagcg

SEQ ID NO: 9067745 - DNA, 22 bp, Homo sapiens
ctaaggcagacagaatatttgg

SEQ ID NO: 9067746 - DNA, 17 bp, Homo sapiens
ctaagggcccactcttc

SEQ ID NO: 9067747 - DNA, 17 bp, Homo sapiens
ctaagggcccactcttc

SEQ ID NO: 9067748 - DNA, 22 bp, Homo sapiens
ttccttccacttcaggattttg

SEQ ID NO: 9067749 - DNA, 22 bp, Homo sapiens
ctacaaatataaaacacagata

SEQ ID NO: 9067750 - DNA, 22 bp, Homo sapiens
ctacaaagaatttctctagctc

SEQ ID NO: 9067751 - DNA, 22 bp, Homo sapiens
ctacaaagctcttctacaggca

SEQ ID NO: 9067752 - DNA, 22 bp, Homo sapiens
ctacaaagtaccacagactggg

SEQ ID NO: 9067753 - DNA, 23 bp, Homo sapiens
ctacaaagtatgagaagacccct

SEQ ID NO: 9067754 - DNA, 22 bp, Homo sapiens
ctacaaaagtaattgtggtttt

SEQ ID NO: 9067755 - DNA, 22 bp, Homo sapiens
ctacaaaagtaattgtggtttt

SEQ ID NO: 9067756 - DNA, 22 bp, Homo sapiens
ttccttccgggcaccaggcact

SEQ ID NO: 9067757 - DNA, 22 bp, Homo sapiens
ttccttcccctagctgagaaac

SEQ ID NO: 9067758 - DNA, 22 bp, Homo sapiens
ttccttccatagcaaaacatgc

SEQ ID NO: 9067759 - DNA, 22 bp, Homo sapiens
ttccttccagcttgtgacagtc

SEQ ID NO: 9067760 - DNA, 22 bp, Homo sapiens
ttccttcctctttcacaacagc

SEQ ID NO: 9067761 - DNA, 22 bp, Homo sapiens
ttctgtatctttcttcaagatt

SEQ ID NO: 9067762 - DNA, 22 bp, Homo sapiens
ttctgtatgtacatatgtgtat

SEQ ID NO: 9067763 - DNA, 22 bp, Homo sapiens
ttctgtatttagtttgaggaca

SEQ ID NO: 9067764 - DNA, 22 bp, Homo sapiens
ttctgtcaaatgccagtagaga

SEQ ID NO: 9067765 - DNA, 22 bp, Homo sapiens
ttctgtcaaatgccagtagaga

SEQ ID NO: 9067766 - DNA, 22 bp, Homo sapiens
ctattttaacttgattacctct

SEQ ID NO: 9067767 - DNA, 22 bp, Homo sapiens
ttctgtagtattcttttggtca

SEQ ID NO: 9067768 - DNA, 22 bp, Homo sapiens
ttctgtaggacttctgccaact

SEQ ID NO: 9067769 - DNA, 22 bp, Homo sapiens
ctattttaacttgattacctct

SEQ ID NO: 9067770 - DNA, 22 bp, Homo sapiens
ctattttaacttgattacctct

SEQ ID NO: 9067771 - DNA, 22 bp, Homo sapiens
ctatttgtacagcattagtaat

SEQ ID NO: 9067772 - DNA, 22 bp, Homo sapiens
ctatttgtacagcattcgagtt

SEQ ID NO: 9067773 - DNA, 22 bp, Homo sapiens
ctatttgtcagtttggctttaa

SEQ ID NO: 9067774 - DNA, 22 bp, Homo sapiens
ctatttgtcacaactggtgttt

SEQ ID NO: 9067775 - DNA, 22 bp, Homo sapiens
ttctgtcacagtgctggtatca

SEQ ID NO: 9067776 - DNA, 22 bp, Homo sapiens
ttctgtcacttaggaggtcata

SEQ ID NO: 9067777 - DNA, 22 bp, Homo sapiens
ttctgtcatcctttctagatgt

SEQ ID NO: 9067778 - DNA, 22 bp, Homo sapiens
ttctgtcatgctcatgtaattg

SEQ ID NO: 9067779 - DNA, 22 bp, Homo sapiens
ttctgtccactgctggggcctc

SEQ ID NO: 9067780 - DNA, 22 bp, Homo sapiens
ctatttattgtgggtatccagg

SEQ ID NO: 9067781 - DNA, 22 bp, Homo sapiens
ctatttatgtgctattttgtat

SEQ ID NO: 9067782 - DNA, 22 bp, Homo sapiens
ctattcaacttgactgtttcac

SEQ ID NO: 9067783 - DNA, 22 bp, Homo sapiens
ctattcactgtggcagagggag

SEQ ID NO: 9067784 - DNA, 22 bp, Homo sapiens
ctattcagcctctaagacaagt

SEQ ID NO: 9067785 - DNA, 22 bp, Homo sapiens
ctattcagttgtgggcaacaat

SEQ ID NO: 9067786 - DNA, 22 bp, Homo sapiens
ctattcagtaagccaaaaccat

SEQ ID NO: 9067787 - DNA, 22 bp, Homo sapiens
ctattcaggtgtccattaatcc

SEQ ID NO: 9067788 - DNA, 22 bp, Homo sapiens
ctagggagtggcagagctggga

SEQ ID NO: 9067789 - DNA, 22 bp, Homo sapiens
ctagggagggatgttggcatga

SEQ ID NO: 9067790 - DNA, 22 bp, Homo sapiens
ctagggccaaaggctgtgatgc

SEQ ID NO: 9067791 - DNA, 22 bp, Homo sapiens
ctatttgaattgtcacaggcta

SEQ ID NO: 9067792 - DNA, 22 bp, Homo sapiens
ctatttgtaaagtgcctggtgt

SEQ ID NO: 9067793 - DNA, 22 bp, Homo sapiens
ctatttgtaagagccccacacc

SEQ ID NO: 9067794 - DNA, 22 bp, Homo sapiens
ctaggcatccagactgggcttg

SEQ ID NO: 9067795 - DNA, 22 bp, Homo sapiens
ctaggcagttctagttctggaa

SEQ ID NO: 9067796 - DNA, 22 bp, Homo sapiens
ctaggccagttaggaagagaag

SEQ ID NO: 9067797 - DNA, 22 bp, Homo sapiens
ctaggccagagagacctcatga

SEQ ID NO: 9067798 - DNA, 22 bp, Homo sapiens
ctaggccacagggcaaaaagga

SEQ ID NO: 9067799 - DNA, 22 bp, Homo sapiens
ctaggccacttgctctcatgga

SEQ ID NO: 9067800 - DNA, 22 bp, Homo sapiens
ctaggcagggtgctgtgccatg

SEQ ID NO: 9067801 - DNA, 22 bp, Homo sapiens
ctaggctcagtctctggtctgt

SEQ ID NO: 9067802 - DNA, 22 bp, Homo sapiens
ctaggcccatgaggtttgctgg

SEQ ID NO: 9067803 - DNA, 22 bp, Homo sapiens
ctaggccatattttgagaactg

SEQ ID NO: 9067804 - DNA, 22 bp, Homo sapiens
ctaggccagttaggaagagaag

SEQ ID NO: 9067805 - DNA, 22 bp, Homo sapiens
ctaggctcttctggaaggttgt

SEQ ID NO: 9067806 - DNA, 22 bp, Homo sapiens
ctaggccttcataggcatggaa

SEQ ID NO: 9067807 - DNA, 22 bp, Homo sapiens
ctaggctgagctgggctgagct

SEQ ID NO: 9067808 - DNA, 22 bp, Homo sapiens
ctagggaacaagatgcccaggg

SEQ ID NO: 9067809 - DNA, 22 bp, Homo sapiens
ctagggagactcgcaggactca

SEQ ID NO: 9067810 - DNA, 22 bp, Homo sapiens
ctaggctgtaaagagctaggag

SEQ ID NO: 9067811 - DNA, 22 bp, Homo sapiens
ctaggctgtaaagagctaggag

SEQ ID NO: 9067812 - DNA, 22 bp, Homo sapiens
ctaggctgtaacccctgccagg

SEQ ID NO: 9067813 - DNA, 22 bp, Homo sapiens
ctaggctgttcatgctcagacc

SEQ ID NO: 9067814 - DNA, 22 bp, Homo sapiens
ctaggctgcagatgcatggaat

SEQ ID NO: 9067815 - DNA, 20 bp, Homo sapiens
ttccttttcgcctctctccc

SEQ ID NO: 9067816 - DNA, 22 bp, Homo sapiens
ttccttttcttaaacatatgtg

SEQ ID NO: 9067817 - DNA, 22 bp, Homo sapiens
ttccttttcttaaacatatgtg

SEQ ID NO: 9067818 - DNA, 22 bp, Homo sapiens
ctagcctgggatttgaacttat

SEQ ID NO: 9067819 - DNA, 22 bp, Homo sapiens
ctaggcagactgagctctaggg

SEQ ID NO: 9067820 - DNA, 20 bp, Homo sapiens
ctaggcagcgagtgactgag

SEQ ID NO: 9067821 - DNA, 22 bp, Homo sapiens
ttccttttacaaatagcctcct

SEQ ID NO: 9067822 - DNA, 22 bp, Homo sapiens
ttccttttagaatcatgaagac

SEQ ID NO: 9067823 - DNA, 22 bp, Homo sapiens
ttcctttctctggactgcagcc

SEQ ID NO: 9067824 - DNA, 22 bp, Homo sapiens
ttccttctaattttacacctga

SEQ ID NO: 9067825 - DNA, 22 bp, Homo sapiens
ctcagagggaggactgggctgg

SEQ ID NO: 9067826 - DNA, 22 bp, Homo sapiens
ctattttgcctgcctagaaatc

SEQ ID NO: 9067827 - DNA, 22 bp, Homo sapiens
ctattttgcctgcctagaaatc

SEQ ID NO: 9067828 - DNA, 17 bp, Homo sapiens
ctattttggagattaaa

SEQ ID NO: 9067829 - DNA, 22 bp, Homo sapiens
ctattttgtccttagtgcaggg

SEQ ID NO: 9067830 - DNA, 22 bp, Homo sapiens
ctatttttctgtaccctaattt

SEQ ID NO: 9067831 - DNA, 23 bp, Homo sapiens
ctcagaggcctgtccagggtggt

SEQ ID NO: 9067832 - DNA, 22 bp, Homo sapiens
ctatttttctgtaccctaattt

SEQ ID NO: 9067833 - DNA, 22 bp, Homo sapiens
ctatttttctgtaccctaattt

SEQ ID NO: 9067834 - DNA, 22 bp, Homo sapiens
ctatttttctgtaccctaattt

SEQ ID NO: 9067835 - DNA, 17 bp, Homo sapiens
ctcagcagggctcactt

SEQ ID NO: 9067836 - DNA, 23 bp, Homo sapiens
ctcagcagcctgctgcagataag

SEQ ID NO: 9067837 - DNA, 22 bp, Homo sapiens
ctcagcagcagggaagaggtca

SEQ ID NO: 9067838 - DNA, 22 bp, Homo sapiens
ctattttgcctgcctagaaatc

SEQ ID NO: 9067839 - DNA, 22 bp, Homo sapiens
ctattttaagaggccattaggt

SEQ ID NO: 9067840 - DNA, 22 bp, Homo sapiens
ttcttgtttattaagatataaa

SEQ ID NO: 9067841 - DNA, 22 bp, Homo sapiens
ttcttgtactggagatacatga

SEQ ID NO: 9067842 - DNA, 22 bp, Homo sapiens
ttcttgtactggagatacatga

SEQ ID NO: 9067843 - DNA, 22 bp, Homo sapiens
ttcttggctgttcatggtcagg

SEQ ID NO: 9067844 - DNA, 22 bp, Homo sapiens
ttcttggccaccagatctcact

SEQ ID NO: 9067845 - DNA, 22 bp, Homo sapiens
ttcttgttctggttctgttagc

SEQ ID NO: 9067846 - DNA, 22 bp, Homo sapiens
ttcttgttccatgaaagacaga

SEQ ID NO: 9067847 - DNA, 22 bp, Homo sapiens
ttgaggagcaggatgggaggct

SEQ ID NO: 9067848 - DNA, 22 bp, Homo sapiens
ttgataaaatgatatcttcttt

SEQ ID NO: 9067849 - DNA, 22 bp, Homo sapiens
ttgatacacaatggaacaatgt

SEQ ID NO: 9067850 - DNA, 22 bp, Homo sapiens
ttgatacacaatggaacaatgt

SEQ ID NO: 9067851 - DNA, 22 bp, Homo sapiens
ttgatacaggccttctagatga

SEQ ID NO: 9067852 - DNA, 22 bp, Homo sapiens
ttgagaaacatctaatctttgt

SEQ ID NO: 9067853 - DNA, 22 bp, Homo sapiens
ttgagctgtatacctatgactg

SEQ ID NO: 9067854 - DNA, 22 bp, Homo sapiens
ttgagctgtaaggtgggatgtg

SEQ ID NO: 9067855 - DNA, 22 bp, Homo sapiens
ttgagcttgaggagttatttga

SEQ ID NO: 9067856 - DNA, 22 bp, Homo sapiens
ttgacttttcttggtcacatga

SEQ ID NO: 9067857 - DNA, 22 bp, Homo sapiens
ctcagcagtatactctgaagat

SEQ ID NO: 9067858 - DNA, 22 bp, Homo sapiens
ttgacccagctttccccacaat

SEQ ID NO: 9067859 - DNA, 22 bp, Homo sapiens
ctcagcagtatactctgaagat

SEQ ID NO: 9067860 - DNA, 22 bp, Homo sapiens
ttgacccagttgtaaaagagct

SEQ ID NO: 9067861 - DNA, 22 bp, Homo sapiens
ttgacttcccagacttgtgttt

SEQ ID NO: 9067862 - DNA, 22 bp, Homo sapiens
ttgactttacagttttcttagg

SEQ ID NO: 9067863 - DNA, 22 bp, Homo sapiens
ttgacttcagcctgtacttgta

SEQ ID NO: 9067864 - DNA, 22 bp, Homo sapiens
ttgactgttaagacttggctct

SEQ ID NO: 9067865 - DNA, 22 bp, Homo sapiens
ctggaaaatgaagaagcagagg

SEQ ID NO: 9067866 - DNA, 22 bp, Homo sapiens
ctgctttgtaaaatagacataa

SEQ ID NO: 9067867 - DNA, 17 bp, Homo sapiens
ctgctttgtgcaacgct

SEQ ID NO: 9067868 - DNA, 23 bp, Homo sapiens
ctgctttcccactccatgctctt

SEQ ID NO: 9067869 - DNA, 22 bp, Homo sapiens
ctgctttctgcaccccaggtcg

SEQ ID NO: 9067870 - DNA, 22 bp, Homo sapiens
ctgctttgattagaagagtaca

SEQ ID NO: 9067871 - DNA, 22 bp, Homo sapiens
ctgctttgattagaagagtaca

SEQ ID NO: 9067872 - DNA, 22 bp, Homo sapiens
ctggacaaccactcagcctcag

SEQ ID NO: 9067873 - DNA, 22 bp, Homo sapiens
ctggacacaaacatctcctctg

SEQ ID NO: 9067874 - DNA, 22 bp, Homo sapiens
ctggacacactggagtctggca

SEQ ID NO: 9067875 - DNA, 22 bp, Homo sapiens
ctggacagaaaaggccactgga

SEQ ID NO: 9067876 - DNA, 22 bp, Homo sapiens
ctggaagtataggggagatgat

SEQ ID NO: 9067877 - DNA, 22 bp, Homo sapiens
ctggaaggttctttgtgtgcct

SEQ ID NO: 9067878 - DNA, 22 bp, Homo sapiens
ctggaaggttctttgtgtgcct

SEQ ID NO: 9067879 - DNA, 22 bp, Homo sapiens
ctggaaggttctttgtgtgcct

SEQ ID NO: 9067880 - DNA, 22 bp, Homo sapiens
ctggacaggctggggactgcaa

SEQ ID NO: 9067881 - DNA, 22 bp, Homo sapiens
ctggacaggctggggactgcaa

SEQ ID NO: 9067882 - DNA, 22 bp, Homo sapiens
ctggacagaaaccagtcctggg

SEQ ID NO: 9067883 - DNA, 22 bp, Homo sapiens
ctggacagaaagggctgctgtg

SEQ ID NO: 9067884 - DNA, 22 bp, Homo sapiens
ctggacagaagtggctgggcag

SEQ ID NO: 9067885 - DNA, 22 bp, Homo sapiens
ctgcctggagcattctgaaggt

SEQ ID NO: 9067886 - DNA, 22 bp, Homo sapiens
ctgcctggaccggcagccctcc

SEQ ID NO: 9067887 - DNA, 22 bp, Homo sapiens
ctgcctggaccggcagccctcc

SEQ ID NO: 9067888 - DNA, 22 bp, Homo sapiens
ctgcctggacagctcttacctt

SEQ ID NO: 9067889 - DNA, 22 bp, Homo sapiens
ctgcctgctcaccagggctctg

SEQ ID NO: 9067890 - DNA, 22 bp, Homo sapiens
ctgcctgctacctgaaatgcca

SEQ ID NO: 9067891 - DNA, 22 bp, Homo sapiens
ctgcctggaatgccagcttctc

SEQ ID NO: 9067892 - DNA, 22 bp, Homo sapiens
ctgcctgctctatccaggcctg

SEQ ID NO: 9067893 - DNA, 22 bp, Homo sapiens
ctgcctggcatggagaagagaa

SEQ ID NO: 9067894 - DNA, 22 bp, Homo sapiens
ctgcctggcatggagaagagaa

SEQ ID NO: 9067895 - DNA, 22 bp, Homo sapiens
ctgcctggcatggagaagagaa

SEQ ID NO: 9067896 - DNA, 22 bp, Homo sapiens
ctgcctggatgaatggcgcctt

SEQ ID NO: 9067897 - DNA, 20 bp, Homo sapiens
ctgcctggaggcctctacct

SEQ ID NO: 9067898 - DNA, 19 bp, Homo sapiens
ctgcttccttccctcactg

SEQ ID NO: 9067899 - DNA, 23 bp, Homo sapiens
ctgcttccttgcttcattgctgg

SEQ ID NO: 9067900 - DNA, 22 bp, Homo sapiens
ctgcttctaagaacctgcagct

SEQ ID NO: 9067901 - DNA, 22 bp, Homo sapiens
ctgcctgggccatgcccagtcc

SEQ ID NO: 9067902 - DNA, 22 bp, Homo sapiens
ctgcctgggccggccaccctct

SEQ ID NO: 9067903 - DNA, 22 bp, Homo sapiens
ctgcctggcctgatctccacgc

SEQ ID NO: 9067904 - DNA, 22 bp, Homo sapiens
ctgcctggcccagggatgggcc

SEQ ID NO: 9067905 - DNA, 22 bp, Homo sapiens
ctgcctggctaaactcaagtcg

SEQ ID NO: 9067906 - DNA, 22 bp, Homo sapiens
ctgctttaggtggaatgttcta

SEQ ID NO: 9067907 - DNA, 22 bp, Homo sapiens
ctggaggcaaagcagaggcatg

SEQ ID NO: 9067908 - DNA, 22 bp, Homo sapiens
ctggaggagcatggactggagt

SEQ ID NO: 9067909 - DNA, 22 bp, Homo sapiens
ctggaggagcatggactggagt

SEQ ID NO: 9067910 - DNA, 22 bp, Homo sapiens
ctggaggagcatggactggagt

SEQ ID NO: 9067911 - DNA, 22 bp, Homo sapiens
ctggaggacccctgcctggaag

SEQ ID NO: 9067912 - DNA, 22 bp, Homo sapiens
ctggaggaccacagaagctggt

SEQ ID NO: 9067913 - DNA, 22 bp, Homo sapiens
ctggaggacccctgcctggaag

SEQ ID NO: 9067914 - DNA, 22 bp, Homo sapiens
ctggaggctggcttcccctggc

SEQ ID NO: 9067915 - DNA, 22 bp, Homo sapiens
ctggaggctgagttgggtctcc

SEQ ID NO: 9067916 - DNA, 22 bp, Homo sapiens
ctggaggctgagttgggtctcc

SEQ ID NO: 9067917 - DNA, 22 bp, Homo sapiens
ctggaggctgagttgggtctcc

SEQ ID NO: 9067918 - DNA, 22 bp, Homo sapiens
ctggaggcagttgccccagtca

SEQ ID NO: 9067919 - DNA, 21 bp, Homo sapiens
ctggaggcaggtggtgccagg

SEQ ID NO: 9067920 - DNA, 21 bp, Homo sapiens
ctggaggcaggtggtgccagg

SEQ ID NO: 9067921 - DNA, 22 bp, Homo sapiens
ctggagctctgtgtgttcctga

SEQ ID NO: 9067922 - DNA, 22 bp, Homo sapiens
ctggaggaataatggcatcttg

SEQ ID NO: 9067923 - DNA, 22 bp, Homo sapiens
ctggagctctgtgtgttcctga

SEQ ID NO: 9067924 - DNA, 22 bp, Homo sapiens
ctggagctctccagagccccgt

SEQ ID NO: 9067925 - DNA, 22 bp, Homo sapiens
ctggagctctgtgtgttcctga

SEQ ID NO: 9067926 - DNA, 22 bp, Homo sapiens
ctggaggaatcacagaaggctt

SEQ ID NO: 9067927 - DNA, 22 bp, Homo sapiens
ctggaggaccacagaagctggt

SEQ ID NO: 9067928 - DNA, 22 bp, Homo sapiens
ctggaggacagaggccatgtct

SEQ ID NO: 9067929 - DNA, 22 bp, Homo sapiens
ctggaggacagaggccatgtct

SEQ ID NO: 9067930 - DNA, 22 bp, Homo sapiens
ctggaggacagaggccatgtct

SEQ ID NO: 9067931 - DNA, 22 bp, Homo sapiens
ctggactcactatggcttcaga

SEQ ID NO: 9067932 - DNA, 22 bp, Homo sapiens
ctggactcatccatagaggtga

SEQ ID NO: 9067933 - DNA, 20 bp, Homo sapiens
ctggacttgctgctcacctg

SEQ ID NO: 9067934 - DNA, 22 bp, Homo sapiens
ctggactttggcccatctgcca

SEQ ID NO: 9067935 - DNA, 22 bp, Homo sapiens
ctggagctctccagagccccgt

SEQ ID NO: 9067936 - DNA, 21 bp, Homo sapiens
ctggactgaggagacagtcgc

SEQ ID NO: 9067937 - DNA, 21 bp, Homo sapiens
ctggactgaggagacagtcgc

SEQ ID NO: 9067938 - DNA, 22 bp, Homo sapiens
ctggacttacttgctgaggact

SEQ ID NO: 9067939 - DNA, 19 bp, Homo sapiens
ctggacctggaggcccgga

SEQ ID NO: 9067940 - DNA, 19 bp, Homo sapiens
ctggacctggaggcccgga

SEQ ID NO: 9067941 - DNA, 22 bp, Homo sapiens
ctggaggggctggcatggtagc

SEQ ID NO: 9067942 - DNA, 22 bp, Homo sapiens
ctggagggcttctgcaggttac

SEQ ID NO: 9067943 - DNA, 22 bp, Homo sapiens
ctggaggtagatggtggtaatg

SEQ ID NO: 9067944 - DNA, 22 bp, Homo sapiens
ctggaggtcacccttagaacat

SEQ ID NO: 9067945 - DNA, 18 bp, Homo sapiens
ctggagtcacagtgggga

SEQ ID NO: 9067946 - DNA, 22 bp, Homo sapiens
ctggagtctccccaggagcgtg

SEQ ID NO: 9067947 - DNA, 22 bp, Homo sapiens
ctggagtcggcgccccaacaga

SEQ ID NO: 9067948 - DNA, 21 bp, Homo sapiens
ctggagtcattttctgagtag

SEQ ID NO: 9067949 - DNA, 22 bp, Homo sapiens
ctggagtcagcaaggacgaggc

SEQ ID NO: 9067950 - DNA, 22 bp, Homo sapiens
ctggagtagccggacgggtctg

SEQ ID NO: 9067951 - DNA, 22 bp, Homo sapiens
ctggaggtgggggcaagagtgt

SEQ ID NO: 9067952 - DNA, 22 bp, Homo sapiens
ctggaggttgggtccaggccag

SEQ ID NO: 9067953 - DNA, 22 bp, Homo sapiens
ctggaggtctacagtggtagct

SEQ ID NO: 9067954 - DNA, 22 bp, Homo sapiens
ctggaggtgcctagatgagctc

SEQ ID NO: 9067955 - DNA, 22 bp, Homo sapiens
ctggaggtgcttcgctggccac

SEQ ID NO: 9067956 - DNA, 22 bp, Homo sapiens
ctggagtgtaaagagcatagaa

SEQ ID NO: 9067957 - DNA, 22 bp, Homo sapiens
ctggctccaccccaggaggatg

SEQ ID NO: 9067958 - DNA, 22 bp, Homo sapiens
ctggctccaccccaggaggatg

SEQ ID NO: 9067959 - DNA, 22 bp, Homo sapiens
ctggcctggggcctcagctgct

SEQ ID NO: 9067960 - DNA, 22 bp, Homo sapiens
ctggcctggggcctcagctgct

SEQ ID NO: 9067961 - DNA, 22 bp, Homo sapiens
ctggcctggggcctcagctgct

SEQ ID NO: 9067962 - DNA, 22 bp, Homo sapiens
ctggcctggggcctcagctgct

SEQ ID NO: 9067963 - DNA, 22 bp, Homo sapiens
ctggcctgggagctgctagcgt

SEQ ID NO: 9067964 - DNA, 22 bp, Homo sapiens
ctggcctggcgcagtggctcac

SEQ ID NO: 9067965 - DNA, 22 bp, Homo sapiens
ctggcctggcgcagtggctcac

SEQ ID NO: 9067966 - DNA, 22 bp, Homo sapiens
ctggcctggcgcagtggctcac

SEQ ID NO: 9067967 - DNA, 22 bp, Homo sapiens
ctggcctggcaggggacctcta

SEQ ID NO: 9067968 - DNA, 22 bp, Homo sapiens
ctggcctggcaggggacctcta

SEQ ID NO: 9067969 - DNA, 22 bp, Homo sapiens
ctggctcctcagtattccactt

SEQ ID NO: 9067970 - DNA, 22 bp, Homo sapiens
ctggctccctggacatggggcc

SEQ ID NO: 9067971 - DNA, 22 bp, Homo sapiens
ctggctccctggacatggggcc

SEQ ID NO: 9067972 - DNA, 23 bp, Homo sapiens
ctggctccgaagactccaggatc

SEQ ID NO: 9067973 - DNA, 23 bp, Homo sapiens
ctggctccgaagactccaggatc

SEQ ID NO: 9067974 - DNA, 22 bp, Homo sapiens
ctggctccaggtcatgcactca

SEQ ID NO: 9067975 - DNA, 22 bp, Homo sapiens
ctggctccactccctgcctgac

SEQ ID NO: 9067976 - DNA, 22 bp, Homo sapiens
ctggctccctctccctgagtca

SEQ ID NO: 9067977 - DNA, 22 bp, Homo sapiens
ctggctccctctccctgagtca

SEQ ID NO: 9067978 - DNA, 22 bp, Homo sapiens
ctggctccctctccctgagtca

SEQ ID NO: 9067979 - DNA, 22 bp, Homo sapiens
ctggctccctcgctgaggtgct

SEQ ID NO: 9067980 - DNA, 22 bp, Homo sapiens
ctggctccaggtcatgcactca

SEQ ID NO: 9067981 - DNA, 22 bp, Homo sapiens
ctggctcctgaggcttggcccc

SEQ ID NO: 9067982 - DNA, 22 bp, Homo sapiens
ctggctcctgaggcttggcccc

SEQ ID NO: 9067983 - DNA, 22 bp, Homo sapiens
ctggctctctgagatattgagt

SEQ ID NO: 9067984 - DNA, 22 bp, Homo sapiens
ctggctctcgctgggagtactt

SEQ ID NO: 9067985 - DNA, 22 bp, Homo sapiens
ctggctctatctccaaggctgg

SEQ ID NO: 9067986 - DNA, 22 bp, Homo sapiens
ctggctctgggctaagctccca

SEQ ID NO: 9067987 - DNA, 22 bp, Homo sapiens
ctggctctgagcccacctccag

SEQ ID NO: 9067988 - DNA, 23 bp, Homo sapiens
ctggctctgtaggtggcatcctt

SEQ ID NO: 9067989 - DNA, 22 bp, Homo sapiens
ctggctctgggctaagctccca

SEQ ID NO: 9067990 - DNA, 23 bp, Homo sapiens
ctggctctgtaggtggcatcctt

SEQ ID NO: 9067991 - DNA, 23 bp, Homo sapiens
ctggctctgtaggtggcatcctt

SEQ ID NO: 9067992 - DNA, 22 bp, Homo sapiens
ctggcccagagagcagagctta

SEQ ID NO: 9067993 - DNA, 22 bp, Homo sapiens
ctggcccagagagcagagctta

SEQ ID NO: 9067994 - DNA, 22 bp, Homo sapiens
ctggcccagagagcagagctta

SEQ ID NO: 9067995 - DNA, 22 bp, Homo sapiens
ctggcccagagagcagagctta

SEQ ID NO: 9067996 - DNA, 22 bp, Homo sapiens
ctggccatgttgcctctgagac

SEQ ID NO: 9067997 - DNA, 22 bp, Homo sapiens
ctggccatgttgcctctgagac

SEQ ID NO: 9067998 - DNA, 22 bp, Homo sapiens
ctggccatctcctgccagcggt

SEQ ID NO: 9067999 - DNA, 22 bp, Homo sapiens
ctggccatatccaccagatgga

SEQ ID NO: 9068000 - DNA, 22 bp, Homo sapiens
ctggccataggttctcagtgtg

SEQ ID NO: 9068001 - DNA, 22 bp, Homo sapiens
ctggccagtgtggctctgatct

SEQ ID NO: 9068002 - DNA, 22 bp, Homo sapiens
ctggccagttgtcctggcttgg

SEQ ID NO: 9068003 - DNA, 22 bp, Homo sapiens
ctggccagttgtcctggcttgg

SEQ ID NO: 9068004 - DNA, 20 bp, Homo sapiens
ctggcccaggatgatggcgc

SEQ ID NO: 9068005 - DNA, 21 bp, Homo sapiens
ctggcccagggatctgcattt

SEQ ID NO: 9068006 - DNA, 22 bp, Homo sapiens
ctggcccagagctctggccttt

SEQ ID NO: 9068007 - DNA, 22 bp, Homo sapiens
ctggcccagagctctggccttt

SEQ ID NO: 9068008 - DNA, 22 bp, Homo sapiens
ctggcccagagctctggccttt

SEQ ID NO: 9068009 - DNA, 22 bp, Homo sapiens
ctggccctgtggaggcaggaac

SEQ ID NO: 9068010 - DNA, 22 bp, Homo sapiens
ctggcctgagaatgctaccctt

SEQ ID NO: 9068011 - DNA, 22 bp, Homo sapiens
ctggcctgaggccgccttcaga

SEQ ID NO: 9068012 - DNA, 22 bp, Homo sapiens
ctggcctgagcacagcggctgc

SEQ ID NO: 9068013 - DNA, 22 bp, Homo sapiens
ctggcctgagcacagcggctgc

SEQ ID NO: 9068014 - DNA, 22 bp, Homo sapiens
ctggcctgaggccgccttcaga

SEQ ID NO: 9068015 - DNA, 22 bp, Homo sapiens
ctggcctgaggccgccttcaga

SEQ ID NO: 9068016 - DNA, 22 bp, Homo sapiens
ctggcctgaggccgccttcaga

SEQ ID NO: 9068017 - DNA, 22 bp, Homo sapiens
ctggcctgaggccgccttcaga

SEQ ID NO: 9068018 - DNA, 22 bp, Homo sapiens
ctggcctgcagatcccagggtc

SEQ ID NO: 9068019 - DNA, 22 bp, Homo sapiens
ctggcctgaggtcggctgtagg

SEQ ID NO: 9068020 - DNA, 22 bp, Homo sapiens
ctggcctgcagatcccagggtc

SEQ ID NO: 9068021 - DNA, 22 bp, Homo sapiens
ctggcctggcagggagggcatg

SEQ ID NO: 9068022 - DNA, 22 bp, Homo sapiens
ctggcctggagcctctgggtgg

SEQ ID NO: 9068023 - DNA, 22 bp, Homo sapiens
ctggcctggcagggagggcatg

SEQ ID NO: 9068024 - DNA, 22 bp, Homo sapiens
ctggatccatcgggtcccgagt

SEQ ID NO: 9068025 - DNA, 22 bp, Homo sapiens
ctggatctgaacatcggtatca

SEQ ID NO: 9068026 - DNA, 22 bp, Homo sapiens
ctggatctaaaggtggatgtag

SEQ ID NO: 9068027 - DNA, 22 bp, Homo sapiens
ctggatctgtcttttggatccc

SEQ ID NO: 9068028 - DNA, 22 bp, Homo sapiens
ctggatctgtttgtgcttgtgg

SEQ ID NO: 9068029 - DNA, 22 bp, Homo sapiens
ctggatctgtcccctttttgtt

SEQ ID NO: 9068030 - DNA, 21 bp, Homo sapiens
ctggatctgtcatcgagtttt

SEQ ID NO: 9068031 - DNA, 22 bp, Homo sapiens
ctggatgcttcctctctgctag

SEQ ID NO: 9068032 - DNA, 22 bp, Homo sapiens
ctggatcttgctgcattgagaa

SEQ ID NO: 9068033 - DNA, 22 bp, Homo sapiens
ctggatctgtcttttggatccc

SEQ ID NO: 9068034 - DNA, 22 bp, Homo sapiens
ctggatcttcagagatcaccag

SEQ ID NO: 9068035 - DNA, 22 bp, Homo sapiens
ctggatgctgagaggtaccaag

SEQ ID NO: 9068036 - DNA, 22 bp, Homo sapiens
ctggatcttgctgcattgagaa

SEQ ID NO: 9068037 - DNA, 22 bp, Homo sapiens
ctggattcatgccaggccaccc

SEQ ID NO: 9068038 - DNA, 22 bp, Homo sapiens
ctggattctcatcagagccaga

SEQ ID NO: 9068039 - DNA, 22 bp, Homo sapiens
ctggattctttcataaaagtca

SEQ ID NO: 9068040 - DNA, 22 bp, Homo sapiens
ctggattttgatgagcagtttt

SEQ ID NO: 9068041 - DNA, 22 bp, Homo sapiens
ctggcaagaaatatatatctta

SEQ ID NO: 9068042 - DNA, 22 bp, Homo sapiens
ctggcaagaaatatatatctta

SEQ ID NO: 9068043 - DNA, 22 bp, Homo sapiens
ctggcacctccagctcatggcc

SEQ ID NO: 9068044 - DNA, 22 bp, Homo sapiens
ctggcactgtgtctgcggaggg

SEQ ID NO: 9068045 - DNA, 22 bp, Homo sapiens
ctggcactgtgtctgcggaggg

SEQ ID NO: 9068046 - DNA, 22 bp, Homo sapiens
ctggcacatgctccctgagtgg

SEQ ID NO: 9068047 - DNA, 22 bp, Homo sapiens
ctggcagattggggtcagcagt

SEQ ID NO: 9068048 - DNA, 22 bp, Homo sapiens
ctggcagcagagctcaacatag

SEQ ID NO: 9068049 - DNA, 22 bp, Homo sapiens
ctggcagcagcttctggatcga

SEQ ID NO: 9068050 - DNA, 22 bp, Homo sapiens
ctggcagcagcttctggatcga

SEQ ID NO: 9068051 - DNA, 22 bp, Homo sapiens
ctggccaccaagagcttgctca

SEQ ID NO: 9068052 - DNA, 23 bp, Homo sapiens
ctggccaccatctttctggcttc

SEQ ID NO: 9068053 - DNA, 22 bp, Homo sapiens
ctggccacatgtgtgctgagca

SEQ ID NO: 9068054 - DNA, 22 bp, Homo sapiens
ctggcatgccttgggtgcctct

SEQ ID NO: 9068055 - DNA, 22 bp, Homo sapiens
ctggcatgtgtttggctcctgt

SEQ ID NO: 9068056 - DNA, 18 bp, Homo sapiens
ctggcattcttccctgga

SEQ ID NO: 9068057 - DNA, 21 bp, Homo sapiens
ctggcattatgatagcgtcct

SEQ ID NO: 9068058 - DNA, 22 bp, Homo sapiens
ctggcatgctaatacagcctgt

SEQ ID NO: 9068059 - DNA, 22 bp, Homo sapiens
ctggccaacttgcttgttggca

SEQ ID NO: 9068060 - DNA, 22 bp, Homo sapiens
ctggcagcatggagcctgtgct

SEQ ID NO: 9068061 - DNA, 22 bp, Homo sapiens
ctggcagcatggagcctgtgct

SEQ ID NO: 9068062 - DNA, 22 bp, Homo sapiens
ctggcagcatggagcctgtgct

SEQ ID NO: 9068063 - DNA, 22 bp, Homo sapiens
ctggcagcaggtcacacgcaga

SEQ ID NO: 9068064 - DNA, 22 bp, Homo sapiens
ctggcagggctctttgggtgct

SEQ ID NO: 9068065 - DNA, 22 bp, Homo sapiens
ctggcagcattaacagagagca

SEQ ID NO: 9068066 - DNA, 22 bp, Homo sapiens
ctggcagcattaacagagagca

SEQ ID NO: 9068067 - DNA, 22 bp, Homo sapiens
ctggcagtgacattgcaggtgc

SEQ ID NO: 9068068 - DNA, 22 bp, Homo sapiens
ctggcagtctggtggaaggcct

SEQ ID NO: 9068069 - DNA, 22 bp, Homo sapiens
ctggcagtctgcctcttcactg

SEQ ID NO: 9068070 - DNA, 22 bp, Homo sapiens
ctggcagtttgccaggagctcg

SEQ ID NO: 9068071 - DNA, 22 bp, Homo sapiens
ctggcagtttgccaggagctcg

SEQ ID NO: 9068072 - DNA, 22 bp, Homo sapiens
ctggcatgaaatggcatctcat

SEQ ID NO: 9068073 - DNA, 22 bp, Homo sapiens
ctggcatgaaatggcatctcat

SEQ ID NO: 9068074 - DNA, 22 bp, Homo sapiens
ctggcatgaaatggcatctcat

SEQ ID NO: 9068075 - DNA, 22 bp, Homo sapiens
ctggcagtggggcctcagtgtt

SEQ ID NO: 9068076 - DNA, 22 bp, Homo sapiens
ctgcagagggtttgagcatcct

SEQ ID NO: 9068077 - DNA, 22 bp, Homo sapiens
ctgcagaggcctcgcctcctct

SEQ ID NO: 9068078 - DNA, 22 bp, Homo sapiens
ctgcagatcttgtgtacttgtc

SEQ ID NO: 9068079 - DNA, 22 bp, Homo sapiens
ctgcagattggcctgatgttca

SEQ ID NO: 9068080 - DNA, 22 bp, Homo sapiens
ctgcagatggtattgttctggt

SEQ ID NO: 9068081 - DNA, 22 bp, Homo sapiens
ctgcagcaaatgttaagtgact

SEQ ID NO: 9068082 - DNA, 22 bp, Homo sapiens
ctgcagcaagagaagtgctgac

SEQ ID NO: 9068083 - DNA, 21 bp, Homo sapiens
ctgcagcaaaactttgctcct

SEQ ID NO: 9068084 - DNA, 22 bp, Homo sapiens
ctgcagatttggtgtctggtga

SEQ ID NO: 9068085 - DNA, 22 bp, Homo sapiens
ctgcagcagcctccagccttgg

SEQ ID NO: 9068086 - DNA, 22 bp, Homo sapiens
ctgcagcaggaggctcctgcag

SEQ ID NO: 9068087 - DNA, 22 bp, Homo sapiens
ctgcagcagggcttgcccacct

SEQ ID NO: 9068088 - DNA, 22 bp, Homo sapiens
ctgcagcagggcttgcccacct

SEQ ID NO: 9068089 - DNA, 22 bp, Homo sapiens
ctgccaggggcctcacaggcca

SEQ ID NO: 9068090 - DNA, 22 bp, Homo sapiens
ctgccagggcatcctgtggtgg

SEQ ID NO: 9068091 - DNA, 22 bp, Homo sapiens
ctgccagctctctggaggctct

SEQ ID NO: 9068092 - DNA, 23 bp, Homo sapiens
ctgcagccgcgtggggacgtgga

SEQ ID NO: 9068093 - DNA, 23 bp, Homo sapiens
ctgcagccgcgtggggacgtgga

SEQ ID NO: 9068094 - DNA, 22 bp, Homo sapiens
ctgcagcatcctagggtctgtg

SEQ ID NO: 9068095 - DNA, 22 bp, Homo sapiens
ctgcagcatcgccacctgcctc

SEQ ID NO: 9068096 - DNA, 22 bp, Homo sapiens
ctgccaggcctccgctgtcccc

SEQ ID NO: 9068097 - DNA, 22 bp, Homo sapiens
ctgccaggcctccgctgtcccc

SEQ ID NO: 9068098 - DNA, 22 bp, Homo sapiens
ctgccaggcctccgctgtcccc

SEQ ID NO: 9068099 - DNA, 22 bp, Homo sapiens
ctgccaggcctccgctgtcccc

SEQ ID NO: 9068100 - DNA, 22 bp, Homo sapiens
ctgcctcctcacgtccacagtg

SEQ ID NO: 9068101 - DNA, 22 bp, Homo sapiens
ctgcctccaggctcaccttgac

SEQ ID NO: 9068102 - DNA, 22 bp, Homo sapiens
ctgcctcctcacgtccacagtg

SEQ ID NO: 9068103 - DNA, 22 bp, Homo sapiens
ctgcctcctgccgtgcagcttc

SEQ ID NO: 9068104 - DNA, 22 bp, Homo sapiens
ctgcctgcgttgcctcgtgcct

SEQ ID NO: 9068105 - DNA, 22 bp, Homo sapiens
ctgcctcagcgttgtggcccta

SEQ ID NO: 9068106 - DNA, 22 bp, Homo sapiens
ctgcctcagcgttgtggcccta

SEQ ID NO: 9068107 - DNA, 22 bp, Homo sapiens
ctgcctcatgctgcctgcagcc

SEQ ID NO: 9068108 - DNA, 22 bp, Homo sapiens
ctgcctagggtctggtaccaca

SEQ ID NO: 9068109 - DNA, 22 bp, Homo sapiens
ctgcctagggtctggtaccaca

SEQ ID NO: 9068110 - DNA, 22 bp, Homo sapiens
ctgcctagatttgaatcctggc

SEQ ID NO: 9068111 - DNA, 22 bp, Homo sapiens
ctgccaggttggcgctcgctct

SEQ ID NO: 9068112 - DNA, 20 bp, Homo sapiens
ctgccatgattgatagagtg

SEQ ID NO: 9068113 - DNA, 22 bp, Homo sapiens
ctgccatctgagggtccagcct

SEQ ID NO: 9068114 - DNA, 22 bp, Homo sapiens
ctgccctgggtgctggggatcc

SEQ ID NO: 9068115 - DNA, 22 bp, Homo sapiens
ctgccctggggggcctccttgc

SEQ ID NO: 9068116 - DNA, 22 bp, Homo sapiens
ctgccctggggggcctccttgc

SEQ ID NO: 9068117 - DNA, 22 bp, Homo sapiens
ctgccctgggttttatgggagt

SEQ ID NO: 9068118 - DNA, 22 bp, Homo sapiens
ctgcctagaaaaccaggctcct

SEQ ID NO: 9068119 - DNA, 22 bp, Homo sapiens
ctgcctagaaaaccaggctcct

SEQ ID NO: 9068120 - DNA, 22 bp, Homo sapiens
ctgatcctcctttaagtagctg

SEQ ID NO: 9068121 - DNA, 22 bp, Homo sapiens
ctgagtccttgggcttagagtg

SEQ ID NO: 9068122 - DNA, 22 bp, Homo sapiens
ctgagtccagggacagaggcgt

SEQ ID NO: 9068123 - DNA, 22 bp, Homo sapiens
ctgaggcagaaaaagcaagggt

SEQ ID NO: 9068124 - DNA, 22 bp, Homo sapiens
ctgaggcagaaaaagcaagggt

SEQ ID NO: 9068125 - DNA, 22 bp, Homo sapiens
ctgagtccagggacagaggcgt

SEQ ID NO: 9068126 - DNA, 22 bp, Homo sapiens
ctgattaactgaactgaattta

SEQ ID NO: 9068127 - DNA, 22 bp, Homo sapiens
ctgatgctctggatgtagtcaa

SEQ ID NO: 9068128 - DNA, 22 bp, Homo sapiens
ctgatgcaaccagcatatggaa

SEQ ID NO: 9068129 - DNA, 22 bp, Homo sapiens
ctgcagagcataaatctgaata

SEQ ID NO: 9068130 - DNA, 22 bp, Homo sapiens
ctgcagaaatatggatgtgata

SEQ ID NO: 9068131 - DNA, 22 bp, Homo sapiens
ctgcagaaatatggatgtgata

SEQ ID NO: 9068132 - DNA, 22 bp, Homo sapiens
ctgcagacctctgaggtccatg

SEQ ID NO: 9068133 - DNA, 22 bp, Homo sapiens
ctgcagaaacctttcctgattt

SEQ ID NO: 9068134 - DNA, 22 bp, Homo sapiens
ctgcacttgacatgctctcaga

SEQ ID NO: 9068135 - DNA, 22 bp, Homo sapiens
ctgcaaaagtaattgcaggttt

SEQ ID NO: 9068136 - DNA, 22 bp, Homo sapiens
ctgcaaaagtaattggggcttt

SEQ ID NO: 9068137 - DNA, 22 bp, Homo sapiens
ctgatttacatatacaaaagat

SEQ ID NO: 9068138 - DNA, 22 bp, Homo sapiens
ctgatttacatatacaaaagat

SEQ ID NO: 9068139 - DNA, 22 bp, Homo sapiens
ctgatttagatttcacacgtga

SEQ ID NO: 9068140 - DNA, 17 bp, Homo sapiens
ctgatttattagcagac

SEQ ID NO: 9068141 - DNA, 22 bp, Homo sapiens
ctgatttctcagttctaggaag

SEQ ID NO: 9068142 - DNA, 22 bp, Homo sapiens
ctgattcctgattcatgctctt

SEQ ID NO: 9068143 - DNA, 22 bp, Homo sapiens
ctgattctttgaagatgcaccc

SEQ ID NO: 9068144 - DNA, 22 bp, Homo sapiens
ctgaggagttggtgaataagcc

SEQ ID NO: 9068145 - DNA, 22 bp, Homo sapiens
ctgaggagtttcttatatgtgt

SEQ ID NO: 9068146 - DNA, 22 bp, Homo sapiens
ctgaggatctactgtgggctca

SEQ ID NO: 9068147 - DNA, 22 bp, Homo sapiens
ctgaggagtttgggttgttcaa

SEQ ID NO: 9068148 - DNA, 22 bp, Homo sapiens
ctgaggagtcagcttactcact

SEQ ID NO: 9068149 - DNA, 22 bp, Homo sapiens
ctgaggagtcagttccactcag

SEQ ID NO: 9068150 - DNA, 22 bp, Homo sapiens
ctgaggaggggcctgagtgaga

SEQ ID NO: 9068151 - DNA, 22 bp, Homo sapiens
ctgaggagtgggtgggcagtga

SEQ ID NO: 9068152 - DNA, 22 bp, Homo sapiens
ctgaggcactgtcagctgaggc

SEQ ID NO: 9068153 - DNA, 22 bp, Homo sapiens
ctgaggcactgtcagctgaggc

SEQ ID NO: 9068154 - DNA, 22 bp, Homo sapiens
ctgaggcactgtcagctgaggc

SEQ ID NO: 9068155 - DNA, 22 bp, Homo sapiens
ctgaggcagaaaaagcaagggt

SEQ ID NO: 9068156 - DNA, 22 bp, Homo sapiens
ctgaggcactggtaatgggcat

SEQ ID NO: 9068157 - DNA, 22 bp, Homo sapiens
ctgaggcactggtaatgggcat

SEQ ID NO: 9068158 - DNA, 22 bp, Homo sapiens
ctgaggcactaacaaggacaag

SEQ ID NO: 9068159 - DNA, 22 bp, Homo sapiens
ctgaggcacctacagtctcggg

SEQ ID NO: 9068160 - DNA, 22 bp, Homo sapiens
ctgaggcacccatcttctcctg

SEQ ID NO: 9068161 - DNA, 22 bp, Homo sapiens
ctgaggaggctaatttgaggat

SEQ ID NO: 9068162 - DNA, 22 bp, Homo sapiens
ctgaggagggaagtccccaaag

SEQ ID NO: 9068163 - DNA, 22 bp, Homo sapiens
ctgaggagctgaaggccctcca

SEQ ID NO: 9068164 - DNA, 22 bp, Homo sapiens
ctgaggagaaatgggatggttc

SEQ ID NO: 9068165 - DNA, 22 bp, Homo sapiens
ctgaggaccccacaggaggccc

SEQ ID NO: 9068166 - DNA, 22 bp, Homo sapiens
ctgaggagaaagatggtccaag

SEQ ID NO: 9068167 - DNA, 22 bp, Homo sapiens
ctgagacccagacacctgagga

SEQ ID NO: 9068168 - DNA, 22 bp, Homo sapiens
ctgagacacggagaggctgtgt

SEQ ID NO: 9068169 - DNA, 22 bp, Homo sapiens
ctgagaatggacagcagggcag

SEQ ID NO: 9068170 - DNA, 22 bp, Homo sapiens
ctctgggcaagtttcttcatga

SEQ ID NO: 9068171 - DNA, 19 bp, Homo sapiens
ctctgggcaagtcacttaa

SEQ ID NO: 9068172 - DNA, 22 bp, Homo sapiens
ctctgggcaagtatgatagaaa

SEQ ID NO: 9068173 - DNA, 22 bp, Homo sapiens
ctctgggcaagtatgatagaaa

SEQ ID NO: 9068174 - DNA, 22 bp, Homo sapiens
ctctgggcaaagatgcctcatc

SEQ ID NO: 9068175 - DNA, 22 bp, Homo sapiens
ctctgggcaaagatgcctcatc

SEQ ID NO: 9068176 - DNA, 18 bp, Homo sapiens
ctctgggagaggcataca

SEQ ID NO: 9068177 - DNA, 22 bp, Homo sapiens
ctctgggatgaggcctaggcac

SEQ ID NO: 9068178 - DNA, 17 bp, Homo sapiens
ctctgggcagcctgggg

SEQ ID NO: 9068179 - DNA, 17 bp, Homo sapiens
ctctgggcagcctgggg

SEQ ID NO: 9068180 - DNA, 17 bp, Homo sapiens
ctctgggcagcctgggg

SEQ ID NO: 9068181 - DNA, 22 bp, Homo sapiens
ctctgggcactgtatgggttct

SEQ ID NO: 9068182 - DNA, 22 bp, Homo sapiens
ctctgggcaccaaagagcagct

SEQ ID NO: 9068183 - DNA, 22 bp, Homo sapiens
ctctgggcaccaaagagcagct

SEQ ID NO: 9068184 - DNA, 22 bp, Homo sapiens
ctctgggcaccaaagagcagct

SEQ ID NO: 9068185 - DNA, 22 bp, Homo sapiens
ctctgggcacattttccaggac

SEQ ID NO: 9068186 - DNA, 22 bp, Homo sapiens
ctctgggcaggaccagtggacc

SEQ ID NO: 9068187 - DNA, 22 bp, Homo sapiens
ctctgggcaggaccagtggacc

SEQ ID NO: 9068188 - DNA, 22 bp, Homo sapiens
ctctgggccaccgctggtgtat

SEQ ID NO: 9068189 - DNA, 22 bp, Homo sapiens
ctctgggcaggacgccaggcct

SEQ ID NO: 9068190 - DNA, 23 bp, Homo sapiens
ttttattgatatgtagctgttgt

SEQ ID NO: 9068191 - DNA, 22 bp, Homo sapiens
ctctgggctccttcagcccttt

SEQ ID NO: 9068192 - DNA, 22 bp, Homo sapiens
ctctgggctccttcagcccttt

SEQ ID NO: 9068193 - DNA, 22 bp, Homo sapiens
ctctgggctgaatggctgaacc

SEQ ID NO: 9068194 - DNA, 22 bp, Homo sapiens
ctctgggctgaatggctgaacc

SEQ ID NO: 9068195 - DNA, 22 bp, Homo sapiens
ttttagttactgcagtagcaaa

SEQ ID NO: 9068196 - DNA, 22 bp, Homo sapiens
ttttagttactgcagtagcaaa

SEQ ID NO: 9068197 - DNA, 22 bp, Homo sapiens
ttttagttgtactgtcaacagt

SEQ ID NO: 9068198 - DNA, 22 bp, Homo sapiens
ctctgggccatgctactgctct

SEQ ID NO: 9068199 - DNA, 21 bp, Homo sapiens
ctctgggccattttcttccac

SEQ ID NO: 9068200 - DNA, 22 bp, Homo sapiens
ctctgggcccacttaaatctgg

SEQ ID NO: 9068201 - DNA, 22 bp, Homo sapiens
ctctgggcggcccaggccaacc

SEQ ID NO: 9068202 - DNA, 22 bp, Homo sapiens
ctctgggcggcccaggccaacc

SEQ ID NO: 9068203 - DNA, 23 bp, Homo sapiens
ctctgggcgggcaggtcagcctc

SEQ ID NO: 9068204 - DNA, 22 bp, Homo sapiens
tttgtcttggcctcagttttct

SEQ ID NO: 9068205 - DNA, 22 bp, Homo sapiens
ctctcctggggagcacacacac

SEQ ID NO: 9068206 - DNA, 22 bp, Homo sapiens
tttgtctttcccctcctcattg

SEQ ID NO: 9068207 - DNA, 22 bp, Homo sapiens
tttgtgaaatgaagtcacaact

SEQ ID NO: 9068208 - DNA, 22 bp, Homo sapiens
tttgtcttgtaagttaaattca

SEQ ID NO: 9068209 - DNA, 19 bp, Homo sapiens
tttgtgaagaaaatgatgc

SEQ ID NO: 9068210 - DNA, 22 bp, Homo sapiens
tttgtgaagggaacagaagtgt

SEQ ID NO: 9068211 - DNA, 22 bp, Homo sapiens
tttgtgaagggaacagaagtgt

SEQ ID NO: 9068212 - DNA, 22 bp, Homo sapiens
tttgtgaacaaacatgaagatg

SEQ ID NO: 9068213 - DNA, 22 bp, Homo sapiens
tttgtgaacaaacatgaagatg

SEQ ID NO: 9068214 - DNA, 22 bp, Homo sapiens
tttgtgaacaaacatgaagatg

SEQ ID NO: 9068215 - DNA, 22 bp, Homo sapiens
tttgtgaacactgcgcagaact

SEQ ID NO: 9068216 - DNA, 22 bp, Homo sapiens
ctctggctggcacctgatctga

SEQ ID NO: 9068217 - DNA, 22 bp, Homo sapiens
ctctggctgcctctcaggcctg

SEQ ID NO: 9068218 - DNA, 22 bp, Homo sapiens
ctctggctgcctctcaggcctg

SEQ ID NO: 9068219 - DNA, 22 bp, Homo sapiens
tttgtgaataggttggcttcca

SEQ ID NO: 9068220 - DNA, 22 bp, Homo sapiens
tttgtgaataggttggcttcca

SEQ ID NO: 9068221 - DNA, 22 bp, Homo sapiens
tttgtgaataggttggcttcca

SEQ ID NO: 9068222 - DNA, 22 bp, Homo sapiens
ctctggctgtttgcagctcaag

SEQ ID NO: 9068223 - DNA, 22 bp, Homo sapiens
ctctggctgtttgcagctcaag

SEQ ID NO: 9068224 - DNA, 19 bp, Homo sapiens
ctctggcttccaaagcatc

SEQ ID NO: 9068225 - DNA, 22 bp, Homo sapiens
ctctggctgtcccgatgagcag

SEQ ID NO: 9068226 - DNA, 22 bp, Homo sapiens
ctctggctgtcccgatgagcag

SEQ ID NO: 9068227 - DNA, 22 bp, Homo sapiens
ctctggctggctgggcctcagt

SEQ ID NO: 9068228 - DNA, 22 bp, Homo sapiens
ctctttttcagccttaccaaag

SEQ ID NO: 9068229 - DNA, 22 bp, Homo sapiens
ctctttttcacctctgtcagcg

SEQ ID NO: 9068230 - DNA, 19 bp, Homo sapiens
ctgaaaaacattctcagga

SEQ ID NO: 9068231 - DNA, 19 bp, Homo sapiens
ctgaaaaacattctcagga

SEQ ID NO: 9068232 - DNA, 19 bp, Homo sapiens
ctgaaaaacattctcagga

SEQ ID NO: 9068233 - DNA, 22 bp, Homo sapiens
ctctttttcagccttaccaaag

SEQ ID NO: 9068234 - DNA, 17 bp, Homo sapiens
ctcttttgtcttcttcc

SEQ ID NO: 9068235 - DNA, 22 bp, Homo sapiens
ctcttttagagatgaaaattgg

SEQ ID NO: 9068236 - DNA, 22 bp, Homo sapiens
ctcttttagagatgaaaattgg

SEQ ID NO: 9068237 - DNA, 22 bp, Homo sapiens
ctcttttatgtgacgtgtgtga

SEQ ID NO: 9068238 - DNA, 22 bp, Homo sapiens
ctcttttaattgtcataacaac

SEQ ID NO: 9068239 - DNA, 22 bp, Homo sapiens
ctcttttaattgtcataacaac

SEQ ID NO: 9068240 - DNA, 22 bp, Homo sapiens
ctcttttacaccaaaaggccta

SEQ ID NO: 9068241 - DNA, 22 bp, Homo sapiens
tttttaagagattctccagtct

SEQ ID NO: 9068242 - DNA, 22 bp, Homo sapiens
tttttaagagattctccagtct

SEQ ID NO: 9068243 - DNA, 22 bp, Homo sapiens
ttttgttttcttagaaacctgg

SEQ ID NO: 9068244 - DNA, 22 bp, Homo sapiens
ttttgttttcttagaaacctgg

SEQ ID NO: 9068245 - DNA, 22 bp, Homo sapiens
ttttgttttcttagaaacctgg

SEQ ID NO: 9068246 - DNA, 22 bp, Homo sapiens
tttttaagctcctttgatgtca

SEQ ID NO: 9068247 - DNA, 22 bp, Homo sapiens
tttttaagagtctggaaatagt

SEQ ID NO: 9068248 - DNA, 22 bp, Homo sapiens
ctctttgtgctattatgatcct

SEQ ID NO: 9068249 - DNA, 21 bp, Homo sapiens
ctctttgtggcaatgtatttt

SEQ ID NO: 9068250 - DNA, 22 bp, Homo sapiens
ctctttgtagcctttgcatatt

SEQ ID NO: 9068251 - DNA, 22 bp, Homo sapiens
ctctttgtcactcatacagtca

SEQ ID NO: 9068252 - DNA, 22 bp, Homo sapiens
ctctggtgtcctttagaattta

SEQ ID NO: 9068253 - DNA, 22 bp, Homo sapiens
ctctggtcaagcaaagaggttt

SEQ ID NO: 9068254 - DNA, 22 bp, Homo sapiens
ctctggtcatttggaagagcat

SEQ ID NO: 9068255 - DNA, 22 bp, Homo sapiens
ctctgggttcactgaggctctg

SEQ ID NO: 9068256 - DNA, 22 bp, Homo sapiens
ctctgggttcactgaggctctg

SEQ ID NO: 9068257 - DNA, 22 bp, Homo sapiens
ctgaacattcttgaacatctgt

SEQ ID NO: 9068258 - DNA, 22 bp, Homo sapiens
ctgaagagaaagggagctcttc

SEQ ID NO: 9068259 - DNA, 22 bp, Homo sapiens
ctgaagagaaagggagctcttc

SEQ ID NO: 9068260 - DNA, 22 bp, Homo sapiens
ctgaagagaaagggagctcttc

SEQ ID NO: 9068261 - DNA, 20 bp, Homo sapiens
ctgaagagactggaggggca

SEQ ID NO: 9068262 - DNA, 22 bp, Homo sapiens
ctgaagagactggagggggcat

SEQ ID NO: 9068263 - DNA, 22 bp, Homo sapiens
ctgaacttattgagtgcttgct

SEQ ID NO: 9068264 - DNA, 22 bp, Homo sapiens
ctgaagaaatatgattgcttaa

SEQ ID NO: 9068265 - DNA, 18 bp, Homo sapiens
ctgaagacaaaatgtcca

SEQ ID NO: 9068266 - DNA, 22 bp, Homo sapiens
ctgaagatgtctgagatgctca

SEQ ID NO: 9068267 - DNA, 22 bp, Homo sapiens
ctgaagatgtctgagatgctca

SEQ ID NO: 9068268 - DNA, 22 bp, Homo sapiens
ctgactgtctcttctcccatga

SEQ ID NO: 9068269 - DNA, 22 bp, Homo sapiens
ctgactgtgagagcaggaatgg

SEQ ID NO: 9068270 - DNA, 22 bp, Homo sapiens
ctgaagaggacgcagcagcaag

SEQ ID NO: 9068271 - DNA, 22 bp, Homo sapiens
ctgaagaggacgcagcagcaag

SEQ ID NO: 9068272 - DNA, 22 bp, Homo sapiens
ctgactgttgctgttgatgagg

SEQ ID NO: 9068273 - DNA, 22 bp, Homo sapiens
ctgactgttgctgttgatgagg

SEQ ID NO: 9068274 - DNA, 22 bp, Homo sapiens
ctgactgtttgctgaaaggtct

SEQ ID NO: 9068275 - DNA, 22 bp, Homo sapiens
ctgacttcagggataaaaagta

SEQ ID NO: 9068276 - DNA, 22 bp, Homo sapiens
ctgagaacatcattcagatatt

SEQ ID NO: 9068277 - DNA, 22 bp, Homo sapiens
ctgagaataaagccagcaggag

SEQ ID NO: 9068278 - DNA, 22 bp, Homo sapiens
ctgagaataaagccagcaggag

SEQ ID NO: 9068279 - DNA, 22 bp, Homo sapiens
ctgagaatggacagcagggcag

SEQ ID NO: 9068280 - DNA, 22 bp, Homo sapiens
cccagggaggtagcaggagaaa

SEQ ID NO: 9068281 - DNA, 22 bp, Homo sapiens
cccagggaggtagcaggagaaa

SEQ ID NO: 9068282 - DNA, 22 bp, Homo sapiens
cccagggaggtagcaggagaaa

SEQ ID NO: 9068283 - DNA, 22 bp, Homo sapiens
cccagggatgtggcagatgtta

SEQ ID NO: 9068284 - DNA, 22 bp, Homo sapiens
cccagggatgtggcagatgtta

SEQ ID NO: 9068285 - DNA, 22 bp, Homo sapiens
tgctgaagtccaagagctccaa

SEQ ID NO: 9068286 - DNA, 22 bp, Homo sapiens
cccagggagagcgcggaggcgg

SEQ ID NO: 9068287 - DNA, 22 bp, Homo sapiens
cccagggactcgggattctagg

SEQ ID NO: 9068288 - DNA, 22 bp, Homo sapiens
cccagggagcttggagaacggg

SEQ ID NO: 9068289 - DNA, 22 bp, Homo sapiens
cccagggagcttggagaacggg

SEQ ID NO: 9068290 - DNA, 20 bp, Homo sapiens
cccagggacctgagctccat

SEQ ID NO: 9068291 - DNA, 22 bp, Homo sapiens
tgctcccaaacgacctactgtg

SEQ ID NO: 9068292 - DNA, 17 bp, Homo sapiens
cccagggaccactgctt

SEQ ID NO: 9068293 - DNA, 22 bp, Homo sapiens
tgctcccaaacgacctactgtg

SEQ ID NO: 9068294 - DNA, 22 bp, Homo sapiens
tgctcccacactactcggaggc

SEQ ID NO: 9068295 - DNA, 22 bp, Homo sapiens
tgctgaataagacgtggcttgt

SEQ ID NO: 9068296 - DNA, 22 bp, Homo sapiens
tgctgaataaataaagtctatt

SEQ ID NO: 9068297 - DNA, 22 bp, Homo sapiens
tgctgaataaagatatattttc

SEQ ID NO: 9068298 - DNA, 22 bp, Homo sapiens
tgctgaataaagatatattttc

SEQ ID NO: 9068299 - DNA, 22 bp, Homo sapiens
tgctgaatatagagcaagaagt

SEQ ID NO: 9068300 - DNA, 22 bp, Homo sapiens
tgctgaataataagattactca

SEQ ID NO: 9068301 - DNA, 21 bp, Homo sapiens
tgctgaatctgccatattttc

SEQ ID NO: 9068302 - DNA, 22 bp, Homo sapiens
tgctgaatgaatggatggttgc

SEQ ID NO: 9068303 - DNA, 22 bp, Homo sapiens
tgctgaatcccaccctccagtg

SEQ ID NO: 9068304 - DNA, 22 bp, Homo sapiens
tgctgaatcaaaacaaaggttt

SEQ ID NO: 9068305 - DNA, 22 bp, Homo sapiens
tgctgaatcatatggtaattct

SEQ ID NO: 9068306 - DNA, 22 bp, Homo sapiens
tgctgaatttacatttttgtag

SEQ ID NO: 9068307 - DNA, 22 bp, Homo sapiens
tgctgaattggtagtactgttg

SEQ ID NO: 9068308 - DNA, 22 bp, Homo sapiens
tgctgaattctaccatccattt

SEQ ID NO: 9068309 - DNA, 22 bp, Homo sapiens
tgctgaattctcattccctgga

SEQ ID NO: 9068310 - DNA, 22 bp, Homo sapiens
tgctgaatttacatttttgtag

SEQ ID NO: 9068311 - DNA, 22 bp, Homo sapiens
tgctgacactattctaaaaagc

SEQ ID NO: 9068312 - DNA, 22 bp, Homo sapiens
tgctgaatgggtgattttggag

SEQ ID NO: 9068313 - DNA, 22 bp, Homo sapiens
tgctgaatgggatatgttgagc

SEQ ID NO: 9068314 - DNA, 22 bp, Homo sapiens
tgctgaatgctgcatgccgtat

SEQ ID NO: 9068315 - DNA, 22 bp, Homo sapiens
tgctgaatggtaaagaagtata

SEQ ID NO: 9068316 - DNA, 22 bp, Homo sapiens
tgctgaatgtgctcccttttaa

SEQ ID NO: 9068317 - DNA, 22 bp, Homo sapiens
tgctgaattaaactctatgtgg

SEQ ID NO: 9068318 - DNA, 22 bp, Homo sapiens
tgctgaattccagggccccact

SEQ ID NO: 9068319 - DNA, 22 bp, Homo sapiens
tgctgcagaaattctgtgagga

SEQ ID NO: 9068320 - DNA, 22 bp, Homo sapiens
tgctgagacagtggataggggc

SEQ ID NO: 9068321 - DNA, 21 bp, Homo sapiens
tgctcagtaaatgctgagtga

SEQ ID NO: 9068322 - DNA, 22 bp, Homo sapiens
cccaggctgagttagaggtgtc

SEQ ID NO: 9068323 - DNA, 21 bp, Homo sapiens
tgctcagtaaatgctgagtga

SEQ ID NO: 9068324 - DNA, 22 bp, Homo sapiens
cccaggctcttatgtgacttgc

SEQ ID NO: 9068325 - DNA, 22 bp, Homo sapiens
cccaggctcctgactcattcta

SEQ ID NO: 9068326 - DNA, 22 bp, Homo sapiens
cccaggctcctagaggcccaga

SEQ ID NO: 9068327 - DNA, 22 bp, Homo sapiens
cccaggctcctgctgtgttgac

SEQ ID NO: 9068328 - DNA, 22 bp, Homo sapiens
cccaggctcctgactcattcta

SEQ ID NO: 9068329 - DNA, 22 bp, Homo sapiens
tgctcagtagcagtgtgctgct

SEQ ID NO: 9068330 - DNA, 22 bp, Homo sapiens
tgctccaggtgtgcctctcatg

SEQ ID NO: 9068331 - DNA, 22 bp, Homo sapiens
tgctcccaaacctgacaggctc

SEQ ID NO: 9068332 - DNA, 22 bp, Homo sapiens
tgctccatgcgctcggccggcg

SEQ ID NO: 9068333 - DNA, 22 bp, Homo sapiens
tgctccatgcgctcggccggcg

SEQ ID NO: 9068334 - DNA, 20 bp, Homo sapiens
tgctccatctaaagtgatta

SEQ ID NO: 9068335 - DNA, 22 bp, Homo sapiens
cccaggctcctagaggcccaga

SEQ ID NO: 9068336 - DNA, 22 bp, Homo sapiens
tgcctgggcctctgaggaaggc

SEQ ID NO: 9068337 - DNA, 22 bp, Homo sapiens
tgcctgggatctgtgccctttg

SEQ ID NO: 9068338 - DNA, 22 bp, Homo sapiens
tgcctgggatctgtgccctttg

SEQ ID NO: 9068339 - DNA, 22 bp, Homo sapiens
tgcctgggagtgaccaagactc

SEQ ID NO: 9068340 - DNA, 22 bp, Homo sapiens
tgcctgggccttcccacctctg

SEQ ID NO: 9068341 - DNA, 22 bp, Homo sapiens
tgcctgggacatgctgtggact

SEQ ID NO: 9068342 - DNA, 22 bp, Homo sapiens
tgcctgggagtgaccaagactc

SEQ ID NO: 9068343 - DNA, 22 bp, Homo sapiens
tgcctgggagtgaccaagactc

SEQ ID NO: 9068344 - DNA, 20 bp, Homo sapiens
tgcctgggaaggcgtggagg

SEQ ID NO: 9068345 - DNA, 22 bp, Homo sapiens
tgcctgctcttgagacttacaa

SEQ ID NO: 9068346 - DNA, 22 bp, Homo sapiens
tgcctgggaaccaatcctggct

SEQ ID NO: 9068347 - DNA, 22 bp, Homo sapiens
tgcctgggaaccaatcctggct

SEQ ID NO: 9068348 - DNA, 22 bp, Homo sapiens
tgcctgctcttgagacttacaa

SEQ ID NO: 9068349 - DNA, 22 bp, Homo sapiens
ccccagggaagctttgcttact

SEQ ID NO: 9068350 - DNA, 22 bp, Homo sapiens
cccccacctgaggacagtctta

SEQ ID NO: 9068351 - DNA, 22 bp, Homo sapiens
cccccaccgtgttcctgctcgg

SEQ ID NO: 9068352 - DNA, 22 bp, Homo sapiens
cccccaccgtgttcctgctcgg

SEQ ID NO: 9068353 - DNA, 18 bp, Homo sapiens
cccccagccaaattctct

SEQ ID NO: 9068354 - DNA, 22 bp, Homo sapiens
cccccagctctgctgggtcccg

SEQ ID NO: 9068355 - DNA, 22 bp, Homo sapiens
cccccagccagcagtgctcagc

SEQ ID NO: 9068356 - DNA, 22 bp, Homo sapiens
cccctcaggtacccgtgcagca

SEQ ID NO: 9068357 - DNA, 21 bp, Homo sapiens
cccctcatacactctccttgc

SEQ ID NO: 9068358 - DNA, 22 bp, Homo sapiens
ccccctgcgcccggcacgtcat

SEQ ID NO: 9068359 - DNA, 22 bp, Homo sapiens
ccccgccctgcgcggggataac

SEQ ID NO: 9068360 - DNA, 22 bp, Homo sapiens
ccccctctgccggggtccttca

SEQ ID NO: 9068361 - DNA, 22 bp, Homo sapiens
cccccaggctctgacacaggag

SEQ ID NO: 9068362 - DNA, 22 bp, Homo sapiens
cccccaggctctgacacaggag

SEQ ID NO: 9068363 - DNA, 22 bp, Homo sapiens
cccctcattcatgtccttgctt

SEQ ID NO: 9068364 - DNA, 22 bp, Homo sapiens
cccctcctggccacactgtcag

SEQ ID NO: 9068365 - DNA, 22 bp, Homo sapiens
cccctcctggccacactgtcag

SEQ ID NO: 9068366 - DNA, 22 bp, Homo sapiens
cccctcgcctgcagagcacagc

SEQ ID NO: 9068367 - DNA, 22 bp, Homo sapiens
cccctctccctcacttatcaat

SEQ ID NO: 9068368 - DNA, 22 bp, Homo sapiens
cccctctgcaaatagccaggct

SEQ ID NO: 9068369 - DNA, 22 bp, Homo sapiens
cccctctggtcaaccagtcaca

SEQ ID NO: 9068370 - DNA, 21 bp, Homo sapiens
ccctcaggaaacagaatgcac

SEQ ID NO: 9068371 - DNA, 22 bp, Homo sapiens
ccctaggcccaaagggtgacat

SEQ ID NO: 9068372 - DNA, 22 bp, Homo sapiens
ccctcagcttctccctgcagct

SEQ ID NO: 9068373 - DNA, 22 bp, Homo sapiens
ccctcagcttctccctgcagct

SEQ ID NO: 9068374 - DNA, 22 bp, Homo sapiens
ccctcagggaccactgacttca

SEQ ID NO: 9068375 - DNA, 22 bp, Homo sapiens
tgctgcagctaaggtgaggtgc

SEQ ID NO: 9068376 - DNA, 22 bp, Homo sapiens
ccccacctgtgcgtctgccgca

SEQ ID NO: 9068377 - DNA, 22 bp, Homo sapiens
ccccaccttgcaattgttccct

SEQ ID NO: 9068378 - DNA, 22 bp, Homo sapiens
tgctgcagattgcagattaact

SEQ ID NO: 9068379 - DNA, 22 bp, Homo sapiens
tgctgcagatcagctgagtcct

SEQ ID NO: 9068380 - DNA, 22 bp, Homo sapiens
tgctgcagcagtgcgggcagct

SEQ ID NO: 9068381 - DNA, 22 bp, Homo sapiens
ccccagccagcaggacctctga

SEQ ID NO: 9068382 - DNA, 22 bp, Homo sapiens
ccccagccagcaggacctctga

SEQ ID NO: 9068383 - DNA, 22 bp, Homo sapiens
ccccagccagcaggacctctga

SEQ ID NO: 9068384 - DNA, 22 bp, Homo sapiens
ccccagccagcaggacctctga

SEQ ID NO: 9068385 - DNA, 22 bp, Homo sapiens
ccccagccagcaggacctctga

SEQ ID NO: 9068386 - DNA, 22 bp, Homo sapiens
ccccagccagcttgtagtagaa

SEQ ID NO: 9068387 - DNA, 22 bp, Homo sapiens
ccccagccagcttgtagtagaa

SEQ ID NO: 9068388 - DNA, 22 bp, Homo sapiens
ccccagccagcttgtagtagaa

SEQ ID NO: 9068389 - DNA, 22 bp, Homo sapiens
ccccagcagcacctggggcagt

SEQ ID NO: 9068390 - DNA, 22 bp, Homo sapiens
ccccagcaggaatacaggggtc

SEQ ID NO: 9068391 - DNA, 22 bp, Homo sapiens
ccccagcagactcagggcaggt

SEQ ID NO: 9068392 - DNA, 22 bp, Homo sapiens
ccccagcagactcagggcaggt

SEQ ID NO: 9068393 - DNA, 22 bp, Homo sapiens
ccccagcagactcagggcaggt

SEQ ID NO: 9068394 - DNA, 22 bp, Homo sapiens
tgctggagagccttggccaagg

SEQ ID NO: 9068395 - DNA, 22 bp, Homo sapiens
tgctggagatcattaatgttca

SEQ ID NO: 9068396 - DNA, 22 bp, Homo sapiens
ccccaggcctgttggatggcgc

SEQ ID NO: 9068397 - DNA, 22 bp, Homo sapiens
ccccaggcctgttggatggcgc

SEQ ID NO: 9068398 - DNA, 22 bp, Homo sapiens
tgctggagcaacattattgtgc

SEQ ID NO: 9068399 - DNA, 22 bp, Homo sapiens
tgctggagacctgcttgcacca

SEQ ID NO: 9068400 - DNA, 22 bp, Homo sapiens
ccccagccttccatgggaattg

SEQ ID NO: 9068401 - DNA, 22 bp, Homo sapiens
ccccagccttccatgggaattg

SEQ ID NO: 9068402 - DNA, 22 bp, Homo sapiens
ccccagcccacaagcatattaa

SEQ ID NO: 9068403 - DNA, 22 bp, Homo sapiens
ccccagcccacaagcatattaa

SEQ ID NO: 9068404 - DNA, 22 bp, Homo sapiens
ccccagcccacaagcatattaa

SEQ ID NO: 9068405 - DNA, 22 bp, Homo sapiens
tgccacagacaggacagaacag

SEQ ID NO: 9068406 - DNA, 22 bp, Homo sapiens
tgccaagggtatgggcaagata

SEQ ID NO: 9068407 - DNA, 22 bp, Homo sapiens
tgccaagtggagctcaggaatc

SEQ ID NO: 9068408 - DNA, 23 bp, Homo sapiens
tgccacaagatctgtgaataaga

SEQ ID NO: 9068409 - DNA, 22 bp, Homo sapiens
tgccaagtttctctcagggact

SEQ ID NO: 9068410 - DNA, 22 bp, Homo sapiens
tgccaagaggtccaggtgggaa

SEQ ID NO: 9068411 - DNA, 23 bp, Homo sapiens
tgcattatcctctctgaagacca

SEQ ID NO: 9068412 - DNA, 22 bp, Homo sapiens
tgcattatcatctggaagcttg

SEQ ID NO: 9068413 - DNA, 23 bp, Homo sapiens
tgcattatcctctctgaagacca

SEQ ID NO: 9068414 - DNA, 22 bp, Homo sapiens
tgcattatcgtcttgatcctct

SEQ ID NO: 9068415 - DNA, 22 bp, Homo sapiens
tgcattatacttttagaaattt

SEQ ID NO: 9068416 - DNA, 22 bp, Homo sapiens
tgcattatacttttagaaattt

SEQ ID NO: 9068417 - DNA, 15 bp, Homo sapiens
tgcattatcaataga

SEQ ID NO: 9068418 - DNA, 22 bp, Homo sapiens
tgcattatacatggatctaaag

SEQ ID NO: 9068419 - DNA, 22 bp, Homo sapiens
tgcattatgcttgtgctgtata

SEQ ID NO: 9068420 - DNA, 22 bp, Homo sapiens
tgcattattacaaggtaagact

SEQ ID NO: 9068421 - DNA, 22 bp, Homo sapiens
tgcattatggctgagtctctca

SEQ ID NO: 9068422 - DNA, 22 bp, Homo sapiens
tgcattattacaaggtaagact

SEQ ID NO: 9068423 - DNA, 22 bp, Homo sapiens
tgcattatgctacccagaagct

SEQ ID NO: 9068424 - DNA, 22 bp, Homo sapiens
tgcattatctttaatgttctca

SEQ ID NO: 9068425 - DNA, 22 bp, Homo sapiens
tgcattattcttttttggtagg

SEQ ID NO: 9068426 - DNA, 22 bp, Homo sapiens
tgcattattgaaggccctgtgg

SEQ ID NO: 9068427 - DNA, 22 bp, Homo sapiens
tgcattatttgcatgtgcctgt

SEQ ID NO: 9068428 - DNA, 22 bp, Homo sapiens
tgcattcaaatcctgatcctgc

SEQ ID NO: 9068429 - DNA, 22 bp, Homo sapiens
tgccaggcctcaggagtctcca

SEQ ID NO: 9068430 - DNA, 22 bp, Homo sapiens
tgccaggcctcaggagtctcca

SEQ ID NO: 9068431 - DNA, 22 bp, Homo sapiens
cccaggaggtgtgcccaactcg

SEQ ID NO: 9068432 - DNA, 22 bp, Homo sapiens
cccaggaggttgaggctgcagt

SEQ ID NO: 9068433 - DNA, 22 bp, Homo sapiens
cccaggaggtggagttcacagt

SEQ ID NO: 9068434 - DNA, 21 bp, Homo sapiens
cccaggaggctgagaagagca

SEQ ID NO: 9068435 - DNA, 21 bp, Homo sapiens
cccaggaggctgagaagagca

SEQ ID NO: 9068436 - DNA, 22 bp, Homo sapiens
cccaggaggtggaggctgcagt

SEQ ID NO: 9068437 - DNA, 22 bp, Homo sapiens
cccaggaggtggaggttgcagt

SEQ ID NO: 9068438 - DNA, 22 bp, Homo sapiens
cccaggaggtggaggttgcagt

SEQ ID NO: 9068439 - DNA, 22 bp, Homo sapiens
cccaggaggtggaggttgcagc

SEQ ID NO: 9068440 - DNA, 22 bp, Homo sapiens
cccaggaggtggaggttgcagc

SEQ ID NO: 9068441 - DNA, 22 bp, Homo sapiens
cccaggaggtggaggctgcagt

SEQ ID NO: 9068442 - DNA, 22 bp, Homo sapiens
cccaggaggtggaggctgcagt

SEQ ID NO: 9068443 - DNA, 22 bp, Homo sapiens
tgccaggcgtggtggtgcgcac

SEQ ID NO: 9068444 - DNA, 22 bp, Homo sapiens
cccaggatgtcgaggctgcagt

SEQ ID NO: 9068445 - DNA, 21 bp, Homo sapiens
tgccaggcctgagctggggtc

SEQ ID NO: 9068446 - DNA, 21 bp, Homo sapiens
tgccaggcctgagctggggtc

SEQ ID NO: 9068447 - DNA, 22 bp, Homo sapiens
cccaggcacatccactctgtga

SEQ ID NO: 9068448 - DNA, 22 bp, Homo sapiens
cccaggcacagattatcccaat

SEQ ID NO: 9068449 - DNA, 22 bp, Homo sapiens
cccaggcagagagctggtgagc

SEQ ID NO: 9068450 - DNA, 22 bp, Homo sapiens
cccaggcagaattagtgtttca

SEQ ID NO: 9068451 - DNA, 22 bp, Homo sapiens
cccaggcagggacgtgctctgg

SEQ ID NO: 9068452 - DNA, 22 bp, Homo sapiens
cccaggcagtgctgatccctca

SEQ ID NO: 9068453 - DNA, 22 bp, Homo sapiens
cccaggcagtgctgatccctca

SEQ ID NO: 9068454 - DNA, 22 bp, Homo sapiens
cccaggcagtgctgatccctca

SEQ ID NO: 9068455 - DNA, 16 bp, Homo sapiens
tgcctgctctgatctc

SEQ ID NO: 9068456 - DNA, 22 bp, Homo sapiens
cccaggcagcggggtctccttg

SEQ ID NO: 9068457 - DNA, 22 bp, Homo sapiens
cccaggcagcggggtctccttg

SEQ ID NO: 9068458 - DNA, 20 bp, Homo sapiens
cccaggcagagctagcggca

SEQ ID NO: 9068459 - DNA, 22 bp, Homo sapiens
cccaggcagccccagaagcttg

SEQ ID NO: 9068460 - DNA, 22 bp, Homo sapiens
cccaggcagccccagaagcttg

SEQ ID NO: 9068461 - DNA, 22 bp, Homo sapiens
cccaggaaaagcagtgccagca

SEQ ID NO: 9068462 - DNA, 19 bp, Homo sapiens
cccagcttgaccacctgct

SEQ ID NO: 9068463 - DNA, 22 bp, Homo sapiens
cccagctgtggcagaggccggg

SEQ ID NO: 9068464 - DNA, 23 bp, Homo sapiens
cccagctttcccactgccgagag

SEQ ID NO: 9068465 - DNA, 22 bp, Homo sapiens
tgcattaaaatgatggagaaat

SEQ ID NO: 9068466 - DNA, 22 bp, Homo sapiens
tgcatgtttgtgtctgagaact

SEQ ID NO: 9068467 - DNA, 22 bp, Homo sapiens
tgcattaaaatgtgcctctctt

SEQ ID NO: 9068468 - DNA, 22 bp, Homo sapiens
tgcattaaatataatctgttga

SEQ ID NO: 9068469 - DNA, 22 bp, Homo sapiens
tgcattaaatataatctgttga

SEQ ID NO: 9068470 - DNA, 22 bp, Homo sapiens
tgcattaaggccattgaaattt

SEQ ID NO: 9068471 - DNA, 22 bp, Homo sapiens
tgcattaagcacacttttgaat

SEQ ID NO: 9068472 - DNA, 22 bp, Homo sapiens
tgcattaagaatttctgaggat

SEQ ID NO: 9068473 - DNA, 22 bp, Homo sapiens
tgcattaaggtaattgtataat

SEQ ID NO: 9068474 - DNA, 22 bp, Homo sapiens
tgcattaagggcctggagatac

SEQ ID NO: 9068475 - DNA, 22 bp, Homo sapiens
tgcattataactgaatgttgtt

SEQ ID NO: 9068476 - DNA, 22 bp, Homo sapiens
tgcattaagtgtctgcatatgg

SEQ ID NO: 9068477 - DNA, 22 bp, Homo sapiens
cccagctcttttagcggcatct

SEQ ID NO: 9068478 - DNA, 22 bp, Homo sapiens
cccagctcttttagcggcatct

SEQ ID NO: 9068479 - DNA, 22 bp, Homo sapiens
cccagctcttcctgggagctaa

SEQ ID NO: 9068480 - DNA, 22 bp, Homo sapiens
cccagctcttttagcggcatct

SEQ ID NO: 9068481 - DNA, 22 bp, Homo sapiens
cccagctcttcaagtcaccccc

SEQ ID NO: 9068482 - DNA, 22 bp, Homo sapiens
cccagctcttcaagtcaccccc

SEQ ID NO: 9068483 - DNA, 22 bp, Homo sapiens
cccagctgcacctctatggcct

SEQ ID NO: 9068484 - DNA, 22 bp, Homo sapiens
cccagctgatttttgcagagat

SEQ ID NO: 9068485 - DNA, 22 bp, Homo sapiens
cccagctgatttttgcagagat

SEQ ID NO: 9068486 - DNA, 22 bp, Homo sapiens
cccagctgatttttgcagagat

SEQ ID NO: 9068487 - DNA, 22 bp, Homo sapiens
cccagctgatttttgcagagat

SEQ ID NO: 9068488 - DNA, 22 bp, Homo sapiens
cccagctgcacctctatggcct

SEQ ID NO: 9068489 - DNA, 23 bp, Homo sapiens
cccagctgcagacaagggagggt

SEQ ID NO: 9068490 - DNA, 23 bp, Homo sapiens
cccagctggaagttagaggacca

SEQ ID NO: 9068491 - DNA, 17 bp, Homo sapiens
cccagctggcagtgccg

SEQ ID NO: 9068492 - DNA, 17 bp, Homo sapiens
cccagctggcagtgccg

SEQ ID NO: 9068493 - DNA, 18 bp, Homo sapiens
cccagctggtgggtcagt

SEQ ID NO: 9068494 - DNA, 18 bp, Homo sapiens
cccagctggtgggtcagt

SEQ ID NO: 9068495 - DNA, 22 bp, Homo sapiens
cccagctgtaacgggtctgcac

SEQ ID NO: 9068496 - DNA, 22 bp, Homo sapiens
cccagctgtaacgggtctgcac

SEQ ID NO: 9068497 - DNA, 22 bp, Homo sapiens
cccagctctggaaggtggggga

SEQ ID NO: 9068498 - DNA, 22 bp, Homo sapiens
cccagctccttacagggccgaa

SEQ ID NO: 9068499 - DNA, 22 bp, Homo sapiens
cccagctccttacagggccgaa

SEQ ID NO: 9068500 - DNA, 22 bp, Homo sapiens
tgcagggaatgcttgcagcatg

SEQ ID NO: 9068501 - DNA, 22 bp, Homo sapiens
cccagcgagtttgccggtgaac

SEQ ID NO: 9068502 - DNA, 22 bp, Homo sapiens
cccagcgagtttgccggtgaac

SEQ ID NO: 9068503 - DNA, 22 bp, Homo sapiens
cccagcgagtttgccggtgaac

SEQ ID NO: 9068504 - DNA, 23 bp, Homo sapiens
cccagcgctgagccctgcaggca

SEQ ID NO: 9068505 - DNA, 22 bp, Homo sapiens
cccagctacctctgctaggaga

SEQ ID NO: 9068506 - DNA, 22 bp, Homo sapiens
cccagcctactctgccatagca

SEQ ID NO: 9068507 - DNA, 22 bp, Homo sapiens
cccagcctactctgccatagca

SEQ ID NO: 9068508 - DNA, 22 bp, Homo sapiens
cccagcctactctgccatagca

SEQ ID NO: 9068509 - DNA, 22 bp, Homo sapiens
cccagcctggtgcactgtgggg

SEQ ID NO: 9068510 - DNA, 22 bp, Homo sapiens
cccagcctactctgccatagca

SEQ ID NO: 9068511 - DNA, 22 bp, Homo sapiens
cccagcctgtgacagccgtcct

SEQ ID NO: 9068512 - DNA, 22 bp, Homo sapiens
cccagcctgtgacagccgtcct

SEQ ID NO: 9068513 - DNA, 22 bp, Homo sapiens
cccagcctgtgacagccgtcct

SEQ ID NO: 9068514 - DNA, 22 bp, Homo sapiens
cccagcctgtgacagccgtcct

SEQ ID NO: 9068515 - DNA, 22 bp, Homo sapiens
cccagcctgtgacagccgtcct

SEQ ID NO: 9068516 - DNA, 22 bp, Homo sapiens
cccagcctgtgacagccgtcct

SEQ ID NO: 9068517 - DNA, 22 bp, Homo sapiens
cccagcctgtgacagccgtcct

SEQ ID NO: 9068518 - DNA, 22 bp, Homo sapiens
cccagcctgtctttcccaatga

SEQ ID NO: 9068519 - DNA, 22 bp, Homo sapiens
cccagcctggtgcactgtgggg

SEQ ID NO: 9068520 - DNA, 22 bp, Homo sapiens
cccagcctggtgcactgtgggg

SEQ ID NO: 9068521 - DNA, 22 bp, Homo sapiens
cccagcctgtctttcccaatga

SEQ ID NO: 9068522 - DNA, 22 bp, Homo sapiens
cccagcctgtctttcccaatga

SEQ ID NO: 9068523 - DNA, 22 bp, Homo sapiens
cccagcctttgcttcctggttc

SEQ ID NO: 9068524 - DNA, 22 bp, Homo sapiens
cccagcctttgcttcctggttc

SEQ ID NO: 9068525 - DNA, 22 bp, Homo sapiens
cccagcctttgcttcctggttc

SEQ ID NO: 9068526 - DNA, 22 bp, Homo sapiens
cccagcctttgcttcctggttc

SEQ ID NO: 9068527 - DNA, 22 bp, Homo sapiens
cccagcctttgcttcctggttc

SEQ ID NO: 9068528 - DNA, 22 bp, Homo sapiens
cccagccttccaccctggacta

SEQ ID NO: 9068529 - DNA, 22 bp, Homo sapiens
cccagccttccaccctggacta

SEQ ID NO: 9068530 - DNA, 22 bp, Homo sapiens
cccagccttccaccctggacta

SEQ ID NO: 9068531 - DNA, 22 bp, Homo sapiens
cccagccttccaccctggacta

SEQ ID NO: 9068532 - DNA, 22 bp, Homo sapiens
ccctccagccatggacccaggt

SEQ ID NO: 9068533 - DNA, 20 bp, Homo sapiens
ccctccagcaaccaggactt

SEQ ID NO: 9068534 - DNA, 22 bp, Homo sapiens
ccctccagagcttgacctgctg

SEQ ID NO: 9068535 - DNA, 22 bp, Homo sapiens
ccctccagagcttgacctgctg

SEQ ID NO: 9068536 - DNA, 22 bp, Homo sapiens
ccctcagtctggctgggaagac

SEQ ID NO: 9068537 - DNA, 22 bp, Homo sapiens
ccctcagttttccagtgtgggc

SEQ ID NO: 9068538 - DNA, 22 bp, Homo sapiens
ccctccagagcctggacattct

SEQ ID NO: 9068539 - DNA, 22 bp, Homo sapiens
ccctccaggcctgtcatgttcc

SEQ ID NO: 9068540 - DNA, 22 bp, Homo sapiens
ccctccagctcaaagcaaccgg

SEQ ID NO: 9068541 - DNA, 22 bp, Homo sapiens
ccctccaggcactgccctcttc

SEQ ID NO: 9068542 - DNA, 22 bp, Homo sapiens
ccctggactgttcagggcctga

SEQ ID NO: 9068543 - DNA, 20 bp, Homo sapiens
ccctggagagaagctccacg

SEQ ID NO: 9068544 - DNA, 20 bp, Homo sapiens
ccctggagagaagctccacg

SEQ ID NO: 9068545 - DNA, 22 bp, Homo sapiens
ccctggagatcgggagaggaag

SEQ ID NO: 9068546 - DNA, 22 bp, Homo sapiens
ccctggagcatctctgctgtct

SEQ ID NO: 9068547 - DNA, 22 bp, Homo sapiens
ccctggagctagtctgagcaga

SEQ ID NO: 9068548 - DNA, 22 bp, Homo sapiens
tggagctgagagccaggctggc

SEQ ID NO: 9068549 - DNA, 22 bp, Homo sapiens
tggagctgagaagtggagctct

SEQ ID NO: 9068550 - DNA, 22 bp, Homo sapiens
tggagctgagaagtggagctct

SEQ ID NO: 9068551 - DNA, 22 bp, Homo sapiens
tggagctgagagccaggctggc

SEQ ID NO: 9068552 - DNA, 22 bp, Homo sapiens
tggagctgagagttaataagga

SEQ ID NO: 9068553 - DNA, 22 bp, Homo sapiens
tggagctgagagccaggctggc

SEQ ID NO: 9068554 - DNA, 22 bp, Homo sapiens
tggagctgagagccaggctggc

SEQ ID NO: 9068555 - DNA, 22 bp, Homo sapiens
tggagctgactcacaccagcta

SEQ ID NO: 9068556 - DNA, 22 bp, Homo sapiens
tggagctgactcacaccagcta

SEQ ID NO: 9068557 - DNA, 23 bp, Homo sapiens
tggagctgacagtcagagggagg

SEQ ID NO: 9068558 - DNA, 22 bp, Homo sapiens
tggagctgagaagtggagctct

SEQ ID NO: 9068559 - DNA, 22 bp, Homo sapiens
tggagctgagaagtggagctct

SEQ ID NO: 9068560 - DNA, 22 bp, Homo sapiens
tggagctgactcacaccagcta

SEQ ID NO: 9068561 - DNA, 21 bp, Homo sapiens
tggatctgtgatctggggcac

SEQ ID NO: 9068562 - DNA, 22 bp, Homo sapiens
tggatctggttccctgagcctt

SEQ ID NO: 9068563 - DNA, 22 bp, Homo sapiens
tggatctgactggcttttcttc

SEQ ID NO: 9068564 - DNA, 22 bp, Homo sapiens
tggatgagattaaagtgaggtt

SEQ ID NO: 9068565 - DNA, 22 bp, Homo sapiens
tggatgaggctgggttaggcag

SEQ ID NO: 9068566 - DNA, 18 bp, Homo sapiens
tggatctttatgaggctg

SEQ ID NO: 9068567 - DNA, 22 bp, Homo sapiens
tggatgagaaactctggtgact

SEQ ID NO: 9068568 - DNA, 22 bp, Homo sapiens
tggatgagttcaatgaggcaga

SEQ ID NO: 9068569 - DNA, 22 bp, Homo sapiens
tggatgagttcaatgaggcaga

SEQ ID NO: 9068570 - DNA, 22 bp, Homo sapiens
tggatgagggctgagcactggg

SEQ ID NO: 9068571 - DNA, 22 bp, Homo sapiens
tggatgagggctgagcactggg

SEQ ID NO: 9068572 - DNA, 22 bp, Homo sapiens
tggatgagtctgagattgggca

SEQ ID NO: 9068573 - DNA, 22 bp, Homo sapiens
tggatgagtctgagattgggca

SEQ ID NO: 9068574 - DNA, 22 bp, Homo sapiens
tggcaacttgcaacctcattct

SEQ ID NO: 9068575 - DNA, 22 bp, Homo sapiens
tggcaagagggatgcaaggttt

SEQ ID NO: 9068576 - DNA, 22 bp, Homo sapiens
tggcaagctcgtttgggtcaga

SEQ ID NO: 9068577 - DNA, 17 bp, Homo sapiens
ccctggctctaggtgga

SEQ ID NO: 9068578 - DNA, 23 bp, Homo sapiens
ccctggccttggggcacaggctg

SEQ ID NO: 9068579 - DNA, 22 bp, Homo sapiens
ccctggctctgcctcagagccc

SEQ ID NO: 9068580 - DNA, 22 bp, Homo sapiens
ccctggctcttcaccacctgcc

SEQ ID NO: 9068581 - DNA, 22 bp, Homo sapiens
ccctggctcttcaccacctgcc

SEQ ID NO: 9068582 - DNA, 22 bp, Homo sapiens
ccctggctcttcaccacctgcc

SEQ ID NO: 9068583 - DNA, 18 bp, Homo sapiens
tggagctgagggcaatgc

SEQ ID NO: 9068584 - DNA, 22 bp, Homo sapiens
tggagctgagcacctccagggc

SEQ ID NO: 9068585 - DNA, 22 bp, Homo sapiens
tggagctgagcacctccagggc

SEQ ID NO: 9068586 - DNA, 22 bp, Homo sapiens
tggagctgagcacctccagggc

SEQ ID NO: 9068587 - DNA, 22 bp, Homo sapiens
tggcagattctggttgatactt

SEQ ID NO: 9068588 - DNA, 22 bp, Homo sapiens
tggcagatgtggtttgagacag

SEQ ID NO: 9068589 - DNA, 22 bp, Homo sapiens
tggcagatgtatatcacagctt

SEQ ID NO: 9068590 - DNA, 22 bp, Homo sapiens
tggcagatgtggcatagagcat

SEQ ID NO: 9068591 - DNA, 22 bp, Homo sapiens
tggcagattgtaggcagttagg

SEQ ID NO: 9068592 - DNA, 22 bp, Homo sapiens
tggcagattttctctggaggag

SEQ ID NO: 9068593 - DNA, 22 bp, Homo sapiens
tggcagatgcgttttcattttc

SEQ ID NO: 9068594 - DNA, 22 bp, Homo sapiens
tggcagcaaaaccagaatcaga

SEQ ID NO: 9068595 - DNA, 22 bp, Homo sapiens
tggcagattttgaagacagaga

SEQ ID NO: 9068596 - DNA, 22 bp, Homo sapiens
tggcagcaatagaaatataatc

SEQ ID NO: 9068597 - DNA, 22 bp, Homo sapiens
tggcagcaaaaccagaatcaga

SEQ ID NO: 9068598 - DNA, 22 bp, Homo sapiens
tggcagcaattagctagagctg

SEQ ID NO: 9068599 - DNA, 22 bp, Homo sapiens
tggcagcaatttgtgatgttga

SEQ ID NO: 9068600 - DNA, 22 bp, Homo sapiens
tggcagcacaaggtggcccatg

SEQ ID NO: 9068601 - DNA, 22 bp, Homo sapiens
tggcagcaccagcagtgtcctt

SEQ ID NO: 9068602 - DNA, 22 bp, Homo sapiens
tggcagcacattgacccgggct

SEQ ID NO: 9068603 - DNA, 21 bp, Homo sapiens
tggcagcacccacaccctctg

SEQ ID NO: 9068604 - DNA, 22 bp, Homo sapiens
tggcagcactaggtactgagct

SEQ ID NO: 9068605 - DNA, 22 bp, Homo sapiens
tggcagcactaggtactgagct

SEQ ID NO: 9068606 - DNA, 22 bp, Homo sapiens
tggcagcacggcatccactctc

SEQ ID NO: 9068607 - DNA, 22 bp, Homo sapiens
tggcagctggagggcaatggcc

SEQ ID NO: 9068608 - DNA, 22 bp, Homo sapiens
tggcagcactaggtactgagct

SEQ ID NO: 9068609 - DNA, 22 bp, Homo sapiens
tggcagctggagggcaatggcc

SEQ ID NO: 9068610 - DNA, 22 bp, Homo sapiens
tggcagctggatcccaaggcag

SEQ ID NO: 9068611 - DNA, 22 bp, Homo sapiens
tggcacagggcttggtcgctca

SEQ ID NO: 9068612 - DNA, 22 bp, Homo sapiens
tggcacagtcctgggtgcctgc

SEQ ID NO: 9068613 - DNA, 22 bp, Homo sapiens
tggcacaggagcactgccctgg

SEQ ID NO: 9068614 - DNA, 22 bp, Homo sapiens
tggcacaggatctcagcggcca

SEQ ID NO: 9068615 - DNA, 22 bp, Homo sapiens
tggcacaggatctcagcggcca

SEQ ID NO: 9068616 - DNA, 22 bp, Homo sapiens
tggcaaggctgtgggggcagag

SEQ ID NO: 9068617 - DNA, 22 bp, Homo sapiens
tggcaaggctgtgggggcagag

SEQ ID NO: 9068618 - DNA, 22 bp, Homo sapiens
tggcaaggccacaggtgcagtt

SEQ ID NO: 9068619 - DNA, 22 bp, Homo sapiens
tggcaaggctgtgggggcagag

SEQ ID NO: 9068620 - DNA, 22 bp, Homo sapiens
tggcaaggctgtgggggcagag

SEQ ID NO: 9068621 - DNA, 23 bp, Homo sapiens
tggcaaggaatgggatggagact

SEQ ID NO: 9068622 - DNA, 23 bp, Homo sapiens
tggcaaggaatgggatggagact

SEQ ID NO: 9068623 - DNA, 22 bp, Homo sapiens
tggcaaggccacaggtgcagtt

SEQ ID NO: 9068624 - DNA, 22 bp, Homo sapiens
tggcaaggccacaggtgcagtt

SEQ ID NO: 9068625 - DNA, 22 bp, Homo sapiens
tggcaaggccacaggtgcagtt

SEQ ID NO: 9068626 - DNA, 22 bp, Homo sapiens
tggcaagggattgtggagaact

SEQ ID NO: 9068627 - DNA, 22 bp, Homo sapiens
tggcacaggaatttagatgcag

SEQ ID NO: 9068628 - DNA, 22 bp, Homo sapiens
tggcacaggaatttagatgcag

SEQ ID NO: 9068629 - DNA, 22 bp, Homo sapiens
tggcagcttcctgctcatagga

SEQ ID NO: 9068630 - DNA, 22 bp, Homo sapiens
tggcagcttcctgctcatagga

SEQ ID NO: 9068631 - DNA, 22 bp, Homo sapiens
tggcagcttcctgctcatagga

SEQ ID NO: 9068632 - DNA, 22 bp, Homo sapiens
tggcagctgtgtccaggtagaa

SEQ ID NO: 9068633 - DNA, 23 bp, Homo sapiens
tggcagctgtgtaagagaaagca

SEQ ID NO: 9068634 - DNA, 22 bp, Homo sapiens
tggcagctggctctgcgcaggc

SEQ ID NO: 9068635 - DNA, 22 bp, Homo sapiens
tggcagctgtcagaatgcaaat

SEQ ID NO: 9068636 - DNA, 22 bp, Homo sapiens
tggcagctgtgcttcattcttt

SEQ ID NO: 9068637 - DNA, 23 bp, Homo sapiens
tggcagctgtgtaagagaaagca

SEQ ID NO: 9068638 - DNA, 22 bp, Homo sapiens
tggccagctttgactgtaaacc

SEQ ID NO: 9068639 - DNA, 22 bp, Homo sapiens
tggccagctttttgtagtgctc

SEQ ID NO: 9068640 - DNA, 22 bp, Homo sapiens
tggccaggaggctgcttctgac

SEQ ID NO: 9068641 - DNA, 22 bp, Homo sapiens
tggccaggaggctgcttctgac

SEQ ID NO: 9068642 - DNA, 22 bp, Homo sapiens
tggccaggaggctgcttctgac

SEQ ID NO: 9068643 - DNA, 22 bp, Homo sapiens
tggccaggaggctgcttctgac

SEQ ID NO: 9068644 - DNA, 22 bp, Homo sapiens
tggccagctgtaggttgtgcag

SEQ ID NO: 9068645 - DNA, 21 bp, Homo sapiens
tggccagctggagtctccaca

SEQ ID NO: 9068646 - DNA, 21 bp, Homo sapiens
tggccagctggagtctccaca

SEQ ID NO: 9068647 - DNA, 22 bp, Homo sapiens
tggcagcttgaatgcagtcttt

SEQ ID NO: 9068648 - DNA, 22 bp, Homo sapiens
tggcagctttttgtttcaggct

SEQ ID NO: 9068649 - DNA, 22 bp, Homo sapiens
cctagtccccaggaggtcagtg

SEQ ID NO: 9068650 - DNA, 22 bp, Homo sapiens
cctatgaagatgttgaggctgg

SEQ ID NO: 9068651 - DNA, 22 bp, Homo sapiens
cctatgaaacgtaatggaatgt

SEQ ID NO: 9068652 - DNA, 22 bp, Homo sapiens
cctagggagcctgagagcagtg

SEQ ID NO: 9068653 - DNA, 22 bp, Homo sapiens
cctaggccttactttcctgtgc

SEQ ID NO: 9068654 - DNA, 22 bp, Homo sapiens
cctaggcttgttttcatcagct

SEQ ID NO: 9068655 - DNA, 22 bp, Homo sapiens
tggccaggcaggtagaacggcc

SEQ ID NO: 9068656 - DNA, 22 bp, Homo sapiens
tggccaggcaggtagaacggcc

SEQ ID NO: 9068657 - DNA, 22 bp, Homo sapiens
tggccaggcaggtagaacggcc

SEQ ID NO: 9068658 - DNA, 22 bp, Homo sapiens
tggccaggcaggtagaacggcc

SEQ ID NO: 9068659 - DNA, 23 bp, Homo sapiens
tggccaggcataaaggtgggtgg

SEQ ID NO: 9068660 - DNA, 22 bp, Homo sapiens
cctaggccctcaaagagcataa

SEQ ID NO: 9068661 - DNA, 22 bp, Homo sapiens
cctaggccctcaaagagcataa

SEQ ID NO: 9068662 - DNA, 23 bp, Homo sapiens
tggccaggcataaaggtgggtgg

SEQ ID NO: 9068663 - DNA, 20 bp, Homo sapiens
tggcccagtggggcagggtg

SEQ ID NO: 9068664 - DNA, 22 bp, Homo sapiens
tggccccatcaagggatgagtt

SEQ ID NO: 9068665 - DNA, 20 bp, Homo sapiens
tggcccagtggggcagggtg

SEQ ID NO: 9068666 - DNA, 20 bp, Homo sapiens
tggcccagtggggcagggtg

SEQ ID NO: 9068667 - DNA, 22 bp, Homo sapiens
cctatggctcctgccctggagt

SEQ ID NO: 9068668 - DNA, 22 bp, Homo sapiens
tggcccagccctgctctagggc

SEQ ID NO: 9068669 - DNA, 22 bp, Homo sapiens
tggcccagcagttctgccccag

SEQ ID NO: 9068670 - DNA, 22 bp, Homo sapiens
tggcccagtgcttatgctctga

SEQ ID NO: 9068671 - DNA, 22 bp, Homo sapiens
tggcccctgaggagcgtcagcc

SEQ ID NO: 9068672 - DNA, 22 bp, Homo sapiens
tggcccctgaggagcatcagcc

SEQ ID NO: 9068673 - DNA, 22 bp, Homo sapiens
tggcccctggcacacggaggat

SEQ ID NO: 9068674 - DNA, 18 bp, Homo sapiens
tggccccttatcagtcct

SEQ ID NO: 9068675 - DNA, 22 bp, Homo sapiens
tggccctgctggacacgcctgc

SEQ ID NO: 9068676 - DNA, 22 bp, Homo sapiens
tggccctgctggccaaaggcta

SEQ ID NO: 9068677 - DNA, 22 bp, Homo sapiens
tggccctgctatgatcctgcaa

SEQ ID NO: 9068678 - DNA, 22 bp, Homo sapiens
tggctcagtttgggggattgaa

SEQ ID NO: 9068679 - DNA, 22 bp, Homo sapiens
tggctcagtttagcagctcagt

SEQ ID NO: 9068680 - DNA, 22 bp, Homo sapiens
tggctcagtttagcagctcagt

SEQ ID NO: 9068681 - DNA, 22 bp, Homo sapiens
tggccctgcttatgtctctctt

SEQ ID NO: 9068682 - DNA, 21 bp, Homo sapiens
tggctcagttgctgggcacag

SEQ ID NO: 9068683 - DNA, 22 bp, Homo sapiens
tggccctgctgtatcatctgct

SEQ ID NO: 9068684 - DNA, 22 bp, Homo sapiens
tggccctgctgggtcagagctg

SEQ ID NO: 9068685 - DNA, 22 bp, Homo sapiens
tggccctgctgggtcagagctg

SEQ ID NO: 9068686 - DNA, 22 bp, Homo sapiens
tggccctgctgggtcagagctg

SEQ ID NO: 9068687 - DNA, 22 bp, Homo sapiens
cctccctgtctacctgttgtgg

SEQ ID NO: 9068688 - DNA, 22 bp, Homo sapiens
cctccctggtggctctggtcta

SEQ ID NO: 9068689 - DNA, 22 bp, Homo sapiens
cctccctggtggctctggtcta

SEQ ID NO: 9068690 - DNA, 22 bp, Homo sapiens
cctccctggccagagcagcagc

SEQ ID NO: 9068691 - DNA, 22 bp, Homo sapiens
cctccctgctcctcaactggca

SEQ ID NO: 9068692 - DNA, 22 bp, Homo sapiens
cctccctgctcctcaactggca

SEQ ID NO: 9068693 - DNA, 22 bp, Homo sapiens
cctccctgggtgacgggctcct

SEQ ID NO: 9068694 - DNA, 22 bp, Homo sapiens
cctccctggtggctctggtcta

SEQ ID NO: 9068695 - DNA, 22 bp, Homo sapiens
cctcctctgggaagattcagag

SEQ ID NO: 9068696 - DNA, 22 bp, Homo sapiens
cctcctggtccagcatctcttt

SEQ ID NO: 9068697 - DNA, 23 bp, Homo sapiens
cctcctcatatctttgactagtg

SEQ ID NO: 9068698 - DNA, 22 bp, Homo sapiens
cctcggctgggccttggccact

SEQ ID NO: 9068699 - DNA, 22 bp, Homo sapiens
cctcgtgtgctaggatccaggt

SEQ ID NO: 9068700 - DNA, 22 bp, Homo sapiens
cctcggagcgggtcagagaggg

SEQ ID NO: 9068701 - DNA, 22 bp, Homo sapiens
cctcggaggcggaggctgcagt

SEQ ID NO: 9068702 - DNA, 22 bp, Homo sapiens
cctcggagcacgccggccgccc

SEQ ID NO: 9068703 - DNA, 18 bp, Homo sapiens
cctcggagcctccgtgtc

SEQ ID NO: 9068704 - DNA, 22 bp, Homo sapiens
cctccagccttcctgaagagcc

SEQ ID NO: 9068705 - DNA, 22 bp, Homo sapiens
cctccagccttcctgaagagcc

SEQ ID NO: 9068706 - DNA, 22 bp, Homo sapiens
cctccagcgcgatccactccgg

SEQ ID NO: 9068707 - DNA, 22 bp, Homo sapiens
tggctgagggggcagttcagga

SEQ ID NO: 9068708 - DNA, 22 bp, Homo sapiens
tggctgagggggcagttcagga

SEQ ID NO: 9068709 - DNA, 22 bp, Homo sapiens
tggctgaggtaactatgaataa

SEQ ID NO: 9068710 - DNA, 22 bp, Homo sapiens
tggctgagggggctctgctcag

SEQ ID NO: 9068711 - DNA, 23 bp, Homo sapiens
tggctgaggtccaggtagtttca

SEQ ID NO: 9068712 - DNA, 22 bp, Homo sapiens
cctccagcattactggcccatg

SEQ ID NO: 9068713 - DNA, 22 bp, Homo sapiens
cctccagcattactggcccatg

SEQ ID NO: 9068714 - DNA, 22 bp, Homo sapiens
cctccagcattactggcccatg

SEQ ID NO: 9068715 - DNA, 22 bp, Homo sapiens
cctccagagggtttcccatgaa

SEQ ID NO: 9068716 - DNA, 22 bp, Homo sapiens
cctccagactttggccatcctc

SEQ ID NO: 9068717 - DNA, 22 bp, Homo sapiens
cctccaagtttgactcaggaca

SEQ ID NO: 9068718 - DNA, 22 bp, Homo sapiens
cctccaagtttgactcaggaca

SEQ ID NO: 9068719 - DNA, 22 bp, Homo sapiens
cctccactctggcctctcaggt

SEQ ID NO: 9068720 - DNA, 22 bp, Homo sapiens
cctccactctggcctctcaggt

SEQ ID NO: 9068721 - DNA, 22 bp, Homo sapiens
cctctggctgtaccactggcac

SEQ ID NO: 9068722 - DNA, 22 bp, Homo sapiens
cctctggctcacagcaccaact

SEQ ID NO: 9068723 - DNA, 22 bp, Homo sapiens
cctctgaggtgagcccagctgg

SEQ ID NO: 9068724 - DNA, 22 bp, Homo sapiens
cctctgaggtcatggacttggc

SEQ ID NO: 9068725 - DNA, 22 bp, Homo sapiens
cctctggggcatcagacaaagg

SEQ ID NO: 9068726 - DNA, 22 bp, Homo sapiens
cctctgggggcttccttaccct

SEQ ID NO: 9068727 - DNA, 22 bp, Homo sapiens
cctctgggggcttccttaccct

SEQ ID NO: 9068728 - DNA, 22 bp, Homo sapiens
cctctggctcacagcaccaact

SEQ ID NO: 9068729 - DNA, 22 bp, Homo sapiens
cctctgggctgcctgcacgggt

SEQ ID NO: 9068730 - DNA, 22 bp, Homo sapiens
cctctgggctggaaaattaatg

SEQ ID NO: 9068731 - DNA, 22 bp, Homo sapiens
cctctgagagaaggccttcagc

SEQ ID NO: 9068732 - DNA, 22 bp, Homo sapiens
cctctgagaacacctggcgtcc

SEQ ID NO: 9068733 - DNA, 22 bp, Homo sapiens
cctctgagaccagctctgcacc

SEQ ID NO: 9068734 - DNA, 22 bp, Homo sapiens
cctctgagaccagctctgcacc

SEQ ID NO: 9068735 - DNA, 22 bp, Homo sapiens
cctctctttcctacaccttgga

SEQ ID NO: 9068736 - DNA, 18 bp, Homo sapiens
cctctgggttttgttccc

SEQ ID NO: 9068737 - DNA, 18 bp, Homo sapiens
cctctgggttttgttccc

SEQ ID NO: 9068738 - DNA, 22 bp, Homo sapiens
cctctgggttagtttagggagc

SEQ ID NO: 9068739 - DNA, 22 bp, Homo sapiens
cctctgtgacaaacagtcctgg

SEQ ID NO: 9068740 - DNA, 22 bp, Homo sapiens
cctctgtgacaaacagtcctgg

SEQ ID NO: 9068741 - DNA, 22 bp, Homo sapiens
cctctgtccccagtgcaggcct

SEQ ID NO: 9068742 - DNA, 22 bp, Homo sapiens
cctctgtgatttctgagccaat

SEQ ID NO: 9068743 - DNA, 22 bp, Homo sapiens
cctctgtgcaggaaatacatgt

SEQ ID NO: 9068744 - DNA, 22 bp, Homo sapiens
cctctgtgatttctgagccaat

SEQ ID NO: 9068745 - DNA, 22 bp, Homo sapiens
cctctgtgacttctaccttcac

SEQ ID NO: 9068746 - DNA, 22 bp, Homo sapiens
cctctggggtgagtgggccact

SEQ ID NO: 9068747 - DNA, 22 bp, Homo sapiens
cctctggggtgagtgggccact

SEQ ID NO: 9068748 - DNA, 22 bp, Homo sapiens
cctctgggggtcctcagagtct

SEQ ID NO: 9068749 - DNA, 22 bp, Homo sapiens
cctctggggtctagcaatagca

SEQ ID NO: 9068750 - DNA, 22 bp, Homo sapiens
cctctgggtatctgtggaagta

SEQ ID NO: 9068751 - DNA, 22 bp, Homo sapiens
cctctgggtatctgtggaagta

SEQ ID NO: 9068752 - DNA, 22 bp, Homo sapiens
cctctgggtgacagactcttgg

SEQ ID NO: 9068753 - DNA, 22 bp, Homo sapiens
cctctgggtgacagactcttgg

SEQ ID NO: 9068754 - DNA, 22 bp, Homo sapiens
cctctgggtgggaggccgggcg

SEQ ID NO: 9068755 - DNA, 22 bp, Homo sapiens
cctctgggtgggaggccgggcg

SEQ ID NO: 9068756 - DNA, 22 bp, Homo sapiens
tggctgcctttcacctcatctc

SEQ ID NO: 9068757 - DNA, 22 bp, Homo sapiens
tggctgccttccctgctggagg

SEQ ID NO: 9068758 - DNA, 20 bp, Homo sapiens
cctctctgcatgctccctga

SEQ ID NO: 9068759 - DNA, 22 bp, Homo sapiens
cctctctcttgtagtccctgcc

SEQ ID NO: 9068760 - DNA, 20 bp, Homo sapiens
cctctctgaagaggtcatct

SEQ ID NO: 9068761 - DNA, 22 bp, Homo sapiens
cctctctgtgtggcctctccat

SEQ ID NO: 9068762 - DNA, 22 bp, Homo sapiens
cctctctgtaagggtccctccc

SEQ ID NO: 9068763 - DNA, 22 bp, Homo sapiens
cctctctgtaagggtccctccc

SEQ ID NO: 9068764 - DNA, 22 bp, Homo sapiens
cctctctgtaagggtccctccc

SEQ ID NO: 9068765 - DNA, 22 bp, Homo sapiens
cctctaggatgtggctggagga

SEQ ID NO: 9068766 - DNA, 23 bp, Homo sapiens
cctctaataaacttgaccttgtg

SEQ ID NO: 9068767 - DNA, 21 bp, Homo sapiens
tggctgcctggctctgtggtt

SEQ ID NO: 9068768 - DNA, 22 bp, Homo sapiens
tggctgcctagtgtctgagcag

SEQ ID NO: 9068769 - DNA, 21 bp, Homo sapiens
tggctgcctacatgctgcagg

SEQ ID NO: 9068770 - DNA, 22 bp, Homo sapiens
tggctgcctagtccctcagcct

SEQ ID NO: 9068771 - DNA, 21 bp, Homo sapiens
tggctgcctacatgctgcagg

SEQ ID NO: 9068772 - DNA, 22 bp, Homo sapiens
tggctgccgactggctcttggc

SEQ ID NO: 9068773 - DNA, 22 bp, Homo sapiens
tggctgccgactggctcttggc

SEQ ID NO: 9068774 - DNA, 22 bp, Homo sapiens
cctgggcaatatagtgaggccc

SEQ ID NO: 9068775 - DNA, 22 bp, Homo sapiens
cctgggcagcctgctcaaggac

SEQ ID NO: 9068776 - DNA, 22 bp, Homo sapiens
cctgggcagcctgctcaaggac

SEQ ID NO: 9068777 - DNA, 22 bp, Homo sapiens
cctgggcatcaacaagcagaga

SEQ ID NO: 9068778 - DNA, 22 bp, Homo sapiens
cctgggaggcggaggttgcagg

SEQ ID NO: 9068779 - DNA, 22 bp, Homo sapiens
cctgggaggcggaggttgcagg

SEQ ID NO: 9068780 - DNA, 22 bp, Homo sapiens
cctgggaggcggaggttgcagt

SEQ ID NO: 9068781 - DNA, 22 bp, Homo sapiens
cctgggaggcggaggttgcagt

SEQ ID NO: 9068782 - DNA, 23 bp, Homo sapiens
cctgggcattggctgcagcttct

SEQ ID NO: 9068783 - DNA, 23 bp, Homo sapiens
cctgggcattggctgcagcttct

SEQ ID NO: 9068784 - DNA, 22 bp, Homo sapiens
cctgggcatctcatgcacctgc

SEQ ID NO: 9068785 - DNA, 22 bp, Homo sapiens
cctgggcattctttgagttctc

SEQ ID NO: 9068786 - DNA, 22 bp, Homo sapiens
cctgggccaggcttgggaatgc

SEQ ID NO: 9068787 - DNA, 22 bp, Homo sapiens
cctgggccaggcttgggaatgc

SEQ ID NO: 9068788 - DNA, 21 bp, Homo sapiens
cctgggccaaattccctggac

SEQ ID NO: 9068789 - DNA, 21 bp, Homo sapiens
cctgggccaaattccctggac

SEQ ID NO: 9068790 - DNA, 22 bp, Homo sapiens
cctgggccaggcttgggaatgc

SEQ ID NO: 9068791 - DNA, 22 bp, Homo sapiens
cctgggcctatcctagaaccaa

SEQ ID NO: 9068792 - DNA, 22 bp, Homo sapiens
cctgggccctcaccgccggtgg

SEQ ID NO: 9068793 - DNA, 22 bp, Homo sapiens
tgtgtctgtgtatacacggcat

SEQ ID NO: 9068794 - DNA, 22 bp, Homo sapiens
tgtgtctgtcctcggttgatgc

SEQ ID NO: 9068795 - DNA, 22 bp, Homo sapiens
tgtggggtgtggtccaggcatc

SEQ ID NO: 9068796 - DNA, 22 bp, Homo sapiens
tgtggggatcttctagcttttc

SEQ ID NO: 9068797 - DNA, 22 bp, Homo sapiens
cctgggcctcacccagctcttg

SEQ ID NO: 9068798 - DNA, 22 bp, Homo sapiens
cctgggcctatcctagaaccaa

SEQ ID NO: 9068799 - DNA, 22 bp, Homo sapiens
cctgggcctcacccagctcttg

SEQ ID NO: 9068800 - DNA, 20 bp, Homo sapiens
tgtggaaaaacagaagcaga

SEQ ID NO: 9068801 - DNA, 22 bp, Homo sapiens
tgtgctttggttttacaggatg

SEQ ID NO: 9068802 - DNA, 22 bp, Homo sapiens
tgtgcttgtcgtggagccaggc

SEQ ID NO: 9068803 - DNA, 22 bp, Homo sapiens
tgtggcaggaagagcttctgag

SEQ ID NO: 9068804 - DNA, 22 bp, Homo sapiens
tgtggcaggaagagcttctgag

SEQ ID NO: 9068805 - DNA, 22 bp, Homo sapiens
tgtggcaggaagagcttctgag

SEQ ID NO: 9068806 - DNA, 22 bp, Homo sapiens
tgtggcaggcaagatgtacaga

SEQ ID NO: 9068807 - DNA, 22 bp, Homo sapiens
tgtggcaggcattctgaggctg

SEQ ID NO: 9068808 - DNA, 22 bp, Homo sapiens
tgtggcaggcattctgaggctg

SEQ ID NO: 9068809 - DNA, 21 bp, Homo sapiens
tgtggctgcctctggccctgg

SEQ ID NO: 9068810 - DNA, 22 bp, Homo sapiens
tgtggcagggatactgaggcag

SEQ ID NO: 9068811 - DNA, 22 bp, Homo sapiens
tgtggcagggatactgaggcag

SEQ ID NO: 9068812 - DNA, 22 bp, Homo sapiens
tgtggcagggatactgaggcag

SEQ ID NO: 9068813 - DNA, 22 bp, Homo sapiens
tgtggcaggcattctgaggctg

SEQ ID NO: 9068814 - DNA, 22 bp, Homo sapiens
tgtggctgggctaataggcaaa

SEQ ID NO: 9068815 - DNA, 22 bp, Homo sapiens
tgtggctgggaagaaggtaact

SEQ ID NO: 9068816 - DNA, 22 bp, Homo sapiens
tgtggctgctcctgggtggtca

SEQ ID NO: 9068817 - DNA, 22 bp, Homo sapiens
tgtggctgctcaggtgcagacc

SEQ ID NO: 9068818 - DNA, 22 bp, Homo sapiens
tgtggctgctcctgggtggtca

SEQ ID NO: 9068819 - DNA, 22 bp, Homo sapiens
tgtggctggattgattttacct

SEQ ID NO: 9068820 - DNA, 15 bp, Homo sapiens
tgtggctggctcctg

SEQ ID NO: 9068821 - DNA, 22 bp, Homo sapiens
tgtggctgtggatgctttccag

SEQ ID NO: 9068822 - DNA, 22 bp, Homo sapiens
tgtggctgtgtccacctgctgc

SEQ ID NO: 9068823 - DNA, 22 bp, Homo sapiens
tgtggctgtggttttcataaat

SEQ ID NO: 9068824 - DNA, 18 bp, Homo sapiens
tgtggctggtccacactg

SEQ ID NO: 9068825 - DNA, 22 bp, Homo sapiens
tgtggctggtctccgagcgtcg

SEQ ID NO: 9068826 - DNA, 22 bp, Homo sapiens
tgtggctgtctgttctcctagg

SEQ ID NO: 9068827 - DNA, 22 bp, Homo sapiens
tgtggctgtgccgtcacacgtg

SEQ ID NO: 9068828 - DNA, 22 bp, Homo sapiens
cctgggaggcagaggttgcagt

SEQ ID NO: 9068829 - DNA, 22 bp, Homo sapiens
cctgggaggcagaggttgcagt

SEQ ID NO: 9068830 - DNA, 19 bp, Homo sapiens
cctgggaggcggaggttgc

SEQ ID NO: 9068831 - DNA, 22 bp, Homo sapiens
tgtggctgttgaggaccccaag

SEQ ID NO: 9068832 - DNA, 22 bp, Homo sapiens
tgtggctgtgtccacctgctgc

SEQ ID NO: 9068833 - DNA, 22 bp, Homo sapiens
tgtggcttttgctagctttgca

SEQ ID NO: 9068834 - DNA, 22 bp, Homo sapiens
tgtgttcaatcaccaaaggtat

SEQ ID NO: 9068835 - DNA, 22 bp, Homo sapiens
tgtgttcaatgacttcatcttt

SEQ ID NO: 9068836 - DNA, 22 bp, Homo sapiens
tgtgttcagtatgacattcaca

SEQ ID NO: 9068837 - DNA, 22 bp, Homo sapiens
tgtgttcagtatgacattcaca

SEQ ID NO: 9068838 - DNA, 22 bp, Homo sapiens
tgtgttcaccaaagtgtagaaa

SEQ ID NO: 9068839 - DNA, 22 bp, Homo sapiens
tgtgttcatcatgatatcaggt

SEQ ID NO: 9068840 - DNA, 22 bp, Homo sapiens
tgtgttcatgtcactggaatcc

SEQ ID NO: 9068841 - DNA, 22 bp, Homo sapiens
tgtgttcatgtatgtatacata

SEQ ID NO: 9068842 - DNA, 19 bp, Homo sapiens
cctgggtccactcagacta

SEQ ID NO: 9068843 - DNA, 19 bp, Homo sapiens
cctgggtccactcagacta

SEQ ID NO: 9068844 - DNA, 22 bp, Homo sapiens
cctgggtcccagccaggctttg

SEQ ID NO: 9068845 - DNA, 22 bp, Homo sapiens
tgtgttctccaactgtagattt

SEQ ID NO: 9068846 - DNA, 22 bp, Homo sapiens
tgtgttctccaactgtagattt

SEQ ID NO: 9068847 - DNA, 23 bp, Homo sapiens
tgtgttctcacacagatgcagta

SEQ ID NO: 9068848 - DNA, 19 bp, Homo sapiens
tgtgttcattcatcagagg

SEQ ID NO: 9068849 - DNA, 22 bp, Homo sapiens
tgtgttcatgttgattcatagc

SEQ ID NO: 9068850 - DNA, 22 bp, Homo sapiens
tgtgttcattagcattgccttg

SEQ ID NO: 9068851 - DNA, 22 bp, Homo sapiens
cctgggtgatgtgctgccctcg

SEQ ID NO: 9068852 - DNA, 22 bp, Homo sapiens
cctgggtgacagagtgagacct

SEQ ID NO: 9068853 - DNA, 22 bp, Homo sapiens
cctgggtgaaatctctcctgca

SEQ ID NO: 9068854 - DNA, 22 bp, Homo sapiens
cctgggtcccatcccagagtga

SEQ ID NO: 9068855 - DNA, 22 bp, Homo sapiens
cctgggtccctgagagatgatt

SEQ ID NO: 9068856 - DNA, 22 bp, Homo sapiens
cctgggtccctgagagatgatt

SEQ ID NO: 9068857 - DNA, 22 bp, Homo sapiens
cctgggtcctggcagcctcctg

SEQ ID NO: 9068858 - DNA, 22 bp, Homo sapiens
cctgggtctatagacttcaaga

SEQ ID NO: 9068859 - DNA, 22 bp, Homo sapiens
cctgggtctatagacttcaaga

SEQ ID NO: 9068860 - DNA, 22 bp, Homo sapiens
cctgggtctcctcctgctggct

SEQ ID NO: 9068861 - DNA, 22 bp, Homo sapiens
cctgggtcttggttcatgctct

SEQ ID NO: 9068862 - DNA, 22 bp, Homo sapiens
cctgggtcttggttcatgctct

SEQ ID NO: 9068863 - DNA, 22 bp, Homo sapiens
cctgggtcttcagtctgctggt

SEQ ID NO: 9068864 - DNA, 22 bp, Homo sapiens
cctgggtcttcagtctgctggt

SEQ ID NO: 9068865 - DNA, 19 bp, Homo sapiens
cctgggtctgcagcattca

SEQ ID NO: 9068866 - DNA, 22 bp, Homo sapiens
cctgggtctggtcactaagtca

SEQ ID NO: 9068867 - DNA, 22 bp, Homo sapiens
cctgggtctgtattggtaggta

SEQ ID NO: 9068868 - DNA, 22 bp, Homo sapiens
cctgggtctgtattggtaggta

SEQ ID NO: 9068869 - DNA, 20 bp, Homo sapiens
cctgggctcaaagcatcctc

SEQ ID NO: 9068870 - DNA, 22 bp, Homo sapiens
cctgggccttgacctcgtgggc

SEQ ID NO: 9068871 - DNA, 22 bp, Homo sapiens
cctgggccttgacctcgtgggc

SEQ ID NO: 9068872 - DNA, 22 bp, Homo sapiens
cctgggccttgacctcgtgggc

SEQ ID NO: 9068873 - DNA, 22 bp, Homo sapiens
cctgggctcaagcgatcttgtc

SEQ ID NO: 9068874 - DNA, 22 bp, Homo sapiens
cctgggcttccacgagcagagg

SEQ ID NO: 9068875 - DNA, 22 bp, Homo sapiens
cctgggctttgctggcaaggcc

SEQ ID NO: 9068876 - DNA, 22 bp, Homo sapiens
cctggggaatagagtcaagggg

SEQ ID NO: 9068877 - DNA, 22 bp, Homo sapiens
cctggggaatcttgcaggggaa

SEQ ID NO: 9068878 - DNA, 22 bp, Homo sapiens
cctggggaatcttgcaggggaa

SEQ ID NO: 9068879 - DNA, 22 bp, Homo sapiens
cctgggctttggaacagtactt

SEQ ID NO: 9068880 - DNA, 22 bp, Homo sapiens
cctgggctttggaacagtactt

SEQ ID NO: 9068881 - DNA, 22 bp, Homo sapiens
cctggggaagtcacttctcttt

SEQ ID NO: 9068882 - DNA, 22 bp, Homo sapiens
tgtgtgtataataatgtctgca

SEQ ID NO: 9068883 - DNA, 22 bp, Homo sapiens
tgtgtgtataataatgtctgca

SEQ ID NO: 9068884 - DNA, 22 bp, Homo sapiens
tgtgtgtcactgaaagaaatct

SEQ ID NO: 9068885 - DNA, 22 bp, Homo sapiens
tgtgtgtcagtcttgtttaggg

SEQ ID NO: 9068886 - DNA, 22 bp, Homo sapiens
tgtgtgtcagtcttgtttaggg

SEQ ID NO: 9068887 - DNA, 22 bp, Homo sapiens
cctgggcctcacccagctcttg

SEQ ID NO: 9068888 - DNA, 19 bp, Homo sapiens
cctgggcctccatcacccc

SEQ ID NO: 9068889 - DNA, 19 bp, Homo sapiens
cctgggcctccatcacccc

SEQ ID NO: 9068890 - DNA, 22 bp, Homo sapiens
cctgggcctgaaaacatttctc

SEQ ID NO: 9068891 - DNA, 22 bp, Homo sapiens
cctgggcctggcgggtcggctc

SEQ ID NO: 9068892 - DNA, 22 bp, Homo sapiens
cctgggcctggcgggtcggctc

SEQ ID NO: 9068893 - DNA, 22 bp, Homo sapiens
cctgggcctctcaaagtgctgg

SEQ ID NO: 9068894 - DNA, 22 bp, Homo sapiens
tgtgcttcatcacttctcagtt

SEQ ID NO: 9068895 - DNA, 22 bp, Homo sapiens
tgtgctgtcagtatcaagggat

SEQ ID NO: 9068896 - DNA, 22 bp, Homo sapiens
tgtgcttctcacatcactgttg

SEQ ID NO: 9068897 - DNA, 22 bp, Homo sapiens
tgtgcttcttgcagctcctgta

SEQ ID NO: 9068898 - DNA, 22 bp, Homo sapiens
tgtgcttcttgcagctcctgta

SEQ ID NO: 9068899 - DNA, 22 bp, Homo sapiens
tgtgctgggagatagagggagg

SEQ ID NO: 9068900 - DNA, 22 bp, Homo sapiens
tgtgctgggaaatggcaggata

SEQ ID NO: 9068901 - DNA, 22 bp, Homo sapiens
tgtgctggggtccagctgagcc

SEQ ID NO: 9068902 - DNA, 22 bp, Homo sapiens
tgtgctgggagatagagggagg

SEQ ID NO: 9068903 - DNA, 22 bp, Homo sapiens
tgtgctggtacatgtgaggatg

SEQ ID NO: 9068904 - DNA, 22 bp, Homo sapiens
tgtgcccagactgcctcagtga

SEQ ID NO: 9068905 - DNA, 20 bp, Homo sapiens
tgtgcccaatgtccaggttc

SEQ ID NO: 9068906 - DNA, 22 bp, Homo sapiens
tgtgcccattacacagaggcat

SEQ ID NO: 9068907 - DNA, 22 bp, Homo sapiens
tgtgcccatccctctggagtgt

SEQ ID NO: 9068908 - DNA, 22 bp, Homo sapiens
tgtgccataggcagcgtggcca

SEQ ID NO: 9068909 - DNA, 22 bp, Homo sapiens
tgtgccatctgatataagagcc

SEQ ID NO: 9068910 - DNA, 22 bp, Homo sapiens
tgtgccagttttgtctaagccc

SEQ ID NO: 9068911 - DNA, 22 bp, Homo sapiens
tgtgccaggccggggcaggaca

SEQ ID NO: 9068912 - DNA, 22 bp, Homo sapiens
tgtgccagtcatccagatgtgt

SEQ ID NO: 9068913 - DNA, 22 bp, Homo sapiens
cctgggagagtctgtggtctcc

SEQ ID NO: 9068914 - DNA, 21 bp, Homo sapiens
cctgggagatcagctgccttc

SEQ ID NO: 9068915 - DNA, 22 bp, Homo sapiens
cctgggagagccatctgtggcc

SEQ ID NO: 9068916 - DNA, 22 bp, Homo sapiens
cctgggagagccatctgtggcc

SEQ ID NO: 9068917 - DNA, 22 bp, Homo sapiens
cctgggaagagctgacaggagg

SEQ ID NO: 9068918 - DNA, 22 bp, Homo sapiens
cctgggaagcccatagcagctt

SEQ ID NO: 9068919 - DNA, 22 bp, Homo sapiens
cctgggaagcccatagcagctt

SEQ ID NO: 9068920 - DNA, 22 bp, Homo sapiens
cctgggagccaagcctctgtgt

SEQ ID NO: 9068921 - DNA, 22 bp, Homo sapiens
cctgggagccaagcctctgtgt

SEQ ID NO: 9068922 - DNA, 22 bp, Homo sapiens
cctgggagccaagcctctgtgt

SEQ ID NO: 9068923 - DNA, 21 bp, Homo sapiens
cctgggagatcagctgccttc

SEQ ID NO: 9068924 - DNA, 21 bp, Homo sapiens
cctgggagatcagctgccttc

SEQ ID NO: 9068925 - DNA, 21 bp, Homo sapiens
cctgggagatcagctgccttc

SEQ ID NO: 9068926 - DNA, 22 bp, Homo sapiens
tgtgccagaaaatatgctgagg

SEQ ID NO: 9068927 - DNA, 22 bp, Homo sapiens
tgtgccagaaaatatgctgagg

SEQ ID NO: 9068928 - DNA, 22 bp, Homo sapiens
cctgggagccgactgactgtgc

SEQ ID NO: 9068929 - DNA, 22 bp, Homo sapiens
cctgggagccgactgactgtgc

SEQ ID NO: 9068930 - DNA, 22 bp, Homo sapiens
tgtgccagcctctggctgtgtc

SEQ ID NO: 9068931 - DNA, 22 bp, Homo sapiens
tgtgccaggcacttgcccaggc

SEQ ID NO: 9068932 - DNA, 22 bp, Homo sapiens
cctggctgtgcattgccggccc

SEQ ID NO: 9068933 - DNA, 22 bp, Homo sapiens
cctggctgtgcattgccggccc

SEQ ID NO: 9068934 - DNA, 22 bp, Homo sapiens
cctggctgctgtcactgaccat

SEQ ID NO: 9068935 - DNA, 22 bp, Homo sapiens
cctggctgctatagcagcatgt

SEQ ID NO: 9068936 - DNA, 22 bp, Homo sapiens
cctggctgctatagcagcatgt

SEQ ID NO: 9068937 - DNA, 22 bp, Homo sapiens
cctggctgctatagcagcatgt

SEQ ID NO: 9068938 - DNA, 22 bp, Homo sapiens
cctggctgcattttgctggatg

SEQ ID NO: 9068939 - DNA, 20 bp, Homo sapiens
cctggctgcattcaggacgg

SEQ ID NO: 9068940 - DNA, 21 bp, Homo sapiens
cctggcttcagggtgcactgg

SEQ ID NO: 9068941 - DNA, 22 bp, Homo sapiens
cctggctgtggcggtgctctca

SEQ ID NO: 9068942 - DNA, 21 bp, Homo sapiens
cctggctgcacagttgctggt

SEQ ID NO: 9068943 - DNA, 22 bp, Homo sapiens
tgtgagggttttaagggaatga

SEQ ID NO: 9068944 - DNA, 22 bp, Homo sapiens
tgtgaggcgaggccagtgagct

SEQ ID NO: 9068945 - DNA, 22 bp, Homo sapiens
tgtgaggcgaggccagtgagct

SEQ ID NO: 9068946 - DNA, 22 bp, Homo sapiens
tgtgaggctacctgccagggtc

SEQ ID NO: 9068947 - DNA, 22 bp, Homo sapiens
tgtgaggctacctgccagggtc

SEQ ID NO: 9068948 - DNA, 22 bp, Homo sapiens
tgtgaggctggcaggggccagg

SEQ ID NO: 9068949 - DNA, 22 bp, Homo sapiens
tgtgaggcttgaagtaattcca

SEQ ID NO: 9068950 - DNA, 22 bp, Homo sapiens
tgtgaggcctctgcaggagcag

SEQ ID NO: 9068951 - DNA, 22 bp, Homo sapiens
tgtgaggcctctgcaggagcag

SEQ ID NO: 9068952 - DNA, 22 bp, Homo sapiens
tgtgaggcctagacagcctggg

SEQ ID NO: 9068953 - DNA, 22 bp, Homo sapiens
tgtgaggcctagacagcctggg

SEQ ID NO: 9068954 - DNA, 22 bp, Homo sapiens
tgtgaggaacaggactagagca

SEQ ID NO: 9068955 - DNA, 20 bp, Homo sapiens
tgtgagcagatgctgagtga

SEQ ID NO: 9068956 - DNA, 22 bp, Homo sapiens
tgtgaaggtaaggtttgcttga

SEQ ID NO: 9068957 - DNA, 22 bp, Homo sapiens
tgtgaaggtagctcttggcact

SEQ ID NO: 9068958 - DNA, 17 bp, Homo sapiens
tgtgagcatctatagaa

SEQ ID NO: 9068959 - DNA, 22 bp, Homo sapiens
tgtgaggacattggaggactca

SEQ ID NO: 9068960 - DNA, 22 bp, Homo sapiens
tgtctttctgcaccacctcaca

SEQ ID NO: 9068961 - DNA, 22 bp, Homo sapiens
tgtctttctgacccaaggtagt

SEQ ID NO: 9068962 - DNA, 20 bp, Homo sapiens
tgtctttccatggctggatc

SEQ ID NO: 9068963 - DNA, 22 bp, Homo sapiens
tgtctttatatatttggaaaat

SEQ ID NO: 9068964 - DNA, 22 bp, Homo sapiens
tgtgaagagagtaataaagtca

SEQ ID NO: 9068965 - DNA, 22 bp, Homo sapiens
tgtctttggaatatttagctga

SEQ ID NO: 9068966 - DNA, 22 bp, Homo sapiens
tgtgaaggtaaggaggggcaag

SEQ ID NO: 9068967 - DNA, 22 bp, Homo sapiens
tgtgaaggtaaggaggggcaag

SEQ ID NO: 9068968 - DNA, 22 bp, Homo sapiens
tgtgaagggcactgtctggaat

SEQ ID NO: 9068969 - DNA, 22 bp, Homo sapiens
tgtgaaggcagcagctctgtcc

SEQ ID NO: 9068970 - DNA, 22 bp, Homo sapiens
tgtgaaggagatgaagggagtg

SEQ ID NO: 9068971 - DNA, 22 bp, Homo sapiens
tgtgaaggcagagccagtgaaa

SEQ ID NO: 9068972 - DNA, 22 bp, Homo sapiens
tgtgaaggagcatgcagagggg

SEQ ID NO: 9068973 - DNA, 22 bp, Homo sapiens
tgtgaaggacttgttccattgt

SEQ ID NO: 9068974 - DNA, 22 bp, Homo sapiens
tgtgaagctggatcctggagct

SEQ ID NO: 9068975 - DNA, 22 bp, Homo sapiens
tgtgaagagtagacatgtggtg

SEQ ID NO: 9068976 - DNA, 22 bp, Homo sapiens
tgtgaagagtagacatgtggtg

SEQ ID NO: 9068977 - DNA, 22 bp, Homo sapiens
tgtgaagagagtaataaagtca

SEQ ID NO: 9068978 - DNA, 22 bp, Homo sapiens
tgtgaagatttggcatgcagaa

SEQ ID NO: 9068979 - DNA, 23 bp, Homo sapiens
tgtctggggcgccagaagagaga

SEQ ID NO: 9068980 - DNA, 21 bp, Homo sapiens
cctggctgcacagttgctggt

SEQ ID NO: 9068981 - DNA, 21 bp, Homo sapiens
cctggctgcacagttgctggt

SEQ ID NO: 9068982 - DNA, 22 bp, Homo sapiens
cctggctgaggggccaaggacc

SEQ ID NO: 9068983 - DNA, 23 bp, Homo sapiens
cctggctgacctgaaggtgtagt

SEQ ID NO: 9068984 - DNA, 22 bp, Homo sapiens
cctggctcttctgtgtcagccc

SEQ ID NO: 9068985 - DNA, 22 bp, Homo sapiens
cctggctgaacaaagtccctcc

SEQ ID NO: 9068986 - DNA, 23 bp, Homo sapiens
cctggctgacctgaaggtgtagt

SEQ ID NO: 9068987 - DNA, 22 bp, Homo sapiens
cctggctcttcgggagtttgtt

SEQ ID NO: 9068988 - DNA, 22 bp, Homo sapiens
cctggctcttcgggagtttgtt

SEQ ID NO: 9068989 - DNA, 22 bp, Homo sapiens
cctggctcttcgggagtttgtt

SEQ ID NO: 9068990 - DNA, 19 bp, Homo sapiens
cctggctctgagcccagcc

SEQ ID NO: 9068991 - DNA, 22 bp, Homo sapiens
tgtctgtctgtccttctcatta

SEQ ID NO: 9068992 - DNA, 22 bp, Homo sapiens
tgtctttagaaagaagcagaca

SEQ ID NO: 9068993 - DNA, 22 bp, Homo sapiens
tgtctttacttagaagttcagg

SEQ ID NO: 9068994 - DNA, 21 bp, Homo sapiens
tgtctttaggacctgttaaat

SEQ ID NO: 9068995 - DNA, 22 bp, Homo sapiens
tgtctgtattagtcagcattct

SEQ ID NO: 9068996 - DNA, 22 bp, Homo sapiens
tgtctgtaggtgtaatagagct

SEQ ID NO: 9068997 - DNA, 20 bp, Homo sapiens
tgtctgtatgcagtcatata

SEQ ID NO: 9068998 - DNA, 22 bp, Homo sapiens
tgtctgtatatcacttttgtcc

SEQ ID NO: 9068999 - DNA, 22 bp, Homo sapiens
tgtctggtgggttgacaggcag

SEQ ID NO: 9069000 - DNA, 22 bp, Homo sapiens
tgtctggtgggttgacaggcag

SEQ ID NO: 9069001 - DNA, 22 bp, Homo sapiens
tgtctgtacaaattttctgtgt

SEQ ID NO: 9069002 - DNA, 22 bp, Homo sapiens
tgtctgtaaggtgtttatgtta

SEQ ID NO: 9069003 - DNA, 22 bp, Homo sapiens
tgtctgtaatcaactgagtttc

SEQ ID NO: 9069004 - DNA, 22 bp, Homo sapiens
tgtctgtaatagtcactatgtg

SEQ ID NO: 9069005 - DNA, 22 bp, Homo sapiens
tgtctggtgggttgacaggcag

SEQ ID NO: 9069006 - DNA, 22 bp, Homo sapiens
tgtctggtgggttgacaggcag

SEQ ID NO: 9069007 - DNA, 22 bp, Homo sapiens
cctggaggtggaggttgcagtg

SEQ ID NO: 9069008 - DNA, 22 bp, Homo sapiens
cctggaggtggaggttgcagtg

SEQ ID NO: 9069009 - DNA, 22 bp, Homo sapiens
cctggcacatagtaagtactag

SEQ ID NO: 9069010 - DNA, 22 bp, Homo sapiens
cctggagcacatggcaggaggc

SEQ ID NO: 9069011 - DNA, 22 bp, Homo sapiens
cctggagcacatggcaggaggc

SEQ ID NO: 9069012 - DNA, 22 bp, Homo sapiens
cctggagcacatggcaggaggc

SEQ ID NO: 9069013 - DNA, 22 bp, Homo sapiens
cctggaggtggaggttgcagtg

SEQ ID NO: 9069014 - DNA, 22 bp, Homo sapiens
cctggagcaaaaatctaaggag

SEQ ID NO: 9069015 - DNA, 22 bp, Homo sapiens
cctggagattatttggtccaat

SEQ ID NO: 9069016 - DNA, 22 bp, Homo sapiens
cctggagcacagcccagtccca

SEQ ID NO: 9069017 - DNA, 22 bp, Homo sapiens
cctggagcacagcccagtccca

SEQ ID NO: 9069018 - DNA, 22 bp, Homo sapiens
tgtagtagcattcacgaagtgt

SEQ ID NO: 9069019 - DNA, 22 bp, Homo sapiens
tgtagtgtagcagggtgggaca

SEQ ID NO: 9069020 - DNA, 22 bp, Homo sapiens
tgtagtgtggcctatctttgcc

SEQ ID NO: 9069021 - DNA, 22 bp, Homo sapiens
tgtagtgtgacataggtgtcca

SEQ ID NO: 9069022 - DNA, 22 bp, Homo sapiens
cctggagaggcgctgcagagga

SEQ ID NO: 9069023 - DNA, 22 bp, Homo sapiens
tgtaaacatatgtatgtatgta

SEQ ID NO: 9069024 - DNA, 22 bp, Homo sapiens
tgtaaacatatgtatgtatgta

SEQ ID NO: 9069025 - DNA, 22 bp, Homo sapiens
tgtaaactccttggtgtgtgaa

SEQ ID NO: 9069026 - DNA, 20 bp, Homo sapiens
tgtaaactgcagagtgagaa

SEQ ID NO: 9069027 - DNA, 22 bp, Homo sapiens
tgtaaactgagggtagctgatt

SEQ ID NO: 9069028 - DNA, 22 bp, Homo sapiens
tgtaaacttttgcatactgctt

SEQ ID NO: 9069029 - DNA, 22 bp, Homo sapiens
tgtaaactgtagaaaatacttt

SEQ ID NO: 9069030 - DNA, 22 bp, Homo sapiens
tgtaggagtccaatcaggagac

SEQ ID NO: 9069031 - DNA, 22 bp, Homo sapiens
tgtaggcatattcatagagttg

SEQ ID NO: 9069032 - DNA, 22 bp, Homo sapiens
tgtaggcatcactttctcttgg

SEQ ID NO: 9069033 - DNA, 22 bp, Homo sapiens
tgtaggcatgaaggctctatag

SEQ ID NO: 9069034 - DNA, 22 bp, Homo sapiens
tgtaggcatattcatagagttg

SEQ ID NO: 9069035 - DNA, 22 bp, Homo sapiens
tgtaggcagcacacctgtgcaa

SEQ ID NO: 9069036 - DNA, 22 bp, Homo sapiens
tgtaggcacatgtatatatccc

SEQ ID NO: 9069037 - DNA, 23 bp, Homo sapiens
tgtaggcagtacagttgtaaatg

SEQ ID NO: 9069038 - DNA, 22 bp, Homo sapiens
tgtattaacattaataaaatgg

SEQ ID NO: 9069039 - DNA, 22 bp, Homo sapiens
tgtattaacattaataaaatgg

SEQ ID NO: 9069040 - DNA, 22 bp, Homo sapiens
tgtattagagcagtagaattat

SEQ ID NO: 9069041 - DNA, 22 bp, Homo sapiens
tgtattatcaagtaaatacatg

SEQ ID NO: 9069042 - DNA, 22 bp, Homo sapiens
tgtcatgcaggtttgttataga

SEQ ID NO: 9069043 - DNA, 22 bp, Homo sapiens
tgtcatggtagctgaaggatgt

SEQ ID NO: 9069044 - DNA, 21 bp, Homo sapiens
cctggcagaagcctgatatgc

SEQ ID NO: 9069045 - DNA, 22 bp, Homo sapiens
cctggcacgaagggctgaggtt

SEQ ID NO: 9069046 - DNA, 22 bp, Homo sapiens
tgtatgtgcttgagaaggtggg

SEQ ID NO: 9069047 - DNA, 22 bp, Homo sapiens
tgtatgtatgtatgtatttggg

SEQ ID NO: 9069048 - DNA, 22 bp, Homo sapiens
cctggcagacagcactgaagct

SEQ ID NO: 9069049 - DNA, 22 bp, Homo sapiens
tggtccagtcgttcctttcctt

SEQ ID NO: 9069050 - DNA, 22 bp, Homo sapiens
cctctgtgcctcgtgtcctctg

SEQ ID NO: 9069051 - DNA, 22 bp, Homo sapiens
cctctgtgcctcgtgtcctctg

SEQ ID NO: 9069052 - DNA, 22 bp, Homo sapiens
cctctgtgcctcagtttcatgt

SEQ ID NO: 9069053 - DNA, 22 bp, Homo sapiens
cctctgtgcctcagtttcatgt

SEQ ID NO: 9069054 - DNA, 22 bp, Homo sapiens
cctctgtgctttgtccagcctc

SEQ ID NO: 9069055 - DNA, 22 bp, Homo sapiens
tggtccatgtcctccatctctc

SEQ ID NO: 9069056 - DNA, 19 bp, Homo sapiens
tggtcccatactgctggcc

SEQ ID NO: 9069057 - DNA, 23 bp, Homo sapiens
tggtccctgagagctggggaggg

SEQ ID NO: 9069058 - DNA, 22 bp, Homo sapiens
tggtccctagcacagctgtcct

SEQ ID NO: 9069059 - DNA, 22 bp, Homo sapiens
tggtccctaggaaagcagtgtt

SEQ ID NO: 9069060 - DNA, 17 bp, Homo sapiens
cctgcccagagacagat

SEQ ID NO: 9069061 - DNA, 17 bp, Homo sapiens
cctgcccagagacagat

SEQ ID NO: 9069062 - DNA, 22 bp, Homo sapiens
tggtcttagctggaaggaggga

SEQ ID NO: 9069063 - DNA, 17 bp, Homo sapiens
cctgcccagagacagat

SEQ ID NO: 9069064 - DNA, 17 bp, Homo sapiens
cctgcccagagacagat

SEQ ID NO: 9069065 - DNA, 22 bp, Homo sapiens
tggtgccttgggcctacagcgc

SEQ ID NO: 9069066 - DNA, 21 bp, Homo sapiens
tggtgccttcagctgtctttt

SEQ ID NO: 9069067 - DNA, 22 bp, Homo sapiens
tggtgctgacagttctgagtgc

SEQ ID NO: 9069068 - DNA, 22 bp, Homo sapiens
tggtgctgacagttctgagtgc

SEQ ID NO: 9069069 - DNA, 22 bp, Homo sapiens
tggtgctgagatgaagtgctcc

SEQ ID NO: 9069070 - DNA, 22 bp, Homo sapiens
cctgcccactccaggagcaact

SEQ ID NO: 9069071 - DNA, 22 bp, Homo sapiens
cctgcccactccaggagcaact

SEQ ID NO: 9069072 - DNA, 22 bp, Homo sapiens
cctgcccacagagagggtgcat

SEQ ID NO: 9069073 - DNA, 22 bp, Homo sapiens
cctgccagtgcctcccactggt

SEQ ID NO: 9069074 - DNA, 22 bp, Homo sapiens
cctgccagtgcctcccactggt

SEQ ID NO: 9069075 - DNA, 22 bp, Homo sapiens
cctgccagtgaagctgacgggc

SEQ ID NO: 9069076 - DNA, 22 bp, Homo sapiens
cctgccagtgaagctgacgggc

SEQ ID NO: 9069077 - DNA, 21 bp, Homo sapiens
cctggagacaaagacagggtg

SEQ ID NO: 9069078 - DNA, 22 bp, Homo sapiens
cctggaaacacatgatgatgaa

SEQ ID NO: 9069079 - DNA, 22 bp, Homo sapiens
cctggactcagaggtgctggtg

SEQ ID NO: 9069080 - DNA, 22 bp, Homo sapiens
cctggaaagagaatgaatgagc

SEQ ID NO: 9069081 - DNA, 22 bp, Homo sapiens
tgtaaacataccagagccaagt

SEQ ID NO: 9069082 - DNA, 22 bp, Homo sapiens
cctggagacctgatggcagcgg

SEQ ID NO: 9069083 - DNA, 22 bp, Homo sapiens
cctggagacgaggctggaccat

SEQ ID NO: 9069084 - DNA, 22 bp, Homo sapiens
cctggagacgaggctggaccat

SEQ ID NO: 9069085 - DNA, 17 bp, Homo sapiens
tggtggctggagtcagg

SEQ ID NO: 9069086 - DNA, 17 bp, Homo sapiens
tggtggctggagtcagg

SEQ ID NO: 9069087 - DNA, 22 bp, Homo sapiens
tggtggctaccaggtcctgggg

SEQ ID NO: 9069088 - DNA, 22 bp, Homo sapiens
tggtggctgttgcagaactgag

SEQ ID NO: 9069089 - DNA, 22 bp, Homo sapiens
tggtgctgccacctcctctgct

SEQ ID NO: 9069090 - DNA, 22 bp, Homo sapiens
tggtgctgataatggcaggatt

SEQ ID NO: 9069091 - DNA, 22 bp, Homo sapiens
tggtgctgccaggctcctgcca

SEQ ID NO: 9069092 - DNA, 22 bp, Homo sapiens
tggtgctgccacctcctctgct

SEQ ID NO: 9069093 - DNA, 22 bp, Homo sapiens
tggtgctgcctcagatgcctta

SEQ ID NO: 9069094 - DNA, 22 bp, Homo sapiens
tggtgctgtctactttgtgcag

SEQ ID NO: 9069095 - DNA, 22 bp, Homo sapiens
cctggcagtcaggggagtcctt

SEQ ID NO: 9069096 - DNA, 22 bp, Homo sapiens
cctggcaggcaagaggaaggga

SEQ ID NO: 9069097 - DNA, 22 bp, Homo sapiens
cctggcaggctggggacagtgc

SEQ ID NO: 9069098 - DNA, 22 bp, Homo sapiens
cctggcaggctggggacagtgc

SEQ ID NO: 9069099 - DNA, 22 bp, Homo sapiens
cctggcaggctggggacagtgc

SEQ ID NO: 9069100 - DNA, 22 bp, Homo sapiens
tgtcattagtttcagccattct

SEQ ID NO: 9069101 - DNA, 22 bp, Homo sapiens
tgtcattagagaaggaccactc

SEQ ID NO: 9069102 - DNA, 22 bp, Homo sapiens
tgtcattatgaggattacaata

SEQ ID NO: 9069103 - DNA, 16 bp, Homo sapiens
tgtcattaccacctgt

SEQ ID NO: 9069104 - DNA, 21 bp, Homo sapiens
tgtcattaatcgctatagaag

SEQ ID NO: 9069105 - DNA, 22 bp, Homo sapiens
tgtcattattagagttgtgctt

SEQ ID NO: 9069106 - DNA, 22 bp, Homo sapiens
tgtcattatggagcttccactg

SEQ ID NO: 9069107 - DNA, 22 bp, Homo sapiens
tgtcattaagtcctttggcgga

SEQ ID NO: 9069108 - DNA, 22 bp, Homo sapiens
tgtcattaagtagggatttgtg

SEQ ID NO: 9069109 - DNA, 22 bp, Homo sapiens
tgtcattaaaatgcttctcaaa

SEQ ID NO: 9069110 - DNA, 22 bp, Homo sapiens
tgtcattatttgaggatagact

SEQ ID NO: 9069111 - DNA, 22 bp, Homo sapiens
cctggcagactgtgagggcagg

SEQ ID NO: 9069112 - DNA, 22 bp, Homo sapiens
cctggcagactgtgagggcagg

SEQ ID NO: 9069113 - DNA, 23 bp, Homo sapiens
cctggcagcaaacgaggaggtta

SEQ ID NO: 9069114 - DNA, 22 bp, Homo sapiens
cctggcagcaggtgggcccgtg

SEQ ID NO: 9069115 - DNA, 22 bp, Homo sapiens
cctggcagcagcacatgccttc

SEQ ID NO: 9069116 - DNA, 18 bp, Homo sapiens
cctggcagccatgcgcgc

SEQ ID NO: 9069117 - DNA, 22 bp, Homo sapiens
cctggcagcattggtagagatt

SEQ ID NO: 9069118 - DNA, 22 bp, Homo sapiens
tgtccagtccttggggtgctgt

SEQ ID NO: 9069119 - DNA, 22 bp, Homo sapiens
tgtccagtgattctcatgagcc

SEQ ID NO: 9069120 - DNA, 22 bp, Homo sapiens
tgtcccacaacatttgaggagg

SEQ ID NO: 9069121 - DNA, 22 bp, Homo sapiens
tgtccatcaggctgcctgtcag

SEQ ID NO: 9069122 - DNA, 22 bp, Homo sapiens
tgtccatggagaagctcagggc

SEQ ID NO: 9069123 - DNA, 22 bp, Homo sapiens
tgtcccagatcacaggagggga

SEQ ID NO: 9069124 - DNA, 22 bp, Homo sapiens
tgtcccagatactggacataga

SEQ ID NO: 9069125 - DNA, 23 bp, Homo sapiens
tgtcccagagggagggataggct

SEQ ID NO: 9069126 - DNA, 19 bp, Homo sapiens
tgtcccagactccgtgtct

SEQ ID NO: 9069127 - DNA, 19 bp, Homo sapiens
tgtcccagactccgtgtct

SEQ ID NO: 9069128 - DNA, 22 bp, Homo sapiens
tgtcccagacacagtatgcgct

SEQ ID NO: 9069129 - DNA, 22 bp, Homo sapiens
tgtcccagacataagtggacat

SEQ ID NO: 9069130 - DNA, 22 bp, Homo sapiens
tgtcccagcactttgggagtct

SEQ ID NO: 9069131 - DNA, 22 bp, Homo sapiens
tgtcctccaggacctgcagggc

SEQ ID NO: 9069132 - DNA, 22 bp, Homo sapiens
tgtcctccagcagcatggtatg

SEQ ID NO: 9069133 - DNA, 22 bp, Homo sapiens
tgtcctccagcagcatggtatg

SEQ ID NO: 9069134 - DNA, 22 bp, Homo sapiens
cctggccaggctctcagcactg

SEQ ID NO: 9069135 - DNA, 22 bp, Homo sapiens
cctggccagtttccaggccctg

SEQ ID NO: 9069136 - DNA, 22 bp, Homo sapiens
cctggccagtttccaggccctg

SEQ ID NO: 9069137 - DNA, 22 bp, Homo sapiens
cctggccagcgccggctgctcg

SEQ ID NO: 9069138 - DNA, 22 bp, Homo sapiens
cctggccagccagggctggggt

SEQ ID NO: 9069139 - DNA, 22 bp, Homo sapiens
cctggcagttttgcccaggatt

SEQ ID NO: 9069140 - DNA, 22 bp, Homo sapiens
cctggccctggaatagggcagg

SEQ ID NO: 9069141 - DNA, 22 bp, Homo sapiens
cctggcctcgtgctcacggctc

SEQ ID NO: 9069142 - DNA, 22 bp, Homo sapiens
cctggcctcagcctagggctga

SEQ ID NO: 9069143 - DNA, 22 bp, Homo sapiens
cctggcctcgtgctcacggctc

SEQ ID NO: 9069144 - DNA, 22 bp, Homo sapiens
cctggcctcctggccttctcat

SEQ ID NO: 9069145 - DNA, 22 bp, Homo sapiens
cctggcctcctggccttctcat

SEQ ID NO: 9069146 - DNA, 22 bp, Homo sapiens
cctggcctcagacagagggtgg

SEQ ID NO: 9069147 - DNA, 22 bp, Homo sapiens
cctggctcccccatcatagctg

SEQ ID NO: 9069148 - DNA, 22 bp, Homo sapiens
cctggctccagctgcctgtcct

SEQ ID NO: 9069149 - DNA, 22 bp, Homo sapiens
cctggctccagctgcctgtcct

SEQ ID NO: 9069150 - DNA, 21 bp, Homo sapiens
cctggctccagaacttccggt

SEQ ID NO: 9069151 - DNA, 21 bp, Homo sapiens
cctggctccagaacttccggt

SEQ ID NO: 9069152 - DNA, 22 bp, Homo sapiens
cctggcctggcactccctctgc

SEQ ID NO: 9069153 - DNA, 22 bp, Homo sapiens
cctggcctgtgaatctgagagc

SEQ ID NO: 9069154 - DNA, 22 bp, Homo sapiens
cctggcctgtgaatctgagagc

SEQ ID NO: 9069155 - DNA, 22 bp, Homo sapiens
cctggcctgctcggctcttaag

SEQ ID NO: 9069156 - DNA, 22 bp, Homo sapiens
cctggcctctccgagtaacctg

SEQ ID NO: 9069157 - DNA, 22 bp, Homo sapiens
cctggctcgctgacctcagggg

SEQ ID NO: 9069158 - DNA, 22 bp, Homo sapiens
cctggctcgctgacctcagggg

SEQ ID NO: 9069159 - DNA, 22 bp, Homo sapiens
cctggctctagaggccactcct

SEQ ID NO: 9069160 - DNA, 22 bp, Homo sapiens
cctggctctagaggccactcct

SEQ ID NO: 9069161 - DNA, 22 bp, Homo sapiens
cctggctctagaggccactcct

SEQ ID NO: 9069162 - DNA, 22 bp, Homo sapiens
cctggctctgaagtccacatca

SEQ ID NO: 9069163 - DNA, 22 bp, Homo sapiens
cctggctctgaagtccacatca

SEQ ID NO: 9069164 - DNA, 22 bp, Homo sapiens
cctggctctgaagtccacatca

SEQ ID NO: 9069165 - DNA, 22 bp, Homo sapiens
cctggctctctgcagatcctgg

SEQ ID NO: 9069166 - DNA, 22 bp, Homo sapiens
cctggctctctgcagatcctgg

SEQ ID NO: 9069167 - DNA, 22 bp, Homo sapiens
cctggctcccggaacagggtct

SEQ ID NO: 9069168 - DNA, 22 bp, Homo sapiens
cctggctccctggacctcatta

SEQ ID NO: 9069169 - DNA, 22 bp, Homo sapiens
cctggctccggttcaagggaaa

SEQ ID NO: 9069170 - DNA, 22 bp, Homo sapiens
cctggctccgtgtcacgtgccc

SEQ ID NO: 9069171 - DNA, 22 bp, Homo sapiens
cctggctcctgcacagatcttt

SEQ ID NO: 9069172 - DNA, 22 bp, Homo sapiens
cctggctcctgcacagatcttt

SEQ ID NO: 9069173 - DNA, 22 bp, Homo sapiens
cctggctcctgcctctgcaggg

SEQ ID NO: 9069174 - DNA, 22 bp, Homo sapiens
cctggctcctgcctctgcaggg

SEQ ID NO: 9069175 - DNA, 22 bp, Homo sapiens
cctggctcctgcctctgcaggg

SEQ ID NO: 9069176 - DNA, 22 bp, Homo sapiens
tgtcctggaaaaatggagagtt

SEQ ID NO: 9069177 - DNA, 22 bp, Homo sapiens
tgtcctcttccagtgctccttc

SEQ ID NO: 9069178 - DNA, 22 bp, Homo sapiens
tgtcctcttccagtgctccttc

SEQ ID NO: 9069179 - DNA, 22 bp, Homo sapiens
tgtctattaattccacataaaa

SEQ ID NO: 9069180 - DNA, 22 bp, Homo sapiens
tgtctatttttactggaccatg

SEQ ID NO: 9069181 - DNA, 22 bp, Homo sapiens
tgtctcagaatggctcataata

SEQ ID NO: 9069182 - DNA, 22 bp, Homo sapiens
tgtctcagatacgccatcaagg

SEQ ID NO: 9069183 - DNA, 22 bp, Homo sapiens
tgtctcaggcccaagccagtaa

SEQ ID NO: 9069184 - DNA, 22 bp, Homo sapiens
tgtctcttgagctgcctgatgc

SEQ ID NO: 9069185 - DNA, 22 bp, Homo sapiens
tgtctcttggagggtctagtga

SEQ ID NO: 9069186 - DNA, 22 bp, Homo sapiens
tgtctctgtgcatttgtgcttc

SEQ ID NO: 9069187 - DNA, 22 bp, Homo sapiens
tgtctcttactttgattcttgg

SEQ ID NO: 9069188 - DNA, 22 bp, Homo sapiens
tgtctcttctgcctccagctgt

SEQ ID NO: 9069189 - DNA, 22 bp, Homo sapiens
tgtctctgtgagatctgacgat

SEQ ID NO: 9069190 - DNA, 22 bp, Homo sapiens
tgtctctgtcttccagggctgt

SEQ ID NO: 9069191 - DNA, 22 bp, Homo sapiens
tgtctctggctgcagcctgttc

SEQ ID NO: 9069192 - DNA, 22 bp, Homo sapiens
tgtctctgggtgattcagtcct

SEQ ID NO: 9069193 - DNA, 22 bp, Homo sapiens
tgtctctggcccatgagcagag

SEQ ID NO: 9069194 - DNA, 22 bp, Homo sapiens
tgtctctggctgcagcctgttc

SEQ ID NO: 9069195 - DNA, 18 bp, Homo sapiens
tgtctcagttctgctatg

SEQ ID NO: 9069196 - DNA, 22 bp, Homo sapiens
cttgaaatccagatttcagagg

SEQ ID NO: 9069197 - DNA, 22 bp, Homo sapiens
cttcttttcatggcttgggaag

SEQ ID NO: 9069198 - DNA, 22 bp, Homo sapiens
cttcttttgaagggcgttgtgt

SEQ ID NO: 9069199 - DNA, 22 bp, Homo sapiens
cttctttagggatctcttgctg

SEQ ID NO: 9069200 - DNA, 22 bp, Homo sapiens
cttctttactttctagaaataa

SEQ ID NO: 9069201 - DNA, 22 bp, Homo sapiens
cttctttcccaggcatgtttta

SEQ ID NO: 9069202 - DNA, 22 bp, Homo sapiens
cttctttcttttgatcacaggt

SEQ ID NO: 9069203 - DNA, 22 bp, Homo sapiens
cttctttgaaaaaggcagtcag

SEQ ID NO: 9069204 - DNA, 22 bp, Homo sapiens
cttctttgttctgttgtctcac

SEQ ID NO: 9069205 - DNA, 22 bp, Homo sapiens
cttctttgttctgttgtctcac

SEQ ID NO: 9069206 - DNA, 22 bp, Homo sapiens
cttcttttacaggtcttgggtt

SEQ ID NO: 9069207 - DNA, 22 bp, Homo sapiens
cttctctctgcataggcatggg

SEQ ID NO: 9069208 - DNA, 23 bp, Homo sapiens
cttctctgagctaggaatgctct

SEQ ID NO: 9069209 - DNA, 22 bp, Homo sapiens
cttcttgaaacctgctccctca

SEQ ID NO: 9069210 - DNA, 22 bp, Homo sapiens
cttcttgaaagtggtgaccctc

SEQ ID NO: 9069211 - DNA, 22 bp, Homo sapiens
cttcttgacttctgggtgccct

SEQ ID NO: 9069212 - DNA, 22 bp, Homo sapiens
cttcttgaagtcctccagaagt

SEQ ID NO: 9069213 - DNA, 22 bp, Homo sapiens
cttcttgattgctttcaaacca

SEQ ID NO: 9069214 - DNA, 19 bp, Homo sapiens
cttcttgataaggttcttt

SEQ ID NO: 9069215 - DNA, 22 bp, Homo sapiens
cttcttgagcatgggtagtact

SEQ ID NO: 9069216 - DNA, 22 bp, Homo sapiens
cttctcttcccagggacacagg

SEQ ID NO: 9069217 - DNA, 22 bp, Homo sapiens
cttctcttcccagggacacagg

SEQ ID NO: 9069218 - DNA, 22 bp, Homo sapiens
cttctcttgggtgtggtgtctt

SEQ ID NO: 9069219 - DNA, 22 bp, Homo sapiens
cttctcttgggtgtggtgtctt

SEQ ID NO: 9069220 - DNA, 22 bp, Homo sapiens
cttctcttcctttgtcaactga

SEQ ID NO: 9069221 - DNA, 22 bp, Homo sapiens
ctggctctgtgggacctggcct

SEQ ID NO: 9069222 - DNA, 22 bp, Homo sapiens
ctggctggggtaccagttgaac

SEQ ID NO: 9069223 - DNA, 22 bp, Homo sapiens
ctggctggtaatggaacgacag

SEQ ID NO: 9069224 - DNA, 22 bp, Homo sapiens
ctggctgggttccaggattcca

SEQ ID NO: 9069225 - DNA, 22 bp, Homo sapiens
ctggctggtagaattgtgacct

SEQ ID NO: 9069226 - DNA, 22 bp, Homo sapiens
ctggctggtcatcagcagtacg

SEQ ID NO: 9069227 - DNA, 22 bp, Homo sapiens
ctggctggtcctcggggacagc

SEQ ID NO: 9069228 - DNA, 22 bp, Homo sapiens
ctggctggtcatgtcatgagcc

SEQ ID NO: 9069229 - DNA, 22 bp, Homo sapiens
ctggctggtcatgtcatgagcc

SEQ ID NO: 9069230 - DNA, 22 bp, Homo sapiens
ctggctggtcctcggggacagc

SEQ ID NO: 9069231 - DNA, 22 bp, Homo sapiens
ctggctggttgtctcaatccag

SEQ ID NO: 9069232 - DNA, 22 bp, Homo sapiens
ctggctgtaacattttgccata

SEQ ID NO: 9069233 - DNA, 22 bp, Homo sapiens
ctggctggttactatttctggt

SEQ ID NO: 9069234 - DNA, 22 bp, Homo sapiens
ctggctggttactatttctggt

SEQ ID NO: 9069235 - DNA, 22 bp, Homo sapiens
ctggctggttccctgctccagg

SEQ ID NO: 9069236 - DNA, 22 bp, Homo sapiens
ctggctggttccctgctccagg

SEQ ID NO: 9069237 - DNA, 22 bp, Homo sapiens
ctggctggttccctgctccagg

SEQ ID NO: 9069238 - DNA, 22 bp, Homo sapiens
cttctctatctttggcacatca

SEQ ID NO: 9069239 - DNA, 22 bp, Homo sapiens
cttctctccctggcactcagac

SEQ ID NO: 9069240 - DNA, 22 bp, Homo sapiens
ctttatcagaaaacacattagg

SEQ ID NO: 9069241 - DNA, 22 bp, Homo sapiens
ctttatatccagatgtttggtg

SEQ ID NO: 9069242 - DNA, 22 bp, Homo sapiens
ctttatatattcccaggctgcc

SEQ ID NO: 9069243 - DNA, 22 bp, Homo sapiens
ctttatctagggtaagaaaacc

SEQ ID NO: 9069244 - DNA, 22 bp, Homo sapiens
ctttatgaaggaacaatgctcc

SEQ ID NO: 9069245 - DNA, 22 bp, Homo sapiens
ctttggcagcctcagctgcagg

SEQ ID NO: 9069246 - DNA, 22 bp, Homo sapiens
ctttgtatctaaatatcttgaa

SEQ ID NO: 9069247 - DNA, 22 bp, Homo sapiens
ctttgtatctaaatatcttgaa

SEQ ID NO: 9069248 - DNA, 22 bp, Homo sapiens
ctttgtatctaaatatcttgaa

SEQ ID NO: 9069249 - DNA, 22 bp, Homo sapiens
ctttgtcattttgtctctcagt

SEQ ID NO: 9069250 - DNA, 19 bp, Homo sapiens
ctttgtcagaacatgcttc

SEQ ID NO: 9069251 - DNA, 22 bp, Homo sapiens
ctttacaacctaagttgaagct

SEQ ID NO: 9069252 - DNA, 22 bp, Homo sapiens
ctttacaacctaagttgaagct

SEQ ID NO: 9069253 - DNA, 22 bp, Homo sapiens
ctttacaattcaagggaactct

SEQ ID NO: 9069254 - DNA, 22 bp, Homo sapiens
ctttacaattcaagggaactct

SEQ ID NO: 9069255 - DNA, 22 bp, Homo sapiens
ctttacaattcaagggaactct

SEQ ID NO: 9069256 - DNA, 22 bp, Homo sapiens
ctttacaattcaagggaactct

SEQ ID NO: 9069257 - DNA, 20 bp, Homo sapiens
ctttagaagaacccaagcat

SEQ ID NO: 9069258 - DNA, 19 bp, Homo sapiens
ctttagacacacctggaca

SEQ ID NO: 9069259 - DNA, 22 bp, Homo sapiens
ctttagacatacagaatttcca

SEQ ID NO: 9069260 - DNA, 22 bp, Homo sapiens
ctttagacatctcattgtgtaa

SEQ ID NO: 9069261 - DNA, 22 bp, Homo sapiens
ctttagaatttgatataatcaa

SEQ ID NO: 9069262 - DNA, 22 bp, Homo sapiens
ctttaggttttgcctgagatct

SEQ ID NO: 9069263 - DNA, 21 bp, Homo sapiens
ctttagtgaaaaggggctaac

SEQ ID NO: 9069264 - DNA, 22 bp, Homo sapiens
ctttagcaacgatgatgatatt

SEQ ID NO: 9069265 - DNA, 22 bp, Homo sapiens
ctttagtgttgttgtgaggatt

SEQ ID NO: 9069266 - DNA, 22 bp, Homo sapiens
cttggctgtctataggaaagag

SEQ ID NO: 9069267 - DNA, 22 bp, Homo sapiens
cttggctgtctataggaaagag

SEQ ID NO: 9069268 - DNA, 22 bp, Homo sapiens
cttggctttagaacatgggagc

SEQ ID NO: 9069269 - DNA, 22 bp, Homo sapiens
cttggctgttgggcattgagaa

SEQ ID NO: 9069270 - DNA, 22 bp, Homo sapiens
cttggctgttgggcattgagaa

SEQ ID NO: 9069271 - DNA, 22 bp, Homo sapiens
cttgggaaaccaatgggctcct

SEQ ID NO: 9069272 - DNA, 22 bp, Homo sapiens
cttgggaaaccaatgggctcct

SEQ ID NO: 9069273 - DNA, 22 bp, Homo sapiens
cttgggaactgccttgcctttg

SEQ ID NO: 9069274 - DNA, 21 bp, Homo sapiens
cttggctgcagtgacaggcat

SEQ ID NO: 9069275 - DNA, 18 bp, Homo sapiens
cttggctgatgggggtgt

SEQ ID NO: 9069276 - DNA, 22 bp, Homo sapiens
cttggctgtcataaggtcctgg

SEQ ID NO: 9069277 - DNA, 22 bp, Homo sapiens
cttggctgggaactgtgattca

SEQ ID NO: 9069278 - DNA, 22 bp, Homo sapiens
cttggctgcttttgtgcacatt

SEQ ID NO: 9069279 - DNA, 22 bp, Homo sapiens
cttggctggaactcctgagaaa

SEQ ID NO: 9069280 - DNA, 22 bp, Homo sapiens
cttgacaactggcagatatata

SEQ ID NO: 9069281 - DNA, 22 bp, Homo sapiens
cttgacaactggcagatatata

SEQ ID NO: 9069282 - DNA, 22 bp, Homo sapiens
cttggattacccatatgattag

SEQ ID NO: 9069283 - DNA, 22 bp, Homo sapiens
ctttacaacctaagttgaagct

SEQ ID NO: 9069284 - DNA, 22 bp, Homo sapiens
ctttacaacctaagttgaagct

SEQ ID NO: 9069285 - DNA, 22 bp, Homo sapiens
cttgggagacacaagaagacat

SEQ ID NO: 9069286 - DNA, 22 bp, Homo sapiens
cttgggagacacaagaagacat

SEQ ID NO: 9069287 - DNA, 22 bp, Homo sapiens
cttgggcaagcagcattcagaa

SEQ ID NO: 9069288 - DNA, 22 bp, Homo sapiens
cttgggcaggggaaacagctgc

SEQ ID NO: 9069289 - DNA, 22 bp, Homo sapiens
cttgggcagggtattgtagaag

SEQ ID NO: 9069290 - DNA, 22 bp, Homo sapiens
gaaaacactttgatctgaaagt

SEQ ID NO: 9069291 - DNA, 17 bp, Homo sapiens
cttttaatttacttccc

SEQ ID NO: 9069292 - DNA, 22 bp, Homo sapiens
ctttgttttactcagaggcatg

SEQ ID NO: 9069293 - DNA, 22 bp, Homo sapiens
ctttgttttactcagaggcatg

SEQ ID NO: 9069294 - DNA, 22 bp, Homo sapiens
ctttgttttactcagaggcatg

SEQ ID NO: 9069295 - DNA, 22 bp, Homo sapiens
ctttgtccattgattcgttcaa

SEQ ID NO: 9069296 - DNA, 22 bp, Homo sapiens
ctttgtcattttgtctctcagt

SEQ ID NO: 9069297 - DNA, 22 bp, Homo sapiens
ctttgtgcttgacccatgggtc

SEQ ID NO: 9069298 - DNA, 22 bp, Homo sapiens
ctttgtggctcctgcaggccat

SEQ ID NO: 9069299 - DNA, 22 bp, Homo sapiens
ctttgtttatatttctcctcga

SEQ ID NO: 9069300 - DNA, 22 bp, Homo sapiens
ctttgtttatatttctcctcga

SEQ ID NO: 9069301 - DNA, 22 bp, Homo sapiens
gaaaagctaggccagttcagct

SEQ ID NO: 9069302 - DNA, 22 bp, Homo sapiens
gaaaagctaggccagttcagct

SEQ ID NO: 9069303 - DNA, 21 bp, Homo sapiens
gaaaagcaagggagtagaaca

SEQ ID NO: 9069304 - DNA, 21 bp, Homo sapiens
gaaaagcaagggagtagaaca

SEQ ID NO: 9069305 - DNA, 22 bp, Homo sapiens
gaaaacatccagagatagacct

SEQ ID NO: 9069306 - DNA, 22 bp, Homo sapiens
gaaaagagacagggtgggtgat

SEQ ID NO: 9069307 - DNA, 22 bp, Homo sapiens
gaaaacatccagagatagacct

SEQ ID NO: 9069308 - DNA, 22 bp, Homo sapiens
gaaaacatccagagatagacct

SEQ ID NO: 9069309 - DNA, 21 bp, Homo sapiens
gaaaagcaagggagtagaaca

SEQ ID NO: 9069310 - DNA, 22 bp, Homo sapiens
gaaaagagtcctgtgtgaggag

SEQ ID NO: 9069311 - DNA, 21 bp, Homo sapiens
gaaaagcaagggagtagaaca

SEQ ID NO: 9069312 - DNA, 22 bp, Homo sapiens
gaaaagggcaagagagagggca

SEQ ID NO: 9069313 - DNA, 22 bp, Homo sapiens
gaaaaggaaatttatagagatc

SEQ ID NO: 9069314 - DNA, 22 bp, Homo sapiens
gaaagggcatgggcatgacaac

SEQ ID NO: 9069315 - DNA, 22 bp, Homo sapiens
gaaagggataccatgttacttg

SEQ ID NO: 9069316 - DNA, 22 bp, Homo sapiens
gaaagggagtggacaacaggca

SEQ ID NO: 9069317 - DNA, 22 bp, Homo sapiens
gaaagggagtggacaacaggca

SEQ ID NO: 9069318 - DNA, 22 bp, Homo sapiens
gaaaggtgccccataggcagga

SEQ ID NO: 9069319 - DNA, 22 bp, Homo sapiens
gaaagtgcctcagtcctcttat

SEQ ID NO: 9069320 - DNA, 18 bp, Homo sapiens
gaaagtgcggggcagggg

SEQ ID NO: 9069321 - DNA, 22 bp, Homo sapiens
gaaagtgcatgtgcccaccatt

SEQ ID NO: 9069322 - DNA, 22 bp, Homo sapiens
gaaagtgccagaataggaggcc

SEQ ID NO: 9069323 - DNA, 22 bp, Homo sapiens
gaaagttcacacatccacatgg

SEQ ID NO: 9069324 - DNA, 22 bp, Homo sapiens
gaaagttattgaaccttattta

SEQ ID NO: 9069325 - DNA, 22 bp, Homo sapiens
gaaagtttataggttatataat

SEQ ID NO: 9069326 - DNA, 22 bp, Homo sapiens
gaaagtgcttttgagtgtgtgc

SEQ ID NO: 9069327 - DNA, 18 bp, Homo sapiens
gaaagtgttgctggtttt

SEQ ID NO: 9069328 - DNA, 22 bp, Homo sapiens
gaaagtgctaggaagtgttaga

SEQ ID NO: 9069329 - DNA, 22 bp, Homo sapiens
gaaagtgctctctctatacaca

SEQ ID NO: 9069330 - DNA, 22 bp, Homo sapiens
gaaagtgcttagagtgtggtat

SEQ ID NO: 9069331 - DNA, 22 bp, Homo sapiens
gaaaatacaaatagccttgaaa

SEQ ID NO: 9069332 - DNA, 21 bp, Homo sapiens
gaaaatacaatgagcttgacc

SEQ ID NO: 9069333 - DNA, 22 bp, Homo sapiens
gaaaagtatgtttattttgact

SEQ ID NO: 9069334 - DNA, 21 bp, Homo sapiens
gaaaatacaatgagcttgacc

SEQ ID NO: 9069335 - DNA, 22 bp, Homo sapiens
gaaagggagtgaagatggtata

SEQ ID NO: 9069336 - DNA, 22 bp, Homo sapiens
gaaagggagtgaagatggtata

SEQ ID NO: 9069337 - DNA, 22 bp, Homo sapiens
gaaaggctcactttagatcatg

SEQ ID NO: 9069338 - DNA, 22 bp, Homo sapiens
gaaaggccaccatgccagggac

SEQ ID NO: 9069339 - DNA, 22 bp, Homo sapiens
gaaaggcatcttcagtctctga

SEQ ID NO: 9069340 - DNA, 22 bp, Homo sapiens
gaaaggcatcttcagtctctga

SEQ ID NO: 9069341 - DNA, 22 bp, Homo sapiens
gaaatacaattttgtcccagct

SEQ ID NO: 9069342 - DNA, 22 bp, Homo sapiens
gaaatacaaatgcctagatcct

SEQ ID NO: 9069343 - DNA, 22 bp, Homo sapiens
gaaatacagaaagggctgaatg

SEQ ID NO: 9069344 - DNA, 22 bp, Homo sapiens
gaaatttacaactttctcatgg

SEQ ID NO: 9069345 - DNA, 22 bp, Homo sapiens
gaaatttattatctacatcatt

SEQ ID NO: 9069346 - DNA, 22 bp, Homo sapiens
gaaatttacaactttctcatgg

SEQ ID NO: 9069347 - DNA, 22 bp, Homo sapiens
gaacacaactcagaatgctggt

SEQ ID NO: 9069348 - DNA, 22 bp, Homo sapiens
gaacactgagagagatgggcag

SEQ ID NO: 9069349 - DNA, 22 bp, Homo sapiens
gaacactgagaaagtcagcttt

SEQ ID NO: 9069350 - DNA, 22 bp, Homo sapiens
gaacactgacattttcctgact

SEQ ID NO: 9069351 - DNA, 22 bp, Homo sapiens
gaacactgagaaagtcagcttt

SEQ ID NO: 9069352 - DNA, 22 bp, Homo sapiens
gaacacagcggggcttacccgg

SEQ ID NO: 9069353 - DNA, 22 bp, Homo sapiens
gaacacagtacttgttcgtctt

SEQ ID NO: 9069354 - DNA, 22 bp, Homo sapiens
gaacacagtcaagggctgctgt

SEQ ID NO: 9069355 - DNA, 22 bp, Homo sapiens
gaaataatacagtgctcttctc

SEQ ID NO: 9069356 - DNA, 22 bp, Homo sapiens
gaaataatttagaaggtattcc

SEQ ID NO: 9069357 - DNA, 22 bp, Homo sapiens
gaaatacaaagccagccatttt

SEQ ID NO: 9069358 - DNA, 22 bp, Homo sapiens
gaaatacaaagccagccatttt

SEQ ID NO: 9069359 - DNA, 22 bp, Homo sapiens
gaaatacaaatgcctagatcct

SEQ ID NO: 9069360 - DNA, 22 bp, Homo sapiens
gaaataatacagtgctcttctc

SEQ ID NO: 9069361 - DNA, 19 bp, Homo sapiens
gaacacttactatatttct

SEQ ID NO: 9069362 - DNA, 22 bp, Homo sapiens
gaacactttaacattccttttc

SEQ ID NO: 9069363 - DNA, 22 bp, Homo sapiens
gaacacttggctttggatttaa

SEQ ID NO: 9069364 - DNA, 22 bp, Homo sapiens
gaacagaattaccgaagatctg

SEQ ID NO: 9069365 - DNA, 22 bp, Homo sapiens
gaacagaagaggctggtgccac

SEQ ID NO: 9069366 - DNA, 22 bp, Homo sapiens
gaacagaattaccgaagatctg

SEQ ID NO: 9069367 - DNA, 22 bp, Homo sapiens
gaacactgaggacactgagaat

SEQ ID NO: 9069368 - DNA, 22 bp, Homo sapiens
gaacactgctgttgggttctga

SEQ ID NO: 9069369 - DNA, 22 bp, Homo sapiens
gaacactggggtatcattgagc

SEQ ID NO: 9069370 - DNA, 22 bp, Homo sapiens
gaacactgtttcttcgtgaaca

SEQ ID NO: 9069371 - DNA, 22 bp, Homo sapiens
gaacagatgggctcagatcctg

SEQ ID NO: 9069372 - DNA, 22 bp, Homo sapiens
gaacagagttgaaacaaggctg

SEQ ID NO: 9069373 - DNA, 19 bp, Homo sapiens
gaacagacttggggtgagg

SEQ ID NO: 9069374 - DNA, 22 bp, Homo sapiens
gaacagaattaccgaagatctg

SEQ ID NO: 9069375 - DNA, 22 bp, Homo sapiens
gaacagacttggaggagtgatc

SEQ ID NO: 9069376 - DNA, 22 bp, Homo sapiens
gaacagagaagctttactaaag

SEQ ID NO: 9069377 - DNA, 22 bp, Homo sapiens
gaacagagttgaaacaaggctg

SEQ ID NO: 9069378 - DNA, 22 bp, Homo sapiens
gaacagagctgactacaaggca

SEQ ID NO: 9069379 - DNA, 22 bp, Homo sapiens
gaacccagtccaggtgcagcct

SEQ ID NO: 9069380 - DNA, 22 bp, Homo sapiens
gaacccagtccaggtgcagcct

SEQ ID NO: 9069381 - DNA, 23 bp, Homo sapiens
gaacccagctctgccacttgcca

SEQ ID NO: 9069382 - DNA, 22 bp, Homo sapiens
gaactgaaacttggtttaaagc

SEQ ID NO: 9069383 - DNA, 22 bp, Homo sapiens
gaactccagatgactcaggaac

SEQ ID NO: 9069384 - DNA, 22 bp, Homo sapiens
gagagctgggctttgggtgaag

SEQ ID NO: 9069385 - DNA, 22 bp, Homo sapiens
gagagctgggctttgggtgaag

SEQ ID NO: 9069386 - DNA, 20 bp, Homo sapiens
gagagctggggatgaggctg

SEQ ID NO: 9069387 - DNA, 20 bp, Homo sapiens
gagagctggggatgaggctg

SEQ ID NO: 9069388 - DNA, 22 bp, Homo sapiens
gagagctgggctttgggtgaag

SEQ ID NO: 9069389 - DNA, 22 bp, Homo sapiens
gagagctgggaaagccgtggag

SEQ ID NO: 9069390 - DNA, 22 bp, Homo sapiens
gagagctgggaaagccgtggag

SEQ ID NO: 9069391 - DNA, 22 bp, Homo sapiens
gagagctgggaaagccgtggag

SEQ ID NO: 9069392 - DNA, 20 bp, Homo sapiens
gagagctggaaataaagtcc

SEQ ID NO: 9069393 - DNA, 22 bp, Homo sapiens
gagagctggattctggataggt

SEQ ID NO: 9069394 - DNA, 22 bp, Homo sapiens
gagagctggattctggataggt

SEQ ID NO: 9069395 - DNA, 22 bp, Homo sapiens
gagagctggattctggataggt

SEQ ID NO: 9069396 - DNA, 22 bp, Homo sapiens
gagagctggccagcttcagtat

SEQ ID NO: 9069397 - DNA, 22 bp, Homo sapiens
gagagctggccagcttcagtat

SEQ ID NO: 9069398 - DNA, 22 bp, Homo sapiens
gagaggtacaccctttaaactt

SEQ ID NO: 9069399 - DNA, 22 bp, Homo sapiens
gagaggtacggaaagagcgtgg

SEQ ID NO: 9069400 - DNA, 22 bp, Homo sapiens
gagagtccttagtttgcaggta

SEQ ID NO: 9069401 - DNA, 22 bp, Homo sapiens
gagagtctaggaacctcatata

SEQ ID NO: 9069402 - DNA, 22 bp, Homo sapiens
gagagctgggttcaagtagctg

SEQ ID NO: 9069403 - DNA, 22 bp, Homo sapiens
gagagctgggttcaagtagctg

SEQ ID NO: 9069404 - DNA, 22 bp, Homo sapiens
gagagctgggggactgtggatg

SEQ ID NO: 9069405 - DNA, 22 bp, Homo sapiens
gagagctgggggactgtggatg

SEQ ID NO: 9069406 - DNA, 22 bp, Homo sapiens
gagagctgggggactgtggatg

SEQ ID NO: 9069407 - DNA, 22 bp, Homo sapiens
gagagctgcattctcagacaca

SEQ ID NO: 9069408 - DNA, 22 bp, Homo sapiens
gagagctgcattctcagacaca

SEQ ID NO: 9069409 - DNA, 22 bp, Homo sapiens
gagagctgcattctcagacaca

SEQ ID NO: 9069410 - DNA, 22 bp, Homo sapiens
gagagctgcagccgagaggggg

SEQ ID NO: 9069411 - DNA, 22 bp, Homo sapiens
gagagctgcattctcagacaca

SEQ ID NO: 9069412 - DNA, 18 bp, Homo sapiens
gagagctgctacctagct

SEQ ID NO: 9069413 - DNA, 17 bp, Homo sapiens
gagagctgctgcttccg

SEQ ID NO: 9069414 - DNA, 17 bp, Homo sapiens
gagagctgctgcttccg

SEQ ID NO: 9069415 - DNA, 17 bp, Homo sapiens
gagagctgctgcttccg

SEQ ID NO: 9069416 - DNA, 17 bp, Homo sapiens
gagagctgctgcttccg

SEQ ID NO: 9069417 - DNA, 22 bp, Homo sapiens
gagagctgcagccgagaggggg

SEQ ID NO: 9069418 - DNA, 22 bp, Homo sapiens
gagagctgcaaggtagggcggg

SEQ ID NO: 9069419 - DNA, 22 bp, Homo sapiens
gagagctgatagatgagctact

SEQ ID NO: 9069420 - DNA, 22 bp, Homo sapiens
gagagctgatagatgagctact

SEQ ID NO: 9069421 - DNA, 22 bp, Homo sapiens
gagagctgaggggcctggcact

SEQ ID NO: 9069422 - DNA, 22 bp, Homo sapiens
gagagctgaggggcctggcact

SEQ ID NO: 9069423 - DNA, 22 bp, Homo sapiens
gagagctccttcaggaagcttc

SEQ ID NO: 9069424 - DNA, 22 bp, Homo sapiens
gagagctccatgttcatgctgt

SEQ ID NO: 9069425 - DNA, 23 bp, Homo sapiens
gagagctgactgtcaagactgtt

SEQ ID NO: 9069426 - DNA, 22 bp, Homo sapiens
gagacagagatcttgctgagtc

SEQ ID NO: 9069427 - DNA, 22 bp, Homo sapiens
gagacagagatcttgctgagtc

SEQ ID NO: 9069428 - DNA, 22 bp, Homo sapiens
gagacagagtttcactcttgtt

SEQ ID NO: 9069429 - DNA, 22 bp, Homo sapiens
gagacagagtttcactcttgtt

SEQ ID NO: 9069430 - DNA, 22 bp, Homo sapiens
gagacagagtttcactcttgtt

SEQ ID NO: 9069431 - DNA, 22 bp, Homo sapiens
gagacagatctcggctccatgc

SEQ ID NO: 9069432 - DNA, 22 bp, Homo sapiens
gagacagagtttcactcttgtt

SEQ ID NO: 9069433 - DNA, 22 bp, Homo sapiens
gactttatttccttatttgtga

SEQ ID NO: 9069434 - DNA, 22 bp, Homo sapiens
gagaaaatagcatgtgtagtat

SEQ ID NO: 9069435 - DNA, 22 bp, Homo sapiens
gactttgtgccaaacgccagaa

SEQ ID NO: 9069436 - DNA, 22 bp, Homo sapiens
gactttggtttgagcaagtcag

SEQ ID NO: 9069437 - DNA, 22 bp, Homo sapiens
gagaaacaacacttgatgcctt

SEQ ID NO: 9069438 - DNA, 22 bp, Homo sapiens
gagacacaagaagacatgcaca

SEQ ID NO: 9069439 - DNA, 22 bp, Homo sapiens
gagacacaggcacagaagaggc

SEQ ID NO: 9069440 - DNA, 22 bp, Homo sapiens
gagacactcaacaaagatatga

SEQ ID NO: 9069441 - DNA, 21 bp, Homo sapiens
gagacagactttcgtcccctg

SEQ ID NO: 9069442 - DNA, 22 bp, Homo sapiens
gagacagagaggtactcaacat

SEQ ID NO: 9069443 - DNA, 22 bp, Homo sapiens
gagacacaggtggttcctgtca

SEQ ID NO: 9069444 - DNA, 22 bp, Homo sapiens
gagacacagcagatattcaatc

SEQ ID NO: 9069445 - DNA, 22 bp, Homo sapiens
gagacacaggcacagaagaggc

SEQ ID NO: 9069446 - DNA, 22 bp, Homo sapiens
gagacacagagaggctgtgtga

SEQ ID NO: 9069447 - DNA, 22 bp, Homo sapiens
gagacacaatctcatttacatt

SEQ ID NO: 9069448 - DNA, 22 bp, Homo sapiens
gagacacaatctcatttacatt

SEQ ID NO: 9069449 - DNA, 22 bp, Homo sapiens
gagacacaagacgcaactctgt

SEQ ID NO: 9069450 - DNA, 22 bp, Homo sapiens
gagacacaagaagacatgcaca

SEQ ID NO: 9069451 - DNA, 22 bp, Homo sapiens
gactgtccagaattcctaggtg

SEQ ID NO: 9069452 - DNA, 22 bp, Homo sapiens
gactgtgacttctgaagcaata

SEQ ID NO: 9069453 - DNA, 22 bp, Homo sapiens
gactgtggcaggctcagcactg

SEQ ID NO: 9069454 - DNA, 22 bp, Homo sapiens
gactgtggggaagcagatgcca

SEQ ID NO: 9069455 - DNA, 22 bp, Homo sapiens
gacccagggtttctgcacaggg

SEQ ID NO: 9069456 - DNA, 22 bp, Homo sapiens
gacttgttctctgactgcttta

SEQ ID NO: 9069457 - DNA, 22 bp, Homo sapiens
gactgtgtccatgtgctggatt

SEQ ID NO: 9069458 - DNA, 22 bp, Homo sapiens
gactgtggtctgttctccaggt

SEQ ID NO: 9069459 - DNA, 22 bp, Homo sapiens
gactgtgtccatgtgctggatt

SEQ ID NO: 9069460 - DNA, 17 bp, Homo sapiens
gacttcaacttctgctg

SEQ ID NO: 9069461 - DNA, 22 bp, Homo sapiens
gacttcaaaggtcaaacatcgc

SEQ ID NO: 9069462 - DNA, 22 bp, Homo sapiens
gacttcaaagcgtgataaagat

SEQ ID NO: 9069463 - DNA, 22 bp, Homo sapiens
gacttcaaaagctgacattcat

SEQ ID NO: 9069464 - DNA, 22 bp, Homo sapiens
gacttctgaattcctatcaggt

SEQ ID NO: 9069465 - DNA, 22 bp, Homo sapiens
gacttcctaagattcaggaatg

SEQ ID NO: 9069466 - DNA, 22 bp, Homo sapiens
gacttcctaagattcaggaatg

SEQ ID NO: 9069467 - DNA, 22 bp, Homo sapiens
gacttcaacttctggggagcaa

SEQ ID NO: 9069468 - DNA, 22 bp, Homo sapiens
gacttcaaatcatgctaaacct

SEQ ID NO: 9069469 - DNA, 17 bp, Homo sapiens
gacttcaacttctgctg

SEQ ID NO: 9069470 - DNA, 20 bp, Homo sapiens
gacttcaatttctatctttt

SEQ ID NO: 9069471 - DNA, 22 bp, Homo sapiens
gacaggaggcagagctcaggtg

SEQ ID NO: 9069472 - DNA, 22 bp, Homo sapiens
gacaggaggcagagctcaggtg

SEQ ID NO: 9069473 - DNA, 22 bp, Homo sapiens
gacaggaggcagagctcaggtg

SEQ ID NO: 9069474 - DNA, 21 bp, Homo sapiens
gacaggcaaggagtcacttag

SEQ ID NO: 9069475 - DNA, 21 bp, Homo sapiens
gacaggcaaggagtcacttag

SEQ ID NO: 9069476 - DNA, 21 bp, Homo sapiens
gacaggcaaggagtcacttag

SEQ ID NO: 9069477 - DNA, 22 bp, Homo sapiens
gacaggcagacctgtgccctgg

SEQ ID NO: 9069478 - DNA, 22 bp, Homo sapiens
gacaggcagacctgtgccctgg

SEQ ID NO: 9069479 - DNA, 22 bp, Homo sapiens
gacaggcaccttgtctgtcttg

SEQ ID NO: 9069480 - DNA, 22 bp, Homo sapiens
gacaggcaattaccagcgccca

SEQ ID NO: 9069481 - DNA, 22 bp, Homo sapiens
gacaggcaccttgtctgtcttg

SEQ ID NO: 9069482 - DNA, 22 bp, Homo sapiens
gacaggcacgaaattgggctgg

SEQ ID NO: 9069483 - DNA, 22 bp, Homo sapiens
gacaggcaattaccagcgccca

SEQ ID NO: 9069484 - DNA, 22 bp, Homo sapiens
gacaggcacgaaattgggctgg

SEQ ID NO: 9069485 - DNA, 22 bp, Homo sapiens
gaccatcctggccaacgtggta

SEQ ID NO: 9069486 - DNA, 22 bp, Homo sapiens
gaccatctgtttaaagcagtgt

SEQ ID NO: 9069487 - DNA, 22 bp, Homo sapiens
gaccatctgtttaaagcagtgt

SEQ ID NO: 9069488 - DNA, 22 bp, Homo sapiens
gacaggcagacctgtgccctgg

SEQ ID NO: 9069489 - DNA, 22 bp, Homo sapiens
gacaggcatgctttcaggacta

SEQ ID NO: 9069490 - DNA, 22 bp, Homo sapiens
gacaggcatgctttcaggacta

SEQ ID NO: 9069491 - DNA, 22 bp, Homo sapiens
gacaggcatgctttcaggacta

SEQ ID NO: 9069492 - DNA, 22 bp, Homo sapiens
gacaggcaggccagggctgtgg

SEQ ID NO: 9069493 - DNA, 22 bp, Homo sapiens
gacaggcagttttccagatcag

SEQ ID NO: 9069494 - DNA, 22 bp, Homo sapiens
gacaggcaggccagggctgtgg

SEQ ID NO: 9069495 - DNA, 18 bp, Homo sapiens
gacccagcagatgggctt

SEQ ID NO: 9069496 - DNA, 22 bp, Homo sapiens
gacccagaggcctgacagtgtg

SEQ ID NO: 9069497 - DNA, 22 bp, Homo sapiens
gacccagaggcctgacagtgtg

SEQ ID NO: 9069498 - DNA, 22 bp, Homo sapiens
gaccatttttacagagcattca

SEQ ID NO: 9069499 - DNA, 22 bp, Homo sapiens
gacccagcttaagtcacatgtt

SEQ ID NO: 9069500 - DNA, 22 bp, Homo sapiens
gacccagcttaagtcacatgtt

SEQ ID NO: 9069501 - DNA, 22 bp, Homo sapiens
gacccagctaaccaggtgggga

SEQ ID NO: 9069502 - DNA, 22 bp, Homo sapiens
gaccatttccaccatgggcaca

SEQ ID NO: 9069503 - DNA, 18 bp, Homo sapiens
gacccagcagatgggctt

SEQ ID NO: 9069504 - DNA, 22 bp, Homo sapiens
gacccaggaagctacttctggt

SEQ ID NO: 9069505 - DNA, 22 bp, Homo sapiens
gacccaggcccaaggctgccag

SEQ ID NO: 9069506 - DNA, 22 bp, Homo sapiens
gacccagggtatccagagctgc

SEQ ID NO: 9069507 - DNA, 22 bp, Homo sapiens
gaactgtagttaatactacaca

SEQ ID NO: 9069508 - DNA, 22 bp, Homo sapiens
gaaggaagggctggctgtcttg

SEQ ID NO: 9069509 - DNA, 22 bp, Homo sapiens
gaaggaagctgtctggatgtgt

SEQ ID NO: 9069510 - DNA, 22 bp, Homo sapiens
gaaggaccctctggggtctcag

SEQ ID NO: 9069511 - DNA, 22 bp, Homo sapiens
gaaggaagtcattagtgcagac

SEQ ID NO: 9069512 - DNA, 22 bp, Homo sapiens
gaaggaagtcattagtgcagac

SEQ ID NO: 9069513 - DNA, 22 bp, Homo sapiens
gaaggaagtcattagtgcagac

SEQ ID NO: 9069514 - DNA, 19 bp, Homo sapiens
gaaggagagctgagttagg

SEQ ID NO: 9069515 - DNA, 22 bp, Homo sapiens
gaaggagagagacatcgtccct

SEQ ID NO: 9069516 - DNA, 22 bp, Homo sapiens
gaaggagaggattgtgaggctg

SEQ ID NO: 9069517 - DNA, 22 bp, Homo sapiens
gaaggagaggattgtgaggctg

SEQ ID NO: 9069518 - DNA, 21 bp, Homo sapiens
gaaggagaaagcaagtgctgc

SEQ ID NO: 9069519 - DNA, 22 bp, Homo sapiens
gaaggagaccctgaagatgctg

SEQ ID NO: 9069520 - DNA, 22 bp, Homo sapiens
gaaggagaccctgaagatgctg

SEQ ID NO: 9069521 - DNA, 22 bp, Homo sapiens
gaaggagagaaaggcaattctg

SEQ ID NO: 9069522 - DNA, 22 bp, Homo sapiens
gaaggagagagacatcgtccct

SEQ ID NO: 9069523 - DNA, 22 bp, Homo sapiens
gaaggcctgtggtagtgagacg

SEQ ID NO: 9069524 - DNA, 17 bp, Homo sapiens
gaaggcctgcacaggcc

SEQ ID NO: 9069525 - DNA, 22 bp, Homo sapiens
gaaggcctagggatgctctgcg

SEQ ID NO: 9069526 - DNA, 22 bp, Homo sapiens
gaaggcctctaccatagaaggc

SEQ ID NO: 9069527 - DNA, 22 bp, Homo sapiens
gaaggccctggtattcttgagg

SEQ ID NO: 9069528 - DNA, 22 bp, Homo sapiens
gaaggcctcactctgcagcata

SEQ ID NO: 9069529 - DNA, 22 bp, Homo sapiens
gaaggccctgttttccctattt

SEQ ID NO: 9069530 - DNA, 22 bp, Homo sapiens
gaaggcctagggatgctctgcg

SEQ ID NO: 9069531 - DNA, 22 bp, Homo sapiens
gaaggcctaggaaggaagcctt

SEQ ID NO: 9069532 - DNA, 22 bp, Homo sapiens
gaaggccctggtattcttgagg

SEQ ID NO: 9069533 - DNA, 22 bp, Homo sapiens
gaaggccctgttttccctattt

SEQ ID NO: 9069534 - DNA, 22 bp, Homo sapiens
gaaggagaggattgtgaggctg

SEQ ID NO: 9069535 - DNA, 22 bp, Homo sapiens
gaaggcccgccctgagcaaggg

SEQ ID NO: 9069536 - DNA, 22 bp, Homo sapiens
gaaggagagggtcaaggataat

SEQ ID NO: 9069537 - DNA, 22 bp, Homo sapiens
gaaggagagggtcaaggataat

SEQ ID NO: 9069538 - DNA, 22 bp, Homo sapiens
gaaggagagggtcaaggataat

SEQ ID NO: 9069539 - DNA, 22 bp, Homo sapiens
gaagtgcctcggtgtccaaggc

SEQ ID NO: 9069540 - DNA, 22 bp, Homo sapiens
gaagtgtctccgtttttaaagg

SEQ ID NO: 9069541 - DNA, 23 bp, Homo sapiens
gaagtgtctgagctgtatttttc

SEQ ID NO: 9069542 - DNA, 20 bp, Homo sapiens
gaagtgtcttgtttctggat

SEQ ID NO: 9069543 - DNA, 22 bp, Homo sapiens
gaagtgttgtatctttttaata

SEQ ID NO: 9069544 - DNA, 22 bp, Homo sapiens
gaagttacatactgtcacttct

SEQ ID NO: 9069545 - DNA, 22 bp, Homo sapiens
gaagtacaaaggacatggaaac

SEQ ID NO: 9069546 - DNA, 22 bp, Homo sapiens
gaagtgaagagattagaaatca

SEQ ID NO: 9069547 - DNA, 18 bp, Homo sapiens
gaagtgaagtgactcaat

SEQ ID NO: 9069548 - DNA, 22 bp, Homo sapiens
gaaggctctggggattgagata

SEQ ID NO: 9069549 - DNA, 22 bp, Homo sapiens
gaaggctctgatttcttgcaaa

SEQ ID NO: 9069550 - DNA, 22 bp, Homo sapiens
gaaggctctggggattgagata

SEQ ID NO: 9069551 - DNA, 22 bp, Homo sapiens
gaaggctccttgagggaaggac

SEQ ID NO: 9069552 - DNA, 22 bp, Homo sapiens
gaaggctagaaacgatgcttat

SEQ ID NO: 9069553 - DNA, 22 bp, Homo sapiens
gaaggcctgtggtagtgagacg

SEQ ID NO: 9069554 - DNA, 22 bp, Homo sapiens
gaaggctcctcaacctctcggg

SEQ ID NO: 9069555 - DNA, 22 bp, Homo sapiens
gaaggctgatgacagattctgc

SEQ ID NO: 9069556 - DNA, 22 bp, Homo sapiens
gaaggctgcatggaggctgtgg

SEQ ID NO: 9069557 - DNA, 22 bp, Homo sapiens
gaaggctgccagtggccctctt

SEQ ID NO: 9069558 - DNA, 22 bp, Homo sapiens
gaaggctgcgaggggagtgccg

SEQ ID NO: 9069559 - DNA, 22 bp, Homo sapiens
gaaggctgatgacagattctgc

SEQ ID NO: 9069560 - DNA, 22 bp, Homo sapiens
gaaggctgagcagacaggccaa

SEQ ID NO: 9069561 - DNA, 22 bp, Homo sapiens
gacacagagataggcctgtgtt

SEQ ID NO: 9069562 - DNA, 22 bp, Homo sapiens
gacacagagataggcctgtgtt

SEQ ID NO: 9069563 - DNA, 22 bp, Homo sapiens
gacacagatgatcaggtgtgga

SEQ ID NO: 9069564 - DNA, 22 bp, Homo sapiens
gacacagctttctgaagagcat

SEQ ID NO: 9069565 - DNA, 22 bp, Homo sapiens
gacacagcttgatgagggcttt

SEQ ID NO: 9069566 - DNA, 23 bp, Homo sapiens
gacacaggagcacccagctgagc

SEQ ID NO: 9069567 - DNA, 23 bp, Homo sapiens
gacacaggagcacccagctgagc

SEQ ID NO: 9069568 - DNA, 22 bp, Homo sapiens
gacacaggattcctggctctgc

SEQ ID NO: 9069569 - DNA, 20 bp, Homo sapiens
gacacaggcagtcctcagag

SEQ ID NO: 9069570 - DNA, 22 bp, Homo sapiens
gacacaggaaaagctccagccc

SEQ ID NO: 9069571 - DNA, 22 bp, Homo sapiens
gacacaggaaaagctccagccc

SEQ ID NO: 9069572 - DNA, 22 bp, Homo sapiens
gacacaggaatcaccttggatg

SEQ ID NO: 9069573 - DNA, 18 bp, Homo sapiens
gacacaggagagagtccc

SEQ ID NO: 9069574 - DNA, 23 bp, Homo sapiens
gacacaggagcacccagctgagc

SEQ ID NO: 9069575 - DNA, 20 bp, Homo sapiens
gacaggagagttaggtaggt

SEQ ID NO: 9069576 - DNA, 20 bp, Homo sapiens
gacaggagagttaggtaggt

SEQ ID NO: 9069577 - DNA, 22 bp, Homo sapiens
gacaggaatgtgtggatgcgga

SEQ ID NO: 9069578 - DNA, 21 bp, Homo sapiens
gacaggactagaccagagctc

SEQ ID NO: 9069579 - DNA, 19 bp, Homo sapiens
gacaggacgaagggaagtt

SEQ ID NO: 9069580 - DNA, 22 bp, Homo sapiens
gacaggaacataaatgtaggag

SEQ ID NO: 9069581 - DNA, 22 bp, Homo sapiens
gacaggaacataaatgtaggag

SEQ ID NO: 9069582 - DNA, 19 bp, Homo sapiens
gacaggaaggctaccagta

SEQ ID NO: 9069583 - DNA, 22 bp, Homo sapiens
gacaggaagtctgaaggaggga

SEQ ID NO: 9069584 - DNA, 22 bp, Homo sapiens
gacaggaagtctgaaggaggga

SEQ ID NO: 9069585 - DNA, 22 bp, Homo sapiens
gacacaggggggcgctagaaga

SEQ ID NO: 9069586 - DNA, 22 bp, Homo sapiens
gacacagggggatgtgtggacg

SEQ ID NO: 9069587 - DNA, 22 bp, Homo sapiens
gacacagggggatgtgtggacg

SEQ ID NO: 9069588 - DNA, 22 bp, Homo sapiens
gacacagggacgtgctctgcct

SEQ ID NO: 9069589 - DNA, 20 bp, Homo sapiens
gacacaggcagtcctcagag

SEQ ID NO: 9069590 - DNA, 22 bp, Homo sapiens
gacagctgtggagaggcatgtg

SEQ ID NO: 9069591 - DNA, 22 bp, Homo sapiens
gacagctgtgcaggagaagggg

SEQ ID NO: 9069592 - DNA, 22 bp, Homo sapiens
gacagctgtggagaggcatgtg

SEQ ID NO: 9069593 - DNA, 22 bp, Homo sapiens
gacaggaacataaatgtaggag

SEQ ID NO: 9069594 - DNA, 22 bp, Homo sapiens
gacacaggtagaataaagtact

SEQ ID NO: 9069595 - DNA, 18 bp, Homo sapiens
gacagctgtcctgagccc

SEQ ID NO: 9069596 - DNA, 22 bp, Homo sapiens
gaattgctgatgaatctgattg

SEQ ID NO: 9069597 - DNA, 22 bp, Homo sapiens
gaattgctctgcctggccagcc

SEQ ID NO: 9069598 - DNA, 22 bp, Homo sapiens
gaattgctaaccaattcaaaat

SEQ ID NO: 9069599 - DNA, 22 bp, Homo sapiens
gaattgatgcttatggtcaggg

SEQ ID NO: 9069600 - DNA, 22 bp, Homo sapiens
gaattctgggagagatctgaca

SEQ ID NO: 9069601 - DNA, 22 bp, Homo sapiens
gaattctagtcacacacattca

SEQ ID NO: 9069602 - DNA, 22 bp, Homo sapiens
gaagttctcaaggatcacagaa

SEQ ID NO: 9069603 - DNA, 22 bp, Homo sapiens
gaagttctcaaggatcacagaa

SEQ ID NO: 9069604 - DNA, 22 bp, Homo sapiens
gaagttcctcgtaggagtctct

SEQ ID NO: 9069605 - DNA, 21 bp, Homo sapiens
gaagttcatgatctttctgct

SEQ ID NO: 9069606 - DNA, 22 bp, Homo sapiens
gaagttcaggtgggaattgagc

SEQ ID NO: 9069607 - DNA, 22 bp, Homo sapiens
gaagttcacatagctggcaggt

SEQ ID NO: 9069608 - DNA, 22 bp, Homo sapiens
gaagttcaatgtcagcatctat

SEQ ID NO: 9069609 - DNA, 22 bp, Homo sapiens
gaagttcaactgccatgcttgg

SEQ ID NO: 9069610 - DNA, 22 bp, Homo sapiens
gaagttcaaaagacagatttga

SEQ ID NO: 9069611 - DNA, 22 bp, Homo sapiens
gaagttcaactgccatgcttgg

SEQ ID NO: 9069612 - DNA, 22 bp, Homo sapiens
gaattcaagtgcaatggtatat

SEQ ID NO: 9069613 - DNA, 22 bp, Homo sapiens
gaattcaatttcttggtctttg

SEQ ID NO: 9069614 - DNA, 22 bp, Homo sapiens
gaattccactttggcttttggg

SEQ ID NO: 9069615 - DNA, 22 bp, Homo sapiens
gaattcctctgagctaggagat

SEQ ID NO: 9069616 - DNA, 22 bp, Homo sapiens
gaagttctagaactgtgccctt

SEQ ID NO: 9069617 - DNA, 22 bp, Homo sapiens
gaggggaaagtgtgaggctgcg

SEQ ID NO: 9069618 - DNA, 22 bp, Homo sapiens
gaggggaaagtgtgaggctgcg

SEQ ID NO: 9069619 - DNA, 22 bp, Homo sapiens
gagggccaatgtgtccctgagc

SEQ ID NO: 9069620 - DNA, 22 bp, Homo sapiens
gagggcagtagcctcgtaccct

SEQ ID NO: 9069621 - DNA, 22 bp, Homo sapiens
gagggcagagtctaatgatgca

SEQ ID NO: 9069622 - DNA, 22 bp, Homo sapiens
gagggcaggggtcttgcacggt

SEQ ID NO: 9069623 - DNA, 22 bp, Homo sapiens
gaggggcagaggtagagaacaa

SEQ ID NO: 9069624 - DNA, 21 bp, Homo sapiens
gaggggcagctcttagcatta

SEQ ID NO: 9069625 - DNA, 22 bp, Homo sapiens
gaggggcacagtaaagggtccc

SEQ ID NO: 9069626 - DNA, 22 bp, Homo sapiens
gaggggcagaatgtgatcaggg

SEQ ID NO: 9069627 - DNA, 22 bp, Homo sapiens
gaggggcaatgagggaaagagt

SEQ ID NO: 9069628 - DNA, 22 bp, Homo sapiens
gaggggagtgtcctccgggccc

SEQ ID NO: 9069629 - DNA, 22 bp, Homo sapiens
gaggggagtgtcctccgggccc

SEQ ID NO: 9069630 - DNA, 22 bp, Homo sapiens
gaggggagtaaagtcatgttac

SEQ ID NO: 9069631 - DNA, 22 bp, Homo sapiens
gagggatctttaggcagcctca

SEQ ID NO: 9069632 - DNA, 22 bp, Homo sapiens
gagggcagagacagtgattcac

SEQ ID NO: 9069633 - DNA, 22 bp, Homo sapiens
gagggatggtagttgacactga

SEQ ID NO: 9069634 - DNA, 22 bp, Homo sapiens
gaggctgggaagtccaagatca

SEQ ID NO: 9069635 - DNA, 22 bp, Homo sapiens
gaggctgggaagtccaatatca

SEQ ID NO: 9069636 - DNA, 22 bp, Homo sapiens
gaggctgggggctgccttcctc

SEQ ID NO: 9069637 - DNA, 22 bp, Homo sapiens
gaggctgggaagtccaagacca

SEQ ID NO: 9069638 - DNA, 22 bp, Homo sapiens
gaggctggcagaaaagcacagg

SEQ ID NO: 9069639 - DNA, 22 bp, Homo sapiens
gaggctggaatattagaaatgt

SEQ ID NO: 9069640 - DNA, 22 bp, Homo sapiens
gaggctggaatattagaaatgt

SEQ ID NO: 9069641 - DNA, 22 bp, Homo sapiens
gaggctggacgtgcatttctac

SEQ ID NO: 9069642 - DNA, 22 bp, Homo sapiens
gaggctggaatattagaaatgt

SEQ ID NO: 9069643 - DNA, 22 bp, Homo sapiens
gaggcctgaggctgcctggagc

SEQ ID NO: 9069644 - DNA, 22 bp, Homo sapiens
gaggcctgaggctgcctggagc

SEQ ID NO: 9069645 - DNA, 22 bp, Homo sapiens
gaggctgcccaactggagtgga

SEQ ID NO: 9069646 - DNA, 22 bp, Homo sapiens
gaggcctgctttggcactctgg

SEQ ID NO: 9069647 - DNA, 22 bp, Homo sapiens
gaggcctgctttggcactctgg

SEQ ID NO: 9069648 - DNA, 22 bp, Homo sapiens
gaggcctgctttggcactctgg

SEQ ID NO: 9069649 - DNA, 22 bp, Homo sapiens
gaggctggagatattccaatct

SEQ ID NO: 9069650 - DNA, 22 bp, Homo sapiens
gaggctggagatattccaatct

SEQ ID NO: 9069651 - DNA, 22 bp, Homo sapiens
gaggctggacgtgcatttctac

SEQ ID NO: 9069652 - DNA, 22 bp, Homo sapiens
gaggctggaggtcaaagatgaa

SEQ ID NO: 9069653 - DNA, 22 bp, Homo sapiens
gaggctggaggtcaaagatgaa

SEQ ID NO: 9069654 - DNA, 22 bp, Homo sapiens
gaggctggcagaaaagcacagg

SEQ ID NO: 9069655 - DNA, 16 bp, Homo sapiens
gaggctggcagatgtc

SEQ ID NO: 9069656 - DNA, 19 bp, Homo sapiens
gaggtcagcaagaagtatt

SEQ ID NO: 9069657 - DNA, 22 bp, Homo sapiens
gaggtatcttagagagtgtaga

SEQ ID NO: 9069658 - DNA, 23 bp, Homo sapiens
gaggtcaaggctgcagtgattgc

SEQ ID NO: 9069659 - DNA, 22 bp, Homo sapiens
gaggtaacaactgaaatgagaa

SEQ ID NO: 9069660 - DNA, 22 bp, Homo sapiens
gaggtaacactgttcagtgggc

SEQ ID NO: 9069661 - DNA, 22 bp, Homo sapiens
gagggttggtgcaaatgggatg

SEQ ID NO: 9069662 - DNA, 22 bp, Homo sapiens
gaggggcctggcactgagctgg

SEQ ID NO: 9069663 - DNA, 22 bp, Homo sapiens
gaggtccagccaagcggcaagg

SEQ ID NO: 9069664 - DNA, 22 bp, Homo sapiens
gaggtccagggtggggcctgag

SEQ ID NO: 9069665 - DNA, 22 bp, Homo sapiens
gaggtccagggtggggcctgag

SEQ ID NO: 9069666 - DNA, 22 bp, Homo sapiens
gaggtgggcggatcacaaggtc

SEQ ID NO: 9069667 - DNA, 22 bp, Homo sapiens
gaggtgggatgtgtgtgctact

SEQ ID NO: 9069668 - DNA, 22 bp, Homo sapiens
gaggtccactgaggcaacaggg

SEQ ID NO: 9069669 - DNA, 22 bp, Homo sapiens
gaggtccactgaggcaacaggg

SEQ ID NO: 9069670 - DNA, 22 bp, Homo sapiens
gaggtcaggtgaggaattaaga

SEQ ID NO: 9069671 - DNA, 22 bp, Homo sapiens
gaggtcaggggagaggctgatg

SEQ ID NO: 9069672 - DNA, 22 bp, Homo sapiens
gaggtcaggggagaggctgatg

SEQ ID NO: 9069673 - DNA, 22 bp, Homo sapiens
gaggtcaggggagaggctgatg

SEQ ID NO: 9069674 - DNA, 22 bp, Homo sapiens
gaggtcaggcttgcagcagggt

SEQ ID NO: 9069675 - DNA, 22 bp, Homo sapiens
gaggtcaggcttgcagcagggt

SEQ ID NO: 9069676 - DNA, 22 bp, Homo sapiens
gaggtcaggctcaagctgggcc

SEQ ID NO: 9069677 - DNA, 22 bp, Homo sapiens
gaggtcaggcttgcagcagggt

SEQ ID NO: 9069678 - DNA, 22 bp, Homo sapiens
gaggtcaggctcaagctgggcc

SEQ ID NO: 9069679 - DNA, 22 bp, Homo sapiens
gagtccaagctagagccactca

SEQ ID NO: 9069680 - DNA, 22 bp, Homo sapiens
gagtccagttgttcacagaggc

SEQ ID NO: 9069681 - DNA, 22 bp, Homo sapiens
gagtcccatgatgatagccaca

SEQ ID NO: 9069682 - DNA, 22 bp, Homo sapiens
gagtcaggcatgaaggtaatta

SEQ ID NO: 9069683 - DNA, 22 bp, Homo sapiens
gagtcaggctagggtgacaggc

SEQ ID NO: 9069684 - DNA, 22 bp, Homo sapiens
gagtcagaatgtcctcctgcgg

SEQ ID NO: 9069685 - DNA, 22 bp, Homo sapiens
gagtcagattgcagacagggct

SEQ ID NO: 9069686 - DNA, 22 bp, Homo sapiens
gagtcagatgaagataaaaggg

SEQ ID NO: 9069687 - DNA, 22 bp, Homo sapiens
gagtcagaccgactgggctcat

SEQ ID NO: 9069688 - DNA, 22 bp, Homo sapiens
gagtcagaccgactgggctcat

SEQ ID NO: 9069689 - DNA, 22 bp, Homo sapiens
gagtcagaagaaactatttaca

SEQ ID NO: 9069690 - DNA, 22 bp, Homo sapiens
gagtcagaaagtagtgtgccta

SEQ ID NO: 9069691 - DNA, 22 bp, Homo sapiens
gagtcagaattgtattttaaac

SEQ ID NO: 9069692 - DNA, 22 bp, Homo sapiens
gagtcagaatgtcctcctgcgg

SEQ ID NO: 9069693 - DNA, 22 bp, Homo sapiens
gagtcagacagggtcacccaga

SEQ ID NO: 9069694 - DNA, 22 bp, Homo sapiens
gaggtggtggtggaggcatagc

SEQ ID NO: 9069695 - DNA, 22 bp, Homo sapiens
gagtcagaaactcactctatag

SEQ ID NO: 9069696 - DNA, 22 bp, Homo sapiens
gagtcagaaagtagtgtgccta

SEQ ID NO: 9069697 - DNA, 20 bp, Homo sapiens
gagtcacagaagaagctgaa

SEQ ID NO: 9069698 - DNA, 22 bp, Homo sapiens
gagtcacaaaagatgcccaggg

SEQ ID NO: 9069699 - DNA, 22 bp, Homo sapiens
gaggcagctgaaggagtgacag

SEQ ID NO: 9069700 - DNA, 22 bp, Homo sapiens
gaggcagctgaagcttcaaaga

SEQ ID NO: 9069701 - DNA, 22 bp, Homo sapiens
gaggcagctgaaggagtgacag

SEQ ID NO: 9069702 - DNA, 22 bp, Homo sapiens
gaggcagctgaaggagtgacag

SEQ ID NO: 9069703 - DNA, 22 bp, Homo sapiens
gaggcagctgggatacaaggga

SEQ ID NO: 9069704 - DNA, 22 bp, Homo sapiens
gaggcagctgggatacaaggga

SEQ ID NO: 9069705 - DNA, 22 bp, Homo sapiens
gaggcccagcattcagggcagg

SEQ ID NO: 9069706 - DNA, 22 bp, Homo sapiens
gaggcagctgggctggtggttt

SEQ ID NO: 9069707 - DNA, 22 bp, Homo sapiens
gaggcccagtcctgcaagcacg

SEQ ID NO: 9069708 - DNA, 22 bp, Homo sapiens
gaggcccaggtcaagcagccac

SEQ ID NO: 9069709 - DNA, 23 bp, Homo sapiens
gaggcagctcctgcagtgccctg

SEQ ID NO: 9069710 - DNA, 18 bp, Homo sapiens
gaggcagctagcaatttt

SEQ ID NO: 9069711 - DNA, 22 bp, Homo sapiens
gaggcagctcttctgaatgggg

SEQ ID NO: 9069712 - DNA, 23 bp, Homo sapiens
gaggcagctcctgcagtgccctg

SEQ ID NO: 9069713 - DNA, 22 bp, Homo sapiens
gaggcagctcttctgaatgggg

SEQ ID NO: 9069714 - DNA, 23 bp, Homo sapiens
gaggcagctcctgcagtgccctg

SEQ ID NO: 9069715 - DNA, 22 bp, Homo sapiens
gaggcagctgaagcttcaaaga

SEQ ID NO: 9069716 - DNA, 22 bp, Homo sapiens
gaggcagctcttctgaatgggg

SEQ ID NO: 9069717 - DNA, 22 bp, Homo sapiens
gaggcagcagaacatggaagag

SEQ ID NO: 9069718 - DNA, 18 bp, Homo sapiens
gaggcagctagcaatttt

SEQ ID NO: 9069719 - DNA, 22 bp, Homo sapiens
gaggcagcaggctgaggaggat

SEQ ID NO: 9069720 - DNA, 22 bp, Homo sapiens
gaggcagcaggctgaggaggat

SEQ ID NO: 9069721 - DNA, 22 bp, Homo sapiens
gaggccctgaagacagctgggg

SEQ ID NO: 9069722 - DNA, 22 bp, Homo sapiens
gaggccctggtaggtcagagtg

SEQ ID NO: 9069723 - DNA, 22 bp, Homo sapiens
gaggcctagtctgcctgctcac

SEQ ID NO: 9069724 - DNA, 20 bp, Homo sapiens
gaggcctcagcctcagctcc

SEQ ID NO: 9069725 - DNA, 20 bp, Homo sapiens
gaggcctcagcctcagctcc

SEQ ID NO: 9069726 - DNA, 20 bp, Homo sapiens
gaggcctcagcctcagctcc

SEQ ID NO: 9069727 - DNA, 22 bp, Homo sapiens
gaggccctccagctgtcagctg

SEQ ID NO: 9069728 - DNA, 22 bp, Homo sapiens
gaggccctccagctgtcagctg

SEQ ID NO: 9069729 - DNA, 22 bp, Homo sapiens
gaggcccagtcctgcaagcacg

SEQ ID NO: 9069730 - DNA, 22 bp, Homo sapiens
gaggcctgaaaggggacctatg

SEQ ID NO: 9069731 - DNA, 22 bp, Homo sapiens
gaggcctctgtcccgccaggga

SEQ ID NO: 9069732 - DNA, 22 bp, Homo sapiens
gaggcctcttctttgttaacct

SEQ ID NO: 9069733 - DNA, 18 bp, Homo sapiens
gaggcctgagaaccaggt

SEQ ID NO: 9069734 - DNA, 18 bp, Homo sapiens
gaggcctgagaaccaggt

SEQ ID NO: 9069735 - DNA, 22 bp, Homo sapiens
gaggcctcctctgagacatctg

SEQ ID NO: 9069736 - DNA, 22 bp, Homo sapiens
gaggcctcaggcgtgggaaggg

SEQ ID NO: 9069737 - DNA, 22 bp, Homo sapiens
gaggcctcaggaatgtcgtgtg

SEQ ID NO: 9069738 - DNA, 21 bp, Homo sapiens
gaggcctcagcctcagctcct

SEQ ID NO: 9069739 - DNA, 22 bp, Homo sapiens
gaggcctctgtcccaccaggga

SEQ ID NO: 9069740 - DNA, 22 bp, Homo sapiens
gaggcagaggttgcagtgagct

SEQ ID NO: 9069741 - DNA, 22 bp, Homo sapiens
gaggcagaggttgttgcagtga

SEQ ID NO: 9069742 - DNA, 22 bp, Homo sapiens
gaggcagaggttgttgcagtga

SEQ ID NO: 9069743 - DNA, 22 bp, Homo sapiens
gaggcagagtcacaaagagtct

SEQ ID NO: 9069744 - DNA, 22 bp, Homo sapiens
gaggcagagtcacaaagagtct

SEQ ID NO: 9069745 - DNA, 22 bp, Homo sapiens
gaggcagagtcacaaagagtct

SEQ ID NO: 9069746 - DNA, 22 bp, Homo sapiens
gaggcagcaaaatatatcataa

SEQ ID NO: 9069747 - DNA, 22 bp, Homo sapiens
gaggcagcaaaatatatcataa

SEQ ID NO: 9069748 - DNA, 22 bp, Homo sapiens
gaggcagcaataaaaagaattt

SEQ ID NO: 9069749 - DNA, 22 bp, Homo sapiens
gaggcagaggttgcagtgagct

SEQ ID NO: 9069750 - DNA, 22 bp, Homo sapiens
gaggcagaggttgcagtgagct

SEQ ID NO: 9069751 - DNA, 22 bp, Homo sapiens
gaggcagaggttgcagtgagct

SEQ ID NO: 9069752 - DNA, 22 bp, Homo sapiens
gaggaggtcgctgctgagcccc

SEQ ID NO: 9069753 - DNA, 22 bp, Homo sapiens
gaggaggtcccccgacatgcct

SEQ ID NO: 9069754 - DNA, 22 bp, Homo sapiens
gaggaggtcccccgacatgcct

SEQ ID NO: 9069755 - DNA, 23 bp, Homo sapiens
gaggagggtctgacaagtgtagc

SEQ ID NO: 9069756 - DNA, 22 bp, Homo sapiens
gaggaggcttccgggaggcacg

SEQ ID NO: 9069757 - DNA, 19 bp, Homo sapiens
gaggaggcttcagctttct

SEQ ID NO: 9069758 - DNA, 22 bp, Homo sapiens
gaggaggctgaacaatgccctg

SEQ ID NO: 9069759 - DNA, 22 bp, Homo sapiens
gaggaaggtcccatcagaattt

SEQ ID NO: 9069760 - DNA, 21 bp, Homo sapiens
gaggaatggtttgcaaagcac

SEQ ID NO: 9069761 - DNA, 22 bp, Homo sapiens
gaggaatgggtgtctcgtgatt

SEQ ID NO: 9069762 - DNA, 22 bp, Homo sapiens
gaggaatgggtgtctcgtgatt

SEQ ID NO: 9069763 - DNA, 22 bp, Homo sapiens
gaggaatgtcagcacaggcctc

SEQ ID NO: 9069764 - DNA, 22 bp, Homo sapiens
gaggacaaggccttgcaattct

SEQ ID NO: 9069765 - DNA, 23 bp, Homo sapiens
gaggacacagcccagacagccgt

SEQ ID NO: 9069766 - DNA, 22 bp, Homo sapiens
gaggacagagccgcctggcaag

SEQ ID NO: 9069767 - DNA, 22 bp, Homo sapiens
gaggacagagccgcctggcaag

SEQ ID NO: 9069768 - DNA, 22 bp, Homo sapiens
gaggacagagccgcctggcaag

SEQ ID NO: 9069769 - DNA, 22 bp, Homo sapiens
gaggacacggccttttggaaaa

SEQ ID NO: 9069770 - DNA, 22 bp, Homo sapiens
gaggacagcttagggcttcctg

SEQ ID NO: 9069771 - DNA, 22 bp, Homo sapiens
gaggacagcttagggcttcctg

SEQ ID NO: 9069772 - DNA, 22 bp, Homo sapiens
gaggacagcttagggcttcctg

SEQ ID NO: 9069773 - DNA, 22 bp, Homo sapiens
gaggacagcttagggcttcctg

SEQ ID NO: 9069774 - DNA, 22 bp, Homo sapiens
gaggacagctctaactaaagtc

SEQ ID NO: 9069775 - DNA, 22 bp, Homo sapiens
gaggaagagagctctgccttgt

SEQ ID NO: 9069776 - DNA, 22 bp, Homo sapiens
gaggaagagagctctgccttgt

SEQ ID NO: 9069777 - DNA, 22 bp, Homo sapiens
gaggaagagcatggccagtttc

SEQ ID NO: 9069778 - DNA, 22 bp, Homo sapiens
gaggaagagcatggccagtttc

SEQ ID NO: 9069779 - DNA, 22 bp, Homo sapiens
gaggaagggctgcctgccgggc

SEQ ID NO: 9069780 - DNA, 22 bp, Homo sapiens
gagctgggaggactgggaactt

SEQ ID NO: 9069781 - DNA, 22 bp, Homo sapiens
gagctgggagttatagcatgtt

SEQ ID NO: 9069782 - DNA, 18 bp, Homo sapiens
gagctgggagaaggaagg

SEQ ID NO: 9069783 - DNA, 22 bp, Homo sapiens
gagctgggacttggaatccaca

SEQ ID NO: 9069784 - DNA, 22 bp, Homo sapiens
gagagttctacctctgaaggcg

SEQ ID NO: 9069785 - DNA, 22 bp, Homo sapiens
gagagttccagtaagtggattc

SEQ ID NO: 9069786 - DNA, 22 bp, Homo sapiens
gagataaagctaccatgttgat

SEQ ID NO: 9069787 - DNA, 22 bp, Homo sapiens
gagagttcttgcctgggtatta

SEQ ID NO: 9069788 - DNA, 22 bp, Homo sapiens
gagatacttaagatggggctcc

SEQ ID NO: 9069789 - DNA, 22 bp, Homo sapiens
gagatactttacagtgattgcc

SEQ ID NO: 9069790 - DNA, 19 bp, Homo sapiens
gagatactgaagtgaggaa

SEQ ID NO: 9069791 - DNA, 22 bp, Homo sapiens
gagatactgcgttgtattaggt

SEQ ID NO: 9069792 - DNA, 22 bp, Homo sapiens
gagatataagatctagaaagga

SEQ ID NO: 9069793 - DNA, 22 bp, Homo sapiens
gagagtggatggagctgcgaag

SEQ ID NO: 9069794 - DNA, 22 bp, Homo sapiens
gagagtggatggagctgcgaag

SEQ ID NO: 9069795 - DNA, 22 bp, Homo sapiens
gagagtctagtgcacctagttt

SEQ ID NO: 9069796 - DNA, 22 bp, Homo sapiens
gagagtctagtgcacctagttt

SEQ ID NO: 9069797 - DNA, 22 bp, Homo sapiens
gagagtgagatcctcctgggga

SEQ ID NO: 9069798 - DNA, 22 bp, Homo sapiens
gagagtgaggcatcaggggcag

SEQ ID NO: 9069799 - DNA, 22 bp, Homo sapiens
gagctggcaagtctgtccttgg

SEQ ID NO: 9069800 - DNA, 22 bp, Homo sapiens
gagctggcacagaaggatctta

SEQ ID NO: 9069801 - DNA, 22 bp, Homo sapiens
gagctggcacagaaggatctta

SEQ ID NO: 9069802 - DNA, 22 bp, Homo sapiens
gagctggcacagaaggatctta

SEQ ID NO: 9069803 - DNA, 22 bp, Homo sapiens
gagctggccgcagagagggcag

SEQ ID NO: 9069804 - DNA, 22 bp, Homo sapiens
gagctggcagtggtagacatgg

SEQ ID NO: 9069805 - DNA, 22 bp, Homo sapiens
gagctggcaggaggctccccga

SEQ ID NO: 9069806 - DNA, 22 bp, Homo sapiens
gagctggcaatgacttgtgtat

SEQ ID NO: 9069807 - DNA, 22 bp, Homo sapiens
gagctggcaggaggctccccga

SEQ ID NO: 9069808 - DNA, 22 bp, Homo sapiens
gagctggaggcagtgctgaggt

SEQ ID NO: 9069809 - DNA, 22 bp, Homo sapiens
gagctggaggaccaggactggg

SEQ ID NO: 9069810 - DNA, 22 bp, Homo sapiens
gagctggaggaccaggactggg

SEQ ID NO: 9069811 - DNA, 22 bp, Homo sapiens
gagctggaagtctgtggtcaga

SEQ ID NO: 9069812 - DNA, 22 bp, Homo sapiens
gagctggccgcagagagggcag

SEQ ID NO: 9069813 - DNA, 22 bp, Homo sapiens
gagctggctgtggttgagtgca

SEQ ID NO: 9069814 - DNA, 22 bp, Homo sapiens
gagctgggaagatagcttgagc

SEQ ID NO: 9069815 - DNA, 22 bp, Homo sapiens
gagctggctaatactgacttat

SEQ ID NO: 9069816 - DNA, 22 bp, Homo sapiens
gagctggctccgccatgctgct

SEQ ID NO: 9069817 - DNA, 22 bp, Homo sapiens
gagctggctccgccatgctgct

SEQ ID NO: 9069818 - DNA, 22 bp, Homo sapiens
gagctggctccgccatgctgct

SEQ ID NO: 9069819 - DNA, 22 bp, Homo sapiens
gagctggctcctccgaggatgg

SEQ ID NO: 9069820 - DNA, 22 bp, Homo sapiens
gagctggctgtggttgagtgca

SEQ ID NO: 9069821 - DNA, 22 bp, Homo sapiens
gagctggccgcagagagggcag

SEQ ID NO: 9069822 - DNA, 22 bp, Homo sapiens
gagctggcctcaggcacaggag

SEQ ID NO: 9069823 - DNA, 22 bp, Homo sapiens
gagctggctaatactgacttat

SEQ ID NO: 9069824 - DNA, 22 bp, Homo sapiens
gatctttagccaagacacacca

SEQ ID NO: 9069825 - DNA, 22 bp, Homo sapiens
gatctttatactgtaataatga

SEQ ID NO: 9069826 - DNA, 21 bp, Homo sapiens
gatctttactttcctacttac

SEQ ID NO: 9069827 - DNA, 22 bp, Homo sapiens
gatctttactactgccttctct

SEQ ID NO: 9069828 - DNA, 22 bp, Homo sapiens
gatctggtttcatcatggactt

SEQ ID NO: 9069829 - DNA, 22 bp, Homo sapiens
gatctggtacaggcctgcagcc

SEQ ID NO: 9069830 - DNA, 22 bp, Homo sapiens
gatctggtacaggcctgcagcc

SEQ ID NO: 9069831 - DNA, 22 bp, Homo sapiens
gatctgggctggagactgagaa

SEQ ID NO: 9069832 - DNA, 22 bp, Homo sapiens
gatccagcttctacacagagct

SEQ ID NO: 9069833 - DNA, 22 bp, Homo sapiens
gatgaaaatcttgagatgtcga

SEQ ID NO: 9069834 - DNA, 22 bp, Homo sapiens
gatgaaaaattgctgtgtcata

SEQ ID NO: 9069835 - DNA, 22 bp, Homo sapiens
gatgaaaaattgctgtgtcata

SEQ ID NO: 9069836 - DNA, 22 bp, Homo sapiens
gatgaaaaattgctgtgtcata

SEQ ID NO: 9069837 - DNA, 22 bp, Homo sapiens
gatcttttcagtcttggtagtt

SEQ ID NO: 9069838 - DNA, 22 bp, Homo sapiens
gatcttttcaggtttctctagt

SEQ ID NO: 9069839 - DNA, 22 bp, Homo sapiens
gatcttttcaggtttctctagt

SEQ ID NO: 9069840 - DNA, 22 bp, Homo sapiens
gatgaaaaaagacgagcatata

SEQ ID NO: 9069841 - DNA, 22 bp, Homo sapiens
gatcttttcagaatttatcagt

SEQ ID NO: 9069842 - DNA, 22 bp, Homo sapiens
gatcttttcagaatttatcagt

SEQ ID NO: 9069843 - DNA, 22 bp, Homo sapiens
gatgaaatgctgagcctgagtt

SEQ ID NO: 9069844 - DNA, 22 bp, Homo sapiens
gatgaaatagaattaatttagg

SEQ ID NO: 9069845 - DNA, 22 bp, Homo sapiens
gatgaaatccagatcacaggtg

SEQ ID NO: 9069846 - DNA, 22 bp, Homo sapiens
gatgcagggctggcaggagctt

SEQ ID NO: 9069847 - DNA, 22 bp, Homo sapiens
gatgcagggctggcaggagctt

SEQ ID NO: 9069848 - DNA, 22 bp, Homo sapiens
gatgcagggctggcaggagctt

SEQ ID NO: 9069849 - DNA, 22 bp, Homo sapiens
gatgcagggaacttagtgggct

SEQ ID NO: 9069850 - DNA, 22 bp, Homo sapiens
gatgcagaaagtagacaccatc

SEQ ID NO: 9069851 - DNA, 22 bp, Homo sapiens
gatgcaaagataaaacagacgc

SEQ ID NO: 9069852 - DNA, 22 bp, Homo sapiens
gatgcaaagataaaacagacgc

SEQ ID NO: 9069853 - DNA, 22 bp, Homo sapiens
gatgcaaagataaaacagacgc

SEQ ID NO: 9069854 - DNA, 22 bp, Homo sapiens
gatgcacagtgaccctgccagt

SEQ ID NO: 9069855 - DNA, 22 bp, Homo sapiens
gatgattttatgtcttgtcatt

SEQ ID NO: 9069856 - DNA, 22 bp, Homo sapiens
gatgattttagttgactaaact

SEQ ID NO: 9069857 - DNA, 22 bp, Homo sapiens
gatgatttgaggatttcatgag

SEQ ID NO: 9069858 - DNA, 22 bp, Homo sapiens
gatgattttctgtgttagaaga

SEQ ID NO: 9069859 - DNA, 22 bp, Homo sapiens
gatgattttgatgcagtaaaga

SEQ ID NO: 9069860 - DNA, 22 bp, Homo sapiens
gatgatttctccattcccttct

SEQ ID NO: 9069861 - DNA, 22 bp, Homo sapiens
gatgatttaagtggccaaagta

SEQ ID NO: 9069862 - DNA, 22 bp, Homo sapiens
gatgcaaactgtgacatagagt

SEQ ID NO: 9069863 - DNA, 22 bp, Homo sapiens
gatgcaaagaggaccttcagta

SEQ ID NO: 9069864 - DNA, 22 bp, Homo sapiens
gatgcaaaccttacatggacct

SEQ ID NO: 9069865 - DNA, 22 bp, Homo sapiens
gatgcaaactgtgacatagagt

SEQ ID NO: 9069866 - DNA, 22 bp, Homo sapiens
gatgattttgatgcagtaaaga

SEQ ID NO: 9069867 - DNA, 22 bp, Homo sapiens
gatgattttgttggtgattcaa

SEQ ID NO: 9069868 - DNA, 22 bp, Homo sapiens
gatgatttttgccagtgtgatg

SEQ ID NO: 9069869 - DNA, 22 bp, Homo sapiens
gatgagaaatggacaggagtgg

SEQ ID NO: 9069870 - DNA, 22 bp, Homo sapiens
gatgagaaggctcagatccaaa

SEQ ID NO: 9069871 - DNA, 22 bp, Homo sapiens
gatgagaatgtttatcaaatgc

SEQ ID NO: 9069872 - DNA, 20 bp, Homo sapiens
gatgagacccatgcatgaga

SEQ ID NO: 9069873 - DNA, 22 bp, Homo sapiens
gatgatgggatccagcaatgta

SEQ ID NO: 9069874 - DNA, 22 bp, Homo sapiens
gatgatgggttgatgtgaaggg

SEQ ID NO: 9069875 - DNA, 22 bp, Homo sapiens
gatgagctgctcaatctgtggt

SEQ ID NO: 9069876 - DNA, 22 bp, Homo sapiens
gatgaggaaaccaaggctcagg

SEQ ID NO: 9069877 - DNA, 22 bp, Homo sapiens
gatgaggaaaccaaggctcagg

SEQ ID NO: 9069878 - DNA, 22 bp, Homo sapiens
gatgaggaaaccaaggctcagg

SEQ ID NO: 9069879 - DNA, 22 bp, Homo sapiens
gatgaagaggcactgacatatt

SEQ ID NO: 9069880 - DNA, 22 bp, Homo sapiens
gatgaagtcattatccttttgg

SEQ ID NO: 9069881 - DNA, 22 bp, Homo sapiens
gatgaagctatttggttggcac

SEQ ID NO: 9069882 - DNA, 18 bp, Homo sapiens
gatgaagctgctggggat

SEQ ID NO: 9069883 - DNA, 22 bp, Homo sapiens
gatgaagctttgaagtctaatc

SEQ ID NO: 9069884 - DNA, 22 bp, Homo sapiens
gatgaagcctgacttctcggtg

SEQ ID NO: 9069885 - DNA, 22 bp, Homo sapiens
gatgaagctaaatctaaggttt

SEQ ID NO: 9069886 - DNA, 21 bp, Homo sapiens
gatgaagcaatctttctgttg

SEQ ID NO: 9069887 - DNA, 22 bp, Homo sapiens
gatgaagccccagtgtaagtaa

SEQ ID NO: 9069888 - DNA, 22 bp, Homo sapiens
gataccagacagggagggagaa

SEQ ID NO: 9069889 - DNA, 22 bp, Homo sapiens
gatacccagcaaaatgcaggag

SEQ ID NO: 9069890 - DNA, 22 bp, Homo sapiens
gatactgtgtcattctcacatg

SEQ ID NO: 9069891 - DNA, 22 bp, Homo sapiens
gatactttccatccaaatgcat

SEQ ID NO: 9069892 - DNA, 22 bp, Homo sapiens
gatagaaagaatatagattcca

SEQ ID NO: 9069893 - DNA, 22 bp, Homo sapiens
gatagaaaggtgttgaaatcca

SEQ ID NO: 9069894 - DNA, 22 bp, Homo sapiens
gatagaaagagtggttcttttt

SEQ ID NO: 9069895 - DNA, 22 bp, Homo sapiens
gatagaaagagtggttcttttt

SEQ ID NO: 9069896 - DNA, 22 bp, Homo sapiens
gatagcagctctggggtcagac

SEQ ID NO: 9069897 - DNA, 22 bp, Homo sapiens
gatagtcacctcccttaacttt

SEQ ID NO: 9069898 - DNA, 22 bp, Homo sapiens
gataatatctggtttattcacc

SEQ ID NO: 9069899 - DNA, 21 bp, Homo sapiens
gataaggcaggaggataagta

SEQ ID NO: 9069900 - DNA, 22 bp, Homo sapiens
gataagcagcagccgttatagg

SEQ ID NO: 9069901 - DNA, 22 bp, Homo sapiens
gataataagcacagcaggatgt

SEQ ID NO: 9069902 - DNA, 22 bp, Homo sapiens
gatacagacaccactcttttcc

SEQ ID NO: 9069903 - DNA, 22 bp, Homo sapiens
gatacagctctggccagatgtg

SEQ ID NO: 9069904 - DNA, 22 bp, Homo sapiens
gatacagtatttaaagagcaac

SEQ ID NO: 9069905 - DNA, 22 bp, Homo sapiens
gatacataaaaatgtgctctat

SEQ ID NO: 9069906 - DNA, 22 bp, Homo sapiens
gataccagacagggagggagaa

SEQ ID NO: 9069907 - DNA, 22 bp, Homo sapiens
gatacatttcaaggaggactgg

SEQ ID NO: 9069908 - DNA, 22 bp, Homo sapiens
gatataggttcatagtgttaca

SEQ ID NO: 9069909 - DNA, 18 bp, Homo sapiens
gatatataggaggaaagt

SEQ ID NO: 9069910 - DNA, 22 bp, Homo sapiens
gatatatgtaaaagtagacaga

SEQ ID NO: 9069911 - DNA, 22 bp, Homo sapiens
gatatttacattaagcacattg

SEQ ID NO: 9069912 - DNA, 21 bp, Homo sapiens
gatatttatgactcattcctt

SEQ ID NO: 9069913 - DNA, 22 bp, Homo sapiens
gatatttacattaagcacattg

SEQ ID NO: 9069914 - DNA, 22 bp, Homo sapiens
gatatttattaagtggttggta

SEQ ID NO: 9069915 - DNA, 22 bp, Homo sapiens
gatattttcgcagggagaattc

SEQ ID NO: 9069916 - DNA, 22 bp, Homo sapiens
gatattttcgcagggagaattc

SEQ ID NO: 9069917 - DNA, 22 bp, Homo sapiens
gatattttcgcagggagaattc

SEQ ID NO: 9069918 - DNA, 22 bp, Homo sapiens
gatattttcagtctcctttcaa

SEQ ID NO: 9069919 - DNA, 22 bp, Homo sapiens
gatattttcagtctcctttcaa

SEQ ID NO: 9069920 - DNA, 22 bp, Homo sapiens
gatattttcattcggatgctca

SEQ ID NO: 9069921 - DNA, 22 bp, Homo sapiens
gatattttcattcggatgctca

SEQ ID NO: 9069922 - DNA, 22 bp, Homo sapiens
gatattttgagaaatcctatga

SEQ ID NO: 9069923 - DNA, 22 bp, Homo sapiens
gatatttttaggtgatgcaggc

SEQ ID NO: 9069924 - DNA, 22 bp, Homo sapiens
gatattttgagaaatcctatga

SEQ ID NO: 9069925 - DNA, 22 bp, Homo sapiens
gatatttttaggtgatgcaggc

SEQ ID NO: 9069926 - DNA, 22 bp, Homo sapiens
gatcacatgagttatctaactt

SEQ ID NO: 9069927 - DNA, 22 bp, Homo sapiens
gatcaaggcagtagggccagct

SEQ ID NO: 9069928 - DNA, 22 bp, Homo sapiens
gatatttttagtatttctgcct

SEQ ID NO: 9069929 - DNA, 22 bp, Homo sapiens
gatatttttagtatttctgcct

SEQ ID NO: 9069930 - DNA, 22 bp, Homo sapiens
gatatttttgcagacacctggg

SEQ ID NO: 9069931 - DNA, 22 bp, Homo sapiens
gatatttttgcagacacctggg

SEQ ID NO: 9069932 - DNA, 22 bp, Homo sapiens
gatcatgctggctgccctgttg

SEQ ID NO: 9069933 - DNA, 22 bp, Homo sapiens
gatcaggaatattggaaagtac

SEQ ID NO: 9069934 - DNA, 22 bp, Homo sapiens
gagtgctgaatgcgagaacaga

SEQ ID NO: 9069935 - DNA, 22 bp, Homo sapiens
gagtgctgctaatgcaagggtg

SEQ ID NO: 9069936 - DNA, 17 bp, Homo sapiens
gagtgctggtggagctc

SEQ ID NO: 9069937 - DNA, 17 bp, Homo sapiens
gagtgctggtggagctc

SEQ ID NO: 9069938 - DNA, 22 bp, Homo sapiens
gagtgctggggtgcagagaggt

SEQ ID NO: 9069939 - DNA, 22 bp, Homo sapiens
gagtgcagtatgagaggctgct

SEQ ID NO: 9069940 - DNA, 22 bp, Homo sapiens
gagtgcagtggcgtgatctctg

SEQ ID NO: 9069941 - DNA, 22 bp, Homo sapiens
gagtgcagtatgagaggctgct

SEQ ID NO: 9069942 - DNA, 22 bp, Homo sapiens
gagtgcatggactactggcttg

SEQ ID NO: 9069943 - DNA, 22 bp, Homo sapiens
gagtggcatatgtgcctgtgaa

SEQ ID NO: 9069944 - DNA, 21 bp, Homo sapiens
gagtgggacatgggagtggtt

SEQ ID NO: 9069945 - DNA, 22 bp, Homo sapiens
gagtggagcaaaagaggtagat

SEQ ID NO: 9069946 - DNA, 22 bp, Homo sapiens
gagtggagcaaaagaggtagat

SEQ ID NO: 9069947 - DNA, 22 bp, Homo sapiens
gagtggagcaaaagaggtagat

SEQ ID NO: 9069948 - DNA, 22 bp, Homo sapiens
gagtcctgcccttgtgtagtcc

SEQ ID NO: 9069949 - DNA, 22 bp, Homo sapiens
gagtcctgcccttgtgtagtcc

SEQ ID NO: 9069950 - DNA, 22 bp, Homo sapiens
gagtcctgatccttagctctcc

SEQ ID NO: 9069951 - DNA, 22 bp, Homo sapiens
gagtcctgaatcctgtggcaac

SEQ ID NO: 9069952 - DNA, 22 bp, Homo sapiens
gagtcctgctttcaattctttt

SEQ ID NO: 9069953 - DNA, 22 bp, Homo sapiens
gagtcctggaaccctgaatgct

SEQ ID NO: 9069954 - DNA, 22 bp, Homo sapiens
gagtcctggaaccctgaatgct

SEQ ID NO: 9069955 - DNA, 22 bp, Homo sapiens
gagtcctgctttcaattctttt

SEQ ID NO: 9069956 - DNA, 22 bp, Homo sapiens
gagtcctggagaaacgcaggtg

SEQ ID NO: 9069957 - DNA, 22 bp, Homo sapiens
gagtcctggcgtccaatttcct

SEQ ID NO: 9069958 - DNA, 21 bp, Homo sapiens
gagtcctggctagggtggcag

SEQ ID NO: 9069959 - DNA, 21 bp, Homo sapiens
gagtcctggctagggtggcag

SEQ ID NO: 9069960 - DNA, 22 bp, Homo sapiens
gagtcctggagagcccgagcgc

SEQ ID NO: 9069961 - DNA, 22 bp, Homo sapiens
gagtcctggcgtccaatttcct

SEQ ID NO: 9069962 - DNA, 19 bp, Homo sapiens
gagtcctgtgctccttgtt

SEQ ID NO: 9069963 - DNA, 22 bp, Homo sapiens
gagtcctgtaactttcttccta

SEQ ID NO: 9069964 - DNA, 22 bp, Homo sapiens
gagtcctgttgtcccagatggg

SEQ ID NO: 9069965 - DNA, 22 bp, Homo sapiens
gagtcctgttgtcccagatggg

SEQ ID NO: 9069966 - DNA, 22 bp, Homo sapiens
gagtgagtggccaggaggcaga

SEQ ID NO: 9069967 - DNA, 22 bp, Homo sapiens
gagtgcagaaattcccttcctg

SEQ ID NO: 9069968 - DNA, 22 bp, Homo sapiens
gagtgcaataaactgttttcta

SEQ ID NO: 9069969 - DNA, 22 bp, Homo sapiens
gagtgcaatggcatgatctggg

SEQ ID NO: 9069970 - DNA, 22 bp, Homo sapiens
gagtgcaagttcttccttcttc

SEQ ID NO: 9069971 - DNA, 22 bp, Homo sapiens
gagtgcaagttttgggtttctt

SEQ ID NO: 9069972 - DNA, 22 bp, Homo sapiens
gagtcttctacgctcacacaaa

SEQ ID NO: 9069973 - DNA, 22 bp, Homo sapiens
gagtctttctgggcttgttctt

SEQ ID NO: 9069974 - DNA, 22 bp, Homo sapiens
gagtctggtgatggtcattgtc

SEQ ID NO: 9069975 - DNA, 22 bp, Homo sapiens
gagtctgtatgtcttccatgca

SEQ ID NO: 9069976 - DNA, 22 bp, Homo sapiens
gagtctttgtatttacttccca

SEQ ID NO: 9069977 - DNA, 22 bp, Homo sapiens
gagtctggccctgatgcatcat

SEQ ID NO: 9069978 - DNA, 22 bp, Homo sapiens
gagtctggactattctggtctt

SEQ ID NO: 9069979 - DNA, 22 bp, Homo sapiens
gagtctgaggggagagctgggt

SEQ ID NO: 9069980 - DNA, 22 bp, Homo sapiens
gagtggggtctgggcatcagtc

SEQ ID NO: 9069981 - DNA, 22 bp, Homo sapiens
gagtgggtaccggagcaggtgc

SEQ ID NO: 9069982 - DNA, 22 bp, Homo sapiens
gagtggggggtccgtctcagtg

SEQ ID NO: 9069983 - DNA, 22 bp, Homo sapiens
gagtggggggtccgtctcagtg

SEQ ID NO: 9069984 - DNA, 22 bp, Homo sapiens
gagtgtctatgtttagtctttc

SEQ ID NO: 9069985 - DNA, 18 bp, Homo sapiens
gagtgtggcactgggccc

SEQ ID NO: 9069986 - DNA, 22 bp, Homo sapiens
gagtgtgggcacgggggccttg

SEQ ID NO: 9069987 - DNA, 22 bp, Homo sapiens
gagtgtggatcccagaagcaga

SEQ ID NO: 9069988 - DNA, 22 bp, Homo sapiens
gagtgtggtgaacaggagcacc

SEQ ID NO: 9069989 - DNA, 22 bp, Homo sapiens
gagtgtggtgaacaggagcacc

SEQ ID NO: 9069990 - DNA, 22 bp, Homo sapiens
gagtgtggtgaacaggagcacc

SEQ ID NO: 9069991 - DNA, 22 bp, Homo sapiens
gagtgtggtgaacaggagcacc

SEQ ID NO: 9069992 - DNA, 22 bp, Homo sapiens
gagttaaaggcagttgaggaaa

SEQ ID NO: 9069993 - DNA, 22 bp, Homo sapiens
gagttctggtcagcagggcagc

SEQ ID NO: 9069994 - DNA, 22 bp, Homo sapiens
gagttctattatggttagaagt

SEQ ID NO: 9069995 - DNA, 19 bp, Homo sapiens
gagttctctgcatcagtga

SEQ ID NO: 9069996 - DNA, 21 bp, Homo sapiens
gataaaatgggccttggtcct

SEQ ID NO: 9069997 - DNA, 22 bp, Homo sapiens
gataaaatatgtggcctttagt

SEQ ID NO: 9069998 - DNA, 22 bp, Homo sapiens
gataaagggggaccaaatgact

SEQ ID NO: 9069999 - DNA, 22 bp, Homo sapiens
gataaagcaggtaggagaagat

SEQ ID NO: 9070000 - DNA, 22 bp, Homo sapiens
gataacaatatgaagtagatat

SEQ ID NO: 9070001 - DNA, 20 bp, Homo sapiens
gataaattgtctcttaagtg

SEQ ID NO: 9070002 - DNA, 22 bp, Homo sapiens
gataaattgcactttttcttac

SEQ ID NO: 9070003 - DNA, 22 bp, Homo sapiens
gataaaagaggaaatttgttca

SEQ ID NO: 9070004 - DNA, 22 bp, Homo sapiens
gagtttgtaaactattcactaa

SEQ ID NO: 9070005 - DNA, 22 bp, Homo sapiens
gagtttagtttggcttaaactg

SEQ ID NO: 9070006 - DNA, 22 bp, Homo sapiens
gagtttaaataacacatttcca

SEQ ID NO: 9070007 - DNA, 22 bp, Homo sapiens
gagtttagtggaatttccttct

SEQ ID NO: 9070008 - DNA, 18 bp, Homo sapiens
gagtttaggttgtagaat

SEQ ID NO: 9070009 - DNA, 22 bp, Homo sapiens
gagtttaggttcatgaacgagt

SEQ ID NO: 9070010 - DNA, 22 bp, Homo sapiens
gagtttagatggcattaaggta

SEQ ID NO: 9070011 - DNA, 22 bp, Homo sapiens
gagtttagccaatttggtcccc

SEQ ID NO: 9070012 - DNA, 22 bp, Homo sapiens
gagttctgttccttgggagttt

SEQ ID NO: 9070013 - DNA, 22 bp, Homo sapiens
gagttctgtgattatttgggac

SEQ ID NO: 9070014 - DNA, 22 bp, Homo sapiens
gagttgaagaaatagttttgat

SEQ ID NO: 9070015 - DNA, 22 bp, Homo sapiens
gagttgatcattatttggtttc

SEQ ID NO: 9070016 - DNA, 22 bp, Homo sapiens
gagtttaaagcatacatatttt

SEQ ID NO: 9070017 - DNA, 22 bp, Homo sapiens
gcctctgcggggcccgagcccg

SEQ ID NO: 9070018 - DNA, 19 bp, Homo sapiens
gcctctgctggggacaggc

SEQ ID NO: 9070019 - DNA, 22 bp, Homo sapiens
gcctctgctctcaggtagcctc

SEQ ID NO: 9070020 - DNA, 22 bp, Homo sapiens
gcctcctgttatgccatgtgcc

SEQ ID NO: 9070021 - DNA, 22 bp, Homo sapiens
gcctctgcatgctcagcaccca

SEQ ID NO: 9070022 - DNA, 22 bp, Homo sapiens
gcctctgcatcatcactccagc

SEQ ID NO: 9070023 - DNA, 22 bp, Homo sapiens
gcctcctgtcccaggctgagga

SEQ ID NO: 9070024 - DNA, 22 bp, Homo sapiens
gccgtggcttctccagctggct

SEQ ID NO: 9070025 - DNA, 22 bp, Homo sapiens
gccgggttcaagccattctcct

SEQ ID NO: 9070026 - DNA, 22 bp, Homo sapiens
gccgagcacagtgcagctgcct

SEQ ID NO: 9070027 - DNA, 22 bp, Homo sapiens
gccgagcacagtgcagctgcct

SEQ ID NO: 9070028 - DNA, 22 bp, Homo sapiens
gccggggctggggagagacatg

SEQ ID NO: 9070029 - DNA, 22 bp, Homo sapiens
gccggaagatgaagtttggtca

SEQ ID NO: 9070030 - DNA, 22 bp, Homo sapiens
gcccaggctggagtgcagtggc

SEQ ID NO: 9070031 - DNA, 22 bp, Homo sapiens
gccctcagagttccccacagtg

SEQ ID NO: 9070032 - DNA, 22 bp, Homo sapiens
gccctcagagttccccacagtg

SEQ ID NO: 9070033 - DNA, 22 bp, Homo sapiens
gccctcagctcctggacacatg

SEQ ID NO: 9070034 - DNA, 22 bp, Homo sapiens
gccctcagcaggaaagatcaac

SEQ ID NO: 9070035 - DNA, 22 bp, Homo sapiens
gccctcagcatcctcagggcca

SEQ ID NO: 9070036 - DNA, 22 bp, Homo sapiens
gccctcagctcctggacacatg

SEQ ID NO: 9070037 - DNA, 21 bp, Homo sapiens
gccctcaggggaggatggcct

SEQ ID NO: 9070038 - DNA, 22 bp, Homo sapiens
gccctcctttgcttctcctagt

SEQ ID NO: 9070039 - DNA, 22 bp, Homo sapiens
gccctctcttctgcagcctcca

SEQ ID NO: 9070040 - DNA, 22 bp, Homo sapiens
gccctctgctcagctcctcagc

SEQ ID NO: 9070041 - DNA, 20 bp, Homo sapiens
gccctctgcctccctcagcg

SEQ ID NO: 9070042 - DNA, 22 bp, Homo sapiens
gccctctggcacagagatgcag

SEQ ID NO: 9070043 - DNA, 22 bp, Homo sapiens
gccctctgctggcctcacctcg

SEQ ID NO: 9070044 - DNA, 22 bp, Homo sapiens
gcccttggggtgtctgtaataa

SEQ ID NO: 9070045 - DNA, 22 bp, Homo sapiens
gccctttgagagtggccttgtt

SEQ ID NO: 9070046 - DNA, 22 bp, Homo sapiens
gccctttgtggtcagaggcctg

SEQ ID NO: 9070047 - DNA, 22 bp, Homo sapiens
gcccttccttagacagcaggat

SEQ ID NO: 9070048 - DNA, 22 bp, Homo sapiens
gcccttctgctgttaggtagcc

SEQ ID NO: 9070049 - DNA, 22 bp, Homo sapiens
gcccttcagttactccttgatg

SEQ ID NO: 9070050 - DNA, 22 bp, Homo sapiens
gcccttcagttactccttgatg

SEQ ID NO: 9070051 - DNA, 22 bp, Homo sapiens
gcccttcatttatagttggaat

SEQ ID NO: 9070052 - DNA, 22 bp, Homo sapiens
gcccttcatttatagttggaat

SEQ ID NO: 9070053 - DNA, 22 bp, Homo sapiens
gcccttcacgatggtatcttag

SEQ ID NO: 9070054 - DNA, 22 bp, Homo sapiens
gccagtggtgagattccctggg

SEQ ID NO: 9070055 - DNA, 19 bp, Homo sapiens
gccagtgtgtggtacagtg

SEQ ID NO: 9070056 - DNA, 22 bp, Homo sapiens
gccagttcctgtggagtcagag

SEQ ID NO: 9070057 - DNA, 22 bp, Homo sapiens
gccagtgtttatagcagtgagg

SEQ ID NO: 9070058 - DNA, 22 bp, Homo sapiens
gccagtgggtagttggagctgg

SEQ ID NO: 9070059 - DNA, 22 bp, Homo sapiens
gccaggctgtttttattactgt

SEQ ID NO: 9070060 - DNA, 22 bp, Homo sapiens
gccaggctgtggggaacttgaa

SEQ ID NO: 9070061 - DNA, 22 bp, Homo sapiens
gccaggctctcagtgactgccc

SEQ ID NO: 9070062 - DNA, 22 bp, Homo sapiens
gccaggctgaggctctggaaga

SEQ ID NO: 9070063 - DNA, 22 bp, Homo sapiens
gccaggctgactcccccggcct

SEQ ID NO: 9070064 - DNA, 22 bp, Homo sapiens
gccaggctcttggttatgtttt

SEQ ID NO: 9070065 - DNA, 22 bp, Homo sapiens
gccaggctggttatttaatgag

SEQ ID NO: 9070066 - DNA, 22 bp, Homo sapiens
gccaggctgtggggaacttgaa

SEQ ID NO: 9070067 - DNA, 22 bp, Homo sapiens
gccaggctggtgtcacaactct

SEQ ID NO: 9070068 - DNA, 22 bp, Homo sapiens
gccaggctgctggctgctgtcc

SEQ ID NO: 9070069 - DNA, 22 bp, Homo sapiens
gccaggctggtgtcacaactct

SEQ ID NO: 9070070 - DNA, 22 bp, Homo sapiens
gccaggctgctggctgctgtcc

SEQ ID NO: 9070071 - DNA, 22 bp, Homo sapiens
gccaggctgctccagggaggcc

SEQ ID NO: 9070072 - DNA, 22 bp, Homo sapiens
gcccaggctagcgtagagtgca

SEQ ID NO: 9070073 - DNA, 22 bp, Homo sapiens
gcccaggctggagtgcagtggc

SEQ ID NO: 9070074 - DNA, 22 bp, Homo sapiens
gccatgtcatctgacttatctg

SEQ ID NO: 9070075 - DNA, 22 bp, Homo sapiens
gccatgtcctgggcatctgcca

SEQ ID NO: 9070076 - DNA, 19 bp, Homo sapiens
gccatgggctggcagcaga

SEQ ID NO: 9070077 - DNA, 22 bp, Homo sapiens
gccatgggcaaatgcagagctg

SEQ ID NO: 9070078 - DNA, 22 bp, Homo sapiens
gccatgggcaaatgcagagctg

SEQ ID NO: 9070079 - DNA, 22 bp, Homo sapiens
gcccaggaggtcaagtagctat

SEQ ID NO: 9070080 - DNA, 22 bp, Homo sapiens
gccattgagattgaagtaagca

SEQ ID NO: 9070081 - DNA, 22 bp, Homo sapiens
gccattgatgtgaaagtaagac

SEQ ID NO: 9070082 - DNA, 22 bp, Homo sapiens
gccattgggctgtagttttttg

SEQ ID NO: 9070083 - DNA, 22 bp, Homo sapiens
gcctggagtactccttgaagtg

SEQ ID NO: 9070084 - DNA, 22 bp, Homo sapiens
gcctggagtactccttgaagtg

SEQ ID NO: 9070085 - DNA, 22 bp, Homo sapiens
gcctggagtagcatggcaagcc

SEQ ID NO: 9070086 - DNA, 22 bp, Homo sapiens
gcctggcaggcctgggccagca

SEQ ID NO: 9070087 - DNA, 21 bp, Homo sapiens
gcctggcaggtggaagggctc

SEQ ID NO: 9070088 - DNA, 22 bp, Homo sapiens
gcctggcagtgatgtcttttgg

SEQ ID NO: 9070089 - DNA, 22 bp, Homo sapiens
gcctggcaggggcctgggagtg

SEQ ID NO: 9070090 - DNA, 22 bp, Homo sapiens
gcctgggaaatggtggggtcag

SEQ ID NO: 9070091 - DNA, 21 bp, Homo sapiens
gcctgggaaatctgggaagcc

SEQ ID NO: 9070092 - DNA, 22 bp, Homo sapiens
gcctgggaaagagtagggaaat

SEQ ID NO: 9070093 - DNA, 22 bp, Homo sapiens
gcctggccgggtcttggatttt

SEQ ID NO: 9070094 - DNA, 22 bp, Homo sapiens
gcctggccgctccgagctccgc

SEQ ID NO: 9070095 - DNA, 22 bp, Homo sapiens
gcctggcctgaactaggaggtg

SEQ ID NO: 9070096 - DNA, 22 bp, Homo sapiens
gcctggcttttgcctcatgttc

SEQ ID NO: 9070097 - DNA, 22 bp, Homo sapiens
gcctggcccagggctcttgttg

SEQ ID NO: 9070098 - DNA, 22 bp, Homo sapiens
gcctggcccagggctccgcagg

SEQ ID NO: 9070099 - DNA, 22 bp, Homo sapiens
gcctggcccagggctccgcagg

SEQ ID NO: 9070100 - DNA, 22 bp, Homo sapiens
gcctggccgctccgagctccgc

SEQ ID NO: 9070101 - DNA, 23 bp, Homo sapiens
gcctggccaccccagggctgctt

SEQ ID NO: 9070102 - DNA, 23 bp, Homo sapiens
gcctggccaccccagggctgctt

SEQ ID NO: 9070103 - DNA, 23 bp, Homo sapiens
gcctggccaccccagggctgctt

SEQ ID NO: 9070104 - DNA, 17 bp, Homo sapiens
gcctggcccagcctggc

SEQ ID NO: 9070105 - DNA, 17 bp, Homo sapiens
gcctggcccagcctggc

SEQ ID NO: 9070106 - DNA, 22 bp, Homo sapiens
gcctggtgtccagaggcgagtg

SEQ ID NO: 9070107 - DNA, 22 bp, Homo sapiens
gcctgggattgtgtaagtgaat

SEQ ID NO: 9070108 - DNA, 22 bp, Homo sapiens
gcctgtgcttaactgacgtgag

SEQ ID NO: 9070109 - DNA, 22 bp, Homo sapiens
gcctggtgtgcgccgcgcagct

SEQ ID NO: 9070110 - DNA, 22 bp, Homo sapiens
gcctgtggccgactgagagcct

SEQ ID NO: 9070111 - DNA, 19 bp, Homo sapiens
gcctgtggcttgatgttgg

SEQ ID NO: 9070112 - DNA, 22 bp, Homo sapiens
gcctgtggcccaactgtctgtc

SEQ ID NO: 9070113 - DNA, 22 bp, Homo sapiens
gcctgtggcccaactgtctgtc

SEQ ID NO: 9070114 - DNA, 22 bp, Homo sapiens
gcctgtggccgactgagagcct

SEQ ID NO: 9070115 - DNA, 22 bp, Homo sapiens
gcctgtggccactgcgtctgca

SEQ ID NO: 9070116 - DNA, 22 bp, Homo sapiens
gcctgtggccactgcgtctgca

SEQ ID NO: 9070117 - DNA, 22 bp, Homo sapiens
gcctgtgtcatgtagtagcttc

SEQ ID NO: 9070118 - DNA, 22 bp, Homo sapiens
gcctgtgggttggagcttggcc

SEQ ID NO: 9070119 - DNA, 22 bp, Homo sapiens
gcctgtggttgctttgggatcc

SEQ ID NO: 9070120 - DNA, 22 bp, Homo sapiens
gcctgttctgccctgagagcct

SEQ ID NO: 9070121 - DNA, 22 bp, Homo sapiens
gcctgttctgccctgagagcct

SEQ ID NO: 9070122 - DNA, 22 bp, Homo sapiens
gcctgttctccagcatccaggt

SEQ ID NO: 9070123 - DNA, 23 bp, Homo sapiens
gcctgggactggtagtgtgacct

SEQ ID NO: 9070124 - DNA, 23 bp, Homo sapiens
gcctgggactcaggaggagctca

SEQ ID NO: 9070125 - DNA, 23 bp, Homo sapiens
gcctgggactcaggaggagctca

SEQ ID NO: 9070126 - DNA, 23 bp, Homo sapiens
gcctgggactcaggaggagctca

SEQ ID NO: 9070127 - DNA, 22 bp, Homo sapiens
gcctgggaactctgatctcctg

SEQ ID NO: 9070128 - DNA, 22 bp, Homo sapiens
gcctgggaagactaagtgggag

SEQ ID NO: 9070129 - DNA, 22 bp, Homo sapiens
gcctgggaagactaagtgggag

SEQ ID NO: 9070130 - DNA, 22 bp, Homo sapiens
gcctgggaagactaagtgggag

SEQ ID NO: 9070131 - DNA, 22 bp, Homo sapiens
gcctgggacccttagctcttgg

SEQ ID NO: 9070132 - DNA, 21 bp, Homo sapiens
gcctgggaagagaaaggtaag

SEQ ID NO: 9070133 - DNA, 21 bp, Homo sapiens
gcctgggatagtggcctccgg

SEQ ID NO: 9070134 - DNA, 22 bp, Homo sapiens
gcctgggatagaggcaatgcat

SEQ ID NO: 9070135 - DNA, 22 bp, Homo sapiens
gcctgggagaatgacctccaac

SEQ ID NO: 9070136 - DNA, 19 bp, Homo sapiens
gcctgggatgggcagaact

SEQ ID NO: 9070137 - DNA, 19 bp, Homo sapiens
gcctgggatgggcagaact

SEQ ID NO: 9070138 - DNA, 19 bp, Homo sapiens
gcctgggatgggcagaact

SEQ ID NO: 9070139 - DNA, 22 bp, Homo sapiens
gcctgggattcccagaggggca

SEQ ID NO: 9070140 - DNA, 22 bp, Homo sapiens
gcctgggattcccagaggggca

SEQ ID NO: 9070141 - DNA, 22 bp, Homo sapiens
gcctgggattctcaaaggggtg

SEQ ID NO: 9070142 - DNA, 18 bp, Homo sapiens
gcctgcctagagcttgcc

SEQ ID NO: 9070143 - DNA, 18 bp, Homo sapiens
gcctgccaactcctgatc

SEQ ID NO: 9070144 - DNA, 17 bp, Homo sapiens
gcctctgcttgtgtcat

SEQ ID NO: 9070145 - DNA, 23 bp, Homo sapiens
gcctctggagccccagtgctcag

SEQ ID NO: 9070146 - DNA, 22 bp, Homo sapiens
gcctgcctcaaaatcccagttc

SEQ ID NO: 9070147 - DNA, 22 bp, Homo sapiens
gcctgcctcaaaatcccagttc

SEQ ID NO: 9070148 - DNA, 22 bp, Homo sapiens
gcctgcctcaaaatcccagttc

SEQ ID NO: 9070149 - DNA, 20 bp, Homo sapiens
gcctgcctcagctagctgag

SEQ ID NO: 9070150 - DNA, 20 bp, Homo sapiens
gcctgcctcagctagctgag

SEQ ID NO: 9070151 - DNA, 22 bp, Homo sapiens
gcctgcctgaaggctgtaccag

SEQ ID NO: 9070152 - DNA, 22 bp, Homo sapiens
gcctgcctgaaggctgtaccag

SEQ ID NO: 9070153 - DNA, 23 bp, Homo sapiens
gcctgcctgacctgtgcaaagtc

SEQ ID NO: 9070154 - DNA, 21 bp, Homo sapiens
gcctgcctgcgtgaccctctt

SEQ ID NO: 9070155 - DNA, 23 bp, Homo sapiens
gcctgcctgacctgtgcaaagtc

SEQ ID NO: 9070156 - DNA, 22 bp, Homo sapiens
gcctgcctttgtatgaccctga

SEQ ID NO: 9070157 - DNA, 22 bp, Homo sapiens
gcctgcctttgtatgaccctga

SEQ ID NO: 9070158 - DNA, 22 bp, Homo sapiens
gcctgcctttgtatgaccctga

SEQ ID NO: 9070159 - DNA, 22 bp, Homo sapiens
gcctgccttcggtgcgcagcgg

SEQ ID NO: 9070160 - DNA, 22 bp, Homo sapiens
gcctgccttcggtgcgcagcgg

SEQ ID NO: 9070161 - DNA, 19 bp, Homo sapiens
gcctgcctgggtttctgag

SEQ ID NO: 9070162 - DNA, 19 bp, Homo sapiens
gcctgcctgggtttctgag

SEQ ID NO: 9070163 - DNA, 22 bp, Homo sapiens
gcctgcctgttggctgaggtgc

SEQ ID NO: 9070164 - DNA, 22 bp, Homo sapiens
gcctgcctgttggctgaggtgc

SEQ ID NO: 9070165 - DNA, 22 bp, Homo sapiens
gcctgcctgttggctgaggtgc

SEQ ID NO: 9070166 - DNA, 22 bp, Homo sapiens
gcctgccttcggtgcgcagcgg

SEQ ID NO: 9070167 - DNA, 22 bp, Homo sapiens
gcctgcctggagcttgaggtga

SEQ ID NO: 9070168 - DNA, 22 bp, Homo sapiens
gcctgcctggagcttgaggtga

SEQ ID NO: 9070169 - DNA, 19 bp, Homo sapiens
gcctgcctgggtttctgag

SEQ ID NO: 9070170 - DNA, 22 bp, Homo sapiens
gcctgcctggagcttgaggtga

SEQ ID NO: 9070171 - DNA, 22 bp, Homo sapiens
gcctgcctgctgtgtgcaagtt

SEQ ID NO: 9070172 - DNA, 22 bp, Homo sapiens
gcctgcctgctgtgtgcaagtt

SEQ ID NO: 9070173 - DNA, 22 bp, Homo sapiens
gcctgcctgctgtcatctgcct

SEQ ID NO: 9070174 - DNA, 22 bp, Homo sapiens
gcctgcctgctgtcatctgcct

SEQ ID NO: 9070175 - DNA, 22 bp, Homo sapiens
gcctgcctgctgtcatctgcct

SEQ ID NO: 9070176 - DNA, 22 bp, Homo sapiens
gcctgcctgctgtcatctgcct

SEQ ID NO: 9070177 - DNA, 21 bp, Homo sapiens
gcctgcctgcgtgaccctctt

SEQ ID NO: 9070178 - DNA, 21 bp, Homo sapiens
gcctgcctgcgtgaccctctt

SEQ ID NO: 9070179 - DNA, 22 bp, Homo sapiens
gcctggagcctcagcaaggagg

SEQ ID NO: 9070180 - DNA, 22 bp, Homo sapiens
gcctggagcctcagcaaggagg

SEQ ID NO: 9070181 - DNA, 22 bp, Homo sapiens
gcctggagcctcagcaaggagg

SEQ ID NO: 9070182 - DNA, 20 bp, Homo sapiens
gcctggaggcaatgggaaga

SEQ ID NO: 9070183 - DNA, 20 bp, Homo sapiens
gcctggaggcaatgggaaga

SEQ ID NO: 9070184 - DNA, 20 bp, Homo sapiens
gcctggaggcagagataaag

SEQ ID NO: 9070185 - DNA, 20 bp, Homo sapiens
gcctggaggcagagataaag

SEQ ID NO: 9070186 - DNA, 22 bp, Homo sapiens
gcctggagggatagaatgcaag

SEQ ID NO: 9070187 - DNA, 22 bp, Homo sapiens
gcctggagggatagaatgcaag

SEQ ID NO: 9070188 - DNA, 22 bp, Homo sapiens
gcctggagggctctagagaggc

SEQ ID NO: 9070189 - DNA, 22 bp, Homo sapiens
gcctggagggctctagagaggc

SEQ ID NO: 9070190 - DNA, 22 bp, Homo sapiens
gcctggaggggacagtctctgg

SEQ ID NO: 9070191 - DNA, 22 bp, Homo sapiens
gcctggaggggacagtctctgg

SEQ ID NO: 9070192 - DNA, 22 bp, Homo sapiens
gcctggagggtccctctctgga

SEQ ID NO: 9070193 - DNA, 22 bp, Homo sapiens
gcctggagggtccctctctgga

SEQ ID NO: 9070194 - DNA, 22 bp, Homo sapiens
gcctggaggggccagggtggta

SEQ ID NO: 9070195 - DNA, 22 bp, Homo sapiens
gcctggaggggccagggtggta

SEQ ID NO: 9070196 - DNA, 22 bp, Homo sapiens
gcctggaggggccagggtggta

SEQ ID NO: 9070197 - DNA, 22 bp, Homo sapiens
gcctgcttctcagtcagcttgg

SEQ ID NO: 9070198 - DNA, 22 bp, Homo sapiens
gcctgctttgtgcctgatcttt

SEQ ID NO: 9070199 - DNA, 22 bp, Homo sapiens
gcctgctttaagtctgttgcct

SEQ ID NO: 9070200 - DNA, 22 bp, Homo sapiens
gcctgccttttggaggcacatt

SEQ ID NO: 9070201 - DNA, 22 bp, Homo sapiens
gcctgctcagacctagcaggcc

SEQ ID NO: 9070202 - DNA, 22 bp, Homo sapiens
gcctgccttttggaggcacatt

SEQ ID NO: 9070203 - DNA, 22 bp, Homo sapiens
gcctgcctttgtgaggaagcgg

SEQ ID NO: 9070204 - DNA, 22 bp, Homo sapiens
gcctgcctttgtgaggaagcgg

SEQ ID NO: 9070205 - DNA, 22 bp, Homo sapiens
gcctgctctgacatccatccca

SEQ ID NO: 9070206 - DNA, 22 bp, Homo sapiens
gcctgctcccagttggcgcctc

SEQ ID NO: 9070207 - DNA, 22 bp, Homo sapiens
gcctgctctccggatccctgat

SEQ ID NO: 9070208 - DNA, 22 bp, Homo sapiens
gcctgctctccggatccctgat

SEQ ID NO: 9070209 - DNA, 22 bp, Homo sapiens
gcctgctctccggatccctgat

SEQ ID NO: 9070210 - DNA, 22 bp, Homo sapiens
gctggagagtgaggggagcaag

SEQ ID NO: 9070211 - DNA, 22 bp, Homo sapiens
gctggagccttctgctctgttg

SEQ ID NO: 9070212 - DNA, 22 bp, Homo sapiens
gctggagctgagttccctgggc

SEQ ID NO: 9070213 - DNA, 22 bp, Homo sapiens
gctggagctgagttccctgggc

SEQ ID NO: 9070214 - DNA, 22 bp, Homo sapiens
gctggagccattggcttggcct

SEQ ID NO: 9070215 - DNA, 22 bp, Homo sapiens
gctggagccaagctgctcttgg

SEQ ID NO: 9070216 - DNA, 22 bp, Homo sapiens
gctggagatgctatgcagaggg

SEQ ID NO: 9070217 - DNA, 22 bp, Homo sapiens
gctggagatgctatgcagaggg

SEQ ID NO: 9070218 - DNA, 22 bp, Homo sapiens
gctggcctcctgctagatggaa

SEQ ID NO: 9070219 - DNA, 22 bp, Homo sapiens
gctggccccgagtgctacgctc

SEQ ID NO: 9070220 - DNA, 22 bp, Homo sapiens
gctggcccagggtcacctagga

SEQ ID NO: 9070221 - DNA, 22 bp, Homo sapiens
gctggcccagtgacccacagtg

SEQ ID NO: 9070222 - DNA, 22 bp, Homo sapiens
gctggcccagtgacccacagtg

SEQ ID NO: 9070223 - DNA, 22 bp, Homo sapiens
gctggagctgcagcctgggcct

SEQ ID NO: 9070224 - DNA, 22 bp, Homo sapiens
gctggagctgcagcctgggcct

SEQ ID NO: 9070225 - DNA, 22 bp, Homo sapiens
gctggccagggctgctcgcgga

SEQ ID NO: 9070226 - DNA, 22 bp, Homo sapiens
gctggccaggtgctttggttct

SEQ ID NO: 9070227 - DNA, 22 bp, Homo sapiens
gctggccagtgtcccagggatc

SEQ ID NO: 9070228 - DNA, 22 bp, Homo sapiens
gctggcctctggagaagggctt

SEQ ID NO: 9070229 - DNA, 22 bp, Homo sapiens
gctggcctgaccagccacaggc

SEQ ID NO: 9070230 - DNA, 22 bp, Homo sapiens
gctggcctgacctgaggctggg

SEQ ID NO: 9070231 - DNA, 22 bp, Homo sapiens
gctggcctgcaaagcccggctg

SEQ ID NO: 9070232 - DNA, 22 bp, Homo sapiens
gctggcctgaccagccacaggc

SEQ ID NO: 9070233 - DNA, 22 bp, Homo sapiens
gctggcctcgcaggcaggatgt

SEQ ID NO: 9070234 - DNA, 22 bp, Homo sapiens
gctggcctcgcaggcaggatgt

SEQ ID NO: 9070235 - DNA, 22 bp, Homo sapiens
gctggcctctacaggccggcca

SEQ ID NO: 9070236 - DNA, 22 bp, Homo sapiens
gctggcctctacaggccggcca

SEQ ID NO: 9070237 - DNA, 22 bp, Homo sapiens
gctgggagtgggcaagatgaga

SEQ ID NO: 9070238 - DNA, 22 bp, Homo sapiens
gctggcctttgaggaagctgcg

SEQ ID NO: 9070239 - DNA, 22 bp, Homo sapiens
gctgggagttactgtctccttt

SEQ ID NO: 9070240 - DNA, 22 bp, Homo sapiens
gctggcctgcgagggcaggctg

SEQ ID NO: 9070241 - DNA, 22 bp, Homo sapiens
gctggcctgggcagcctgtcgg

SEQ ID NO: 9070242 - DNA, 22 bp, Homo sapiens
gctggcctgggcagcctgtcgg

SEQ ID NO: 9070243 - DNA, 22 bp, Homo sapiens
gctggcctgctgggcaccaccg

SEQ ID NO: 9070244 - DNA, 22 bp, Homo sapiens
gctggcctgctgggcaccaccg

SEQ ID NO: 9070245 - DNA, 22 bp, Homo sapiens
gctggccttgtgtctgaggaag

SEQ ID NO: 9070246 - DNA, 22 bp, Homo sapiens
gctggcctgggctcaagaccag

SEQ ID NO: 9070247 - DNA, 22 bp, Homo sapiens
gctggcctgggctcaagaccag

SEQ ID NO: 9070248 - DNA, 22 bp, Homo sapiens
gctggccttctgcagagttctg

SEQ ID NO: 9070249 - DNA, 22 bp, Homo sapiens
gctggcctgtctagagccttac

SEQ ID NO: 9070250 - DNA, 22 bp, Homo sapiens
gctgggcaccggagagacccca

SEQ ID NO: 9070251 - DNA, 22 bp, Homo sapiens
gctgggcacctctcccagattg

SEQ ID NO: 9070252 - DNA, 22 bp, Homo sapiens
gctgggcagctgaggcctctca

SEQ ID NO: 9070253 - DNA, 22 bp, Homo sapiens
gctgggcagcccctacagagag

SEQ ID NO: 9070254 - DNA, 22 bp, Homo sapiens
gctgggcagcccctacagagag

SEQ ID NO: 9070255 - DNA, 22 bp, Homo sapiens
gctgggcagcccctacagagag

SEQ ID NO: 9070256 - DNA, 22 bp, Homo sapiens
gctgggcagcctggccgctgcc

SEQ ID NO: 9070257 - DNA, 22 bp, Homo sapiens
gctgggcagcctggccgctgcc

SEQ ID NO: 9070258 - DNA, 22 bp, Homo sapiens
gctgctctgttaattgctgtaa

SEQ ID NO: 9070259 - DNA, 22 bp, Homo sapiens
gctgctctgtgacagcctccgg

SEQ ID NO: 9070260 - DNA, 22 bp, Homo sapiens
gctgctcttttcagagatgaga

SEQ ID NO: 9070261 - DNA, 22 bp, Homo sapiens
gctgctgcaagagccagctctt

SEQ ID NO: 9070262 - DNA, 21 bp, Homo sapiens
gctggagagccaggcaggggc

SEQ ID NO: 9070263 - DNA, 22 bp, Homo sapiens
gctgctctccaagcctccttga

SEQ ID NO: 9070264 - DNA, 20 bp, Homo sapiens
gctgctctccacggtctgca

SEQ ID NO: 9070265 - DNA, 22 bp, Homo sapiens
gctgctctctccctaagttggg

SEQ ID NO: 9070266 - DNA, 22 bp, Homo sapiens
gctgctctgaaaatgactgttg

SEQ ID NO: 9070267 - DNA, 19 bp, Homo sapiens
gctgctctgggtctcatct

SEQ ID NO: 9070268 - DNA, 22 bp, Homo sapiens
gctgctctggctctgcagtgtc

SEQ ID NO: 9070269 - DNA, 22 bp, Homo sapiens
gctgctctcagagctcatgctg

SEQ ID NO: 9070270 - DNA, 22 bp, Homo sapiens
gctgctctacccatgcatctgt

SEQ ID NO: 9070271 - DNA, 22 bp, Homo sapiens
gctgcctgtcccaggatgagga

SEQ ID NO: 9070272 - DNA, 22 bp, Homo sapiens
gctgaggattgaagagttgcca

SEQ ID NO: 9070273 - DNA, 22 bp, Homo sapiens
gctgaggcaaaccaagaatgta

SEQ ID NO: 9070274 - DNA, 22 bp, Homo sapiens
gctgaggcaagatttgaaccca

SEQ ID NO: 9070275 - DNA, 22 bp, Homo sapiens
gctgaggcaaatagttttaagt

SEQ ID NO: 9070276 - DNA, 22 bp, Homo sapiens
gctgaggcaaaccaagaatgta

SEQ ID NO: 9070277 - DNA, 22 bp, Homo sapiens
gctgaggcagtccacccttgtg

SEQ ID NO: 9070278 - DNA, 22 bp, Homo sapiens
gctgcctgatcatacaccaggg

SEQ ID NO: 9070279 - DNA, 22 bp, Homo sapiens
gctgaggattgaagagttgcca

SEQ ID NO: 9070280 - DNA, 22 bp, Homo sapiens
gctgaggattgaagagttgcca

SEQ ID NO: 9070281 - DNA, 20 bp, Homo sapiens
gctgaggattcctggcccct

SEQ ID NO: 9070282 - DNA, 22 bp, Homo sapiens
gctgaggatatagcaggaacaa

SEQ ID NO: 9070283 - DNA, 22 bp, Homo sapiens
gctgaggattacttgaagtcag

SEQ ID NO: 9070284 - DNA, 22 bp, Homo sapiens
gctgagctcccagcagtatctg

SEQ ID NO: 9070285 - DNA, 22 bp, Homo sapiens
gctgagctgaggcagggctggg

SEQ ID NO: 9070286 - DNA, 22 bp, Homo sapiens
gctgagctagaaaaggaccaca

SEQ ID NO: 9070287 - DNA, 22 bp, Homo sapiens
gctgagccacaggcagtgcact

SEQ ID NO: 9070288 - DNA, 22 bp, Homo sapiens
gctgcctggagctcagcctgcc

SEQ ID NO: 9070289 - DNA, 22 bp, Homo sapiens
gctgcctggagctcagcctgcc

SEQ ID NO: 9070290 - DNA, 22 bp, Homo sapiens
gctgcctgctcggctcctggga

SEQ ID NO: 9070291 - DNA, 22 bp, Homo sapiens
gctgcctgcttcatgtgggaga

SEQ ID NO: 9070292 - DNA, 22 bp, Homo sapiens
gctgcctgctcggctcctggga

SEQ ID NO: 9070293 - DNA, 22 bp, Homo sapiens
gctgcctgctcacccggcctgg

SEQ ID NO: 9070294 - DNA, 22 bp, Homo sapiens
gctgcctgccttgcctggagga

SEQ ID NO: 9070295 - DNA, 22 bp, Homo sapiens
gctgcctgatgtccagcaggac

SEQ ID NO: 9070296 - DNA, 22 bp, Homo sapiens
gctctgtgttccctccaggctc

SEQ ID NO: 9070297 - DNA, 22 bp, Homo sapiens
gctcttgaaaatcaaaagggaa

SEQ ID NO: 9070298 - DNA, 22 bp, Homo sapiens
gctcttgaaataatggctaatg

SEQ ID NO: 9070299 - DNA, 22 bp, Homo sapiens
gctcttcattctcccaaatagg

SEQ ID NO: 9070300 - DNA, 22 bp, Homo sapiens
gctcttccatttctcttgaact

SEQ ID NO: 9070301 - DNA, 22 bp, Homo sapiens
gctctgtgttcctctggattgc

SEQ ID NO: 9070302 - DNA, 22 bp, Homo sapiens
gctgagagtgggtgcagtgctt

SEQ ID NO: 9070303 - DNA, 22 bp, Homo sapiens
gctgagagtgtgagatcagatt

SEQ ID NO: 9070304 - DNA, 22 bp, Homo sapiens
gctgagcagcctaagcaaattt

SEQ ID NO: 9070305 - DNA, 22 bp, Homo sapiens
gctgagcagggtggggaaaggc

SEQ ID NO: 9070306 - DNA, 22 bp, Homo sapiens
gctgagcagcctaagcaaattt

SEQ ID NO: 9070307 - DNA, 22 bp, Homo sapiens
gctcttgatttccaggagctag

SEQ ID NO: 9070308 - DNA, 22 bp, Homo sapiens
gctcttgatgttcattgacttg

SEQ ID NO: 9070309 - DNA, 22 bp, Homo sapiens
gctcttgatttccaggagctag

SEQ ID NO: 9070310 - DNA, 22 bp, Homo sapiens
gctcttgacagctacatctggc

SEQ ID NO: 9070311 - DNA, 22 bp, Homo sapiens
gctcttgaatatgggtttcatg

SEQ ID NO: 9070312 - DNA, 22 bp, Homo sapiens
gctcttgaccttggagaactcg

SEQ ID NO: 9070313 - DNA, 21 bp, Homo sapiens
gctcttgaataagcataataa

SEQ ID NO: 9070314 - DNA, 22 bp, Homo sapiens
gctcttgactcccagttctgtg

SEQ ID NO: 9070315 - DNA, 22 bp, Homo sapiens
gctcttgatacatcaagaactt

SEQ ID NO: 9070316 - DNA, 22 bp, Homo sapiens
gctcttgaggaagtgcagggca

SEQ ID NO: 9070317 - DNA, 22 bp, Homo sapiens
gctcttgaggaagtgcagggca

SEQ ID NO: 9070318 - DNA, 22 bp, Homo sapiens
gctctgagcccccagaagcaga

SEQ ID NO: 9070319 - DNA, 22 bp, Homo sapiens
gctctctttccatgtggaggat

SEQ ID NO: 9070320 - DNA, 22 bp, Homo sapiens
gctcctggctctggccaaggga

SEQ ID NO: 9070321 - DNA, 22 bp, Homo sapiens
gctcctggcttcactgacatca

SEQ ID NO: 9070322 - DNA, 19 bp, Homo sapiens
gctcctgggcctcactcat

SEQ ID NO: 9070323 - DNA, 22 bp, Homo sapiens
gctctgagtaaatgaaagcatt

SEQ ID NO: 9070324 - DNA, 22 bp, Homo sapiens
gctctgaggctgggagcactct

SEQ ID NO: 9070325 - DNA, 22 bp, Homo sapiens
gctctgagtgattaaggagctt

SEQ ID NO: 9070326 - DNA, 22 bp, Homo sapiens
gctctgagtgatcagctgggaa

SEQ ID NO: 9070327 - DNA, 21 bp, Homo sapiens
gctctgccacttaccagattt

SEQ ID NO: 9070328 - DNA, 18 bp, Homo sapiens
gctctgcagctgaggctt

SEQ ID NO: 9070329 - DNA, 22 bp, Homo sapiens
gctctgccaaggacccattctc

SEQ ID NO: 9070330 - DNA, 22 bp, Homo sapiens
gctcctggcaggcagtgtgtgt

SEQ ID NO: 9070331 - DNA, 22 bp, Homo sapiens
gctcctggctctctgagggctg

SEQ ID NO: 9070332 - DNA, 22 bp, Homo sapiens
gctcctggctccaggcagccaa

SEQ ID NO: 9070333 - DNA, 22 bp, Homo sapiens
gctcctggctccaggcagccaa

SEQ ID NO: 9070334 - DNA, 22 bp, Homo sapiens
gctccaggagctcacagctcgc

SEQ ID NO: 9070335 - DNA, 22 bp, Homo sapiens
gctccaggagagggaagcagat

SEQ ID NO: 9070336 - DNA, 22 bp, Homo sapiens
gctccaggagagggaagcagat

SEQ ID NO: 9070337 - DNA, 22 bp, Homo sapiens
gctcctggcaggcagtgtgtgt

SEQ ID NO: 9070338 - DNA, 22 bp, Homo sapiens
gctcctcttatttcatcagggc

SEQ ID NO: 9070339 - DNA, 22 bp, Homo sapiens
gctcctcttatttcatcagggc

SEQ ID NO: 9070340 - DNA, 22 bp, Homo sapiens
gctcctctgtcaaatgagagtg

SEQ ID NO: 9070341 - DNA, 22 bp, Homo sapiens
gctcctctcccagagctgcagg

SEQ ID NO: 9070342 - DNA, 22 bp, Homo sapiens
gctcctctgtcaaatgagagtg

SEQ ID NO: 9070343 - DNA, 22 bp, Homo sapiens
gctccagagtgtggcatctggg

SEQ ID NO: 9070344 - DNA, 22 bp, Homo sapiens
gctccagatgaaaggccagagg

SEQ ID NO: 9070345 - DNA, 22 bp, Homo sapiens
gctccagcacctagagcaggtc

SEQ ID NO: 9070346 - DNA, 22 bp, Homo sapiens
gctccagatgaatgcacttgtt

SEQ ID NO: 9070347 - DNA, 22 bp, Homo sapiens
gctccactaggaatctgctctt

SEQ ID NO: 9070348 - DNA, 22 bp, Homo sapiens
gctccacttccttctgccctca

SEQ ID NO: 9070349 - DNA, 22 bp, Homo sapiens
gctccacttgcagctaggcttg

SEQ ID NO: 9070350 - DNA, 22 bp, Homo sapiens
gctccagagcagagactaggtt

SEQ ID NO: 9070351 - DNA, 22 bp, Homo sapiens
gctcagagcactcagactcagc

SEQ ID NO: 9070352 - DNA, 22 bp, Homo sapiens
gctcagagcatcccagtgaatg

SEQ ID NO: 9070353 - DNA, 22 bp, Homo sapiens
gctcagagcatcccagtgaatg

SEQ ID NO: 9070354 - DNA, 19 bp, Homo sapiens
gctcagagccatgggggct

SEQ ID NO: 9070355 - DNA, 22 bp, Homo sapiens
gctcagagcccgaggcttgcat

SEQ ID NO: 9070356 - DNA, 19 bp, Homo sapiens
gctcagagccatgggggct

SEQ ID NO: 9070357 - DNA, 22 bp, Homo sapiens
gctcatgactgtaatcccagca

SEQ ID NO: 9070358 - DNA, 22 bp, Homo sapiens
gctcatgggcccagagcagccc

SEQ ID NO: 9070359 - DNA, 22 bp, Homo sapiens
gctcagagatggggaatgaaaa

SEQ ID NO: 9070360 - DNA, 22 bp, Homo sapiens
gctcagagatgttcagtagctt

SEQ ID NO: 9070361 - DNA, 22 bp, Homo sapiens
gctcagagatgttcagtagctt

SEQ ID NO: 9070362 - DNA, 22 bp, Homo sapiens
gctcagagatgtctgctgcctt

SEQ ID NO: 9070363 - DNA, 22 bp, Homo sapiens
gctcagaaaagtgaggctcagt

SEQ ID NO: 9070364 - DNA, 22 bp, Homo sapiens
gctcactggcctgaagaggacg

SEQ ID NO: 9070365 - DNA, 22 bp, Homo sapiens
gcctgtttactttgccgcagga

SEQ ID NO: 9070366 - DNA, 22 bp, Homo sapiens
gctcactgccattctctagatg

SEQ ID NO: 9070367 - DNA, 22 bp, Homo sapiens
gctcactgcaagctctgcctcc

SEQ ID NO: 9070368 - DNA, 22 bp, Homo sapiens
gctcactgcaagctccgcctcc

SEQ ID NO: 9070369 - DNA, 22 bp, Homo sapiens
gctcactgcaacctctgcctcc

SEQ ID NO: 9070370 - DNA, 22 bp, Homo sapiens
gctcactgcaacctccgccttc

SEQ ID NO: 9070371 - DNA, 22 bp, Homo sapiens
gcagggtggatggcagggccag

SEQ ID NO: 9070372 - DNA, 22 bp, Homo sapiens
gcagggtgacgttgcccacctc

SEQ ID NO: 9070373 - DNA, 22 bp, Homo sapiens
gcagggtgatagtgaggctcag

SEQ ID NO: 9070374 - DNA, 22 bp, Homo sapiens
gcagggtgccgacttcagggat

SEQ ID NO: 9070375 - DNA, 19 bp, Homo sapiens
gcaggtggatgtggtcagc

SEQ ID NO: 9070376 - DNA, 22 bp, Homo sapiens
gcaggtggcagaggtgggatct

SEQ ID NO: 9070377 - DNA, 22 bp, Homo sapiens
gcaggtggtgggggagccgttc

SEQ ID NO: 9070378 - DNA, 22 bp, Homo sapiens
gcaggtgggagccgctgcctga

SEQ ID NO: 9070379 - DNA, 22 bp, Homo sapiens
gcaggtgggggtcggtgcatct

SEQ ID NO: 9070380 - DNA, 22 bp, Homo sapiens
gcaggtgggggtcggtgcatct

SEQ ID NO: 9070381 - DNA, 22 bp, Homo sapiens
gcagtgggcaacaagagctgga

SEQ ID NO: 9070382 - DNA, 22 bp, Homo sapiens
gcagtgggcaacaagagctgga

SEQ ID NO: 9070383 - DNA, 22 bp, Homo sapiens
gcagtgggcaacaagagctgga

SEQ ID NO: 9070384 - DNA, 22 bp, Homo sapiens
gcagtgggcaacaagagctgga

SEQ ID NO: 9070385 - DNA, 22 bp, Homo sapiens
gcagtgggcctgaggaagggtg

SEQ ID NO: 9070386 - DNA, 22 bp, Homo sapiens
gcagtgggcctgaggaagggtg

SEQ ID NO: 9070387 - DNA, 22 bp, Homo sapiens
gcagtgggcctgaggaagggtg

SEQ ID NO: 9070388 - DNA, 22 bp, Homo sapiens
gcagtggggcgctgggagttgg

SEQ ID NO: 9070389 - DNA, 22 bp, Homo sapiens
gcagtggtccagttcacaccca

SEQ ID NO: 9070390 - DNA, 22 bp, Homo sapiens
gcagtggggcgctgggagttgg

SEQ ID NO: 9070391 - DNA, 22 bp, Homo sapiens
gcagtggggcgctgggagttgg

SEQ ID NO: 9070392 - DNA, 22 bp, Homo sapiens
gcagtggggaatgctggggaga

SEQ ID NO: 9070393 - DNA, 22 bp, Homo sapiens
gcagtggggaatgctggggaga

SEQ ID NO: 9070394 - DNA, 22 bp, Homo sapiens
gcagtaagatgtttcccagagc

SEQ ID NO: 9070395 - DNA, 22 bp, Homo sapiens
gcagtactttatcacatggaat

SEQ ID NO: 9070396 - DNA, 22 bp, Homo sapiens
gcagtactttaagggatgaagc

SEQ ID NO: 9070397 - DNA, 22 bp, Homo sapiens
gcagtactttatcacatggaat

SEQ ID NO: 9070398 - DNA, 22 bp, Homo sapiens
gcagtactttaagggatgaagc

SEQ ID NO: 9070399 - DNA, 22 bp, Homo sapiens
gcagtagagaagccaggctgta

SEQ ID NO: 9070400 - DNA, 22 bp, Homo sapiens
gcagtagaactgtcatgatgtt

SEQ ID NO: 9070401 - DNA, 22 bp, Homo sapiens
gcagtagaactgtcatgatgtt

SEQ ID NO: 9070402 - DNA, 22 bp, Homo sapiens
gcagtagaacgtgttgaatcaa

SEQ ID NO: 9070403 - DNA, 22 bp, Homo sapiens
gcagtatacactgatacatgag

SEQ ID NO: 9070404 - DNA, 22 bp, Homo sapiens
gcagtaggagtttccagggtgg

SEQ ID NO: 9070405 - DNA, 18 bp, Homo sapiens
gcagtaggcgcgcaggac

SEQ ID NO: 9070406 - DNA, 22 bp, Homo sapiens
gcagtaggggctggagggctgt

SEQ ID NO: 9070407 - DNA, 19 bp, Homo sapiens
gccagcagaatgatgaggc

SEQ ID NO: 9070408 - DNA, 19 bp, Homo sapiens
gccagcagaatgatgaggc

SEQ ID NO: 9070409 - DNA, 19 bp, Homo sapiens
gccagcagaatgatgaggc

SEQ ID NO: 9070410 - DNA, 22 bp, Homo sapiens
gccagcagccacagaagtcact

SEQ ID NO: 9070411 - DNA, 22 bp, Homo sapiens
gccagcaaagcaagttgtcagc

SEQ ID NO: 9070412 - DNA, 22 bp, Homo sapiens
gccagcagcccagaaggacttt

SEQ ID NO: 9070413 - DNA, 22 bp, Homo sapiens
gccagcagcgagagtttaacct

SEQ ID NO: 9070414 - DNA, 22 bp, Homo sapiens
gccagcagctcttgggcgggca

SEQ ID NO: 9070415 - DNA, 22 bp, Homo sapiens
gccagcagctgtggggtggcca

SEQ ID NO: 9070416 - DNA, 22 bp, Homo sapiens
gccagcagcttcttctcatcct

SEQ ID NO: 9070417 - DNA, 22 bp, Homo sapiens
gccagcagggaagccttgggct

SEQ ID NO: 9070418 - DNA, 22 bp, Homo sapiens
gccagcagggaagccttgggct

SEQ ID NO: 9070419 - DNA, 22 bp, Homo sapiens
gccacaggcacttaagggctgg

SEQ ID NO: 9070420 - DNA, 22 bp, Homo sapiens
gccacaggcacttaagggctgg

SEQ ID NO: 9070421 - DNA, 22 bp, Homo sapiens
gccagaggctcaggttgccatg

SEQ ID NO: 9070422 - DNA, 22 bp, Homo sapiens
gccagatctgacatagtggaag

SEQ ID NO: 9070423 - DNA, 22 bp, Homo sapiens
gccagatttacagatttgccct

SEQ ID NO: 9070424 - DNA, 22 bp, Homo sapiens
gccagcaaagcaagttgtcagc

SEQ ID NO: 9070425 - DNA, 22 bp, Homo sapiens
gccacaggcacttaagggctgg

SEQ ID NO: 9070426 - DNA, 22 bp, Homo sapiens
gccacaggaaagcaccctggag

SEQ ID NO: 9070427 - DNA, 22 bp, Homo sapiens
gccacaggaaagcaccctggag

SEQ ID NO: 9070428 - DNA, 22 bp, Homo sapiens
gccacagcttagatcacagcct

SEQ ID NO: 9070429 - DNA, 22 bp, Homo sapiens
gccacagctccagtcaggtgac

SEQ ID NO: 9070430 - DNA, 22 bp, Homo sapiens
gccacagcggggccgctagagc

SEQ ID NO: 9070431 - DNA, 22 bp, Homo sapiens
gcatggcttctgccaggcacct

SEQ ID NO: 9070432 - DNA, 22 bp, Homo sapiens
gcatgggcaagaggactggggg

SEQ ID NO: 9070433 - DNA, 22 bp, Homo sapiens
gcatgtctgtaattacagagcc

SEQ ID NO: 9070434 - DNA, 22 bp, Homo sapiens
gcatgtgtcatctgcctttcgt

SEQ ID NO: 9070435 - DNA, 22 bp, Homo sapiens
gcatgtgtctccccagtggagg

SEQ ID NO: 9070436 - DNA, 22 bp, Homo sapiens
gcatgtgtggaggagatgtgct

SEQ ID NO: 9070437 - DNA, 22 bp, Homo sapiens
gcatgttttgcaacaagtgacc

SEQ ID NO: 9070438 - DNA, 22 bp, Homo sapiens
gccaatcaggaggctgtacatc

SEQ ID NO: 9070439 - DNA, 22 bp, Homo sapiens
gccacagcaacaataatgcagc

SEQ ID NO: 9070440 - DNA, 22 bp, Homo sapiens
gccacagacagagagtctagtg

SEQ ID NO: 9070441 - DNA, 22 bp, Homo sapiens
gccacagacagagagtctagtg

SEQ ID NO: 9070442 - DNA, 22 bp, Homo sapiens
gccacacttattctcatgcaca

SEQ ID NO: 9070443 - DNA, 22 bp, Homo sapiens
gccacagacagagagtctagtg

SEQ ID NO: 9070444 - DNA, 22 bp, Homo sapiens
gcagctattgtctcctgggccc

SEQ ID NO: 9070445 - DNA, 22 bp, Homo sapiens
gcagctattgtctcctgggccc

SEQ ID NO: 9070446 - DNA, 22 bp, Homo sapiens
gcagctattgtctcctgggccc

SEQ ID NO: 9070447 - DNA, 18 bp, Homo sapiens
gcagctagccaggggggc

SEQ ID NO: 9070448 - DNA, 22 bp, Homo sapiens
gcagctattgtctcctgggccc

SEQ ID NO: 9070449 - DNA, 22 bp, Homo sapiens
gcagctcagtaaaagaggagca

SEQ ID NO: 9070450 - DNA, 22 bp, Homo sapiens
gcagctcccttgaacttctcct

SEQ ID NO: 9070451 - DNA, 22 bp, Homo sapiens
gcagctcccatcagggcacaga

SEQ ID NO: 9070452 - DNA, 22 bp, Homo sapiens
gcagctcctttaggctgcaaag

SEQ ID NO: 9070453 - DNA, 18 bp, Homo sapiens
gcagctgacactggagtt

SEQ ID NO: 9070454 - DNA, 18 bp, Homo sapiens
gcagctgacactggagtt

SEQ ID NO: 9070455 - DNA, 22 bp, Homo sapiens
gcagctgacatctggctgggcc

SEQ ID NO: 9070456 - DNA, 22 bp, Homo sapiens
gcagctgaatgtccattgctgc

SEQ ID NO: 9070457 - DNA, 20 bp, Homo sapiens
gcagctgaaagtatgacacc

SEQ ID NO: 9070458 - DNA, 22 bp, Homo sapiens
gcagctgaagctgcagttccag

SEQ ID NO: 9070459 - DNA, 22 bp, Homo sapiens
gcagctgaaagggatctctaca

SEQ ID NO: 9070460 - DNA, 22 bp, Homo sapiens
gcagagcctgtgtctgagcaaa

SEQ ID NO: 9070461 - DNA, 22 bp, Homo sapiens
gcagagcctgtgtctgagcaaa

SEQ ID NO: 9070462 - DNA, 22 bp, Homo sapiens
gcagagcctgtgtctgagcaaa

SEQ ID NO: 9070463 - DNA, 22 bp, Homo sapiens
gcagagccttgcgtcatgtgcc

SEQ ID NO: 9070464 - DNA, 21 bp, Homo sapiens
gcagagccggggcgagaaggc

SEQ ID NO: 9070465 - DNA, 22 bp, Homo sapiens
gcagagctatcttctggatttg

SEQ ID NO: 9070466 - DNA, 22 bp, Homo sapiens
gcagagcggtgatcaggcgcag

SEQ ID NO: 9070467 - DNA, 22 bp, Homo sapiens
gcagagctcaaggtgttcagct

SEQ ID NO: 9070468 - DNA, 22 bp, Homo sapiens
gcagcctctgcagttcaggagg

SEQ ID NO: 9070469 - DNA, 22 bp, Homo sapiens
gcagcgctgtaggcccaaggca

SEQ ID NO: 9070470 - DNA, 22 bp, Homo sapiens
gcagcgtggggctgagtcagct

SEQ ID NO: 9070471 - DNA, 19 bp, Homo sapiens
gcaggcacagccctgggtg

SEQ ID NO: 9070472 - DNA, 22 bp, Homo sapiens
gcaggcaccgcggcggcaggtt

SEQ ID NO: 9070473 - DNA, 22 bp, Homo sapiens
gcaggcaccgcggcggcaggtt

SEQ ID NO: 9070474 - DNA, 22 bp, Homo sapiens
gcaggcaccgcggcggcaggtt

SEQ ID NO: 9070475 - DNA, 22 bp, Homo sapiens
gcaggcaccgcggcggcaggtt

SEQ ID NO: 9070476 - DNA, 22 bp, Homo sapiens
gcaggcacctcgtggagtggaa

SEQ ID NO: 9070477 - DNA, 22 bp, Homo sapiens
gcaggcacctcgtggagtggaa

SEQ ID NO: 9070478 - DNA, 22 bp, Homo sapiens
gcaggagccagggattccagga

SEQ ID NO: 9070479 - DNA, 22 bp, Homo sapiens
gcaggagccctggcatgttctt

SEQ ID NO: 9070480 - DNA, 22 bp, Homo sapiens
gcaggagccctggcatgttctt

SEQ ID NO: 9070481 - DNA, 22 bp, Homo sapiens
gcaggagccaggccgagctggt

SEQ ID NO: 9070482 - DNA, 22 bp, Homo sapiens
gcaggagccaggccgagctggt

SEQ ID NO: 9070483 - DNA, 22 bp, Homo sapiens
gcaggagccacttcagggatgc

SEQ ID NO: 9070484 - DNA, 22 bp, Homo sapiens
gcaggagccacttcagggatgc

SEQ ID NO: 9070485 - DNA, 22 bp, Homo sapiens
gcaggagctcgtttccaggctg

SEQ ID NO: 9070486 - DNA, 22 bp, Homo sapiens
gcaggagctcgtttccaggctg

SEQ ID NO: 9070487 - DNA, 22 bp, Homo sapiens
gcaggagaacaaagcaagctgc

SEQ ID NO: 9070488 - DNA, 22 bp, Homo sapiens
gcaggactttgtggatgatgga

SEQ ID NO: 9070489 - DNA, 22 bp, Homo sapiens
gcaggagaaatgaagattgggt

SEQ ID NO: 9070490 - DNA, 22 bp, Homo sapiens
gcaggagagccagcaggcttcc

SEQ ID NO: 9070491 - DNA, 22 bp, Homo sapiens
gcaggactcaaatctgaaggca

SEQ ID NO: 9070492 - DNA, 22 bp, Homo sapiens
gcaggacaggcgttggtccagt

SEQ ID NO: 9070493 - DNA, 22 bp, Homo sapiens
gcaggacattcagtgaatgggc

SEQ ID NO: 9070494 - DNA, 22 bp, Homo sapiens
gcaggacattcagtgaatgggc

SEQ ID NO: 9070495 - DNA, 22 bp, Homo sapiens
gcagctgacatctggctgggcc

SEQ ID NO: 9070496 - DNA, 22 bp, Homo sapiens
gcagctgagagaagaacagggc

SEQ ID NO: 9070497 - DNA, 22 bp, Homo sapiens
gcagctgagcgtgaggaagagt

SEQ ID NO: 9070498 - DNA, 22 bp, Homo sapiens
gcagctgagagaagaacagggc

SEQ ID NO: 9070499 - DNA, 22 bp, Homo sapiens
gcagctgagagaagaacagggc

SEQ ID NO: 9070500 - DNA, 22 bp, Homo sapiens
gcagctgagcgtgaggaagagt

SEQ ID NO: 9070501 - DNA, 22 bp, Homo sapiens
gcagctgagcgtgaggaagagt

SEQ ID NO: 9070502 - DNA, 22 bp, Homo sapiens
gcagctgatggaagtcctattg

SEQ ID NO: 9070503 - DNA, 22 bp, Homo sapiens
gcagggacgccagggacagcaa

SEQ ID NO: 9070504 - DNA, 22 bp, Homo sapiens
gcagggaccttgcccaccctcc

SEQ ID NO: 9070505 - DNA, 22 bp, Homo sapiens
gcagggaaacaggtgctaagga

SEQ ID NO: 9070506 - DNA, 22 bp, Homo sapiens
gcaggctggaggctgttctggg

SEQ ID NO: 9070507 - DNA, 22 bp, Homo sapiens
gcaggctggggtagccccactt

SEQ ID NO: 9070508 - DNA, 21 bp, Homo sapiens
gcaggctggtcaaacctcagt

SEQ ID NO: 9070509 - DNA, 21 bp, Homo sapiens
gcaggctggtcaaacctcagt

SEQ ID NO: 9070510 - DNA, 21 bp, Homo sapiens
gcaggctggtcaaacctcagt

SEQ ID NO: 9070511 - DNA, 22 bp, Homo sapiens
gcaggctggtctgaccatccct

SEQ ID NO: 9070512 - DNA, 14 bp, Homo sapiens
gcaggcagaccacc

SEQ ID NO: 9070513 - DNA, 22 bp, Homo sapiens
gcaggcagagaaggaacattta

SEQ ID NO: 9070514 - DNA, 22 bp, Homo sapiens
gcaggcagagaaggaacattta

SEQ ID NO: 9070515 - DNA, 22 bp, Homo sapiens
gcaggcagagaggggtttccag

SEQ ID NO: 9070516 - DNA, 22 bp, Homo sapiens
gcaggcagagaggggtttccag

SEQ ID NO: 9070517 - DNA, 22 bp, Homo sapiens
gcaggcagagaaggaacattta

SEQ ID NO: 9070518 - DNA, 21 bp, Homo sapiens
gcaggcactctagaggagctg

SEQ ID NO: 9070519 - DNA, 17 bp, Homo sapiens
gcaggcactgctgcctg

SEQ ID NO: 9070520 - DNA, 22 bp, Homo sapiens
gcaggctggaggctgttctggg

SEQ ID NO: 9070521 - DNA, 22 bp, Homo sapiens
gcaggctggaggctgttctggg

SEQ ID NO: 9070522 - DNA, 22 bp, Homo sapiens
gcaggctgctgagatccttagg

SEQ ID NO: 9070523 - DNA, 22 bp, Homo sapiens
gcaggcagagaggggtttccag

SEQ ID NO: 9070524 - DNA, 22 bp, Homo sapiens
gcaggctgccctcttgtgttga

SEQ ID NO: 9070525 - DNA, 22 bp, Homo sapiens
gcaggggctgagcaccagcggg

SEQ ID NO: 9070526 - DNA, 22 bp, Homo sapiens
gcaggggctgagcaccagcggg

SEQ ID NO: 9070527 - DNA, 22 bp, Homo sapiens
gcaggggctgagcaccagcggg

SEQ ID NO: 9070528 - DNA, 22 bp, Homo sapiens
gcaggggctactctgagcttcc

SEQ ID NO: 9070529 - DNA, 22 bp, Homo sapiens
gcaggggctgagcaccagcggg

SEQ ID NO: 9070530 - DNA, 22 bp, Homo sapiens
gcaggggctgctgggaactcgg

SEQ ID NO: 9070531 - DNA, 22 bp, Homo sapiens
gcaggggctgctgggaactcgg

SEQ ID NO: 9070532 - DNA, 22 bp, Homo sapiens
gcagggggatggagttgaaatg

SEQ ID NO: 9070533 - DNA, 22 bp, Homo sapiens
gcagggggtcattcacgctggc

SEQ ID NO: 9070534 - DNA, 22 bp, Homo sapiens
gcaggggcaggagatctcaggc

SEQ ID NO: 9070535 - DNA, 22 bp, Homo sapiens
gcaggggctaaggacacagaga

SEQ ID NO: 9070536 - DNA, 22 bp, Homo sapiens
gcaggggcggctgggtttccag

SEQ ID NO: 9070537 - DNA, 22 bp, Homo sapiens
gcaggggctactctgagcttcc

SEQ ID NO: 9070538 - DNA, 22 bp, Homo sapiens
gcagggcagaaggtgctgagga

SEQ ID NO: 9070539 - DNA, 20 bp, Homo sapiens
gcagggcaagggatatgaaa

SEQ ID NO: 9070540 - DNA, 22 bp, Homo sapiens
gattcacagaacttagtcaagc

SEQ ID NO: 9070541 - DNA, 22 bp, Homo sapiens
gattcaatgttgcagatggaat

SEQ ID NO: 9070542 - DNA, 22 bp, Homo sapiens
gattcaatgttgcagatggaat

SEQ ID NO: 9070543 - DNA, 22 bp, Homo sapiens
gattcacagtttaggctgggct

SEQ ID NO: 9070544 - DNA, 22 bp, Homo sapiens
gattcaaaaataagctcctatt

SEQ ID NO: 9070545 - DNA, 22 bp, Homo sapiens
gattatggtagaaacaagaagt

SEQ ID NO: 9070546 - DNA, 22 bp, Homo sapiens
gattcaaagttaatgaagatgc

SEQ ID NO: 9070547 - DNA, 22 bp, Homo sapiens
gattcaaaagtttgagctccaa

SEQ ID NO: 9070548 - DNA, 22 bp, Homo sapiens
gattcaaagacagactcatttc

SEQ ID NO: 9070549 - DNA, 22 bp, Homo sapiens
gattatggagaaataattagaa

SEQ ID NO: 9070550 - DNA, 22 bp, Homo sapiens
gattatggagaagaacaatgaa

SEQ ID NO: 9070551 - DNA, 22 bp, Homo sapiens
gattatggatggacagtggagc

SEQ ID NO: 9070552 - DNA, 22 bp, Homo sapiens
gattatggtaacaatgattaaa

SEQ ID NO: 9070553 - DNA, 22 bp, Homo sapiens
gattattttgtgcaataatcgg

SEQ ID NO: 9070554 - DNA, 22 bp, Homo sapiens
gattattttgtgcaataatcgg

SEQ ID NO: 9070555 - DNA, 22 bp, Homo sapiens
gattaggagggagaggcaagta

SEQ ID NO: 9070556 - DNA, 22 bp, Homo sapiens
gatgttattgtgatcatgatac

SEQ ID NO: 9070557 - DNA, 22 bp, Homo sapiens
gatgtgtttccaggatttgttt

SEQ ID NO: 9070558 - DNA, 22 bp, Homo sapiens
gatgtttggctcaaacgagtgt

SEQ ID NO: 9070559 - DNA, 21 bp, Homo sapiens
gattaaatttaagctacatgc

SEQ ID NO: 9070560 - DNA, 21 bp, Homo sapiens
gattaaatttaagctacatgc

SEQ ID NO: 9070561 - DNA, 19 bp, Homo sapiens
gatttaaacgtggctctat

SEQ ID NO: 9070562 - DNA, 22 bp, Homo sapiens
gatttaaagtagacctttgttt

SEQ ID NO: 9070563 - DNA, 22 bp, Homo sapiens
gattgtggaagtcagtggttct

SEQ ID NO: 9070564 - DNA, 22 bp, Homo sapiens
gatttacagatctaagggtcac

SEQ ID NO: 9070565 - DNA, 22 bp, Homo sapiens
gatttacagatctaagggtcac

SEQ ID NO: 9070566 - DNA, 22 bp, Homo sapiens
gatttacaaagctctctagtgt

SEQ ID NO: 9070567 - DNA, 22 bp, Homo sapiens
gatttacaaagctctctagtgt

SEQ ID NO: 9070568 - DNA, 22 bp, Homo sapiens
gatttacagatctaagggtcac

SEQ ID NO: 9070569 - DNA, 22 bp, Homo sapiens
gatttacaaagctctctagtgt

SEQ ID NO: 9070570 - DNA, 22 bp, Homo sapiens
gatttaaagtagacctttgttt

SEQ ID NO: 9070571 - DNA, 22 bp, Homo sapiens
gattgcttatacacaagatgaa

SEQ ID NO: 9070572 - DNA, 22 bp, Homo sapiens
gattgcaccttttaaaatgtga

SEQ ID NO: 9070573 - DNA, 22 bp, Homo sapiens
gattgaatcatatgaaattgtg

SEQ ID NO: 9070574 - DNA, 22 bp, Homo sapiens
gatttcaaaggttctgcatgcc

SEQ ID NO: 9070575 - DNA, 22 bp, Homo sapiens
gatttattggtctttcattggt

SEQ ID NO: 9070576 - DNA, 22 bp, Homo sapiens
gatttataaaggttgcactgga

SEQ ID NO: 9070577 - DNA, 22 bp, Homo sapiens
gatttatagtatgtgctttcag

SEQ ID NO: 9070578 - DNA, 22 bp, Homo sapiens
gatttacagctatacccaatgg

SEQ ID NO: 9070579 - DNA, 22 bp, Homo sapiens
gatttacagctatacccaatgg

SEQ ID NO: 9070580 - DNA, 22 bp, Homo sapiens
gatttacagctatacccaatgg

SEQ ID NO: 9070581 - DNA, 22 bp, Homo sapiens
gatttacagatctaagggtcac

SEQ ID NO: 9070582 - DNA, 22 bp, Homo sapiens
gatttacaggttaggtcctgta

SEQ ID NO: 9070583 - DNA, 22 bp, Homo sapiens
gatttacaggttaggtcctgta

SEQ ID NO: 9070584 - DNA, 22 bp, Homo sapiens
gatttacaggttaggtcctgta

SEQ ID NO: 9070585 - DNA, 22 bp, Homo sapiens
gatttacaggttaggtcctgta

SEQ ID NO: 9070586 - DNA, 22 bp, Homo sapiens
gatgcattgcatcgagtagctt

SEQ ID NO: 9070587 - DNA, 22 bp, Homo sapiens
gatgcattacaaaagtgattat

SEQ ID NO: 9070588 - DNA, 22 bp, Homo sapiens
gatgcctgtggtgagcacacat

SEQ ID NO: 9070589 - DNA, 22 bp, Homo sapiens
gatgcctgcatttcaggagagt

SEQ ID NO: 9070590 - DNA, 22 bp, Homo sapiens
gatgctgaagtgaagtgatctt

SEQ ID NO: 9070591 - DNA, 22 bp, Homo sapiens
gatgctgaagtgaagtgatctt

SEQ ID NO: 9070592 - DNA, 22 bp, Homo sapiens
gatgctgaaatccagttcgggg

SEQ ID NO: 9070593 - DNA, 22 bp, Homo sapiens
gatgcgggcccgctccactgcc

SEQ ID NO: 9070594 - DNA, 22 bp, Homo sapiens
gatgctggcctggccatctggg

SEQ ID NO: 9070595 - DNA, 22 bp, Homo sapiens
gatgctgagaggtggagggaac

SEQ ID NO: 9070596 - DNA, 22 bp, Homo sapiens
gatgctgataattcatgagaag

SEQ ID NO: 9070597 - DNA, 22 bp, Homo sapiens
gatgctgccagtcaatcccaag

SEQ ID NO: 9070598 - DNA, 22 bp, Homo sapiens
gatgctgctcgggtgcctggga

SEQ ID NO: 9070599 - DNA, 22 bp, Homo sapiens
gatgctggcctggccatctggg

SEQ ID NO: 9070600 - DNA, 22 bp, Homo sapiens
gatgctttggccccatcatgag

SEQ ID NO: 9070601 - DNA, 22 bp, Homo sapiens
gatgcttcagtaagaatgcatt

SEQ ID NO: 9070602 - DNA, 22 bp, Homo sapiens
gatggaagaaaaatgcatgtct

SEQ ID NO: 9070603 - DNA, 22 bp, Homo sapiens
gatgggaggaacctgggtccct

SEQ ID NO: 9070604 - DNA, 18 bp, Homo sapiens
gatgggagcaagagaaga

SEQ ID NO: 9070605 - DNA, 22 bp, Homo sapiens
gatgggcatcaaacatgacgtg

SEQ ID NO: 9070606 - DNA, 18 bp, Homo sapiens
gatgggagcaagagaaga

SEQ ID NO: 9070607 - DNA, 22 bp, Homo sapiens
gatggcttcacttacatggctg

SEQ ID NO: 9070608 - DNA, 22 bp, Homo sapiens
gatggaggaaaagttggaatgc

SEQ ID NO: 9070609 - DNA, 22 bp, Homo sapiens
gatggaagaaaaatgcatgtct

SEQ ID NO: 9070610 - DNA, 22 bp, Homo sapiens
gatggacacctcctgaggttct

SEQ ID NO: 9070611 - DNA, 22 bp, Homo sapiens
gatggacagcctggaaggaaag

SEQ ID NO: 9070612 - DNA, 22 bp, Homo sapiens
gatggcctcatggctgcaggcc

SEQ ID NO: 9070613 - DNA, 22 bp, Homo sapiens
gatgtacactcagaaaagtcat

SEQ ID NO: 9070614 - DNA, 22 bp, Homo sapiens
gatgtagacacttggaggctta

SEQ ID NO: 9070615 - DNA, 22 bp, Homo sapiens
gatgtccatttcaaacctcatt

SEQ ID NO: 9070616 - DNA, 19 bp, Homo sapiens
gatgtcctccatagtacgg

SEQ ID NO: 9070617 - DNA, 18 bp, Homo sapiens
gatgtaaaatagtagctt

SEQ ID NO: 9070618 - DNA, 22 bp, Homo sapiens
gatgtaaaattcttggttgtca

SEQ ID NO: 9070619 - DNA, 22 bp, Homo sapiens
gatgtacaagattgtaggaatg

SEQ ID NO: 9070620 - DNA, 22 bp, Homo sapiens
gatgtacaagtaaaatatgtgt

SEQ ID NO: 9070621 - DNA, 22 bp, Homo sapiens
gatggggttttgccaggctggt

SEQ ID NO: 9070622 - DNA, 22 bp, Homo sapiens
gatgggtgggttctgtgagagg

SEQ ID NO: 9070623 - DNA, 22 bp, Homo sapiens
gatgggtgggttctgtgagagg

SEQ ID NO: 9070624 - DNA, 22 bp, Homo sapiens
gatgggcttcttccatgaagaa

SEQ ID NO: 9070625 - DNA, 22 bp, Homo sapiens
gatggggctggctttgagggtt

SEQ ID NO: 9070626 - DNA, 17 bp, Homo sapiens
gatggggctgacatcag

SEQ ID NO: 9070627 - DNA, 22 bp, Homo sapiens
gcacaatggaccgtgtgctctg

SEQ ID NO: 9070628 - DNA, 22 bp, Homo sapiens
gcacaataattcttgttttgct

SEQ ID NO: 9070629 - DNA, 22 bp, Homo sapiens
gcacaataacagccaaggttat

SEQ ID NO: 9070630 - DNA, 22 bp, Homo sapiens
gcacaagtttcttcattgttca

SEQ ID NO: 9070631 - DNA, 16 bp, Homo sapiens
gcacacacatcaatga

SEQ ID NO: 9070632 - DNA, 22 bp, Homo sapiens
gcacacacatgtgagtacatgc

SEQ ID NO: 9070633 - DNA, 22 bp, Homo sapiens
gcacacactgttttcctcacat

SEQ ID NO: 9070634 - DNA, 22 bp, Homo sapiens
gcacacacatgtgagtacatgc

SEQ ID NO: 9070635 - DNA, 16 bp, Homo sapiens
gcacacacatcaatga

SEQ ID NO: 9070636 - DNA, 22 bp, Homo sapiens
gcacccaggccggcgactgcag

SEQ ID NO: 9070637 - DNA, 22 bp, Homo sapiens
gcacacacatgtgagtacatgc

SEQ ID NO: 9070638 - DNA, 22 bp, Homo sapiens
gcacacactgttttcctcacat

SEQ ID NO: 9070639 - DNA, 22 bp, Homo sapiens
gcacccagtgggatgcttagca

SEQ ID NO: 9070640 - DNA, 22 bp, Homo sapiens
gcacccagggcaggaagtgagg

SEQ ID NO: 9070641 - DNA, 22 bp, Homo sapiens
gcacccagtttgtctcagggtt

SEQ ID NO: 9070642 - DNA, 22 bp, Homo sapiens
gcacccaggcttgggcagcaac

SEQ ID NO: 9070643 - DNA, 22 bp, Homo sapiens
gcacacactgttttcctcacat

SEQ ID NO: 9070644 - DNA, 22 bp, Homo sapiens
gcacccagggacttggctggcc

SEQ ID NO: 9070645 - DNA, 22 bp, Homo sapiens
gcacttgtcaaatattatagta

SEQ ID NO: 9070646 - DNA, 22 bp, Homo sapiens
gcacttgtggatttgatataca

SEQ ID NO: 9070647 - DNA, 22 bp, Homo sapiens
gcacctgctggaatcagtctgt

SEQ ID NO: 9070648 - DNA, 17 bp, Homo sapiens
gcaccgtgggcacactc

SEQ ID NO: 9070649 - DNA, 22 bp, Homo sapiens
gcacctgcaggatgagccaggg

SEQ ID NO: 9070650 - DNA, 22 bp, Homo sapiens
gcacctgctcacacatgtgact

SEQ ID NO: 9070651 - DNA, 22 bp, Homo sapiens
gcaccctctgagctccgctccg

SEQ ID NO: 9070652 - DNA, 22 bp, Homo sapiens
gcaccgccttggaccgcccgct

SEQ ID NO: 9070653 - DNA, 22 bp, Homo sapiens
gcaccgccttggaccgcccgct

SEQ ID NO: 9070654 - DNA, 22 bp, Homo sapiens
gcagagccccattgctggcggg

SEQ ID NO: 9070655 - DNA, 22 bp, Homo sapiens
gcagagccaggctggggcaggt

SEQ ID NO: 9070656 - DNA, 22 bp, Homo sapiens
gcagagcccctcaagccagcct

SEQ ID NO: 9070657 - DNA, 22 bp, Homo sapiens
gcagagcccctcaagccagcct

SEQ ID NO: 9070658 - DNA, 22 bp, Homo sapiens
gcagagccccattgctggcggg

SEQ ID NO: 9070659 - DNA, 22 bp, Homo sapiens
gcagagccagaatggccaggac

SEQ ID NO: 9070660 - DNA, 22 bp, Homo sapiens
gcagagccaggagcccaggatc

SEQ ID NO: 9070661 - DNA, 22 bp, Homo sapiens
gcagaagctgggcagcgaggtg

SEQ ID NO: 9070662 - DNA, 22 bp, Homo sapiens
gcagaagctgggcagcgaggtg

SEQ ID NO: 9070663 - DNA, 22 bp, Homo sapiens
gcagagcatgtcctcaggacag

SEQ ID NO: 9070664 - DNA, 22 bp, Homo sapiens
gcagagcagtgcttgcccagcg

SEQ ID NO: 9070665 - DNA, 22 bp, Homo sapiens
gcagagcagtgcttgcccagcg

SEQ ID NO: 9070666 - DNA, 22 bp, Homo sapiens
gcagagcatgtcctcaggacag

SEQ ID NO: 9070667 - DNA, 18 bp, Homo sapiens
gcagagcatcaagggtta

SEQ ID NO: 9070668 - DNA, 22 bp, Homo sapiens
gcagaaacttggagaagccagg

SEQ ID NO: 9070669 - DNA, 22 bp, Homo sapiens
gcagaaagcttagagggtttgc

SEQ ID NO: 9070670 - DNA, 21 bp, Homo sapiens
gcagaaaggaatcttaggtcc

SEQ ID NO: 9070671 - DNA, 23 bp, Homo sapiens
gcagaaattctcacactgaggcc

SEQ ID NO: 9070672 - DNA, 22 bp, Homo sapiens
gcactttgcccctcctttggca

SEQ ID NO: 9070673 - DNA, 22 bp, Homo sapiens
gcactttgtggattgtatttcc

SEQ ID NO: 9070674 - DNA, 22 bp, Homo sapiens
gcagaagcagggcaggggcaaa

SEQ ID NO: 9070675 - DNA, 22 bp, Homo sapiens
gcagaagcccggtcagcgcacg

SEQ ID NO: 9070676 - DNA, 22 bp, Homo sapiens
gcagaagctgggagaagggatt

SEQ ID NO: 9070677 - DNA, 22 bp, Homo sapiens
gcagaagctgggagaagggatt

SEQ ID NO: 9070678 - DNA, 22 bp, Homo sapiens
gcagaagaccatggtggaaaga

SEQ ID NO: 9070679 - DNA, 22 bp, Homo sapiens
gcagaacatttcacagtatctt

SEQ ID NO: 9070680 - DNA, 22 bp, Homo sapiens
gcagaacaacgtaggagtggag

SEQ ID NO: 9070681 - DNA, 22 bp, Homo sapiens
gattttcatgataaacttgtga

SEQ ID NO: 9070682 - DNA, 22 bp, Homo sapiens
gattttcatgataaacttgtga

SEQ ID NO: 9070683 - DNA, 22 bp, Homo sapiens
gattttctgagccttcaaattt

SEQ ID NO: 9070684 - DNA, 22 bp, Homo sapiens
gattttatatggcatactgtgg

SEQ ID NO: 9070685 - DNA, 22 bp, Homo sapiens
gattttatcgtcatccttctgg

SEQ ID NO: 9070686 - DNA, 22 bp, Homo sapiens
gattttattagcccaaactttg

SEQ ID NO: 9070687 - DNA, 21 bp, Homo sapiens
gattttaaagagactgccaca

SEQ ID NO: 9070688 - DNA, 22 bp, Homo sapiens
gattttacatgtcatatctatt

SEQ ID NO: 9070689 - DNA, 22 bp, Homo sapiens
gattttacaaactgcaggaccc

SEQ ID NO: 9070690 - DNA, 22 bp, Homo sapiens
gattttactgtctgtgtatctc

SEQ ID NO: 9070691 - DNA, 22 bp, Homo sapiens
gatttcttcattcattagatgg

SEQ ID NO: 9070692 - DNA, 22 bp, Homo sapiens
gatttcttgacccctgtctcag

SEQ ID NO: 9070693 - DNA, 22 bp, Homo sapiens
gatttcttgagcaagttgctta

SEQ ID NO: 9070694 - DNA, 22 bp, Homo sapiens
gatttctttgcaagctgtgttc

SEQ ID NO: 9070695 - DNA, 22 bp, Homo sapiens
gatttggcttggatgattaaac

SEQ ID NO: 9070696 - DNA, 22 bp, Homo sapiens
gattttctgagccttcaaattt

SEQ ID NO: 9070697 - DNA, 22 bp, Homo sapiens
gattttctgagccttcaaattt

SEQ ID NO: 9070698 - DNA, 22 bp, Homo sapiens
gattttcttgggaaacaatgag

SEQ ID NO: 9070699 - DNA, 22 bp, Homo sapiens
gattttcttgggaaacaatgag

SEQ ID NO: 9070700 - DNA, 22 bp, Homo sapiens
gattttcttgggaaacaatgag

SEQ ID NO: 9070701 - DNA, 22 bp, Homo sapiens
gattttcttgggaaacaatgag

SEQ ID NO: 9070702 - DNA, 22 bp, Homo sapiens
gatttttcagtataaaatatat

SEQ ID NO: 9070703 - DNA, 22 bp, Homo sapiens
gcaaacatccactgcccttgta

SEQ ID NO: 9070704 - DNA, 22 bp, Homo sapiens
gcaaacataatatgaagacact

SEQ ID NO: 9070705 - DNA, 22 bp, Homo sapiens
gcaaacataatatgaagacact

SEQ ID NO: 9070706 - DNA, 22 bp, Homo sapiens
gcaaacataatatgaagacact

SEQ ID NO: 9070707 - DNA, 22 bp, Homo sapiens
gcaatagtatttattaaagtag

SEQ ID NO: 9070708 - DNA, 22 bp, Homo sapiens
gcaatagtgcctattctcttga

SEQ ID NO: 9070709 - DNA, 18 bp, Homo sapiens
gcaaacattcttccagtc

SEQ ID NO: 9070710 - DNA, 22 bp, Homo sapiens
gcaaacattccacagaaggaag

SEQ ID NO: 9070711 - DNA, 22 bp, Homo sapiens
gcaaacattccacagaaggaag

SEQ ID NO: 9070712 - DNA, 22 bp, Homo sapiens
gcaaacatttggtctagtgtgt

SEQ ID NO: 9070713 - DNA, 22 bp, Homo sapiens
gcaaacatgttgtgagatacca

SEQ ID NO: 9070714 - DNA, 22 bp, Homo sapiens
gcaaacatgtgctcattttgtg

SEQ ID NO: 9070715 - DNA, 22 bp, Homo sapiens
gcaaacattcaggagtacagga

SEQ ID NO: 9070716 - DNA, 22 bp, Homo sapiens
gcaaacattcaggagtacagga

SEQ ID NO: 9070717 - DNA, 22 bp, Homo sapiens
gcaaacatctttatttggcaag

SEQ ID NO: 9070718 - DNA, 22 bp, Homo sapiens
gcaaacatcttagccatagagt

SEQ ID NO: 9070719 - DNA, 22 bp, Homo sapiens
gcaaacatgctgagaaataaga

SEQ ID NO: 9070720 - DNA, 22 bp, Homo sapiens
gcaaacatgctgagaaataaga

SEQ ID NO: 9070721 - DNA, 22 bp, Homo sapiens
gcacaaagatgaatacagaatg

SEQ ID NO: 9070722 - DNA, 22 bp, Homo sapiens
gcacaaactgcaattacttttg

SEQ ID NO: 9070723 - DNA, 22 bp, Homo sapiens
gcacaaaaggtacttcatgtag

SEQ ID NO: 9070724 - DNA, 22 bp, Homo sapiens
gcacaaactgcaattacttttg

SEQ ID NO: 9070725 - DNA, 22 bp, Homo sapiens
gcacaaaacacattttgacaat

SEQ ID NO: 9070726 - DNA, 22 bp, Homo sapiens
gcacaagaataaccatatttaa

SEQ ID NO: 9070727 - DNA, 22 bp, Homo sapiens
gcacaaaggtggaaggaggaag

SEQ ID NO: 9070728 - DNA, 22 bp, Homo sapiens
gcacaaaggtggaaggaggaag

SEQ ID NO: 9070729 - DNA, 22 bp, Homo sapiens
gcaattattatgtgacttttac

SEQ ID NO: 9070730 - DNA, 20 bp, Homo sapiens
gcaatatatgagtgcaataa

SEQ ID NO: 9070731 - DNA, 22 bp, Homo sapiens
gcaatatactttctggcagtga

SEQ ID NO: 9070732 - DNA, 22 bp, Homo sapiens
gcaatataaccagttgtcatgc

SEQ ID NO: 9070733 - DNA, 22 bp, Homo sapiens
gcaatataatttgtgggatatc

SEQ ID NO: 9070734 - DNA, 22 bp, Homo sapiens
gcaatgattgcattagaagatg

SEQ ID NO: 9070735 - DNA, 22 bp, Homo sapiens
gcaatgattgcattagaagatg

SEQ ID NO: 9070736 - DNA, 22 bp, Homo sapiens
taaagctagaaggtgctgtaca

SEQ ID NO: 9070737 - DNA, 22 bp, Homo sapiens
taaagctatgcttaatttatca

SEQ ID NO: 9070738 - DNA, 21 bp, Homo sapiens
taaagctcgttcaggaaagtc

SEQ ID NO: 9070739 - DNA, 22 bp, Homo sapiens
taaagctattgctgtttattgt

SEQ ID NO: 9070740 - DNA, 22 bp, Homo sapiens
taaagctattatagttatgttt

SEQ ID NO: 9070741 - DNA, 22 bp, Homo sapiens
taaagctgttcagtgcagaaag

SEQ ID NO: 9070742 - DNA, 22 bp, Homo sapiens
taaagcaggcatctctctcctc

SEQ ID NO: 9070743 - DNA, 22 bp, Homo sapiens
taaaaccattcctgctttcatg

SEQ ID NO: 9070744 - DNA, 19 bp, Homo sapiens
taaaacgtgcatggcagca

SEQ ID NO: 9070745 - DNA, 22 bp, Homo sapiens
taaaacagcagggcagagaagt

SEQ ID NO: 9070746 - DNA, 22 bp, Homo sapiens
taaaacagcagggcagagaagt

SEQ ID NO: 9070747 - DNA, 22 bp, Homo sapiens
taaaggcagccactgagctcaa

SEQ ID NO: 9070748 - DNA, 22 bp, Homo sapiens
taaaggaggagttaatgagact

SEQ ID NO: 9070749 - DNA, 22 bp, Homo sapiens
taaaggagtgtgatgaaaggga

SEQ ID NO: 9070750 - DNA, 22 bp, Homo sapiens
taaaggcaaactctccaaggat

SEQ ID NO: 9070751 - DNA, 22 bp, Homo sapiens
taaaggaatcagttttagagat

SEQ ID NO: 9070752 - DNA, 18 bp, Homo sapiens
taaaggaagtgggagagg

SEQ ID NO: 9070753 - DNA, 22 bp, Homo sapiens
taaaggaagaattctctgtgat

SEQ ID NO: 9070754 - DNA, 22 bp, Homo sapiens
taaaggcagttggagttgagga

SEQ ID NO: 9070755 - DNA, 22 bp, Homo sapiens
taaaggcagttctgattaggtc

SEQ ID NO: 9070756 - DNA, 22 bp, Homo sapiens
taaaggcagtaattcctgagtt

SEQ ID NO: 9070757 - DNA, 22 bp, Homo sapiens
taaaggcagccactgagctcaa

SEQ ID NO: 9070758 - DNA, 22 bp, Homo sapiens
taaaggcactgcgtccctcaaa

SEQ ID NO: 9070759 - DNA, 22 bp, Homo sapiens
taaaggcagttggagttgagga

SEQ ID NO: 9070760 - DNA, 22 bp, Homo sapiens
taaaggcctagtaagttgagac

SEQ ID NO: 9070761 - DNA, 22 bp, Homo sapiens
taaaggctttattttccagtca

SEQ ID NO: 9070762 - DNA, 22 bp, Homo sapiens
taaatacttttactccactgat

SEQ ID NO: 9070763 - DNA, 22 bp, Homo sapiens
gtttaacatctgtgaagctgct

SEQ ID NO: 9070764 - DNA, 22 bp, Homo sapiens
gtttaataatgttgaattacta

SEQ ID NO: 9070765 - DNA, 22 bp, Homo sapiens
gtttaacattgtaccaacacct

SEQ ID NO: 9070766 - DNA, 22 bp, Homo sapiens
gtttttcctgctgacttgggtc

SEQ ID NO: 9070767 - DNA, 22 bp, Homo sapiens
gtttttctaagtagcgatattt

SEQ ID NO: 9070768 - DNA, 22 bp, Homo sapiens
gtttttccttgctgaggacccg

SEQ ID NO: 9070769 - DNA, 22 bp, Homo sapiens
gtttttctagaaatctcctcct

SEQ ID NO: 9070770 - DNA, 22 bp, Homo sapiens
gtttttctagaaatctcctcct

SEQ ID NO: 9070771 - DNA, 22 bp, Homo sapiens
gttttttcatgagtagttatct

SEQ ID NO: 9070772 - DNA, 22 bp, Homo sapiens
gttttttgggtgtatatcttct

SEQ ID NO: 9070773 - DNA, 22 bp, Homo sapiens
taaaacacctgtagtgtctgcc

SEQ ID NO: 9070774 - DNA, 22 bp, Homo sapiens
taaaacacataaactctctatt

SEQ ID NO: 9070775 - DNA, 22 bp, Homo sapiens
taaaacacctgtagtgtctgcc

SEQ ID NO: 9070776 - DNA, 22 bp, Homo sapiens
taaaacactcagcacctagcaa

SEQ ID NO: 9070777 - DNA, 22 bp, Homo sapiens
gtttttctttgtgtgaagacaa

SEQ ID NO: 9070778 - DNA, 22 bp, Homo sapiens
gtttttctttgtgtgaagacaa

SEQ ID NO: 9070779 - DNA, 20 bp, Homo sapiens
gtttttctctcttgccacta

SEQ ID NO: 9070780 - DNA, 22 bp, Homo sapiens
gtttttctaggaccatgtgatt

SEQ ID NO: 9070781 - DNA, 22 bp, Homo sapiens
gtttttctagactgggagtttg

SEQ ID NO: 9070782 - DNA, 22 bp, Homo sapiens
gtttttctagactgggagtttg

SEQ ID NO: 9070783 - DNA, 22 bp, Homo sapiens
gtttttctaggaccatgtgatt

SEQ ID NO: 9070784 - DNA, 22 bp, Homo sapiens
gtttttctctgaaatagttgac

SEQ ID NO: 9070785 - DNA, 20 bp, Homo sapiens
gtttttcttgggcgagctat

SEQ ID NO: 9070786 - DNA, 22 bp, Homo sapiens
gtttttctgtgagcggtaaagg

SEQ ID NO: 9070787 - DNA, 22 bp, Homo sapiens
taagaaatttagttatagaatg

SEQ ID NO: 9070788 - DNA, 22 bp, Homo sapiens
taagaaatttagttatagaatg

SEQ ID NO: 9070789 - DNA, 22 bp, Homo sapiens
taagaaatttagttatagaatg

SEQ ID NO: 9070790 - DNA, 22 bp, Homo sapiens
taagaaatttagttatagaatg

SEQ ID NO: 9070791 - DNA, 22 bp, Homo sapiens
taagaaatttagttatagaatg

SEQ ID NO: 9070792 - DNA, 20 bp, Homo sapiens
taagaacaagactaggaagc

SEQ ID NO: 9070793 - DNA, 22 bp, Homo sapiens
taacagaatttgctaaactccg

SEQ ID NO: 9070794 - DNA, 22 bp, Homo sapiens
taacagagatagaaatgtaaag

SEQ ID NO: 9070795 - DNA, 22 bp, Homo sapiens
taacactgtccaaagaattcca

SEQ ID NO: 9070796 - DNA, 22 bp, Homo sapiens
taacactgtgcccagagtccca

SEQ ID NO: 9070797 - DNA, 22 bp, Homo sapiens
taacactgtggtgttctttgtc

SEQ ID NO: 9070798 - DNA, 22 bp, Homo sapiens
taacactgtaaacctagatgtt

SEQ ID NO: 9070799 - DNA, 22 bp, Homo sapiens
taacactgtccaaagaattcca

SEQ ID NO: 9070800 - DNA, 22 bp, Homo sapiens
taacagaatagcagaaacagaa

SEQ ID NO: 9070801 - DNA, 22 bp, Homo sapiens
taacactgtgtctgccatatcc

SEQ ID NO: 9070802 - DNA, 22 bp, Homo sapiens
taacagaatagcagaaacagaa

SEQ ID NO: 9070803 - DNA, 20 bp, Homo sapiens
taagaacaagactaggaagc

SEQ ID NO: 9070804 - DNA, 22 bp, Homo sapiens
taacactggcttttgctgaggc

SEQ ID NO: 9070805 - DNA, 22 bp, Homo sapiens
taacactggagagttggttgtg

SEQ ID NO: 9070806 - DNA, 22 bp, Homo sapiens
taacactggcttttgctgaggc

SEQ ID NO: 9070807 - DNA, 22 bp, Homo sapiens
taacactggtatttcatttagt

SEQ ID NO: 9070808 - DNA, 22 bp, Homo sapiens
taacactggttatccctgtgca

SEQ ID NO: 9070809 - DNA, 22 bp, Homo sapiens
taacactggttatccctgtgca

SEQ ID NO: 9070810 - DNA, 22 bp, Homo sapiens
taacactgccatgctggagtca

SEQ ID NO: 9070811 - DNA, 22 bp, Homo sapiens
taacactggagagttggttgtg

SEQ ID NO: 9070812 - DNA, 22 bp, Homo sapiens
taacactgcttcattttggaga

SEQ ID NO: 9070813 - DNA, 22 bp, Homo sapiens
taaatgagatttgttcttttgt

SEQ ID NO: 9070814 - DNA, 22 bp, Homo sapiens
taacactgaaaatgatgcatgt

SEQ ID NO: 9070815 - DNA, 22 bp, Homo sapiens
taacactgatttgttctcaggg

SEQ ID NO: 9070816 - DNA, 22 bp, Homo sapiens
taacactgaaaatgatgcatgt

SEQ ID NO: 9070817 - DNA, 22 bp, Homo sapiens
taacactatccagatatgataa

SEQ ID NO: 9070818 - DNA, 22 bp, Homo sapiens
taaatgataataatgctagtgt

SEQ ID NO: 9070819 - DNA, 22 bp, Homo sapiens
taacactaagaatctaaattta

SEQ ID NO: 9070820 - DNA, 22 bp, Homo sapiens
taaatgagtaatatagctgttt

SEQ ID NO: 9070821 - DNA, 22 bp, Homo sapiens
taaatgagtaatatagctgttt

SEQ ID NO: 9070822 - DNA, 22 bp, Homo sapiens
taaatgaagaaatggagattgt

SEQ ID NO: 9070823 - DNA, 22 bp, Homo sapiens
taaatgagatttgttcttttgt

SEQ ID NO: 9070824 - DNA, 22 bp, Homo sapiens
taaatgaaagggtttaatttat

SEQ ID NO: 9070825 - DNA, 22 bp, Homo sapiens
taaatgagatgtacataactca

SEQ ID NO: 9070826 - DNA, 22 bp, Homo sapiens
taaatcacccatctcctaatct

SEQ ID NO: 9070827 - DNA, 22 bp, Homo sapiens
taaatcagggagtcatctgcga

SEQ ID NO: 9070828 - DNA, 22 bp, Homo sapiens
taaatcttgtggcaatgcttct

SEQ ID NO: 9070829 - DNA, 22 bp, Homo sapiens
taaatgaaagggtttaatttat

SEQ ID NO: 9070830 - DNA, 22 bp, Homo sapiens
gtggtttgtgcatagctcctat

SEQ ID NO: 9070831 - DNA, 22 bp, Homo sapiens
gtggtgagttcaggctggggtg

SEQ ID NO: 9070832 - DNA, 22 bp, Homo sapiens
gtggtgcaggccagcaggggcg

SEQ ID NO: 9070833 - DNA, 22 bp, Homo sapiens
gtggtgcaggccagcaggggcg

SEQ ID NO: 9070834 - DNA, 22 bp, Homo sapiens
gtggtgcatccttgagtaagct

SEQ ID NO: 9070835 - DNA, 22 bp, Homo sapiens
gtggtcctgcacccgcttggcc

SEQ ID NO: 9070836 - DNA, 22 bp, Homo sapiens
gtggtcctcataattcagtgag

SEQ ID NO: 9070837 - DNA, 22 bp, Homo sapiens
gtggtctggggtcaggcctgag

SEQ ID NO: 9070838 - DNA, 22 bp, Homo sapiens
gtggtcctggcaaccatggtga

SEQ ID NO: 9070839 - DNA, 22 bp, Homo sapiens
gtggtgagttcaggctggggtg

SEQ ID NO: 9070840 - DNA, 22 bp, Homo sapiens
gtgtcaataaatagcggtgtgg

SEQ ID NO: 9070841 - DNA, 22 bp, Homo sapiens
gtgtcaacagccgaagataaat

SEQ ID NO: 9070842 - DNA, 22 bp, Homo sapiens
gtgtcacaagagcccaggaaac

SEQ ID NO: 9070843 - DNA, 22 bp, Homo sapiens
gtgtcacaggcccagctcttca

SEQ ID NO: 9070844 - DNA, 22 bp, Homo sapiens
gtgtcacatggtttactgcagc

SEQ ID NO: 9070845 - DNA, 22 bp, Homo sapiens
gtgtacaaaatgtctccatgga

SEQ ID NO: 9070846 - DNA, 22 bp, Homo sapiens
gtgtacaaaatgtctccatgga

SEQ ID NO: 9070847 - DNA, 17 bp, Homo sapiens
gtgtacaagcagaaggc

SEQ ID NO: 9070848 - DNA, 22 bp, Homo sapiens
gtgtaattagtagtaaattcaa

SEQ ID NO: 9070849 - DNA, 22 bp, Homo sapiens
gtgtaagtatctttgtatcttt

SEQ ID NO: 9070850 - DNA, 22 bp, Homo sapiens
gtgtaagtatctttgtatcttt

SEQ ID NO: 9070851 - DNA, 22 bp, Homo sapiens
gtggttttggaggccactgttt

SEQ ID NO: 9070852 - DNA, 22 bp, Homo sapiens
gtggtttgttttattcctggaa

SEQ ID NO: 9070853 - DNA, 22 bp, Homo sapiens
gtggttttattcgttcctctgt

SEQ ID NO: 9070854 - DNA, 22 bp, Homo sapiens
gtggttttattcgttcctctgt

SEQ ID NO: 9070855 - DNA, 22 bp, Homo sapiens
gtgtaaatcagcttgtgtaata

SEQ ID NO: 9070856 - DNA, 22 bp, Homo sapiens
gtgggtggaggcgtcgagggca

SEQ ID NO: 9070857 - DNA, 22 bp, Homo sapiens
gtggtcagaaatctcagtggca

SEQ ID NO: 9070858 - DNA, 22 bp, Homo sapiens
gtggtcagagatgacagtgggt

SEQ ID NO: 9070859 - DNA, 22 bp, Homo sapiens
gtggtcagaatggagcccagga

SEQ ID NO: 9070860 - DNA, 22 bp, Homo sapiens
gtggtcaggggctgaggtgccc

SEQ ID NO: 9070861 - DNA, 22 bp, Homo sapiens
gtgggtgatgtactggaggcca

SEQ ID NO: 9070862 - DNA, 22 bp, Homo sapiens
gtgggtccgcttggttccggtg

SEQ ID NO: 9070863 - DNA, 22 bp, Homo sapiens
gtgggtccctaaacacatccca

SEQ ID NO: 9070864 - DNA, 22 bp, Homo sapiens
gtgggtgatgtactggaggcca

SEQ ID NO: 9070865 - DNA, 18 bp, Homo sapiens
gtggggtgttgtgaggat

SEQ ID NO: 9070866 - DNA, 22 bp, Homo sapiens
gtggggtgtccagcagcgagct

SEQ ID NO: 9070867 - DNA, 18 bp, Homo sapiens
gtggggtgttgtgaggat

SEQ ID NO: 9070868 - DNA, 22 bp, Homo sapiens
gtggggtctctctgtacctccc

SEQ ID NO: 9070869 - DNA, 22 bp, Homo sapiens
gtggggtagatctttctcagga

SEQ ID NO: 9070870 - DNA, 22 bp, Homo sapiens
gtggggtctgtcctcttctggg

SEQ ID NO: 9070871 - DNA, 22 bp, Homo sapiens
gtggggtagatctttctcagga

SEQ ID NO: 9070872 - DNA, 22 bp, Homo sapiens
gtggggtagatctttctcagga

SEQ ID NO: 9070873 - DNA, 22 bp, Homo sapiens
gtgggggctggctcgtcctgtg

SEQ ID NO: 9070874 - DNA, 22 bp, Homo sapiens
gtggggaggcctaagcaagttg

SEQ ID NO: 9070875 - DNA, 22 bp, Homo sapiens
gtggggaggcctaagcaagttg

SEQ ID NO: 9070876 - DNA, 22 bp, Homo sapiens
gtggggaggcctaagcaagttg

SEQ ID NO: 9070877 - DNA, 22 bp, Homo sapiens
gtggggaggcattcttctccct

SEQ ID NO: 9070878 - DNA, 22 bp, Homo sapiens
gtggggaggcattcttctccct

SEQ ID NO: 9070879 - DNA, 22 bp, Homo sapiens
gtggggagcagccttagcccct

SEQ ID NO: 9070880 - DNA, 22 bp, Homo sapiens
gtggggagcagccttagcccct

SEQ ID NO: 9070881 - DNA, 22 bp, Homo sapiens
gtgggggcaggcagtgctagga

SEQ ID NO: 9070882 - DNA, 22 bp, Homo sapiens
gtgggggcagtgggcttcgagc

SEQ ID NO: 9070883 - DNA, 22 bp, Homo sapiens
gtgggggctggaaatcttgcca

SEQ ID NO: 9070884 - DNA, 22 bp, Homo sapiens
gtgggccttgcagggtgcaggg

SEQ ID NO: 9070885 - DNA, 22 bp, Homo sapiens
gtgggcctcttgagggtggcta

SEQ ID NO: 9070886 - DNA, 22 bp, Homo sapiens
gtgggcctcccctttacgagcc

SEQ ID NO: 9070887 - DNA, 22 bp, Homo sapiens
gtgggccagttcctcacaggta

SEQ ID NO: 9070888 - DNA, 22 bp, Homo sapiens
gtgggccagttcctcacaggta

SEQ ID NO: 9070889 - DNA, 22 bp, Homo sapiens
gtgggccaggcgtctaggccct

SEQ ID NO: 9070890 - DNA, 22 bp, Homo sapiens
gtgggcctgatgctgccatgag

SEQ ID NO: 9070891 - DNA, 22 bp, Homo sapiens
gtgggctggaccctcctgctcc

SEQ ID NO: 9070892 - DNA, 22 bp, Homo sapiens
gtgggcagagcaagggaactca

SEQ ID NO: 9070893 - DNA, 22 bp, Homo sapiens
gtgggcagacatgatagaagga

SEQ ID NO: 9070894 - DNA, 22 bp, Homo sapiens
gtgggcagaattgaatctttaa

SEQ ID NO: 9070895 - DNA, 22 bp, Homo sapiens
gtgggcaaggtccctgccagct

SEQ ID NO: 9070896 - DNA, 22 bp, Homo sapiens
gtgggcagacatgatagaagga

SEQ ID NO: 9070897 - DNA, 20 bp, Homo sapiens
gtgggcagcaggcatactgg

SEQ ID NO: 9070898 - DNA, 20 bp, Homo sapiens
gtgggcagcaggcatactgg

SEQ ID NO: 9070899 - DNA, 20 bp, Homo sapiens
gtgggcagcaggcatactgg

SEQ ID NO: 9070900 - DNA, 22 bp, Homo sapiens
gtgggcagcaccagggaagtgt

SEQ ID NO: 9070901 - DNA, 20 bp, Homo sapiens
gtgggcagatgtgtgcatgg

SEQ ID NO: 9070902 - DNA, 20 bp, Homo sapiens
gtgggcagatgtgtgcatgg

SEQ ID NO: 9070903 - DNA, 22 bp, Homo sapiens
gtgggcagaggagagaacatta

SEQ ID NO: 9070904 - DNA, 22 bp, Homo sapiens
gtgggccacatcccagggctct

SEQ ID NO: 9070905 - DNA, 22 bp, Homo sapiens
gtgggccacatcccagggctct

SEQ ID NO: 9070906 - DNA, 22 bp, Homo sapiens
gtgggccacatcccagggctct

SEQ ID NO: 9070907 - DNA, 22 bp, Homo sapiens
gtgggccaggccggagtgcaga

SEQ ID NO: 9070908 - DNA, 19 bp, Homo sapiens
gtgggccaggcagaaggct

SEQ ID NO: 9070909 - DNA, 19 bp, Homo sapiens
gtgggccaggcagaaggct

SEQ ID NO: 9070910 - DNA, 22 bp, Homo sapiens
gtgggccactgggaggcaaggg

SEQ ID NO: 9070911 - DNA, 22 bp, Homo sapiens
gtgggccagcttttctcctggg

SEQ ID NO: 9070912 - DNA, 22 bp, Homo sapiens
gtgggcagtgtgtcagtatctt

SEQ ID NO: 9070913 - DNA, 22 bp, Homo sapiens
gtgggcagtgtgtcagtatctt

SEQ ID NO: 9070914 - DNA, 22 bp, Homo sapiens
gtgggcagtggtttgcgcggtc

SEQ ID NO: 9070915 - DNA, 22 bp, Homo sapiens
gtgggcagcctgtccggagacc

SEQ ID NO: 9070916 - DNA, 22 bp, Homo sapiens
gtgtggggccaggatcagggct

SEQ ID NO: 9070917 - DNA, 22 bp, Homo sapiens
gtgtggggaggagagagccctt

SEQ ID NO: 9070918 - DNA, 22 bp, Homo sapiens
gtgtggggagctgcagccacat

SEQ ID NO: 9070919 - DNA, 22 bp, Homo sapiens
gtgtgcagtagagaaagagcag

SEQ ID NO: 9070920 - DNA, 22 bp, Homo sapiens
gtgtgcagtctgctaggcaggg

SEQ ID NO: 9070921 - DNA, 22 bp, Homo sapiens
gtgtggggctcagtgggaatgt

SEQ ID NO: 9070922 - DNA, 22 bp, Homo sapiens
gtgtgggggcagctctgatatg

SEQ ID NO: 9070923 - DNA, 22 bp, Homo sapiens
gtgtggggtcttctcttggcct

SEQ ID NO: 9070924 - DNA, 22 bp, Homo sapiens
gtgtggggtcttctcttggcct

SEQ ID NO: 9070925 - DNA, 22 bp, Homo sapiens
gtgtgtcagagctcagagaagt

SEQ ID NO: 9070926 - DNA, 22 bp, Homo sapiens
gtgtgcagaagacacaagacat

SEQ ID NO: 9070927 - DNA, 22 bp, Homo sapiens
gtgtgcagaagacacaagacat

SEQ ID NO: 9070928 - DNA, 22 bp, Homo sapiens
gtgtgcagaggcaggaggtgct

SEQ ID NO: 9070929 - DNA, 22 bp, Homo sapiens
gtgtgcagaggcaggaggtgct

SEQ ID NO: 9070930 - DNA, 22 bp, Homo sapiens
gtgtgcagatgtgatgctgggc

SEQ ID NO: 9070931 - DNA, 22 bp, Homo sapiens
gtgtgcagcagagacaggactc

SEQ ID NO: 9070932 - DNA, 22 bp, Homo sapiens
gtgtgcagaacagggagtgggt

SEQ ID NO: 9070933 - DNA, 22 bp, Homo sapiens
gtgtgcagaacagggagtgggt

SEQ ID NO: 9070934 - DNA, 21 bp, Homo sapiens
gtgtgagtagcatgtgtctca

SEQ ID NO: 9070935 - DNA, 22 bp, Homo sapiens
gtgtgcaggtgtcagtgcagct

SEQ ID NO: 9070936 - DNA, 22 bp, Homo sapiens
gtgtgcagtagagaaagagcag

SEQ ID NO: 9070937 - DNA, 22 bp, Homo sapiens
gtgtgcagggatgagtgcaggt

SEQ ID NO: 9070938 - DNA, 22 bp, Homo sapiens
gtgtgcaggccacaggccaggg

SEQ ID NO: 9070939 - DNA, 22 bp, Homo sapiens
gtgtcagatgtccagggcagca

SEQ ID NO: 9070940 - DNA, 22 bp, Homo sapiens
gtgtcattaaccaccatgcaaa

SEQ ID NO: 9070941 - DNA, 22 bp, Homo sapiens
gtgtcattactgaaagattgaa

SEQ ID NO: 9070942 - DNA, 23 bp, Homo sapiens
gtgtcattactgtaattattgtg

SEQ ID NO: 9070943 - DNA, 22 bp, Homo sapiens
gtgtccacggctgagaatgatt

SEQ ID NO: 9070944 - DNA, 22 bp, Homo sapiens
gtgtccagagaaactcacagct

SEQ ID NO: 9070945 - DNA, 22 bp, Homo sapiens
gtgtcccaaagattagaaatca

SEQ ID NO: 9070946 - DNA, 22 bp, Homo sapiens
gtgtccattcactgcaacactt

SEQ ID NO: 9070947 - DNA, 19 bp, Homo sapiens
gtgtccatggagcatggag

SEQ ID NO: 9070948 - DNA, 22 bp, Homo sapiens
gtgtcccaatgttcaggacggc

SEQ ID NO: 9070949 - DNA, 22 bp, Homo sapiens
gtgtcccactctggaggtgaag

SEQ ID NO: 9070950 - DNA, 22 bp, Homo sapiens
gtgtcccaatctacttttccct

SEQ ID NO: 9070951 - DNA, 22 bp, Homo sapiens
gtgtccagggccgtgttgtctt

SEQ ID NO: 9070952 - DNA, 22 bp, Homo sapiens
gtgtccagagaactgtgggagc

SEQ ID NO: 9070953 - DNA, 22 bp, Homo sapiens
gtgtcctgcaggccaggaatgg

SEQ ID NO: 9070954 - DNA, 22 bp, Homo sapiens
gtgtcctgggctggtagagctg

SEQ ID NO: 9070955 - DNA, 18 bp, Homo sapiens
gtgtcctggctgcggcgc

SEQ ID NO: 9070956 - DNA, 22 bp, Homo sapiens
gtgtcctgccaccctgggcttt

SEQ ID NO: 9070957 - DNA, 22 bp, Homo sapiens
gtgtcctgccaccctgggcttt

SEQ ID NO: 9070958 - DNA, 22 bp, Homo sapiens
gtgtcccagccccacaggcctg

SEQ ID NO: 9070959 - DNA, 22 bp, Homo sapiens
gtgtcccagcagcacattggct

SEQ ID NO: 9070960 - DNA, 22 bp, Homo sapiens
gtgtcccaggagaggagacaat

SEQ ID NO: 9070961 - DNA, 22 bp, Homo sapiens
gtgtcctgagtgaggcctggcc

SEQ ID NO: 9070962 - DNA, 22 bp, Homo sapiens
gtgtccttataagaagagatgc

SEQ ID NO: 9070963 - DNA, 22 bp, Homo sapiens
gtgtccttgcagtttgaagaaa

SEQ ID NO: 9070964 - DNA, 18 bp, Homo sapiens
gtgtcctttgcaagaaac

SEQ ID NO: 9070965 - DNA, 22 bp, Homo sapiens
gtgtccttttatgtgactggtt

SEQ ID NO: 9070966 - DNA, 22 bp, Homo sapiens
gtgtcctttccgggcctggagg

SEQ ID NO: 9070967 - DNA, 22 bp, Homo sapiens
gtgtctctaggacctggtacta

SEQ ID NO: 9070968 - DNA, 22 bp, Homo sapiens
gtgtctctatctatgcctgaag

SEQ ID NO: 9070969 - DNA, 22 bp, Homo sapiens
gtgtgagcatcaaagcctgtca

SEQ ID NO: 9070970 - DNA, 22 bp, Homo sapiens
gtgtctctatctatgcctgaag

SEQ ID NO: 9070971 - DNA, 22 bp, Homo sapiens
gtgtctcttttcagactcttca

SEQ ID NO: 9070972 - DNA, 22 bp, Homo sapiens
gtgtctgagtttggaaagtcca

SEQ ID NO: 9070973 - DNA, 22 bp, Homo sapiens
gttctccttgtggctgcagcag

SEQ ID NO: 9070974 - DNA, 22 bp, Homo sapiens
gttctcctggctcccaccctgc

SEQ ID NO: 9070975 - DNA, 22 bp, Homo sapiens
gttctctatcattagtgaattt

SEQ ID NO: 9070976 - DNA, 22 bp, Homo sapiens
gttctgagtcctcctttgaagg

SEQ ID NO: 9070977 - DNA, 22 bp, Homo sapiens
gttctgaggcaaaggcagcagc

SEQ ID NO: 9070978 - DNA, 20 bp, Homo sapiens
gttctcactgatctgcaggg

SEQ ID NO: 9070979 - DNA, 22 bp, Homo sapiens
gttctccctgtcccctgagctt

SEQ ID NO: 9070980 - DNA, 22 bp, Homo sapiens
gttctccctgtcccctgagctt

SEQ ID NO: 9070981 - DNA, 22 bp, Homo sapiens
gttctcagttcaggaaggacat

SEQ ID NO: 9070982 - DNA, 22 bp, Homo sapiens
gttctcagtggggagcagggtt

SEQ ID NO: 9070983 - DNA, 22 bp, Homo sapiens
gttctcagtggggagcagggtt

SEQ ID NO: 9070984 - DNA, 22 bp, Homo sapiens
gttctcatagtggaaaataggt

SEQ ID NO: 9070985 - DNA, 22 bp, Homo sapiens
gttctcatagtggaaaataggt

SEQ ID NO: 9070986 - DNA, 22 bp, Homo sapiens
gttgtgaatagtgccgcaataa

SEQ ID NO: 9070987 - DNA, 22 bp, Homo sapiens
gttgtgaatagtgccgcaataa

SEQ ID NO: 9070988 - DNA, 22 bp, Homo sapiens
gttgttttataggctcatgcct

SEQ ID NO: 9070989 - DNA, 22 bp, Homo sapiens
gttctgagtcctcctttgaagg

SEQ ID NO: 9070990 - DNA, 22 bp, Homo sapiens
gttctgagtcctcctttgaagg

SEQ ID NO: 9070991 - DNA, 22 bp, Homo sapiens
gttctgagtcctcctttgaagg

SEQ ID NO: 9070992 - DNA, 21 bp, Homo sapiens
gttctgagttagagttggcca

SEQ ID NO: 9070993 - DNA, 22 bp, Homo sapiens
gttctgagtggcccaagccctg

SEQ ID NO: 9070994 - DNA, 22 bp, Homo sapiens
gttgtcaggtaaaacagtatgg

SEQ ID NO: 9070995 - DNA, 22 bp, Homo sapiens
gttattttatctctgagaggtt

SEQ ID NO: 9070996 - DNA, 21 bp, Homo sapiens
gttattttaagtgagctttgc

SEQ ID NO: 9070997 - DNA, 19 bp, Homo sapiens
gttcaaacactgattcagc

SEQ ID NO: 9070998 - DNA, 22 bp, Homo sapiens
gttcaaaattcaaatggtatac

SEQ ID NO: 9070999 - DNA, 22 bp, Homo sapiens
gttattttcattggctcagact

SEQ ID NO: 9071000 - DNA, 22 bp, Homo sapiens
gttattttaacttctcagtaat

SEQ ID NO: 9071001 - DNA, 22 bp, Homo sapiens
gttattttaacttctcagtaat

SEQ ID NO: 9071002 - DNA, 22 bp, Homo sapiens
gtgtgtcctcagtagtggcatg

SEQ ID NO: 9071003 - DNA, 22 bp, Homo sapiens
gtgtgtccaggcgggagtcaag

SEQ ID NO: 9071004 - DNA, 22 bp, Homo sapiens
gttctatgttgagatagctaat

SEQ ID NO: 9071005 - DNA, 22 bp, Homo sapiens
gttctaggctaggggagtaaga

SEQ ID NO: 9071006 - DNA, 22 bp, Homo sapiens
gttctagatgactgagcagctg

SEQ ID NO: 9071007 - DNA, 22 bp, Homo sapiens
gttctacagttcctattactta

SEQ ID NO: 9071008 - DNA, 22 bp, Homo sapiens
gttctacagttcctattactta

SEQ ID NO: 9071009 - DNA, 22 bp, Homo sapiens
gttctaatattttaaaagccaa

SEQ ID NO: 9071010 - DNA, 21 bp, Homo sapiens
gttctacagttttagaattcc

SEQ ID NO: 9071011 - DNA, 22 bp, Homo sapiens
gttctacatgacactcaacatt

SEQ ID NO: 9071012 - DNA, 22 bp, Homo sapiens
gttcaagtctggggctgccagt

SEQ ID NO: 9071013 - DNA, 22 bp, Homo sapiens
gttctaataggagaaaagacag

SEQ ID NO: 9071014 - DNA, 21 bp, Homo sapiens
gttcaagtatttttttcgctg

SEQ ID NO: 9071015 - DNA, 22 bp, Homo sapiens
gttcaaggaagggaggaaagcc

SEQ ID NO: 9071016 - DNA, 21 bp, Homo sapiens
gttcaaatcctgacactacac

SEQ ID NO: 9071017 - DNA, 21 bp, Homo sapiens
gttcaaatcctgacactacac

SEQ ID NO: 9071018 - DNA, 22 bp, Homo sapiens
gttcaaatggctgcagttacca

SEQ ID NO: 9071019 - DNA, 22 bp, Homo sapiens
gttcaaatctcaggacttcaga

SEQ ID NO: 9071020 - DNA, 22 bp, Homo sapiens
gttcaaatggctgcagttacca

SEQ ID NO: 9071021 - DNA, 22 bp, Homo sapiens
gttcaaattctatgaaatatgt

SEQ ID NO: 9071022 - DNA, 21 bp, Homo sapiens
gttcaaatgggtagattcaca

SEQ ID NO: 9071023 - DNA, 21 bp, Homo sapiens
gttcaaatgggtagattcaca

SEQ ID NO: 9071024 - DNA, 22 bp, Homo sapiens
gttcaagaccagcctggccaac

SEQ ID NO: 9071025 - DNA, 22 bp, Homo sapiens
gttcaagaccagcctggccaac

SEQ ID NO: 9071026 - DNA, 22 bp, Homo sapiens
gttcaagaccagcctggccaac

SEQ ID NO: 9071027 - DNA, 22 bp, Homo sapiens
gttcaaattgattttggtaaag

SEQ ID NO: 9071028 - DNA, 22 bp, Homo sapiens
gttcaaattgagatggtataaa

SEQ ID NO: 9071029 - DNA, 22 bp, Homo sapiens
gttcaaattgagatggtataaa

SEQ ID NO: 9071030 - DNA, 22 bp, Homo sapiens
gttcaaattttctaggtgggtg

SEQ ID NO: 9071031 - DNA, 22 bp, Homo sapiens
gttcaaattttggctgtactgc

SEQ ID NO: 9071032 - DNA, 22 bp, Homo sapiens
gttcaagaccagcctggccaac

SEQ ID NO: 9071033 - DNA, 22 bp, Homo sapiens
gttcaaattttggctgtactgc

SEQ ID NO: 9071034 - DNA, 20 bp, Homo sapiens
gtgcctggagaagaggctgt

SEQ ID NO: 9071035 - DNA, 20 bp, Homo sapiens
gtgcctggagaagaggctgt

SEQ ID NO: 9071036 - DNA, 22 bp, Homo sapiens
gtgcctggcacacagaaggcaa

SEQ ID NO: 9071037 - DNA, 22 bp, Homo sapiens
gtgcctggagctaatgtgtata

SEQ ID NO: 9071038 - DNA, 20 bp, Homo sapiens
gtgcctggagaagaggctgt

SEQ ID NO: 9071039 - DNA, 22 bp, Homo sapiens
gtgcctggcagggtcagctgct

SEQ ID NO: 9071040 - DNA, 22 bp, Homo sapiens
gtgcctgtttcttttgaattca

SEQ ID NO: 9071041 - DNA, 22 bp, Homo sapiens
gtgcctggcatgcgccggtgct

SEQ ID NO: 9071042 - DNA, 23 bp, Homo sapiens
gtgcgccaggacaacctgacgga

SEQ ID NO: 9071043 - DNA, 23 bp, Homo sapiens
gtgcgccaggacaacctgacgga

SEQ ID NO: 9071044 - DNA, 22 bp, Homo sapiens
gtgcctttgagaagtttctctg

SEQ ID NO: 9071045 - DNA, 22 bp, Homo sapiens
gtgcctttgagaagtttctctg

SEQ ID NO: 9071046 - DNA, 22 bp, Homo sapiens
gtgcctttgtgtctaaaacagc

SEQ ID NO: 9071047 - DNA, 22 bp, Homo sapiens
gtgccttttcttcatagttact

SEQ ID NO: 9071048 - DNA, 22 bp, Homo sapiens
gtggaaggtgctagaacaagga

SEQ ID NO: 9071049 - DNA, 22 bp, Homo sapiens
gtggaaggtgctagaacaagga

SEQ ID NO: 9071050 - DNA, 22 bp, Homo sapiens
gtggaagggactgcctagagga

SEQ ID NO: 9071051 - DNA, 22 bp, Homo sapiens
gtggaagggtcacagcccctac

SEQ ID NO: 9071052 - DNA, 22 bp, Homo sapiens
gtggaaggtaatgcagcttact

SEQ ID NO: 9071053 - DNA, 22 bp, Homo sapiens
gtggaaggtgaaggagcagcga

SEQ ID NO: 9071054 - DNA, 22 bp, Homo sapiens
gtggaaggaattaacagactag

SEQ ID NO: 9071055 - DNA, 22 bp, Homo sapiens
gtggaaggaattaacagactag

SEQ ID NO: 9071056 - DNA, 22 bp, Homo sapiens
gtggaagggactgcctagagga

SEQ ID NO: 9071057 - DNA, 22 bp, Homo sapiens
gtggaagggactgcctagagga

SEQ ID NO: 9071058 - DNA, 22 bp, Homo sapiens
gtggaaggaattaacagactag

SEQ ID NO: 9071059 - DNA, 22 bp, Homo sapiens
gtggaaggaagagatggcccca

SEQ ID NO: 9071060 - DNA, 22 bp, Homo sapiens
gtggaaggaagagatggcccca

SEQ ID NO: 9071061 - DNA, 22 bp, Homo sapiens
gtggaaaactgagaaaattgct

SEQ ID NO: 9071062 - DNA, 22 bp, Homo sapiens
gtgctttttataaggcagactg

SEQ ID NO: 9071063 - DNA, 22 bp, Homo sapiens
gtgctacagactgagtacactt

SEQ ID NO: 9071064 - DNA, 22 bp, Homo sapiens
gtggaagaggcaagatagctct

SEQ ID NO: 9071065 - DNA, 22 bp, Homo sapiens
gtggaacagaactgtttattga

SEQ ID NO: 9071066 - DNA, 22 bp, Homo sapiens
gtggaagaggcaagatagctct

SEQ ID NO: 9071067 - DNA, 22 bp, Homo sapiens
gtgaaggccgtccttggggact

SEQ ID NO: 9071068 - DNA, 22 bp, Homo sapiens
gtgaaggccgtccttggggact

SEQ ID NO: 9071069 - DNA, 22 bp, Homo sapiens
gtgaaggccagtagggtcctgg

SEQ ID NO: 9071070 - DNA, 22 bp, Homo sapiens
gtgaaggccagtagggtcctgg

SEQ ID NO: 9071071 - DNA, 22 bp, Homo sapiens
gtgaaggcagccatcgacagtt

SEQ ID NO: 9071072 - DNA, 22 bp, Homo sapiens
gtgaaggcagccatcgacagtt

SEQ ID NO: 9071073 - DNA, 22 bp, Homo sapiens
gtgaaggattggagggcatctt

SEQ ID NO: 9071074 - DNA, 22 bp, Homo sapiens
gtgaaggcaatgataagagtga

SEQ ID NO: 9071075 - DNA, 22 bp, Homo sapiens
gtgaaggcaatgataagagtga

SEQ ID NO: 9071076 - DNA, 22 bp, Homo sapiens
gtgaaggcaatgataagagtga

SEQ ID NO: 9071077 - DNA, 22 bp, Homo sapiens
gtgaaggctgtgtgaaagttct

SEQ ID NO: 9071078 - DNA, 22 bp, Homo sapiens
gtgaaggcttgacgtcatcagg

SEQ ID NO: 9071079 - DNA, 22 bp, Homo sapiens
gtgaaggcttgacgtcatcagg

SEQ ID NO: 9071080 - DNA, 22 bp, Homo sapiens
gtgaaggctacaagagatcaag

SEQ ID NO: 9071081 - DNA, 22 bp, Homo sapiens
gtgaaggctgtgtgaaagttct

SEQ ID NO: 9071082 - DNA, 22 bp, Homo sapiens
gtgaaggctacaagagatcaag

SEQ ID NO: 9071083 - DNA, 22 bp, Homo sapiens
gtgaaggctacaagagatcaag

SEQ ID NO: 9071084 - DNA, 20 bp, Homo sapiens
gtgaaggctaagcacagagg

SEQ ID NO: 9071085 - DNA, 20 bp, Homo sapiens
gtgaaggctaagcacagagg

SEQ ID NO: 9071086 - DNA, 22 bp, Homo sapiens
gtgaaggctaattaaacaagtt

SEQ ID NO: 9071087 - DNA, 22 bp, Homo sapiens
gtgacaatattagctcaggggc

SEQ ID NO: 9071088 - DNA, 22 bp, Homo sapiens
gtgacagaaacagggctagaat

SEQ ID NO: 9071089 - DNA, 22 bp, Homo sapiens
gtgacagagttttagatctcat

SEQ ID NO: 9071090 - DNA, 22 bp, Homo sapiens
gtgacagagtgagaccttgtct

SEQ ID NO: 9071091 - DNA, 22 bp, Homo sapiens
gtgacaggccactgcggctctg

SEQ ID NO: 9071092 - DNA, 22 bp, Homo sapiens
gtgacagtcaaagacatgactt

SEQ ID NO: 9071093 - DNA, 22 bp, Homo sapiens
gtgacattcaggatatcaatgg

SEQ ID NO: 9071094 - DNA, 22 bp, Homo sapiens
gtgaccagtgatgctgaggagt

SEQ ID NO: 9071095 - DNA, 22 bp, Homo sapiens
gtgcctggaactgggtaggctg

SEQ ID NO: 9071096 - DNA, 22 bp, Homo sapiens
gtgcctggaactgggtaggctg

SEQ ID NO: 9071097 - DNA, 22 bp, Homo sapiens
gtgcctggaactgggtaggctg

SEQ ID NO: 9071098 - DNA, 22 bp, Homo sapiens
gtgcctgcagcaatccatggca

SEQ ID NO: 9071099 - DNA, 22 bp, Homo sapiens
gtgcctgctgcagagtcgctgt

SEQ ID NO: 9071100 - DNA, 22 bp, Homo sapiens
gtgcctgctacctgacttgttt

SEQ ID NO: 9071101 - DNA, 22 bp, Homo sapiens
gtggaggacaaaagaagccttt

SEQ ID NO: 9071102 - DNA, 22 bp, Homo sapiens
gtggaggagaggcgccttgcgg

SEQ ID NO: 9071103 - DNA, 20 bp, Homo sapiens
gtggatgatcagtgtagtgg

SEQ ID NO: 9071104 - DNA, 20 bp, Homo sapiens
gtggatgatcagtgtagtgg

SEQ ID NO: 9071105 - DNA, 22 bp, Homo sapiens
gtggatgatgagtgactacaga

SEQ ID NO: 9071106 - DNA, 22 bp, Homo sapiens
gtggatgattgactctgtagac

SEQ ID NO: 9071107 - DNA, 22 bp, Homo sapiens
gtggagtggtgatggataggtt

SEQ ID NO: 9071108 - DNA, 22 bp, Homo sapiens
gtggatgagataactgtagaag

SEQ ID NO: 9071109 - DNA, 22 bp, Homo sapiens
gtggagaggaacccagctctgt

SEQ ID NO: 9071110 - DNA, 22 bp, Homo sapiens
gtggagccctggtagggacccc

SEQ ID NO: 9071111 - DNA, 22 bp, Homo sapiens
gtggagagagataagcctggtc

SEQ ID NO: 9071112 - DNA, 22 bp, Homo sapiens
gtggacagagctagaaaatgtg

SEQ ID NO: 9071113 - DNA, 22 bp, Homo sapiens
gtggaatttttacctatgaatg

SEQ ID NO: 9071114 - DNA, 22 bp, Homo sapiens
gtggcagagggtgagctggact

SEQ ID NO: 9071115 - DNA, 22 bp, Homo sapiens
gtggcagagtgcggttctgacc

SEQ ID NO: 9071116 - DNA, 22 bp, Homo sapiens
gtggcagaggttcctcagtgtg

SEQ ID NO: 9071117 - DNA, 22 bp, Homo sapiens
gtggcagagttgctgactagaa

SEQ ID NO: 9071118 - DNA, 22 bp, Homo sapiens
gtggcagcaaatgcctggacta

SEQ ID NO: 9071119 - DNA, 22 bp, Homo sapiens
gtggattacaagacagttgaga

SEQ ID NO: 9071120 - DNA, 22 bp, Homo sapiens
gtggcacacaggagagagctca

SEQ ID NO: 9071121 - DNA, 22 bp, Homo sapiens
gtggcaagtgttccaagaggcg

SEQ ID NO: 9071122 - DNA, 22 bp, Homo sapiens
gtggcagagccaggctttgaac

SEQ ID NO: 9071123 - DNA, 22 bp, Homo sapiens
gtggcccaggcttggcgctggc

SEQ ID NO: 9071124 - DNA, 22 bp, Homo sapiens
gtggccccagggccctgtctgg

SEQ ID NO: 9071125 - DNA, 22 bp, Homo sapiens
gtggcccaggcttggcgctggc

SEQ ID NO: 9071126 - DNA, 22 bp, Homo sapiens
gtggcccaggcaccctgatgac

SEQ ID NO: 9071127 - DNA, 22 bp, Homo sapiens
gtggccctctgatagggtcagg

SEQ ID NO: 9071128 - DNA, 22 bp, Homo sapiens
gtggccctcagcagttgccaag

SEQ ID NO: 9071129 - DNA, 22 bp, Homo sapiens
gtggccctctgatagggtcagg

SEQ ID NO: 9071130 - DNA, 21 bp, Homo sapiens
gtggccctgccgcagtgtcca

SEQ ID NO: 9071131 - DNA, 22 bp, Homo sapiens
gtggccaggacattgccaggca

SEQ ID NO: 9071132 - DNA, 22 bp, Homo sapiens
gtggccagctgtcagcaccctt

SEQ ID NO: 9071133 - DNA, 22 bp, Homo sapiens
gtggccaggacattgccaggca

SEQ ID NO: 9071134 - DNA, 22 bp, Homo sapiens
gtggccaggacattgccaggca

SEQ ID NO: 9071135 - DNA, 22 bp, Homo sapiens
gtggccaggagagggtgggaca

SEQ ID NO: 9071136 - DNA, 22 bp, Homo sapiens
gtggccaggagaccttgggcat

SEQ ID NO: 9071137 - DNA, 22 bp, Homo sapiens
gtggccaggagaccttgggcat

SEQ ID NO: 9071138 - DNA, 18 bp, Homo sapiens
gtggccagcctggtcttg

SEQ ID NO: 9071139 - DNA, 22 bp, Homo sapiens
gtggccagccccatggacagtt

SEQ ID NO: 9071140 - DNA, 22 bp, Homo sapiens
gtggccagccagggtgctgatg

SEQ ID NO: 9071141 - DNA, 22 bp, Homo sapiens
gtggccagccagggtgctgatg

SEQ ID NO: 9071142 - DNA, 22 bp, Homo sapiens
gtggccagccagggtgctgatg

SEQ ID NO: 9071143 - DNA, 22 bp, Homo sapiens
gtggccagcaagtgctgcctct

SEQ ID NO: 9071144 - DNA, 22 bp, Homo sapiens
gtggccagaggtcccatgtgtc

SEQ ID NO: 9071145 - DNA, 22 bp, Homo sapiens
gtggccagaggtcccatgtgtc

SEQ ID NO: 9071146 - DNA, 22 bp, Homo sapiens
gtggccagcaagtgctgcctct

SEQ ID NO: 9071147 - DNA, 22 bp, Homo sapiens
gtggccagcaagtgctgcctct

SEQ ID NO: 9071148 - DNA, 22 bp, Homo sapiens
gtggccagccagggtgctgatg

SEQ ID NO: 9071149 - DNA, 22 bp, Homo sapiens
gtggccagaagactgcaatgct

SEQ ID NO: 9071150 - DNA, 22 bp, Homo sapiens
gtggccagaatcttgaggcctt

SEQ ID NO: 9071151 - DNA, 22 bp, Homo sapiens
gtggccagaatcttgaggcctt

SEQ ID NO: 9071152 - DNA, 22 bp, Homo sapiens
gtggccagaggtcccatgtgtc

SEQ ID NO: 9071153 - DNA, 22 bp, Homo sapiens
gtggcaggatcacggctcactg

SEQ ID NO: 9071154 - DNA, 20 bp, Homo sapiens
gtggcaggcagtgaaggagc

SEQ ID NO: 9071155 - DNA, 22 bp, Homo sapiens
gtggcagggcaatgctccctct

SEQ ID NO: 9071156 - DNA, 22 bp, Homo sapiens
gtggcagggcaatgctccctct

SEQ ID NO: 9071157 - DNA, 22 bp, Homo sapiens
gtggcaggagagacacagccat

SEQ ID NO: 9071158 - DNA, 22 bp, Homo sapiens
gtggcagctggtatgcagacag

SEQ ID NO: 9071159 - DNA, 22 bp, Homo sapiens
gtggcagctgtgggacactggt

SEQ ID NO: 9071160 - DNA, 22 bp, Homo sapiens
gtggcagctggtatgcagacag

SEQ ID NO: 9071161 - DNA, 22 bp, Homo sapiens
gtggcaggggtattccagctga

SEQ ID NO: 9071162 - DNA, 22 bp, Homo sapiens
gtggcaggggtattccagctga

SEQ ID NO: 9071163 - DNA, 22 bp, Homo sapiens
gtggcaggggtattccagctga

SEQ ID NO: 9071164 - DNA, 22 bp, Homo sapiens
gtggcagttctgtgtctcttgt

SEQ ID NO: 9071165 - DNA, 22 bp, Homo sapiens
gtggcagtgggatgctatcagg

SEQ ID NO: 9071166 - DNA, 22 bp, Homo sapiens
gtgggagaagatttggtcatct

SEQ ID NO: 9071167 - DNA, 22 bp, Homo sapiens
gtggcttcatcaactgtgctta

SEQ ID NO: 9071168 - DNA, 22 bp, Homo sapiens
gtggcttccatgtgcatctgac

SEQ ID NO: 9071169 - DNA, 22 bp, Homo sapiens
gtgggagccctcagggaggtgc

SEQ ID NO: 9071170 - DNA, 22 bp, Homo sapiens
gtgggagcatggtcccagtgcc

SEQ ID NO: 9071171 - DNA, 22 bp, Homo sapiens
gtgggagaagatttggtcatct

SEQ ID NO: 9071172 - DNA, 22 bp, Homo sapiens
gtgggagaagccctgttcgtag

SEQ ID NO: 9071173 - DNA, 22 bp, Homo sapiens
gtgggagaagccctgttcgtag

SEQ ID NO: 9071174 - DNA, 22 bp, Homo sapiens
gtgggatgcagtggtgagtggc

SEQ ID NO: 9071175 - DNA, 22 bp, Homo sapiens
gtgggatgcttaggatcttgcc

SEQ ID NO: 9071176 - DNA, 22 bp, Homo sapiens
gtgggatgcagtggtgagtggc

SEQ ID NO: 9071177 - DNA, 22 bp, Homo sapiens
gtgggagcttcatcaagcagtt

SEQ ID NO: 9071178 - DNA, 22 bp, Homo sapiens
gtgggagctgcggaggcctggg

SEQ ID NO: 9071179 - DNA, 22 bp, Homo sapiens
gtggctgctacagagctggagg

SEQ ID NO: 9071180 - DNA, 22 bp, Homo sapiens
gtggctgcagagggcacagcat

SEQ ID NO: 9071181 - DNA, 22 bp, Homo sapiens
gtggctgcatcggggtgaccag

SEQ ID NO: 9071182 - DNA, 22 bp, Homo sapiens
gtggctgcagctctgaacggac

SEQ ID NO: 9071183 - DNA, 22 bp, Homo sapiens
gtggctgcagcccagcggcacg

SEQ ID NO: 9071184 - DNA, 22 bp, Homo sapiens
gtggctgcagcggctgtggaga

SEQ ID NO: 9071185 - DNA, 22 bp, Homo sapiens
gtggctgggctccgagcggctt

SEQ ID NO: 9071186 - DNA, 22 bp, Homo sapiens
gtggctgggctccgagcggctt

SEQ ID NO: 9071187 - DNA, 22 bp, Homo sapiens
gtggcttcaccccagttgtctc

SEQ ID NO: 9071188 - DNA, 22 bp, Homo sapiens
gtggcttcacatggcatttggc

SEQ ID NO: 9071189 - DNA, 22 bp, Homo sapiens
gtggctggtttcctgcatgcaa

SEQ ID NO: 9071190 - DNA, 22 bp, Homo sapiens
gtggcctctgtgctcctgccta

SEQ ID NO: 9071191 - DNA, 22 bp, Homo sapiens
gtggcctctgttggctcctagg

SEQ ID NO: 9071192 - DNA, 20 bp, Homo sapiens
gtggcctctcacattctgag

SEQ ID NO: 9071193 - DNA, 20 bp, Homo sapiens
gtggcctctcacattctgag

SEQ ID NO: 9071194 - DNA, 22 bp, Homo sapiens
gtggcctctgtgctcctgccta

SEQ ID NO: 9071195 - DNA, 22 bp, Homo sapiens
gtggcctcctccgtccgcctct

SEQ ID NO: 9071196 - DNA, 23 bp, Homo sapiens
gtggcctccccggaatgcctcgc

SEQ ID NO: 9071197 - DNA, 22 bp, Homo sapiens
gtggccctgtcccaggcctcct

SEQ ID NO: 9071198 - DNA, 21 bp, Homo sapiens
gtggccctggtgtggctgcac

SEQ ID NO: 9071199 - DNA, 22 bp, Homo sapiens
gtggcctggaaaggctggtctg

SEQ ID NO: 9071200 - DNA, 22 bp, Homo sapiens
gtggcctgccgtgtggtatggg

SEQ ID NO: 9071201 - DNA, 21 bp, Homo sapiens
gtggcctgattatgaatgggt

SEQ ID NO: 9071202 - DNA, 22 bp, Homo sapiens
gtggcctctgttggctcctagg

SEQ ID NO: 9071203 - DNA, 22 bp, Homo sapiens
gtggcctctgttggctcctagg

SEQ ID NO: 9071204 - DNA, 22 bp, Homo sapiens
gtggcctggggtttgttctgag

SEQ ID NO: 9071205 - DNA, 22 bp, Homo sapiens
gtggcctggcgagctggcgcgg

SEQ ID NO: 9071206 - DNA, 22 bp, Homo sapiens
gtggcctggatgagcttcgaca

SEQ ID NO: 9071207 - DNA, 22 bp, Homo sapiens
gtggcctggcgagctggcgcgg

SEQ ID NO: 9071208 - DNA, 22 bp, Homo sapiens
gtggctcagcggagctctgcac

SEQ ID NO: 9071209 - DNA, 22 bp, Homo sapiens
gtggctctccattgacatggaa

SEQ ID NO: 9071210 - DNA, 22 bp, Homo sapiens
gtggctctcgccagcctgcggg

SEQ ID NO: 9071211 - DNA, 21 bp, Homo sapiens
gtggctctgccaggactgaaa

SEQ ID NO: 9071212 - DNA, 21 bp, Homo sapiens
gtggctctgccaggactgaaa

SEQ ID NO: 9071213 - DNA, 22 bp, Homo sapiens
gtggctctgtaaaatgcctgca

SEQ ID NO: 9071214 - DNA, 22 bp, Homo sapiens
gtggctgcagagccagcaagct

SEQ ID NO: 9071215 - DNA, 17 bp, Homo sapiens
gtggctgcacacacatg

SEQ ID NO: 9071216 - DNA, 22 bp, Homo sapiens
gtggctgacaaccactggagga

SEQ ID NO: 9071217 - DNA, 22 bp, Homo sapiens
gtctgagggacagagtcctggc

SEQ ID NO: 9071218 - DNA, 22 bp, Homo sapiens
gtctgaggcgaggcctgagaac

SEQ ID NO: 9071219 - DNA, 22 bp, Homo sapiens
gtctgaggggtttcccaggaca

SEQ ID NO: 9071220 - DNA, 22 bp, Homo sapiens
gtctgaggggtttcccaggaca

SEQ ID NO: 9071221 - DNA, 22 bp, Homo sapiens
gtctgagggagaaggatctggg

SEQ ID NO: 9071222 - DNA, 22 bp, Homo sapiens
gtctgagcaccctggcctgtca

SEQ ID NO: 9071223 - DNA, 20 bp, Homo sapiens
gtctgaggagcagtgggaaa

SEQ ID NO: 9071224 - DNA, 20 bp, Homo sapiens
gtctgaggagcagtgggaaa

SEQ ID NO: 9071225 - DNA, 22 bp, Homo sapiens
gtctctgagctctgagctggct

SEQ ID NO: 9071226 - DNA, 22 bp, Homo sapiens
gtctcttttatggtgagttgat

SEQ ID NO: 9071227 - DNA, 19 bp, Homo sapiens
gtctctggatttcaggtcc

SEQ ID NO: 9071228 - DNA, 19 bp, Homo sapiens
gtctctggatttcaggtcc

SEQ ID NO: 9071229 - DNA, 22 bp, Homo sapiens
gtctgaagccagtggtagtccg

SEQ ID NO: 9071230 - DNA, 22 bp, Homo sapiens
gtctgagactgggcacatacct

SEQ ID NO: 9071231 - DNA, 22 bp, Homo sapiens
gtcggccacgcaggtgcggtag

SEQ ID NO: 9071232 - DNA, 22 bp, Homo sapiens
gtcctttttgtaaaatattcat

SEQ ID NO: 9071233 - DNA, 22 bp, Homo sapiens
gtccttgcttgagacaggcagt

SEQ ID NO: 9071234 - DNA, 22 bp, Homo sapiens
gtccttgctttggagcaggcta

SEQ ID NO: 9071235 - DNA, 22 bp, Homo sapiens
gtccttcagctttatctgaaca

SEQ ID NO: 9071236 - DNA, 22 bp, Homo sapiens
gtccttcatttcctgatctcta

SEQ ID NO: 9071237 - DNA, 22 bp, Homo sapiens
gtccttcaagtaacctgggacc

SEQ ID NO: 9071238 - DNA, 22 bp, Homo sapiens
gtccttcaaggtccttggtgtg

SEQ ID NO: 9071239 - DNA, 22 bp, Homo sapiens
gtccttcagcacctccctcggc

SEQ ID NO: 9071240 - DNA, 21 bp, Homo sapiens
gtccttcagcaagttagtggc

SEQ ID NO: 9071241 - DNA, 22 bp, Homo sapiens
gtccttgcttgagacaggcagt

SEQ ID NO: 9071242 - DNA, 22 bp, Homo sapiens
gtccttgaggaaacagatgtga

SEQ ID NO: 9071243 - DNA, 22 bp, Homo sapiens
gtccttcctgcagggatggatg

SEQ ID NO: 9071244 - DNA, 17 bp, Homo sapiens
gtctgggctttagagac

SEQ ID NO: 9071245 - DNA, 22 bp, Homo sapiens
gtctgggctcctggcaggcagc

SEQ ID NO: 9071246 - DNA, 22 bp, Homo sapiens
gtctgggctcccagggtcggcg

SEQ ID NO: 9071247 - DNA, 22 bp, Homo sapiens
gtctgggctcccagggtcggcg

SEQ ID NO: 9071248 - DNA, 22 bp, Homo sapiens
gtctgggcttagggacatggca

SEQ ID NO: 9071249 - DNA, 22 bp, Homo sapiens
gtctgggcttcagagttagaga

SEQ ID NO: 9071250 - DNA, 22 bp, Homo sapiens
gtctgggctcctggcaggcagc

SEQ ID NO: 9071251 - DNA, 22 bp, Homo sapiens
gtctgggcacctggcctgggaa

SEQ ID NO: 9071252 - DNA, 22 bp, Homo sapiens
gtctgggcacctggcctgggaa

SEQ ID NO: 9071253 - DNA, 22 bp, Homo sapiens
gtctgggcaagggagatggcgc

SEQ ID NO: 9071254 - DNA, 22 bp, Homo sapiens
gtctgggccaggcgagccgagg

SEQ ID NO: 9071255 - DNA, 22 bp, Homo sapiens
gtctgggcatcagactgcgggc

SEQ ID NO: 9071256 - DNA, 22 bp, Homo sapiens
gtctgggcagcagcatttctta

SEQ ID NO: 9071257 - DNA, 22 bp, Homo sapiens
gtctgggcaggaatctgcattc

SEQ ID NO: 9071258 - DNA, 22 bp, Homo sapiens
gtctggctttatatttgctatt

SEQ ID NO: 9071259 - DNA, 22 bp, Homo sapiens
gtctggctttatatttgctatt

SEQ ID NO: 9071260 - DNA, 22 bp, Homo sapiens
gtctggctttatatttgctatt

SEQ ID NO: 9071261 - DNA, 22 bp, Homo sapiens
gtctggctttgctcagatgctg

SEQ ID NO: 9071262 - DNA, 22 bp, Homo sapiens
gtctggctttgctcagatgctg

SEQ ID NO: 9071263 - DNA, 22 bp, Homo sapiens
gtctggcttttgccctgtgttt

SEQ ID NO: 9071264 - DNA, 22 bp, Homo sapiens
gtctggctagagacaccctccc

SEQ ID NO: 9071265 - DNA, 22 bp, Homo sapiens
gtctggcctgccagctctggtg

SEQ ID NO: 9071266 - DNA, 22 bp, Homo sapiens
gtctggcattcttcctggagaa

SEQ ID NO: 9071267 - DNA, 22 bp, Homo sapiens
gtctggcatatgcaaagtgcat

SEQ ID NO: 9071268 - DNA, 22 bp, Homo sapiens
gtctggccatttgcccattgtg

SEQ ID NO: 9071269 - DNA, 22 bp, Homo sapiens
gtctggccatttgcccattgtg

SEQ ID NO: 9071270 - DNA, 22 bp, Homo sapiens
gtctggccatttgcccattgtg

SEQ ID NO: 9071271 - DNA, 22 bp, Homo sapiens
gtctggctcccactcttacaaa

SEQ ID NO: 9071272 - DNA, 22 bp, Homo sapiens
gtctggctgtccagcttatcta

SEQ ID NO: 9071273 - DNA, 20 bp, Homo sapiens
gtctgcagtaagagggaata

SEQ ID NO: 9071274 - DNA, 18 bp, Homo sapiens
gtctgccaacaactatca

SEQ ID NO: 9071275 - DNA, 22 bp, Homo sapiens
gtctgcattgaccctactagtc

SEQ ID NO: 9071276 - DNA, 21 bp, Homo sapiens
gtctggatgcccttctcttgg

SEQ ID NO: 9071277 - DNA, 19 bp, Homo sapiens
gtctggatttttcggtaac

SEQ ID NO: 9071278 - DNA, 22 bp, Homo sapiens
gtctgccatgtggagaaagcca

SEQ ID NO: 9071279 - DNA, 22 bp, Homo sapiens
gtctgaggtcattagctctctt

SEQ ID NO: 9071280 - DNA, 22 bp, Homo sapiens
gtctgaggtcattagctctctt

SEQ ID NO: 9071281 - DNA, 22 bp, Homo sapiens
gtctgagggttgtgctggagga

SEQ ID NO: 9071282 - DNA, 22 bp, Homo sapiens
gtctgcagagggaaggcttcag

SEQ ID NO: 9071283 - DNA, 22 bp, Homo sapiens
gtcctgtgtcccagagaaagag

SEQ ID NO: 9071284 - DNA, 22 bp, Homo sapiens
gtcctggtagggctctgtgtct

SEQ ID NO: 9071285 - DNA, 22 bp, Homo sapiens
gtcctgggtccccgcaggtcag

SEQ ID NO: 9071286 - DNA, 22 bp, Homo sapiens
gtcctgggtccccgcaggtcag

SEQ ID NO: 9071287 - DNA, 22 bp, Homo sapiens
gtcctgtgtgagtgcaccacct

SEQ ID NO: 9071288 - DNA, 22 bp, Homo sapiens
gtcctgtgtgagtgcaccacct

SEQ ID NO: 9071289 - DNA, 22 bp, Homo sapiens
gtcctgttgtgagctgccttcc

SEQ ID NO: 9071290 - DNA, 22 bp, Homo sapiens
gtcccataagtagtgcaacttg

SEQ ID NO: 9071291 - DNA, 22 bp, Homo sapiens
gtcccagggatgcagacatgag

SEQ ID NO: 9071292 - DNA, 22 bp, Homo sapiens
gtcccagggaggttcagggctt

SEQ ID NO: 9071293 - DNA, 22 bp, Homo sapiens
gtcccagggaggttcagggctt

SEQ ID NO: 9071294 - DNA, 22 bp, Homo sapiens
gtcccagggatgcagacatgag

SEQ ID NO: 9071295 - DNA, 22 bp, Homo sapiens
gtccatacagtggcacacatct

SEQ ID NO: 9071296 - DNA, 22 bp, Homo sapiens
gtccatctgtcacttatagtcg

SEQ ID NO: 9071297 - DNA, 22 bp, Homo sapiens
gtccatctagaatttatttcta

SEQ ID NO: 9071298 - DNA, 22 bp, Homo sapiens
gtccatctccaccatctgggag

SEQ ID NO: 9071299 - DNA, 22 bp, Homo sapiens
gtccatgattctgtgtagtaga

SEQ ID NO: 9071300 - DNA, 22 bp, Homo sapiens
gtccatgactgtgactcacatg

SEQ ID NO: 9071301 - DNA, 22 bp, Homo sapiens
gtccatctttgatgaaaactta

SEQ ID NO: 9071302 - DNA, 18 bp, Homo sapiens
gtccatggcctccaccca

SEQ ID NO: 9071303 - DNA, 22 bp, Homo sapiens
gtccattttattcagagacttt

SEQ ID NO: 9071304 - DNA, 22 bp, Homo sapiens
gtcccagaaacatattgctggt

SEQ ID NO: 9071305 - DNA, 22 bp, Homo sapiens
gtcccagggaagaaggcagcac

SEQ ID NO: 9071306 - DNA, 22 bp, Homo sapiens
gtcccagggaagaaggcagcac

SEQ ID NO: 9071307 - DNA, 22 bp, Homo sapiens
gtcaggccctggcagccgtgac

SEQ ID NO: 9071308 - DNA, 22 bp, Homo sapiens
gtcaggccaatactctccagca

SEQ ID NO: 9071309 - DNA, 19 bp, Homo sapiens
gtcaggcacgtgagagcat

SEQ ID NO: 9071310 - DNA, 19 bp, Homo sapiens
gtcaggcacgtgagagcat

SEQ ID NO: 9071311 - DNA, 22 bp, Homo sapiens
gtcaggattataatccccatgg

SEQ ID NO: 9071312 - DNA, 22 bp, Homo sapiens
gtcaggacattttaccatcctg

SEQ ID NO: 9071313 - DNA, 22 bp, Homo sapiens
gtcaggacaggctctggactga

SEQ ID NO: 9071314 - DNA, 22 bp, Homo sapiens
gtcaggacaggctctggactga

SEQ ID NO: 9071315 - DNA, 22 bp, Homo sapiens
gtcaggactctgacccgtcccg

SEQ ID NO: 9071316 - DNA, 22 bp, Homo sapiens
gtcaggacaaggtggtctccag

SEQ ID NO: 9071317 - DNA, 22 bp, Homo sapiens
gtcaggacaaggtggtctccag

SEQ ID NO: 9071318 - DNA, 22 bp, Homo sapiens
gtcaggaagtggcattggagaa

SEQ ID NO: 9071319 - DNA, 22 bp, Homo sapiens
gtcaggaagcaaggttgggcat

SEQ ID NO: 9071320 - DNA, 22 bp, Homo sapiens
gtcaggaaaacccgggttgact

SEQ ID NO: 9071321 - DNA, 22 bp, Homo sapiens
gtcaggagaggccatcagcttt

SEQ ID NO: 9071322 - DNA, 22 bp, Homo sapiens
gtcaggagagacctgttctcct

SEQ ID NO: 9071323 - DNA, 20 bp, Homo sapiens
gtcaggattagtaaactctg

SEQ ID NO: 9071324 - DNA, 18 bp, Homo sapiens
gtcagaggatggggaaat

SEQ ID NO: 9071325 - DNA, 22 bp, Homo sapiens
gtcagctgtctccccagagtgg

SEQ ID NO: 9071326 - DNA, 22 bp, Homo sapiens
gtcagctgggcatctgcagatg

SEQ ID NO: 9071327 - DNA, 22 bp, Homo sapiens
gtcaggaaaaattgataatttt

SEQ ID NO: 9071328 - DNA, 22 bp, Homo sapiens
gtcaggaaaaattgataatttt

SEQ ID NO: 9071329 - DNA, 22 bp, Homo sapiens
gtcaggaaaaattgataatttt

SEQ ID NO: 9071330 - DNA, 22 bp, Homo sapiens
gtcagaggggacaagacacaga

SEQ ID NO: 9071331 - DNA, 22 bp, Homo sapiens
ggtgtccatcaggctgtgcttc

SEQ ID NO: 9071332 - DNA, 22 bp, Homo sapiens
ggtgtcccaggccagctgtgtg

SEQ ID NO: 9071333 - DNA, 22 bp, Homo sapiens
ggtgtccgcgctgtagaaggtc

SEQ ID NO: 9071334 - DNA, 22 bp, Homo sapiens
ggtggccattctaccgccttct

SEQ ID NO: 9071335 - DNA, 22 bp, Homo sapiens
ggtggtgggagagctttctgga

SEQ ID NO: 9071336 - DNA, 23 bp, Homo sapiens
ggtggtggtgagtcacgggctca

SEQ ID NO: 9071337 - DNA, 22 bp, Homo sapiens
ggtggtggtcccgacttgggag

SEQ ID NO: 9071338 - DNA, 22 bp, Homo sapiens
ggtggttcacgcctataatccc

SEQ ID NO: 9071339 - DNA, 23 bp, Homo sapiens
ggtggtggtgagtcacgggctca

SEQ ID NO: 9071340 - DNA, 22 bp, Homo sapiens
ggtgtagctctgtgtcccactg

SEQ ID NO: 9071341 - DNA, 22 bp, Homo sapiens
ggtggcaggctggcattggcaa

SEQ ID NO: 9071342 - DNA, 22 bp, Homo sapiens
ggtggcagttacaggggcaaat

SEQ ID NO: 9071343 - DNA, 22 bp, Homo sapiens
ggtggcagttacaggggcaaat

SEQ ID NO: 9071344 - DNA, 22 bp, Homo sapiens
ggtggcaggctggcattggcaa

SEQ ID NO: 9071345 - DNA, 22 bp, Homo sapiens
ggtggccataggaccagcctgg

SEQ ID NO: 9071346 - DNA, 22 bp, Homo sapiens
ggtggccataggaccagcctgg

SEQ ID NO: 9071347 - DNA, 22 bp, Homo sapiens
ggtggccaggccagctctggcc

SEQ ID NO: 9071348 - DNA, 23 bp, Homo sapiens
ggtggcaggagtggatgctgagc

SEQ ID NO: 9071349 - DNA, 22 bp, Homo sapiens
ggtggcaggccctgagcatccc

SEQ ID NO: 9071350 - DNA, 22 bp, Homo sapiens
ggtggcaggccctgagcatccc

SEQ ID NO: 9071351 - DNA, 22 bp, Homo sapiens
ggtggcaggccctgagcatccc

SEQ ID NO: 9071352 - DNA, 22 bp, Homo sapiens
ggtggcaggccctgagcatccc

SEQ ID NO: 9071353 - DNA, 22 bp, Homo sapiens
ggtggcaggctggcattggcaa

SEQ ID NO: 9071354 - DNA, 22 bp, Homo sapiens
ggtggcagcgtctatctgacat

SEQ ID NO: 9071355 - DNA, 22 bp, Homo sapiens
ggtggcagcgtctatctgacat

SEQ ID NO: 9071356 - DNA, 22 bp, Homo sapiens
ggtggcagcgtctatctgacat

SEQ ID NO: 9071357 - DNA, 22 bp, Homo sapiens
ggtggcagcatggtcccagtgt

SEQ ID NO: 9071358 - DNA, 23 bp, Homo sapiens
ggtggcaggagtggatgctgagc

SEQ ID NO: 9071359 - DNA, 23 bp, Homo sapiens
ggtggcaggagtggatgctgagc

SEQ ID NO: 9071360 - DNA, 22 bp, Homo sapiens
ggtgaggggagagtgaaagaaa

SEQ ID NO: 9071361 - DNA, 22 bp, Homo sapiens
ggtgaggggagagtgaaagaaa

SEQ ID NO: 9071362 - DNA, 22 bp, Homo sapiens
ggtgagggtaaatataggcaaa

SEQ ID NO: 9071363 - DNA, 22 bp, Homo sapiens
ggtgagggtaaatataggcaaa

SEQ ID NO: 9071364 - DNA, 22 bp, Homo sapiens
ggtgcaggcggtggggcaagta

SEQ ID NO: 9071365 - DNA, 22 bp, Homo sapiens
ggtgcaggcggtggggcaagta

SEQ ID NO: 9071366 - DNA, 22 bp, Homo sapiens
ggtgcaggcggtggggcaagta

SEQ ID NO: 9071367 - DNA, 22 bp, Homo sapiens
ggtgcaggagcggggtgctcgg

SEQ ID NO: 9071368 - DNA, 22 bp, Homo sapiens
ggtggcagaggtgcatcagccc

SEQ ID NO: 9071369 - DNA, 22 bp, Homo sapiens
ggtggcagaggtgcatcagccc

SEQ ID NO: 9071370 - DNA, 22 bp, Homo sapiens
ggtggcagaggtgcatcagccc

SEQ ID NO: 9071371 - DNA, 22 bp, Homo sapiens
ggtggcagagaggaggtagttt

SEQ ID NO: 9071372 - DNA, 22 bp, Homo sapiens
ggtgatgaaaagtgcctttatc

SEQ ID NO: 9071373 - DNA, 22 bp, Homo sapiens
ggtgattctgtgaggggctgac

SEQ ID NO: 9071374 - DNA, 17 bp, Homo sapiens
ggtgagtgtccaggtgg

SEQ ID NO: 9071375 - DNA, 22 bp, Homo sapiens
ggtgagggtaaatataggcaaa

SEQ ID NO: 9071376 - DNA, 22 bp, Homo sapiens
ggtgcaggacgaagtgggggtt

SEQ ID NO: 9071377 - DNA, 22 bp, Homo sapiens
gtacagaggttgctggaggctc

SEQ ID NO: 9071378 - DNA, 22 bp, Homo sapiens
gtaaatattccctcggttccta

SEQ ID NO: 9071379 - DNA, 22 bp, Homo sapiens
gtaaatattaaaggctgctaga

SEQ ID NO: 9071380 - DNA, 22 bp, Homo sapiens
gtaaatattaaaggctgctaga

SEQ ID NO: 9071381 - DNA, 22 bp, Homo sapiens
gtaaataactggtaattggggt

SEQ ID NO: 9071382 - DNA, 22 bp, Homo sapiens
gtaaataactggtaattggggt

SEQ ID NO: 9071383 - DNA, 22 bp, Homo sapiens
gtaaataactggtaattggggt

SEQ ID NO: 9071384 - DNA, 22 bp, Homo sapiens
gtaaatataaatgctagctgcc

SEQ ID NO: 9071385 - DNA, 22 bp, Homo sapiens
gtaaatataaatgctagctgcc

SEQ ID NO: 9071386 - DNA, 16 bp, Homo sapiens
gtaaaggcagggaatt

SEQ ID NO: 9071387 - DNA, 22 bp, Homo sapiens
gtaaaggcccattcaaacagct

SEQ ID NO: 9071388 - DNA, 22 bp, Homo sapiens
gtaaaggctctgataagtactg

SEQ ID NO: 9071389 - DNA, 22 bp, Homo sapiens
gtaaagaagtttttgaatgcat

SEQ ID NO: 9071390 - DNA, 22 bp, Homo sapiens
gtaaacatgctgtgtactcagc

SEQ ID NO: 9071391 - DNA, 23 bp, Homo sapiens
gtaaaatacgcagtgcagtgtga

SEQ ID NO: 9071392 - DNA, 22 bp, Homo sapiens
ggtgtcctgggcaggcagctga

SEQ ID NO: 9071393 - DNA, 22 bp, Homo sapiens
ggtgtcctcactatagcaagtc

SEQ ID NO: 9071394 - DNA, 22 bp, Homo sapiens
gtacatattaaaggtctataaa

SEQ ID NO: 9071395 - DNA, 22 bp, Homo sapiens
gtacataaaggaggctctttgc

SEQ ID NO: 9071396 - DNA, 22 bp, Homo sapiens
gtacataaaatactgccatgta

SEQ ID NO: 9071397 - DNA, 22 bp, Homo sapiens
gtacataagaaattactacaga

SEQ ID NO: 9071398 - DNA, 22 bp, Homo sapiens
gtacataagaaattactacaga

SEQ ID NO: 9071399 - DNA, 22 bp, Homo sapiens
gtacataattttcagccagttt

SEQ ID NO: 9071400 - DNA, 22 bp, Homo sapiens
gtacatatcctttacgttttgt

SEQ ID NO: 9071401 - DNA, 22 bp, Homo sapiens
gtacagtagtaaaagtgaatga

SEQ ID NO: 9071402 - DNA, 22 bp, Homo sapiens
gtacatttaggattcattgaaa

SEQ ID NO: 9071403 - DNA, 22 bp, Homo sapiens
gtatatctcttacatacacaca

SEQ ID NO: 9071404 - DNA, 22 bp, Homo sapiens
gtatatatgtgtgaacatgtat

SEQ ID NO: 9071405 - DNA, 22 bp, Homo sapiens
gtatatattggataaaccagag

SEQ ID NO: 9071406 - DNA, 22 bp, Homo sapiens
gtatggtttatagggaaattgt

SEQ ID NO: 9071407 - DNA, 22 bp, Homo sapiens
gtatatcttcagaaattatagg

SEQ ID NO: 9071408 - DNA, 22 bp, Homo sapiens
gtatatgagaaccatggaggtg

SEQ ID NO: 9071409 - DNA, 22 bp, Homo sapiens
gtatatatcggcactattttaa

SEQ ID NO: 9071410 - DNA, 22 bp, Homo sapiens
gtatagaaggatctggtgaatt

SEQ ID NO: 9071411 - DNA, 22 bp, Homo sapiens
ggcacagagctttgtcccagtt

SEQ ID NO: 9071412 - DNA, 22 bp, Homo sapiens
ggcacagagctccagccttggc

SEQ ID NO: 9071413 - DNA, 22 bp, Homo sapiens
ggcacagagctccagccttggc

SEQ ID NO: 9071414 - DNA, 22 bp, Homo sapiens
ggcacagagcccagcttcctag

SEQ ID NO: 9071415 - DNA, 22 bp, Homo sapiens
ggcacagagttggcagagctgc

SEQ ID NO: 9071416 - DNA, 22 bp, Homo sapiens
ggcacagagttggcagagctgc

SEQ ID NO: 9071417 - DNA, 22 bp, Homo sapiens
ggcacagagttggcagagctgc

SEQ ID NO: 9071418 - DNA, 22 bp, Homo sapiens
ggcacagagttggcagagctgc

SEQ ID NO: 9071419 - DNA, 22 bp, Homo sapiens
ggcacagcacagagcacatgta

SEQ ID NO: 9071420 - DNA, 22 bp, Homo sapiens
ggcacagcaagaagggaaatga

SEQ ID NO: 9071421 - DNA, 23 bp, Homo sapiens
ggcacagatgctgagcatgtgca

SEQ ID NO: 9071422 - DNA, 22 bp, Homo sapiens
ggcacagcacagtggacccagg

SEQ ID NO: 9071423 - DNA, 22 bp, Homo sapiens
ggcagacacaaaaacataaggt

SEQ ID NO: 9071424 - DNA, 22 bp, Homo sapiens
ggcagaatgggctattataatg

SEQ ID NO: 9071425 - DNA, 22 bp, Homo sapiens
ggcagaatggaaagatatcata

SEQ ID NO: 9071426 - DNA, 19 bp, Homo sapiens
ggcagaattttatgagctg

SEQ ID NO: 9071427 - DNA, 20 bp, Homo sapiens
ggcagaatgtgagcagctgc

SEQ ID NO: 9071428 - DNA, 22 bp, Homo sapiens
ggcagaatttgccattcaagct

SEQ ID NO: 9071429 - DNA, 22 bp, Homo sapiens
ggcacagcactgtaggcctggg

SEQ ID NO: 9071430 - DNA, 22 bp, Homo sapiens
ggcacagcaccttttcacattg

SEQ ID NO: 9071431 - DNA, 22 bp, Homo sapiens
ggcagagcttgttccttctgtt

SEQ ID NO: 9071432 - DNA, 23 bp, Homo sapiens
ggcagagagcatggctggggccc

SEQ ID NO: 9071433 - DNA, 22 bp, Homo sapiens
ggcagagactgggttggcagag

SEQ ID NO: 9071434 - DNA, 22 bp, Homo sapiens
ggcagagactgggttggcagag

SEQ ID NO: 9071435 - DNA, 22 bp, Homo sapiens
ggcagagaatctggctgtttac

SEQ ID NO: 9071436 - DNA, 22 bp, Homo sapiens
ggcagacactcaaaagctggga

SEQ ID NO: 9071437 - DNA, 22 bp, Homo sapiens
ggcagacactcaaaagctggga

SEQ ID NO: 9071438 - DNA, 22 bp, Homo sapiens
ggcagacacctttatgtctaat

SEQ ID NO: 9071439 - DNA, 19 bp, Homo sapiens
ggcagacacagttgacatg

SEQ ID NO: 9071440 - DNA, 19 bp, Homo sapiens
ggcagacacagttgacatg

SEQ ID NO: 9071441 - DNA, 22 bp, Homo sapiens
ggagtgtgggatggagctcagg

SEQ ID NO: 9071442 - DNA, 22 bp, Homo sapiens
ggagttcactgtgcaggctctg

SEQ ID NO: 9071443 - DNA, 22 bp, Homo sapiens
ggagtggtgtcactgagaggaa

SEQ ID NO: 9071444 - DNA, 22 bp, Homo sapiens
ggcaaggcctgcagctcagtgt

SEQ ID NO: 9071445 - DNA, 22 bp, Homo sapiens
ggcaaggcctgcagctcagtgt

SEQ ID NO: 9071446 - DNA, 22 bp, Homo sapiens
ggcaaggccttgcccagcattc

SEQ ID NO: 9071447 - DNA, 22 bp, Homo sapiens
ggcacacagatggagcactagc

SEQ ID NO: 9071448 - DNA, 22 bp, Homo sapiens
ggagtgggaacaatgacatggt

SEQ ID NO: 9071449 - DNA, 22 bp, Homo sapiens
ggagtgggaacaatgacatggt

SEQ ID NO: 9071450 - DNA, 22 bp, Homo sapiens
ggagtgggcagcactgccctgt

SEQ ID NO: 9071451 - DNA, 22 bp, Homo sapiens
ggagtggcctctcctgtgcagg

SEQ ID NO: 9071452 - DNA, 22 bp, Homo sapiens
ggagtggcctctcctgtgcagg

SEQ ID NO: 9071453 - DNA, 22 bp, Homo sapiens
ggagtggcactctgaggcgggg

SEQ ID NO: 9071454 - DNA, 22 bp, Homo sapiens
ggcaggcagatggctgcaccaa

SEQ ID NO: 9071455 - DNA, 22 bp, Homo sapiens
ggcaggcagatggctgcaccaa

SEQ ID NO: 9071456 - DNA, 22 bp, Homo sapiens
ggcagctgtgaagtgcctcaca

SEQ ID NO: 9071457 - DNA, 22 bp, Homo sapiens
ggcagctgtgaagtgcctcaca

SEQ ID NO: 9071458 - DNA, 22 bp, Homo sapiens
ggcagctgtgaagtgcctcaca

SEQ ID NO: 9071459 - DNA, 22 bp, Homo sapiens
ggcagctgtgaagtgcctcaca

SEQ ID NO: 9071460 - DNA, 22 bp, Homo sapiens
ggcagctgtctctgagttagca

SEQ ID NO: 9071461 - DNA, 22 bp, Homo sapiens
ggcagctgtctctgagttagca

SEQ ID NO: 9071462 - DNA, 22 bp, Homo sapiens
ggcagctgtctctgagttagca

SEQ ID NO: 9071463 - DNA, 22 bp, Homo sapiens
ggcagctgtctctgagttagca

SEQ ID NO: 9071464 - DNA, 22 bp, Homo sapiens
ggcagctgtaagatgagtgaat

SEQ ID NO: 9071465 - DNA, 22 bp, Homo sapiens
ggcagctgtaagatgagtgaat

SEQ ID NO: 9071466 - DNA, 22 bp, Homo sapiens
ggcagctggttctttccattaa

SEQ ID NO: 9071467 - DNA, 22 bp, Homo sapiens
ggcagctggttctttccattaa

SEQ ID NO: 9071468 - DNA, 22 bp, Homo sapiens
ggcagctgtaagatgagtgaat

SEQ ID NO: 9071469 - DNA, 22 bp, Homo sapiens
ggcagctgtctcattcacacct

SEQ ID NO: 9071470 - DNA, 22 bp, Homo sapiens
ggcagctgtctcattcacacct

SEQ ID NO: 9071471 - DNA, 22 bp, Homo sapiens
ggcagctgtctcattcacacct

SEQ ID NO: 9071472 - DNA, 22 bp, Homo sapiens
ggcagctgtaagatgagtgaat

SEQ ID NO: 9071473 - DNA, 22 bp, Homo sapiens
ggcagctgtaagatgagtgaat

SEQ ID NO: 9071474 - DNA, 22 bp, Homo sapiens
ggcagctgtaagatgagtgaat

SEQ ID NO: 9071475 - DNA, 22 bp, Homo sapiens
ggcagctgggttggccagaaac

SEQ ID NO: 9071476 - DNA, 22 bp, Homo sapiens
ggcagctgggttggccagaaac

SEQ ID NO: 9071477 - DNA, 22 bp, Homo sapiens
ggcagctgggttggccagaaac

SEQ ID NO: 9071478 - DNA, 22 bp, Homo sapiens
ggcagctggttctttccattaa

SEQ ID NO: 9071479 - DNA, 22 bp, Homo sapiens
ggcagctgggttggccagaaac

SEQ ID NO: 9071480 - DNA, 22 bp, Homo sapiens
ggcagctgggtcacaccgatct

SEQ ID NO: 9071481 - DNA, 22 bp, Homo sapiens
ggcagctgggtcacaccgatct

SEQ ID NO: 9071482 - DNA, 22 bp, Homo sapiens
ggcagctgggttggccagaaac

SEQ ID NO: 9071483 - DNA, 22 bp, Homo sapiens
ggcagctgggtgcctaataatg

SEQ ID NO: 9071484 - DNA, 22 bp, Homo sapiens
ggcagctgggttggccagaaac

SEQ ID NO: 9071485 - DNA, 23 bp, Homo sapiens
ggcagctgggcagcactcatggg

SEQ ID NO: 9071486 - DNA, 22 bp, Homo sapiens
ggcagctggggcagtgccctgt

SEQ ID NO: 9071487 - DNA, 22 bp, Homo sapiens
ggcagctggggcagtgccctgt

SEQ ID NO: 9071488 - DNA, 23 bp, Homo sapiens
ggcagctgggcagcactcatggg

SEQ ID NO: 9071489 - DNA, 22 bp, Homo sapiens
ggcagctggggcagtgccctgt

SEQ ID NO: 9071490 - DNA, 22 bp, Homo sapiens
ggcagctggggcagtgccctgt

SEQ ID NO: 9071491 - DNA, 22 bp, Homo sapiens
ggcagctggggcagtgccctgt

SEQ ID NO: 9071492 - DNA, 22 bp, Homo sapiens
ggcagctggggcagtgccctgt

SEQ ID NO: 9071493 - DNA, 22 bp, Homo sapiens
ggcagctctgctccttggctcc

SEQ ID NO: 9071494 - DNA, 22 bp, Homo sapiens
ggcagctgcacgttgtcccgtc

SEQ ID NO: 9071495 - DNA, 22 bp, Homo sapiens
ggcagctgcaaatctgctctgt

SEQ ID NO: 9071496 - DNA, 22 bp, Homo sapiens
ggcagctgcacgttgtcccgtc

SEQ ID NO: 9071497 - DNA, 22 bp, Homo sapiens
ggcagctgcacgttgtcccgtc

SEQ ID NO: 9071498 - DNA, 17 bp, Homo sapiens
ggcagctgccacttttt

SEQ ID NO: 9071499 - DNA, 22 bp, Homo sapiens
ggcagctggcctcctcgcccac

SEQ ID NO: 9071500 - DNA, 22 bp, Homo sapiens
ggcagctggcctcctcgcccac

SEQ ID NO: 9071501 - DNA, 22 bp, Homo sapiens
ggcagctggcctcctcgcccac

SEQ ID NO: 9071502 - DNA, 22 bp, Homo sapiens
ggcagctggcctcctcgcccac

SEQ ID NO: 9071503 - DNA, 22 bp, Homo sapiens
ggcagctggcctcctcgcccac

SEQ ID NO: 9071504 - DNA, 19 bp, Homo sapiens
ggcagctggacgctgttca

SEQ ID NO: 9071505 - DNA, 22 bp, Homo sapiens
ggcagctgctgcattacgttgt

SEQ ID NO: 9071506 - DNA, 22 bp, Homo sapiens
ggcagctgctgcattacgttgt

SEQ ID NO: 9071507 - DNA, 22 bp, Homo sapiens
ggcagaggaagctggaagtggg

SEQ ID NO: 9071508 - DNA, 22 bp, Homo sapiens
ggcagaggaagctggaagtggg

SEQ ID NO: 9071509 - DNA, 22 bp, Homo sapiens
ggcagaggaagctggaagtggg

SEQ ID NO: 9071510 - DNA, 22 bp, Homo sapiens
ggcagaggaagctggaagtggg

SEQ ID NO: 9071511 - DNA, 22 bp, Homo sapiens
ggcagaggaagctggaagtggg

SEQ ID NO: 9071512 - DNA, 22 bp, Homo sapiens
ggcagaggaagctggaagtggg

SEQ ID NO: 9071513 - DNA, 22 bp, Homo sapiens
ggcaggctgcttgggtcatgtc

SEQ ID NO: 9071514 - DNA, 22 bp, Homo sapiens
ggcaggctgcttgggtcatgtc

SEQ ID NO: 9071515 - DNA, 22 bp, Homo sapiens
ggcaggctgcttgggtcatgtc

SEQ ID NO: 9071516 - DNA, 22 bp, Homo sapiens
ggcaggctcagcagccaaggag

SEQ ID NO: 9071517 - DNA, 22 bp, Homo sapiens
ggcaggctccaagcatcctatg

SEQ ID NO: 9071518 - DNA, 22 bp, Homo sapiens
ggcaggcgtggtggcctcagaa

SEQ ID NO: 9071519 - DNA, 22 bp, Homo sapiens
ggcaggcgtggtggcctcagaa

SEQ ID NO: 9071520 - DNA, 22 bp, Homo sapiens
ggcaggctagcactgatgtcct

SEQ ID NO: 9071521 - DNA, 22 bp, Homo sapiens
ggcaggcctgagaggcagggct

SEQ ID NO: 9071522 - DNA, 22 bp, Homo sapiens
ggcaggcgtggtggcctcagaa

SEQ ID NO: 9071523 - DNA, 22 bp, Homo sapiens
ggcaggcgtggtggcctcagaa

SEQ ID NO: 9071524 - DNA, 22 bp, Homo sapiens
ggcaggcattagagattcccag

SEQ ID NO: 9071525 - DNA, 22 bp, Homo sapiens
ggcaggcattgcaacatgtaca

SEQ ID NO: 9071526 - DNA, 22 bp, Homo sapiens
ggcaggcattgcaacatgtaca

SEQ ID NO: 9071527 - DNA, 22 bp, Homo sapiens
ggcaggcagcctccatccacag

SEQ ID NO: 9071528 - DNA, 22 bp, Homo sapiens
ggcaggtgaggcatgtgcctgg

SEQ ID NO: 9071529 - DNA, 22 bp, Homo sapiens
ggcaggtgaggcatgtgcctgg

SEQ ID NO: 9071530 - DNA, 19 bp, Homo sapiens
ggcaggctggatagagagg

SEQ ID NO: 9071531 - DNA, 22 bp, Homo sapiens
ggcaggctggctttgttccagg

SEQ ID NO: 9071532 - DNA, 22 bp, Homo sapiens
ggcaggctggctttgttccagg

SEQ ID NO: 9071533 - DNA, 17 bp, Homo sapiens
ggcaggtgcggggccgc

SEQ ID NO: 9071534 - DNA, 22 bp, Homo sapiens
ggcaggtgcgcatgttgcatta

SEQ ID NO: 9071535 - DNA, 22 bp, Homo sapiens
ggcaggtgctaagagaggtaaa

SEQ ID NO: 9071536 - DNA, 20 bp, Homo sapiens
ggcaggtgctcgcttggtct

SEQ ID NO: 9071537 - DNA, 21 bp, Homo sapiens
ggagggcagcccagactggct

SEQ ID NO: 9071538 - DNA, 20 bp, Homo sapiens
ggagggcagctgagagttgg

SEQ ID NO: 9071539 - DNA, 22 bp, Homo sapiens
ggagggccatcttgggtgtgat

SEQ ID NO: 9071540 - DNA, 22 bp, Homo sapiens
ggagggccatcttgggtgtgat

SEQ ID NO: 9071541 - DNA, 22 bp, Homo sapiens
ggagggcatcaatcaggcctgg

SEQ ID NO: 9071542 - DNA, 22 bp, Homo sapiens
ggagggcccctccagtgggcag

SEQ ID NO: 9071543 - DNA, 22 bp, Homo sapiens
ggagggcccctccagtgggcag

SEQ ID NO: 9071544 - DNA, 22 bp, Homo sapiens
ggagggaatgtctagcattctt

SEQ ID NO: 9071545 - DNA, 22 bp, Homo sapiens
ggagggcacaggaccagaaatc

SEQ ID NO: 9071546 - DNA, 22 bp, Homo sapiens
ggagggcagagtcccctgctga

SEQ ID NO: 9071547 - DNA, 22 bp, Homo sapiens
ggagggagagtgaccctaccaa

SEQ ID NO: 9071548 - DNA, 22 bp, Homo sapiens
ggagggacccactgcggtgacc

SEQ ID NO: 9071549 - DNA, 22 bp, Homo sapiens
ggagggagagtgaccctaccaa

SEQ ID NO: 9071550 - DNA, 22 bp, Homo sapiens
ggagggctgtagaggagacctg

SEQ ID NO: 9071551 - DNA, 18 bp, Homo sapiens
ggagggctttggggactg

SEQ ID NO: 9071552 - DNA, 22 bp, Homo sapiens
ggagggctgccaggtggagcgg

SEQ ID NO: 9071553 - DNA, 22 bp, Homo sapiens
ggagggctgccaggtggagcgg

SEQ ID NO: 9071554 - DNA, 22 bp, Homo sapiens
ggagggctgccaggtggagcgg

SEQ ID NO: 9071555 - DNA, 22 bp, Homo sapiens
ggagggccctgggtgcagctct

SEQ ID NO: 9071556 - DNA, 22 bp, Homo sapiens
ggaggcggaggttgcagtgagt

SEQ ID NO: 9071557 - DNA, 22 bp, Homo sapiens
ggaggcggggaaggcatcccat

SEQ ID NO: 9071558 - DNA, 22 bp, Homo sapiens
ggaggcggaggttgcagtgagc

SEQ ID NO: 9071559 - DNA, 22 bp, Homo sapiens
ggaggccttgaggccaggagct

SEQ ID NO: 9071560 - DNA, 22 bp, Homo sapiens
ggaggcctggacttcctgatgg

SEQ ID NO: 9071561 - DNA, 22 bp, Homo sapiens
ggaggcctcagtaccttgcttt

SEQ ID NO: 9071562 - DNA, 22 bp, Homo sapiens
ggaggcccagaaggaagcccag

SEQ ID NO: 9071563 - DNA, 22 bp, Homo sapiens
ggaggccatgggcagaatcttt

SEQ ID NO: 9071564 - DNA, 22 bp, Homo sapiens
ggaggcctagaaaagtggttct

SEQ ID NO: 9071565 - DNA, 22 bp, Homo sapiens
ggaggctgaggcaggcggatca

SEQ ID NO: 9071566 - DNA, 22 bp, Homo sapiens
ggaggctgaggcccctcacagg

SEQ ID NO: 9071567 - DNA, 22 bp, Homo sapiens
ggaggctgaggcaggcggatca

SEQ ID NO: 9071568 - DNA, 22 bp, Homo sapiens
ggaggctgaggcaggcggatca

SEQ ID NO: 9071569 - DNA, 22 bp, Homo sapiens
ggaggctgagaagtccaagatc

SEQ ID NO: 9071570 - DNA, 22 bp, Homo sapiens
ggaggggaggattaatgacaaa

SEQ ID NO: 9071571 - DNA, 22 bp, Homo sapiens
ggaggggagtctcccaaagccg

SEQ ID NO: 9071572 - DNA, 22 bp, Homo sapiens
ggaggggagtctcccaaagccg

SEQ ID NO: 9071573 - DNA, 22 bp, Homo sapiens
ggagggggaaactttggctgcc

SEQ ID NO: 9071574 - DNA, 22 bp, Homo sapiens
ggagggggaagaagctaaagac

SEQ ID NO: 9071575 - DNA, 22 bp, Homo sapiens
ggagggggaattcagccccagc

SEQ ID NO: 9071576 - DNA, 22 bp, Homo sapiens
ggagggggactgacactgattt

SEQ ID NO: 9071577 - DNA, 22 bp, Homo sapiens
ggaggggtggaaggagtgcctg

SEQ ID NO: 9071578 - DNA, 22 bp, Homo sapiens
ggaggggtggaaggagtgcctg

SEQ ID NO: 9071579 - DNA, 22 bp, Homo sapiens
ggagggtgcattttaccctgtg

SEQ ID NO: 9071580 - DNA, 22 bp, Homo sapiens
ggagggtgcattttaccctgtg

SEQ ID NO: 9071581 - DNA, 22 bp, Homo sapiens
ggagtaaggctcagaggaaatg

SEQ ID NO: 9071582 - DNA, 22 bp, Homo sapiens
ggaggttctgatttgtcacaac

SEQ ID NO: 9071583 - DNA, 22 bp, Homo sapiens
ggagtagctgcattccgagcac

SEQ ID NO: 9071584 - DNA, 22 bp, Homo sapiens
ggaggttctctctttgcagagc

SEQ ID NO: 9071585 - DNA, 22 bp, Homo sapiens
ggaggtggtttgatttctatat

SEQ ID NO: 9071586 - DNA, 22 bp, Homo sapiens
ggaggtggtggcagtgacaatt

SEQ ID NO: 9071587 - DNA, 22 bp, Homo sapiens
ggaggtgggctaaggactctct

SEQ ID NO: 9071588 - DNA, 22 bp, Homo sapiens
ggaggtgggctaaggactctct

SEQ ID NO: 9071589 - DNA, 22 bp, Homo sapiens
ggaggtggcctgaaaatgtggc

SEQ ID NO: 9071590 - DNA, 22 bp, Homo sapiens
ggaggtgggagcctccagtggt

SEQ ID NO: 9071591 - DNA, 22 bp, Homo sapiens
ggaggtgggagcctccagtggt

SEQ ID NO: 9071592 - DNA, 22 bp, Homo sapiens
ggaggtgggagtttagttcttg

SEQ ID NO: 9071593 - DNA, 22 bp, Homo sapiens
ggaggtgggattaggacctaaa

SEQ ID NO: 9071594 - DNA, 22 bp, Homo sapiens
ggaggtggaggttgcagtgagc

SEQ ID NO: 9071595 - DNA, 22 bp, Homo sapiens
ggaggtggaggttgcagtgagc

SEQ ID NO: 9071596 - DNA, 22 bp, Homo sapiens
ggaggtccatgtgaatgtggcc

SEQ ID NO: 9071597 - DNA, 20 bp, Homo sapiens
ggagggtggaagaaagcaag

SEQ ID NO: 9071598 - DNA, 20 bp, Homo sapiens
ggagggtggaagaaagcaag

SEQ ID NO: 9071599 - DNA, 22 bp, Homo sapiens
ggagggtggcagcgtcctgggc

SEQ ID NO: 9071600 - DNA, 22 bp, Homo sapiens
ggaggtcaaatggagggctggg

SEQ ID NO: 9071601 - DNA, 22 bp, Homo sapiens
ggaggtagcctcaaaagcagct

SEQ ID NO: 9071602 - DNA, 22 bp, Homo sapiens
ggaggtagtctgagtcataggc

SEQ ID NO: 9071603 - DNA, 22 bp, Homo sapiens
gctgggctgagctagacttggc

SEQ ID NO: 9071604 - DNA, 22 bp, Homo sapiens
gctgggctgagctagacttggc

SEQ ID NO: 9071605 - DNA, 22 bp, Homo sapiens
gctgggctgcgtcggggaagcc

SEQ ID NO: 9071606 - DNA, 22 bp, Homo sapiens
gctgggctgcccaacctctgac

SEQ ID NO: 9071607 - DNA, 22 bp, Homo sapiens
gctgggctgcccaacctctgac

SEQ ID NO: 9071608 - DNA, 22 bp, Homo sapiens
gctgggctgcccaacctctgac

SEQ ID NO: 9071609 - DNA, 22 bp, Homo sapiens
gcttacaggtgaggcagcaaga

SEQ ID NO: 9071610 - DNA, 22 bp, Homo sapiens
gcttagcaaacatctgtagtcc

SEQ ID NO: 9071611 - DNA, 22 bp, Homo sapiens
gcttagcagtgtgtgcttttga

SEQ ID NO: 9071612 - DNA, 22 bp, Homo sapiens
gcttagcagtcacacattgttc

SEQ ID NO: 9071613 - DNA, 22 bp, Homo sapiens
gcttagcatcttacaatgctga

SEQ ID NO: 9071614 - DNA, 20 bp, Homo sapiens
gcttagcaggcatagtagct

SEQ ID NO: 9071615 - DNA, 20 bp, Homo sapiens
gcttagcaggcatagtagct

SEQ ID NO: 9071616 - DNA, 22 bp, Homo sapiens
gcttagcacagaatgagagttc

SEQ ID NO: 9071617 - DNA, 22 bp, Homo sapiens
gcttagcaatgtgacaagatgc

SEQ ID NO: 9071618 - DNA, 22 bp, Homo sapiens
gcttatgatgtttacataaaag

SEQ ID NO: 9071619 - DNA, 22 bp, Homo sapiens
gcttagtgtaggacctggaata

SEQ ID NO: 9071620 - DNA, 22 bp, Homo sapiens
gcttagtggtgtgcaaaggggt

SEQ ID NO: 9071621 - DNA, 16 bp, Homo sapiens
gcttagtgagagcaac

SEQ ID NO: 9071622 - DNA, 22 bp, Homo sapiens
gctgggctctgtcatgccttcc

SEQ ID NO: 9071623 - DNA, 22 bp, Homo sapiens
gctgggctctgtcatgccttcc

SEQ ID NO: 9071624 - DNA, 22 bp, Homo sapiens
gctgggctcgttcccacacgcg

SEQ ID NO: 9071625 - DNA, 22 bp, Homo sapiens
gctgggctcgttcccacacgcg

SEQ ID NO: 9071626 - DNA, 21 bp, Homo sapiens
gctgggctccagtctgccgct

SEQ ID NO: 9071627 - DNA, 22 bp, Homo sapiens
gctgggctctttacccctgtac

SEQ ID NO: 9071628 - DNA, 22 bp, Homo sapiens
gctgggctcttatcacctgtac

SEQ ID NO: 9071629 - DNA, 22 bp, Homo sapiens
gctgggctcttatcacctgtac

SEQ ID NO: 9071630 - DNA, 22 bp, Homo sapiens
gctgggctgagaagttaagcaa

SEQ ID NO: 9071631 - DNA, 22 bp, Homo sapiens
gctgggctctttacccctgtac

SEQ ID NO: 9071632 - DNA, 22 bp, Homo sapiens
gctgggcatgtgaccaacagaa

SEQ ID NO: 9071633 - DNA, 22 bp, Homo sapiens
gctgggccagagcagcagcact

SEQ ID NO: 9071634 - DNA, 22 bp, Homo sapiens
gctgggctcagacctagtgaac

SEQ ID NO: 9071635 - DNA, 22 bp, Homo sapiens
gctgggctcagacctagtgaac

SEQ ID NO: 9071636 - DNA, 22 bp, Homo sapiens
gctgggctccaggccagggtga

SEQ ID NO: 9071637 - DNA, 22 bp, Homo sapiens
gctgggctccaggccagggtga

SEQ ID NO: 9071638 - DNA, 22 bp, Homo sapiens
gctgggctccaccctcaactgt

SEQ ID NO: 9071639 - DNA, 22 bp, Homo sapiens
gctgggctcatttgtgtgtctg

SEQ ID NO: 9071640 - DNA, 22 bp, Homo sapiens
gcttccttattgttgccatagt

SEQ ID NO: 9071641 - DNA, 22 bp, Homo sapiens
gcttccttccttacattggtgg

SEQ ID NO: 9071642 - DNA, 22 bp, Homo sapiens
gcttcctgtaggcaggtccaag

SEQ ID NO: 9071643 - DNA, 22 bp, Homo sapiens
gcttcctgtatcctcctgtacc

SEQ ID NO: 9071644 - DNA, 22 bp, Homo sapiens
gcttcctgtccaggccccacat

SEQ ID NO: 9071645 - DNA, 22 bp, Homo sapiens
gcttcctgtccaggccccacat

SEQ ID NO: 9071646 - DNA, 17 bp, Homo sapiens
gcttcctgtgctgggga

SEQ ID NO: 9071647 - DNA, 22 bp, Homo sapiens
gcttctcaattctcaccctcca

SEQ ID NO: 9071648 - DNA, 20 bp, Homo sapiens
gcttctcagggcttctctga

SEQ ID NO: 9071649 - DNA, 22 bp, Homo sapiens
gcttcgctgctagctagttggt

SEQ ID NO: 9071650 - DNA, 22 bp, Homo sapiens
gcttattttatcctattcacta

SEQ ID NO: 9071651 - DNA, 22 bp, Homo sapiens
gcttcaaactgagcttcaagtg

SEQ ID NO: 9071652 - DNA, 20 bp, Homo sapiens
gcttcaaagccatcctttta

SEQ ID NO: 9071653 - DNA, 22 bp, Homo sapiens
gcttcacagaatcaatagttgg

SEQ ID NO: 9071654 - DNA, 22 bp, Homo sapiens
gcttcagactggagcagaggaa

SEQ ID NO: 9071655 - DNA, 22 bp, Homo sapiens
gcttcattactgacagtctgtg

SEQ ID NO: 9071656 - DNA, 22 bp, Homo sapiens
gcttcctggagggagagagctg

SEQ ID NO: 9071657 - DNA, 22 bp, Homo sapiens
gcttcctggagggagagagctg

SEQ ID NO: 9071658 - DNA, 21 bp, Homo sapiens
ggaaagaaggcaaggctcagg

SEQ ID NO: 9071659 - DNA, 22 bp, Homo sapiens
ggaaagaatcaagtgatcctgt

SEQ ID NO: 9071660 - DNA, 22 bp, Homo sapiens
ggaaagagcccagcagtgcttg

SEQ ID NO: 9071661 - DNA, 22 bp, Homo sapiens
ggaaagatttgtcacatgaatg

SEQ ID NO: 9071662 - DNA, 22 bp, Homo sapiens
ggaaagccaggtgctctggtgt

SEQ ID NO: 9071663 - DNA, 22 bp, Homo sapiens
ggaactcctgctccaagcagct

SEQ ID NO: 9071664 - DNA, 22 bp, Homo sapiens
ggaaagagctaaaagggtgaga

SEQ ID NO: 9071665 - DNA, 22 bp, Homo sapiens
ggaaagagggacccagcttggt

SEQ ID NO: 9071666 - DNA, 22 bp, Homo sapiens
ggaaagagggacccagcttggt

SEQ ID NO: 9071667 - DNA, 22 bp, Homo sapiens
ggaaagatttgtcacatgaatg

SEQ ID NO: 9071668 - DNA, 22 bp, Homo sapiens
ggaaagatgtaatattatctaa

SEQ ID NO: 9071669 - DNA, 22 bp, Homo sapiens
ggaaaactgaggctctcagcag

SEQ ID NO: 9071670 - DNA, 22 bp, Homo sapiens
ggaaaactgaggctctcagcag

SEQ ID NO: 9071671 - DNA, 20 bp, Homo sapiens
ggaaaaatgcatgctcaaga

SEQ ID NO: 9071672 - DNA, 22 bp, Homo sapiens
ggaaacacatgatcagacatct

SEQ ID NO: 9071673 - DNA, 22 bp, Homo sapiens
ggaaacagctctttggggctgt

SEQ ID NO: 9071674 - DNA, 19 bp, Homo sapiens
ggaaacaggggccagagga

SEQ ID NO: 9071675 - DNA, 19 bp, Homo sapiens
ggaaacaggggccagagga

SEQ ID NO: 9071676 - DNA, 19 bp, Homo sapiens
ggaaacaggggccagagga

SEQ ID NO: 9071677 - DNA, 22 bp, Homo sapiens
ggaaacatgcctgctggacagt

SEQ ID NO: 9071678 - DNA, 22 bp, Homo sapiens
ggaagggagtagttggaatgca

SEQ ID NO: 9071679 - DNA, 22 bp, Homo sapiens
ggaagggagtagttggaatgca

SEQ ID NO: 9071680 - DNA, 22 bp, Homo sapiens
ggaagaaatctggttaagagat

SEQ ID NO: 9071681 - DNA, 22 bp, Homo sapiens
ggaagaaatgctcttctatgcg

SEQ ID NO: 9071682 - DNA, 22 bp, Homo sapiens
ggaagaaatctggttaagagat

SEQ ID NO: 9071683 - DNA, 22 bp, Homo sapiens
ggaagggcaaaagagatgaact

SEQ ID NO: 9071684 - DNA, 22 bp, Homo sapiens
ggaaggtgctccctggacagag

SEQ ID NO: 9071685 - DNA, 22 bp, Homo sapiens
ggaaggtcgagctgcatctggc

SEQ ID NO: 9071686 - DNA, 22 bp, Homo sapiens
ggaaggggtgtcgcccatggat

SEQ ID NO: 9071687 - DNA, 22 bp, Homo sapiens
ggaaggggtgtcgcccatggat

SEQ ID NO: 9071688 - DNA, 22 bp, Homo sapiens
ggaaggggttaggggtccctga

SEQ ID NO: 9071689 - DNA, 22 bp, Homo sapiens
ggaagaaagcacacaaacttga

SEQ ID NO: 9071690 - DNA, 22 bp, Homo sapiens
ggaagaaaatgggcaacaggtg

SEQ ID NO: 9071691 - DNA, 22 bp, Homo sapiens
ggaagaaagacatttattttga

SEQ ID NO: 9071692 - DNA, 22 bp, Homo sapiens
ggaagaaaatgggcaacaggtg

SEQ ID NO: 9071693 - DNA, 22 bp, Homo sapiens
ggaagaaaggtggacaacaggt

SEQ ID NO: 9071694 - DNA, 17 bp, Homo sapiens
ggaagaaaaggatcatc

SEQ ID NO: 9071695 - DNA, 17 bp, Homo sapiens
ggaagaaaaggatcatc

SEQ ID NO: 9071696 - DNA, 18 bp, Homo sapiens
ggaagaaaaggaactcag

SEQ ID NO: 9071697 - DNA, 22 bp, Homo sapiens
ggaggagctgctgtgggggccc

SEQ ID NO: 9071698 - DNA, 22 bp, Homo sapiens
ggaggaggcaagtaccagatgc

SEQ ID NO: 9071699 - DNA, 22 bp, Homo sapiens
ggaggcagaatagagtgtgggt

SEQ ID NO: 9071700 - DNA, 22 bp, Homo sapiens
ggaggcagaatagagtgtgggt

SEQ ID NO: 9071701 - DNA, 22 bp, Homo sapiens
ggaggcagaatagagtgtgggt

SEQ ID NO: 9071702 - DNA, 22 bp, Homo sapiens
ggaggcagaatagagtgtgggt

SEQ ID NO: 9071703 - DNA, 22 bp, Homo sapiens
ggaggccaagtcactgacctgg

SEQ ID NO: 9071704 - DNA, 22 bp, Homo sapiens
ggaggccaccatggagtcactt

SEQ ID NO: 9071705 - DNA, 22 bp, Homo sapiens
ggaggccaccatggagtcactt

SEQ ID NO: 9071706 - DNA, 22 bp, Homo sapiens
ggaggccacggtttagcaccga

SEQ ID NO: 9071707 - DNA, 22 bp, Homo sapiens
ggaggccacggtttagcaccga

SEQ ID NO: 9071708 - DNA, 22 bp, Homo sapiens
ggaggccagcctgaggctgagg

SEQ ID NO: 9071709 - DNA, 22 bp, Homo sapiens
ggaggccagtcctggccgggct

SEQ ID NO: 9071710 - DNA, 22 bp, Homo sapiens
ggaggccatcagggagggcatt

SEQ ID NO: 9071711 - DNA, 22 bp, Homo sapiens
ggaggccatcagggagggcatt

SEQ ID NO: 9071712 - DNA, 22 bp, Homo sapiens
ggaggccatctggctggaggct

SEQ ID NO: 9071713 - DNA, 22 bp, Homo sapiens
ggaggccatctggctggaggct

SEQ ID NO: 9071714 - DNA, 22 bp, Homo sapiens
ggaggccagcctgaggctgagg

SEQ ID NO: 9071715 - DNA, 22 bp, Homo sapiens
ggaggccagcctgaggctgagg

SEQ ID NO: 9071716 - DNA, 22 bp, Homo sapiens
ggaggccaggaaggctcggaga

SEQ ID NO: 9071717 - DNA, 22 bp, Homo sapiens
ggaggccaggtgggagtcatct

SEQ ID NO: 9071718 - DNA, 22 bp, Homo sapiens
ggaggccagggacccagtcagc

SEQ ID NO: 9071719 - DNA, 22 bp, Homo sapiens
ggaggccagggacccagtcagc

SEQ ID NO: 9071720 - DNA, 22 bp, Homo sapiens
ggaggagcccactcaaagggga

SEQ ID NO: 9071721 - DNA, 22 bp, Homo sapiens
ggaggaccatcctggtttcacc

SEQ ID NO: 9071722 - DNA, 22 bp, Homo sapiens
ggaggacaggggctgcagcaca

SEQ ID NO: 9071723 - DNA, 22 bp, Homo sapiens
ggaggacaggggctgcagcaca

SEQ ID NO: 9071724 - DNA, 22 bp, Homo sapiens
ggaggacactggctctgccttc

SEQ ID NO: 9071725 - DNA, 22 bp, Homo sapiens
ggaggaagggcccaggctttat

SEQ ID NO: 9071726 - DNA, 22 bp, Homo sapiens
ggaggaagccctcggtgcccca

SEQ ID NO: 9071727 - DNA, 22 bp, Homo sapiens
ggaggaagaggttgttctctca

SEQ ID NO: 9071728 - DNA, 22 bp, Homo sapiens
ggaggaagcacacggcttgtat

SEQ ID NO: 9071729 - DNA, 22 bp, Homo sapiens
ggaggaagcacacggcttgtat

SEQ ID NO: 9071730 - DNA, 22 bp, Homo sapiens
ggaggaagaggttgttctctca

SEQ ID NO: 9071731 - DNA, 22 bp, Homo sapiens
ggagctgatggtagaagaatga

SEQ ID NO: 9071732 - DNA, 22 bp, Homo sapiens
ggagctgatgacgtcaccatgg

SEQ ID NO: 9071733 - DNA, 22 bp, Homo sapiens
ggagctgcacgctctgaagcct

SEQ ID NO: 9071734 - DNA, 22 bp, Homo sapiens
ggaggaaaggctccctccctct

SEQ ID NO: 9071735 - DNA, 22 bp, Homo sapiens
ggagctgcacgctctgaagcct

SEQ ID NO: 9071736 - DNA, 22 bp, Homo sapiens
ggagctgagacccagtggctga

SEQ ID NO: 9071737 - DNA, 22 bp, Homo sapiens
ggagctgaaggggtgggctcag

SEQ ID NO: 9071738 - DNA, 22 bp, Homo sapiens
ggagctgaaccccatcgtgctg

SEQ ID NO: 9071739 - DNA, 22 bp, Homo sapiens
ggagctctgtgtctctcctgcc

SEQ ID NO: 9071740 - DNA, 22 bp, Homo sapiens
ggagctctcttgtggtactccc

SEQ ID NO: 9071741 - DNA, 22 bp, Homo sapiens
ggagctctctcagggggtccaa

SEQ ID NO: 9071742 - DNA, 16 bp, Homo sapiens
ggagctcctcgacttt

SEQ ID NO: 9071743 - DNA, 17 bp, Homo sapiens
ggagctccagctactgc

SEQ ID NO: 9071744 - DNA, 22 bp, Homo sapiens
ggagctcagtggggggactgtg

SEQ ID NO: 9071745 - DNA, 22 bp, Homo sapiens
ggagctcctggcagtgacagag

SEQ ID NO: 9071746 - DNA, 22 bp, Homo sapiens
ggagctaggcaaagctcacgga

SEQ ID NO: 9071747 - DNA, 22 bp, Homo sapiens
ggagctagcctgtctctgttta

SEQ ID NO: 9071748 - DNA, 22 bp, Homo sapiens
ggagctagtagtttcatgagtt

SEQ ID NO: 9071749 - DNA, 22 bp, Homo sapiens
ggagccttagacatctgatcct

SEQ ID NO: 9071750 - DNA, 22 bp, Homo sapiens
ggagccttccagactgcccaca

SEQ ID NO: 9071751 - DNA, 22 bp, Homo sapiens
ggagccttgggcgctctcccat

SEQ ID NO: 9071752 - DNA, 22 bp, Homo sapiens
ggagcctgtgggatgagatgtg

SEQ ID NO: 9071753 - DNA, 22 bp, Homo sapiens
ggagcctgttagttgagtgctc

SEQ ID NO: 9071754 - DNA, 22 bp, Homo sapiens
ggagcctgtgggatgagatgtg

SEQ ID NO: 9071755 - DNA, 22 bp, Homo sapiens
ggagcctgtggctgcttgaagc

SEQ ID NO: 9071756 - DNA, 22 bp, Homo sapiens
ggagcctgtggccgtcacgact

SEQ ID NO: 9071757 - DNA, 22 bp, Homo sapiens
ggagcctgtgcccaagcccaga

SEQ ID NO: 9071758 - DNA, 22 bp, Homo sapiens
ggagcctgtgcccaagcccaga

SEQ ID NO: 9071759 - DNA, 22 bp, Homo sapiens
ggagcctggttactagagcctg

SEQ ID NO: 9071760 - DNA, 22 bp, Homo sapiens
ggagcctggttactagagcctg

SEQ ID NO: 9071761 - DNA, 22 bp, Homo sapiens
ggagagggggctccctgcttgg

SEQ ID NO: 9071762 - DNA, 23 bp, Homo sapiens
ggagaggggtgtgggcatcttta

SEQ ID NO: 9071763 - DNA, 23 bp, Homo sapiens
ggagaggggtgtgggcatcttta

SEQ ID NO: 9071764 - DNA, 22 bp, Homo sapiens
ggagaggcttggcccagcctgg

SEQ ID NO: 9071765 - DNA, 22 bp, Homo sapiens
ggagaggcttggcccagcctgg

SEQ ID NO: 9071766 - DNA, 22 bp, Homo sapiens
ggagagggtaggggtcctgccc

SEQ ID NO: 9071767 - DNA, 22 bp, Homo sapiens
ggagagggtaggggtcctgccc

SEQ ID NO: 9071768 - DNA, 22 bp, Homo sapiens
ggagaggtgaatggctgctcta

SEQ ID NO: 9071769 - DNA, 22 bp, Homo sapiens
ggagagggtgtggaaagttatc

SEQ ID NO: 9071770 - DNA, 22 bp, Homo sapiens
ggagaggtgtattcagtgggtc

SEQ ID NO: 9071771 - DNA, 22 bp, Homo sapiens
ggagaggtgtattcagtgggtc

SEQ ID NO: 9071772 - DNA, 22 bp, Homo sapiens
ggagaggtgagaggtacaagtt

SEQ ID NO: 9071773 - DNA, 22 bp, Homo sapiens
ggagaggtgcaggtcagtggca

SEQ ID NO: 9071774 - DNA, 22 bp, Homo sapiens
ggagacactggaaagtattaca

SEQ ID NO: 9071775 - DNA, 22 bp, Homo sapiens
ggagacagcaggaagaaatatc

SEQ ID NO: 9071776 - DNA, 22 bp, Homo sapiens
ggagacagcaggaagaaatatc

SEQ ID NO: 9071777 - DNA, 22 bp, Homo sapiens
ggagacagcaggaagaaatatc

SEQ ID NO: 9071778 - DNA, 17 bp, Homo sapiens
ggagacagggtctttaa

SEQ ID NO: 9071779 - DNA, 17 bp, Homo sapiens
ggagacagggtctttaa

SEQ ID NO: 9071780 - DNA, 17 bp, Homo sapiens
ggagacagggtctttaa

SEQ ID NO: 9071781 - DNA, 22 bp, Homo sapiens
ggagaatgattctttgctcact

SEQ ID NO: 9071782 - DNA, 22 bp, Homo sapiens
ggagaaggtggctcagcaaagg

SEQ ID NO: 9071783 - DNA, 22 bp, Homo sapiens
ggagaatgatatatagctcagt

SEQ ID NO: 9071784 - DNA, 22 bp, Homo sapiens
ggagaaggtggctcagcaaagg

SEQ ID NO: 9071785 - DNA, 22 bp, Homo sapiens
ggagaaggtggctcagcaaagg

SEQ ID NO: 9071786 - DNA, 22 bp, Homo sapiens
ggagaaggtggctcagcaaagg

SEQ ID NO: 9071787 - DNA, 22 bp, Homo sapiens
ggagaaggaagaaagctactat

SEQ ID NO: 9071788 - DNA, 22 bp, Homo sapiens
ggagaaggaagaaagctactat

SEQ ID NO: 9071789 - DNA, 22 bp, Homo sapiens
ggagaaggaatattggagtagg

SEQ ID NO: 9071790 - DNA, 22 bp, Homo sapiens
ggagaaggaatattggagtagg

SEQ ID NO: 9071791 - DNA, 21 bp, Homo sapiens
ggagaaggacaatgttgagta

SEQ ID NO: 9071792 - DNA, 21 bp, Homo sapiens
ggagaaggacaatgttgagta

SEQ ID NO: 9071793 - DNA, 21 bp, Homo sapiens
ggagaaggacaatgttgagta

SEQ ID NO: 9071794 - DNA, 22 bp, Homo sapiens
ggagaaggcacacccacctctg

SEQ ID NO: 9071795 - DNA, 19 bp, Homo sapiens
ggagaagcccaggaatcct

SEQ ID NO: 9071796 - DNA, 22 bp, Homo sapiens
ggagaagccaggtgataagcaa

SEQ ID NO: 9071797 - DNA, 22 bp, Homo sapiens
ggaataaaaattgtttactgta

SEQ ID NO: 9071798 - DNA, 22 bp, Homo sapiens
ggaataaagaatctggttcccc

SEQ ID NO: 9071799 - DNA, 22 bp, Homo sapiens
ggaataaagaatctggttcccc

SEQ ID NO: 9071800 - DNA, 22 bp, Homo sapiens
ggaagtagaagtaatgaaatca

SEQ ID NO: 9071801 - DNA, 18 bp, Homo sapiens
ggaagtaggaagaggaag

SEQ ID NO: 9071802 - DNA, 23 bp, Homo sapiens
ggaagtcagcggagaggtggctg

SEQ ID NO: 9071803 - DNA, 22 bp, Homo sapiens
ggaagtcctggccatctgccgg

SEQ ID NO: 9071804 - DNA, 22 bp, Homo sapiens
ggaagtcctcatacctgattct

SEQ ID NO: 9071805 - DNA, 18 bp, Homo sapiens
ggaaggtgctggagtgca

SEQ ID NO: 9071806 - DNA, 22 bp, Homo sapiens
ggaagtggtagagccatgagtg

SEQ ID NO: 9071807 - DNA, 22 bp, Homo sapiens
ggaagtggtagagccatgagtg

SEQ ID NO: 9071808 - DNA, 22 bp, Homo sapiens
ggaagtgtttgtgcagatggcc

SEQ ID NO: 9071809 - DNA, 22 bp, Homo sapiens
ggaagtgtttccttgggcagca

SEQ ID NO: 9071810 - DNA, 22 bp, Homo sapiens
ggaagtgtagtccgaagttgcg

SEQ ID NO: 9071811 - DNA, 22 bp, Homo sapiens
ggaagtgtggctaagccaagaa

SEQ ID NO: 9071812 - DNA, 22 bp, Homo sapiens
gggaggagcttggagattcact

SEQ ID NO: 9071813 - DNA, 22 bp, Homo sapiens
gggaggagcttggagattcact

SEQ ID NO: 9071814 - DNA, 20 bp, Homo sapiens
gggaggccccagagtccagg

SEQ ID NO: 9071815 - DNA, 20 bp, Homo sapiens
gggaggccccagagtccagg

SEQ ID NO: 9071816 - DNA, 22 bp, Homo sapiens
gggagaaggagctagttcttga

SEQ ID NO: 9071817 - DNA, 22 bp, Homo sapiens
gggagaaggagctagttcttga

SEQ ID NO: 9071818 - DNA, 22 bp, Homo sapiens
gggagaaggaggactgtgctgt

SEQ ID NO: 9071819 - DNA, 22 bp, Homo sapiens
gggaggctctgctcagcccccg

SEQ ID NO: 9071820 - DNA, 22 bp, Homo sapiens
gggaggctgccatccttcagga

SEQ ID NO: 9071821 - DNA, 22 bp, Homo sapiens
gggaggctggctctggccacag

SEQ ID NO: 9071822 - DNA, 20 bp, Homo sapiens
gggaggccccagagtccagg

SEQ ID NO: 9071823 - DNA, 18 bp, Homo sapiens
gggaggccccagcaggag

SEQ ID NO: 9071824 - DNA, 22 bp, Homo sapiens
gggaggcgccgagggtagctaa

SEQ ID NO: 9071825 - DNA, 22 bp, Homo sapiens
gggaggctcagtggtgtcctct

SEQ ID NO: 9071826 - DNA, 22 bp, Homo sapiens
gggaccagtgtctgtgagaaaa

SEQ ID NO: 9071827 - DNA, 22 bp, Homo sapiens
gggaccaggtcagggctctgac

SEQ ID NO: 9071828 - DNA, 22 bp, Homo sapiens
gggagaaatgtctggcctgctg

SEQ ID NO: 9071829 - DNA, 17 bp, Homo sapiens
gggactcaagatggggt

SEQ ID NO: 9071830 - DNA, 22 bp, Homo sapiens
gggatggactgacggtagcgcg

SEQ ID NO: 9071831 - DNA, 22 bp, Homo sapiens
gggatgccagtcctggccctgc

SEQ ID NO: 9071832 - DNA, 22 bp, Homo sapiens
gggatgaggatcaatcagggag

SEQ ID NO: 9071833 - DNA, 22 bp, Homo sapiens
gggatctgacttgctggtgggt

SEQ ID NO: 9071834 - DNA, 21 bp, Homo sapiens
gggatctgaggcaagtctcct

SEQ ID NO: 9071835 - DNA, 22 bp, Homo sapiens
gggatctgacttgctggtgggt

SEQ ID NO: 9071836 - DNA, 22 bp, Homo sapiens
gggagggacacaaagagttccc

SEQ ID NO: 9071837 - DNA, 20 bp, Homo sapiens
gggatgagagtcctagctct

SEQ ID NO: 9071838 - DNA, 22 bp, Homo sapiens
gggatctgagttgtcaggaagg

SEQ ID NO: 9071839 - DNA, 22 bp, Homo sapiens
gggatctgatgcactgctgaaa

SEQ ID NO: 9071840 - DNA, 22 bp, Homo sapiens
gggatctgagtaggcagaagct

SEQ ID NO: 9071841 - DNA, 22 bp, Homo sapiens
gggatctgagttgtcaggaagg

SEQ ID NO: 9071842 - DNA, 22 bp, Homo sapiens
gggagggaaagcttgatctgtc

SEQ ID NO: 9071843 - DNA, 22 bp, Homo sapiens
gggagggaaagcttgatctgtc

SEQ ID NO: 9071844 - DNA, 22 bp, Homo sapiens
gggagggaaggaggcgccgtgt

SEQ ID NO: 9071845 - DNA, 22 bp, Homo sapiens
gggagggaaggaccttatgaat

SEQ ID NO: 9071846 - DNA, 22 bp, Homo sapiens
gggagggaaggtacctgtgtga

SEQ ID NO: 9071847 - DNA, 22 bp, Homo sapiens
gggatggggagctggaaagggg

SEQ ID NO: 9071848 - DNA, 22 bp, Homo sapiens
gggatggggagctggaaagggg

SEQ ID NO: 9071849 - DNA, 22 bp, Homo sapiens
gggcagaggggcgcttccctct

SEQ ID NO: 9071850 - DNA, 22 bp, Homo sapiens
gggatggggagctggaaagggg

SEQ ID NO: 9071851 - DNA, 22 bp, Homo sapiens
gggatggggagctggaaagggg

SEQ ID NO: 9071852 - DNA, 19 bp, Homo sapiens
gggatgggccctcaccctc

SEQ ID NO: 9071853 - DNA, 22 bp, Homo sapiens
gggatggagggtagagcaagtg

SEQ ID NO: 9071854 - DNA, 22 bp, Homo sapiens
gggatggagggtagagcaagtg

SEQ ID NO: 9071855 - DNA, 22 bp, Homo sapiens
gggatggctcaaaggagtcagg

SEQ ID NO: 9071856 - DNA, 22 bp, Homo sapiens
gggatggctcaaaggagtcagg

SEQ ID NO: 9071857 - DNA, 22 bp, Homo sapiens
gggatggctgcctgcatcagga

SEQ ID NO: 9071858 - DNA, 22 bp, Homo sapiens
gggatggctcaaaggagtcagg

SEQ ID NO: 9071859 - DNA, 22 bp, Homo sapiens
gggcggggggagctggaatgaa

SEQ ID NO: 9071860 - DNA, 22 bp, Homo sapiens
gggcggggtggctcatgcctgt

SEQ ID NO: 9071861 - DNA, 22 bp, Homo sapiens
gggcggtgcctgtctccgaagc

SEQ ID NO: 9071862 - DNA, 22 bp, Homo sapiens
gggctaagtggatcagtcagga

SEQ ID NO: 9071863 - DNA, 22 bp, Homo sapiens
gggcggggggagctggaatgaa

SEQ ID NO: 9071864 - DNA, 22 bp, Homo sapiens
gggcggggcttccgtcctccac

SEQ ID NO: 9071865 - DNA, 22 bp, Homo sapiens
gggcggatcatttgaggtcagg

SEQ ID NO: 9071866 - DNA, 22 bp, Homo sapiens
gggcggcgtcggcgaggccatc

SEQ ID NO: 9071867 - DNA, 22 bp, Homo sapiens
gggcggatcacctgaggtcagg

SEQ ID NO: 9071868 - DNA, 22 bp, Homo sapiens
gggcctgttctgattggcagat

SEQ ID NO: 9071869 - DNA, 19 bp, Homo sapiens
gggcccagcatggagggtt

SEQ ID NO: 9071870 - DNA, 19 bp, Homo sapiens
gggcccagcatggagggtt

SEQ ID NO: 9071871 - DNA, 19 bp, Homo sapiens
gggcccagcatggagggtt

SEQ ID NO: 9071872 - DNA, 19 bp, Homo sapiens
gggcccagcatggagggtt

SEQ ID NO: 9071873 - DNA, 22 bp, Homo sapiens
gggcctgtgtgttcaggagcct

SEQ ID NO: 9071874 - DNA, 22 bp, Homo sapiens
gggcctgtgcacagttctgtta

SEQ ID NO: 9071875 - DNA, 22 bp, Homo sapiens
gggcctgtatgggtctcagata

SEQ ID NO: 9071876 - DNA, 22 bp, Homo sapiens
gggcctgtatgggtctcagata

SEQ ID NO: 9071877 - DNA, 22 bp, Homo sapiens
gggcctggtgcttctgactcct

SEQ ID NO: 9071878 - DNA, 22 bp, Homo sapiens
gggcctggtgcttctgactcct

SEQ ID NO: 9071879 - DNA, 22 bp, Homo sapiens
gggcctggtgcttctgactcct

SEQ ID NO: 9071880 - DNA, 22 bp, Homo sapiens
gggccatgagaggttcatcaac

SEQ ID NO: 9071881 - DNA, 22 bp, Homo sapiens
gggccatgagaggttcatcaac

SEQ ID NO: 9071882 - DNA, 22 bp, Homo sapiens
gggccatgagaggttcatcaac

SEQ ID NO: 9071883 - DNA, 22 bp, Homo sapiens
gggccatgagaggttcatcaac

SEQ ID NO: 9071884 - DNA, 22 bp, Homo sapiens
gggccatgagaggttcatcaac

SEQ ID NO: 9071885 - DNA, 22 bp, Homo sapiens
gggcccagcactggctgggatc

SEQ ID NO: 9071886 - DNA, 22 bp, Homo sapiens
gggcccagcactggctgggatc

SEQ ID NO: 9071887 - DNA, 22 bp, Homo sapiens
gggcccagcactggctgggatc

SEQ ID NO: 9071888 - DNA, 22 bp, Homo sapiens
gggcagaggttcaacttcaaca

SEQ ID NO: 9071889 - DNA, 22 bp, Homo sapiens
gggcagcaaatctgagtctggt

SEQ ID NO: 9071890 - DNA, 18 bp, Homo sapiens
gggcagcacagcagcctc

SEQ ID NO: 9071891 - DNA, 18 bp, Homo sapiens
gggcagcacagcagcctc

SEQ ID NO: 9071892 - DNA, 18 bp, Homo sapiens
gggcagcacagcagcctc

SEQ ID NO: 9071893 - DNA, 22 bp, Homo sapiens
gggcagcacgtttcaggaggat

SEQ ID NO: 9071894 - DNA, 22 bp, Homo sapiens
gggcagcacgtttcaggaggat

SEQ ID NO: 9071895 - DNA, 22 bp, Homo sapiens
gggcagcactcatacctatatt

SEQ ID NO: 9071896 - DNA, 22 bp, Homo sapiens
gggcagcagaattggacagaaa

SEQ ID NO: 9071897 - DNA, 22 bp, Homo sapiens
gggcagctcctgtggaatccac

SEQ ID NO: 9071898 - DNA, 22 bp, Homo sapiens
gggcagcctgctttctgatcca

SEQ ID NO: 9071899 - DNA, 22 bp, Homo sapiens
gggccaggtcggtgaatggtca

SEQ ID NO: 9071900 - DNA, 22 bp, Homo sapiens
gggccaggtcggtgaatggtca

SEQ ID NO: 9071901 - DNA, 22 bp, Homo sapiens
gggggctagagagatgaaatat

SEQ ID NO: 9071902 - DNA, 22 bp, Homo sapiens
ggggactgccttccacagacac

SEQ ID NO: 9071903 - DNA, 22 bp, Homo sapiens
ggggaccctcaggactgcgtct

SEQ ID NO: 9071904 - DNA, 22 bp, Homo sapiens
gggggctggaatatccatcaac

SEQ ID NO: 9071905 - DNA, 22 bp, Homo sapiens
gggggctggaatatccatcaac

SEQ ID NO: 9071906 - DNA, 23 bp, Homo sapiens
gggggctggttgactctctgcag

SEQ ID NO: 9071907 - DNA, 22 bp, Homo sapiens
gggggctgtcctgtgcattgta

SEQ ID NO: 9071908 - DNA, 22 bp, Homo sapiens
ggggggtgacaagtagaggttg

SEQ ID NO: 9071909 - DNA, 20 bp, Homo sapiens
ggggggcttcagggcctgtg

SEQ ID NO: 9071910 - DNA, 22 bp, Homo sapiens
ggggggcagctgtcctggccat

SEQ ID NO: 9071911 - DNA, 22 bp, Homo sapiens
gggtccagggacgtttctgcag

SEQ ID NO: 9071912 - DNA, 22 bp, Homo sapiens
gggtccagctacatcagggtgg

SEQ ID NO: 9071913 - DNA, 22 bp, Homo sapiens
ggggtaggaagagaaaatagtg

SEQ ID NO: 9071914 - DNA, 16 bp, Homo sapiens
gggggtgagagagagt

SEQ ID NO: 9071915 - DNA, 22 bp, Homo sapiens
gggggtgaggacaggagcactg

SEQ ID NO: 9071916 - DNA, 22 bp, Homo sapiens
gggggtggttctaagtcctata

SEQ ID NO: 9071917 - DNA, 17 bp, Homo sapiens
gggtgggcactgctggc

SEQ ID NO: 9071918 - DNA, 23 bp, Homo sapiens
gggtgggccaaattaggtagcct

SEQ ID NO: 9071919 - DNA, 22 bp, Homo sapiens
gggtgggccactgagcagcgtg

SEQ ID NO: 9071920 - DNA, 22 bp, Homo sapiens
gggtgggcccagcccagagaag

SEQ ID NO: 9071921 - DNA, 22 bp, Homo sapiens
gggtgggcctgtctggccatgt

SEQ ID NO: 9071922 - DNA, 22 bp, Homo sapiens
gggtgaggagctgccagtcatg

SEQ ID NO: 9071923 - DNA, 20 bp, Homo sapiens
gggtgagatgtaggagaggg

SEQ ID NO: 9071924 - DNA, 22 bp, Homo sapiens
gggtctggcatgctgagatgga

SEQ ID NO: 9071925 - DNA, 22 bp, Homo sapiens
gggtctggcatgctgagatgga

SEQ ID NO: 9071926 - DNA, 22 bp, Homo sapiens
gggtctggcatgctgagatgga

SEQ ID NO: 9071927 - DNA, 22 bp, Homo sapiens
gggtctggcatgctgagatgga

SEQ ID NO: 9071928 - DNA, 22 bp, Homo sapiens
gggtctggagggcagcccttct

SEQ ID NO: 9071929 - DNA, 22 bp, Homo sapiens
gggtcttcatttattctacact

SEQ ID NO: 9071930 - DNA, 22 bp, Homo sapiens
gggtcttcgccgccgccataac

SEQ ID NO: 9071931 - DNA, 22 bp, Homo sapiens
gggtctgggcaggcgcttcctc

SEQ ID NO: 9071932 - DNA, 22 bp, Homo sapiens
gggtctggcatgctgagatgga

SEQ ID NO: 9071933 - DNA, 22 bp, Homo sapiens
gggtgaagctcctgcaggggcc

SEQ ID NO: 9071934 - DNA, 22 bp, Homo sapiens
gggtgacatagtgatggggcat

SEQ ID NO: 9071935 - DNA, 22 bp, Homo sapiens
gggtgagacagaaagagcaaaa

SEQ ID NO: 9071936 - DNA, 20 bp, Homo sapiens
gggtgagatgtaggagaggg

SEQ ID NO: 9071937 - DNA, 22 bp, Homo sapiens
gggtctctcatgcagttgctgt

SEQ ID NO: 9071938 - DNA, 22 bp, Homo sapiens
gggtctccatgttaacatcact

SEQ ID NO: 9071939 - DNA, 22 bp, Homo sapiens
gggtctggacggctgcaggaag

SEQ ID NO: 9071940 - DNA, 22 bp, Homo sapiens
gggtctggagatccgggtgaag

SEQ ID NO: 9071941 - DNA, 22 bp, Homo sapiens
gggtctggacggctgcaggaag

SEQ ID NO: 9071942 - DNA, 23 bp, Homo sapiens
ggggacagagggcagcccgcatc

SEQ ID NO: 9071943 - DNA, 23 bp, Homo sapiens
ggggacagagggcagcccgcatc

SEQ ID NO: 9071944 - DNA, 23 bp, Homo sapiens
ggggaagtggcagtgagtgaggc

SEQ ID NO: 9071945 - DNA, 22 bp, Homo sapiens
ggggaagtcggagcctgagcac

SEQ ID NO: 9071946 - DNA, 22 bp, Homo sapiens
ggggacagtcgatctagtgatt

SEQ ID NO: 9071947 - DNA, 22 bp, Homo sapiens
ggggacagtcgatctagtgatt

SEQ ID NO: 9071948 - DNA, 22 bp, Homo sapiens
ggggacagtcgatctagtgatt

SEQ ID NO: 9071949 - DNA, 22 bp, Homo sapiens
ggggacagttaaagaccaagac

SEQ ID NO: 9071950 - DNA, 22 bp, Homo sapiens
ggggacagttaaagaccaagac

SEQ ID NO: 9071951 - DNA, 23 bp, Homo sapiens
ggggacagttcccactggggtct

SEQ ID NO: 9071952 - DNA, 23 bp, Homo sapiens
ggggacagttcccactggggtct

SEQ ID NO: 9071953 - DNA, 20 bp, Homo sapiens
ggggacccagaatcacagct

SEQ ID NO: 9071954 - DNA, 22 bp, Homo sapiens
gggctggcaggacctgggctga

SEQ ID NO: 9071955 - DNA, 22 bp, Homo sapiens
gggctggcaggacctgggctga

SEQ ID NO: 9071956 - DNA, 22 bp, Homo sapiens
gggctggatctcctgcaggcag

SEQ ID NO: 9071957 - DNA, 22 bp, Homo sapiens
gggctggagccagctgtggctg

SEQ ID NO: 9071958 - DNA, 22 bp, Homo sapiens
gggctgagaattcagctttcct

SEQ ID NO: 9071959 - DNA, 22 bp, Homo sapiens
gggctctgtgttctagctctcg

SEQ ID NO: 9071960 - DNA, 22 bp, Homo sapiens
gggctctgtggttgtgctttgt

SEQ ID NO: 9071961 - DNA, 22 bp, Homo sapiens
gggctctgtgttctagctctcg

SEQ ID NO: 9071962 - DNA, 22 bp, Homo sapiens
gggctgagacgatggggtcttc

SEQ ID NO: 9071963 - DNA, 22 bp, Homo sapiens
gggctgagagctggaatctgag

SEQ ID NO: 9071964 - DNA, 22 bp, Homo sapiens
gggctgagaattcagctttcct

SEQ ID NO: 9071965 - DNA, 22 bp, Homo sapiens
gggctgagaattcagctttcct

SEQ ID NO: 9071966 - DNA, 22 bp, Homo sapiens
gggctgcttatactgatgataa

SEQ ID NO: 9071967 - DNA, 22 bp, Homo sapiens
gggctctgggtcgtgtctccat

SEQ ID NO: 9071968 - DNA, 22 bp, Homo sapiens
gggctaggcttggccagcactg

SEQ ID NO: 9071969 - DNA, 20 bp, Homo sapiens
gggctagaccagggcagagg

SEQ ID NO: 9071970 - DNA, 22 bp, Homo sapiens
gggctagcctcttccctgctcc

SEQ ID NO: 9071971 - DNA, 22 bp, Homo sapiens
gggctagcagattctacctaat

SEQ ID NO: 9071972 - DNA, 22 bp, Homo sapiens
gggctagcctcttccctgctcc

SEQ ID NO: 9071973 - DNA, 22 bp, Homo sapiens
gggctagcctcttccctgctcc

SEQ ID NO: 9071974 - DNA, 22 bp, Homo sapiens
gggctctggtacttcctggctc

SEQ ID NO: 9071975 - DNA, 22 bp, Homo sapiens
ggctggctcagggcttgagaga

SEQ ID NO: 9071976 - DNA, 22 bp, Homo sapiens
ggctggctcatgcaaagggtga

SEQ ID NO: 9071977 - DNA, 22 bp, Homo sapiens
ggctggctccacctaggtagct

SEQ ID NO: 9071978 - DNA, 22 bp, Homo sapiens
ggctggctccacctaggtagct

SEQ ID NO: 9071979 - DNA, 22 bp, Homo sapiens
ggctggctgataaagggttgag

SEQ ID NO: 9071980 - DNA, 22 bp, Homo sapiens
ggctggctcttaccgacagcgt

SEQ ID NO: 9071981 - DNA, 22 bp, Homo sapiens
ggctggctgcatgccccctcct

SEQ ID NO: 9071982 - DNA, 22 bp, Homo sapiens
ggctggctggatgaatggatta

SEQ ID NO: 9071983 - DNA, 22 bp, Homo sapiens
ggctggctggatgaatggatta

SEQ ID NO: 9071984 - DNA, 22 bp, Homo sapiens
ggctgtggtggcatccctgagc

SEQ ID NO: 9071985 - DNA, 22 bp, Homo sapiens
ggctggcttgccaagctcaggg

SEQ ID NO: 9071986 - DNA, 22 bp, Homo sapiens
ggctggctgtgccctgtactct

SEQ ID NO: 9071987 - DNA, 22 bp, Homo sapiens
ggctggctggcttagcagagga

SEQ ID NO: 9071988 - DNA, 22 bp, Homo sapiens
ggctggctggctggtagacaag

SEQ ID NO: 9071989 - DNA, 22 bp, Homo sapiens
ggctggctggctggtagacaag

SEQ ID NO: 9071990 - DNA, 22 bp, Homo sapiens
ggcttccaaggtcctctccacc

SEQ ID NO: 9071991 - DNA, 22 bp, Homo sapiens
ggcttcagtgagctgagctcac

SEQ ID NO: 9071992 - DNA, 17 bp, Homo sapiens
ggcttccaggtggctct

SEQ ID NO: 9071993 - DNA, 22 bp, Homo sapiens
ggcttccagtgatgcctctttg

SEQ ID NO: 9071994 - DNA, 22 bp, Homo sapiens
ggcttccagctgggccttggag

SEQ ID NO: 9071995 - DNA, 22 bp, Homo sapiens
ggcttccagctgggccttggag

SEQ ID NO: 9071996 - DNA, 22 bp, Homo sapiens
ggcttccaaggtcctctccacc

SEQ ID NO: 9071997 - DNA, 22 bp, Homo sapiens
ggcttccctaaacctttccact

SEQ ID NO: 9071998 - DNA, 22 bp, Homo sapiens
gggaacagcctcaccagccctg

SEQ ID NO: 9071999 - DNA, 22 bp, Homo sapiens
gggaacagagtgccagactgac

SEQ ID NO: 9072000 - DNA, 22 bp, Homo sapiens
gggaacagcatatctgaagggt

SEQ ID NO: 9072001 - DNA, 22 bp, Homo sapiens
gggaacagagtgccagactgac

SEQ ID NO: 9072002 - DNA, 22 bp, Homo sapiens
gggaacagagtgccagactgac

SEQ ID NO: 9072003 - DNA, 22 bp, Homo sapiens
gggaagaagacatggtgaaggc

SEQ ID NO: 9072004 - DNA, 22 bp, Homo sapiens
gggaccaggtcagggctctgac

SEQ ID NO: 9072005 - DNA, 23 bp, Homo sapiens
gggaccaggcccttcctggtttg

SEQ ID NO: 9072006 - DNA, 18 bp, Homo sapiens
gggaagaggatctggccc

SEQ ID NO: 9072007 - DNA, 22 bp, Homo sapiens
gggaagagatttccacatcatt

SEQ ID NO: 9072008 - DNA, 22 bp, Homo sapiens
gggaagagatttccacatcatt

SEQ ID NO: 9072009 - DNA, 22 bp, Homo sapiens
ggcttcctttcactaccctcag

SEQ ID NO: 9072010 - DNA, 22 bp, Homo sapiens
ggcttcctggggcctcctgcaa

SEQ ID NO: 9072011 - DNA, 22 bp, Homo sapiens
ggcttcctggagaaggtctgag

SEQ ID NO: 9072012 - DNA, 22 bp, Homo sapiens
ggcttcctgggcatgtgttcta

SEQ ID NO: 9072013 - DNA, 22 bp, Homo sapiens
ggcttcctccttcctgctgtca

SEQ ID NO: 9072014 - DNA, 22 bp, Homo sapiens
ggcttcctatcccatctgagtg

SEQ ID NO: 9072015 - DNA, 22 bp, Homo sapiens
ggcttcctatcccatctgagtg

SEQ ID NO: 9072016 - DNA, 22 bp, Homo sapiens
ggcttcctaatactccctacac

SEQ ID NO: 9072017 - DNA, 22 bp, Homo sapiens
ggcttctccaggtactgagcat

SEQ ID NO: 9072018 - DNA, 22 bp, Homo sapiens
ggctttgcttctccagatgctt

SEQ ID NO: 9072019 - DNA, 22 bp, Homo sapiens
ggctttgctttggctgtttcag

SEQ ID NO: 9072020 - DNA, 22 bp, Homo sapiens
ggctttgggattcagcatgaga

SEQ ID NO: 9072021 - DNA, 22 bp, Homo sapiens
gggaaaggatttacagtttgat

SEQ ID NO: 9072022 - DNA, 22 bp, Homo sapiens
gggaaaggatcagtgggaggct

SEQ ID NO: 9072023 - DNA, 23 bp, Homo sapiens
ggctggcccggggctgctcctga

SEQ ID NO: 9072024 - DNA, 22 bp, Homo sapiens
ggctggcctcagggtcctcgct

SEQ ID NO: 9072025 - DNA, 23 bp, Homo sapiens
ggctggcccggggctgctcctga

SEQ ID NO: 9072026 - DNA, 23 bp, Homo sapiens
ggctggcccggggctgctcctga

SEQ ID NO: 9072027 - DNA, 23 bp, Homo sapiens
ggctggcccggggctgctcctga

SEQ ID NO: 9072028 - DNA, 22 bp, Homo sapiens
ggctggctatctgtggttgcct

SEQ ID NO: 9072029 - DNA, 22 bp, Homo sapiens
ggctggctacattggaggaagg

SEQ ID NO: 9072030 - DNA, 22 bp, Homo sapiens
ggctggctacattggaggaagg

SEQ ID NO: 9072031 - DNA, 22 bp, Homo sapiens
ggctggcctctacagggaggca

SEQ ID NO: 9072032 - DNA, 22 bp, Homo sapiens
ggctggcctgtgtggccgccac

SEQ ID NO: 9072033 - DNA, 22 bp, Homo sapiens
ggctgcaggaacgacggagggg

SEQ ID NO: 9072034 - DNA, 22 bp, Homo sapiens
ggctgccttcagactccagctt

SEQ ID NO: 9072035 - DNA, 22 bp, Homo sapiens
ggctctcagggaaaggcctccc

SEQ ID NO: 9072036 - DNA, 22 bp, Homo sapiens
ggctccttcaagcctgtcactg

SEQ ID NO: 9072037 - DNA, 20 bp, Homo sapiens
ggctccttctttcatggccc

SEQ ID NO: 9072038 - DNA, 22 bp, Homo sapiens
ggctccttcaaagcacctggct

SEQ ID NO: 9072039 - DNA, 22 bp, Homo sapiens
ggctccttatctctcctatgcc

SEQ ID NO: 9072040 - DNA, 22 bp, Homo sapiens
ggctcctggggaggtgagcttg

SEQ ID NO: 9072041 - DNA, 22 bp, Homo sapiens
ggctcctggaggcaccactggt

SEQ ID NO: 9072042 - DNA, 23 bp, Homo sapiens
ggctcctggattcaaatcctgcc

SEQ ID NO: 9072043 - DNA, 23 bp, Homo sapiens
ggctcctggattcaaatcctgcc

SEQ ID NO: 9072044 - DNA, 23 bp, Homo sapiens
ggctcctggattcaaatcctgcc

SEQ ID NO: 9072045 - DNA, 22 bp, Homo sapiens
ggctgcagagctgggtgggcct

SEQ ID NO: 9072046 - DNA, 22 bp, Homo sapiens
ggctgcagagctgggtgggcct

SEQ ID NO: 9072047 - DNA, 19 bp, Homo sapiens
ggctgcagagccccggcgc

SEQ ID NO: 9072048 - DNA, 22 bp, Homo sapiens
ggctgcagaggcccccagtggg

SEQ ID NO: 9072049 - DNA, 22 bp, Homo sapiens
ggctgcaaaggaaaagtggtga

SEQ ID NO: 9072050 - DNA, 22 bp, Homo sapiens
ggctgcaagacaaggttggttt

SEQ ID NO: 9072051 - DNA, 22 bp, Homo sapiens
ggctgcacgcctctcagcttgc

SEQ ID NO: 9072052 - DNA, 22 bp, Homo sapiens
ggctgatgagcttagctagaga

SEQ ID NO: 9072053 - DNA, 22 bp, Homo sapiens
ggctctcagggaaaggcctccc

SEQ ID NO: 9072054 - DNA, 19 bp, Homo sapiens
ggctctcccttgagagagc

SEQ ID NO: 9072055 - DNA, 22 bp, Homo sapiens
ggctgagttgagaggattactt

SEQ ID NO: 9072056 - DNA, 22 bp, Homo sapiens
ggcaggtgcttgtcgaaggcct

SEQ ID NO: 9072057 - DNA, 22 bp, Homo sapiens
ggccacctctgccctactgagt

SEQ ID NO: 9072058 - DNA, 22 bp, Homo sapiens
ggcaggtgctctgtgggcctgg

SEQ ID NO: 9072059 - DNA, 22 bp, Homo sapiens
ggcaggtgctctgtgggcctgg

SEQ ID NO: 9072060 - DNA, 22 bp, Homo sapiens
ggcaggtgctgggagcatctca

SEQ ID NO: 9072061 - DNA, 22 bp, Homo sapiens
ggcaggtgctgggagcatctca

SEQ ID NO: 9072062 - DNA, 22 bp, Homo sapiens
ggccagaagttggaaaagagcc

SEQ ID NO: 9072063 - DNA, 22 bp, Homo sapiens
ggccacctgggatctcatcctg

SEQ ID NO: 9072064 - DNA, 22 bp, Homo sapiens
ggccacctgggatctcatcctg

SEQ ID NO: 9072065 - DNA, 22 bp, Homo sapiens
ggccacctggctgtgggggcag

SEQ ID NO: 9072066 - DNA, 22 bp, Homo sapiens
ggccacctgggatctcatcctg

SEQ ID NO: 9072067 - DNA, 22 bp, Homo sapiens
ggccacctctgccctactgagt

SEQ ID NO: 9072068 - DNA, 20 bp, Homo sapiens
ggccacctgcttcagacccc

SEQ ID NO: 9072069 - DNA, 20 bp, Homo sapiens
ggccacctgcttcagacccc

SEQ ID NO: 9072070 - DNA, 22 bp, Homo sapiens
ggccacctggctgtgggggcag

SEQ ID NO: 9072071 - DNA, 22 bp, Homo sapiens
ggccaccttcctgtggtctctg

SEQ ID NO: 9072072 - DNA, 22 bp, Homo sapiens
ggccaccttccagttgcctgca

SEQ ID NO: 9072073 - DNA, 22 bp, Homo sapiens
ggccaccttccagttgcctgca

SEQ ID NO: 9072074 - DNA, 22 bp, Homo sapiens
ggccaccttaagttaaggatat

SEQ ID NO: 9072075 - DNA, 22 bp, Homo sapiens
ggccacctgggttcgactgggc

SEQ ID NO: 9072076 - DNA, 22 bp, Homo sapiens
ggccagaggtggtacatagctt

SEQ ID NO: 9072077 - DNA, 18 bp, Homo sapiens
ggccagagggagggtccc

SEQ ID NO: 9072078 - DNA, 18 bp, Homo sapiens
ggccagagggagggtccc

SEQ ID NO: 9072079 - DNA, 22 bp, Homo sapiens
ggccagaggtgtcctcagttct

SEQ ID NO: 9072080 - DNA, 22 bp, Homo sapiens
ggccatgggaagaggtggagag

SEQ ID NO: 9072081 - DNA, 17 bp, Homo sapiens
ggccagaggcggggctg

SEQ ID NO: 9072082 - DNA, 18 bp, Homo sapiens
ggccagagggagggtccc

SEQ ID NO: 9072083 - DNA, 22 bp, Homo sapiens
ggccagagagcagccaggattc

SEQ ID NO: 9072084 - DNA, 22 bp, Homo sapiens
ggccagaggccacagctgtgtc

SEQ ID NO: 9072085 - DNA, 22 bp, Homo sapiens
ggccagaggacctctcatagcc

SEQ ID NO: 9072086 - DNA, 22 bp, Homo sapiens
ggccagaggacctctcatagcc

SEQ ID NO: 9072087 - DNA, 22 bp, Homo sapiens
ggccagaggccacagctgtgtc

SEQ ID NO: 9072088 - DNA, 22 bp, Homo sapiens
ggccccagattctgggctgggt

SEQ ID NO: 9072089 - DNA, 22 bp, Homo sapiens
ggccccagattctgggctgggt

SEQ ID NO: 9072090 - DNA, 22 bp, Homo sapiens
ggccccagattctgggctgggt

SEQ ID NO: 9072091 - DNA, 22 bp, Homo sapiens
ggccccaggtagaagatataga

SEQ ID NO: 9072092 - DNA, 22 bp, Homo sapiens
ggccccacgggggagtcctagt

SEQ ID NO: 9072093 - DNA, 22 bp, Homo sapiens
ggccccaaatgtcaatagtact

SEQ ID NO: 9072094 - DNA, 22 bp, Homo sapiens
ggccccagattctgggctgggt

SEQ ID NO: 9072095 - DNA, 22 bp, Homo sapiens
ggccccagattctgggctgggt

SEQ ID NO: 9072096 - DNA, 22 bp, Homo sapiens
ggcccagcctcagacatgccct

SEQ ID NO: 9072097 - DNA, 22 bp, Homo sapiens
ggcccagcctggcaacaatgac

SEQ ID NO: 9072098 - DNA, 22 bp, Homo sapiens
ggccccagttcactcctggccg

SEQ ID NO: 9072099 - DNA, 22 bp, Homo sapiens
ggccccagttcactcctggccg

SEQ ID NO: 9072100 - DNA, 22 bp, Homo sapiens
ggcccccagggtgggtgtagac

SEQ ID NO: 9072101 - DNA, 22 bp, Homo sapiens
ggccccaggtctgaacacgctg

SEQ ID NO: 9072102 - DNA, 22 bp, Homo sapiens
ggccccagttcactcctggccg

SEQ ID NO: 9072103 - DNA, 22 bp, Homo sapiens
ggccccagttcactcctggccg

SEQ ID NO: 9072104 - DNA, 22 bp, Homo sapiens
ggcccctcagcatctgagtcag

SEQ ID NO: 9072105 - DNA, 22 bp, Homo sapiens
ggcccctcagcatctgagtcag

SEQ ID NO: 9072106 - DNA, 19 bp, Homo sapiens
ggcccctctcacaggagtt

SEQ ID NO: 9072107 - DNA, 22 bp, Homo sapiens
ggcccctgcggactgcctagag

SEQ ID NO: 9072108 - DNA, 22 bp, Homo sapiens
ggcccctgcggactgcctagag

SEQ ID NO: 9072109 - DNA, 22 bp, Homo sapiens
ggcccctcttgtggcacatacg

SEQ ID NO: 9072110 - DNA, 22 bp, Homo sapiens
ggcccacttgaaatggagctca

SEQ ID NO: 9072111 - DNA, 22 bp, Homo sapiens
ggcccagccggcgagtctcgcg

SEQ ID NO: 9072112 - DNA, 22 bp, Homo sapiens
ggcccacactgacagctgagct

SEQ ID NO: 9072113 - DNA, 22 bp, Homo sapiens
ggcccacactgacagctgagct

SEQ ID NO: 9072114 - DNA, 20 bp, Homo sapiens
ggccatgggttgcctgaggt

SEQ ID NO: 9072115 - DNA, 22 bp, Homo sapiens
ggccatggtcatgggtgagctt

SEQ ID NO: 9072116 - DNA, 22 bp, Homo sapiens
ggccatggtgaggtcttctcag

SEQ ID NO: 9072117 - DNA, 22 bp, Homo sapiens
ggccatggtggtttgagcacct

SEQ ID NO: 9072118 - DNA, 22 bp, Homo sapiens
ggccatggttggggaagacatg

SEQ ID NO: 9072119 - DNA, 22 bp, Homo sapiens
ggccatgtttggcagaaggatt

SEQ ID NO: 9072120 - DNA, 22 bp, Homo sapiens
ggccattgcaacgtcaggagga

SEQ ID NO: 9072121 - DNA, 22 bp, Homo sapiens
ggccatttgcttggagaacttt

SEQ ID NO: 9072122 - DNA, 22 bp, Homo sapiens
ggctcaggagaggggctaaaag

SEQ ID NO: 9072123 - DNA, 22 bp, Homo sapiens
ggctcaggatgagccttctcat

SEQ ID NO: 9072124 - DNA, 22 bp, Homo sapiens
ggctcagcttggtgcgcagaaa

SEQ ID NO: 9072125 - DNA, 22 bp, Homo sapiens
ggctcagcttatctgggcaggc

SEQ ID NO: 9072126 - DNA, 22 bp, Homo sapiens
ggccttgggaggagggtcagaa

SEQ ID NO: 9072127 - DNA, 22 bp, Homo sapiens
ggccttggcctagccctccagg

SEQ ID NO: 9072128 - DNA, 21 bp, Homo sapiens
ggccttggcgggggccgaatt

SEQ ID NO: 9072129 - DNA, 20 bp, Homo sapiens
ggccttggcctctttgcagc

SEQ ID NO: 9072130 - DNA, 22 bp, Homo sapiens
ggccttggctcctgcagggagt

SEQ ID NO: 9072131 - DNA, 22 bp, Homo sapiens
ggccttgggaggagggtcagaa

SEQ ID NO: 9072132 - DNA, 21 bp, Homo sapiens
ggccttggcgggggccgaatt

SEQ ID NO: 9072133 - DNA, 22 bp, Homo sapiens
ggctcatcagaaatacctgaca

SEQ ID NO: 9072134 - DNA, 20 bp, Homo sapiens
ggctcatcttgtctgctgac

SEQ ID NO: 9072135 - DNA, 22 bp, Homo sapiens
ggctccaaagggcagtgtgagg

SEQ ID NO: 9072136 - DNA, 19 bp, Homo sapiens
ggctcagtgacataggtgc

SEQ ID NO: 9072137 - DNA, 22 bp, Homo sapiens
ggctcagtgggaacaagctgag

SEQ ID NO: 9072138 - DNA, 22 bp, Homo sapiens
ggctcagtaagtcaggttcatt

SEQ ID NO: 9072139 - DNA, 22 bp, Homo sapiens
ggctcctgccgtcttttctgag

SEQ ID NO: 9072140 - DNA, 22 bp, Homo sapiens
ggctccaacactaaatgtgttt

SEQ ID NO: 9072141 - DNA, 22 bp, Homo sapiens
ggctcctgatgctcagatttca

SEQ ID NO: 9072142 - DNA, 22 bp, Homo sapiens
ggcccctgtaaaatgtacatgt

SEQ ID NO: 9072143 - DNA, 22 bp, Homo sapiens
ggcccctggcaccaggctgatt

SEQ ID NO: 9072144 - DNA, 22 bp, Homo sapiens
ggccctctgcctgtgctggcga

SEQ ID NO: 9072145 - DNA, 22 bp, Homo sapiens
ggccctctgctcacttcctatt

SEQ ID NO: 9072146 - DNA, 22 bp, Homo sapiens
ggccctcttttatccatcataa

SEQ ID NO: 9072147 - DNA, 22 bp, Homo sapiens
ggccctcttttatccatcataa

SEQ ID NO: 9072148 - DNA, 22 bp, Homo sapiens
ggccctctggtgagtatcacat

SEQ ID NO: 9072149 - DNA, 22 bp, Homo sapiens
ggcctgggcccactgtcaagag

SEQ ID NO: 9072150 - DNA, 23 bp, Homo sapiens
ggcctgtgttttgtctgaagtac

SEQ ID NO: 9072151 - DNA, 22 bp, Homo sapiens
ggcctgggcctttgtgttttga

SEQ ID NO: 9072152 - DNA, 22 bp, Homo sapiens
ggccctgagctgaagtactgtg

SEQ ID NO: 9072153 - DNA, 22 bp, Homo sapiens
ggccctgagcacagctcctctc

SEQ ID NO: 9072154 - DNA, 22 bp, Homo sapiens
ggccctgagctgaagtactgtg

SEQ ID NO: 9072155 - DNA, 22 bp, Homo sapiens
ggccttccttcccagcctactg

SEQ ID NO: 9072156 - DNA, 21 bp, Homo sapiens
ggccttcccctgcagtctccg

SEQ ID NO: 9072157 - DNA, 22 bp, Homo sapiens
ggccttcctggcggctcagggt

SEQ ID NO: 9072158 - DNA, 22 bp, Homo sapiens
ggccttccagggaagacagggc

SEQ ID NO: 9072159 - DNA, 22 bp, Homo sapiens
ggccttagtgaggtcctgatgc

SEQ ID NO: 9072160 - DNA, 22 bp, Homo sapiens
ggccttatggcaaagtcagttg

SEQ ID NO: 9072161 - DNA, 22 bp, Homo sapiens
ggccttcacgtgacctggcgtg

SEQ ID NO: 9072162 - DNA, 22 bp, Homo sapiens
ggccttagcggtcatagcaaag

SEQ ID NO: 9072163 - DNA, 22 bp, Homo sapiens
ggccttaggctcaacaggcaga

SEQ ID NO: 9072164 - DNA, 22 bp, Homo sapiens
ggccttggagtcagccttgagc

SEQ ID NO: 9072165 - DNA, 22 bp, Homo sapiens
ggccttgctgcttccagaaggt

SEQ ID NO: 9072166 - DNA, 19 bp, Homo sapiens
ggccttgctctgtggcagc

SEQ ID NO: 9072167 - DNA, 22 bp, Homo sapiens
ggccttgatcctccagagcact

SEQ ID NO: 9072168 - DNA, 22 bp, Homo sapiens
ggccttgatctctctaactgct

SEQ ID NO: 9072169 - DNA, 19 bp, Homo sapiens
ggccttgatgagtggggag

SEQ ID NO: 9072170 - DNA, 22 bp, Homo sapiens
ggccttgatgttcttgggagat

SEQ ID NO: 9072171 - DNA, 22 bp, Homo sapiens
ggccttgacagttaagagacct

SEQ ID NO: 9072172 - DNA, 22 bp, Homo sapiens
ggccttgatcctccagagcact

SEQ ID NO: 9072173 - DNA, 22 bp, Homo sapiens
ggccttgagcagggagaaacca

SEQ ID NO: 9072174 - DNA, 22 bp, Homo sapiens
ggccttgagagccagtgcaggc

SEQ ID NO: 9072175 - DNA, 22 bp, Homo sapiens
ggccttgacagttaagagacct

SEQ ID NO: 9072176 - DNA, 22 bp, Homo sapiens
tgtgaaagcagccatgggcatt

SEQ ID NO: 9072177 - DNA, 22 bp, Homo sapiens
tgtgaaagcaagtctagttctc

SEQ ID NO: 9072178 - DNA, 22 bp, Homo sapiens
tgtgaaagagtcttatagtttc

SEQ ID NO: 9072179 - DNA, 22 bp, Homo sapiens
tgtgaaagtcaaattaattgaa

SEQ ID NO: 9072180 - DNA, 22 bp, Homo sapiens
tgtgaaaggagccatagacagt

SEQ ID NO: 9072181 - DNA, 22 bp, Homo sapiens
tgtgaaaggaaggcatgaaaag

SEQ ID NO: 9072182 - DNA, 23 bp, Homo sapiens
tgtgacagggtcattgaaaaggg

SEQ ID NO: 9072183 - DNA, 22 bp, Homo sapiens
tgtgacaagcattgtatattgg

SEQ ID NO: 9072184 - DNA, 20 bp, Homo sapiens
tgtgacaaaggcatatttta

SEQ ID NO: 9072185 - DNA, 23 bp, Homo sapiens
tgtgaattgaggacatcaaaagc

SEQ ID NO: 9072186 - DNA, 22 bp, Homo sapiens
tgtgaatggacaattaaatcta

SEQ ID NO: 9072187 - DNA, 22 bp, Homo sapiens
tgtgaatggacaattaaatcta

SEQ ID NO: 9072188 - DNA, 22 bp, Homo sapiens
tgtgaatatacttaatgccact

SEQ ID NO: 9072189 - DNA, 22 bp, Homo sapiens
tgtgaatagtgccgcaataaac

SEQ ID NO: 9072190 - DNA, 22 bp, Homo sapiens
tgtgaatatccatttgtttcag

SEQ ID NO: 9072191 - DNA, 22 bp, Homo sapiens
tgtgaaggttaaataatatgat

SEQ ID NO: 9072192 - DNA, 22 bp, Homo sapiens
tgtgaaggttaaataatatgat

SEQ ID NO: 9072193 - DNA, 23 bp, Homo sapiens
tgtgaaggtgggtccaagggctg

SEQ ID NO: 9072194 - DNA, 22 bp, Homo sapiens
tgtgaataatgccgcaataaac

SEQ ID NO: 9072195 - DNA, 22 bp, Homo sapiens
tgtgaataccttgaattcatca

SEQ ID NO: 9072196 - DNA, 22 bp, Homo sapiens
tgtgaataccttgaattcatca

SEQ ID NO: 9072197 - DNA, 22 bp, Homo sapiens
tgtgaatagtcagcattttgtt

SEQ ID NO: 9072198 - DNA, 22 bp, Homo sapiens
tgtgaatagattgaagctttgg

SEQ ID NO: 9072199 - DNA, 22 bp, Homo sapiens
tgtgaccataatttgtaaataa

SEQ ID NO: 9072200 - DNA, 22 bp, Homo sapiens
tgtgactgaagtgtctagacct

SEQ ID NO: 9072201 - DNA, 22 bp, Homo sapiens
tgtgactgagctgcagagtgtc

SEQ ID NO: 9072202 - DNA, 22 bp, Homo sapiens
tgtgactggagtccagcccact

SEQ ID NO: 9072203 - DNA, 22 bp, Homo sapiens
tgtgactggttgtcccgctttc

SEQ ID NO: 9072204 - DNA, 22 bp, Homo sapiens
tgtgactggttgtcccgctttc

SEQ ID NO: 9072205 - DNA, 22 bp, Homo sapiens
tgtgactgtggacttttgtggg

SEQ ID NO: 9072206 - DNA, 22 bp, Homo sapiens
tgtgacttataacatagaattt

SEQ ID NO: 9072207 - DNA, 22 bp, Homo sapiens
tgtgattatattgtagtacatt

SEQ ID NO: 9072208 - DNA, 22 bp, Homo sapiens
tgtgattatattgtagtacatt

SEQ ID NO: 9072209 - DNA, 22 bp, Homo sapiens
tgtgatttcactggtgacatgt

SEQ ID NO: 9072210 - DNA, 22 bp, Homo sapiens
tgtgatgtcagtggtatcaaag

SEQ ID NO: 9072211 - DNA, 22 bp, Homo sapiens
tgtgagcactgtgatgctgttc

SEQ ID NO: 9072212 - DNA, 22 bp, Homo sapiens
tgtgctctgcaatcagttcttt

SEQ ID NO: 9072213 - DNA, 22 bp, Homo sapiens
tgtgctctgaagagtgcatgtc

SEQ ID NO: 9072214 - DNA, 22 bp, Homo sapiens
tgtgctctgactttctcctggt

SEQ ID NO: 9072215 - DNA, 17 bp, Homo sapiens
tgtgctctctcactcag

SEQ ID NO: 9072216 - DNA, 23 bp, Homo sapiens
tgtgctcccaaatgtaggtctat

SEQ ID NO: 9072217 - DNA, 22 bp, Homo sapiens
tgtgctattacacatttattta

SEQ ID NO: 9072218 - DNA, 22 bp, Homo sapiens
tgtgctatttgactgtttgcta

SEQ ID NO: 9072219 - DNA, 22 bp, Homo sapiens
tgtgctcagtctttggctggga

SEQ ID NO: 9072220 - DNA, 22 bp, Homo sapiens
tgtgctcagccaggggcaggcc

SEQ ID NO: 9072221 - DNA, 22 bp, Homo sapiens
tgtgctcagccaggggcaggcc

SEQ ID NO: 9072222 - DNA, 22 bp, Homo sapiens
tgtgctatttttgcatatgtgt

SEQ ID NO: 9072223 - DNA, 22 bp, Homo sapiens
tgtgctcttgtctgtgactaac

SEQ ID NO: 9072224 - DNA, 22 bp, Homo sapiens
tgtgctgagtgatcccattcct

SEQ ID NO: 9072225 - DNA, 22 bp, Homo sapiens
tgtgctgctctcagtgacagcc

SEQ ID NO: 9072226 - DNA, 22 bp, Homo sapiens
tgtggaaagtcaagttccagga

SEQ ID NO: 9072227 - DNA, 22 bp, Homo sapiens
tgtgcctgagttggctgagtac

SEQ ID NO: 9072228 - DNA, 18 bp, Homo sapiens
tgtgcctctgcaggacgt

SEQ ID NO: 9072229 - DNA, 22 bp, Homo sapiens
tgtgcctgagttggctgagtac

SEQ ID NO: 9072230 - DNA, 22 bp, Homo sapiens
tgtgcctggagtccctgaggag

SEQ ID NO: 9072231 - DNA, 22 bp, Homo sapiens
tgtgcctgatggtcacgtggcc

SEQ ID NO: 9072232 - DNA, 22 bp, Homo sapiens
tgtgcctggcattctgggcttc

SEQ ID NO: 9072233 - DNA, 22 bp, Homo sapiens
tgtgcctggcattctgggcttc

SEQ ID NO: 9072234 - DNA, 22 bp, Homo sapiens
tgtgcctggatctctgtgacaa

SEQ ID NO: 9072235 - DNA, 22 bp, Homo sapiens
tgtgcctttcatcatgcttttg

SEQ ID NO: 9072236 - DNA, 22 bp, Homo sapiens
tgtgcctttaaggggagctgag

SEQ ID NO: 9072237 - DNA, 22 bp, Homo sapiens
tgtgcctgtcaccctcagagag

SEQ ID NO: 9072238 - DNA, 22 bp, Homo sapiens
tgtgcctggtccctgagtcgag

SEQ ID NO: 9072239 - DNA, 22 bp, Homo sapiens
tgtgccttatgaattctttctg

SEQ ID NO: 9072240 - DNA, 22 bp, Homo sapiens
tgtgcctgtgacagcgacctgg

SEQ ID NO: 9072241 - DNA, 22 bp, Homo sapiens
tgtgcctgttcccactttgcct

SEQ ID NO: 9072242 - DNA, 22 bp, Homo sapiens
tgtgcccattccacttgagtac

SEQ ID NO: 9072243 - DNA, 22 bp, Homo sapiens
tgtgccctgttaaatgcacagt

SEQ ID NO: 9072244 - DNA, 20 bp, Homo sapiens
tgtgccctgcagacttcttt

SEQ ID NO: 9072245 - DNA, 22 bp, Homo sapiens
tgtgcctctgaagggcggacgg

SEQ ID NO: 9072246 - DNA, 19 bp, Homo sapiens
tgtgcctcctcgtctccta

SEQ ID NO: 9072247 - DNA, 19 bp, Homo sapiens
tgtgcctctatagcatgtg

SEQ ID NO: 9072248 - DNA, 18 bp, Homo sapiens
tgtgcctctgcaggacgt

SEQ ID NO: 9072249 - DNA, 22 bp, Homo sapiens
tgtgccaagactatattgtgct

SEQ ID NO: 9072250 - DNA, 22 bp, Homo sapiens
tgtgcagtttctatgttgtcca

SEQ ID NO: 9072251 - DNA, 22 bp, Homo sapiens
tgtgcagtttctatgttgtcca

SEQ ID NO: 9072252 - DNA, 22 bp, Homo sapiens
tgtgcagttttaagtggtctaa

SEQ ID NO: 9072253 - DNA, 22 bp, Homo sapiens
tgtgcacaatgtgcaggtttgt

SEQ ID NO: 9072254 - DNA, 22 bp, Homo sapiens
tgtgcacataaaacagtactag

SEQ ID NO: 9072255 - DNA, 23 bp, Homo sapiens
tgtgcacatctgacgggtgaagg

SEQ ID NO: 9072256 - DNA, 22 bp, Homo sapiens
tgtgcacattctaggactagta

SEQ ID NO: 9072257 - DNA, 22 bp, Homo sapiens
tgtgcagaaactgggaaggaag

SEQ ID NO: 9072258 - DNA, 22 bp, Homo sapiens
tgtgcagagaagccactggggg

SEQ ID NO: 9072259 - DNA, 22 bp, Homo sapiens
tgtgcaatcttgagcaatttat

SEQ ID NO: 9072260 - DNA, 20 bp, Homo sapiens
tgtgcaggagagtgaggctg

SEQ ID NO: 9072261 - DNA, 22 bp, Homo sapiens
tgtgcagggaagggcatgctat

SEQ ID NO: 9072262 - DNA, 22 bp, Homo sapiens
tgtgcagagttgaagacaggag

SEQ ID NO: 9072263 - DNA, 22 bp, Homo sapiens
tgtgcagagcggggaagagcac

SEQ ID NO: 9072264 - DNA, 22 bp, Homo sapiens
tgtgcagagcccacaggcagct

SEQ ID NO: 9072265 - DNA, 22 bp, Homo sapiens
tgtcttttataactgacatata

SEQ ID NO: 9072266 - DNA, 22 bp, Homo sapiens
tgtcttttataactgacatata

SEQ ID NO: 9072267 - DNA, 22 bp, Homo sapiens
tgtcttttacctaatgagctgg

SEQ ID NO: 9072268 - DNA, 22 bp, Homo sapiens
tgtcttttacctaatgagctgg

SEQ ID NO: 9072269 - DNA, 22 bp, Homo sapiens
tgtcttttgccaaagatcagtt

SEQ ID NO: 9072270 - DNA, 19 bp, Homo sapiens
tgtctttggtctgagtttc

SEQ ID NO: 9072271 - DNA, 22 bp, Homo sapiens
tgtctttttactatgttcaatc

SEQ ID NO: 9072272 - DNA, 22 bp, Homo sapiens
tgtgaaaaaagttctagaagga

SEQ ID NO: 9072273 - DNA, 22 bp, Homo sapiens
tgtcttttggagcatctttctt

SEQ ID NO: 9072274 - DNA, 22 bp, Homo sapiens
tgtcttttggagcatctttctt

SEQ ID NO: 9072275 - DNA, 22 bp, Homo sapiens
tgtcttttggagcatctttctt

SEQ ID NO: 9072276 - DNA, 22 bp, Homo sapiens
tgtcttttggagcatctttctt

SEQ ID NO: 9072277 - DNA, 22 bp, Homo sapiens
tgtgaaaaaagttctagaagga

SEQ ID NO: 9072278 - DNA, 22 bp, Homo sapiens
tgtgaaacggagtcagggaagg

SEQ ID NO: 9072279 - DNA, 22 bp, Homo sapiens
tgtcttcagtaaaatacactat

SEQ ID NO: 9072280 - DNA, 22 bp, Homo sapiens
tgtcttcaggagtaaatatcat

SEQ ID NO: 9072281 - DNA, 22 bp, Homo sapiens
tgtcttcatctccatgcacaga

SEQ ID NO: 9072282 - DNA, 21 bp, Homo sapiens
tgtcttcatatgagatggtgt

SEQ ID NO: 9072283 - DNA, 22 bp, Homo sapiens
tgtcttcattctgtatgtccag

SEQ ID NO: 9072284 - DNA, 20 bp, Homo sapiens
tgtcttcattatggtgccct

SEQ ID NO: 9072285 - DNA, 20 bp, Homo sapiens
tgtcttcattatggtgccct

SEQ ID NO: 9072286 - DNA, 17 bp, Homo sapiens
tgtcttctgaagagagc

SEQ ID NO: 9072287 - DNA, 17 bp, Homo sapiens
tgtcttctgaagagagc

SEQ ID NO: 9072288 - DNA, 22 bp, Homo sapiens
tgtcttctaccttgacagcatt

SEQ ID NO: 9072289 - DNA, 22 bp, Homo sapiens
tgtcttcgctacaatgaaaagg

SEQ ID NO: 9072290 - DNA, 22 bp, Homo sapiens
tgtcttgactttagagccagga

SEQ ID NO: 9072291 - DNA, 22 bp, Homo sapiens
tgtcttcttcataaggagagtg

SEQ ID NO: 9072292 - DNA, 22 bp, Homo sapiens
tgtcttgattagaatgatgggc

SEQ ID NO: 9072293 - DNA, 22 bp, Homo sapiens
tgtctttaagcaaacagtgttt

SEQ ID NO: 9072294 - DNA, 22 bp, Homo sapiens
tgtcttaatttggatgatgttt

SEQ ID NO: 9072295 - DNA, 22 bp, Homo sapiens
tgtcttaacataaaaggaaatc

SEQ ID NO: 9072296 - DNA, 22 bp, Homo sapiens
tgtctgtggcaattgtgggtaa

SEQ ID NO: 9072297 - DNA, 22 bp, Homo sapiens
tgtctgtggcaattgtgggtaa

SEQ ID NO: 9072298 - DNA, 22 bp, Homo sapiens
tgtcttcagataggcattcttc

SEQ ID NO: 9072299 - DNA, 22 bp, Homo sapiens
tgtcttcagcaaatgcctttct

SEQ ID NO: 9072300 - DNA, 22 bp, Homo sapiens
tgtcttcagcagtcatctgggg

SEQ ID NO: 9072301 - DNA, 22 bp, Homo sapiens
tgtcttcactcaagtctcttgg

SEQ ID NO: 9072302 - DNA, 22 bp, Homo sapiens
tgtcttcaaatattgaaatcct

SEQ ID NO: 9072303 - DNA, 22 bp, Homo sapiens
tgtcttatgtagatactgagaa

SEQ ID NO: 9072304 - DNA, 22 bp, Homo sapiens
tgtcttcaaatattgaaatcct

SEQ ID NO: 9072305 - DNA, 22 bp, Homo sapiens
tgtcttattttgaagtgttcac

SEQ ID NO: 9072306 - DNA, 23 bp, Homo sapiens
tgtcttatctagcttctagaggc

SEQ ID NO: 9072307 - DNA, 22 bp, Homo sapiens
tgtctgctggttgggagcttaa

SEQ ID NO: 9072308 - DNA, 22 bp, Homo sapiens
tgtctgggagggacagggctac

SEQ ID NO: 9072309 - DNA, 23 bp, Homo sapiens
tgtctggctcatggtgggtctca

SEQ ID NO: 9072310 - DNA, 22 bp, Homo sapiens
tgtctggcatagttgctccctg

SEQ ID NO: 9072311 - DNA, 22 bp, Homo sapiens
tgtctggcatagttgctccctg

SEQ ID NO: 9072312 - DNA, 22 bp, Homo sapiens
tgtctgtgacagacctttgcta

SEQ ID NO: 9072313 - DNA, 22 bp, Homo sapiens
tgtctgcagaagatggcatggg

SEQ ID NO: 9072314 - DNA, 22 bp, Homo sapiens
tgtctgccaccccatcaagctc

SEQ ID NO: 9072315 - DNA, 22 bp, Homo sapiens
tgtctgccaaagcttcctcctg

SEQ ID NO: 9072316 - DNA, 22 bp, Homo sapiens
tgtctgagtggtgcaaggctga

SEQ ID NO: 9072317 - DNA, 22 bp, Homo sapiens
tgtctgatggggattgctcttc

SEQ ID NO: 9072318 - DNA, 22 bp, Homo sapiens
tgtctgatgatagtgtctctcc

SEQ ID NO: 9072319 - DNA, 22 bp, Homo sapiens
tgtctgcctgtctctgtgcaaa

SEQ ID NO: 9072320 - DNA, 21 bp, Homo sapiens
tgtctgcctgcttcttcactc

SEQ ID NO: 9072321 - DNA, 21 bp, Homo sapiens
tgtctgcctgcttcttcactc

SEQ ID NO: 9072322 - DNA, 22 bp, Homo sapiens
tgtctgccattagcccagtcca

SEQ ID NO: 9072323 - DNA, 22 bp, Homo sapiens
tgtctgcccattcatgggcaca

SEQ ID NO: 9072324 - DNA, 21 bp, Homo sapiens
tgtctgcccctgtttaccaga

SEQ ID NO: 9072325 - DNA, 22 bp, Homo sapiens
tgtctgcctgcgggccggcaca

SEQ ID NO: 9072326 - DNA, 22 bp, Homo sapiens
tgtctgccctcaacccagaggc

SEQ ID NO: 9072327 - DNA, 20 bp, Homo sapiens
tgtctgctcataataaaccc

SEQ ID NO: 9072328 - DNA, 22 bp, Homo sapiens
tgtctgctacttggttctacca

SEQ ID NO: 9072329 - DNA, 22 bp, Homo sapiens
tgtctgaggaagtcagcccttt

SEQ ID NO: 9072330 - DNA, 22 bp, Homo sapiens
tgtctgagtgcatatgtgctgg

SEQ ID NO: 9072331 - DNA, 22 bp, Homo sapiens
tgtctgaattttggaatcaagt

SEQ ID NO: 9072332 - DNA, 22 bp, Homo sapiens
tgtctgaatcgcttcctagagg

SEQ ID NO: 9072333 - DNA, 22 bp, Homo sapiens
tgtctgaaggcaggtggagaac

SEQ ID NO: 9072334 - DNA, 22 bp, Homo sapiens
tgtctgaatctcggtttcctca

SEQ ID NO: 9072335 - DNA, 22 bp, Homo sapiens
tgtctgaattcaagaaattcaa

SEQ ID NO: 9072336 - DNA, 22 bp, Homo sapiens
tgtctgaacaaactctgcctcc

SEQ ID NO: 9072337 - DNA, 22 bp, Homo sapiens
tgtctgaactgcactgaaagac

SEQ ID NO: 9072338 - DNA, 22 bp, Homo sapiens
tgtctgaacgaagtaggtccac

SEQ ID NO: 9072339 - DNA, 22 bp, Homo sapiens
tgtctgaagcagccagtgctgt

SEQ ID NO: 9072340 - DNA, 22 bp, Homo sapiens
tgtctgaagcagccagtgctgt

SEQ ID NO: 9072341 - DNA, 22 bp, Homo sapiens
tgtctctgaaatatgtggctcc

SEQ ID NO: 9072342 - DNA, 22 bp, Homo sapiens
tgtctctgaaatatgtggctcc

SEQ ID NO: 9072343 - DNA, 22 bp, Homo sapiens
tgtctctgaagccccctccttt

SEQ ID NO: 9072344 - DNA, 22 bp, Homo sapiens
tgtctctgaactgggttttctt

SEQ ID NO: 9072345 - DNA, 22 bp, Homo sapiens
tgtctctgaacagcttactaaa

SEQ ID NO: 9072346 - DNA, 19 bp, Homo sapiens
tgtctctgaaagatgagct

SEQ ID NO: 9072347 - DNA, 22 bp, Homo sapiens
tgtctctgataagtagttcagt

SEQ ID NO: 9072348 - DNA, 22 bp, Homo sapiens
tgtctctgataagtagttcagt

SEQ ID NO: 9072349 - DNA, 22 bp, Homo sapiens
tgtctctgctgcaccttctggg

SEQ ID NO: 9072350 - DNA, 22 bp, Homo sapiens
tgtctctgccagctagcagaat

SEQ ID NO: 9072351 - DNA, 18 bp, Homo sapiens
tgtctctgaattccagtg

SEQ ID NO: 9072352 - DNA, 22 bp, Homo sapiens
tgtctctgaggtgagggtcagc

SEQ ID NO: 9072353 - DNA, 22 bp, Homo sapiens
tgtctctgctgcaccttctggg

SEQ ID NO: 9072354 - DNA, 22 bp, Homo sapiens
tgtctctgctgcaccttctggg

SEQ ID NO: 9072355 - DNA, 22 bp, Homo sapiens
tgtctctgctttccttgcaggg

SEQ ID NO: 9072356 - DNA, 22 bp, Homo sapiens
tgtctctgctttccttgcaggg

SEQ ID NO: 9072357 - DNA, 22 bp, Homo sapiens
tgtctcttggctctatcactta

SEQ ID NO: 9072358 - DNA, 22 bp, Homo sapiens
tgtctctggcccatgagcagag

SEQ ID NO: 9072359 - DNA, 22 bp, Homo sapiens
tgtctcttggtgtccagaggag

SEQ ID NO: 9072360 - DNA, 22 bp, Homo sapiens
tgtctgaaacttggtcctatgc

SEQ ID NO: 9072361 - DNA, 22 bp, Homo sapiens
tgtctgaaagaggacgagctgg

SEQ ID NO: 9072362 - DNA, 22 bp, Homo sapiens
tgtctgaaacttggtcctatgc

SEQ ID NO: 9072363 - DNA, 20 bp, Homo sapiens
tgtctgaaaaggaagctatc

SEQ ID NO: 9072364 - DNA, 21 bp, Homo sapiens
tgtctcctgttggcacatggc

SEQ ID NO: 9072365 - DNA, 19 bp, Homo sapiens
tgtctcctcatgcaagtgt

SEQ ID NO: 9072366 - DNA, 22 bp, Homo sapiens
tgtctcctcatactgtcatatt

SEQ ID NO: 9072367 - DNA, 23 bp, Homo sapiens
tgtctaggatcagtcaggatgag

SEQ ID NO: 9072368 - DNA, 22 bp, Homo sapiens
tgtcgcagctgaaaatctcaat

SEQ ID NO: 9072369 - DNA, 22 bp, Homo sapiens
tgtctagggagctgctcaggct

SEQ ID NO: 9072370 - DNA, 22 bp, Homo sapiens
tgttgttttctcatggagaata

SEQ ID NO: 9072371 - DNA, 21 bp, Homo sapiens
tgttgttttatggctatgaat

SEQ ID NO: 9072372 - DNA, 22 bp, Homo sapiens
tgtttaagctgatgaggtatcg

SEQ ID NO: 9072373 - DNA, 22 bp, Homo sapiens
tgtttaaatagaacatactgca

SEQ ID NO: 9072374 - DNA, 22 bp, Homo sapiens
tgtttaaatagaacatactgca

SEQ ID NO: 9072375 - DNA, 22 bp, Homo sapiens
tgtttaaccaccattctattct

SEQ ID NO: 9072376 - DNA, 22 bp, Homo sapiens
tgtttaactagttttcacactt

SEQ ID NO: 9072377 - DNA, 20 bp, Homo sapiens
tgttgggatgaagttaacct

SEQ ID NO: 9072378 - DNA, 22 bp, Homo sapiens
tgttgattagtgtttagactta

SEQ ID NO: 9072379 - DNA, 22 bp, Homo sapiens
tgttgggaagctctgccagggg

SEQ ID NO: 9072380 - DNA, 22 bp, Homo sapiens
tgttgtactcaacagatgaatt

SEQ ID NO: 9072381 - DNA, 22 bp, Homo sapiens
tgttggtgaagtctctctgctg

SEQ ID NO: 9072382 - DNA, 22 bp, Homo sapiens
tgttgactcaacactgtgggca

SEQ ID NO: 9072383 - DNA, 22 bp, Homo sapiens
tgttcttttctctaaactgata

SEQ ID NO: 9072384 - DNA, 22 bp, Homo sapiens
tgtttattgctgcaattgtgcc

SEQ ID NO: 9072385 - DNA, 22 bp, Homo sapiens
tgtttataccttggtataacca

SEQ ID NO: 9072386 - DNA, 22 bp, Homo sapiens
tgtttattcatggctaatgaaa

SEQ ID NO: 9072387 - DNA, 22 bp, Homo sapiens
tgttctttggcttcacagctct

SEQ ID NO: 9072388 - DNA, 22 bp, Homo sapiens
tgttctttgctgttgatgtaga

SEQ ID NO: 9072389 - DNA, 22 bp, Homo sapiens
tgttcttgagcctttagaccta

SEQ ID NO: 9072390 - DNA, 22 bp, Homo sapiens
tgttcttgagcctttagaccta

SEQ ID NO: 9072391 - DNA, 22 bp, Homo sapiens
tgttctttcagttagacacagt

SEQ ID NO: 9072392 - DNA, 22 bp, Homo sapiens
tgttaggcccatctctgaaggt

SEQ ID NO: 9072393 - DNA, 22 bp, Homo sapiens
tgttagtattggcaaatttgtt

SEQ ID NO: 9072394 - DNA, 22 bp, Homo sapiens
tgttcttaacttttgtgtatat

SEQ ID NO: 9072395 - DNA, 22 bp, Homo sapiens
tgttcttagcaggagcatctat

SEQ ID NO: 9072396 - DNA, 22 bp, Homo sapiens
tgttcttagcaggagcatctat

SEQ ID NO: 9072397 - DNA, 22 bp, Homo sapiens
tgttcttaggtatttgacagtc

SEQ ID NO: 9072398 - DNA, 22 bp, Homo sapiens
tgttaagagagtttctaatatt

SEQ ID NO: 9072399 - DNA, 22 bp, Homo sapiens
tgttacagtggctttttaaaca

SEQ ID NO: 9072400 - DNA, 22 bp, Homo sapiens
tgttacagtggctttttaaaca

SEQ ID NO: 9072401 - DNA, 22 bp, Homo sapiens
tgttactgatttgatatacagt

SEQ ID NO: 9072402 - DNA, 22 bp, Homo sapiens
tgttacttcttggtaaaggaga

SEQ ID NO: 9072403 - DNA, 22 bp, Homo sapiens
tgttaaattgattcacctttct

SEQ ID NO: 9072404 - DNA, 22 bp, Homo sapiens
tgttaacatactgctttctaat

SEQ ID NO: 9072405 - DNA, 22 bp, Homo sapiens
tgttaacaataagtccaggcat

SEQ ID NO: 9072406 - DNA, 22 bp, Homo sapiens
tgttaaatgtattatgtgttct

SEQ ID NO: 9072407 - DNA, 22 bp, Homo sapiens
tgttaaatgtattatgtgttct

SEQ ID NO: 9072408 - DNA, 22 bp, Homo sapiens
tgttaaatgttcctttactgga

SEQ ID NO: 9072409 - DNA, 18 bp, Homo sapiens
tgttaaatgaagatttgc

SEQ ID NO: 9072410 - DNA, 22 bp, Homo sapiens
tgttaaatgagattggaatttg

SEQ ID NO: 9072411 - DNA, 22 bp, Homo sapiens
tgttaaatgagattggaatttg

SEQ ID NO: 9072412 - DNA, 22 bp, Homo sapiens
tgtttttgtctccttgtctgct

SEQ ID NO: 9072413 - DNA, 22 bp, Homo sapiens
tgtttttccatgtgcagaacaa

SEQ ID NO: 9072414 - DNA, 22 bp, Homo sapiens
tgttttatttctccaagaggga

SEQ ID NO: 9072415 - DNA, 22 bp, Homo sapiens
tgttttatataagcagagcggt

SEQ ID NO: 9072416 - DNA, 22 bp, Homo sapiens
tgttttatgagccatataacct

SEQ ID NO: 9072417 - DNA, 22 bp, Homo sapiens
tgttttatcaagatggcatgtc

SEQ ID NO: 9072418 - DNA, 23 bp, Homo sapiens
tgtttgtttctatgagagatagc

SEQ ID NO: 9072419 - DNA, 22 bp, Homo sapiens
tgttttaagctctagaagggga

SEQ ID NO: 9072420 - DNA, 22 bp, Homo sapiens
tgttttaagagcgcactttata

SEQ ID NO: 9072421 - DNA, 22 bp, Homo sapiens
tgttttaatctcccattgctct

SEQ ID NO: 9072422 - DNA, 22 bp, Homo sapiens
tgttttaagggtcaactgtcac

SEQ ID NO: 9072423 - DNA, 22 bp, Homo sapiens
tgtttgttccctctctttcctg

SEQ ID NO: 9072424 - DNA, 20 bp, Homo sapiens
tgtttgtgtggggccttggc

SEQ ID NO: 9072425 - DNA, 20 bp, Homo sapiens
tgtttgtgtggggccttggc

SEQ ID NO: 9072426 - DNA, 22 bp, Homo sapiens
tgtttgtggaatattctttaag

SEQ ID NO: 9072427 - DNA, 20 bp, Homo sapiens
tgtttgtgccagctttgtca

SEQ ID NO: 9072428 - DNA, 22 bp, Homo sapiens
tgtttgcattaattagaaggta

SEQ ID NO: 9072429 - DNA, 22 bp, Homo sapiens
tgtttgcattgttaattcagtc

SEQ ID NO: 9072430 - DNA, 22 bp, Homo sapiens
ttaaacagacagtaaatgaaac

SEQ ID NO: 9072431 - DNA, 22 bp, Homo sapiens
ttaaaccatagtttaacataag

SEQ ID NO: 9072432 - DNA, 22 bp, Homo sapiens
ttaaaccacaaggcaagttttg

SEQ ID NO: 9072433 - DNA, 22 bp, Homo sapiens
ttaaaatttccccaccatgtat

SEQ ID NO: 9072434 - DNA, 22 bp, Homo sapiens
ttaaaattatggcccatttgga

SEQ ID NO: 9072435 - DNA, 22 bp, Homo sapiens
ttaaaaccatcagctgtaagat

SEQ ID NO: 9072436 - DNA, 22 bp, Homo sapiens
ttaaaacagcgtgaatctggca

SEQ ID NO: 9072437 - DNA, 22 bp, Homo sapiens
ttaaaagaatcctgttatcctc

SEQ ID NO: 9072438 - DNA, 22 bp, Homo sapiens
ttaaaagagacttcctttgttt

SEQ ID NO: 9072439 - DNA, 22 bp, Homo sapiens
ttaaaagacctgttgaggttag

SEQ ID NO: 9072440 - DNA, 22 bp, Homo sapiens
ttaaaagagacttcctttgttt

SEQ ID NO: 9072441 - DNA, 22 bp, Homo sapiens
ttaaaatgcagattatgactca

SEQ ID NO: 9072442 - DNA, 22 bp, Homo sapiens
ttaaaatgcagattatgactca

SEQ ID NO: 9072443 - DNA, 22 bp, Homo sapiens
ttaaaaaccatcttcctttcct

SEQ ID NO: 9072444 - DNA, 20 bp, Homo sapiens
ttaaaaagagtcacaggaga

SEQ ID NO: 9072445 - DNA, 20 bp, Homo sapiens
ttaaaaagagtcacaggaga

SEQ ID NO: 9072446 - DNA, 17 bp, Homo sapiens
tgttttttccctgttct

SEQ ID NO: 9072447 - DNA, 22 bp, Homo sapiens
ttaaaaaccatcttcctttcct

SEQ ID NO: 9072448 - DNA, 22 bp, Homo sapiens
tgtttttttatatacctgaagt

SEQ ID NO: 9072449 - DNA, 22 bp, Homo sapiens
tgtgtacaggccttgctagact

SEQ ID NO: 9072450 - DNA, 22 bp, Homo sapiens
tgtggggactgagtggaggctt

SEQ ID NO: 9072451 - DNA, 22 bp, Homo sapiens
tgtggggaagagtatgacttgg

SEQ ID NO: 9072452 - DNA, 22 bp, Homo sapiens
tgtgtacacaatgattgcagag

SEQ ID NO: 9072453 - DNA, 22 bp, Homo sapiens
tgtgggaggtctggaaggctcc

SEQ ID NO: 9072454 - DNA, 22 bp, Homo sapiens
tgtgggaggtctggaaggctcc

SEQ ID NO: 9072455 - DNA, 22 bp, Homo sapiens
tgtgggcaggagcacaagtcag

SEQ ID NO: 9072456 - DNA, 22 bp, Homo sapiens
tgtgggatggttttgccagaat

SEQ ID NO: 9072457 - DNA, 22 bp, Homo sapiens
tgtgggcaggcccgggtctgag

SEQ ID NO: 9072458 - DNA, 22 bp, Homo sapiens
tgtgggctccccctcactctgt

SEQ ID NO: 9072459 - DNA, 22 bp, Homo sapiens
tgtggaagtgccaatgacaaat

SEQ ID NO: 9072460 - DNA, 22 bp, Homo sapiens
tgtggaagaaacaagacacttt

SEQ ID NO: 9072461 - DNA, 22 bp, Homo sapiens
tgtggaatgctcctaagtgaat

SEQ ID NO: 9072462 - DNA, 22 bp, Homo sapiens
tgtggaatgctcctaagtgaat

SEQ ID NO: 9072463 - DNA, 22 bp, Homo sapiens
tgtggccttgcagcctggaggt

SEQ ID NO: 9072464 - DNA, 22 bp, Homo sapiens
tgtggctcaggcggcttctcct

SEQ ID NO: 9072465 - DNA, 22 bp, Homo sapiens
tgtggctcggccagctgctgaa

SEQ ID NO: 9072466 - DNA, 22 bp, Homo sapiens
tgtggctctcctcctgctgccc

SEQ ID NO: 9072467 - DNA, 22 bp, Homo sapiens
tgtggctgactcctggtcccca

SEQ ID NO: 9072468 - DNA, 21 bp, Homo sapiens
tgtggctgacaccctttggga

SEQ ID NO: 9072469 - DNA, 23 bp, Homo sapiens
tgtggctgagaaattgacaactt

SEQ ID NO: 9072470 - DNA, 22 bp, Homo sapiens
tgtggctgactcctggtcccca

SEQ ID NO: 9072471 - DNA, 22 bp, Homo sapiens
tgtggctgatcaaagcgctcag

SEQ ID NO: 9072472 - DNA, 19 bp, Homo sapiens
tgtggctgagcactcctta

SEQ ID NO: 9072473 - DNA, 22 bp, Homo sapiens
tgtgggaggaacacagccagaa

SEQ ID NO: 9072474 - DNA, 22 bp, Homo sapiens
tgtgggagaaggaagcaagctg

SEQ ID NO: 9072475 - DNA, 22 bp, Homo sapiens
tgtgggacagggacagcaagag

SEQ ID NO: 9072476 - DNA, 22 bp, Homo sapiens
tgtggctgccaccctgaagccg

SEQ ID NO: 9072477 - DNA, 22 bp, Homo sapiens
tgtgggaagatgttgcaggaga

SEQ ID NO: 9072478 - DNA, 22 bp, Homo sapiens
tgtggctgcaaaggaaggctgc

SEQ ID NO: 9072479 - DNA, 22 bp, Homo sapiens
tgtggctgcaggcgatggagga

SEQ ID NO: 9072480 - DNA, 22 bp, Homo sapiens
tgtggctgcaggcgatggagga

SEQ ID NO: 9072481 - DNA, 22 bp, Homo sapiens
tgtggctgcagacactggagcc

SEQ ID NO: 9072482 - DNA, 21 bp, Homo sapiens
tgtgtcactaactagaggcta

SEQ ID NO: 9072483 - DNA, 22 bp, Homo sapiens
tgtgtcagaggtagagatggca

SEQ ID NO: 9072484 - DNA, 22 bp, Homo sapiens
tgtgtgcatgttaatgagaaaa

SEQ ID NO: 9072485 - DNA, 22 bp, Homo sapiens
tgtgtgccagcctacgaggagc

SEQ ID NO: 9072486 - DNA, 22 bp, Homo sapiens
tgtgtgcctgagccgtgcctgg

SEQ ID NO: 9072487 - DNA, 22 bp, Homo sapiens
tgtgtgctaatgtatgctctaa

SEQ ID NO: 9072488 - DNA, 21 bp, Homo sapiens
tgtgtgggcatatctgctgca

SEQ ID NO: 9072489 - DNA, 22 bp, Homo sapiens
tgtgtgggagcacgggctgttg

SEQ ID NO: 9072490 - DNA, 22 bp, Homo sapiens
tgtgtggcaagctgtatgctag

SEQ ID NO: 9072491 - DNA, 22 bp, Homo sapiens
tgtgtgtgagtcctggctttcc

SEQ ID NO: 9072492 - DNA, 22 bp, Homo sapiens
tgtgtgtgactcatactagaac

SEQ ID NO: 9072493 - DNA, 22 bp, Homo sapiens
tgtgtgtgcacatgcatataca

SEQ ID NO: 9072494 - DNA, 22 bp, Homo sapiens
tgtgtgtgcacatgcatataca

SEQ ID NO: 9072495 - DNA, 22 bp, Homo sapiens
tgtgtgtgaaccattgagggct

SEQ ID NO: 9072496 - DNA, 22 bp, Homo sapiens
tgtgtgtgaaccattgagggct

SEQ ID NO: 9072497 - DNA, 22 bp, Homo sapiens
tgtgtgtgtaaaagcatttata

SEQ ID NO: 9072498 - DNA, 20 bp, Homo sapiens
tgtgtgtgtacttctaaata

SEQ ID NO: 9072499 - DNA, 20 bp, Homo sapiens
tgtgtgtgtacttctaaata

SEQ ID NO: 9072500 - DNA, 23 bp, Homo sapiens
tgtgtgtgtattctacgcaaggt

SEQ ID NO: 9072501 - DNA, 22 bp, Homo sapiens
tgtgtgtgtcctcatttgcaga

SEQ ID NO: 9072502 - DNA, 22 bp, Homo sapiens
tgtgtgtgtgcgcgcacgcata

SEQ ID NO: 9072503 - DNA, 22 bp, Homo sapiens
tgtgtgtgttcctcctcagcta

SEQ ID NO: 9072504 - DNA, 22 bp, Homo sapiens
tgtgtgtgcaggagagcaggtg

SEQ ID NO: 9072505 - DNA, 22 bp, Homo sapiens
tgtgtgtgcacgtgcgcgcgag

SEQ ID NO: 9072506 - DNA, 22 bp, Homo sapiens
tgtgtgtggggaggcagcagat

SEQ ID NO: 9072507 - DNA, 22 bp, Homo sapiens
tgtgtgtgtaaaagcatttata

SEQ ID NO: 9072508 - DNA, 22 bp, Homo sapiens
tgtgtgtgggcggaacggcccc

SEQ ID NO: 9072509 - DNA, 22 bp, Homo sapiens
tgttaaaaattcagctctagat

SEQ ID NO: 9072510 - DNA, 22 bp, Homo sapiens
tgttaaaaattcagctctagat

SEQ ID NO: 9072511 - DNA, 22 bp, Homo sapiens
tgttaaactgtattgcataagg

SEQ ID NO: 9072512 - DNA, 19 bp, Homo sapiens
tgtgtgtttatatatgtat

SEQ ID NO: 9072513 - DNA, 22 bp, Homo sapiens
tgtgtgtgtttctgctcataca

SEQ ID NO: 9072514 - DNA, 22 bp, Homo sapiens
tgtgtgtgtttctgctcataca

SEQ ID NO: 9072515 - DNA, 22 bp, Homo sapiens
tgtgtgtgtttacagtttctca

SEQ ID NO: 9072516 - DNA, 22 bp, Homo sapiens
tgtgtgtgtttacagtttctca

SEQ ID NO: 9072517 - DNA, 22 bp, Homo sapiens
tgtgtgtgtttctgctcataca

SEQ ID NO: 9072518 - DNA, 22 bp, Homo sapiens
tgtgtgtgtttataaatctaaa

SEQ ID NO: 9072519 - DNA, 22 bp, Homo sapiens
tgtgtgtgtttataaatctaaa

SEQ ID NO: 9072520 - DNA, 22 bp, Homo sapiens
ttcaggaaatttgtgtcacagg

SEQ ID NO: 9072521 - DNA, 22 bp, Homo sapiens
ttcaggaaatgtctgcctacca

SEQ ID NO: 9072522 - DNA, 22 bp, Homo sapiens
ttcaggaaattggagtccttct

SEQ ID NO: 9072523 - DNA, 22 bp, Homo sapiens
ttcaggaaattggagtccttct

SEQ ID NO: 9072524 - DNA, 22 bp, Homo sapiens
ttcaggaagcctttcttggtct

SEQ ID NO: 9072525 - DNA, 22 bp, Homo sapiens
ttcaggaagcctttcttggtct

SEQ ID NO: 9072526 - DNA, 22 bp, Homo sapiens
ttcaggaaggtcctatagcaga

SEQ ID NO: 9072527 - DNA, 20 bp, Homo sapiens
ttcaggaataagatagcagc

SEQ ID NO: 9072528 - DNA, 22 bp, Homo sapiens
ttcaggaagtgctgcctggtgt

SEQ ID NO: 9072529 - DNA, 22 bp, Homo sapiens
ttcagcttgaatctggctttga

SEQ ID NO: 9072530 - DNA, 22 bp, Homo sapiens
ttcagctagcatctcacttggt

SEQ ID NO: 9072531 - DNA, 22 bp, Homo sapiens
ttcagcttcatttgtctttatg

SEQ ID NO: 9072532 - DNA, 21 bp, Homo sapiens
ttcagcttatgtgtcacttgc

SEQ ID NO: 9072533 - DNA, 22 bp, Homo sapiens
ttcagccagtcatcagtcttgt

SEQ ID NO: 9072534 - DNA, 22 bp, Homo sapiens
ttcactgaagtttcttccatgt

SEQ ID NO: 9072535 - DNA, 22 bp, Homo sapiens
ttcacctgtgttttgtggctga

SEQ ID NO: 9072536 - DNA, 22 bp, Homo sapiens
ttcacgttgttgaagaaaatac

SEQ ID NO: 9072537 - DNA, 22 bp, Homo sapiens
ttcactagcaacattacaagaa

SEQ ID NO: 9072538 - DNA, 19 bp, Homo sapiens
ttcactaattgtaagattt

SEQ ID NO: 9072539 - DNA, 22 bp, Homo sapiens
ttcaccattacatacaaagatg

SEQ ID NO: 9072540 - DNA, 22 bp, Homo sapiens
ttcaccctggaccagaaattgg

SEQ ID NO: 9072541 - DNA, 22 bp, Homo sapiens
ttcagcagcttttagtacattg

SEQ ID NO: 9072542 - DNA, 19 bp, Homo sapiens
ttcagcaggctgaagcttc

SEQ ID NO: 9072543 - DNA, 22 bp, Homo sapiens
ttcagcaggtggtgagttctgc

SEQ ID NO: 9072544 - DNA, 17 bp, Homo sapiens
ttcagcagtgtttctcc

SEQ ID NO: 9072545 - DNA, 22 bp, Homo sapiens
ttcagcagtcgtccaggaaaag

SEQ ID NO: 9072546 - DNA, 22 bp, Homo sapiens
ttcagcagtgcagacacccagt

SEQ ID NO: 9072547 - DNA, 21 bp, Homo sapiens
ttcagcagtcctctagagata

SEQ ID NO: 9072548 - DNA, 22 bp, Homo sapiens
ttcagcagtcgtccaggaaaag

SEQ ID NO: 9072549 - DNA, 22 bp, Homo sapiens
ttcacatttactggtttgtccg

SEQ ID NO: 9072550 - DNA, 22 bp, Homo sapiens
ttcacattgttttaatgtgaat

SEQ ID NO: 9072551 - DNA, 22 bp, Homo sapiens
ttcacattgtgcagattatggt

SEQ ID NO: 9072552 - DNA, 22 bp, Homo sapiens
ttcacattggtgatatgtttct

SEQ ID NO: 9072553 - DNA, 19 bp, Homo sapiens
ttcacattggaagaagtag

SEQ ID NO: 9072554 - DNA, 22 bp, Homo sapiens
ttcacatttgaaaggaaagata

SEQ ID NO: 9072555 - DNA, 20 bp, Homo sapiens
ttcacatttctgtagtgatt

SEQ ID NO: 9072556 - DNA, 22 bp, Homo sapiens
ttcacatttctctgctgtttga

SEQ ID NO: 9072557 - DNA, 22 bp, Homo sapiens
ttcaccagaggttagaatattt

SEQ ID NO: 9072558 - DNA, 22 bp, Homo sapiens
ttcaccagaggttagaatattt

SEQ ID NO: 9072559 - DNA, 20 bp, Homo sapiens
ttatttctcattctcctact

SEQ ID NO: 9072560 - DNA, 22 bp, Homo sapiens
ttatttgcccatgtttagcaga

SEQ ID NO: 9072561 - DNA, 22 bp, Homo sapiens
ttatttgtatcaaggacggttg

SEQ ID NO: 9072562 - DNA, 22 bp, Homo sapiens
ttatttgtgaatcatttatcta

SEQ ID NO: 9072563 - DNA, 22 bp, Homo sapiens
ttatttgtaaggcagggccagt

SEQ ID NO: 9072564 - DNA, 22 bp, Homo sapiens
ttatttgtaaaggtccatagta

SEQ ID NO: 9072565 - DNA, 22 bp, Homo sapiens
ttccagccatggtttccctatg

SEQ ID NO: 9072566 - DNA, 22 bp, Homo sapiens
ttccagcccgcgacttgttcag

SEQ ID NO: 9072567 - DNA, 22 bp, Homo sapiens
ttccagcccgcgacttgttcag

SEQ ID NO: 9072568 - DNA, 20 bp, Homo sapiens
ttccagccgccacttccgcc

SEQ ID NO: 9072569 - DNA, 22 bp, Homo sapiens
ttccagccagatttgctgggtt

SEQ ID NO: 9072570 - DNA, 22 bp, Homo sapiens
ttccagccactttatactgcta

SEQ ID NO: 9072571 - DNA, 22 bp, Homo sapiens
ttccagcctttatccatccaga

SEQ ID NO: 9072572 - DNA, 17 bp, Homo sapiens
ttccagcatgttactaa

SEQ ID NO: 9072573 - DNA, 22 bp, Homo sapiens
ttccagcaggcagacaggagat

SEQ ID NO: 9072574 - DNA, 22 bp, Homo sapiens
ttccagcagcgtgggagaagta

SEQ ID NO: 9072575 - DNA, 22 bp, Homo sapiens
ttccagcacagaagtatacatt

SEQ ID NO: 9072576 - DNA, 22 bp, Homo sapiens
ttccagatatttttatgtggaa

SEQ ID NO: 9072577 - DNA, 22 bp, Homo sapiens
ttccagatgtttaagttctgct

SEQ ID NO: 9072578 - DNA, 22 bp, Homo sapiens
ttccagagtgactgtgccactt

SEQ ID NO: 9072579 - DNA, 22 bp, Homo sapiens
ttccagagtctggttccatggt

SEQ ID NO: 9072580 - DNA, 23 bp, Homo sapiens
ttccagagtccacatctgccacc

SEQ ID NO: 9072581 - DNA, 22 bp, Homo sapiens
ttccagaggttctcagccctgt

SEQ ID NO: 9072582 - DNA, 22 bp, Homo sapiens
ttccagcttagagcatcatgtt

SEQ ID NO: 9072583 - DNA, 22 bp, Homo sapiens
ttcattcatgtattgtctatgg

SEQ ID NO: 9072584 - DNA, 22 bp, Homo sapiens
ttcattcattcatgaatgttaa

SEQ ID NO: 9072585 - DNA, 23 bp, Homo sapiens
ttccagaggaagaagtcatgact

SEQ ID NO: 9072586 - DNA, 23 bp, Homo sapiens
ttccagaggaagaagtcatgact

SEQ ID NO: 9072587 - DNA, 22 bp, Homo sapiens
ttccagaggagtgattcagagg

SEQ ID NO: 9072588 - DNA, 22 bp, Homo sapiens
ttccagaggagtgattcagagg

SEQ ID NO: 9072589 - DNA, 23 bp, Homo sapiens
ttcattgagctgttcttgaggat

SEQ ID NO: 9072590 - DNA, 22 bp, Homo sapiens
ttcaggaatcaaccaagtcatt

SEQ ID NO: 9072591 - DNA, 22 bp, Homo sapiens
ttcaggaatataggcattgaca

SEQ ID NO: 9072592 - DNA, 22 bp, Homo sapiens
ttcaggaataattatcatatga

SEQ ID NO: 9072593 - DNA, 23 bp, Homo sapiens
ttcattcaaaaggaaaagtcatg

SEQ ID NO: 9072594 - DNA, 22 bp, Homo sapiens
ttcattacttaggcaggcattt

SEQ ID NO: 9072595 - DNA, 22 bp, Homo sapiens
ttcattaattcattcagtgact

SEQ ID NO: 9072596 - DNA, 22 bp, Homo sapiens
ttcattactgaattctcactac

SEQ ID NO: 9072597 - DNA, 22 bp, Homo sapiens
ttcattaagtataaaatgtggt

SEQ ID NO: 9072598 - DNA, 22 bp, Homo sapiens
ttcattcatctctaaaatgcct

SEQ ID NO: 9072599 - DNA, 22 bp, Homo sapiens
ttattcttcttctcttgccagg

SEQ ID NO: 9072600 - DNA, 22 bp, Homo sapiens
ttatttatggccctcacctgat

SEQ ID NO: 9072601 - DNA, 22 bp, Homo sapiens
ttatttatggccctcacctgat

SEQ ID NO: 9072602 - DNA, 22 bp, Homo sapiens
ttattattgattcgctctcaaa

SEQ ID NO: 9072603 - DNA, 22 bp, Homo sapiens
ttatgacagaaatgaaaagctg

SEQ ID NO: 9072604 - DNA, 22 bp, Homo sapiens
ttatgacaggaaaatcacagaa

SEQ ID NO: 9072605 - DNA, 19 bp, Homo sapiens
ttatgaatagcttcatcca

SEQ ID NO: 9072606 - DNA, 22 bp, Homo sapiens
ttatgaaagacatttctgttgg

SEQ ID NO: 9072607 - DNA, 22 bp, Homo sapiens
ttatgacatatgagtacaagta

SEQ ID NO: 9072608 - DNA, 22 bp, Homo sapiens
ttatgatttgccacagattggt

SEQ ID NO: 9072609 - DNA, 22 bp, Homo sapiens
ttattattccccaagtcattat

SEQ ID NO: 9072610 - DNA, 22 bp, Homo sapiens
ttattattccccaagtcattat

SEQ ID NO: 9072611 - DNA, 22 bp, Homo sapiens
ttatatgtatgcttataaacca

SEQ ID NO: 9072612 - DNA, 22 bp, Homo sapiens
ttagtgcaattcagagaacaat

SEQ ID NO: 9072613 - DNA, 22 bp, Homo sapiens
ttagtgcaaacctcagagacac

SEQ ID NO: 9072614 - DNA, 22 bp, Homo sapiens
ttagtcttctcatagtaaaact

SEQ ID NO: 9072615 - DNA, 22 bp, Homo sapiens
ttagtcacttcttccttcatca

SEQ ID NO: 9072616 - DNA, 22 bp, Homo sapiens
ttagtcaatagtgaatatagag

SEQ ID NO: 9072617 - DNA, 22 bp, Homo sapiens
ttagtcaaatcattctgtttct

SEQ ID NO: 9072618 - DNA, 22 bp, Homo sapiens
ttagtaaataaagtctactttc

SEQ ID NO: 9072619 - DNA, 22 bp, Homo sapiens
ttagtacaagagattaattact

SEQ ID NO: 9072620 - DNA, 22 bp, Homo sapiens
ttagtaattagaaagtaattct

SEQ ID NO: 9072621 - DNA, 22 bp, Homo sapiens
ttagtacaagagattaattact

SEQ ID NO: 9072622 - DNA, 22 bp, Homo sapiens
ttagtacattgattcattatgt

SEQ ID NO: 9072623 - DNA, 22 bp, Homo sapiens
ttagtacattcactgtggtagg

SEQ ID NO: 9072624 - DNA, 22 bp, Homo sapiens
ttagggttacaccagcctcctg

SEQ ID NO: 9072625 - DNA, 22 bp, Homo sapiens
ttagggttacaccagcctcctg

SEQ ID NO: 9072626 - DNA, 22 bp, Homo sapiens
ttagggttacaccagcctcctg

SEQ ID NO: 9072627 - DNA, 22 bp, Homo sapiens
ttagcatttctggaatcacaag

SEQ ID NO: 9072628 - DNA, 22 bp, Homo sapiens
ttaggaaattatggtttcagat

SEQ ID NO: 9072629 - DNA, 22 bp, Homo sapiens
ttagcatttcatttcaagagga

SEQ ID NO: 9072630 - DNA, 22 bp, Homo sapiens
ttaggaaattccacctgtattc

SEQ ID NO: 9072631 - DNA, 22 bp, Homo sapiens
ttagggagctcagtcctcagat

SEQ ID NO: 9072632 - DNA, 22 bp, Homo sapiens
ttagggaaggacagtgaagaaa

SEQ ID NO: 9072633 - DNA, 22 bp, Homo sapiens
ttagcagcaatggcatcaacta

SEQ ID NO: 9072634 - DNA, 22 bp, Homo sapiens
ttagcagcaatggcatcaacta

SEQ ID NO: 9072635 - DNA, 22 bp, Homo sapiens
ttagcaaacctggactacagat

SEQ ID NO: 9072636 - DNA, 22 bp, Homo sapiens
ttagcagcggtcagttttgaag

SEQ ID NO: 9072637 - DNA, 22 bp, Homo sapiens
ttagcagcatccctggcctgta

SEQ ID NO: 9072638 - DNA, 22 bp, Homo sapiens
ttagcagctaaactgacagacc

SEQ ID NO: 9072639 - DNA, 22 bp, Homo sapiens
ttagcagctaagtcatgctgca

SEQ ID NO: 9072640 - DNA, 22 bp, Homo sapiens
ttagcagctaagtcatgctgca

SEQ ID NO: 9072641 - DNA, 22 bp, Homo sapiens
ttagcagcttttaaatggttct

SEQ ID NO: 9072642 - DNA, 22 bp, Homo sapiens
ttagcagcttagactgcctggg

SEQ ID NO: 9072643 - DNA, 22 bp, Homo sapiens
ttagcagcttttaaatggttct

SEQ ID NO: 9072644 - DNA, 22 bp, Homo sapiens
ttagcattctcatttgcataaa

SEQ ID NO: 9072645 - DNA, 22 bp, Homo sapiens
ttagcattctgcctcctatatc

SEQ ID NO: 9072646 - DNA, 22 bp, Homo sapiens
ttacattttgcacagatgtccc

SEQ ID NO: 9072647 - DNA, 22 bp, Homo sapiens
ttagaaatacaagtgaggttga

SEQ ID NO: 9072648 - DNA, 22 bp, Homo sapiens
ttagaaatacaagtgaggttga

SEQ ID NO: 9072649 - DNA, 22 bp, Homo sapiens
ttagaaaggagcttatttcttt

SEQ ID NO: 9072650 - DNA, 22 bp, Homo sapiens
ttagaaaggttttgctctgaaa

SEQ ID NO: 9072651 - DNA, 22 bp, Homo sapiens
ttagaaaggggtgaatcaatgg

SEQ ID NO: 9072652 - DNA, 22 bp, Homo sapiens
ttagaaatcacctctgaagatc

SEQ ID NO: 9072653 - DNA, 22 bp, Homo sapiens
ttagaaatcacctctgaagatc

SEQ ID NO: 9072654 - DNA, 22 bp, Homo sapiens
ttagaaatgtcacagatctgat

SEQ ID NO: 9072655 - DNA, 22 bp, Homo sapiens
ttagaaatgtcacagatctgat

SEQ ID NO: 9072656 - DNA, 22 bp, Homo sapiens
ttagaaatgtcacagatctgat

SEQ ID NO: 9072657 - DNA, 22 bp, Homo sapiens
ttagataatgttattgtaattt

SEQ ID NO: 9072658 - DNA, 22 bp, Homo sapiens
ttagataatgtagagatatgag

SEQ ID NO: 9072659 - DNA, 22 bp, Homo sapiens
ttagataacagtagaatatcaa

SEQ ID NO: 9072660 - DNA, 22 bp, Homo sapiens
ttagaacttaagaatactgtct

SEQ ID NO: 9072661 - DNA, 22 bp, Homo sapiens
ttagatacctttgtgttgtaga

SEQ ID NO: 9072662 - DNA, 22 bp, Homo sapiens
ttagaacactgagaaagtgatg

SEQ ID NO: 9072663 - DNA, 22 bp, Homo sapiens
ttagaacagtagaagaaagggt

SEQ ID NO: 9072664 - DNA, 22 bp, Homo sapiens
ttagaacatagcaacagaatta

SEQ ID NO: 9072665 - DNA, 22 bp, Homo sapiens
ttacatgatgatttcataaaca

SEQ ID NO: 9072666 - DNA, 22 bp, Homo sapiens
ttacatgcaggtcagactgcat

SEQ ID NO: 9072667 - DNA, 22 bp, Homo sapiens
ttacatgcttagagatgcatgc

SEQ ID NO: 9072668 - DNA, 22 bp, Homo sapiens
ttacatgggccatttagacatg

SEQ ID NO: 9072669 - DNA, 21 bp, Homo sapiens
ttacatggacatggaggcctt

SEQ ID NO: 9072670 - DNA, 22 bp, Homo sapiens
ttacatggatgtaaaaaagtta

SEQ ID NO: 9072671 - DNA, 22 bp, Homo sapiens
ttacatggtaaacactctttta

SEQ ID NO: 9072672 - DNA, 22 bp, Homo sapiens
ttacatgggcttgtgagtcctt

SEQ ID NO: 9072673 - DNA, 22 bp, Homo sapiens
ttacagcagtgggaaggagtca

SEQ ID NO: 9072674 - DNA, 22 bp, Homo sapiens
ttacagcagcagggacagacta

SEQ ID NO: 9072675 - DNA, 22 bp, Homo sapiens
ttacatgactcaatagaagggc

SEQ ID NO: 9072676 - DNA, 22 bp, Homo sapiens
ttacagcacagtgcttttactg

SEQ ID NO: 9072677 - DNA, 17 bp, Homo sapiens
ttacagcagcaatagag

SEQ ID NO: 9072678 - DNA, 22 bp, Homo sapiens
ttacagcaaagtgcgcagacct

SEQ ID NO: 9072679 - DNA, 22 bp, Homo sapiens
ttacagattcaagctctttgaa

SEQ ID NO: 9072680 - DNA, 19 bp, Homo sapiens
ttacagatgtggaaattga

SEQ ID NO: 9072681 - DNA, 22 bp, Homo sapiens
ttacagatgtttcaggaatact

SEQ ID NO: 9072682 - DNA, 22 bp, Homo sapiens
ttacagatcatcaaggtataat

SEQ ID NO: 9072683 - DNA, 22 bp, Homo sapiens
ttacatgttctcatacacagag

SEQ ID NO: 9072684 - DNA, 22 bp, Homo sapiens
ttacatgttctcatacacagag

SEQ ID NO: 9072685 - DNA, 22 bp, Homo sapiens
ttacatggtgccccgatggtac

SEQ ID NO: 9072686 - DNA, 23 bp, Homo sapiens
ttacatggtagtcaaagctaaag

SEQ ID NO: 9072687 - DNA, 22 bp, Homo sapiens
ttacatggttgttggaaatgct

SEQ ID NO: 9072688 - DNA, 21 bp, Homo sapiens
ttacatggtttatcatatgga

SEQ ID NO: 9072689 - DNA, 22 bp, Homo sapiens
ttacatggtttatttacctaag

SEQ ID NO: 9072690 - DNA, 22 bp, Homo sapiens
ttacatgtggtgtgaagaagag

SEQ ID NO: 9072691 - DNA, 22 bp, Homo sapiens
ttacattttagttaacctgtga

SEQ ID NO: 9072692 - DNA, 22 bp, Homo sapiens
ttacatttggctatgtcctcta

SEQ ID NO: 9072693 - DNA, 22 bp, Homo sapiens
ttacattcagaaagatttgagt

SEQ ID NO: 9072694 - DNA, 21 bp, Homo sapiens
ttacattcagaggagtggaag

SEQ ID NO: 9072695 - DNA, 22 bp, Homo sapiens
ttacattcaatttctagaggta

SEQ ID NO: 9072696 - DNA, 22 bp, Homo sapiens
ttacattcaaggaactcattct

SEQ ID NO: 9072697 - DNA, 22 bp, Homo sapiens
ttacattcttatctcagttatt

SEQ ID NO: 9072698 - DNA, 22 bp, Homo sapiens
ttacattcttggaatcttgttt

SEQ ID NO: 9072699 - DNA, 22 bp, Homo sapiens
ttacattcttggaatcttgttt

SEQ ID NO: 9072700 - DNA, 22 bp, Homo sapiens
ttacattcattgaagtgattca

SEQ ID NO: 9072701 - DNA, 22 bp, Homo sapiens
ttacattcccagtgtgcagcat

SEQ ID NO: 9072702 - DNA, 22 bp, Homo sapiens
ttacagaaaagggctttaagag

SEQ ID NO: 9072703 - DNA, 22 bp, Homo sapiens
ttacagaaaagggctttaagag

SEQ ID NO: 9072704 - DNA, 22 bp, Homo sapiens
ttacagatacatttcttttgtt

SEQ ID NO: 9072705 - DNA, 22 bp, Homo sapiens
ttacagatactttgtaggcaag

SEQ ID NO: 9072706 - DNA, 22 bp, Homo sapiens
ttacagatactttgtaggcaag

SEQ ID NO: 9072707 - DNA, 22 bp, Homo sapiens
ttacagagctcatttctaaggg

SEQ ID NO: 9072708 - DNA, 22 bp, Homo sapiens
ttacagacaaactgtgttaagt

SEQ ID NO: 9072709 - DNA, 22 bp, Homo sapiens
ttacaagatatgtgagaactag

SEQ ID NO: 9072710 - DNA, 22 bp, Homo sapiens
ttacaagatctttgaaggcaag

SEQ ID NO: 9072711 - DNA, 22 bp, Homo sapiens
ttacaagattgatttgcttggc

SEQ ID NO: 9072712 - DNA, 22 bp, Homo sapiens
ttacaagattgatttgcttggc

SEQ ID NO: 9072713 - DNA, 22 bp, Homo sapiens
ttacaagatgggaaagggaagt

SEQ ID NO: 9072714 - DNA, 22 bp, Homo sapiens
ttacaagattaattattggagt

SEQ ID NO: 9072715 - DNA, 22 bp, Homo sapiens
ttacaagacactgctgacacag

SEQ ID NO: 9072716 - DNA, 22 bp, Homo sapiens
ttacaagacagtgtggtaaata

SEQ ID NO: 9072717 - DNA, 22 bp, Homo sapiens
ttacaagataacctgatgctgt

SEQ ID NO: 9072718 - DNA, 22 bp, Homo sapiens
ttacaagataacggagaaagca

SEQ ID NO: 9072719 - DNA, 22 bp, Homo sapiens
ttacaagataacctgatgctgt

SEQ ID NO: 9072720 - DNA, 22 bp, Homo sapiens
ttacaatgtaaggcatggttct

SEQ ID NO: 9072721 - DNA, 19 bp, Homo sapiens
ttacaatggtgattaggtt

SEQ ID NO: 9072722 - DNA, 22 bp, Homo sapiens
ttacaattgagtctattgtatg

SEQ ID NO: 9072723 - DNA, 22 bp, Homo sapiens
ttacaattgagtctattgtatg

SEQ ID NO: 9072724 - DNA, 22 bp, Homo sapiens
ttacaagacacagtgctgaagg

SEQ ID NO: 9072725 - DNA, 23 bp, Homo sapiens
ttacaactatttgccatgttgtt

SEQ ID NO: 9072726 - DNA, 21 bp, Homo sapiens
ttacaacatttgtgttctatg

SEQ ID NO: 9072727 - DNA, 23 bp, Homo sapiens
ttacaacagtgtccatatttgta

SEQ ID NO: 9072728 - DNA, 22 bp, Homo sapiens
ttacaacatatgataggagtct

SEQ ID NO: 9072729 - DNA, 22 bp, Homo sapiens
ttacaacatatgataggagtct

SEQ ID NO: 9072730 - DNA, 22 bp, Homo sapiens
ttacaacaccaggcagtatcct

SEQ ID NO: 9072731 - DNA, 22 bp, Homo sapiens
ttacaacagcgatttacctgtc

SEQ ID NO: 9072732 - DNA, 22 bp, Homo sapiens
ttacaacagacacatattctaa

SEQ ID NO: 9072733 - DNA, 22 bp, Homo sapiens
ttacaacaaaggcacgtgcatg

SEQ ID NO: 9072734 - DNA, 22 bp, Homo sapiens
ttacaacaaaggcacgtgcatg

SEQ ID NO: 9072735 - DNA, 22 bp, Homo sapiens
ttacaacaaaggcacgtgcatg

SEQ ID NO: 9072736 - DNA, 17 bp, Homo sapiens
ttacaacaattcatgag

SEQ ID NO: 9072737 - DNA, 22 bp, Homo sapiens
ttacaacaaaggcacgtgcatg

SEQ ID NO: 9072738 - DNA, 17 bp, Homo sapiens
ttacaacaattcatgag

SEQ ID NO: 9072739 - DNA, 22 bp, Homo sapiens
ttaattaagagatactgcagta

SEQ ID NO: 9072740 - DNA, 22 bp, Homo sapiens
ttacaaagagaagttgtagaat

SEQ ID NO: 9072741 - DNA, 20 bp, Homo sapiens
ttacaaagaggcatcgcttt

SEQ ID NO: 9072742 - DNA, 22 bp, Homo sapiens
ttaattaaattcatgagcattg

SEQ ID NO: 9072743 - DNA, 22 bp, Homo sapiens
ttaattaactagccaaccacta

SEQ ID NO: 9072744 - DNA, 21 bp, Homo sapiens
ttacaaagctacagatgttgc

SEQ ID NO: 9072745 - DNA, 22 bp, Homo sapiens
ttacaaagtgctgcaccatttt

SEQ ID NO: 9072746 - DNA, 22 bp, Homo sapiens
ttacaaaggtagttttgtctat

SEQ ID NO: 9072747 - DNA, 22 bp, Homo sapiens
ttacaaagttctgagttcaaac

SEQ ID NO: 9072748 - DNA, 22 bp, Homo sapiens
ttaataagtagtagttattgtt

SEQ ID NO: 9072749 - DNA, 22 bp, Homo sapiens
ttaataagtagtagttattgtt

SEQ ID NO: 9072750 - DNA, 22 bp, Homo sapiens
ttaatacaactgttgtcactgg

SEQ ID NO: 9072751 - DNA, 22 bp, Homo sapiens
ttaatacaagcatatgcacaca

SEQ ID NO: 9072752 - DNA, 22 bp, Homo sapiens
ttaatacaagcatatgcacaca

SEQ ID NO: 9072753 - DNA, 22 bp, Homo sapiens
ttaatacaagcatatgcacaca

SEQ ID NO: 9072754 - DNA, 22 bp, Homo sapiens
ttaatgtatggggttgagatga

SEQ ID NO: 9072755 - DNA, 22 bp, Homo sapiens
ttaatacagtctccagaagtaa

SEQ ID NO: 9072756 - DNA, 22 bp, Homo sapiens
ttaatacagaagcaagacactg

SEQ ID NO: 9072757 - DNA, 22 bp, Homo sapiens
ttaatacagtctccagaagtaa

SEQ ID NO: 9072758 - DNA, 22 bp, Homo sapiens
ttaaactatagcttgatgtgaa

SEQ ID NO: 9072759 - DNA, 23 bp, Homo sapiens
ttaaacttcagtgcagaacactc

SEQ ID NO: 9072760 - DNA, 22 bp, Homo sapiens
ttaaagagaactcaatgaatga

SEQ ID NO: 9072761 - DNA, 22 bp, Homo sapiens
ttaaagaggcatgggaatgtat

SEQ ID NO: 9072762 - DNA, 22 bp, Homo sapiens
ttaaagaggtagttaggtttaa

SEQ ID NO: 9072763 - DNA, 22 bp, Homo sapiens
ttaaagatgcagctttagagaa

SEQ ID NO: 9072764 - DNA, 22 bp, Homo sapiens
ttaaagatgcagctttagagaa

SEQ ID NO: 9072765 - DNA, 22 bp, Homo sapiens
ttaaagattctgaggctgatta

SEQ ID NO: 9072766 - DNA, 22 bp, Homo sapiens
ttaaagcacctccttggatgtg

SEQ ID NO: 9072767 - DNA, 22 bp, Homo sapiens
ttaaagcaaaaactaggatgga

SEQ ID NO: 9072768 - DNA, 22 bp, Homo sapiens
ttaaagcaaccatcaatttgga

SEQ ID NO: 9072769 - DNA, 22 bp, Homo sapiens
ttaaagcagtttgtatacatgg

SEQ ID NO: 9072770 - DNA, 22 bp, Homo sapiens
ttaaagcaggcatcattcctca

SEQ ID NO: 9072771 - DNA, 22 bp, Homo sapiens
ttaaagcactaaatgatgaggg

SEQ ID NO: 9072772 - DNA, 22 bp, Homo sapiens
ttaataaagtatgaattggaaa

SEQ ID NO: 9072773 - DNA, 22 bp, Homo sapiens
ttaataaagtatgaattggaaa

SEQ ID NO: 9072774 - DNA, 22 bp, Homo sapiens
ttaataaagtatgaattggaaa

SEQ ID NO: 9072775 - DNA, 22 bp, Homo sapiens
tggtcaatgaagatacactatt

SEQ ID NO: 9072776 - DNA, 22 bp, Homo sapiens
tggtcaacaacattgactggat

SEQ ID NO: 9072777 - DNA, 22 bp, Homo sapiens
tggtcaaagctgcggtcagcaa

SEQ ID NO: 9072778 - DNA, 22 bp, Homo sapiens
tggtatttccaggcttatggta

SEQ ID NO: 9072779 - DNA, 22 bp, Homo sapiens
tggtatcagagccatctgtatt

SEQ ID NO: 9072780 - DNA, 22 bp, Homo sapiens
tgggttctagagggaccagaac

SEQ ID NO: 9072781 - DNA, 22 bp, Homo sapiens
tgggttctttcacttctcagtt

SEQ ID NO: 9072782 - DNA, 22 bp, Homo sapiens
tggtaaaaaccgcaattacatt

SEQ ID NO: 9072783 - DNA, 22 bp, Homo sapiens
tgggttggtcagcataagatgg

SEQ ID NO: 9072784 - DNA, 19 bp, Homo sapiens
tgggttggaagggaatgaa

SEQ ID NO: 9072785 - DNA, 22 bp, Homo sapiens
tggtaaaaactgcaattacttt

SEQ ID NO: 9072786 - DNA, 22 bp, Homo sapiens
tggtaaggggtggaaccagagc

SEQ ID NO: 9072787 - DNA, 16 bp, Homo sapiens
tgggtgggaggagcgg

SEQ ID NO: 9072788 - DNA, 16 bp, Homo sapiens
tgggtgggaggagcgg

SEQ ID NO: 9072789 - DNA, 22 bp, Homo sapiens
tgggtgggagcgccctgtctgg

SEQ ID NO: 9072790 - DNA, 22 bp, Homo sapiens
tgggtgggagcgccctgtctgg

SEQ ID NO: 9072791 - DNA, 21 bp, Homo sapiens
tgggtgggcagagtctcttca

SEQ ID NO: 9072792 - DNA, 21 bp, Homo sapiens
tgggtgggcagagtctcttca

SEQ ID NO: 9072793 - DNA, 22 bp, Homo sapiens
tgggtgaggagaggctgtctaa

SEQ ID NO: 9072794 - DNA, 20 bp, Homo sapiens
tgggtgagagtgtttgctct

SEQ ID NO: 9072795 - DNA, 22 bp, Homo sapiens
tgggtgaggatgatgaggcagc

SEQ ID NO: 9072796 - DNA, 22 bp, Homo sapiens
tgggtgaggatgatgaggcagc

SEQ ID NO: 9072797 - DNA, 22 bp, Homo sapiens
tgggtgaggatgatgaggcagc

SEQ ID NO: 9072798 - DNA, 22 bp, Homo sapiens
tgggtgaggatgatgaggcagc

SEQ ID NO: 9072799 - DNA, 22 bp, Homo sapiens
tgggtgagggacaaaagtttct

SEQ ID NO: 9072800 - DNA, 22 bp, Homo sapiens
tgggtgctctgcgaccgtaggg

SEQ ID NO: 9072801 - DNA, 22 bp, Homo sapiens
tgggtgcttcgtcagctctgag

SEQ ID NO: 9072802 - DNA, 22 bp, Homo sapiens
tgggtgcttcgtcagctctgag

SEQ ID NO: 9072803 - DNA, 22 bp, Homo sapiens
tgggtgggagcgccctgtctgg

SEQ ID NO: 9072804 - DNA, 22 bp, Homo sapiens
tgggtggaataaatcagttctg

SEQ ID NO: 9072805 - DNA, 22 bp, Homo sapiens
tgggtgccaacctctggtggcc

SEQ ID NO: 9072806 - DNA, 20 bp, Homo sapiens
tgggtgcctgccacggggcc

SEQ ID NO: 9072807 - DNA, 20 bp, Homo sapiens
tgggtgcctgccacggggcc

SEQ ID NO: 9072808 - DNA, 22 bp, Homo sapiens
tgggtgcaggtcttgtgccagg

SEQ ID NO: 9072809 - DNA, 21 bp, Homo sapiens
tgggtccccgacacgctacct

SEQ ID NO: 9072810 - DNA, 22 bp, Homo sapiens
tgggtcccaggaaggaccagca

SEQ ID NO: 9072811 - DNA, 22 bp, Homo sapiens
tgggtcccaaactcctagaggt

SEQ ID NO: 9072812 - DNA, 22 bp, Homo sapiens
tgggtcccaatctgaaatgtca

SEQ ID NO: 9072813 - DNA, 22 bp, Homo sapiens
tgggtcctcgtcttccaaggca

SEQ ID NO: 9072814 - DNA, 22 bp, Homo sapiens
tgggtccctcatgagaggcatt

SEQ ID NO: 9072815 - DNA, 22 bp, Homo sapiens
tgggtcctaaatgcagtcacat

SEQ ID NO: 9072816 - DNA, 22 bp, Homo sapiens
tgggtccctcatgagaggcatt

SEQ ID NO: 9072817 - DNA, 20 bp, Homo sapiens
tgggtccctgcagtttgaag

SEQ ID NO: 9072818 - DNA, 22 bp, Homo sapiens
tgggtccctctggagtagtaca

SEQ ID NO: 9072819 - DNA, 22 bp, Homo sapiens
tgggtcccttcagctctcatgg

SEQ ID NO: 9072820 - DNA, 22 bp, Homo sapiens
tgggtcctggctttgtcagggt

SEQ ID NO: 9072821 - DNA, 22 bp, Homo sapiens
tgggtcctggaaggcgacaggt

SEQ ID NO: 9072822 - DNA, 22 bp, Homo sapiens
tgggtcctgcactgcaagcacc

SEQ ID NO: 9072823 - DNA, 20 bp, Homo sapiens
tgggtcctgcttcttcctga

SEQ ID NO: 9072824 - DNA, 20 bp, Homo sapiens
tgggtcctgcacattctcca

SEQ ID NO: 9072825 - DNA, 22 bp, Homo sapiens
tgggtcctctgagagggcagcg

SEQ ID NO: 9072826 - DNA, 22 bp, Homo sapiens
tgggtcctctggagcagcagca

SEQ ID NO: 9072827 - DNA, 22 bp, Homo sapiens
tgggtccttgctgattgctgag

SEQ ID NO: 9072828 - DNA, 22 bp, Homo sapiens
tgggtccttgctggcttcaaag

SEQ ID NO: 9072829 - DNA, 22 bp, Homo sapiens
tgggtctccagttcagggcagg

SEQ ID NO: 9072830 - DNA, 22 bp, Homo sapiens
tgggtcctttttggacttcttc

SEQ ID NO: 9072831 - DNA, 22 bp, Homo sapiens
tgggtccttcaaagctgggtct

SEQ ID NO: 9072832 - DNA, 22 bp, Homo sapiens
tgggtccttgccatcttggagt

SEQ ID NO: 9072833 - DNA, 22 bp, Homo sapiens
tgggtccttgctaacttctatg

SEQ ID NO: 9072834 - DNA, 22 bp, Homo sapiens
tgggtcctgtctccttgttctg

SEQ ID NO: 9072835 - DNA, 20 bp, Homo sapiens
tgggtcctgtgggagaagaa

SEQ ID NO: 9072836 - DNA, 23 bp, Homo sapiens
tgggtctctagtacaggcaggca

SEQ ID NO: 9072837 - DNA, 20 bp, Homo sapiens
tgggtctgcttggcttcagt

SEQ ID NO: 9072838 - DNA, 22 bp, Homo sapiens
tgggtctttatgggggccagga

SEQ ID NO: 9072839 - DNA, 22 bp, Homo sapiens
tgggtgaaaattttggtggcac

SEQ ID NO: 9072840 - DNA, 22 bp, Homo sapiens
tgggtctgtagggctgtccaat

SEQ ID NO: 9072841 - DNA, 22 bp, Homo sapiens
tgggtaggggacgtggaagaaa

SEQ ID NO: 9072842 - DNA, 22 bp, Homo sapiens
tgggtaggggacgtggaagaaa

SEQ ID NO: 9072843 - DNA, 22 bp, Homo sapiens
tgggtagggacttagctggctg

SEQ ID NO: 9072844 - DNA, 22 bp, Homo sapiens
tgggtagggagctggaatccta

SEQ ID NO: 9072845 - DNA, 22 bp, Homo sapiens
tgggtaggaatcgagtgtatgg

SEQ ID NO: 9072846 - DNA, 22 bp, Homo sapiens
tgggtaaaatgagttaggagaa

SEQ ID NO: 9072847 - DNA, 22 bp, Homo sapiens
tgggtaaggtactgtagatctg

SEQ ID NO: 9072848 - DNA, 22 bp, Homo sapiens
tgggtaaggtactgtagatctg

SEQ ID NO: 9072849 - DNA, 22 bp, Homo sapiens
tgggtaagtggaggacaaagta

SEQ ID NO: 9072850 - DNA, 22 bp, Homo sapiens
tgggtaagaattgggggctctg

SEQ ID NO: 9072851 - DNA, 22 bp, Homo sapiens
tgggtaaactgggtctggagag

SEQ ID NO: 9072852 - DNA, 23 bp, Homo sapiens
tggggttgaattgtagctgtgcc

SEQ ID NO: 9072853 - DNA, 23 bp, Homo sapiens
tggggttgaattgtagctgtgcc

SEQ ID NO: 9072854 - DNA, 23 bp, Homo sapiens
tgggtagagctgcaaggacactg

SEQ ID NO: 9072855 - DNA, 22 bp, Homo sapiens
tgggtagagtggagggataaga

SEQ ID NO: 9072856 - DNA, 22 bp, Homo sapiens
tggggtctggagttgcccatga

SEQ ID NO: 9072857 - DNA, 22 bp, Homo sapiens
tggggtcgagggttctctggca

SEQ ID NO: 9072858 - DNA, 23 bp, Homo sapiens
tgggggtgcacgggccacatctt

SEQ ID NO: 9072859 - DNA, 22 bp, Homo sapiens
tgggggtgctgagaagacagga

SEQ ID NO: 9072860 - DNA, 22 bp, Homo sapiens
tgggggtgccctatgaggaagc

SEQ ID NO: 9072861 - DNA, 22 bp, Homo sapiens
tggggggcacttcagcacaatg

SEQ ID NO: 9072862 - DNA, 22 bp, Homo sapiens
tgggggctgtgcacaggctcac

SEQ ID NO: 9072863 - DNA, 22 bp, Homo sapiens
tgggggtgaaagtctggacagt

SEQ ID NO: 9072864 - DNA, 21 bp, Homo sapiens
tgggggtgaggcctaggaatc

SEQ ID NO: 9072865 - DNA, 22 bp, Homo sapiens
tggggtggaacccttctgctgg

SEQ ID NO: 9072866 - DNA, 22 bp, Homo sapiens
tggggtgctttcttgcctgtac

SEQ ID NO: 9072867 - DNA, 22 bp, Homo sapiens
tgggggctgagtaagatgagat

SEQ ID NO: 9072868 - DNA, 22 bp, Homo sapiens
tgggggctccaggctccaggga

SEQ ID NO: 9072869 - DNA, 22 bp, Homo sapiens
tgggggctccaggctccaggga

SEQ ID NO: 9072870 - DNA, 22 bp, Homo sapiens
tgggggctagaacccagggatt

SEQ ID NO: 9072871 - DNA, 17 bp, Homo sapiens
tgggggcgccagggtct

SEQ ID NO: 9072872 - DNA, 22 bp, Homo sapiens
tgggggcatggaccagcctggc

SEQ ID NO: 9072873 - DNA, 22 bp, Homo sapiens
tgggggcagccaggctgtcaag

SEQ ID NO: 9072874 - DNA, 22 bp, Homo sapiens
tgggggcagaggattcaggaat

SEQ ID NO: 9072875 - DNA, 22 bp, Homo sapiens
tgggggcagccaggctgtcaag

SEQ ID NO: 9072876 - DNA, 22 bp, Homo sapiens
tgggggagcgacagacataatt

SEQ ID NO: 9072877 - DNA, 22 bp, Homo sapiens
tgggggagccttcacagtagct

SEQ ID NO: 9072878 - DNA, 22 bp, Homo sapiens
tgggggagctcagtccagccca

SEQ ID NO: 9072879 - DNA, 22 bp, Homo sapiens
tgggggcacttcgaggtcgcct

SEQ ID NO: 9072880 - DNA, 22 bp, Homo sapiens
tgggggcacttcgaggtcgcct

SEQ ID NO: 9072881 - DNA, 22 bp, Homo sapiens
tgggggcacttcgaggtcgcct

SEQ ID NO: 9072882 - DNA, 22 bp, Homo sapiens
tggggctggggatcttgagcct

SEQ ID NO: 9072883 - DNA, 22 bp, Homo sapiens
tggggctgtcccggtttggcga

SEQ ID NO: 9072884 - DNA, 22 bp, Homo sapiens
tggggctggctattgtctccct

SEQ ID NO: 9072885 - DNA, 22 bp, Homo sapiens
tggggctggcacagtctctatt

SEQ ID NO: 9072886 - DNA, 23 bp, Homo sapiens
tggggctctggcaggcctgaggt

SEQ ID NO: 9072887 - DNA, 22 bp, Homo sapiens
tggggctggcacagtctctatt

SEQ ID NO: 9072888 - DNA, 20 bp, Homo sapiens
tggggcctgtttctgtggtt

SEQ ID NO: 9072889 - DNA, 22 bp, Homo sapiens
tggggcctgaggtggagctgca

SEQ ID NO: 9072890 - DNA, 22 bp, Homo sapiens
tggggcagcagacctttcttgg

SEQ ID NO: 9072891 - DNA, 22 bp, Homo sapiens
tggggcagcagacctttcttgg

SEQ ID NO: 9072892 - DNA, 22 bp, Homo sapiens
tggggccagggaggaccagaca

SEQ ID NO: 9072893 - DNA, 22 bp, Homo sapiens
tggggccaggtggctgcaggtc

SEQ ID NO: 9072894 - DNA, 19 bp, Homo sapiens
tggggcctcctgtccctgg

SEQ ID NO: 9072895 - DNA, 19 bp, Homo sapiens
tggggcctcctgtccctgg

SEQ ID NO: 9072896 - DNA, 22 bp, Homo sapiens
tggggcctgaaaggttctcgcc

SEQ ID NO: 9072897 - DNA, 22 bp, Homo sapiens
tggggccatctcacccactgtt

SEQ ID NO: 9072898 - DNA, 19 bp, Homo sapiens
tggggatgctgatgaccaa

SEQ ID NO: 9072899 - DNA, 22 bp, Homo sapiens
tggggatgaaacccaggcatct

SEQ ID NO: 9072900 - DNA, 22 bp, Homo sapiens
tggggatgtaaatgaggtgata

SEQ ID NO: 9072901 - DNA, 22 bp, Homo sapiens
tggggatgtaaatgaggtgata

SEQ ID NO: 9072902 - DNA, 17 bp, Homo sapiens
tggggatggttcatgag

SEQ ID NO: 9072903 - DNA, 22 bp, Homo sapiens
tggggagtgatgcctcggataa

SEQ ID NO: 9072904 - DNA, 22 bp, Homo sapiens
tggggaggttcgggaatcttgt

SEQ ID NO: 9072905 - DNA, 22 bp, Homo sapiens
tggggaggttcgggaatcttgt

SEQ ID NO: 9072906 - DNA, 22 bp, Homo sapiens
tggggaggtaacaatttcaggc

SEQ ID NO: 9072907 - DNA, 21 bp, Homo sapiens
tggggaggggacctgattatg

SEQ ID NO: 9072908 - DNA, 23 bp, Homo sapiens
tggggagggaagtcatttctgta

SEQ ID NO: 9072909 - DNA, 23 bp, Homo sapiens
tggggagggaagtcatttctgta

SEQ ID NO: 9072910 - DNA, 22 bp, Homo sapiens
tggggaggatatgtgagttatt

SEQ ID NO: 9072911 - DNA, 22 bp, Homo sapiens
tggggaggaagtcagatttcag

SEQ ID NO: 9072912 - DNA, 22 bp, Homo sapiens
tggggacagggctcagcaattt

SEQ ID NO: 9072913 - DNA, 22 bp, Homo sapiens
tggggacaggagacttacagct

SEQ ID NO: 9072914 - DNA, 22 bp, Homo sapiens
tggggacaggagacttacagct

SEQ ID NO: 9072915 - DNA, 22 bp, Homo sapiens
tggggacagggctcagcaattt

SEQ ID NO: 9072916 - DNA, 22 bp, Homo sapiens
tggggacatagccagtctggct

SEQ ID NO: 9072917 - DNA, 22 bp, Homo sapiens
tggggacattcatgcaggttgt

SEQ ID NO: 9072918 - DNA, 22 bp, Homo sapiens
tggggacattcatgcaggttgt

SEQ ID NO: 9072919 - DNA, 22 bp, Homo sapiens
tggggaagggcaccctggagac

SEQ ID NO: 9072920 - DNA, 22 bp, Homo sapiens
tggggacacagaggttcgttgg

SEQ ID NO: 9072921 - DNA, 22 bp, Homo sapiens
tggggaaggcggagcttgcagc

SEQ ID NO: 9072922 - DNA, 22 bp, Homo sapiens
tggggaaggcggagcttgcagc

SEQ ID NO: 9072923 - DNA, 17 bp, Homo sapiens
tggggaagctcagattt

SEQ ID NO: 9072924 - DNA, 22 bp, Homo sapiens
tgggctttgagctcggtcacct

SEQ ID NO: 9072925 - DNA, 18 bp, Homo sapiens
tgggcttgaaagcaaggt

SEQ ID NO: 9072926 - DNA, 18 bp, Homo sapiens
tgggcttgaaagcaaggt

SEQ ID NO: 9072927 - DNA, 22 bp, Homo sapiens
tgggcttctggagtggggcaga

SEQ ID NO: 9072928 - DNA, 22 bp, Homo sapiens
tgggcttctggagtggggcaga

SEQ ID NO: 9072929 - DNA, 22 bp, Homo sapiens
tgggcttggtttctaggtaggt

SEQ ID NO: 9072930 - DNA, 22 bp, Homo sapiens
tgggctttatcatgggtctggt

SEQ ID NO: 9072931 - DNA, 22 bp, Homo sapiens
tgggcttcataattggtcctag

SEQ ID NO: 9072932 - DNA, 22 bp, Homo sapiens
tgggcttcctggagcctgtgct

SEQ ID NO: 9072933 - DNA, 23 bp, Homo sapiens
tgggcttctgagaaagcacctaa

SEQ ID NO: 9072934 - DNA, 19 bp, Homo sapiens
tgggcttccccagggcaga

SEQ ID NO: 9072935 - DNA, 22 bp, Homo sapiens
tgggcttcctggagcctgtgct

SEQ ID NO: 9072936 - DNA, 22 bp, Homo sapiens
tgggcttcctggagcctgtgct

SEQ ID NO: 9072937 - DNA, 22 bp, Homo sapiens
tgggctggctgaggcattcact

SEQ ID NO: 9072938 - DNA, 22 bp, Homo sapiens
tgggctggctgaggcattcact

SEQ ID NO: 9072939 - DNA, 22 bp, Homo sapiens
tgggctggctgaacttcaacct

SEQ ID NO: 9072940 - DNA, 22 bp, Homo sapiens
tgggctggctgaacttcaacct

SEQ ID NO: 9072941 - DNA, 22 bp, Homo sapiens
tgggcctcctgccctggcctag

SEQ ID NO: 9072942 - DNA, 22 bp, Homo sapiens
tgggcctcctgccctggcctag

SEQ ID NO: 9072943 - DNA, 22 bp, Homo sapiens
tgggcctcctgccctggcctag

SEQ ID NO: 9072944 - DNA, 22 bp, Homo sapiens
tgggcctccgcatggcccagcg

SEQ ID NO: 9072945 - DNA, 22 bp, Homo sapiens
tgggcctcctccgacagccggg

SEQ ID NO: 9072946 - DNA, 22 bp, Homo sapiens
tgggcctcatgcccagccaccc

SEQ ID NO: 9072947 - DNA, 22 bp, Homo sapiens
tgggcctcatgcccagccaccc

SEQ ID NO: 9072948 - DNA, 22 bp, Homo sapiens
tgggcctcatcttcaatgagtc

SEQ ID NO: 9072949 - DNA, 21 bp, Homo sapiens
tgggcctcaggcagctgtgac

SEQ ID NO: 9072950 - DNA, 19 bp, Homo sapiens
tgggcctcacaatgctccc

SEQ ID NO: 9072951 - DNA, 22 bp, Homo sapiens
tgggccagttctttactcgtcc

SEQ ID NO: 9072952 - DNA, 17 bp, Homo sapiens
tgggccagtagaaggga

SEQ ID NO: 9072953 - DNA, 22 bp, Homo sapiens
tgggccaggtctgtgtcagctg

SEQ ID NO: 9072954 - DNA, 22 bp, Homo sapiens
tgggccagggcacccagtccag

SEQ ID NO: 9072955 - DNA, 22 bp, Homo sapiens
tgggccaggcatgtgatcagca

SEQ ID NO: 9072956 - DNA, 22 bp, Homo sapiens
tgggccaggcatgtgatcagca

SEQ ID NO: 9072957 - DNA, 22 bp, Homo sapiens
tgggccagggcacccagtccag

SEQ ID NO: 9072958 - DNA, 23 bp, Homo sapiens
tgggccagggagtccggtttctt

SEQ ID NO: 9072959 - DNA, 22 bp, Homo sapiens
tgggcctcggggaagcccgtgt

SEQ ID NO: 9072960 - DNA, 22 bp, Homo sapiens
tgggcctcggggaagcccgtgt

SEQ ID NO: 9072961 - DNA, 22 bp, Homo sapiens
tgggcctcggagcacaggagac

SEQ ID NO: 9072962 - DNA, 22 bp, Homo sapiens
tgggcctcggagcacaggagac

SEQ ID NO: 9072963 - DNA, 22 bp, Homo sapiens
tgggcctctgggttagtcccta

SEQ ID NO: 9072964 - DNA, 23 bp, Homo sapiens
tgggcctctccacccttttctgt

SEQ ID NO: 9072965 - DNA, 22 bp, Homo sapiens
tgggcctctgccacgctccccc

SEQ ID NO: 9072966 - DNA, 20 bp, Homo sapiens
tgggcctctggtgcctctgg

SEQ ID NO: 9072967 - DNA, 20 bp, Homo sapiens
tgggcctctggtgcctctgg

SEQ ID NO: 9072968 - DNA, 22 bp, Homo sapiens
tgggcctctgtttcctcatctg

SEQ ID NO: 9072969 - DNA, 22 bp, Homo sapiens
tgggcctctgtttcctcatctg

SEQ ID NO: 9072970 - DNA, 22 bp, Homo sapiens
tgggcctgaaggagctgcgccc

SEQ ID NO: 9072971 - DNA, 22 bp, Homo sapiens
tgggcctgaaggagctgcgccc

SEQ ID NO: 9072972 - DNA, 22 bp, Homo sapiens
tgggcctgaaattcccatttta

SEQ ID NO: 9072973 - DNA, 22 bp, Homo sapiens
tgggcctgagctcaccaggggc

SEQ ID NO: 9072974 - DNA, 20 bp, Homo sapiens
tgggcctgagcctgtgggct

SEQ ID NO: 9072975 - DNA, 22 bp, Homo sapiens
tgggcctgagtttgggaactgg

SEQ ID NO: 9072976 - DNA, 22 bp, Homo sapiens
tgggcctgagtttgggaactgg

SEQ ID NO: 9072977 - DNA, 22 bp, Homo sapiens
tgggcctgacacttactaggga

SEQ ID NO: 9072978 - DNA, 22 bp, Homo sapiens
tgggcctgactcacctgcctcc

SEQ ID NO: 9072979 - DNA, 22 bp, Homo sapiens
tgggcctgactcacctgcctcc

SEQ ID NO: 9072980 - DNA, 22 bp, Homo sapiens
tgggcctgactcacctgcctcc

SEQ ID NO: 9072981 - DNA, 20 bp, Homo sapiens
tgggcctgagcctgtgggct

SEQ ID NO: 9072982 - DNA, 22 bp, Homo sapiens
tgggcctgattcttgaatcctg

SEQ ID NO: 9072983 - DNA, 22 bp, Homo sapiens
tgggcctgatttatcatcttca

SEQ ID NO: 9072984 - DNA, 18 bp, Homo sapiens
tgggcctgcatcctagtc

SEQ ID NO: 9072985 - DNA, 18 bp, Homo sapiens
tgggcctgcatcctagtc

SEQ ID NO: 9072986 - DNA, 22 bp, Homo sapiens
tgggcctgattcttgaatcctg

SEQ ID NO: 9072987 - DNA, 21 bp, Homo sapiens
tgggcctgattcccagggtca

SEQ ID NO: 9072988 - DNA, 21 bp, Homo sapiens
tgggcctgattcccagggtca

SEQ ID NO: 9072989 - DNA, 19 bp, Homo sapiens
tgggcctgcatctgggtct

SEQ ID NO: 9072990 - DNA, 19 bp, Homo sapiens
tgggcctgcatctgggtct

SEQ ID NO: 9072991 - DNA, 22 bp, Homo sapiens
tgggcctgccccaggcttcagc

SEQ ID NO: 9072992 - DNA, 22 bp, Homo sapiens
tgggcctgccccaggcttcagc

SEQ ID NO: 9072993 - DNA, 22 bp, Homo sapiens
tgggcctgccccaggcttcagc

SEQ ID NO: 9072994 - DNA, 22 bp, Homo sapiens
tgggcctgccccaggcttcagc

SEQ ID NO: 9072995 - DNA, 22 bp, Homo sapiens
tgggcctgccccaggcttcagc

SEQ ID NO: 9072996 - DNA, 23 bp, Homo sapiens
tgggcctggaaagccttagagag

SEQ ID NO: 9072997 - DNA, 23 bp, Homo sapiens
tgggcctggaaagccttagagag

SEQ ID NO: 9072998 - DNA, 22 bp, Homo sapiens
tgggcctgctggggcattttca

SEQ ID NO: 9072999 - DNA, 22 bp, Homo sapiens
tgggcctgggctcctgtcctct

SEQ ID NO: 9073000 - DNA, 22 bp, Homo sapiens
tgggcctgggctcctgtcctct

SEQ ID NO: 9073001 - DNA, 22 bp, Homo sapiens
tgggcctgggctggacagcctg

SEQ ID NO: 9073002 - DNA, 22 bp, Homo sapiens
tgggcctgggctggacagcctg

SEQ ID NO: 9073003 - DNA, 22 bp, Homo sapiens
tgggcctgggctcctgtcctct

SEQ ID NO: 9073004 - DNA, 22 bp, Homo sapiens
tgggcctgggtctttgctgcca

SEQ ID NO: 9073005 - DNA, 22 bp, Homo sapiens
tgggcctgggtctttgctgcca

SEQ ID NO: 9073006 - DNA, 22 bp, Homo sapiens
tgggcctggggcagcccaaatc

SEQ ID NO: 9073007 - DNA, 22 bp, Homo sapiens
tgggctgcaccctcagcctctg

SEQ ID NO: 9073008 - DNA, 22 bp, Homo sapiens
tgggctgagtgtggaactagtt

SEQ ID NO: 9073009 - DNA, 22 bp, Homo sapiens
tgggctgcaccctcagcctctg

SEQ ID NO: 9073010 - DNA, 22 bp, Homo sapiens
tgggctgcccaaggtggccatg

SEQ ID NO: 9073011 - DNA, 22 bp, Homo sapiens
tgggctgccggcaggctctgcc

SEQ ID NO: 9073012 - DNA, 22 bp, Homo sapiens
tgggctctggtttcctggctgg

SEQ ID NO: 9073013 - DNA, 22 bp, Homo sapiens
tgggctcttcctatagtttata

SEQ ID NO: 9073014 - DNA, 22 bp, Homo sapiens
tgggctgagcactgaggaagga

SEQ ID NO: 9073015 - DNA, 22 bp, Homo sapiens
tgggctctagactttagtgtgg

SEQ ID NO: 9073016 - DNA, 22 bp, Homo sapiens
tgggctctcacacatgttctga

SEQ ID NO: 9073017 - DNA, 22 bp, Homo sapiens
tgggctctgaagtcagtctgct

SEQ ID NO: 9073018 - DNA, 22 bp, Homo sapiens
tgggctctgaagtcagtctgct

SEQ ID NO: 9073019 - DNA, 22 bp, Homo sapiens
tgggctattaggaccaggccat

SEQ ID NO: 9073020 - DNA, 22 bp, Homo sapiens
tgggctaaatagagaaaggata

SEQ ID NO: 9073021 - DNA, 22 bp, Homo sapiens
tgggctactctgggagcctaac

SEQ ID NO: 9073022 - DNA, 22 bp, Homo sapiens
tgggcgacagagcaagactccg

SEQ ID NO: 9073023 - DNA, 22 bp, Homo sapiens
tgggcgacagagcaagactccg

SEQ ID NO: 9073024 - DNA, 22 bp, Homo sapiens
tgggcctgttggggttgagtta

SEQ ID NO: 9073025 - DNA, 22 bp, Homo sapiens
tgggcctgtttcccttcagggc

SEQ ID NO: 9073026 - DNA, 22 bp, Homo sapiens
tgggcctgtttcccttcagggc

SEQ ID NO: 9073027 - DNA, 22 bp, Homo sapiens
tgggcctgtggggatcttgaag

SEQ ID NO: 9073028 - DNA, 22 bp, Homo sapiens
tgggcctgttggggttgagtta

SEQ ID NO: 9073029 - DNA, 22 bp, Homo sapiens
tgggcctgttgcctgagtccat

SEQ ID NO: 9073030 - DNA, 22 bp, Homo sapiens
tgggcctgttgcctgagtccat

SEQ ID NO: 9073031 - DNA, 22 bp, Homo sapiens
tgggcctgtggcttggctctag

SEQ ID NO: 9073032 - DNA, 22 bp, Homo sapiens
tgggcctgtggcttggctctag

SEQ ID NO: 9073033 - DNA, 22 bp, Homo sapiens
tgggcctgtggcttggctctag

SEQ ID NO: 9073034 - DNA, 22 bp, Homo sapiens
tgggcctgtggcttggctctag

SEQ ID NO: 9073035 - DNA, 22 bp, Homo sapiens
tgggcctgtggcttggctctag

SEQ ID NO: 9073036 - DNA, 22 bp, Homo sapiens
tgggcctgtgatgctgggctat

SEQ ID NO: 9073037 - DNA, 22 bp, Homo sapiens
tgggcctgtgatgctgggctat

SEQ ID NO: 9073038 - DNA, 20 bp, Homo sapiens
tgggcctgtggcagaagtct

SEQ ID NO: 9073039 - DNA, 22 bp, Homo sapiens
tgggcctgggttcctcctgggc

SEQ ID NO: 9073040 - DNA, 22 bp, Homo sapiens
tgggcctgggttcctcctgggc

SEQ ID NO: 9073041 - DNA, 21 bp, Homo sapiens
tgggcctgtccctcttggagg

SEQ ID NO: 9073042 - DNA, 22 bp, Homo sapiens
tgggcctgtgatgctgggctat

SEQ ID NO: 9073043 - DNA, 22 bp, Homo sapiens
tgggccacctgctctgtttcta

SEQ ID NO: 9073044 - DNA, 22 bp, Homo sapiens
tgggccacctgcttttttgcat

SEQ ID NO: 9073045 - DNA, 22 bp, Homo sapiens
tgggccacagctcacacatcca

SEQ ID NO: 9073046 - DNA, 22 bp, Homo sapiens
tgggccacaagccatgggacca

SEQ ID NO: 9073047 - DNA, 22 bp, Homo sapiens
tgggccacaagccatgggacca

SEQ ID NO: 9073048 - DNA, 22 bp, Homo sapiens
tgggccaagttaaatgccaggg

SEQ ID NO: 9073049 - DNA, 22 bp, Homo sapiens
tgggccacaagccatgggacca

SEQ ID NO: 9073050 - DNA, 22 bp, Homo sapiens
tgggccacacacagaagaatca

SEQ ID NO: 9073051 - DNA, 22 bp, Homo sapiens
tgggccagcaattgctgctcag

SEQ ID NO: 9073052 - DNA, 22 bp, Homo sapiens
tgggccacgggggtggagagct

SEQ ID NO: 9073053 - DNA, 22 bp, Homo sapiens
tgggccacgggggtggagagct

SEQ ID NO: 9073054 - DNA, 22 bp, Homo sapiens
tgggccacgggggtggagagct

SEQ ID NO: 9073055 - DNA, 22 bp, Homo sapiens
tgggccacgtcatctcccacaa

SEQ ID NO: 9073056 - DNA, 22 bp, Homo sapiens
tgggccagctgaagtgccgccc

SEQ ID NO: 9073057 - DNA, 22 bp, Homo sapiens
tgggccaggatttcaagaccct

SEQ ID NO: 9073058 - DNA, 22 bp, Homo sapiens
tgggccaggatttcaagaccct

SEQ ID NO: 9073059 - DNA, 22 bp, Homo sapiens
tgggccagctgaagtgccgccc

SEQ ID NO: 9073060 - DNA, 22 bp, Homo sapiens
tgggccagctccctgcccctgg

SEQ ID NO: 9073061 - DNA, 22 bp, Homo sapiens
tgggccagcactgggtgctcat

SEQ ID NO: 9073062 - DNA, 22 bp, Homo sapiens
tgggccagcactgggtgctcat

SEQ ID NO: 9073063 - DNA, 22 bp, Homo sapiens
tgggcaggggccctgcttccgt

SEQ ID NO: 9073064 - DNA, 22 bp, Homo sapiens
tgggcaggggccctgcttccgt

SEQ ID NO: 9073065 - DNA, 22 bp, Homo sapiens
tgggcaggggccctgcttccgt

SEQ ID NO: 9073066 - DNA, 22 bp, Homo sapiens
tgggcaggggccctgcttccgt

SEQ ID NO: 9073067 - DNA, 22 bp, Homo sapiens
tgggcagggtctctgttatcag

SEQ ID NO: 9073068 - DNA, 22 bp, Homo sapiens
tgggcagggtctctgttatcag

SEQ ID NO: 9073069 - DNA, 22 bp, Homo sapiens
tgggcaggtgctattttccatg

SEQ ID NO: 9073070 - DNA, 19 bp, Homo sapiens
tgggcaggttcagtaatgg

SEQ ID NO: 9073071 - DNA, 19 bp, Homo sapiens
tgggcaggttcagtaatgg

SEQ ID NO: 9073072 - DNA, 23 bp, Homo sapiens
tgggcatctcctctgtgccaggc

SEQ ID NO: 9073073 - DNA, 22 bp, Homo sapiens
tgggcatcatggacagcagagg

SEQ ID NO: 9073074 - DNA, 22 bp, Homo sapiens
tgggcatgagtggacagagaag

SEQ ID NO: 9073075 - DNA, 22 bp, Homo sapiens
tgggcagtgagaaaggtcaggt

SEQ ID NO: 9073076 - DNA, 19 bp, Homo sapiens
tgggcagtgccagggctta

SEQ ID NO: 9073077 - DNA, 22 bp, Homo sapiens
tgggcagtggctgggcctctct

SEQ ID NO: 9073078 - DNA, 22 bp, Homo sapiens
tgggcagggagctggaaccaca

SEQ ID NO: 9073079 - DNA, 22 bp, Homo sapiens
tgggcagggagctggaaccaca

SEQ ID NO: 9073080 - DNA, 23 bp, Homo sapiens
tgggcagcttctgcatgcccacc

SEQ ID NO: 9073081 - DNA, 22 bp, Homo sapiens
tgggcagccatcccagcctctc

SEQ ID NO: 9073082 - DNA, 19 bp, Homo sapiens
tgggcagctccctctgtcc

SEQ ID NO: 9073083 - DNA, 22 bp, Homo sapiens
tgggcagggatctcttttgcaa

SEQ ID NO: 9073084 - DNA, 22 bp, Homo sapiens
tgggcagggatctcttttgcaa

SEQ ID NO: 9073085 - DNA, 22 bp, Homo sapiens
tgggcagggatctcttttgcaa

SEQ ID NO: 9073086 - DNA, 22 bp, Homo sapiens
tgggcagggagctggaaccaca

SEQ ID NO: 9073087 - DNA, 22 bp, Homo sapiens
tgggcagggagctggaaccaca

SEQ ID NO: 9073088 - DNA, 22 bp, Homo sapiens
tgggcagggagctggaaccaca

SEQ ID NO: 9073089 - DNA, 22 bp, Homo sapiens
tgggcagggagctggaaccaca

SEQ ID NO: 9073090 - DNA, 22 bp, Homo sapiens
tgggcagcagcaaagccagact

SEQ ID NO: 9073091 - DNA, 22 bp, Homo sapiens
tgggcagcagcaaagccagact

SEQ ID NO: 9073092 - DNA, 22 bp, Homo sapiens
tgggcagcaaagactgtgtgct

SEQ ID NO: 9073093 - DNA, 22 bp, Homo sapiens
tgggcagcaaagactgtgtgct

SEQ ID NO: 9073094 - DNA, 20 bp, Homo sapiens
tgggcagcactgctggctgg

SEQ ID NO: 9073095 - DNA, 20 bp, Homo sapiens
tgggcagcactgctggctgg

SEQ ID NO: 9073096 - DNA, 22 bp, Homo sapiens
tgggcagcaaagactgtgtgct

SEQ ID NO: 9073097 - DNA, 16 bp, Homo sapiens
tgggcagatgagaaga

SEQ ID NO: 9073098 - DNA, 22 bp, Homo sapiens
tgggcagatctttggtggctag

SEQ ID NO: 9073099 - DNA, 15 bp, Homo sapiens
tgggcagatcacttg

SEQ ID NO: 9073100 - DNA, 22 bp, Homo sapiens
tgggcagagttgtgatgaactg

SEQ ID NO: 9073101 - DNA, 21 bp, Homo sapiens
tgggcagatggcagtgtggct

SEQ ID NO: 9073102 - DNA, 22 bp, Homo sapiens
tgggcagatgtcctctgaagtg

SEQ ID NO: 9073103 - DNA, 22 bp, Homo sapiens
tgggcagatgtggctctccttg

SEQ ID NO: 9073104 - DNA, 22 bp, Homo sapiens
tgggcagattaatgcagtggct

SEQ ID NO: 9073105 - DNA, 22 bp, Homo sapiens
tgggagtcagacagcctgagat

SEQ ID NO: 9073106 - DNA, 22 bp, Homo sapiens
tgggagtgaggcagagtctatc

SEQ ID NO: 9073107 - DNA, 22 bp, Homo sapiens
tgggaggccgaggcaggtggat

SEQ ID NO: 9073108 - DNA, 22 bp, Homo sapiens
tgggaggccgaggcaggtggat

SEQ ID NO: 9073109 - DNA, 22 bp, Homo sapiens
tgggaggcttccagaccttgct

SEQ ID NO: 9073110 - DNA, 22 bp, Homo sapiens
tgggaggcaggtaggtgatgat

SEQ ID NO: 9073111 - DNA, 22 bp, Homo sapiens
tgggaggcaggtaggtgatgat

SEQ ID NO: 9073112 - DNA, 22 bp, Homo sapiens
tgggaggcaggtaggtgatgat

SEQ ID NO: 9073113 - DNA, 22 bp, Homo sapiens
tgggaggccaaggcaggcggat

SEQ ID NO: 9073114 - DNA, 22 bp, Homo sapiens
tgggaggccgaggcaggtggat

SEQ ID NO: 9073115 - DNA, 22 bp, Homo sapiens
tgggaggcccaggcctggcagg

SEQ ID NO: 9073116 - DNA, 22 bp, Homo sapiens
tgggaggcccaggcctggcagg

SEQ ID NO: 9073117 - DNA, 22 bp, Homo sapiens
tgggaggcccaggcctggcagg

SEQ ID NO: 9073118 - DNA, 22 bp, Homo sapiens
tgggatagattgatggatagag

SEQ ID NO: 9073119 - DNA, 22 bp, Homo sapiens
tgggagtgatacagtatggaat

SEQ ID NO: 9073120 - DNA, 22 bp, Homo sapiens
tgggatagtagctgagagacaa

SEQ ID NO: 9073121 - DNA, 22 bp, Homo sapiens
tgggatagtggccaggaccccc

SEQ ID NO: 9073122 - DNA, 22 bp, Homo sapiens
tgggatagggctattgctcaca

SEQ ID NO: 9073123 - DNA, 22 bp, Homo sapiens
tgggatgagctatatagaaagt

SEQ ID NO: 9073124 - DNA, 22 bp, Homo sapiens
tgggatgagaagtgcgagggtt

SEQ ID NO: 9073125 - DNA, 22 bp, Homo sapiens
tgggatgaggcctctgttgtga

SEQ ID NO: 9073126 - DNA, 23 bp, Homo sapiens
tgggatggattcaccagtgtgct

SEQ ID NO: 9073127 - DNA, 23 bp, Homo sapiens
tgggatggattcaccagtgtgct

SEQ ID NO: 9073128 - DNA, 23 bp, Homo sapiens
tgggatggattcaccagtgtgct

SEQ ID NO: 9073129 - DNA, 22 bp, Homo sapiens
tgggatgagggtgagccacatg

SEQ ID NO: 9073130 - DNA, 22 bp, Homo sapiens
tgggatgagttgttaggactga

SEQ ID NO: 9073131 - DNA, 22 bp, Homo sapiens
tgggatgataggtaagtaatta

SEQ ID NO: 9073132 - DNA, 19 bp, Homo sapiens
tgggatgatgcagaaggta

SEQ ID NO: 9073133 - DNA, 19 bp, Homo sapiens
tgggatgatgcagaaggta

SEQ ID NO: 9073134 - DNA, 22 bp, Homo sapiens
tgggatggcatcctgggccttg

SEQ ID NO: 9073135 - DNA, 21 bp, Homo sapiens
tgggatgggtctgggaccagc

SEQ ID NO: 9073136 - DNA, 22 bp, Homo sapiens
tgggcaaactgtcaaccatgtc

SEQ ID NO: 9073137 - DNA, 20 bp, Homo sapiens
tgggattgttttttagcttc

SEQ ID NO: 9073138 - DNA, 22 bp, Homo sapiens
tgggcaaatgtcactttctttt

SEQ ID NO: 9073139 - DNA, 22 bp, Homo sapiens
tgggcaaaggctgtaacccatc

SEQ ID NO: 9073140 - DNA, 22 bp, Homo sapiens
tgggcaaatgctttttagtcaa

SEQ ID NO: 9073141 - DNA, 22 bp, Homo sapiens
tgggcaaagtcacatacatgat

SEQ ID NO: 9073142 - DNA, 22 bp, Homo sapiens
tgggcaagtatcggactctgag

SEQ ID NO: 9073143 - DNA, 22 bp, Homo sapiens
tgggcaagtatcggactctgag

SEQ ID NO: 9073144 - DNA, 22 bp, Homo sapiens
tgggcaaggctggagcctgcag

SEQ ID NO: 9073145 - DNA, 22 bp, Homo sapiens
tgggcaagtcacttctgtcttt

SEQ ID NO: 9073146 - DNA, 22 bp, Homo sapiens
tgggcacaaacatctgcctgtt

SEQ ID NO: 9073147 - DNA, 22 bp, Homo sapiens
tgggcacagaatagatggccca

SEQ ID NO: 9073148 - DNA, 22 bp, Homo sapiens
tgggcacaaacatctgcctgtt

SEQ ID NO: 9073149 - DNA, 22 bp, Homo sapiens
tgggcacactgaatctgctatt

SEQ ID NO: 9073150 - DNA, 22 bp, Homo sapiens
tgggcagagtcgtggggaatag

SEQ ID NO: 9073151 - DNA, 22 bp, Homo sapiens
tgggcagagtcatacaggagac

SEQ ID NO: 9073152 - DNA, 22 bp, Homo sapiens
tgggcagagtagctcagaagaa

SEQ ID NO: 9073153 - DNA, 22 bp, Homo sapiens
tgggcagaggctctgaagtcca

SEQ ID NO: 9073154 - DNA, 22 bp, Homo sapiens
tgggcagaggctctgaagtcca

SEQ ID NO: 9073155 - DNA, 22 bp, Homo sapiens
tgggcagaggcagcagaaacct

SEQ ID NO: 9073156 - DNA, 22 bp, Homo sapiens
tgggcagaggacagggaagatc

SEQ ID NO: 9073157 - DNA, 22 bp, Homo sapiens
tgggcagagatctggatcaaac

SEQ ID NO: 9073158 - DNA, 22 bp, Homo sapiens
tgggcagagatctggatcaaac

SEQ ID NO: 9073159 - DNA, 22 bp, Homo sapiens
tgggcactatggctctgtgcac

SEQ ID NO: 9073160 - DNA, 22 bp, Homo sapiens
tgggcactcctggggacagctg

SEQ ID NO: 9073161 - DNA, 22 bp, Homo sapiens
tgggcagagagtagaggcaacg

SEQ ID NO: 9073162 - DNA, 22 bp, Homo sapiens
tgggcagactgagccctgtccc

SEQ ID NO: 9073163 - DNA, 22 bp, Homo sapiens
tgggcagagagtagaggcaacg

SEQ ID NO: 9073164 - DNA, 22 bp, Homo sapiens
tgggcacaggggtaggaatgag

SEQ ID NO: 9073165 - DNA, 22 bp, Homo sapiens
tgggcacaggggaatggatgaa

SEQ ID NO: 9073166 - DNA, 22 bp, Homo sapiens
tggtcctggaaggtcctgaggg

SEQ ID NO: 9073167 - DNA, 22 bp, Homo sapiens
tggtcctggaaggtcctgaggg

SEQ ID NO: 9073168 - DNA, 22 bp, Homo sapiens
tggtcctggagagtgttccata

SEQ ID NO: 9073169 - DNA, 22 bp, Homo sapiens
tggtcctgggcacagtatatgc

SEQ ID NO: 9073170 - DNA, 22 bp, Homo sapiens
tggtcctggccttgaccccagg

SEQ ID NO: 9073171 - DNA, 22 bp, Homo sapiens
tggtcctggagatcaatatgca

SEQ ID NO: 9073172 - DNA, 22 bp, Homo sapiens
tggtcctggccttgaccccagg

SEQ ID NO: 9073173 - DNA, 22 bp, Homo sapiens
tggtcctgctacaggggattag

SEQ ID NO: 9073174 - DNA, 22 bp, Homo sapiens
tggtcctgcttgctgcttaaga

SEQ ID NO: 9073175 - DNA, 23 bp, Homo sapiens
tggtcctgccaacggtgcccctc

SEQ ID NO: 9073176 - DNA, 23 bp, Homo sapiens
tggtcctgccaacggtgcccctc

SEQ ID NO: 9073177 - DNA, 22 bp, Homo sapiens
tggtcctgcccacgcccatctg

SEQ ID NO: 9073178 - DNA, 22 bp, Homo sapiens
tggtcctgccccgtgcacagag

SEQ ID NO: 9073179 - DNA, 20 bp, Homo sapiens
tggtcctcacatgccatctt

SEQ ID NO: 9073180 - DNA, 22 bp, Homo sapiens
tggtccagggtgtagtacagag

SEQ ID NO: 9073181 - DNA, 22 bp, Homo sapiens
tggtcctgaggcttgtttccac

SEQ ID NO: 9073182 - DNA, 22 bp, Homo sapiens
tggtcctgatcaccgctgggca

SEQ ID NO: 9073183 - DNA, 22 bp, Homo sapiens
tggtcctgcagtaatagacatc

SEQ ID NO: 9073184 - DNA, 22 bp, Homo sapiens
tggtcctgagaatcctgtcctc

SEQ ID NO: 9073185 - DNA, 22 bp, Homo sapiens
tggtcctgagcaccagcctgac

SEQ ID NO: 9073186 - DNA, 22 bp, Homo sapiens
tggtcctgagcaccagcctgac

SEQ ID NO: 9073187 - DNA, 22 bp, Homo sapiens
tggtccagacatttctgaggta

SEQ ID NO: 9073188 - DNA, 22 bp, Homo sapiens
tggtccagatgccttggcttta

SEQ ID NO: 9073189 - DNA, 22 bp, Homo sapiens
tggtcagttgcatcagagaagt

SEQ ID NO: 9073190 - DNA, 22 bp, Homo sapiens
tggtcattaattcttaccttta

SEQ ID NO: 9073191 - DNA, 22 bp, Homo sapiens
tggtcaggtacctctggctgtc

SEQ ID NO: 9073192 - DNA, 22 bp, Homo sapiens
tggtcaggggcttctgagctgt

SEQ ID NO: 9073193 - DNA, 22 bp, Homo sapiens
tggtcaggggcttctgagctgt

SEQ ID NO: 9073194 - DNA, 22 bp, Homo sapiens
tggtcaggctgctctgcggcgt

SEQ ID NO: 9073195 - DNA, 22 bp, Homo sapiens
tggtcagcgtttgtcagagcag

SEQ ID NO: 9073196 - DNA, 22 bp, Homo sapiens
tggtcaggattctcagcccttc

SEQ ID NO: 9073197 - DNA, 22 bp, Homo sapiens
tggtctctgtgctcgggcatgg

SEQ ID NO: 9073198 - DNA, 22 bp, Homo sapiens
tggtgaagtcagcggagcccgg

SEQ ID NO: 9073199 - DNA, 22 bp, Homo sapiens
tggtgagaagttttgagattct

SEQ ID NO: 9073200 - DNA, 22 bp, Homo sapiens
tggtgagaattggttggattta

SEQ ID NO: 9073201 - DNA, 20 bp, Homo sapiens
tggtgagagcacctgatggg

SEQ ID NO: 9073202 - DNA, 22 bp, Homo sapiens
tggtgagacaggatcaacccct

SEQ ID NO: 9073203 - DNA, 22 bp, Homo sapiens
tggtgagaccttgttccttatg

SEQ ID NO: 9073204 - DNA, 22 bp, Homo sapiens
tggtgagataactttcggcaag

SEQ ID NO: 9073205 - DNA, 22 bp, Homo sapiens
tggtgagagctgaccgtgcgag

SEQ ID NO: 9073206 - DNA, 22 bp, Homo sapiens
tggtgagagcagaccttctttt

SEQ ID NO: 9073207 - DNA, 22 bp, Homo sapiens
tggtgcaatgttgaaagggagt

SEQ ID NO: 9073208 - DNA, 22 bp, Homo sapiens
tggtgcaagtctctgaggaggg

SEQ ID NO: 9073209 - DNA, 22 bp, Homo sapiens
tggtgaggtcatagagaactgt

SEQ ID NO: 9073210 - DNA, 22 bp, Homo sapiens
tggtgagatgcagcaacagaca

SEQ ID NO: 9073211 - DNA, 22 bp, Homo sapiens
tggtgagatgtatggagggttg

SEQ ID NO: 9073212 - DNA, 22 bp, Homo sapiens
tggtccttgctatagagtgata

SEQ ID NO: 9073213 - DNA, 22 bp, Homo sapiens
tggtcctttaagtctttctctg

SEQ ID NO: 9073214 - DNA, 21 bp, Homo sapiens
tggtccttctttactgcctcc

SEQ ID NO: 9073215 - DNA, 22 bp, Homo sapiens
tggtccttgctatagagtgata

SEQ ID NO: 9073216 - DNA, 22 bp, Homo sapiens
tggtccttcttgaagagtgagt

SEQ ID NO: 9073217 - DNA, 22 bp, Homo sapiens
tggtccttcttgaagagtgagt

SEQ ID NO: 9073218 - DNA, 23 bp, Homo sapiens
tggtctcagcctgtgagagctga

SEQ ID NO: 9073219 - DNA, 22 bp, Homo sapiens
tggtcctgtgttcttcctgcct

SEQ ID NO: 9073220 - DNA, 22 bp, Homo sapiens
tggtcctgtctcaaggagcctt

SEQ ID NO: 9073221 - DNA, 22 bp, Homo sapiens
tggtcctgtctcaaggagcctt

SEQ ID NO: 9073222 - DNA, 20 bp, Homo sapiens
tggtcctgtcccacccactc

SEQ ID NO: 9073223 - DNA, 22 bp, Homo sapiens
tggtcctgtagctctctaagtt

SEQ ID NO: 9073224 - DNA, 20 bp, Homo sapiens
tggtcctgtcccacccactc

SEQ ID NO: 9073225 - DNA, 23 bp, Homo sapiens
tggtcctggttgaggtgggcccc

SEQ ID NO: 9073226 - DNA, 22 bp, Homo sapiens
tggtcctgtagcacttgattag

SEQ ID NO: 9073227 - DNA, 22 bp, Homo sapiens
tggtcctggggtgcaggctgac

SEQ ID NO: 9073228 - DNA, 22 bp, Homo sapiens
tggtcctggggatctgcagtga

SEQ ID NO: 9073229 - DNA, 22 bp, Homo sapiens
tggtcctggtgcaagtgcattt

SEQ ID NO: 9073230 - DNA, 22 bp, Homo sapiens
tggtcctggtcatctgggctgg

SEQ ID NO: 9073231 - DNA, 22 bp, Homo sapiens
tggtcctggtagcggtgtgctt

SEQ ID NO: 9073232 - DNA, 16 bp, Homo sapiens
tggtggggaggacagc

SEQ ID NO: 9073233 - DNA, 22 bp, Homo sapiens
tggtgggcacagtgcccaggct

SEQ ID NO: 9073234 - DNA, 22 bp, Homo sapiens
tggtgggagtgagggcatgcca

SEQ ID NO: 9073235 - DNA, 22 bp, Homo sapiens
tggtgggagtccgctgtgctgc

SEQ ID NO: 9073236 - DNA, 22 bp, Homo sapiens
tggtgggagtccgctgtgctgc

SEQ ID NO: 9073237 - DNA, 22 bp, Homo sapiens
tggtggcagcaggagggcccct

SEQ ID NO: 9073238 - DNA, 22 bp, Homo sapiens
tggtggcagctgggacagaggt

SEQ ID NO: 9073239 - DNA, 22 bp, Homo sapiens
tggtggcagtctcctggctgtg

SEQ ID NO: 9073240 - DNA, 23 bp, Homo sapiens
tggtggcagaagtagcagatgac

SEQ ID NO: 9073241 - DNA, 22 bp, Homo sapiens
tggtggcacaagggagagaatc

SEQ ID NO: 9073242 - DNA, 23 bp, Homo sapiens
tggtggcagaagtagcagatgac

SEQ ID NO: 9073243 - DNA, 22 bp, Homo sapiens
tggtggcaatgtcctggagaag

SEQ ID NO: 9073244 - DNA, 22 bp, Homo sapiens
tggtggcaatgtcctggagaag

SEQ ID NO: 9073245 - DNA, 22 bp, Homo sapiens
tggtggcaatgtcctggagaag

SEQ ID NO: 9073246 - DNA, 22 bp, Homo sapiens
tggtggagctgtggccacgacc

SEQ ID NO: 9073247 - DNA, 21 bp, Homo sapiens
tggtggagtgtgctgagcatg

SEQ ID NO: 9073248 - DNA, 21 bp, Homo sapiens
tggtggagtgtgctgagcatg

SEQ ID NO: 9073249 - DNA, 19 bp, Homo sapiens
tggtggaggtgcacctgac

SEQ ID NO: 9073250 - DNA, 22 bp, Homo sapiens
tggtggcaaatcaggacacttc

SEQ ID NO: 9073251 - DNA, 22 bp, Homo sapiens
tggtggcaacattgctggagtg

SEQ ID NO: 9073252 - DNA, 22 bp, Homo sapiens
tggtgcagtcattggcccaggg

SEQ ID NO: 9073253 - DNA, 22 bp, Homo sapiens
tggtgccaagcatgaggactct

SEQ ID NO: 9073254 - DNA, 22 bp, Homo sapiens
tggtgccacttcttaggctggt

SEQ ID NO: 9073255 - DNA, 22 bp, Homo sapiens
tgtacaatctgatgatgtatgg

SEQ ID NO: 9073256 - DNA, 22 bp, Homo sapiens
tgtacaatagctattatctcca

SEQ ID NO: 9073257 - DNA, 22 bp, Homo sapiens
tgtacaaattcagttctagggt

SEQ ID NO: 9073258 - DNA, 22 bp, Homo sapiens
tgtacaaattcagttctagggt

SEQ ID NO: 9073259 - DNA, 22 bp, Homo sapiens
tgtacaaattcattgaactgta

SEQ ID NO: 9073260 - DNA, 22 bp, Homo sapiens
tgtacaaattcattgaactgta

SEQ ID NO: 9073261 - DNA, 17 bp, Homo sapiens
tgtacaacagtaccttc

SEQ ID NO: 9073262 - DNA, 22 bp, Homo sapiens
tgtacacagtatgaggcatctt

SEQ ID NO: 9073263 - DNA, 22 bp, Homo sapiens
tgtacacaattcttaacataca

SEQ ID NO: 9073264 - DNA, 22 bp, Homo sapiens
tgtacacaattcttaacataca

SEQ ID NO: 9073265 - DNA, 22 bp, Homo sapiens
tgtacacaacctacagtctgct

SEQ ID NO: 9073266 - DNA, 22 bp, Homo sapiens
tgtacaatgtggccagtgttaa

SEQ ID NO: 9073267 - DNA, 22 bp, Homo sapiens
tgtacacatggtgtacactccc

SEQ ID NO: 9073268 - DNA, 22 bp, Homo sapiens
tgtacagactgtatttacaagt

SEQ ID NO: 9073269 - DNA, 22 bp, Homo sapiens
tgtacagaaggcactaaggtca

SEQ ID NO: 9073270 - DNA, 22 bp, Homo sapiens
tgtacagactttgcagtgtgca

SEQ ID NO: 9073271 - DNA, 22 bp, Homo sapiens
tgtacagaggtgtacatatgat

SEQ ID NO: 9073272 - DNA, 22 bp, Homo sapiens
tgtaccatgtgactggagtctt

SEQ ID NO: 9073273 - DNA, 22 bp, Homo sapiens
tgtaccatgcgacgcctctcac

SEQ ID NO: 9073274 - DNA, 20 bp, Homo sapiens
tgtaccataatgactggctc

SEQ ID NO: 9073275 - DNA, 22 bp, Homo sapiens
tgtaccataatgtgtattttaa

SEQ ID NO: 9073276 - DNA, 22 bp, Homo sapiens
tgtaccatatagatggtacctt

SEQ ID NO: 9073277 - DNA, 22 bp, Homo sapiens
tgtaccataggtctatcattct

SEQ ID NO: 9073278 - DNA, 22 bp, Homo sapiens
tgtaccatatatgttactgact

SEQ ID NO: 9073279 - DNA, 22 bp, Homo sapiens
tgtaccatctcagcattcagga

SEQ ID NO: 9073280 - DNA, 22 bp, Homo sapiens
tgtaccagtgttgagaatgaga

SEQ ID NO: 9073281 - DNA, 22 bp, Homo sapiens
tgtacagctgccttttttactt

SEQ ID NO: 9073282 - DNA, 22 bp, Homo sapiens
tgtacagaggtgtacatatgat

SEQ ID NO: 9073283 - DNA, 22 bp, Homo sapiens
tgtacagattgatcatggagag

SEQ ID NO: 9073284 - DNA, 21 bp, Homo sapiens
tgtaacaaaatactgcagatt

SEQ ID NO: 9073285 - DNA, 23 bp, Homo sapiens
tgtaaattttgtagtcacatttt

SEQ ID NO: 9073286 - DNA, 23 bp, Homo sapiens
tgtaaattttgtagtcacatttt

SEQ ID NO: 9073287 - DNA, 22 bp, Homo sapiens
tgtaaattggaaatcaatcaag

SEQ ID NO: 9073288 - DNA, 22 bp, Homo sapiens
tgtaacatatgtaaaagcacct

SEQ ID NO: 9073289 - DNA, 22 bp, Homo sapiens
tgtaacagtaagcctgtgagct

SEQ ID NO: 9073290 - DNA, 22 bp, Homo sapiens
tgtaacaatttcttactattgt

SEQ ID NO: 9073291 - DNA, 23 bp, Homo sapiens
tgtaacaatttcatatacatgca

SEQ ID NO: 9073292 - DNA, 23 bp, Homo sapiens
tgtaacaatttcatatacatgca

SEQ ID NO: 9073293 - DNA, 22 bp, Homo sapiens
tgtaagaataatgatttctaag

SEQ ID NO: 9073294 - DNA, 22 bp, Homo sapiens
tgtaagaaaagtaaatagtgac

SEQ ID NO: 9073295 - DNA, 22 bp, Homo sapiens
tgtaagaaaagtaaatagtgac

SEQ ID NO: 9073296 - DNA, 22 bp, Homo sapiens
tgtaagaacaactgtcaaatgt

SEQ ID NO: 9073297 - DNA, 23 bp, Homo sapiens
tgtaacttcttaaattcttcact

SEQ ID NO: 9073298 - DNA, 22 bp, Homo sapiens
tgtacaaagagtatagctttga

SEQ ID NO: 9073299 - DNA, 22 bp, Homo sapiens
tgtacaaagccagaactcccaa

SEQ ID NO: 9073300 - DNA, 22 bp, Homo sapiens
tgtacaaaggtactttgatgtt

SEQ ID NO: 9073301 - DNA, 22 bp, Homo sapiens
tgtacaaagttaaacctatata

SEQ ID NO: 9073302 - DNA, 22 bp, Homo sapiens
tgtacaaaacaagatgggggta

SEQ ID NO: 9073303 - DNA, 22 bp, Homo sapiens
tgtaagtacattgaaacatctt

SEQ ID NO: 9073304 - DNA, 22 bp, Homo sapiens
tgtaattttctcaagtttctac

SEQ ID NO: 9073305 - DNA, 22 bp, Homo sapiens
tgtaattttctcaagtttctac

SEQ ID NO: 9073306 - DNA, 22 bp, Homo sapiens
tggtggggtcatcgtcagatgc

SEQ ID NO: 9073307 - DNA, 23 bp, Homo sapiens
tggtggggtcttggagacagcac

SEQ ID NO: 9073308 - DNA, 23 bp, Homo sapiens
tggtggggtcttggagacagcac

SEQ ID NO: 9073309 - DNA, 22 bp, Homo sapiens
tggtgtgggcgtggcaggcaag

SEQ ID NO: 9073310 - DNA, 22 bp, Homo sapiens
tggttcctcaagcgctggcggc

SEQ ID NO: 9073311 - DNA, 22 bp, Homo sapiens
tggttacacaagtgtgtgcagt

SEQ ID NO: 9073312 - DNA, 22 bp, Homo sapiens
tggttacacagcatgtggactt

SEQ ID NO: 9073313 - DNA, 22 bp, Homo sapiens
tggttaaatgggaagagcaaca

SEQ ID NO: 9073314 - DNA, 22 bp, Homo sapiens
tggttaaatgggaagagcaaca

SEQ ID NO: 9073315 - DNA, 22 bp, Homo sapiens
tggttgtgagcgatggatggag

SEQ ID NO: 9073316 - DNA, 22 bp, Homo sapiens
tggttgaataagatagttttat

SEQ ID NO: 9073317 - DNA, 22 bp, Homo sapiens
tggttgcctctcagagattccg

SEQ ID NO: 9073318 - DNA, 22 bp, Homo sapiens
tggtttataacatgtctcatga

SEQ ID NO: 9073319 - DNA, 21 bp, Homo sapiens
tggtttatttcactcagcata

SEQ ID NO: 9073320 - DNA, 22 bp, Homo sapiens
tggtttatttctctgaaaggtt

SEQ ID NO: 9073321 - DNA, 22 bp, Homo sapiens
tggtttatatcttgattctagt

SEQ ID NO: 9073322 - DNA, 21 bp, Homo sapiens
tggtttatgtgcttagggtct

SEQ ID NO: 9073323 - DNA, 22 bp, Homo sapiens
tggtttatgctgttgcagctct

SEQ ID NO: 9073324 - DNA, 23 bp, Homo sapiens
tggtttatgatatgtatgggaat

SEQ ID NO: 9073325 - DNA, 22 bp, Homo sapiens
tggtttctgccctcagagctca

SEQ ID NO: 9073326 - DNA, 22 bp, Homo sapiens
tggtttctgggtttgtctagga

SEQ ID NO: 9073327 - DNA, 22 bp, Homo sapiens
tggtttctctgaactctacgac

SEQ ID NO: 9073328 - DNA, 22 bp, Homo sapiens
tggtttctcagactctttgcag

SEQ ID NO: 9073329 - DNA, 20 bp, Homo sapiens
tgtaaataggcattgtagtt

SEQ ID NO: 9073330 - DNA, 22 bp, Homo sapiens
tgtaaataatgcatgtaaatca

SEQ ID NO: 9073331 - DNA, 22 bp, Homo sapiens
tgtaaataatgcatgtaaatca

SEQ ID NO: 9073332 - DNA, 22 bp, Homo sapiens
tgtaaataatgcatgtaaatca

SEQ ID NO: 9073333 - DNA, 22 bp, Homo sapiens
tgtaaagtgaggataagaacag

SEQ ID NO: 9073334 - DNA, 22 bp, Homo sapiens
tgtaaataatgcatgtaaatca

SEQ ID NO: 9073335 - DNA, 22 bp, Homo sapiens
tgtaaagatccttagcaacatc

SEQ ID NO: 9073336 - DNA, 22 bp, Homo sapiens
tgtaaagatccttagcaacatc

SEQ ID NO: 9073337 - DNA, 22 bp, Homo sapiens
tgtaaagtattcccaaccaggg

SEQ ID NO: 9073338 - DNA, 18 bp, Homo sapiens
tgtaaacactttcattct

SEQ ID NO: 9073339 - DNA, 20 bp, Homo sapiens
tgtaaacaatagtgttcttg

SEQ ID NO: 9073340 - DNA, 22 bp, Homo sapiens
tgtaaacaaatgcattcttgct

SEQ ID NO: 9073341 - DNA, 18 bp, Homo sapiens
tgtaaacactttcattct

SEQ ID NO: 9073342 - DNA, 22 bp, Homo sapiens
tgtaaacagccccatggagagc

SEQ ID NO: 9073343 - DNA, 22 bp, Homo sapiens
tgtaaagagaatggtatatgga

SEQ ID NO: 9073344 - DNA, 22 bp, Homo sapiens
tgtaaagagaaggcttataaag

SEQ ID NO: 9073345 - DNA, 22 bp, Homo sapiens
tgtaaaataattctccatgttt

SEQ ID NO: 9073346 - DNA, 22 bp, Homo sapiens
tgtaaaaggaaatcaaagcact

SEQ ID NO: 9073347 - DNA, 23 bp, Homo sapiens
tgtaaaagcatttgtcagcctgg

SEQ ID NO: 9073348 - DNA, 22 bp, Homo sapiens
tgtaaaaggaaatcaaagcact

SEQ ID NO: 9073349 - DNA, 23 bp, Homo sapiens
tgtaaaagcatttgtcagcctgg

SEQ ID NO: 9073350 - DNA, 23 bp, Homo sapiens
tgtaaaagcatttgtcagcctgg

SEQ ID NO: 9073351 - DNA, 22 bp, Homo sapiens
tgtaaaagacatttctaagcaa

SEQ ID NO: 9073352 - DNA, 22 bp, Homo sapiens
tgtaaaaagcccagccgctgag

SEQ ID NO: 9073353 - DNA, 22 bp, Homo sapiens
tgtaaaaccaaatcaatctagt

SEQ ID NO: 9073354 - DNA, 20 bp, Homo sapiens
tgtaaaacaaggtgaatcct

SEQ ID NO: 9073355 - DNA, 22 bp, Homo sapiens
tggtttctttccactctccacc

SEQ ID NO: 9073356 - DNA, 22 bp, Homo sapiens
tggtttgacaatgaggactggt

SEQ ID NO: 9073357 - DNA, 22 bp, Homo sapiens
tggtttgtatatgtttgtgaga

SEQ ID NO: 9073358 - DNA, 22 bp, Homo sapiens
tggtttgagagtgtgagctttt

SEQ ID NO: 9073359 - DNA, 18 bp, Homo sapiens
tggtttgtcatgagaatt

SEQ ID NO: 9073360 - DNA, 22 bp, Homo sapiens
tgtattcttagttttaatcaga

SEQ ID NO: 9073361 - DNA, 22 bp, Homo sapiens
tgtattcttagttttaatcaga

SEQ ID NO: 9073362 - DNA, 22 bp, Homo sapiens
tgtattctctcaatatttcata

SEQ ID NO: 9073363 - DNA, 22 bp, Homo sapiens
tgtatgtatacacatagatacg

SEQ ID NO: 9073364 - DNA, 22 bp, Homo sapiens
tgtatgctttccttctttctgg

SEQ ID NO: 9073365 - DNA, 22 bp, Homo sapiens
tgtatttaattgtatcatcaca

SEQ ID NO: 9073366 - DNA, 22 bp, Homo sapiens
tgtatttaattgtatcatcaca

SEQ ID NO: 9073367 - DNA, 22 bp, Homo sapiens
tgtattgaattgtgttatatct

SEQ ID NO: 9073368 - DNA, 22 bp, Homo sapiens
tgtatttaagctttacctaaaa

SEQ ID NO: 9073369 - DNA, 20 bp, Homo sapiens
tgtatttcatgcattcctgg

SEQ ID NO: 9073370 - DNA, 22 bp, Homo sapiens
tgtatttcaattttagcaccaa

SEQ ID NO: 9073371 - DNA, 22 bp, Homo sapiens
tgtatttcgctaggtactccct

SEQ ID NO: 9073372 - DNA, 22 bp, Homo sapiens
tgtatttcctggtttagatcaa

SEQ ID NO: 9073373 - DNA, 22 bp, Homo sapiens
tgtatttggtgtatttaatgag

SEQ ID NO: 9073374 - DNA, 22 bp, Homo sapiens
tgtattttcagagtggcatttc

SEQ ID NO: 9073375 - DNA, 22 bp, Homo sapiens
tgtattttctgaagataatcaa

SEQ ID NO: 9073376 - DNA, 22 bp, Homo sapiens
tgtattttctgaagataatcaa

SEQ ID NO: 9073377 - DNA, 22 bp, Homo sapiens
tgtattttgtgaggatcactct

SEQ ID NO: 9073378 - DNA, 22 bp, Homo sapiens
tgtattttgtgaggatcactct

SEQ ID NO: 9073379 - DNA, 22 bp, Homo sapiens
tgtattttgtgaggatcactct

SEQ ID NO: 9073380 - DNA, 22 bp, Homo sapiens
tgtatttttagacctttagacc

SEQ ID NO: 9073381 - DNA, 22 bp, Homo sapiens
tgtatttttagacctttagacc

SEQ ID NO: 9073382 - DNA, 22 bp, Homo sapiens
tgtcaaaaagctgggacaagca

SEQ ID NO: 9073383 - DNA, 22 bp, Homo sapiens
tgtatttttaggaatgcgctat

SEQ ID NO: 9073384 - DNA, 22 bp, Homo sapiens
tgtatttttaggaatgcgctat

SEQ ID NO: 9073385 - DNA, 22 bp, Homo sapiens
tgtcaaactgtgacttctaatg

SEQ ID NO: 9073386 - DNA, 22 bp, Homo sapiens
tgtcaaacaaattaccaaactg

SEQ ID NO: 9073387 - DNA, 22 bp, Homo sapiens
tgtcaaaaccttggaggcaagg

SEQ ID NO: 9073388 - DNA, 22 bp, Homo sapiens
tgtcacaaaaatcagtaattgc

SEQ ID NO: 9073389 - DNA, 22 bp, Homo sapiens
tgtcacacttggtggttttggt

SEQ ID NO: 9073390 - DNA, 22 bp, Homo sapiens
tgtcacagagcaactatttctt

SEQ ID NO: 9073391 - DNA, 22 bp, Homo sapiens
tgtcacaaacatacattataga

SEQ ID NO: 9073392 - DNA, 22 bp, Homo sapiens
tgtcaatgaagatatgaataat

SEQ ID NO: 9073393 - DNA, 22 bp, Homo sapiens
tgtcaccagctgctcctcagga

SEQ ID NO: 9073394 - DNA, 22 bp, Homo sapiens
tgtcaccagttccaggaaataa

SEQ ID NO: 9073395 - DNA, 22 bp, Homo sapiens
tgtcaccactggctgaaacacc

SEQ ID NO: 9073396 - DNA, 22 bp, Homo sapiens
tgtcaccacatttgtcaatatc

SEQ ID NO: 9073397 - DNA, 22 bp, Homo sapiens
tgtcaccatgccagcttctgcc

SEQ ID NO: 9073398 - DNA, 22 bp, Homo sapiens
tgtcacctctttggctgcagct

SEQ ID NO: 9073399 - DNA, 22 bp, Homo sapiens
tgtcaccatgccagcttctgcc

SEQ ID NO: 9073400 - DNA, 22 bp, Homo sapiens
tgtcacattgaatatgatttat

SEQ ID NO: 9073401 - DNA, 23 bp, Homo sapiens
tgtcacatttagttggcattgtt

SEQ ID NO: 9073402 - DNA, 22 bp, Homo sapiens
tgtcacatgacacaaatatcta

SEQ ID NO: 9073403 - DNA, 22 bp, Homo sapiens
tgtcacatgtgtggcatttttc

SEQ ID NO: 9073404 - DNA, 21 bp, Homo sapiens
tgtcacagattctcagcttgc

SEQ ID NO: 9073405 - DNA, 22 bp, Homo sapiens
tgtcacagatcgtttttgagct

SEQ ID NO: 9073406 - DNA, 22 bp, Homo sapiens
tgtcacagtctcgtgagcatct

SEQ ID NO: 9073407 - DNA, 22 bp, Homo sapiens
tgtcacagtctcgtgagcatct

SEQ ID NO: 9073408 - DNA, 22 bp, Homo sapiens
tgtcacataggcaaaatgtttt

SEQ ID NO: 9073409 - DNA, 22 bp, Homo sapiens
tgtcacataggcaaaatgtttt

SEQ ID NO: 9073410 - DNA, 22 bp, Homo sapiens
tgtcacataatttatctgtagg

SEQ ID NO: 9073411 - DNA, 22 bp, Homo sapiens
tgtatattctgcctaaaagctt

SEQ ID NO: 9073412 - DNA, 22 bp, Homo sapiens
tgtatattgcctgagtctttcc

SEQ ID NO: 9073413 - DNA, 22 bp, Homo sapiens
tgtatattcactgagcaagggg

SEQ ID NO: 9073414 - DNA, 22 bp, Homo sapiens
tgtatcaatcatgtaatttggt

SEQ ID NO: 9073415 - DNA, 22 bp, Homo sapiens
tgtatcttagtgtgaaaatatt

SEQ ID NO: 9073416 - DNA, 22 bp, Homo sapiens
tgtatgaaaaggaatagattga

SEQ ID NO: 9073417 - DNA, 22 bp, Homo sapiens
tgtatgaagccagaatctgttt

SEQ ID NO: 9073418 - DNA, 22 bp, Homo sapiens
tgtatgaagacttcttctgtgt

SEQ ID NO: 9073419 - DNA, 22 bp, Homo sapiens
tgtatgaatctcatttgtttaa

SEQ ID NO: 9073420 - DNA, 22 bp, Homo sapiens
tgtatgaatatgtattttcata

SEQ ID NO: 9073421 - DNA, 22 bp, Homo sapiens
tgtataaatttaaattcctgct

SEQ ID NO: 9073422 - DNA, 22 bp, Homo sapiens
tgtagcagagtatctctgtttt

SEQ ID NO: 9073423 - DNA, 22 bp, Homo sapiens
tgtagcagtgtctaccacatta

SEQ ID NO: 9073424 - DNA, 22 bp, Homo sapiens
tgtagattttggagtctacaag

SEQ ID NO: 9073425 - DNA, 17 bp, Homo sapiens
tgtagcttctccttctc

SEQ ID NO: 9073426 - DNA, 19 bp, Homo sapiens
tgtagcagtttaaaacaac

SEQ ID NO: 9073427 - DNA, 22 bp, Homo sapiens
tgtagccagaagtcatagggtg

SEQ ID NO: 9073428 - DNA, 22 bp, Homo sapiens
tgtagaaattagtaagatcaac

SEQ ID NO: 9073429 - DNA, 22 bp, Homo sapiens
tgtagaaattagtaagatcaac

SEQ ID NO: 9073430 - DNA, 22 bp, Homo sapiens
tgtagaaagaatatgtttcata

SEQ ID NO: 9073431 - DNA, 22 bp, Homo sapiens
tgtagaagctagcctggagcca

SEQ ID NO: 9073432 - DNA, 22 bp, Homo sapiens
tgtagaagtaggagtcatctca

SEQ ID NO: 9073433 - DNA, 22 bp, Homo sapiens
tgtagaagtttatgaacacatt

SEQ ID NO: 9073434 - DNA, 22 bp, Homo sapiens
tgtagaaaattggagcattcat

SEQ ID NO: 9073435 - DNA, 22 bp, Homo sapiens
tgtactaatgcatttaactaac

SEQ ID NO: 9073436 - DNA, 22 bp, Homo sapiens
tgtccctggaactatggctcca

SEQ ID NO: 9073437 - DNA, 22 bp, Homo sapiens
tgtccctggagcttctgtcccc

SEQ ID NO: 9073438 - DNA, 22 bp, Homo sapiens
tgtccctggtggaggctggcag

SEQ ID NO: 9073439 - DNA, 22 bp, Homo sapiens
tgtccctgatccactggacccc

SEQ ID NO: 9073440 - DNA, 22 bp, Homo sapiens
tgtccctctgaggcttccctgg

SEQ ID NO: 9073441 - DNA, 18 bp, Homo sapiens
tgtccctgcaaataacat

SEQ ID NO: 9073442 - DNA, 22 bp, Homo sapiens
tgtcccctttacctccgcagcc

SEQ ID NO: 9073443 - DNA, 22 bp, Homo sapiens
tgtcccctttctttccttcgta

SEQ ID NO: 9073444 - DNA, 22 bp, Homo sapiens
tgtccctatcctcatgcaggcc

SEQ ID NO: 9073445 - DNA, 22 bp, Homo sapiens
tgtccctcattgacgctgtgcc

SEQ ID NO: 9073446 - DNA, 22 bp, Homo sapiens
tgtccccaaggttcagcccaca

SEQ ID NO: 9073447 - DNA, 22 bp, Homo sapiens
tgtcccatggataccaggctat

SEQ ID NO: 9073448 - DNA, 22 bp, Homo sapiens
tgtcccatggacacaacttctt

SEQ ID NO: 9073449 - DNA, 22 bp, Homo sapiens
tgtcccagcactttgggagtct

SEQ ID NO: 9073450 - DNA, 22 bp, Homo sapiens
tgtcccagcagctgggttctct

SEQ ID NO: 9073451 - DNA, 22 bp, Homo sapiens
tgtccaggtggcctctgctgct

SEQ ID NO: 9073452 - DNA, 22 bp, Homo sapiens
tgtccagggggcttacctggag

SEQ ID NO: 9073453 - DNA, 22 bp, Homo sapiens
tgtccagggatggggtcaggga

SEQ ID NO: 9073454 - DNA, 22 bp, Homo sapiens
tgtcccagtcaaggctgtcatc

SEQ ID NO: 9073455 - DNA, 22 bp, Homo sapiens
tgtcccagtcaaggctgtcatc

SEQ ID NO: 9073456 - DNA, 22 bp, Homo sapiens
tgtcccagttcccagggttgct

SEQ ID NO: 9073457 - DNA, 22 bp, Homo sapiens
tgtcccagtttatctgggactg

SEQ ID NO: 9073458 - DNA, 22 bp, Homo sapiens
tgtcccagtttatctgggactg

SEQ ID NO: 9073459 - DNA, 22 bp, Homo sapiens
tgtcccatggacacaacttctt

SEQ ID NO: 9073460 - DNA, 22 bp, Homo sapiens
tgtcccagttttgcaggttaga

SEQ ID NO: 9073461 - DNA, 22 bp, Homo sapiens
tgtcccaggctgaagtacagtg

SEQ ID NO: 9073462 - DNA, 22 bp, Homo sapiens
tgtcccaggcctcatgttgcca

SEQ ID NO: 9073463 - DNA, 22 bp, Homo sapiens
tgtcccaggtcctagatgacca

SEQ ID NO: 9073464 - DNA, 22 bp, Homo sapiens
tgtcccagggaaggcccagcac

SEQ ID NO: 9073465 - DNA, 22 bp, Homo sapiens
tgtcccagggaaggcccagcac

SEQ ID NO: 9073466 - DNA, 22 bp, Homo sapiens
tgtcccagggaaggcccagcac

SEQ ID NO: 9073467 - DNA, 22 bp, Homo sapiens
tgtcctgttcatggctctggac

SEQ ID NO: 9073468 - DNA, 22 bp, Homo sapiens
tgtcctgttcttgctgtgtcct

SEQ ID NO: 9073469 - DNA, 22 bp, Homo sapiens
tgtcctgggtccctgctagaag

SEQ ID NO: 9073470 - DNA, 22 bp, Homo sapiens
tgtcctgggtccctgctagaag

SEQ ID NO: 9073471 - DNA, 22 bp, Homo sapiens
tgtcctgtaggaggcagaacaa

SEQ ID NO: 9073472 - DNA, 22 bp, Homo sapiens
tgtcctggtgcttcttgggatt

SEQ ID NO: 9073473 - DNA, 22 bp, Homo sapiens
tgtcctgtgcactgtagcatgt

SEQ ID NO: 9073474 - DNA, 22 bp, Homo sapiens
tgtcctgtgcactgtagcatgt

SEQ ID NO: 9073475 - DNA, 22 bp, Homo sapiens
tgtcctgtgccaccttcctgag

SEQ ID NO: 9073476 - DNA, 22 bp, Homo sapiens
tgtcctgtgcactgtagcatgt

SEQ ID NO: 9073477 - DNA, 22 bp, Homo sapiens
tgtcctgtgacctggcaccaca

SEQ ID NO: 9073478 - DNA, 22 bp, Homo sapiens
tgtcctgtgacctggcaccaca

SEQ ID NO: 9073479 - DNA, 22 bp, Homo sapiens
tgtcctgtgattccagctcttc

SEQ ID NO: 9073480 - DNA, 22 bp, Homo sapiens
tgtcctggggcgacttggggcc

SEQ ID NO: 9073481 - DNA, 22 bp, Homo sapiens
tgtcctggggacaagaggccct

SEQ ID NO: 9073482 - DNA, 22 bp, Homo sapiens
tgtcctgggtcaaatcctggtc

SEQ ID NO: 9073483 - DNA, 22 bp, Homo sapiens
tgtcctgggaatgggatgcagt

SEQ ID NO: 9073484 - DNA, 22 bp, Homo sapiens
tgtcctgggaggcggggtccag

SEQ ID NO: 9073485 - DNA, 22 bp, Homo sapiens
tgtcctcagatatgtctactct

SEQ ID NO: 9073486 - DNA, 22 bp, Homo sapiens
tgtcctcacaggaatgaacttt

SEQ ID NO: 9073487 - DNA, 22 bp, Homo sapiens
tgtcctcacacgtagggagtaa

SEQ ID NO: 9073488 - DNA, 22 bp, Homo sapiens
tgtcctcaaggagcttcagtct

SEQ ID NO: 9073489 - DNA, 22 bp, Homo sapiens
tgtcctagatccagctgtgctg

SEQ ID NO: 9073490 - DNA, 22 bp, Homo sapiens
tgtcattttcagcttatgcttc

SEQ ID NO: 9073491 - DNA, 22 bp, Homo sapiens
tgtcattttatgtatgtggtct

SEQ ID NO: 9073492 - DNA, 22 bp, Homo sapiens
tgtcattttcatcctaaggagc

SEQ ID NO: 9073493 - DNA, 22 bp, Homo sapiens
tgtcattttctaatctgttgtc

SEQ ID NO: 9073494 - DNA, 22 bp, Homo sapiens
tgtcatttcctgaatgctgagt

SEQ ID NO: 9073495 - DNA, 22 bp, Homo sapiens
tgtcattttctggttagttaat

SEQ ID NO: 9073496 - DNA, 21 bp, Homo sapiens
tgtccaaggtatgcactgggg

SEQ ID NO: 9073497 - DNA, 22 bp, Homo sapiens
tgtccagagtcacagagctcaa

SEQ ID NO: 9073498 - DNA, 22 bp, Homo sapiens
tgtccacatcactcacttgtca

SEQ ID NO: 9073499 - DNA, 22 bp, Homo sapiens
tgtccaatgccctttccacatg

SEQ ID NO: 9073500 - DNA, 22 bp, Homo sapiens
tgtcatttactccataccctca

SEQ ID NO: 9073501 - DNA, 22 bp, Homo sapiens
tgtcatttaatagatatgatgg

SEQ ID NO: 9073502 - DNA, 22 bp, Homo sapiens
tgtcatttatcttatagtaatc

SEQ ID NO: 9073503 - DNA, 22 bp, Homo sapiens
tgtcatttagtcctctgtgtgt

SEQ ID NO: 9073504 - DNA, 22 bp, Homo sapiens
tgtcatttatgcttcttcagtg

SEQ ID NO: 9073505 - DNA, 20 bp, Homo sapiens
tgtcatttatttatcaaatg

SEQ ID NO: 9073506 - DNA, 22 bp, Homo sapiens
tgtcatttattctcttattcta

SEQ ID NO: 9073507 - DNA, 23 bp, Homo sapiens
tgtcatctccagactcccagtgc

SEQ ID NO: 9073508 - DNA, 22 bp, Homo sapiens
tgtcatctcttgcaggaagcct

SEQ ID NO: 9073509 - DNA, 23 bp, Homo sapiens
tgtcatctccagactcccagtgc

SEQ ID NO: 9073510 - DNA, 22 bp, Homo sapiens
tgtcatctggcctggccttgtg

SEQ ID NO: 9073511 - DNA, 22 bp, Homo sapiens
tgtcatctgcgggtggcactgc

SEQ ID NO: 9073512 - DNA, 22 bp, Homo sapiens
tgtcatctggcctgattggtgt

SEQ ID NO: 9073513 - DNA, 22 bp, Homo sapiens
tgtcatctgtgttttgctggag

SEQ ID NO: 9073514 - DNA, 22 bp, Homo sapiens
tgtcattatttgcctactgact

SEQ ID NO: 9073515 - DNA, 22 bp, Homo sapiens
tgtcatatgttgatgaaagaga

SEQ ID NO: 9073516 - DNA, 22 bp, Homo sapiens
tgtcacttcaggaatgcaggga

SEQ ID NO: 9073517 - DNA, 19 bp, Homo sapiens
tgtcactgtcatggcccag

SEQ ID NO: 9073518 - DNA, 22 bp, Homo sapiens
tgtcactcgctcagtccctgtg

SEQ ID NO: 9073519 - DNA, 22 bp, Homo sapiens
tgtcactcaagttccaatttac

SEQ ID NO: 9073520 - DNA, 18 bp, Homo sapiens
tgtcactctggagcccag

SEQ ID NO: 9073521 - DNA, 22 bp, Homo sapiens
tgtcactttggggagagttttg

SEQ ID NO: 9073522 - DNA, 21 bp, Homo sapiens
tgtcagaaataagcatgtgat

SEQ ID NO: 9073523 - DNA, 22 bp, Homo sapiens
tgtcagaactctattgatgtcc

SEQ ID NO: 9073524 - DNA, 21 bp, Homo sapiens
tgtcagaaataagcatgtgat

SEQ ID NO: 9073525 - DNA, 18 bp, Homo sapiens
tgtcagtaaagtgacaga

SEQ ID NO: 9073526 - DNA, 22 bp, Homo sapiens
tgtcagttcagtgattacaaaa

SEQ ID NO: 9073527 - DNA, 22 bp, Homo sapiens
tgtcagtgtctgaggttttata

SEQ ID NO: 9073528 - DNA, 22 bp, Homo sapiens
tgtcagtttggctctaaagttt

SEQ ID NO: 9073529 - DNA, 22 bp, Homo sapiens
tgtcatagtgtggtagcagtgg

SEQ ID NO: 9073530 - DNA, 22 bp, Homo sapiens
tgtcagtttggctctaaagttt

SEQ ID NO: 9073531 - DNA, 22 bp, Homo sapiens
tgtcataaaacacaagctgttg

SEQ ID NO: 9073532 - DNA, 22 bp, Homo sapiens
tgtcagtgaaaaattgtgatag

SEQ ID NO: 9073533 - DNA, 22 bp, Homo sapiens
tgtcagtgagttagttgcaagt

SEQ ID NO: 9073534 - DNA, 22 bp, Homo sapiens
tgtcagtgagttgggtcctgag

SEQ ID NO: 9073535 - DNA, 22 bp, Homo sapiens
tgtcagtgacagatttatgatc

SEQ ID NO: 9073536 - DNA, 22 bp, Homo sapiens
tgtcagtgccaactttgctggt

SEQ ID NO: 9073537 - DNA, 20 bp, Homo sapiens
tgtcagtgcctgaggcacag

SEQ ID NO: 9073538 - DNA, 22 bp, Homo sapiens
tgtcagtgcacagatggttgat

SEQ ID NO: 9073539 - DNA, 22 bp, Homo sapiens
tgtcagtgatttgtagggaatt

SEQ ID NO: 9073540 - DNA, 22 bp, Homo sapiens
tgtcagtggtagacccagaggt

SEQ ID NO: 9073541 - DNA, 22 bp, Homo sapiens
tgtcagtggtcatagtagaaaa

SEQ ID NO: 9073542 - DNA, 22 bp, Homo sapiens
tgtcagtgtaactcttatagca

SEQ ID NO: 9073543 - DNA, 22 bp, Homo sapiens
tgtcagtgtatacatacagtat

SEQ ID NO: 9073544 - DNA, 22 bp, Homo sapiens
tggaagggggaagacagctctg

SEQ ID NO: 9073545 - DNA, 22 bp, Homo sapiens
tggaaggggagctggaaagggg

SEQ ID NO: 9073546 - DNA, 22 bp, Homo sapiens
tggaaggggccaggcgcggagt

SEQ ID NO: 9073547 - DNA, 22 bp, Homo sapiens
tggaaggggttacgcagcagga

SEQ ID NO: 9073548 - DNA, 22 bp, Homo sapiens
tggaagggggaagacagctctg

SEQ ID NO: 9073549 - DNA, 22 bp, Homo sapiens
tggaaggggttacgcagcagga

SEQ ID NO: 9073550 - DNA, 22 bp, Homo sapiens
tggaaggcaacggagtgagctg

SEQ ID NO: 9073551 - DNA, 22 bp, Homo sapiens
tggaagggagtgacagtcagag

SEQ ID NO: 9073552 - DNA, 22 bp, Homo sapiens
tggaaggaagccaaggaaggtt

SEQ ID NO: 9073553 - DNA, 22 bp, Homo sapiens
tggaaggaagccaaggaaggtt

SEQ ID NO: 9073554 - DNA, 22 bp, Homo sapiens
tggaaggagactgggaagtgtg

SEQ ID NO: 9073555 - DNA, 22 bp, Homo sapiens
tggaaggagactgggaagtgtg

SEQ ID NO: 9073556 - DNA, 22 bp, Homo sapiens
tggaaggagctaaggacctggg

SEQ ID NO: 9073557 - DNA, 22 bp, Homo sapiens
tggaaggagctaaggacctggg

SEQ ID NO: 9073558 - DNA, 22 bp, Homo sapiens
tggaaggagctaaggacctggg

SEQ ID NO: 9073559 - DNA, 20 bp, Homo sapiens
tggaataagttaagttgttt

SEQ ID NO: 9073560 - DNA, 22 bp, Homo sapiens
tggaatatgcaattgcatttca

SEQ ID NO: 9073561 - DNA, 23 bp, Homo sapiens
tggaataataaggtacattaaca

SEQ ID NO: 9073562 - DNA, 22 bp, Homo sapiens
tggaatcagttacatgtggttg

SEQ ID NO: 9073563 - DNA, 22 bp, Homo sapiens
tggaataactcaccaaggtcat

SEQ ID NO: 9073564 - DNA, 22 bp, Homo sapiens
tggaagtgtctacatgtggagt

SEQ ID NO: 9073565 - DNA, 22 bp, Homo sapiens
tggaagtggcagaggaagtggt

SEQ ID NO: 9073566 - DNA, 21 bp, Homo sapiens
tggaagtggttcatttgctgc

SEQ ID NO: 9073567 - DNA, 22 bp, Homo sapiens
tggaagtgatgctgaggtgacg

SEQ ID NO: 9073568 - DNA, 22 bp, Homo sapiens
tggaagtgctaaactggagtgt

SEQ ID NO: 9073569 - DNA, 22 bp, Homo sapiens
tggaagtgccttgctggctgtg

SEQ ID NO: 9073570 - DNA, 22 bp, Homo sapiens
tggaagagggagctgggtggcc

SEQ ID NO: 9073571 - DNA, 22 bp, Homo sapiens
tggaagaggcccatgactgcct

SEQ ID NO: 9073572 - DNA, 22 bp, Homo sapiens
tggaagaggccagaaagtggga

SEQ ID NO: 9073573 - DNA, 22 bp, Homo sapiens
tggaagatcaaccaggattgac

SEQ ID NO: 9073574 - DNA, 22 bp, Homo sapiens
tggaagatgaataaagattcta

SEQ ID NO: 9073575 - DNA, 22 bp, Homo sapiens
tggaagatgaataaagattcta

SEQ ID NO: 9073576 - DNA, 22 bp, Homo sapiens
tggaagagggagctgggtggcc

SEQ ID NO: 9073577 - DNA, 22 bp, Homo sapiens
tggaagaggtggaagtggcttc

SEQ ID NO: 9073578 - DNA, 22 bp, Homo sapiens
tggaagagcaggcagacaatgc

SEQ ID NO: 9073579 - DNA, 22 bp, Homo sapiens
tggaagagaaaggagtggatct

SEQ ID NO: 9073580 - DNA, 22 bp, Homo sapiens
tggaagagaaaggagtggatct

SEQ ID NO: 9073581 - DNA, 17 bp, Homo sapiens
tggaagcttcatgttgg

SEQ ID NO: 9073582 - DNA, 22 bp, Homo sapiens
tggaagctcaaggcagggtgag

SEQ ID NO: 9073583 - DNA, 22 bp, Homo sapiens
tggaaggaaaggtagcagagaa

SEQ ID NO: 9073584 - DNA, 22 bp, Homo sapiens
tggaaggaaaggtagcagagaa

SEQ ID NO: 9073585 - DNA, 22 bp, Homo sapiens
tggaaggaagccaaggaaggtt

SEQ ID NO: 9073586 - DNA, 22 bp, Homo sapiens
tggaaggaacagagtttgaaac

SEQ ID NO: 9073587 - DNA, 23 bp, Homo sapiens
tggaagcagaagtttcaatatcc

SEQ ID NO: 9073588 - DNA, 22 bp, Homo sapiens
tggaagcacttgggttttgttg

SEQ ID NO: 9073589 - DNA, 22 bp, Homo sapiens
tggaagcagtcacttcctagtt

SEQ ID NO: 9073590 - DNA, 22 bp, Homo sapiens
tggaagcccagaaggaagcaga

SEQ ID NO: 9073591 - DNA, 22 bp, Homo sapiens
tggaagccagctgggcacctgc

SEQ ID NO: 9073592 - DNA, 22 bp, Homo sapiens
tggaagcagtgattcttgtctg

SEQ ID NO: 9073593 - DNA, 22 bp, Homo sapiens
tggaagcatcacttcttgcctg

SEQ ID NO: 9073594 - DNA, 22 bp, Homo sapiens
tggaagcatagcagcgtgtgtg

SEQ ID NO: 9073595 - DNA, 20 bp, Homo sapiens
tggacacagccctgttgagt

SEQ ID NO: 9073596 - DNA, 18 bp, Homo sapiens
tggacacatggcctgggt

SEQ ID NO: 9073597 - DNA, 22 bp, Homo sapiens
tggacagaaacccgagtgatct

SEQ ID NO: 9073598 - DNA, 22 bp, Homo sapiens
tggacaggatagtgcagtacgc

SEQ ID NO: 9073599 - DNA, 22 bp, Homo sapiens
tggacagcttgcagagccaccc

SEQ ID NO: 9073600 - DNA, 23 bp, Homo sapiens
tggacagcagcagcagtgtcacc

SEQ ID NO: 9073601 - DNA, 22 bp, Homo sapiens
tggacaacatagtgagacctca

SEQ ID NO: 9073602 - DNA, 22 bp, Homo sapiens
tggaattttgtattagctttga

SEQ ID NO: 9073603 - DNA, 22 bp, Homo sapiens
tggaatgttgcataagatctga

SEQ ID NO: 9073604 - DNA, 19 bp, Homo sapiens
tggaatgttccaaggaggc

SEQ ID NO: 9073605 - DNA, 22 bp, Homo sapiens
tggaatgcagtgggagcttacc

SEQ ID NO: 9073606 - DNA, 22 bp, Homo sapiens
tggaatgacagagagtctgaat

SEQ ID NO: 9073607 - DNA, 22 bp, Homo sapiens
tggacagggcagagaccgagtc

SEQ ID NO: 9073608 - DNA, 22 bp, Homo sapiens
tggacaggtgagtgactcaggg

SEQ ID NO: 9073609 - DNA, 22 bp, Homo sapiens
tggacaggtgagtgactcaggg

SEQ ID NO: 9073610 - DNA, 22 bp, Homo sapiens
tggacaggtgagtgactcaggg

SEQ ID NO: 9073611 - DNA, 20 bp, Homo sapiens
tggaccaccctcctctttgc

SEQ ID NO: 9073612 - DNA, 22 bp, Homo sapiens
tggaccagcagccccagtgcct

SEQ ID NO: 9073613 - DNA, 22 bp, Homo sapiens
tggactcaagtccaagttcacg

SEQ ID NO: 9073614 - DNA, 22 bp, Homo sapiens
tggactccagtgtctgtgttct

SEQ ID NO: 9073615 - DNA, 22 bp, Homo sapiens
tggactcagtgctgccattccc

SEQ ID NO: 9073616 - DNA, 20 bp, Homo sapiens
tggacctgtctctttaggga

SEQ ID NO: 9073617 - DNA, 19 bp, Homo sapiens
tggacctgtgcccatggct

SEQ ID NO: 9073618 - DNA, 19 bp, Homo sapiens
tggacctgtgcccatggct

SEQ ID NO: 9073619 - DNA, 21 bp, Homo sapiens
tggacttatggagtgtttctt

SEQ ID NO: 9073620 - DNA, 21 bp, Homo sapiens
tggactggtgagtttaggctg

SEQ ID NO: 9073621 - DNA, 22 bp, Homo sapiens
tggactggaatgctgatcctct

SEQ ID NO: 9073622 - DNA, 22 bp, Homo sapiens
tggaccccctcaaggcagagct

SEQ ID NO: 9073623 - DNA, 22 bp, Homo sapiens
tggaccccctcaaggcagagct

SEQ ID NO: 9073624 - DNA, 22 bp, Homo sapiens
tggaccccagacaagccagggt

SEQ ID NO: 9073625 - DNA, 22 bp, Homo sapiens
tggaccccagacaagccagggt

SEQ ID NO: 9073626 - DNA, 23 bp, Homo sapiens
tggaccctgcacaccagctctac

SEQ ID NO: 9073627 - DNA, 22 bp, Homo sapiens
tggacctgctggatgggcaggt

SEQ ID NO: 9073628 - DNA, 22 bp, Homo sapiens
tggacctggggtggcctcctct

SEQ ID NO: 9073629 - DNA, 22 bp, Homo sapiens
tggacctgctggatgggcaggt

SEQ ID NO: 9073630 - DNA, 23 bp, Homo sapiens
tggacctgaaccagtgcctctgt

SEQ ID NO: 9073631 - DNA, 22 bp, Homo sapiens
tggacctcactgtctgctggta

SEQ ID NO: 9073632 - DNA, 22 bp, Homo sapiens
tggacctgagcctggccctgcc

SEQ ID NO: 9073633 - DNA, 21 bp, Homo sapiens
tgctttatgggaaaaatgtca

SEQ ID NO: 9073634 - DNA, 22 bp, Homo sapiens
tgctttatgtggctgatactca

SEQ ID NO: 9073635 - DNA, 22 bp, Homo sapiens
tgctttataacttagtttatgg

SEQ ID NO: 9073636 - DNA, 22 bp, Homo sapiens
tgctttattaagagagaaattt

SEQ ID NO: 9073637 - DNA, 20 bp, Homo sapiens
tgctttgatggaaatacagc

SEQ ID NO: 9073638 - DNA, 21 bp, Homo sapiens
tgctttgcaggtggatttagt

SEQ ID NO: 9073639 - DNA, 22 bp, Homo sapiens
tgctttgctctcactgtaaggt

SEQ ID NO: 9073640 - DNA, 22 bp, Homo sapiens
tgctttgctctgtctctagcta

SEQ ID NO: 9073641 - DNA, 19 bp, Homo sapiens
tgctttgccttgattagct

SEQ ID NO: 9073642 - DNA, 22 bp, Homo sapiens
tgctttgcagtgtctaacagaa

SEQ ID NO: 9073643 - DNA, 22 bp, Homo sapiens
tgcttctttactataggcaatt

SEQ ID NO: 9073644 - DNA, 22 bp, Homo sapiens
tgctttaaccatcttgtttgga

SEQ ID NO: 9073645 - DNA, 22 bp, Homo sapiens
tgctttaaaatggactgttttg

SEQ ID NO: 9073646 - DNA, 22 bp, Homo sapiens
tgcttgctcgccgcctgctgac

SEQ ID NO: 9073647 - DNA, 22 bp, Homo sapiens
tgcttgctccctcacactgtcc

SEQ ID NO: 9073648 - DNA, 19 bp, Homo sapiens
tgcttgcctgcctttccca

SEQ ID NO: 9073649 - DNA, 19 bp, Homo sapiens
tggaaaatggattgaatca

SEQ ID NO: 9073650 - DNA, 19 bp, Homo sapiens
tggaaaatggattgaatca

SEQ ID NO: 9073651 - DNA, 22 bp, Homo sapiens
tggaaaatcaggggacattgat

SEQ ID NO: 9073652 - DNA, 22 bp, Homo sapiens
tggaaaacattgagataccaag

SEQ ID NO: 9073653 - DNA, 21 bp, Homo sapiens
tggaaaacatttaaatagcaa

SEQ ID NO: 9073654 - DNA, 22 bp, Homo sapiens
tggaaaactttggtggtgaggg

SEQ ID NO: 9073655 - DNA, 22 bp, Homo sapiens
tggaaaacaaagctctcattat

SEQ ID NO: 9073656 - DNA, 22 bp, Homo sapiens
tggaaacagatcataactaagc

SEQ ID NO: 9073657 - DNA, 22 bp, Homo sapiens
tggaaacacccacgcatgcata

SEQ ID NO: 9073658 - DNA, 22 bp, Homo sapiens
tggaaacactcaagcttatatt

SEQ ID NO: 9073659 - DNA, 22 bp, Homo sapiens
tggaaacactcaagcttatatt

SEQ ID NO: 9073660 - DNA, 22 bp, Homo sapiens
tggaaacactcaagcttatatt

SEQ ID NO: 9073661 - DNA, 22 bp, Homo sapiens
tggaaagagaaactcttgctaa

SEQ ID NO: 9073662 - DNA, 22 bp, Homo sapiens
tggaaagaggaagtgcccagca

SEQ ID NO: 9073663 - DNA, 22 bp, Homo sapiens
tggaaagaggtagaggatctgg

SEQ ID NO: 9073664 - DNA, 22 bp, Homo sapiens
tggaaagaggtagaggatctgg

SEQ ID NO: 9073665 - DNA, 19 bp, Homo sapiens
tgctttgctcttggactca

SEQ ID NO: 9073666 - DNA, 22 bp, Homo sapiens
tggaaaaactgagacttagaca

SEQ ID NO: 9073667 - DNA, 21 bp, Homo sapiens
tggaaaaatgtggcctagtga

SEQ ID NO: 9073668 - DNA, 22 bp, Homo sapiens
tggaaaaactgagacttagaca

SEQ ID NO: 9073669 - DNA, 22 bp, Homo sapiens
tggaaaaaacccagactctaga

SEQ ID NO: 9073670 - DNA, 22 bp, Homo sapiens
tggaaaaaacccagactctaga

SEQ ID NO: 9073671 - DNA, 22 bp, Homo sapiens
tggaaaaaaattggctagcttc

SEQ ID NO: 9073672 - DNA, 20 bp, Homo sapiens
tgcttttatacctataatga

SEQ ID NO: 9073673 - DNA, 22 bp, Homo sapiens
tgctttttagtactgtcttatt

SEQ ID NO: 9073674 - DNA, 22 bp, Homo sapiens
tgctttttagtactgtcttatt

SEQ ID NO: 9073675 - DNA, 22 bp, Homo sapiens
tggaaatacttgccataaaact

SEQ ID NO: 9073676 - DNA, 22 bp, Homo sapiens
tggaaagtgctctagactttct

SEQ ID NO: 9073677 - DNA, 22 bp, Homo sapiens
tggaaatacaagaagtatgtca

SEQ ID NO: 9073678 - DNA, 22 bp, Homo sapiens
tggaaagtctcttttgactgta

SEQ ID NO: 9073679 - DNA, 22 bp, Homo sapiens
tggaaagtgagacatatttata

SEQ ID NO: 9073680 - DNA, 22 bp, Homo sapiens
tggaaagtgagacatatttata

SEQ ID NO: 9073681 - DNA, 22 bp, Homo sapiens
tggaaaggaggcttgtggaata

SEQ ID NO: 9073682 - DNA, 22 bp, Homo sapiens
tggaaaggacagttgctgatag

SEQ ID NO: 9073683 - DNA, 21 bp, Homo sapiens
tggaaagattcaaagaccagg

SEQ ID NO: 9073684 - DNA, 22 bp, Homo sapiens
tggaaaggacagttgctgatag

SEQ ID NO: 9073685 - DNA, 22 bp, Homo sapiens
tggaacaagggttcatttaaat

SEQ ID NO: 9073686 - DNA, 19 bp, Homo sapiens
tggaacaaactgcaatgac

SEQ ID NO: 9073687 - DNA, 22 bp, Homo sapiens
tggaacaaattacaattaactt

SEQ ID NO: 9073688 - DNA, 22 bp, Homo sapiens
tggaacaacatgctggaaaatt

SEQ ID NO: 9073689 - DNA, 22 bp, Homo sapiens
tggaaatgtatttgggcatgcc

SEQ ID NO: 9073690 - DNA, 22 bp, Homo sapiens
tggaaatggatctgatgagtct

SEQ ID NO: 9073691 - DNA, 22 bp, Homo sapiens
tggaacgtcgtaatgttggtta

SEQ ID NO: 9073692 - DNA, 22 bp, Homo sapiens
tggaacctaaaaatgtcattgc

SEQ ID NO: 9073693 - DNA, 22 bp, Homo sapiens
tggaaccatcaaagagatcctg

SEQ ID NO: 9073694 - DNA, 22 bp, Homo sapiens
tggagggatacaaagatgaaaa

SEQ ID NO: 9073695 - DNA, 20 bp, Homo sapiens
tggagggattgttggcaaat

SEQ ID NO: 9073696 - DNA, 23 bp, Homo sapiens
tggagggcagaataacagactac

SEQ ID NO: 9073697 - DNA, 22 bp, Homo sapiens
tggagggcatgctgtccatggg

SEQ ID NO: 9073698 - DNA, 22 bp, Homo sapiens
tggagggaacccaggctgctct

SEQ ID NO: 9073699 - DNA, 22 bp, Homo sapiens
tggagggatacaaagatgaaaa

SEQ ID NO: 9073700 - DNA, 22 bp, Homo sapiens
tggagggaacccaggctgctct

SEQ ID NO: 9073701 - DNA, 22 bp, Homo sapiens
tggagggaacaaaggagtccca

SEQ ID NO: 9073702 - DNA, 22 bp, Homo sapiens
tggaggctgtgtgcatgagacc

SEQ ID NO: 9073703 - DNA, 22 bp, Homo sapiens
tggaggctggtttctgctgagg

SEQ ID NO: 9073704 - DNA, 22 bp, Homo sapiens
tggaggctggtttctgctgagg

SEQ ID NO: 9073705 - DNA, 22 bp, Homo sapiens
tggagggaacaaaggagtccca

SEQ ID NO: 9073706 - DNA, 22 bp, Homo sapiens
tggaggtggagttggaaactga

SEQ ID NO: 9073707 - DNA, 22 bp, Homo sapiens
tggagggctaagctgagggata

SEQ ID NO: 9073708 - DNA, 22 bp, Homo sapiens
tggagggcgcttagatggaggg

SEQ ID NO: 9073709 - DNA, 22 bp, Homo sapiens
tggaggtggcacaagggaggtc

SEQ ID NO: 9073710 - DNA, 22 bp, Homo sapiens
tggaggtgggagggactgtcct

SEQ ID NO: 9073711 - DNA, 22 bp, Homo sapiens
tggaggtggtgcccagcaattt

SEQ ID NO: 9073712 - DNA, 22 bp, Homo sapiens
tggaggtggggctcaggaatct

SEQ ID NO: 9073713 - DNA, 22 bp, Homo sapiens
tggaggtggggctcaggaatct

SEQ ID NO: 9073714 - DNA, 23 bp, Homo sapiens
tggataaaatacttacattcaac

SEQ ID NO: 9073715 - DNA, 22 bp, Homo sapiens
tggagttgtgtcatctttgtaa

SEQ ID NO: 9073716 - DNA, 22 bp, Homo sapiens
tggataaaatgacattacctga

SEQ ID NO: 9073717 - DNA, 23 bp, Homo sapiens
tggagttgatgtccttctgtgct

SEQ ID NO: 9073718 - DNA, 22 bp, Homo sapiens
tggataaatgtgcagatgacat

SEQ ID NO: 9073719 - DNA, 22 bp, Homo sapiens
tggataaatggtgctatcaccc

SEQ ID NO: 9073720 - DNA, 22 bp, Homo sapiens
tggataaatagatacacttgca

SEQ ID NO: 9073721 - DNA, 22 bp, Homo sapiens
tggatatccttgttaactttct

SEQ ID NO: 9073722 - DNA, 22 bp, Homo sapiens
tggatgctgtaggacacgctct

SEQ ID NO: 9073723 - DNA, 22 bp, Homo sapiens
tggaggtgtataaggtagcttc

SEQ ID NO: 9073724 - DNA, 22 bp, Homo sapiens
tggaggtgtccaactcgtgggt

SEQ ID NO: 9073725 - DNA, 22 bp, Homo sapiens
tggaggttgggatgcttgtgat

SEQ ID NO: 9073726 - DNA, 23 bp, Homo sapiens
tggaggttttactgagttgagga

SEQ ID NO: 9073727 - DNA, 22 bp, Homo sapiens
tggagtctgtgatgctctgggt

SEQ ID NO: 9073728 - DNA, 22 bp, Homo sapiens
tggagtccccgagaggcctgca

SEQ ID NO: 9073729 - DNA, 22 bp, Homo sapiens
tggagtggacttcatgaggcca

SEQ ID NO: 9073730 - DNA, 22 bp, Homo sapiens
tggagtgaagtaaagaggacaa

SEQ ID NO: 9073731 - DNA, 22 bp, Homo sapiens
tggagtgaagtaaagaggacaa

SEQ ID NO: 9073732 - DNA, 20 bp, Homo sapiens
tggaggcacctgtggagatc

SEQ ID NO: 9073733 - DNA, 20 bp, Homo sapiens
tggaggcacctgtggagatc

SEQ ID NO: 9073734 - DNA, 20 bp, Homo sapiens
tggaggcagagccagaggga

SEQ ID NO: 9073735 - DNA, 20 bp, Homo sapiens
tggaggcagagccagaggga

SEQ ID NO: 9073736 - DNA, 22 bp, Homo sapiens
tggaggcaccactggctgcccg

SEQ ID NO: 9073737 - DNA, 22 bp, Homo sapiens
tggaggcaggtggaggagtgaa

SEQ ID NO: 9073738 - DNA, 23 bp, Homo sapiens
tggaggcaggatgctaaggagtc

SEQ ID NO: 9073739 - DNA, 22 bp, Homo sapiens
tggaggcaggggatacaggtca

SEQ ID NO: 9073740 - DNA, 22 bp, Homo sapiens
tggaggcaggagacagggcaaa

SEQ ID NO: 9073741 - DNA, 22 bp, Homo sapiens
tggaggcaggagacagggcaaa

SEQ ID NO: 9073742 - DNA, 18 bp, Homo sapiens
tggaggcagagttctggc

SEQ ID NO: 9073743 - DNA, 22 bp, Homo sapiens
tggaggcagtaactgagcaaca

SEQ ID NO: 9073744 - DNA, 22 bp, Homo sapiens
tggaggcagtaactgagcaaca

SEQ ID NO: 9073745 - DNA, 22 bp, Homo sapiens
tggaggcccacactgggtagat

SEQ ID NO: 9073746 - DNA, 22 bp, Homo sapiens
tggaggctggagtgcagtggcg

SEQ ID NO: 9073747 - DNA, 22 bp, Homo sapiens
tggaggctggagtgcagtggcg

SEQ ID NO: 9073748 - DNA, 22 bp, Homo sapiens
tggaggccctcattgtagaagt

SEQ ID NO: 9073749 - DNA, 22 bp, Homo sapiens
tggaggagtgtgattgtctgcc

SEQ ID NO: 9073750 - DNA, 22 bp, Homo sapiens
tggaggagggctggtgtctgta

SEQ ID NO: 9073751 - DNA, 22 bp, Homo sapiens
tggaggagggctggtgtctgta

SEQ ID NO: 9073752 - DNA, 22 bp, Homo sapiens
tggaggagggctggtgtctgta

SEQ ID NO: 9073753 - DNA, 22 bp, Homo sapiens
tggaggattaatctggaaagat

SEQ ID NO: 9073754 - DNA, 22 bp, Homo sapiens
tggaggatgcctggggaggcct

SEQ ID NO: 9073755 - DNA, 22 bp, Homo sapiens
tggaggattccacttacatgag

SEQ ID NO: 9073756 - DNA, 19 bp, Homo sapiens
tggaggagaggaaaagtca

SEQ ID NO: 9073757 - DNA, 22 bp, Homo sapiens
tggaggaggaacttcttatctc

SEQ ID NO: 9073758 - DNA, 22 bp, Homo sapiens
tggaggaggatgcatttgttgt

SEQ ID NO: 9073759 - DNA, 19 bp, Homo sapiens
tggaggagaggaaaagtca

SEQ ID NO: 9073760 - DNA, 19 bp, Homo sapiens
tggaggagaggaaaagtca

SEQ ID NO: 9073761 - DNA, 22 bp, Homo sapiens
tggaggagaccgcattttattt

SEQ ID NO: 9073762 - DNA, 22 bp, Homo sapiens
tggaggagaatttatggtcgaa

SEQ ID NO: 9073763 - DNA, 22 bp, Homo sapiens
tggaggagaactccctggctac

SEQ ID NO: 9073764 - DNA, 22 bp, Homo sapiens
tggaggagaactccctggctac

SEQ ID NO: 9073765 - DNA, 20 bp, Homo sapiens
tggagctgtggtaaggagca

SEQ ID NO: 9073766 - DNA, 22 bp, Homo sapiens
tggagctgtcactcagaaccaa

SEQ ID NO: 9073767 - DNA, 22 bp, Homo sapiens
tggagctgtcactcagaaccaa

SEQ ID NO: 9073768 - DNA, 22 bp, Homo sapiens
tggagcttgggactcttggtag

SEQ ID NO: 9073769 - DNA, 20 bp, Homo sapiens
tggagctgtaatcttgtctg

SEQ ID NO: 9073770 - DNA, 20 bp, Homo sapiens
tggagctgtaatcttgtctg

SEQ ID NO: 9073771 - DNA, 22 bp, Homo sapiens
tggagctgtagccaccaccctg

SEQ ID NO: 9073772 - DNA, 22 bp, Homo sapiens
tggagctgtagccaccaccctg

SEQ ID NO: 9073773 - DNA, 22 bp, Homo sapiens
tggagctggtaaacagtgacat

SEQ ID NO: 9073774 - DNA, 22 bp, Homo sapiens
tggagctggtaaacagtgacat

SEQ ID NO: 9073775 - DNA, 22 bp, Homo sapiens
tggagctggttctggggaagct

SEQ ID NO: 9073776 - DNA, 23 bp, Homo sapiens
tggagctgggatttgatttgatt

SEQ ID NO: 9073777 - DNA, 22 bp, Homo sapiens
tggagctgggagtcctgggctg

SEQ ID NO: 9073778 - DNA, 22 bp, Homo sapiens
tggagctgggagtcctgggctg

SEQ ID NO: 9073779 - DNA, 22 bp, Homo sapiens
tggagctgggagtcctgggctg

SEQ ID NO: 9073780 - DNA, 22 bp, Homo sapiens
tggagctgggagtcctgggctg

SEQ ID NO: 9073781 - DNA, 22 bp, Homo sapiens
tggagctgggatttgaactgca

SEQ ID NO: 9073782 - DNA, 22 bp, Homo sapiens
tggagctggtaaacagtgacat

SEQ ID NO: 9073783 - DNA, 22 bp, Homo sapiens
tggagctggggtttgaatctgg

SEQ ID NO: 9073784 - DNA, 23 bp, Homo sapiens
tggagctgggctcagaccctggg

SEQ ID NO: 9073785 - DNA, 22 bp, Homo sapiens
tggagctggggtttgaatctgg

SEQ ID NO: 9073786 - DNA, 23 bp, Homo sapiens
tggagctgggctcagaccctggg

SEQ ID NO: 9073787 - DNA, 23 bp, Homo sapiens
tggagctgggctcagaccctggg

SEQ ID NO: 9073788 - DNA, 23 bp, Homo sapiens
tggagctgggctcagaccctggg

SEQ ID NO: 9073789 - DNA, 20 bp, Homo sapiens
tggagctccagcgtccatgt

SEQ ID NO: 9073790 - DNA, 22 bp, Homo sapiens
tggagctgaactttgaggccag

SEQ ID NO: 9073791 - DNA, 22 bp, Homo sapiens
tggagctgaactttgaggccag

SEQ ID NO: 9073792 - DNA, 22 bp, Homo sapiens
tggagcctgttctgagaagccg

SEQ ID NO: 9073793 - DNA, 23 bp, Homo sapiens
tggagcctgggatacaatagatg

SEQ ID NO: 9073794 - DNA, 22 bp, Homo sapiens
tggagccttttacccacaggag

SEQ ID NO: 9073795 - DNA, 23 bp, Homo sapiens
tggagctgacagtcagagggagg

SEQ ID NO: 9073796 - DNA, 21 bp, Homo sapiens
tggagctgaatttttggcatc

SEQ ID NO: 9073797 - DNA, 21 bp, Homo sapiens
tggagctgaatttttggcatc

SEQ ID NO: 9073798 - DNA, 21 bp, Homo sapiens
tggagctgaatttttggcatc

SEQ ID NO: 9073799 - DNA, 22 bp, Homo sapiens
tggagctgaactttgaggccag

SEQ ID NO: 9073800 - DNA, 22 bp, Homo sapiens
tggagctgaactttgaggccag

SEQ ID NO: 9073801 - DNA, 22 bp, Homo sapiens
tggagctgaactttgaggccag

SEQ ID NO: 9073802 - DNA, 22 bp, Homo sapiens
tggagcccagggtgagaaggag

SEQ ID NO: 9073803 - DNA, 22 bp, Homo sapiens
tggagcccagacactggcattg

SEQ ID NO: 9073804 - DNA, 22 bp, Homo sapiens
tggagcccaggagaggataaac

SEQ ID NO: 9073805 - DNA, 18 bp, Homo sapiens
tggagccattgccaccat

SEQ ID NO: 9073806 - DNA, 22 bp, Homo sapiens
tggagctggaatttgagctgga

SEQ ID NO: 9073807 - DNA, 22 bp, Homo sapiens
tggagctggaatttgagctgga

SEQ ID NO: 9073808 - DNA, 22 bp, Homo sapiens
tggagctggaatttctgggcct

SEQ ID NO: 9073809 - DNA, 22 bp, Homo sapiens
tggagctggaatttctgggcct

SEQ ID NO: 9073810 - DNA, 22 bp, Homo sapiens
tggagctggaatttctgggcct

SEQ ID NO: 9073811 - DNA, 22 bp, Homo sapiens
tggagctggaagacagtgatat

SEQ ID NO: 9073812 - DNA, 22 bp, Homo sapiens
tggagctggaagacagtgatat

SEQ ID NO: 9073813 - DNA, 22 bp, Homo sapiens
tggagctggcttgtggaagttg

SEQ ID NO: 9073814 - DNA, 22 bp, Homo sapiens
tggagctggcttgtggaagttg

SEQ ID NO: 9073815 - DNA, 22 bp, Homo sapiens
tggagctggaatttgagctgga

SEQ ID NO: 9073816 - DNA, 22 bp, Homo sapiens
tggagctggcagcggaaaaggg

SEQ ID NO: 9073817 - DNA, 22 bp, Homo sapiens
tggagctgatacagctggcttt

SEQ ID NO: 9073818 - DNA, 22 bp, Homo sapiens
tggagctgatacagctggcttt

SEQ ID NO: 9073819 - DNA, 22 bp, Homo sapiens
tggagctgatacagctggcttt

SEQ ID NO: 9073820 - DNA, 18 bp, Homo sapiens
tggagctgagtgctgtgc

SEQ ID NO: 9073821 - DNA, 18 bp, Homo sapiens
tggagctgagtgctgtgc

SEQ ID NO: 9073822 - DNA, 21 bp, Homo sapiens
tggagctgccacttgtcctcc

SEQ ID NO: 9073823 - DNA, 21 bp, Homo sapiens
tggagctgccacttgagctgc

SEQ ID NO: 9073824 - DNA, 22 bp, Homo sapiens
tggagctgcctggcacctacag

SEQ ID NO: 9073825 - DNA, 22 bp, Homo sapiens
tggagctgcctggcacctacag

SEQ ID NO: 9073826 - DNA, 22 bp, Homo sapiens
tggagctgcctggcacctacag

SEQ ID NO: 9073827 - DNA, 22 bp, Homo sapiens
tggagctggaagacagtgatat

SEQ ID NO: 9073828 - DNA, 22 bp, Homo sapiens
tggagctggaagaatgtagacg

SEQ ID NO: 9073829 - DNA, 17 bp, Homo sapiens
tggagctgcgtgtgttc

SEQ ID NO: 9073830 - DNA, 22 bp, Homo sapiens
tggagcaggaagtctatggctg

SEQ ID NO: 9073831 - DNA, 22 bp, Homo sapiens
tggagcaggaagtctatggctg

SEQ ID NO: 9073832 - DNA, 22 bp, Homo sapiens
tggagcaggtgccaggtgtgtg

SEQ ID NO: 9073833 - DNA, 22 bp, Homo sapiens
tggagcaggaagtctatggctg

SEQ ID NO: 9073834 - DNA, 18 bp, Homo sapiens
tggagcaggaagcctggc

SEQ ID NO: 9073835 - DNA, 22 bp, Homo sapiens
tggagcaggtgctcagggtaat

SEQ ID NO: 9073836 - DNA, 22 bp, Homo sapiens
tggagcaggtgctcagggtaat

SEQ ID NO: 9073837 - DNA, 22 bp, Homo sapiens
tggagcaggtgggatgtcgtga

SEQ ID NO: 9073838 - DNA, 22 bp, Homo sapiens
tggagcagtggtcctggagatg

SEQ ID NO: 9073839 - DNA, 22 bp, Homo sapiens
tggagcatgagagtctttagct

SEQ ID NO: 9073840 - DNA, 22 bp, Homo sapiens
tggagccagcccaggcccctct

SEQ ID NO: 9073841 - DNA, 22 bp, Homo sapiens
tggagagtggatatgggagcaa

SEQ ID NO: 9073842 - DNA, 22 bp, Homo sapiens
tggagagtggtttgggggacat

SEQ ID NO: 9073843 - DNA, 22 bp, Homo sapiens
tggagagtgtagacttcagagt

SEQ ID NO: 9073844 - DNA, 22 bp, Homo sapiens
tggagagtctctgagccagggc

SEQ ID NO: 9073845 - DNA, 22 bp, Homo sapiens
tggagcagagatgggagcccaa

SEQ ID NO: 9073846 - DNA, 22 bp, Homo sapiens
tggagaggtttaaacaaaagtt

SEQ ID NO: 9073847 - DNA, 22 bp, Homo sapiens
tggagaggtttaaacaaaagtt

SEQ ID NO: 9073848 - DNA, 22 bp, Homo sapiens
tggagaggttgaataacttgtc

SEQ ID NO: 9073849 - DNA, 22 bp, Homo sapiens
tggagaggagcaccatggccat

SEQ ID NO: 9073850 - DNA, 19 bp, Homo sapiens
tggagaggaaatgctgctc

SEQ ID NO: 9073851 - DNA, 19 bp, Homo sapiens
tggagaggaaatgctgctc

SEQ ID NO: 9073852 - DNA, 22 bp, Homo sapiens
tggagaggttgaataacttgtc

SEQ ID NO: 9073853 - DNA, 22 bp, Homo sapiens
tggagaggagcaccatggccat

SEQ ID NO: 9073854 - DNA, 22 bp, Homo sapiens
tggagaggagcaccatggccat

SEQ ID NO: 9073855 - DNA, 22 bp, Homo sapiens
tggagaggagcaccatggccat

SEQ ID NO: 9073856 - DNA, 22 bp, Homo sapiens
tggagaggagcaccatggccat

SEQ ID NO: 9073857 - DNA, 22 bp, Homo sapiens
tggagaggagcaccatggccat

SEQ ID NO: 9073858 - DNA, 22 bp, Homo sapiens
tggagcagagatggtggccttc

SEQ ID NO: 9073859 - DNA, 22 bp, Homo sapiens
tggagcagagatggtggccttc

SEQ ID NO: 9073860 - DNA, 22 bp, Homo sapiens
tggagcagcatcactttgagct

SEQ ID NO: 9073861 - DNA, 22 bp, Homo sapiens
tggagcagcatcactttgagct

SEQ ID NO: 9073862 - DNA, 22 bp, Homo sapiens
tggagcagctaagcctctgaga

SEQ ID NO: 9073863 - DNA, 22 bp, Homo sapiens
tggagcagccatgatgacagag

SEQ ID NO: 9073864 - DNA, 22 bp, Homo sapiens
tggagaaagctgcatatggaaa

SEQ ID NO: 9073865 - DNA, 22 bp, Homo sapiens
tggagaagattggtcaccattc

SEQ ID NO: 9073866 - DNA, 22 bp, Homo sapiens
tggagaagattggtcaccattc

SEQ ID NO: 9073867 - DNA, 22 bp, Homo sapiens
tggagaaaaggttgaatccatc

SEQ ID NO: 9073868 - DNA, 22 bp, Homo sapiens
tggagaaaaggttgaatccatc

SEQ ID NO: 9073869 - DNA, 22 bp, Homo sapiens
tggagaaggccggccaggagtg

SEQ ID NO: 9073870 - DNA, 22 bp, Homo sapiens
tggagaaggggcagggtctcca

SEQ ID NO: 9073871 - DNA, 22 bp, Homo sapiens
tggagaaggccggccaggagtg

SEQ ID NO: 9073872 - DNA, 22 bp, Homo sapiens
tggagaaggacagcctgagaaa

SEQ ID NO: 9073873 - DNA, 22 bp, Homo sapiens
tggagagaaagttgaatggagg

SEQ ID NO: 9073874 - DNA, 22 bp, Homo sapiens
tggagaagtcaaagtgaacagg

SEQ ID NO: 9073875 - DNA, 22 bp, Homo sapiens
tggagaagtcaaagtgaacagg

SEQ ID NO: 9073876 - DNA, 22 bp, Homo sapiens
tggagagaagaggcagtgtgct

SEQ ID NO: 9073877 - DNA, 22 bp, Homo sapiens
tggagagaacagtgtctgaaag

SEQ ID NO: 9073878 - DNA, 22 bp, Homo sapiens
tggagagaacagtgtctgaaag

SEQ ID NO: 9073879 - DNA, 22 bp, Homo sapiens
tggagagcacagttcctgcttc

SEQ ID NO: 9073880 - DNA, 22 bp, Homo sapiens
tggagagcaatgaggggcaggc

SEQ ID NO: 9073881 - DNA, 22 bp, Homo sapiens
tggagagcccgagacatcctgt

SEQ ID NO: 9073882 - DNA, 21 bp, Homo sapiens
tggagagcccttgcctgagtc

SEQ ID NO: 9073883 - DNA, 22 bp, Homo sapiens
tggagagctcctatttgctgtc

SEQ ID NO: 9073884 - DNA, 22 bp, Homo sapiens
tggagagcgtgcttagcactct

SEQ ID NO: 9073885 - DNA, 22 bp, Homo sapiens
tggagagctatttggacctcca

SEQ ID NO: 9073886 - DNA, 22 bp, Homo sapiens
tggagagcgcgacgggaggaag

SEQ ID NO: 9073887 - DNA, 22 bp, Homo sapiens
tggagagcgcgacgggaggaag

SEQ ID NO: 9073888 - DNA, 22 bp, Homo sapiens
tggagaggaaagtgcagttttg

SEQ ID NO: 9073889 - DNA, 22 bp, Homo sapiens
tggagaggaaagtgcagttttg

SEQ ID NO: 9073890 - DNA, 19 bp, Homo sapiens
tggagaggaaatgctgctc

SEQ ID NO: 9073891 - DNA, 22 bp, Homo sapiens
tgctgcttggaaatggggctga

SEQ ID NO: 9073892 - DNA, 20 bp, Homo sapiens
tgctgctttgccactagttg

SEQ ID NO: 9073893 - DNA, 22 bp, Homo sapiens
tgctgcttttgtatatcagaga

SEQ ID NO: 9073894 - DNA, 20 bp, Homo sapiens
tgctgctgtgagcgtccctg

SEQ ID NO: 9073895 - DNA, 22 bp, Homo sapiens
tgctgctgttgacggctgtcca

SEQ ID NO: 9073896 - DNA, 19 bp, Homo sapiens
tgctgcttccagctcactc

SEQ ID NO: 9073897 - DNA, 22 bp, Homo sapiens
tgctgcttcacctgttgtacag

SEQ ID NO: 9073898 - DNA, 22 bp, Homo sapiens
tgctgctgatggatgcctggac

SEQ ID NO: 9073899 - DNA, 22 bp, Homo sapiens
tgctggagaaagtttttctgaa

SEQ ID NO: 9073900 - DNA, 22 bp, Homo sapiens
tgctggagaagctcctgggact

SEQ ID NO: 9073901 - DNA, 22 bp, Homo sapiens
tgctggagaagctcctgggact

SEQ ID NO: 9073902 - DNA, 22 bp, Homo sapiens
tgctggagaactgctctgtgtt

SEQ ID NO: 9073903 - DNA, 22 bp, Homo sapiens
tgctggagaactgctctgtgtt

SEQ ID NO: 9073904 - DNA, 22 bp, Homo sapiens
tgctggagaactgctctgtgtt

SEQ ID NO: 9073905 - DNA, 22 bp, Homo sapiens
tgctggagcggaggtgagccag

SEQ ID NO: 9073906 - DNA, 23 bp, Homo sapiens
tgctggagacaagtgtgagaagg

SEQ ID NO: 9073907 - DNA, 20 bp, Homo sapiens
tgctgcagtttcatgggact

SEQ ID NO: 9073908 - DNA, 22 bp, Homo sapiens
tgctgcatagcagctcctgaaa

SEQ ID NO: 9073909 - DNA, 22 bp, Homo sapiens
tgctgccaaatgcgagctctgt

SEQ ID NO: 9073910 - DNA, 22 bp, Homo sapiens
tgctgccaagcccgtgctcctg

SEQ ID NO: 9073911 - DNA, 22 bp, Homo sapiens
tgctgccacctggtggctgaag

SEQ ID NO: 9073912 - DNA, 22 bp, Homo sapiens
tgctgccacccctcaccagagc

SEQ ID NO: 9073913 - DNA, 22 bp, Homo sapiens
tgctgccacatttaaagagggg

SEQ ID NO: 9073914 - DNA, 22 bp, Homo sapiens
tgctgccacatttaaagagggg

SEQ ID NO: 9073915 - DNA, 17 bp, Homo sapiens
tgctgccaagtcccaac

SEQ ID NO: 9073916 - DNA, 22 bp, Homo sapiens
tgctgccacaaattcagctgcc

SEQ ID NO: 9073917 - DNA, 22 bp, Homo sapiens
tgctgccaggtcttgctgtcca

SEQ ID NO: 9073918 - DNA, 22 bp, Homo sapiens
tgctgccagggctctgcccaca

SEQ ID NO: 9073919 - DNA, 21 bp, Homo sapiens
tgctgccatagacctgaggga

SEQ ID NO: 9073920 - DNA, 21 bp, Homo sapiens
tgctgccatagacctgaggga

SEQ ID NO: 9073921 - DNA, 21 bp, Homo sapiens
tgctgccatcatgcagagatg

SEQ ID NO: 9073922 - DNA, 22 bp, Homo sapiens
tgctgccagccaggccatggag

SEQ ID NO: 9073923 - DNA, 22 bp, Homo sapiens
tgctgccactggtagtctcatt

SEQ ID NO: 9073924 - DNA, 22 bp, Homo sapiens
tgctgccagagagacagggact

SEQ ID NO: 9073925 - DNA, 22 bp, Homo sapiens
tgctgctgacatttggggcttg

SEQ ID NO: 9073926 - DNA, 22 bp, Homo sapiens
tgctgctgacatttggggcttg

SEQ ID NO: 9073927 - DNA, 22 bp, Homo sapiens
tgctgctgatgcatagtctgct

SEQ ID NO: 9073928 - DNA, 21 bp, Homo sapiens
tgctgctgatcggggttggct

SEQ ID NO: 9073929 - DNA, 22 bp, Homo sapiens
tgctgctgaggctaaagtatag

SEQ ID NO: 9073930 - DNA, 22 bp, Homo sapiens
tgctgctgaaaaggtgtgctta

SEQ ID NO: 9073931 - DNA, 22 bp, Homo sapiens
tgctgccatgcagagcaacaga

SEQ ID NO: 9073932 - DNA, 22 bp, Homo sapiens
tgctgccatggtcgctggtgtc

SEQ ID NO: 9073933 - DNA, 22 bp, Homo sapiens
tgctggaggagtttactgtggc

SEQ ID NO: 9073934 - DNA, 22 bp, Homo sapiens
tgctggaggagtttactgtggc

SEQ ID NO: 9073935 - DNA, 22 bp, Homo sapiens
tgctggaggagtttactgtggc

SEQ ID NO: 9073936 - DNA, 22 bp, Homo sapiens
tgctggaggagaaggttgctca

SEQ ID NO: 9073937 - DNA, 20 bp, Homo sapiens
tgctggaggcgccggcgctc

SEQ ID NO: 9073938 - DNA, 22 bp, Homo sapiens
tgctggaggcctgactgtgttt

SEQ ID NO: 9073939 - DNA, 22 bp, Homo sapiens
tgctggaggcctgactgtgttt

SEQ ID NO: 9073940 - DNA, 19 bp, Homo sapiens
tgctggaggttgacagggt

SEQ ID NO: 9073941 - DNA, 22 bp, Homo sapiens
tgctggaggggcctgaccagga

SEQ ID NO: 9073942 - DNA, 19 bp, Homo sapiens
tgctggagggtagtgagtc

SEQ ID NO: 9073943 - DNA, 22 bp, Homo sapiens
tgctggagtggcactgtgtggc

SEQ ID NO: 9073944 - DNA, 22 bp, Homo sapiens
tgctggagtggcactgtgtggc

SEQ ID NO: 9073945 - DNA, 21 bp, Homo sapiens
tgctggcaagactcaggaata

SEQ ID NO: 9073946 - DNA, 18 bp, Homo sapiens
tgctggcaactactattg

SEQ ID NO: 9073947 - DNA, 22 bp, Homo sapiens
tgctggcatcttaatgttctgt

SEQ ID NO: 9073948 - DNA, 22 bp, Homo sapiens
tgctggctgaggcctgagcggg

SEQ ID NO: 9073949 - DNA, 23 bp, Homo sapiens
tgctggctgaaacagccaaagga

SEQ ID NO: 9073950 - DNA, 21 bp, Homo sapiens
tgctggctgaaaggcacagag

SEQ ID NO: 9073951 - DNA, 21 bp, Homo sapiens
tgctggctgaaaggcacagag

SEQ ID NO: 9073952 - DNA, 22 bp, Homo sapiens
tgctggctcctcgaggcttcgt

SEQ ID NO: 9073953 - DNA, 22 bp, Homo sapiens
tgctggctcctcgaggcttcgt

SEQ ID NO: 9073954 - DNA, 22 bp, Homo sapiens
tgctggctcctcgaggcttcgt

SEQ ID NO: 9073955 - DNA, 22 bp, Homo sapiens
tgctggctctgggccaagcagg

SEQ ID NO: 9073956 - DNA, 22 bp, Homo sapiens
tgctggctctaggctgagacag

SEQ ID NO: 9073957 - DNA, 22 bp, Homo sapiens
tgctggctctaggctgagacag

SEQ ID NO: 9073958 - DNA, 22 bp, Homo sapiens
tgctggctcagtttgcagactc

SEQ ID NO: 9073959 - DNA, 22 bp, Homo sapiens
tgctggctatttaaagaagaaa

SEQ ID NO: 9073960 - DNA, 22 bp, Homo sapiens
tgctggctccaacctggcatct

SEQ ID NO: 9073961 - DNA, 22 bp, Homo sapiens
tgctggctcccaggagccgctg

SEQ ID NO: 9073962 - DNA, 22 bp, Homo sapiens
tgctggctactgatggcaggcc

SEQ ID NO: 9073963 - DNA, 22 bp, Homo sapiens
tgctggctactgatggcaggcc

SEQ ID NO: 9073964 - DNA, 22 bp, Homo sapiens
tgctggcatttcaggactcacc

SEQ ID NO: 9073965 - DNA, 22 bp, Homo sapiens
tgctggctgtatatgtgagagt

SEQ ID NO: 9073966 - DNA, 22 bp, Homo sapiens
tgctggctgggctgctggagac

SEQ ID NO: 9073967 - DNA, 22 bp, Homo sapiens
tgctggctgtatatgtgagagt

SEQ ID NO: 9073968 - DNA, 22 bp, Homo sapiens
tgctggctgtatatgtgagagt

SEQ ID NO: 9073969 - DNA, 22 bp, Homo sapiens
tgctggctgggctgctggagac

SEQ ID NO: 9073970 - DNA, 22 bp, Homo sapiens
tgctggctggcctggcctggac

SEQ ID NO: 9073971 - DNA, 22 bp, Homo sapiens
tgctggctggcctggcctggac

SEQ ID NO: 9073972 - DNA, 22 bp, Homo sapiens
tgctggctggagtgcctctgga

SEQ ID NO: 9073973 - DNA, 22 bp, Homo sapiens
tgctggctggagtgcctctgga

SEQ ID NO: 9073974 - DNA, 22 bp, Homo sapiens
tgctggctggatcagagattgg

SEQ ID NO: 9073975 - DNA, 22 bp, Homo sapiens
tgctggctggatcagagattgg

SEQ ID NO: 9073976 - DNA, 22 bp, Homo sapiens
tgctggctggatcagagattgg

SEQ ID NO: 9073977 - DNA, 22 bp, Homo sapiens
tgctggctgccaggttccctgt

SEQ ID NO: 9073978 - DNA, 22 bp, Homo sapiens
tgctggctgcagtgctgtcaaa

SEQ ID NO: 9073979 - DNA, 22 bp, Homo sapiens
tgctggctgttctagggaggcc

SEQ ID NO: 9073980 - DNA, 22 bp, Homo sapiens
tgctggcttagatatcactgcc

SEQ ID NO: 9073981 - DNA, 22 bp, Homo sapiens
tgctggcttatttagtaaatgt

SEQ ID NO: 9073982 - DNA, 23 bp, Homo sapiens
tgctggcttccagctgctccctc

SEQ ID NO: 9073983 - DNA, 23 bp, Homo sapiens
tgctggcttccagctgctccctc

SEQ ID NO: 9073984 - DNA, 22 bp, Homo sapiens
tgctggctgtccctacctggct

SEQ ID NO: 9073985 - DNA, 22 bp, Homo sapiens
tgctggctgtgtaccatctcaa

SEQ ID NO: 9073986 - DNA, 22 bp, Homo sapiens
tgctggctgttctagggaggcc

SEQ ID NO: 9073987 - DNA, 23 bp, Homo sapiens
tgctggctgtgttattgccaaca

SEQ ID NO: 9073988 - DNA, 22 bp, Homo sapiens
tgctggctgtgtaccatctcaa

SEQ ID NO: 9073989 - DNA, 23 bp, Homo sapiens
tgctggggtagtttgtggcacag

SEQ ID NO: 9073990 - DNA, 23 bp, Homo sapiens
tgctggggtagtttgtggcacag

SEQ ID NO: 9073991 - DNA, 22 bp, Homo sapiens
tgctggggtcatggggcgcccg

SEQ ID NO: 9073992 - DNA, 20 bp, Homo sapiens
tgctggggacatacagggtg

SEQ ID NO: 9073993 - DNA, 22 bp, Homo sapiens
tgctggggcagaagagccaaga

SEQ ID NO: 9073994 - DNA, 22 bp, Homo sapiens
tgctggggcagaagagccaaga

SEQ ID NO: 9073995 - DNA, 22 bp, Homo sapiens
tgctggggatccgtaccaaccc

SEQ ID NO: 9073996 - DNA, 22 bp, Homo sapiens
tgctgtcagttggcaggatgag

SEQ ID NO: 9073997 - DNA, 22 bp, Homo sapiens
tgctgtcccccgtgtctgggct

SEQ ID NO: 9073998 - DNA, 22 bp, Homo sapiens
tgctgtagccctgcacagtgca

SEQ ID NO: 9073999 - DNA, 23 bp, Homo sapiens
tgctggttcaaaaaggaaggagg

SEQ ID NO: 9074000 - DNA, 23 bp, Homo sapiens
tgctggtgtttttgggaccaggg

SEQ ID NO: 9074001 - DNA, 23 bp, Homo sapiens
tgctggtgtttttgggaccaggg

SEQ ID NO: 9074002 - DNA, 21 bp, Homo sapiens
tgctgggtttgcccatcaggc

SEQ ID NO: 9074003 - DNA, 22 bp, Homo sapiens
tgctgggtggttgctcctcccg

SEQ ID NO: 9074004 - DNA, 22 bp, Homo sapiens
tgctgggtgttccgcacttgac

SEQ ID NO: 9074005 - DNA, 21 bp, Homo sapiens
tgctggtgagctcatgtggct

SEQ ID NO: 9074006 - DNA, 21 bp, Homo sapiens
tgctggtgagctcatgtggct

SEQ ID NO: 9074007 - DNA, 22 bp, Homo sapiens
tgctggtgattaaatcctgaag

SEQ ID NO: 9074008 - DNA, 22 bp, Homo sapiens
tgctggtggagaaagtggaggt

SEQ ID NO: 9074009 - DNA, 22 bp, Homo sapiens
tgctggtggagaaagtggaggt

SEQ ID NO: 9074010 - DNA, 22 bp, Homo sapiens
tgctggtgattaaatcctgaag

SEQ ID NO: 9074011 - DNA, 22 bp, Homo sapiens
tgctggtgaggtccttgctgga

SEQ ID NO: 9074012 - DNA, 22 bp, Homo sapiens
tgctgggctgcacccccagagt

SEQ ID NO: 9074013 - DNA, 22 bp, Homo sapiens
tgctgggctggggcctcagacc

SEQ ID NO: 9074014 - DNA, 22 bp, Homo sapiens
tgctgggctgttcctgtccatg

SEQ ID NO: 9074015 - DNA, 22 bp, Homo sapiens
tgctgggcttgaaagctgctaa

SEQ ID NO: 9074016 - DNA, 22 bp, Homo sapiens
tgctgggcttcacccccacagt

SEQ ID NO: 9074017 - DNA, 22 bp, Homo sapiens
tgctgggctagaagctgaggcc

SEQ ID NO: 9074018 - DNA, 22 bp, Homo sapiens
tgctgggcctttacctccaggg

SEQ ID NO: 9074019 - DNA, 22 bp, Homo sapiens
tgctgggctagggtggagctct

SEQ ID NO: 9074020 - DNA, 22 bp, Homo sapiens
tgctgggctcaacctccagagc

SEQ ID NO: 9074021 - DNA, 22 bp, Homo sapiens
tgctgggctagggtggagctct

SEQ ID NO: 9074022 - DNA, 22 bp, Homo sapiens
tgctgggccaaagcagggtttt

SEQ ID NO: 9074023 - DNA, 22 bp, Homo sapiens
tgctggcttggaaggaaagcgc

SEQ ID NO: 9074024 - DNA, 22 bp, Homo sapiens
tgctggcttcctgtgcacagca

SEQ ID NO: 9074025 - DNA, 23 bp, Homo sapiens
tgctgggcagagctggtgctgag

SEQ ID NO: 9074026 - DNA, 22 bp, Homo sapiens
tgcttcagcactttgagagcct

SEQ ID NO: 9074027 - DNA, 22 bp, Homo sapiens
tgcttcagcactttgagagcct

SEQ ID NO: 9074028 - DNA, 22 bp, Homo sapiens
tgcttcacaagaattcaggacc

SEQ ID NO: 9074029 - DNA, 22 bp, Homo sapiens
tgcttcagtgctctgagcctgt

SEQ ID NO: 9074030 - DNA, 22 bp, Homo sapiens
tgcttcagtgtgtcattattta

SEQ ID NO: 9074031 - DNA, 22 bp, Homo sapiens
tgcttcaggagatgtcaccatg

SEQ ID NO: 9074032 - DNA, 22 bp, Homo sapiens
tgcttcaggaagaaacgccagg

SEQ ID NO: 9074033 - DNA, 22 bp, Homo sapiens
tgcttcagtcctatgggcaggt

SEQ ID NO: 9074034 - DNA, 22 bp, Homo sapiens
tgcttctcccaaccagggcctg

SEQ ID NO: 9074035 - DNA, 21 bp, Homo sapiens
tgcttctctagatcaactact

SEQ ID NO: 9074036 - DNA, 21 bp, Homo sapiens
tgcttctctagatcaactact

SEQ ID NO: 9074037 - DNA, 23 bp, Homo sapiens
tgcttctctgcttgacagttctg

SEQ ID NO: 9074038 - DNA, 23 bp, Homo sapiens
tgcttctctgcttgacagttctg

SEQ ID NO: 9074039 - DNA, 22 bp, Homo sapiens
tgcttaaaatgatgattatttt

SEQ ID NO: 9074040 - DNA, 22 bp, Homo sapiens
tgctgtgcatcatagtgtttgg

SEQ ID NO: 9074041 - DNA, 18 bp, Homo sapiens
tgctgtgcacagccctat

SEQ ID NO: 9074042 - DNA, 22 bp, Homo sapiens
tgcttaaaaagctccatcaata

SEQ ID NO: 9074043 - DNA, 22 bp, Homo sapiens
tgctgtgaggttgagaaggaag

SEQ ID NO: 9074044 - DNA, 22 bp, Homo sapiens
tgctgtgaggttgagaaggaag

SEQ ID NO: 9074045 - DNA, 22 bp, Homo sapiens
tgctgtgcaaaggtgatgtgag

SEQ ID NO: 9074046 - DNA, 22 bp, Homo sapiens
tgctgtgaggttgagaaggaag

SEQ ID NO: 9074047 - DNA, 22 bp, Homo sapiens
tgctgtgacagagtctcatgga

SEQ ID NO: 9074048 - DNA, 22 bp, Homo sapiens
tgctgtctttttcccttcctaa

SEQ ID NO: 9074049 - DNA, 17 bp, Homo sapiens
tgctgtctgcttcccta

SEQ ID NO: 9074050 - DNA, 22 bp, Homo sapiens
tgctgtctgtttactggctata

SEQ ID NO: 9074051 - DNA, 22 bp, Homo sapiens
tgctgtctttcattgtctgcct

SEQ ID NO: 9074052 - DNA, 22 bp, Homo sapiens
tgctgtccctaagtctcttcaa

SEQ ID NO: 9074053 - DNA, 22 bp, Homo sapiens
tgcttaaaggatagtttaaact

SEQ ID NO: 9074054 - DNA, 22 bp, Homo sapiens
tgcttaaacacatacatacata

SEQ ID NO: 9074055 - DNA, 22 bp, Homo sapiens
tgcttaggttggtctagaccat

SEQ ID NO: 9074056 - DNA, 22 bp, Homo sapiens
tgcttagggctcctccaataga

SEQ ID NO: 9074057 - DNA, 22 bp, Homo sapiens
tgcttaggtgttatgtaatatc

SEQ ID NO: 9074058 - DNA, 22 bp, Homo sapiens
tgcttaggctaacaaaaatagc

SEQ ID NO: 9074059 - DNA, 22 bp, Homo sapiens
tgcttaatattgtgatgtaata

SEQ ID NO: 9074060 - DNA, 22 bp, Homo sapiens
tgctcagttcaaggaaggtgga

SEQ ID NO: 9074061 - DNA, 22 bp, Homo sapiens
tgctcagttaagcagaggaaat

SEQ ID NO: 9074062 - DNA, 19 bp, Homo sapiens
tgctcagtggctaaaagca

SEQ ID NO: 9074063 - DNA, 22 bp, Homo sapiens
tgctcagtgagtctgtgacagg

SEQ ID NO: 9074064 - DNA, 21 bp, Homo sapiens
tgctcatgagcccacagctgc

SEQ ID NO: 9074065 - DNA, 22 bp, Homo sapiens
tgctcatgatgccttttaaaag

SEQ ID NO: 9074066 - DNA, 22 bp, Homo sapiens
tgctcatcaacatgatgatcat

SEQ ID NO: 9074067 - DNA, 22 bp, Homo sapiens
tgctcatcaacatgatgatcat

SEQ ID NO: 9074068 - DNA, 22 bp, Homo sapiens
tgctcagcttcagaggatcccc

SEQ ID NO: 9074069 - DNA, 22 bp, Homo sapiens
tgctcagtagcagtgtgctgct

SEQ ID NO: 9074070 - DNA, 22 bp, Homo sapiens
tgctcagtcctcctgcagtgcc

SEQ ID NO: 9074071 - DNA, 22 bp, Homo sapiens
tgctcactgaactcttgctgtc

SEQ ID NO: 9074072 - DNA, 22 bp, Homo sapiens
tgctcactgaactcttgctgtc

SEQ ID NO: 9074073 - DNA, 22 bp, Homo sapiens
tgctcacaattatcagaagtat

SEQ ID NO: 9074074 - DNA, 22 bp, Homo sapiens
tgctcacaattatcagaagtat

SEQ ID NO: 9074075 - DNA, 22 bp, Homo sapiens
tgctcacagcccagaacataat

SEQ ID NO: 9074076 - DNA, 21 bp, Homo sapiens
tgctcacagatgtgctcagtg

SEQ ID NO: 9074077 - DNA, 22 bp, Homo sapiens
tgctcagaaagccaccagagcg

SEQ ID NO: 9074078 - DNA, 22 bp, Homo sapiens
tgctcagacaagctgaacagta

SEQ ID NO: 9074079 - DNA, 22 bp, Homo sapiens
tgctcagactagctccagggaa

SEQ ID NO: 9074080 - DNA, 22 bp, Homo sapiens
tgctcagacaagctgaacagta

SEQ ID NO: 9074081 - DNA, 22 bp, Homo sapiens
tgctcagagactctccctgagc

SEQ ID NO: 9074082 - DNA, 22 bp, Homo sapiens
tgctcagagctccagctctcct

SEQ ID NO: 9074083 - DNA, 22 bp, Homo sapiens
tgctcagcgccaaagctgatgg

SEQ ID NO: 9074084 - DNA, 22 bp, Homo sapiens
tgctcagcagatctcaggagat

SEQ ID NO: 9074085 - DNA, 22 bp, Homo sapiens
tgctcagcagtcaaggtcatag

SEQ ID NO: 9074086 - DNA, 22 bp, Homo sapiens
tgcggaaggcagcgcagggtgg

SEQ ID NO: 9074087 - DNA, 22 bp, Homo sapiens
tgctaaattcattattgattta

SEQ ID NO: 9074088 - DNA, 22 bp, Homo sapiens
tgctaaattgcgttagccaaga

SEQ ID NO: 9074089 - DNA, 22 bp, Homo sapiens
tgctaacaaagtctaaatcata

SEQ ID NO: 9074090 - DNA, 22 bp, Homo sapiens
tgcgttgcgctcctgcagcagg

SEQ ID NO: 9074091 - DNA, 22 bp, Homo sapiens
tgcgggttggtggcatatgcag

SEQ ID NO: 9074092 - DNA, 22 bp, Homo sapiens
tgctattttagacatactttgt

SEQ ID NO: 9074093 - DNA, 22 bp, Homo sapiens
tgctatttctctgctgtaaaat

SEQ ID NO: 9074094 - DNA, 19 bp, Homo sapiens
tgctatttgaagaagtgta

SEQ ID NO: 9074095 - DNA, 19 bp, Homo sapiens
tgctatttgaagaagtgta

SEQ ID NO: 9074096 - DNA, 22 bp, Homo sapiens
tgctattaaattaaattgatat

SEQ ID NO: 9074097 - DNA, 22 bp, Homo sapiens
tgctattacctgctggacagtc

SEQ ID NO: 9074098 - DNA, 22 bp, Homo sapiens
tgctatcaccaactctgctaag

SEQ ID NO: 9074099 - DNA, 22 bp, Homo sapiens
tgcgaccctagccccctcactt

SEQ ID NO: 9074100 - DNA, 22 bp, Homo sapiens
tgccttttctgtagctctggaa

SEQ ID NO: 9074101 - DNA, 22 bp, Homo sapiens
tgccttttgaagcctcacaggt

SEQ ID NO: 9074102 - DNA, 20 bp, Homo sapiens
tgcctttcctgtttcatctt

SEQ ID NO: 9074103 - DNA, 22 bp, Homo sapiens
tgccttttccagtttctagggg

SEQ ID NO: 9074104 - DNA, 22 bp, Homo sapiens
tgccttttccagcttccaggag

SEQ ID NO: 9074105 - DNA, 22 bp, Homo sapiens
tgccttttatggctagcctcag

SEQ ID NO: 9074106 - DNA, 22 bp, Homo sapiens
tgccttggattgcagggaacct

SEQ ID NO: 9074107 - DNA, 20 bp, Homo sapiens
tgccttggagcagccaaggt

SEQ ID NO: 9074108 - DNA, 20 bp, Homo sapiens
tgccttggagcagccaaggt

SEQ ID NO: 9074109 - DNA, 20 bp, Homo sapiens
tgccttggagcagccaaggt

SEQ ID NO: 9074110 - DNA, 20 bp, Homo sapiens
tgccttgggacagtgcctgt

SEQ ID NO: 9074111 - DNA, 21 bp, Homo sapiens
tgccttggcaaatgaccatga

SEQ ID NO: 9074112 - DNA, 21 bp, Homo sapiens
tgccttggcaaatgaccatga

SEQ ID NO: 9074113 - DNA, 22 bp, Homo sapiens
tgccttgggatatatggacact

SEQ ID NO: 9074114 - DNA, 22 bp, Homo sapiens
tgccttgggagccagcatgcca

SEQ ID NO: 9074115 - DNA, 22 bp, Homo sapiens
tgccttgggagccagcatgcca

SEQ ID NO: 9074116 - DNA, 22 bp, Homo sapiens
tgccttgtggggaaggatttag

SEQ ID NO: 9074117 - DNA, 22 bp, Homo sapiens
tgcctgtggaaaggctggtgct

SEQ ID NO: 9074118 - DNA, 22 bp, Homo sapiens
tgcctgtgcccttcttggcatt

SEQ ID NO: 9074119 - DNA, 22 bp, Homo sapiens
tgcctgtgtcacagtgatgttt

SEQ ID NO: 9074120 - DNA, 22 bp, Homo sapiens
tgcctgtgtccccttcttggca

SEQ ID NO: 9074121 - DNA, 22 bp, Homo sapiens
tgccttcttctccctggctcag

SEQ ID NO: 9074122 - DNA, 22 bp, Homo sapiens
tgccttgcaggttttaaataca

SEQ ID NO: 9074123 - DNA, 22 bp, Homo sapiens
tgccttgaacatagtggacagt

SEQ ID NO: 9074124 - DNA, 22 bp, Homo sapiens
tgccttgacagttgtaagacct

SEQ ID NO: 9074125 - DNA, 21 bp, Homo sapiens
tgcctggcctttgcttttcct

SEQ ID NO: 9074126 - DNA, 22 bp, Homo sapiens
tgcctggctaatttttgtatcc

SEQ ID NO: 9074127 - DNA, 22 bp, Homo sapiens
tgcctggctctatcagtggtgg

SEQ ID NO: 9074128 - DNA, 22 bp, Homo sapiens
tgcctggctgaggtgacaggtt

SEQ ID NO: 9074129 - DNA, 22 bp, Homo sapiens
tgcctggccctgacagccctgg

SEQ ID NO: 9074130 - DNA, 22 bp, Homo sapiens
tgcctggccctgacagccctgg

SEQ ID NO: 9074131 - DNA, 21 bp, Homo sapiens
tgcctggcctttgcttttcct

SEQ ID NO: 9074132 - DNA, 20 bp, Homo sapiens
tgcctggcctttctctgccc

SEQ ID NO: 9074133 - DNA, 22 bp, Homo sapiens
tgcctgggggactaaggccaaa

SEQ ID NO: 9074134 - DNA, 22 bp, Homo sapiens
tgcctgggggactaaggccaaa

SEQ ID NO: 9074135 - DNA, 22 bp, Homo sapiens
tgcctggggttggcaaactgct

SEQ ID NO: 9074136 - DNA, 22 bp, Homo sapiens
tgcctgggtccaggccaagcct

SEQ ID NO: 9074137 - DNA, 22 bp, Homo sapiens
tgcctgggtccaggccaagcct

SEQ ID NO: 9074138 - DNA, 22 bp, Homo sapiens
tgcctgggtccaggccaagcct

SEQ ID NO: 9074139 - DNA, 22 bp, Homo sapiens
tgcctgggctcggtagccatcg

SEQ ID NO: 9074140 - DNA, 22 bp, Homo sapiens
tgcctggggattgctctgggcc

SEQ ID NO: 9074141 - DNA, 22 bp, Homo sapiens
tgcctggctgggctgctcatgg

SEQ ID NO: 9074142 - DNA, 22 bp, Homo sapiens
tgcctgtcttaatatctggaaa

SEQ ID NO: 9074143 - DNA, 22 bp, Homo sapiens
tgcctgtctctgactgccatta

SEQ ID NO: 9074144 - DNA, 22 bp, Homo sapiens
tgcctgtcttcaggagtgtcac

SEQ ID NO: 9074145 - DNA, 22 bp, Homo sapiens
tgcctgtcttcaggagtgtcac

SEQ ID NO: 9074146 - DNA, 22 bp, Homo sapiens
tgcctgtctctgactgccatta

SEQ ID NO: 9074147 - DNA, 22 bp, Homo sapiens
tgcctgtctcctctgcagggtg

SEQ ID NO: 9074148 - DNA, 19 bp, Homo sapiens
tgcctgtcagtagatctca

SEQ ID NO: 9074149 - DNA, 22 bp, Homo sapiens
tgcctgtcctgaggatgagggt

SEQ ID NO: 9074150 - DNA, 19 bp, Homo sapiens
tgcctgtcagtagatctca

SEQ ID NO: 9074151 - DNA, 22 bp, Homo sapiens
tgcctgtctttcctccctcgta

SEQ ID NO: 9074152 - DNA, 22 bp, Homo sapiens
tgcctgtcttggagtcctggcc

SEQ ID NO: 9074153 - DNA, 22 bp, Homo sapiens
tgcctgtcttggagtcctggcc

SEQ ID NO: 9074154 - DNA, 22 bp, Homo sapiens
tgcctgggtgtaaagggccaac

SEQ ID NO: 9074155 - DNA, 22 bp, Homo sapiens
tgcctgggttcccaccccaaag

SEQ ID NO: 9074156 - DNA, 22 bp, Homo sapiens
tgcctgggtgtaaagggccaac

SEQ ID NO: 9074157 - DNA, 22 bp, Homo sapiens
tgcctgtcagggggagtgggaa

SEQ ID NO: 9074158 - DNA, 22 bp, Homo sapiens
tgcctgggttgactcttagctg

SEQ ID NO: 9074159 - DNA, 22 bp, Homo sapiens
tgcctgggtgctggctggtcac

SEQ ID NO: 9074160 - DNA, 22 bp, Homo sapiens
tgctgcagggatttcagagaca

SEQ ID NO: 9074161 - DNA, 22 bp, Homo sapiens
tgctgcaggtgtgttcagtgag

SEQ ID NO: 9074162 - DNA, 22 bp, Homo sapiens
tgctgaggttgtggagtgcatt

SEQ ID NO: 9074163 - DNA, 22 bp, Homo sapiens
tgctgaggtttctgactatgga

SEQ ID NO: 9074164 - DNA, 22 bp, Homo sapiens
tgctgaggtttctgactatgga

SEQ ID NO: 9074165 - DNA, 22 bp, Homo sapiens
tgctgaggtttcgtctgcttgc

SEQ ID NO: 9074166 - DNA, 22 bp, Homo sapiens
tgctgaggcccaggagcacttt

SEQ ID NO: 9074167 - DNA, 20 bp, Homo sapiens
tgctgaggcctgaggcctgg

SEQ ID NO: 9074168 - DNA, 22 bp, Homo sapiens
tgctgaggcagtcctaacagga

SEQ ID NO: 9074169 - DNA, 22 bp, Homo sapiens
tgctgaggcatttggacagagt

SEQ ID NO: 9074170 - DNA, 22 bp, Homo sapiens
tgctgaggcatttggacagagt

SEQ ID NO: 9074171 - DNA, 22 bp, Homo sapiens
tgctgaggcagatgtctgtgac

SEQ ID NO: 9074172 - DNA, 22 bp, Homo sapiens
tgctgaggtcacggcggccaga

SEQ ID NO: 9074173 - DNA, 22 bp, Homo sapiens
tgctgaggctagacctggaagt

SEQ ID NO: 9074174 - DNA, 22 bp, Homo sapiens
tgctgagggagcatcaaagaaa

SEQ ID NO: 9074175 - DNA, 22 bp, Homo sapiens
tgctgagggagcatcaaagaaa

SEQ ID NO: 9074176 - DNA, 22 bp, Homo sapiens
tgctgagggctgttaaggaagc

SEQ ID NO: 9074177 - DNA, 22 bp, Homo sapiens
tgctgaggtcaccttgctgcta

SEQ ID NO: 9074178 - DNA, 22 bp, Homo sapiens
tgctgaggaggtggctgtgctt

SEQ ID NO: 9074179 - DNA, 22 bp, Homo sapiens
tgctgaggaggtggctgtgctt

SEQ ID NO: 9074180 - DNA, 22 bp, Homo sapiens
tgctgaggactaaaggagatga

SEQ ID NO: 9074181 - DNA, 22 bp, Homo sapiens
tgctgaggacacctagccttct

SEQ ID NO: 9074182 - DNA, 22 bp, Homo sapiens
tgctgagcgcatccggcggccg

SEQ ID NO: 9074183 - DNA, 22 bp, Homo sapiens
tgctgagcgcatccggcggccg

SEQ ID NO: 9074184 - DNA, 22 bp, Homo sapiens
tgctgagcgcatccggcggccg

SEQ ID NO: 9074185 - DNA, 23 bp, Homo sapiens
tgctcttctcagacctgtcagcc

SEQ ID NO: 9074186 - DNA, 22 bp, Homo sapiens
tgctgaaacaataacatactgg

SEQ ID NO: 9074187 - DNA, 22 bp, Homo sapiens
tgctcttcggggccactgcttg

SEQ ID NO: 9074188 - DNA, 22 bp, Homo sapiens
tgctctggtcctccctcggcgc

SEQ ID NO: 9074189 - DNA, 22 bp, Homo sapiens
tgctctgggggaagccagctgt

SEQ ID NO: 9074190 - DNA, 20 bp, Homo sapiens
tgctctgggggtggagagac

SEQ ID NO: 9074191 - DNA, 20 bp, Homo sapiens
tgctctgggggtggagagac

SEQ ID NO: 9074192 - DNA, 23 bp, Homo sapiens
tgctcccaggtgacgctgctgtt

SEQ ID NO: 9074193 - DNA, 23 bp, Homo sapiens
tgctcccaggtgacgctgctgtt

SEQ ID NO: 9074194 - DNA, 22 bp, Homo sapiens
tgctcccaggcattctctgttg

SEQ ID NO: 9074195 - DNA, 22 bp, Homo sapiens
tgctcccagggactctggctgg

SEQ ID NO: 9074196 - DNA, 22 bp, Homo sapiens
tgctcccagggactctggctgg

SEQ ID NO: 9074197 - DNA, 22 bp, Homo sapiens
tgctcccaggctctgtggtctg

SEQ ID NO: 9074198 - DNA, 22 bp, Homo sapiens
tgctcccaggcattctctgttg

SEQ ID NO: 9074199 - DNA, 22 bp, Homo sapiens
tgctcccaggactcttgagcca

SEQ ID NO: 9074200 - DNA, 22 bp, Homo sapiens
tgctcccaggactcttgagcca

SEQ ID NO: 9074201 - DNA, 22 bp, Homo sapiens
tgctcctgctgcatgcatctcc

SEQ ID NO: 9074202 - DNA, 22 bp, Homo sapiens
tgctcctgctgcatgcatctcc

SEQ ID NO: 9074203 - DNA, 22 bp, Homo sapiens
tgctcctgctgcatgcatctcc

SEQ ID NO: 9074204 - DNA, 22 bp, Homo sapiens
tgctctaagaactctaggaatt

SEQ ID NO: 9074205 - DNA, 22 bp, Homo sapiens
tgctcctgtttcatcagctata

SEQ ID NO: 9074206 - DNA, 17 bp, Homo sapiens
tgctcctgggacaagga

SEQ ID NO: 9074207 - DNA, 22 bp, Homo sapiens
tgctctggggagctcctctgcg

SEQ ID NO: 9074208 - DNA, 22 bp, Homo sapiens
tgctctgggctcaatggcagct

SEQ ID NO: 9074209 - DNA, 22 bp, Homo sapiens
tgctctgggattcagcagcctg

SEQ ID NO: 9074210 - DNA, 22 bp, Homo sapiens
tgctctggctggagcaatgact

SEQ ID NO: 9074211 - DNA, 22 bp, Homo sapiens
tgctctcatggaggtagagaat

SEQ ID NO: 9074212 - DNA, 22 bp, Homo sapiens
tgctctcagagtcaggaggtaa

SEQ ID NO: 9074213 - DNA, 22 bp, Homo sapiens
tgctctggctgggatgagtgca

SEQ ID NO: 9074214 - DNA, 22 bp, Homo sapiens
tgctctctcaggcctggcccac

SEQ ID NO: 9074215 - DNA, 22 bp, Homo sapiens
tgctctgggattcagcagcctg

SEQ ID NO: 9074216 - DNA, 22 bp, Homo sapiens
tggccacttggcatgtgtgcca

SEQ ID NO: 9074217 - DNA, 22 bp, Homo sapiens
tggccaccttcccacttctgcc

SEQ ID NO: 9074218 - DNA, 22 bp, Homo sapiens
tggccaccttcccacttctgcc

SEQ ID NO: 9074219 - DNA, 22 bp, Homo sapiens
tggccaccttatggctattgga

SEQ ID NO: 9074220 - DNA, 22 bp, Homo sapiens
tggccaccttatggctattgga

SEQ ID NO: 9074221 - DNA, 20 bp, Homo sapiens
tggccacctgcgtcccagcc

SEQ ID NO: 9074222 - DNA, 19 bp, Homo sapiens
tggccacctctgctgttct

SEQ ID NO: 9074223 - DNA, 19 bp, Homo sapiens
tggccacctctgctgttct

SEQ ID NO: 9074224 - DNA, 22 bp, Homo sapiens
tggccacagtgtccagcagcag

SEQ ID NO: 9074225 - DNA, 22 bp, Homo sapiens
tggccacatgcgtctgtgaggc

SEQ ID NO: 9074226 - DNA, 20 bp, Homo sapiens
tggccaccactgtatatcaa

SEQ ID NO: 9074227 - DNA, 22 bp, Homo sapiens
tggccaccaccaatacttgcct

SEQ ID NO: 9074228 - DNA, 22 bp, Homo sapiens
tggccacccaccctaatctttc

SEQ ID NO: 9074229 - DNA, 22 bp, Homo sapiens
tggccacccccaatgtcagtag

SEQ ID NO: 9074230 - DNA, 22 bp, Homo sapiens
tggccacccccaatgtcagtag

SEQ ID NO: 9074231 - DNA, 22 bp, Homo sapiens
tggccacccagctgacgccttc

SEQ ID NO: 9074232 - DNA, 22 bp, Homo sapiens
tggccacccagctgacgccttc

SEQ ID NO: 9074233 - DNA, 22 bp, Homo sapiens
tggccacccctttctctgcact

SEQ ID NO: 9074234 - DNA, 22 bp, Homo sapiens
tggccacccctttctctgcact

SEQ ID NO: 9074235 - DNA, 22 bp, Homo sapiens
tggcatttctggccatttgtgt

SEQ ID NO: 9074236 - DNA, 22 bp, Homo sapiens
tggccacacccacctagaggag

SEQ ID NO: 9074237 - DNA, 22 bp, Homo sapiens
tggccacagcctctgccagttc

SEQ ID NO: 9074238 - DNA, 22 bp, Homo sapiens
tggccacactgcccccactggg

SEQ ID NO: 9074239 - DNA, 22 bp, Homo sapiens
tggcatttcacctttcatttcc

SEQ ID NO: 9074240 - DNA, 19 bp, Homo sapiens
tggcattggtccagataaa

SEQ ID NO: 9074241 - DNA, 22 bp, Homo sapiens
tggcattgcttctgaagtggag

SEQ ID NO: 9074242 - DNA, 22 bp, Homo sapiens
tggcatgtttaatgtactgtat

SEQ ID NO: 9074243 - DNA, 22 bp, Homo sapiens
tggcatgtggcagctggttcag

SEQ ID NO: 9074244 - DNA, 22 bp, Homo sapiens
tggcatgtaacatctccagatt

SEQ ID NO: 9074245 - DNA, 22 bp, Homo sapiens
tggcatgtatacttgagtagga

SEQ ID NO: 9074246 - DNA, 22 bp, Homo sapiens
tggccaggcattcagataagac

SEQ ID NO: 9074247 - DNA, 21 bp, Homo sapiens
tggccagctgctcgtctcctc

SEQ ID NO: 9074248 - DNA, 22 bp, Homo sapiens
tggccagcctggtgcttgctcc

SEQ ID NO: 9074249 - DNA, 22 bp, Homo sapiens
tggccagccttgtcatcgcttt

SEQ ID NO: 9074250 - DNA, 22 bp, Homo sapiens
tggccagccttgtcatcgcttt

SEQ ID NO: 9074251 - DNA, 22 bp, Homo sapiens
tggccagctgagatttagcaca

SEQ ID NO: 9074252 - DNA, 22 bp, Homo sapiens
tggccaggccggggacagaact

SEQ ID NO: 9074253 - DNA, 22 bp, Homo sapiens
tggccaggccggggacagaact

SEQ ID NO: 9074254 - DNA, 22 bp, Homo sapiens
tggccaggcctcttggtgccca

SEQ ID NO: 9074255 - DNA, 22 bp, Homo sapiens
tggccaggccggggacagaact

SEQ ID NO: 9074256 - DNA, 22 bp, Homo sapiens
tggccaggccggggacagaact

SEQ ID NO: 9074257 - DNA, 22 bp, Homo sapiens
tggccaggcattcagataagac

SEQ ID NO: 9074258 - DNA, 22 bp, Homo sapiens
tggccagattcatgcatgtatc

SEQ ID NO: 9074259 - DNA, 22 bp, Homo sapiens
tggccagattcatgcatgtatc

SEQ ID NO: 9074260 - DNA, 22 bp, Homo sapiens
tggccagcacttagcccttacc

SEQ ID NO: 9074261 - DNA, 23 bp, Homo sapiens
tggccagcagaagcaaggggagc

SEQ ID NO: 9074262 - DNA, 22 bp, Homo sapiens
tggccagccagaaagaagcctt

SEQ ID NO: 9074263 - DNA, 22 bp, Homo sapiens
tggccagccacaatataaagta

SEQ ID NO: 9074264 - DNA, 22 bp, Homo sapiens
tggccagcagagttcactctct

SEQ ID NO: 9074265 - DNA, 22 bp, Homo sapiens
tggccagcagagttcactctct

SEQ ID NO: 9074266 - DNA, 22 bp, Homo sapiens
tggccagcccttcagccatgcc

SEQ ID NO: 9074267 - DNA, 22 bp, Homo sapiens
tggccagcccttcagccatgcc

SEQ ID NO: 9074268 - DNA, 22 bp, Homo sapiens
tggccagccctcttcccacact

SEQ ID NO: 9074269 - DNA, 22 bp, Homo sapiens
tggccagccctcttcccacact

SEQ ID NO: 9074270 - DNA, 22 bp, Homo sapiens
tggccagccataaaagaaccca

SEQ ID NO: 9074271 - DNA, 22 bp, Homo sapiens
tggccaggggagttcccctcca

SEQ ID NO: 9074272 - DNA, 23 bp, Homo sapiens
tggccagggtactacacccaccc

SEQ ID NO: 9074273 - DNA, 19 bp, Homo sapiens
tggccaggtactgtctgct

SEQ ID NO: 9074274 - DNA, 22 bp, Homo sapiens
tggccaggctggtctggaacgc

SEQ ID NO: 9074275 - DNA, 22 bp, Homo sapiens
tggccaggctggtctggaacgc

SEQ ID NO: 9074276 - DNA, 22 bp, Homo sapiens
tggccaggctggtctggaacgc

SEQ ID NO: 9074277 - DNA, 22 bp, Homo sapiens
tggccaggtgtgggttctcaga

SEQ ID NO: 9074278 - DNA, 22 bp, Homo sapiens
tggccaggtgtgggttctcaga

SEQ ID NO: 9074279 - DNA, 22 bp, Homo sapiens
tggccaggtgtgggttctcaga

SEQ ID NO: 9074280 - DNA, 22 bp, Homo sapiens
tggccaggttgggctttgcagc

SEQ ID NO: 9074281 - DNA, 22 bp, Homo sapiens
tggccaggtgtgggttctcaga

SEQ ID NO: 9074282 - DNA, 22 bp, Homo sapiens
tggccaggttgggctttgcagc

SEQ ID NO: 9074283 - DNA, 22 bp, Homo sapiens
tggccagtagataggcaggcaa

SEQ ID NO: 9074284 - DNA, 23 bp, Homo sapiens
tggccaggtagaggaggtagtga

SEQ ID NO: 9074285 - DNA, 19 bp, Homo sapiens
tggccaggtactgtctgct

SEQ ID NO: 9074286 - DNA, 19 bp, Homo sapiens
tggccaggtactgtctgct

SEQ ID NO: 9074287 - DNA, 19 bp, Homo sapiens
tggccaggtactgtctgct

SEQ ID NO: 9074288 - DNA, 19 bp, Homo sapiens
tggccaggtactgtctgct

SEQ ID NO: 9074289 - DNA, 23 bp, Homo sapiens
tggcatagtgaggggcacagaga

SEQ ID NO: 9074290 - DNA, 22 bp, Homo sapiens
tggcagtggcgggactcagggc

SEQ ID NO: 9074291 - DNA, 22 bp, Homo sapiens
tggcagtggcgggactcagggc

SEQ ID NO: 9074292 - DNA, 22 bp, Homo sapiens
tggcagtggcatcaccccaata

SEQ ID NO: 9074293 - DNA, 22 bp, Homo sapiens
tggcagtggcactgcccccata

SEQ ID NO: 9074294 - DNA, 22 bp, Homo sapiens
tggcagtggcatcaccccaata

SEQ ID NO: 9074295 - DNA, 22 bp, Homo sapiens
tggcagtgccccttgaccagtg

SEQ ID NO: 9074296 - DNA, 22 bp, Homo sapiens
tggcagtgccccttgaccagtg

SEQ ID NO: 9074297 - DNA, 22 bp, Homo sapiens
tggcagtgctgcagtgccctta

SEQ ID NO: 9074298 - DNA, 22 bp, Homo sapiens
tggcagtggataggggagcggt

SEQ ID NO: 9074299 - DNA, 22 bp, Homo sapiens
tggcagtggataggggagcggt

SEQ ID NO: 9074300 - DNA, 22 bp, Homo sapiens
tggcagtggataggggagcggt

SEQ ID NO: 9074301 - DNA, 19 bp, Homo sapiens
tggcagtgtggggtatgaa

SEQ ID NO: 9074302 - DNA, 19 bp, Homo sapiens
tggcagtgtggggtatgaa

SEQ ID NO: 9074303 - DNA, 19 bp, Homo sapiens
tggcagtgtggggtatgaa

SEQ ID NO: 9074304 - DNA, 22 bp, Homo sapiens
tggcagtgtgtgagctgttatt

SEQ ID NO: 9074305 - DNA, 22 bp, Homo sapiens
tggcagtgtttctaaggggctc

SEQ ID NO: 9074306 - DNA, 22 bp, Homo sapiens
tggcagtgttgtgccacattcc

SEQ ID NO: 9074307 - DNA, 22 bp, Homo sapiens
tggcagtggctcagagtgcaga

SEQ ID NO: 9074308 - DNA, 22 bp, Homo sapiens
tggcagtggctcagagtgcaga

SEQ ID NO: 9074309 - DNA, 22 bp, Homo sapiens
tggcagtggctcagagtgcaga

SEQ ID NO: 9074310 - DNA, 19 bp, Homo sapiens
tggcatgatgatggatggg

SEQ ID NO: 9074311 - DNA, 22 bp, Homo sapiens
tggcatgaagtcagcagctggg

SEQ ID NO: 9074312 - DNA, 17 bp, Homo sapiens
tggcatgagggtgtggg

SEQ ID NO: 9074313 - DNA, 22 bp, Homo sapiens
tggcatggcaaccctgcaggga

SEQ ID NO: 9074314 - DNA, 22 bp, Homo sapiens
tggcatggcatttagagaatta

SEQ ID NO: 9074315 - DNA, 21 bp, Homo sapiens
tggcatggaggtagcagtgtg

SEQ ID NO: 9074316 - DNA, 21 bp, Homo sapiens
tggcatggaggtagcagtgtg

SEQ ID NO: 9074317 - DNA, 22 bp, Homo sapiens
tggcagggtgccagttgcgagt

SEQ ID NO: 9074318 - DNA, 22 bp, Homo sapiens
tggcagggtacaccttaacacc

SEQ ID NO: 9074319 - DNA, 22 bp, Homo sapiens
tggcagggtacaccttaacacc

SEQ ID NO: 9074320 - DNA, 22 bp, Homo sapiens
tggcagggtcttgctgtgttgc

SEQ ID NO: 9074321 - DNA, 22 bp, Homo sapiens
tggcagggtcttgctgtgttgc

SEQ ID NO: 9074322 - DNA, 22 bp, Homo sapiens
tggcagggtcttgctgtgttgc

SEQ ID NO: 9074323 - DNA, 22 bp, Homo sapiens
tggcaggtggagacagcagagc

SEQ ID NO: 9074324 - DNA, 22 bp, Homo sapiens
tggcaggtggctctggcattct

SEQ ID NO: 9074325 - DNA, 22 bp, Homo sapiens
tggcaggttaacttacaactgt

SEQ ID NO: 9074326 - DNA, 18 bp, Homo sapiens
tggcaggtccagctgtgg

SEQ ID NO: 9074327 - DNA, 22 bp, Homo sapiens
tggcaggtgaagttgttaggga

SEQ ID NO: 9074328 - DNA, 22 bp, Homo sapiens
tggcagtccctctggtagcacc

SEQ ID NO: 9074329 - DNA, 22 bp, Homo sapiens
tggcagtagatccagtctctct

SEQ ID NO: 9074330 - DNA, 22 bp, Homo sapiens
tggcagtccagaccctggactc

SEQ ID NO: 9074331 - DNA, 21 bp, Homo sapiens
tggcaggttcaaaggcctatc

SEQ ID NO: 9074332 - DNA, 22 bp, Homo sapiens
tggcagtgaaccaaggctccaa

SEQ ID NO: 9074333 - DNA, 22 bp, Homo sapiens
tggcagtgaagctgtctttagg

SEQ ID NO: 9074334 - DNA, 22 bp, Homo sapiens
tggcagtgaagctgtctttagg

SEQ ID NO: 9074335 - DNA, 23 bp, Homo sapiens
tggcagtgatcaaaagcttacat

SEQ ID NO: 9074336 - DNA, 18 bp, Homo sapiens
tggcagtgaggtaggcat

SEQ ID NO: 9074337 - DNA, 18 bp, Homo sapiens
tggcagtgaggtaggcat

SEQ ID NO: 9074338 - DNA, 22 bp, Homo sapiens
tggcagtgaaagacaattgggc

SEQ ID NO: 9074339 - DNA, 22 bp, Homo sapiens
tggcagtgaaagacaattgggc

SEQ ID NO: 9074340 - DNA, 22 bp, Homo sapiens
tggcagtgaaccaaggctccaa

SEQ ID NO: 9074341 - DNA, 18 bp, Homo sapiens
tggcagtgccaccttctc

SEQ ID NO: 9074342 - DNA, 22 bp, Homo sapiens
tggcagtgatgcttatggtttg

SEQ ID NO: 9074343 - DNA, 18 bp, Homo sapiens
tggcagtgccaccttctc

SEQ ID NO: 9074344 - DNA, 18 bp, Homo sapiens
tggcagtgccaccttctc

SEQ ID NO: 9074345 - DNA, 22 bp, Homo sapiens
tggcagtgatgcttatggtttg

SEQ ID NO: 9074346 - DNA, 23 bp, Homo sapiens
tggcagtgcccagggagatgatc

SEQ ID NO: 9074347 - DNA, 22 bp, Homo sapiens
tggcagtgatgcggcaggacat

SEQ ID NO: 9074348 - DNA, 23 bp, Homo sapiens
tggcagtgatcaaaagcttacat

SEQ ID NO: 9074349 - DNA, 21 bp, Homo sapiens
tggcctgaagctccctctccc

SEQ ID NO: 9074350 - DNA, 22 bp, Homo sapiens
tggcctgaattatggcagatct

SEQ ID NO: 9074351 - DNA, 22 bp, Homo sapiens
tggcctctgtgggagctgagca

SEQ ID NO: 9074352 - DNA, 20 bp, Homo sapiens
tggcctctgtagaggccaag

SEQ ID NO: 9074353 - DNA, 22 bp, Homo sapiens
tggcctctgggaaagcagattc

SEQ ID NO: 9074354 - DNA, 22 bp, Homo sapiens
tggcctgattttgctaagagaa

SEQ ID NO: 9074355 - DNA, 22 bp, Homo sapiens
tggcctgagttgtctgcaggcc

SEQ ID NO: 9074356 - DNA, 22 bp, Homo sapiens
tggcctgagttgtctgcaggcc

SEQ ID NO: 9074357 - DNA, 22 bp, Homo sapiens
tggcctgatacttccagagttc

SEQ ID NO: 9074358 - DNA, 22 bp, Homo sapiens
tggcctgactgtccagccaggg

SEQ ID NO: 9074359 - DNA, 22 bp, Homo sapiens
tggcctgaggctcggcatgggt

SEQ ID NO: 9074360 - DNA, 23 bp, Homo sapiens
tggcctgcagagtttctgctggg

SEQ ID NO: 9074361 - DNA, 18 bp, Homo sapiens
tggcctggagacaactct

SEQ ID NO: 9074362 - DNA, 18 bp, Homo sapiens
tggcctggagacaactct

SEQ ID NO: 9074363 - DNA, 18 bp, Homo sapiens
tggcctggagacaactct

SEQ ID NO: 9074364 - DNA, 23 bp, Homo sapiens
tggcctggagagaaaagatgagt

SEQ ID NO: 9074365 - DNA, 23 bp, Homo sapiens
tggcctggagagaaaagatgagt

SEQ ID NO: 9074366 - DNA, 18 bp, Homo sapiens
tggcctggagacaactct

SEQ ID NO: 9074367 - DNA, 22 bp, Homo sapiens
tggcctggaagagaggtcgagg

SEQ ID NO: 9074368 - DNA, 22 bp, Homo sapiens
tggcctggaagagaggtcgagg

SEQ ID NO: 9074369 - DNA, 22 bp, Homo sapiens
tggcctggcagagcaaggcctg

SEQ ID NO: 9074370 - DNA, 22 bp, Homo sapiens
tggcctggcagagcaaggcctg

SEQ ID NO: 9074371 - DNA, 22 bp, Homo sapiens
tggcctggcagagcaaggcctg

SEQ ID NO: 9074372 - DNA, 22 bp, Homo sapiens
tggcctggcagagcaaggcctg

SEQ ID NO: 9074373 - DNA, 22 bp, Homo sapiens
tggcctggccacatccagcagg

SEQ ID NO: 9074374 - DNA, 22 bp, Homo sapiens
tggcctggccacatccagcagg

SEQ ID NO: 9074375 - DNA, 22 bp, Homo sapiens
tggcctggaacctggcagggac

SEQ ID NO: 9074376 - DNA, 22 bp, Homo sapiens
tggcctggaaaaatgcagatgg

SEQ ID NO: 9074377 - DNA, 22 bp, Homo sapiens
tggcctggaaaaatgcagatgg

SEQ ID NO: 9074378 - DNA, 22 bp, Homo sapiens
tggcctggaaaaatgcagatgg

SEQ ID NO: 9074379 - DNA, 22 bp, Homo sapiens
tggcccttcaaattccctagtc

SEQ ID NO: 9074380 - DNA, 22 bp, Homo sapiens
tggcccttctgagcacagggcc

SEQ ID NO: 9074381 - DNA, 22 bp, Homo sapiens
tggccctttgggtgcaggggca

SEQ ID NO: 9074382 - DNA, 22 bp, Homo sapiens
tggccctttggtttatgactga

SEQ ID NO: 9074383 - DNA, 22 bp, Homo sapiens
tggcccttgttcaaatatgtca

SEQ ID NO: 9074384 - DNA, 22 bp, Homo sapiens
tggcccttgtcctgggagagtt

SEQ ID NO: 9074385 - DNA, 22 bp, Homo sapiens
tggcctagagaagccaaaagat

SEQ ID NO: 9074386 - DNA, 22 bp, Homo sapiens
tggcccttttgtgaagtggcca

SEQ ID NO: 9074387 - DNA, 22 bp, Homo sapiens
tggccctgtgtgcaggctgcac

SEQ ID NO: 9074388 - DNA, 22 bp, Homo sapiens
tggccctgtgtcctgctgccag

SEQ ID NO: 9074389 - DNA, 22 bp, Homo sapiens
tggccctgtggaggtcagtgag

SEQ ID NO: 9074390 - DNA, 22 bp, Homo sapiens
tggccctgtggaggtcagtgag

SEQ ID NO: 9074391 - DNA, 22 bp, Homo sapiens
tggccctgtctgcacacaggat

SEQ ID NO: 9074392 - DNA, 22 bp, Homo sapiens
tggccctggtggcacagcctgc

SEQ ID NO: 9074393 - DNA, 22 bp, Homo sapiens
tggccctgggcagaggcaacat

SEQ ID NO: 9074394 - DNA, 22 bp, Homo sapiens
tggccctgggcagaggcaacat

SEQ ID NO: 9074395 - DNA, 22 bp, Homo sapiens
tggccctgacaggtcctgggca

SEQ ID NO: 9074396 - DNA, 22 bp, Homo sapiens
tggccctgacaggtcctgggca

SEQ ID NO: 9074397 - DNA, 22 bp, Homo sapiens
tggccctgacacgtggtactgg

SEQ ID NO: 9074398 - DNA, 22 bp, Homo sapiens
tggccctgaggacccagtgtgg

SEQ ID NO: 9074399 - DNA, 22 bp, Homo sapiens
tggccctgaggacccagtgtgg

SEQ ID NO: 9074400 - DNA, 22 bp, Homo sapiens
tggccctgacttggaggcctga

SEQ ID NO: 9074401 - DNA, 22 bp, Homo sapiens
tggccctgaggggctgtgcccc

SEQ ID NO: 9074402 - DNA, 22 bp, Homo sapiens
tggccctgagggctcggagcca

SEQ ID NO: 9074403 - DNA, 22 bp, Homo sapiens
tggccctgcacccagagcagtt

SEQ ID NO: 9074404 - DNA, 22 bp, Homo sapiens
tggccctgcacccagagcagtt

SEQ ID NO: 9074405 - DNA, 22 bp, Homo sapiens
tggccctgcagaactagcctgg

SEQ ID NO: 9074406 - DNA, 23 bp, Homo sapiens
tggccctgaatctgtcctggagg

SEQ ID NO: 9074407 - DNA, 23 bp, Homo sapiens
tggccctgaatctgtcctggagg

SEQ ID NO: 9074408 - DNA, 22 bp, Homo sapiens
tggccctgaatcaaggccagca

SEQ ID NO: 9074409 - DNA, 22 bp, Homo sapiens
tggcccaggtgcacccagaggc

SEQ ID NO: 9074410 - DNA, 22 bp, Homo sapiens
tggcccaggtgcaagagacaga

SEQ ID NO: 9074411 - DNA, 22 bp, Homo sapiens
tggcccagtcagcaggagaggg

SEQ ID NO: 9074412 - DNA, 22 bp, Homo sapiens
tggcccagtcagcaggagaggg

SEQ ID NO: 9074413 - DNA, 22 bp, Homo sapiens
tggcccaggcgaggtgggcaga

SEQ ID NO: 9074414 - DNA, 22 bp, Homo sapiens
tggcccaggcgaggtgggcaga

SEQ ID NO: 9074415 - DNA, 22 bp, Homo sapiens
tggcccagggagttcatggtgt

SEQ ID NO: 9074416 - DNA, 22 bp, Homo sapiens
tggcccaggaggccagagggca

SEQ ID NO: 9074417 - DNA, 22 bp, Homo sapiens
tggcccaggaggccagagggca

SEQ ID NO: 9074418 - DNA, 22 bp, Homo sapiens
tggcccagctgcagatggtgga

SEQ ID NO: 9074419 - DNA, 22 bp, Homo sapiens
tggcccaggaggccagagggca

SEQ ID NO: 9074420 - DNA, 22 bp, Homo sapiens
tggcccaggggctcttggtgtt

SEQ ID NO: 9074421 - DNA, 22 bp, Homo sapiens
tggcccagggcacagcagggag

SEQ ID NO: 9074422 - DNA, 22 bp, Homo sapiens
tggcccagggagttcatggtgt

SEQ ID NO: 9074423 - DNA, 22 bp, Homo sapiens
tggcccagggtctacagcctca

SEQ ID NO: 9074424 - DNA, 22 bp, Homo sapiens
tggcccaggtctctctgagccc

SEQ ID NO: 9074425 - DNA, 22 bp, Homo sapiens
tggcccaggtctctctgagccc

SEQ ID NO: 9074426 - DNA, 22 bp, Homo sapiens
tggcccaggtctctctgagccc

SEQ ID NO: 9074427 - DNA, 22 bp, Homo sapiens
tggcccaggtctctctgagccc

SEQ ID NO: 9074428 - DNA, 22 bp, Homo sapiens
tggccagtgattaatgacgctt

SEQ ID NO: 9074429 - DNA, 22 bp, Homo sapiens
tggccagtggggttgagcagga

SEQ ID NO: 9074430 - DNA, 22 bp, Homo sapiens
tggccagtttgctcaggcagtc

SEQ ID NO: 9074431 - DNA, 22 bp, Homo sapiens
tggccatgaaggaggcagcaga

SEQ ID NO: 9074432 - DNA, 22 bp, Homo sapiens
tggccatgacatggaggctttg

SEQ ID NO: 9074433 - DNA, 22 bp, Homo sapiens
tggccatgggatagtgcagggg

SEQ ID NO: 9074434 - DNA, 22 bp, Homo sapiens
tggcccagctcagggtgggcgg

SEQ ID NO: 9074435 - DNA, 22 bp, Homo sapiens
tggcccagctcagggtgggcgg

SEQ ID NO: 9074436 - DNA, 22 bp, Homo sapiens
tggcccagccctgctctagggc

SEQ ID NO: 9074437 - DNA, 22 bp, Homo sapiens
tggcactcactctcagagtctg

SEQ ID NO: 9074438 - DNA, 22 bp, Homo sapiens
tggcactatggatgagactgat

SEQ ID NO: 9074439 - DNA, 22 bp, Homo sapiens
tggcacctgaacttagaggtgt

SEQ ID NO: 9074440 - DNA, 22 bp, Homo sapiens
tggcacttagatcaggttgggt

SEQ ID NO: 9074441 - DNA, 22 bp, Homo sapiens
tggcactgtggatttcacaagt

SEQ ID NO: 9074442 - DNA, 22 bp, Homo sapiens
tggcactgggatgctactgtta

SEQ ID NO: 9074443 - DNA, 22 bp, Homo sapiens
tggcactgggacagatgctctc

SEQ ID NO: 9074444 - DNA, 22 bp, Homo sapiens
tggcactggcgcaggatggcgg

SEQ ID NO: 9074445 - DNA, 22 bp, Homo sapiens
tggcactgccaacctgctaggt

SEQ ID NO: 9074446 - DNA, 22 bp, Homo sapiens
tggcactgagcagccgcggcag

SEQ ID NO: 9074447 - DNA, 22 bp, Homo sapiens
tggcactgaccccaggcctgtg

SEQ ID NO: 9074448 - DNA, 21 bp, Homo sapiens
tggcactgcttagcaggttcc

SEQ ID NO: 9074449 - DNA, 22 bp, Homo sapiens
tggcactgcctggcagggcccc

SEQ ID NO: 9074450 - DNA, 22 bp, Homo sapiens
tggcactggaatcgtagccttg

SEQ ID NO: 9074451 - DNA, 22 bp, Homo sapiens
tggcagagcaaaaagatagaat

SEQ ID NO: 9074452 - DNA, 22 bp, Homo sapiens
tggcagagcccagaactgagca

SEQ ID NO: 9074453 - DNA, 22 bp, Homo sapiens
tggcagagcccagaactgagca

SEQ ID NO: 9074454 - DNA, 22 bp, Homo sapiens
tggcagagctggctgcggatga

SEQ ID NO: 9074455 - DNA, 22 bp, Homo sapiens
tggcagaggaaaaagtcactgg

SEQ ID NO: 9074456 - DNA, 22 bp, Homo sapiens
tggcacagtgctggatggtgct

SEQ ID NO: 9074457 - DNA, 22 bp, Homo sapiens
tggcacagcccagagctcttga

SEQ ID NO: 9074458 - DNA, 22 bp, Homo sapiens
tggcacagagggacccagcagc

SEQ ID NO: 9074459 - DNA, 22 bp, Homo sapiens
tggcacagagggacccagcagc

SEQ ID NO: 9074460 - DNA, 17 bp, Homo sapiens
tggcacagaggtgctat

SEQ ID NO: 9074461 - DNA, 22 bp, Homo sapiens
tggcacagacatttaatagcct

SEQ ID NO: 9074462 - DNA, 22 bp, Homo sapiens
tggcacagacagcacagcaatg

SEQ ID NO: 9074463 - DNA, 22 bp, Homo sapiens
tggcacagacagcacagcaatg

SEQ ID NO: 9074464 - DNA, 22 bp, Homo sapiens
tggcacagacagatcaggagtc

SEQ ID NO: 9074465 - DNA, 22 bp, Homo sapiens
tggcacagaaaaatgctccatt

SEQ ID NO: 9074466 - DNA, 22 bp, Homo sapiens
tggcacagaaaaatgctccatt

SEQ ID NO: 9074467 - DNA, 22 bp, Homo sapiens
tggcacagaaaaatgctccatt

SEQ ID NO: 9074468 - DNA, 22 bp, Homo sapiens
tggcacagaaaaatgctccatt

SEQ ID NO: 9074469 - DNA, 20 bp, Homo sapiens
tggcacagaacccttgccta

SEQ ID NO: 9074470 - DNA, 22 bp, Homo sapiens
tggcaattcccttggtcaacag

SEQ ID NO: 9074471 - DNA, 22 bp, Homo sapiens
tggcaatgtaggcaagaacatt

SEQ ID NO: 9074472 - DNA, 21 bp, Homo sapiens
tggcaatggccaacagtcatc

SEQ ID NO: 9074473 - DNA, 22 bp, Homo sapiens
tggcacacagagaagacacttg

SEQ ID NO: 9074474 - DNA, 22 bp, Homo sapiens
tggcaatttgtagagtaaatta

SEQ ID NO: 9074475 - DNA, 22 bp, Homo sapiens
tggatttgctaccttctgatat

SEQ ID NO: 9074476 - DNA, 22 bp, Homo sapiens
tggatttctccagctctccatt

SEQ ID NO: 9074477 - DNA, 22 bp, Homo sapiens
tggatttattaggttggtgaaa

SEQ ID NO: 9074478 - DNA, 22 bp, Homo sapiens
tggattcacaccattctcctgc

SEQ ID NO: 9074479 - DNA, 22 bp, Homo sapiens
tggattcacaccattctcctgc

SEQ ID NO: 9074480 - DNA, 22 bp, Homo sapiens
tggattgataaaatgggatgtt

SEQ ID NO: 9074481 - DNA, 22 bp, Homo sapiens
tggattgataagagacaagtga

SEQ ID NO: 9074482 - DNA, 22 bp, Homo sapiens
tggatgtgagaaggatcaggct

SEQ ID NO: 9074483 - DNA, 20 bp, Homo sapiens
tggatgtcaaattaggctgg

SEQ ID NO: 9074484 - DNA, 22 bp, Homo sapiens
tggatgtttgaagttgcatgtg

SEQ ID NO: 9074485 - DNA, 22 bp, Homo sapiens
tggcaaattttggcaagctgaa

SEQ ID NO: 9074486 - DNA, 22 bp, Homo sapiens
tggcaaagtatctgtcccagct

SEQ ID NO: 9074487 - DNA, 22 bp, Homo sapiens
tggcaatatgctttcagtggcc

SEQ ID NO: 9074488 - DNA, 22 bp, Homo sapiens
tggcaatataatcatctgctct

SEQ ID NO: 9074489 - DNA, 22 bp, Homo sapiens
tggcaatatccacaattacttt

SEQ ID NO: 9074490 - DNA, 22 bp, Homo sapiens
tggcaaaggcgctcacatgcct

SEQ ID NO: 9074491 - DNA, 22 bp, Homo sapiens
tggcaaagtatctgtcccagct

SEQ ID NO: 9074492 - DNA, 22 bp, Homo sapiens
tggcaaagattaccacatctac

SEQ ID NO: 9074493 - DNA, 22 bp, Homo sapiens
tggcaaactggaggaagccctg

SEQ ID NO: 9074494 - DNA, 22 bp, Homo sapiens
tggatttgggagcctttccttc

SEQ ID NO: 9074495 - DNA, 22 bp, Homo sapiens
tggcaaagactgcaaggacttt

SEQ ID NO: 9074496 - DNA, 22 bp, Homo sapiens
tggcaaagactgcaaggacttt

SEQ ID NO: 9074497 - DNA, 22 bp, Homo sapiens
tggcagctgaggggaggctttg

SEQ ID NO: 9074498 - DNA, 22 bp, Homo sapiens
tggcagctgattagatggtgcc

SEQ ID NO: 9074499 - DNA, 22 bp, Homo sapiens
tggcagctctgttcaacatgag

SEQ ID NO: 9074500 - DNA, 22 bp, Homo sapiens
tggcagctctgttcaacatgag

SEQ ID NO: 9074501 - DNA, 17 bp, Homo sapiens
tggcagctgaaagctct

SEQ ID NO: 9074502 - DNA, 17 bp, Homo sapiens
tggcagctgaaagctct

SEQ ID NO: 9074503 - DNA, 22 bp, Homo sapiens
tggcaggaaaaagggccagagg

SEQ ID NO: 9074504 - DNA, 22 bp, Homo sapiens
tggcagctgcaggcctcctgag

SEQ ID NO: 9074505 - DNA, 22 bp, Homo sapiens
tggcagctgccatgtccacgtg

SEQ ID NO: 9074506 - DNA, 22 bp, Homo sapiens
tggcagctgaggggaggctttg

SEQ ID NO: 9074507 - DNA, 22 bp, Homo sapiens
tggcaggaagacgtggggcacc

SEQ ID NO: 9074508 - DNA, 22 bp, Homo sapiens
tggcaggaaataccctgcctag

SEQ ID NO: 9074509 - DNA, 22 bp, Homo sapiens
tggcaggaaggagactcagccc

SEQ ID NO: 9074510 - DNA, 22 bp, Homo sapiens
tggcaggaaggagactcagccc

SEQ ID NO: 9074511 - DNA, 20 bp, Homo sapiens
tggcaggaatagggccagag

SEQ ID NO: 9074512 - DNA, 22 bp, Homo sapiens
tggcaggagagcgtcagatcag

SEQ ID NO: 9074513 - DNA, 20 bp, Homo sapiens
tggcaggaatagggccagag

SEQ ID NO: 9074514 - DNA, 22 bp, Homo sapiens
tggcaggagcctgcggggaggt

SEQ ID NO: 9074515 - DNA, 22 bp, Homo sapiens
tggcaggatctttgagagtgaa

SEQ ID NO: 9074516 - DNA, 22 bp, Homo sapiens
tggcaggaggttttctccagga

SEQ ID NO: 9074517 - DNA, 20 bp, Homo sapiens
tggcaggaggcagcagtgga

SEQ ID NO: 9074518 - DNA, 20 bp, Homo sapiens
tggcaggaggcagcagtgga

SEQ ID NO: 9074519 - DNA, 22 bp, Homo sapiens
tggcagggcctgaatcttatac

SEQ ID NO: 9074520 - DNA, 22 bp, Homo sapiens
tggcaggggaggtgcttgctta

SEQ ID NO: 9074521 - DNA, 22 bp, Homo sapiens
tggcaggggaggtgcttgctta

SEQ ID NO: 9074522 - DNA, 18 bp, Homo sapiens
tggcaggggcagtacgcc

SEQ ID NO: 9074523 - DNA, 21 bp, Homo sapiens
tggcaggggtagtagtacagc

SEQ ID NO: 9074524 - DNA, 22 bp, Homo sapiens
tggcagggagttcgttcacaac

SEQ ID NO: 9074525 - DNA, 22 bp, Homo sapiens
tggcagggagccaccggtcatg

SEQ ID NO: 9074526 - DNA, 21 bp, Homo sapiens
tggcaggcagctggaagcttg

SEQ ID NO: 9074527 - DNA, 21 bp, Homo sapiens
tggcaggcagctggaagcttg

SEQ ID NO: 9074528 - DNA, 21 bp, Homo sapiens
tggcaggcagctggaagcttg

SEQ ID NO: 9074529 - DNA, 21 bp, Homo sapiens
tggcaggcagctggaagcttg

SEQ ID NO: 9074530 - DNA, 22 bp, Homo sapiens
tggcaggcagtgtgggagctgg

SEQ ID NO: 9074531 - DNA, 22 bp, Homo sapiens
tggcaggcaagttcagctccac

SEQ ID NO: 9074532 - DNA, 22 bp, Homo sapiens
tggcagctacagacagaggtga

SEQ ID NO: 9074533 - DNA, 18 bp, Homo sapiens
tggcagctaggtaaagaa

SEQ ID NO: 9074534 - DNA, 22 bp, Homo sapiens
tggcagctcccagagcttccaa

SEQ ID NO: 9074535 - DNA, 22 bp, Homo sapiens
tggcagctattacaaggaagtc

SEQ ID NO: 9074536 - DNA, 22 bp, Homo sapiens
tggcagctcatttggaaatgga

SEQ ID NO: 9074537 - DNA, 22 bp, Homo sapiens
tggcagcctggaatctctcagc

SEQ ID NO: 9074538 - DNA, 22 bp, Homo sapiens
tggcagcctcagacaaggacct

SEQ ID NO: 9074539 - DNA, 22 bp, Homo sapiens
tggcagcattaattattcaggt

SEQ ID NO: 9074540 - DNA, 22 bp, Homo sapiens
tggcagcattaattattcaggt

SEQ ID NO: 9074541 - DNA, 22 bp, Homo sapiens
tggcagcattaattattcaggt

SEQ ID NO: 9074542 - DNA, 19 bp, Homo sapiens
tggcagcattggtaccttg

SEQ ID NO: 9074543 - DNA, 22 bp, Homo sapiens
tggcagccatcagagcaggggt

SEQ ID NO: 9074544 - DNA, 22 bp, Homo sapiens
tggcagcattttttccagaaca

SEQ ID NO: 9074545 - DNA, 22 bp, Homo sapiens
tggcagcattttttccagaaca

SEQ ID NO: 9074546 - DNA, 22 bp, Homo sapiens
tggcagcatgttatgtaaggaa

SEQ ID NO: 9074547 - DNA, 22 bp, Homo sapiens
tggcagcatgttatgtaaggaa

SEQ ID NO: 9074548 - DNA, 22 bp, Homo sapiens
tggcagcagggcccctggagga

SEQ ID NO: 9074549 - DNA, 22 bp, Homo sapiens
tggcagcagggaggccagtgtt

SEQ ID NO: 9074550 - DNA, 22 bp, Homo sapiens
tggcagcagggaggccagtgtt

SEQ ID NO: 9074551 - DNA, 22 bp, Homo sapiens
tggcagcagctaacttaggcag

SEQ ID NO: 9074552 - DNA, 18 bp, Homo sapiens
tggcagcaggaagccatt

SEQ ID NO: 9074553 - DNA, 22 bp, Homo sapiens
tggcagcagccatggaaggccc

SEQ ID NO: 9074554 - DNA, 22 bp, Homo sapiens
tggcagcagcaaatggcatatc

SEQ ID NO: 9074555 - DNA, 22 bp, Homo sapiens
tggcagcagcaaatggcatatc

SEQ ID NO: 9074556 - DNA, 22 bp, Homo sapiens
tggcagcagacatctgaggtct

SEQ ID NO: 9074557 - DNA, 22 bp, Homo sapiens
tggcagcagacaaaaggccatt

SEQ ID NO: 9074558 - DNA, 22 bp, Homo sapiens
tggcagagtcatcacatctgga

SEQ ID NO: 9074559 - DNA, 22 bp, Homo sapiens
tggcagagtggaccatactcaa

SEQ ID NO: 9074560 - DNA, 22 bp, Homo sapiens
tggcagagttcgctgtgccttt

SEQ ID NO: 9074561 - DNA, 22 bp, Homo sapiens
tggcagcacttgaacttgagcc

SEQ ID NO: 9074562 - DNA, 22 bp, Homo sapiens
tggcagcacttgaacttgagcc

SEQ ID NO: 9074563 - DNA, 22 bp, Homo sapiens
tggcagataaaataatagggaa

SEQ ID NO: 9074564 - DNA, 22 bp, Homo sapiens
tggcagataaacatgtgataaa

SEQ ID NO: 9074565 - DNA, 23 bp, Homo sapiens
tggcagatacaggcatgacttct

SEQ ID NO: 9074566 - DNA, 22 bp, Homo sapiens
tggctgtgcggcctcgggcaga

SEQ ID NO: 9074567 - DNA, 20 bp, Homo sapiens
tggctgtgggcatctgtttc

SEQ ID NO: 9074568 - DNA, 22 bp, Homo sapiens
tggctgtgggatatgtgactga

SEQ ID NO: 9074569 - DNA, 22 bp, Homo sapiens
tggctgtggactcagatggctc

SEQ ID NO: 9074570 - DNA, 22 bp, Homo sapiens
tggctgtgtccctgtccagagt

SEQ ID NO: 9074571 - DNA, 22 bp, Homo sapiens
tggctgtgttaccacttcatgt

SEQ ID NO: 9074572 - DNA, 22 bp, Homo sapiens
tggctggttttggtgagctccg

SEQ ID NO: 9074573 - DNA, 22 bp, Homo sapiens
tggctggtcacatggtaggtct

SEQ ID NO: 9074574 - DNA, 22 bp, Homo sapiens
tggctggacagtgggcagtgga

SEQ ID NO: 9074575 - DNA, 22 bp, Homo sapiens
tggctggagagggtcccatgag

SEQ ID NO: 9074576 - DNA, 22 bp, Homo sapiens
tggctggcaaggctggagtcag

SEQ ID NO: 9074577 - DNA, 22 bp, Homo sapiens
tggctggcagtaggctagtggc

SEQ ID NO: 9074578 - DNA, 18 bp, Homo sapiens
tggctggcagtgggcagc

SEQ ID NO: 9074579 - DNA, 18 bp, Homo sapiens
tggctggcagtgggcagc

SEQ ID NO: 9074580 - DNA, 22 bp, Homo sapiens
tggctggcgttggggccagtga

SEQ ID NO: 9074581 - DNA, 22 bp, Homo sapiens
tggctgggagctggaactgggc

SEQ ID NO: 9074582 - DNA, 23 bp, Homo sapiens
tggctggcgcctgcctcaccctg

SEQ ID NO: 9074583 - DNA, 22 bp, Homo sapiens
tggcttcttgacttcttggctg

SEQ ID NO: 9074584 - DNA, 22 bp, Homo sapiens
tggcttcttcatatgtgatctt

SEQ ID NO: 9074585 - DNA, 22 bp, Homo sapiens
tggcttcttagaccagtggcct

SEQ ID NO: 9074586 - DNA, 22 bp, Homo sapiens
tggctttcgctatagagcacgg

SEQ ID NO: 9074587 - DNA, 22 bp, Homo sapiens
tggctttatacttaagcacaat

SEQ ID NO: 9074588 - DNA, 22 bp, Homo sapiens
tgggaaagactcaggacaggag

SEQ ID NO: 9074589 - DNA, 21 bp, Homo sapiens
tggctttgccctgcttgcccc

SEQ ID NO: 9074590 - DNA, 22 bp, Homo sapiens
tggctttgacttaccagaagtg

SEQ ID NO: 9074591 - DNA, 22 bp, Homo sapiens
tggctttgaaatccagtcatta

SEQ ID NO: 9074592 - DNA, 22 bp, Homo sapiens
tgggaaagccagcagtgtcacc

SEQ ID NO: 9074593 - DNA, 22 bp, Homo sapiens
tgggaaagtgttgaggtgtctt

SEQ ID NO: 9074594 - DNA, 22 bp, Homo sapiens
tgggaaagtgtagcctgcaggc

SEQ ID NO: 9074595 - DNA, 22 bp, Homo sapiens
tgggaacagtagctgctgagct

SEQ ID NO: 9074596 - DNA, 22 bp, Homo sapiens
tgggaacacctgctgcccagtg

SEQ ID NO: 9074597 - DNA, 22 bp, Homo sapiens
tgggaacaacatgcactgccac

SEQ ID NO: 9074598 - DNA, 22 bp, Homo sapiens
tgggaagaagcagagaactgga

SEQ ID NO: 9074599 - DNA, 22 bp, Homo sapiens
tgggaagaagcagagaactgga

SEQ ID NO: 9074600 - DNA, 22 bp, Homo sapiens
tgggaagaggcgggaggctgtt

SEQ ID NO: 9074601 - DNA, 22 bp, Homo sapiens
tgggaagaggcgggaggctgtt

SEQ ID NO: 9074602 - DNA, 22 bp, Homo sapiens
tgggaagactcctcaggaggcg

SEQ ID NO: 9074603 - DNA, 19 bp, Homo sapiens
tggcttctgttttcatgtt

SEQ ID NO: 9074604 - DNA, 22 bp, Homo sapiens
tggcttctgggacttgtgagca

SEQ ID NO: 9074605 - DNA, 22 bp, Homo sapiens
tggcttctgagtctcctgacat

SEQ ID NO: 9074606 - DNA, 22 bp, Homo sapiens
tggcttcctgtgtaatgaggtg

SEQ ID NO: 9074607 - DNA, 22 bp, Homo sapiens
tggcttcctggacagatgcggt

SEQ ID NO: 9074608 - DNA, 22 bp, Homo sapiens
tggcttctcagaatactctgga

SEQ ID NO: 9074609 - DNA, 22 bp, Homo sapiens
tggcttcagagacagaatctat

SEQ ID NO: 9074610 - DNA, 22 bp, Homo sapiens
tggcttcagagtctgagttctt

SEQ ID NO: 9074611 - DNA, 19 bp, Homo sapiens
tggcttcctgactctcatc

SEQ ID NO: 9074612 - DNA, 19 bp, Homo sapiens
tggcttcctgactctcatc

SEQ ID NO: 9074613 - DNA, 22 bp, Homo sapiens
tggcttcctgcacagtgtctgc

SEQ ID NO: 9074614 - DNA, 22 bp, Homo sapiens
tggcttcctgcatggatcctct

SEQ ID NO: 9074615 - DNA, 22 bp, Homo sapiens
tggcttcaggagcacctggctt

SEQ ID NO: 9074616 - DNA, 17 bp, Homo sapiens
tggcttccctgggccac

SEQ ID NO: 9074617 - DNA, 22 bp, Homo sapiens
tggcttccgccgcgggcctcgg

SEQ ID NO: 9074618 - DNA, 22 bp, Homo sapiens
tggcttcctaaactgatttcca

SEQ ID NO: 9074619 - DNA, 22 bp, Homo sapiens
tggcttcctaggagcccgtgct

SEQ ID NO: 9074620 - DNA, 22 bp, Homo sapiens
tgggagctggggttggacgtct

SEQ ID NO: 9074621 - DNA, 22 bp, Homo sapiens
tgggaggacttgtgggcttcat

SEQ ID NO: 9074622 - DNA, 22 bp, Homo sapiens
tgggaggaatgtcactgagcca

SEQ ID NO: 9074623 - DNA, 22 bp, Homo sapiens
tgggaggaatgtcactgagcca

SEQ ID NO: 9074624 - DNA, 22 bp, Homo sapiens
tgggaggagccctctgggaagg

SEQ ID NO: 9074625 - DNA, 22 bp, Homo sapiens
tgggaggcagaagttgactgga

SEQ ID NO: 9074626 - DNA, 22 bp, Homo sapiens
tgggaggcaggtaggtgatgat

SEQ ID NO: 9074627 - DNA, 22 bp, Homo sapiens
tgggaggcagaagttgactgga

SEQ ID NO: 9074628 - DNA, 22 bp, Homo sapiens
tgggaggcagaagttgactgga

SEQ ID NO: 9074629 - DNA, 22 bp, Homo sapiens
tgggagcagccaacatggcctt

SEQ ID NO: 9074630 - DNA, 22 bp, Homo sapiens
tgggagctcctggagggcagga

SEQ ID NO: 9074631 - DNA, 22 bp, Homo sapiens
tgggagcaagctggtgctggag

SEQ ID NO: 9074632 - DNA, 22 bp, Homo sapiens
tgggagcaccctgaggagcttc

SEQ ID NO: 9074633 - DNA, 22 bp, Homo sapiens
tgggagagtgctcaatgtgcaa

SEQ ID NO: 9074634 - DNA, 22 bp, Homo sapiens
tgggagagtctaaaaccgaggt

SEQ ID NO: 9074635 - DNA, 22 bp, Homo sapiens
tgggagcaaatgactgggagat

SEQ ID NO: 9074636 - DNA, 19 bp, Homo sapiens
tgggagaggcaacagagta

SEQ ID NO: 9074637 - DNA, 22 bp, Homo sapiens
tgggagaggctgccatcttgca

SEQ ID NO: 9074638 - DNA, 19 bp, Homo sapiens
tgggagaggcaacagagta

SEQ ID NO: 9074639 - DNA, 19 bp, Homo sapiens
tgggagaggcaacagagta

SEQ ID NO: 9074640 - DNA, 21 bp, Homo sapiens
tgggagagggctcagctaccc

SEQ ID NO: 9074641 - DNA, 21 bp, Homo sapiens
tgggagagggctcagctaccc

SEQ ID NO: 9074642 - DNA, 22 bp, Homo sapiens
tgggagaacccagggtcaggct

SEQ ID NO: 9074643 - DNA, 22 bp, Homo sapiens
tgggagaagcagcagccaagtg

SEQ ID NO: 9074644 - DNA, 22 bp, Homo sapiens
tgggagaagcagcagccaagtg

SEQ ID NO: 9074645 - DNA, 22 bp, Homo sapiens
tgggagaaagaaccctgagtga

SEQ ID NO: 9074646 - DNA, 22 bp, Homo sapiens
tgggagaaagaaccctgagtga

SEQ ID NO: 9074647 - DNA, 22 bp, Homo sapiens
tgggagaatcttgctctgctac

SEQ ID NO: 9074648 - DNA, 22 bp, Homo sapiens
tgggagaagcatggggtgcaga

SEQ ID NO: 9074649 - DNA, 22 bp, Homo sapiens
tgggagaagcatggggtgcaga

SEQ ID NO: 9074650 - DNA, 22 bp, Homo sapiens
tgggagaagcagtgggacagta

SEQ ID NO: 9074651 - DNA, 22 bp, Homo sapiens
tgggaaggggagctggaaagga

SEQ ID NO: 9074652 - DNA, 22 bp, Homo sapiens
tgggaagggtcaacagctggaa

SEQ ID NO: 9074653 - DNA, 22 bp, Homo sapiens
tgggaagggtcaacagctggaa

SEQ ID NO: 9074654 - DNA, 22 bp, Homo sapiens
tgggaagggtcaacagctggaa

SEQ ID NO: 9074655 - DNA, 22 bp, Homo sapiens
tgggaaggggagctggaaagga

SEQ ID NO: 9074656 - DNA, 22 bp, Homo sapiens
tgggaaggggagctggaaagga

SEQ ID NO: 9074657 - DNA, 22 bp, Homo sapiens
tgggaaggggagctggaaagga

SEQ ID NO: 9074658 - DNA, 22 bp, Homo sapiens
tgggaaggggagctggaaagga

SEQ ID NO: 9074659 - DNA, 22 bp, Homo sapiens
tgggaagggcctgcccttcctc

SEQ ID NO: 9074660 - DNA, 22 bp, Homo sapiens
tgggaagggtcaacagctggaa

SEQ ID NO: 9074661 - DNA, 22 bp, Homo sapiens
tgggaagggtcagtttcttcat

SEQ ID NO: 9074662 - DNA, 22 bp, Homo sapiens
tgggaaggtgtagaaagaacaa

SEQ ID NO: 9074663 - DNA, 22 bp, Homo sapiens
tgggaaggtacacgggaaagag

SEQ ID NO: 9074664 - DNA, 22 bp, Homo sapiens
tgggaaggtacacgggaaagag

SEQ ID NO: 9074665 - DNA, 22 bp, Homo sapiens
tgggaaggcgtggaagtagaag

SEQ ID NO: 9074666 - DNA, 22 bp, Homo sapiens
tgggaagggagagtgtcctgga

SEQ ID NO: 9074667 - DNA, 22 bp, Homo sapiens
tgggaagcctagcagacagctg

SEQ ID NO: 9074668 - DNA, 22 bp, Homo sapiens
tgggaagcattaatgatagggg

SEQ ID NO: 9074669 - DNA, 22 bp, Homo sapiens
tgggaaggcgtggaagtagaag

SEQ ID NO: 9074670 - DNA, 22 bp, Homo sapiens
tgggaagggagtttcttggagt

SEQ ID NO: 9074671 - DNA, 22 bp, Homo sapiens
tgggaagggccgatggagcctc

SEQ ID NO: 9074672 - DNA, 22 bp, Homo sapiens
tgggaagggccgatggagcctc

SEQ ID NO: 9074673 - DNA, 22 bp, Homo sapiens
tgggaagggccgatggagcctc

SEQ ID NO: 9074674 - DNA, 22 bp, Homo sapiens
tgggaagatggagtgacaggca

SEQ ID NO: 9074675 - DNA, 22 bp, Homo sapiens
tgggaagatggagtgacaggca

SEQ ID NO: 9074676 - DNA, 22 bp, Homo sapiens
tgggaagatggagtgacaggca

SEQ ID NO: 9074677 - DNA, 22 bp, Homo sapiens
tgggaagcattaatgatagggg

SEQ ID NO: 9074678 - DNA, 22 bp, Homo sapiens
tgggaagatgaggtgccatggg

SEQ ID NO: 9074679 - DNA, 22 bp, Homo sapiens
tgggaagatgaggtgccatggg

SEQ ID NO: 9074680 - DNA, 22 bp, Homo sapiens
tgggaagatgaggtgccatggg

SEQ ID NO: 9074681 - DNA, 22 bp, Homo sapiens
tgggaagaggggtataaagaag

SEQ ID NO: 9074682 - DNA, 21 bp, Homo sapiens
tgggacagtgatggctcctcc

SEQ ID NO: 9074683 - DNA, 22 bp, Homo sapiens
tgggacagtgaccccagaggtc

SEQ ID NO: 9074684 - DNA, 22 bp, Homo sapiens
tgggacagtgaccccagaggtc

SEQ ID NO: 9074685 - DNA, 22 bp, Homo sapiens
tgggacagttgtcctccactct

SEQ ID NO: 9074686 - DNA, 22 bp, Homo sapiens
tgggacagtgtgccttgctcct

SEQ ID NO: 9074687 - DNA, 22 bp, Homo sapiens
tgggaagttgtaccttctgtta

SEQ ID NO: 9074688 - DNA, 22 bp, Homo sapiens
tgggaatacaattctgagagaa

SEQ ID NO: 9074689 - DNA, 22 bp, Homo sapiens
tgggaagtaggacagtgcagtt

SEQ ID NO: 9074690 - DNA, 22 bp, Homo sapiens
tgggaagtaggacagtgcagtt

SEQ ID NO: 9074691 - DNA, 22 bp, Homo sapiens
tgggaatgggcctagaaggctg

SEQ ID NO: 9074692 - DNA, 23 bp, Homo sapiens
tgggaatgacatctagagcagag

SEQ ID NO: 9074693 - DNA, 22 bp, Homo sapiens
tgggaatggatgctaagtgcta

SEQ ID NO: 9074694 - DNA, 22 bp, Homo sapiens
tgggaatgctgagcccatgtat

SEQ ID NO: 9074695 - DNA, 22 bp, Homo sapiens
tgggaatgtggcaaggcataga

SEQ ID NO: 9074696 - DNA, 22 bp, Homo sapiens
tgggacaggttggagagaagca

SEQ ID NO: 9074697 - DNA, 22 bp, Homo sapiens
tgggacagtgaccccagaggtc

SEQ ID NO: 9074698 - DNA, 22 bp, Homo sapiens
tgggacagtgaccccagaggtc

SEQ ID NO: 9074699 - DNA, 22 bp, Homo sapiens
tgggacaggttggagagaagca

SEQ ID NO: 9074700 - DNA, 22 bp, Homo sapiens
tgggacaccctcacgcctgcac

SEQ ID NO: 9074701 - DNA, 22 bp, Homo sapiens
tggcgtgccctccagacttggc

SEQ ID NO: 9074702 - DNA, 23 bp, Homo sapiens
tggctaaacagtggagaaagctt

SEQ ID NO: 9074703 - DNA, 22 bp, Homo sapiens
tggcggggcagctctggcttct

SEQ ID NO: 9074704 - DNA, 20 bp, Homo sapiens
tggcggggatgagggagtta

SEQ ID NO: 9074705 - DNA, 20 bp, Homo sapiens
tggcggggatgagggagtta

SEQ ID NO: 9074706 - DNA, 21 bp, Homo sapiens
tggcggggacttgtggctgcc

SEQ ID NO: 9074707 - DNA, 21 bp, Homo sapiens
tggcggggacttgtggctgcc

SEQ ID NO: 9074708 - DNA, 22 bp, Homo sapiens
tggctcagaactacttctagtt

SEQ ID NO: 9074709 - DNA, 22 bp, Homo sapiens
tggctcagagccttgagagctg

SEQ ID NO: 9074710 - DNA, 22 bp, Homo sapiens
tggctcagagccttgagagctg

SEQ ID NO: 9074711 - DNA, 22 bp, Homo sapiens
tggctcagagagggagtgtgga

SEQ ID NO: 9074712 - DNA, 22 bp, Homo sapiens
tggcctggttatattgctatca

SEQ ID NO: 9074713 - DNA, 22 bp, Homo sapiens
tggcctggttgttgctgccgtt

SEQ ID NO: 9074714 - DNA, 22 bp, Homo sapiens
tggcctggttgttgctgccgtt

SEQ ID NO: 9074715 - DNA, 22 bp, Homo sapiens
tggcctggttgttgctgccgtt

SEQ ID NO: 9074716 - DNA, 22 bp, Homo sapiens
tggcctggtgtctgcgaggcct

SEQ ID NO: 9074717 - DNA, 22 bp, Homo sapiens
tggcctggtccttgtcaaggca

SEQ ID NO: 9074718 - DNA, 22 bp, Homo sapiens
tggcctggtgctcaggcagtag

SEQ ID NO: 9074719 - DNA, 22 bp, Homo sapiens
tggcctggtaccacatagattt

SEQ ID NO: 9074720 - DNA, 22 bp, Homo sapiens
tggcctggtaccacatagattt

SEQ ID NO: 9074721 - DNA, 22 bp, Homo sapiens
tggcctgggtgctgctgacatc

SEQ ID NO: 9074722 - DNA, 22 bp, Homo sapiens
tggcctgggtgctgctgacatc

SEQ ID NO: 9074723 - DNA, 22 bp, Homo sapiens
tggcctgggtgctgctgacatc

SEQ ID NO: 9074724 - DNA, 22 bp, Homo sapiens
tggcctggccctgaggccctgt

SEQ ID NO: 9074725 - DNA, 22 bp, Homo sapiens
tggcctggccctgaggccctgt

SEQ ID NO: 9074726 - DNA, 22 bp, Homo sapiens
tggcctggccctgaggccctgt

SEQ ID NO: 9074727 - DNA, 22 bp, Homo sapiens
tggcctggctcacagtgagatt

SEQ ID NO: 9074728 - DNA, 22 bp, Homo sapiens
tggcctgggtcacaccagggtc

SEQ ID NO: 9074729 - DNA, 22 bp, Homo sapiens
tggcgaggccaggccagggcct

SEQ ID NO: 9074730 - DNA, 22 bp, Homo sapiens
tggccttgtctctcagaaccgc

SEQ ID NO: 9074731 - DNA, 22 bp, Homo sapiens
tggccttttctttcacaggcaa

SEQ ID NO: 9074732 - DNA, 22 bp, Homo sapiens
tggccttgttctctctcccatc

SEQ ID NO: 9074733 - DNA, 22 bp, Homo sapiens
tggcgaagctgaacataggcta

SEQ ID NO: 9074734 - DNA, 22 bp, Homo sapiens
tggccttggtcctctttgcaat

SEQ ID NO: 9074735 - DNA, 22 bp, Homo sapiens
tggccttggtcctctttgcaat

SEQ ID NO: 9074736 - DNA, 22 bp, Homo sapiens
tggccttggtcacaatgcaaac

SEQ ID NO: 9074737 - DNA, 22 bp, Homo sapiens
tggccttgggtccttagcatca

SEQ ID NO: 9074738 - DNA, 22 bp, Homo sapiens
tggccttgtgtttaagcaagaa

SEQ ID NO: 9074739 - DNA, 22 bp, Homo sapiens
tggccttgtgtttaagcaagaa

SEQ ID NO: 9074740 - DNA, 15 bp, Homo sapiens
tggccttgtggttgt

SEQ ID NO: 9074741 - DNA, 22 bp, Homo sapiens
tggccttgtgtttaagcaagaa

SEQ ID NO: 9074742 - DNA, 22 bp, Homo sapiens
tggccttgtgttttagagaaag

SEQ ID NO: 9074743 - DNA, 22 bp, Homo sapiens
tggccttggccttttctgctcc

SEQ ID NO: 9074744 - DNA, 22 bp, Homo sapiens
tggccttggctgagagatttaa

SEQ ID NO: 9074745 - DNA, 22 bp, Homo sapiens
tggccttgcccagcgcctaggt

SEQ ID NO: 9074746 - DNA, 22 bp, Homo sapiens
tggccttggccgtgctggggtc

SEQ ID NO: 9074747 - DNA, 22 bp, Homo sapiens
tggccttgggcaggtggcctgc

SEQ ID NO: 9074748 - DNA, 20 bp, Homo sapiens
tggccttggggagctcacac

SEQ ID NO: 9074749 - DNA, 20 bp, Homo sapiens
tggccttggggagctcacac

SEQ ID NO: 9074750 - DNA, 22 bp, Homo sapiens
tggccttcctggtgactcatga

SEQ ID NO: 9074751 - DNA, 22 bp, Homo sapiens
tggccttcctggtgactcatga

SEQ ID NO: 9074752 - DNA, 22 bp, Homo sapiens
tggccttgaaccaggtctccac

SEQ ID NO: 9074753 - DNA, 22 bp, Homo sapiens
tggccttgaactcatcacgtgg

SEQ ID NO: 9074754 - DNA, 22 bp, Homo sapiens
tggcctgtggcttaaggtctgt

SEQ ID NO: 9074755 - DNA, 22 bp, Homo sapiens
tggcctgtcttgttgtgctaga

SEQ ID NO: 9074756 - DNA, 22 bp, Homo sapiens
tggccttgagatgcagcagcca

SEQ ID NO: 9074757 - DNA, 22 bp, Homo sapiens
tggccttgagtggtctccgccc

SEQ ID NO: 9074758 - DNA, 22 bp, Homo sapiens
tggccttgattatgccagtaga

SEQ ID NO: 9074759 - DNA, 22 bp, Homo sapiens
tggccttgataactggggagag

SEQ ID NO: 9074760 - DNA, 21 bp, Homo sapiens
tggccttgagagtctccttgc

SEQ ID NO: 9074761 - DNA, 22 bp, Homo sapiens
tggccttgagaatgtccctagg

SEQ ID NO: 9074762 - DNA, 18 bp, Homo sapiens
tggccttgaatcatatca

SEQ ID NO: 9074763 - DNA, 22 bp, Homo sapiens
tggccttgagagatcaaaaggt

SEQ ID NO: 9074764 - DNA, 22 bp, Homo sapiens
tggccttgccacatttgtcagc

SEQ ID NO: 9074765 - DNA, 22 bp, Homo sapiens
tggccttggacagagcgctcct

SEQ ID NO: 9074766 - DNA, 22 bp, Homo sapiens
tggccttggagaggcacggccc

SEQ ID NO: 9074767 - DNA, 22 bp, Homo sapiens
tggccttggagaggcacggccc

SEQ ID NO: 9074768 - DNA, 22 bp, Homo sapiens
tggccttggcagtgagaagagt

SEQ ID NO: 9074769 - DNA, 22 bp, Homo sapiens
tggctcagtaatcgagtctcct

SEQ ID NO: 9074770 - DNA, 22 bp, Homo sapiens
tggctcaggggtctggctctgt

SEQ ID NO: 9074771 - DNA, 22 bp, Homo sapiens
tggctcagtcatggatgagtaa

SEQ ID NO: 9074772 - DNA, 22 bp, Homo sapiens
tggctcaggatctaagcagaat

SEQ ID NO: 9074773 - DNA, 22 bp, Homo sapiens
tggctcaggatctaagcagaat

SEQ ID NO: 9074774 - DNA, 22 bp, Homo sapiens
tggctcagctttccccatctgg

SEQ ID NO: 9074775 - DNA, 22 bp, Homo sapiens
tggctcagatttttgtaggctt

SEQ ID NO: 9074776 - DNA, 22 bp, Homo sapiens
tggctcagcttacttttgaggg

SEQ ID NO: 9074777 - DNA, 22 bp, Homo sapiens
tggctcagctgtcacagcctgg

SEQ ID NO: 9074778 - DNA, 22 bp, Homo sapiens
tggctccacaggccagggtgtg

SEQ ID NO: 9074779 - DNA, 22 bp, Homo sapiens
tggctcctgcatttgtgctaac

SEQ ID NO: 9074780 - DNA, 22 bp, Homo sapiens
tggctcctgcagaccatctgga

SEQ ID NO: 9074781 - DNA, 18 bp, Homo sapiens
tggctcctgcctcctgca

SEQ ID NO: 9074782 - DNA, 20 bp, Homo sapiens
tggctcctgcggtggaacca

SEQ ID NO: 9074783 - DNA, 22 bp, Homo sapiens
tggctcctggcaggtgtttcaa

SEQ ID NO: 9074784 - DNA, 22 bp, Homo sapiens
tggctcctcttctgggtgtccc

SEQ ID NO: 9074785 - DNA, 22 bp, Homo sapiens
tggctcctccctgtgtgtgcgt

SEQ ID NO: 9074786 - DNA, 22 bp, Homo sapiens
tggctcctcatcacagttggtg

SEQ ID NO: 9074787 - DNA, 22 bp, Homo sapiens
tggctcctcatcacagttggtg

SEQ ID NO: 9074788 - DNA, 22 bp, Homo sapiens
tggctcctcacgtcctcagagc

SEQ ID NO: 9074789 - DNA, 22 bp, Homo sapiens
tggctcctgcagaccatctgga

SEQ ID NO: 9074790 - DNA, 22 bp, Homo sapiens
tggctcctcttctgggtgtccc

SEQ ID NO: 9074791 - DNA, 22 bp, Homo sapiens
tggctcctcttctgggtgtccc

SEQ ID NO: 9074792 - DNA, 22 bp, Homo sapiens
tggctcctaatcggcttctttc

SEQ ID NO: 9074793 - DNA, 22 bp, Homo sapiens
tggctcctatcaaggagtgggt

SEQ ID NO: 9074794 - DNA, 22 bp, Homo sapiens
tggctcctatcaaggagtgggt

SEQ ID NO: 9074795 - DNA, 22 bp, Homo sapiens
tggctcctaggatggtgcctgg

SEQ ID NO: 9074796 - DNA, 22 bp, Homo sapiens
tggctctggattaatctaggaa

SEQ ID NO: 9074797 - DNA, 22 bp, Homo sapiens
tggctctggccaccgggagggc

SEQ ID NO: 9074798 - DNA, 22 bp, Homo sapiens
tggctctggattaatctaggaa

SEQ ID NO: 9074799 - DNA, 22 bp, Homo sapiens
tggctctgggaatctgttgctt

SEQ ID NO: 9074800 - DNA, 22 bp, Homo sapiens
tggctctgggaatctgttgctt

SEQ ID NO: 9074801 - DNA, 22 bp, Homo sapiens
tggctctgggaatgggaagatg

SEQ ID NO: 9074802 - DNA, 23 bp, Homo sapiens
tggctctgtggatccctcaggag

SEQ ID NO: 9074803 - DNA, 22 bp, Homo sapiens
tggctctgtggtcttagcatgc

SEQ ID NO: 9074804 - DNA, 22 bp, Homo sapiens
tggctctgtggatgttctgacc

SEQ ID NO: 9074805 - DNA, 22 bp, Homo sapiens
tggctctgtcgccgtttggaat

SEQ ID NO: 9074806 - DNA, 22 bp, Homo sapiens
tggctctggcgtgaagcccaga

SEQ ID NO: 9074807 - DNA, 22 bp, Homo sapiens
tggctctggggacagtaagtcc

SEQ ID NO: 9074808 - DNA, 22 bp, Homo sapiens
tggctctgtgcttctagtatct

SEQ ID NO: 9074809 - DNA, 22 bp, Homo sapiens
tggctctgtgcttctagtatct

SEQ ID NO: 9074810 - DNA, 22 bp, Homo sapiens
tggctctgttcgccatcaggag

SEQ ID NO: 9074811 - DNA, 22 bp, Homo sapiens
tggctctgttcgccatcaggag

SEQ ID NO: 9074812 - DNA, 22 bp, Homo sapiens
tggctctgtgtctcccagcagc

SEQ ID NO: 9074813 - DNA, 23 bp, Homo sapiens
tggctctgtgtcacatacaggat

SEQ ID NO: 9074814 - DNA, 19 bp, Homo sapiens
tggctctgtttctctggag

SEQ ID NO: 9074815 - DNA, 19 bp, Homo sapiens
tggctctgtttctctggag

SEQ ID NO: 9074816 - DNA, 22 bp, Homo sapiens
tggctctgttgtgctgagccag

SEQ ID NO: 9074817 - DNA, 22 bp, Homo sapiens
tggctctgttgtgctgagccag

SEQ ID NO: 9074818 - DNA, 22 bp, Homo sapiens
tggctctgttgtgctgagccag

SEQ ID NO: 9074819 - DNA, 22 bp, Homo sapiens
tggctctgagacacaggctctc

SEQ ID NO: 9074820 - DNA, 22 bp, Homo sapiens
tggctctgagacacaggctctc

SEQ ID NO: 9074821 - DNA, 20 bp, Homo sapiens
tggctctcaccctgtgcgat

SEQ ID NO: 9074822 - DNA, 22 bp, Homo sapiens
tggctcctttccgggtctccag

SEQ ID NO: 9074823 - DNA, 22 bp, Homo sapiens
tggctccttccgcagcatgcct

SEQ ID NO: 9074824 - DNA, 22 bp, Homo sapiens
tggctccttcattctcctgcca

SEQ ID NO: 9074825 - DNA, 18 bp, Homo sapiens
tggctcctgcctcctgca

SEQ ID NO: 9074826 - DNA, 20 bp, Homo sapiens
tggctcctggctcctccctc

SEQ ID NO: 9074827 - DNA, 22 bp, Homo sapiens
tggctctgagtctgcccttggc

SEQ ID NO: 9074828 - DNA, 23 bp, Homo sapiens
tggctctgagaggttcagatgct

SEQ ID NO: 9074829 - DNA, 23 bp, Homo sapiens
tggctctgagaggttcagatgct

SEQ ID NO: 9074830 - DNA, 21 bp, Homo sapiens
tggctctgagcctcatggctg

SEQ ID NO: 9074831 - DNA, 21 bp, Homo sapiens
tggctctgagcctcatggctg

SEQ ID NO: 9074832 - DNA, 18 bp, Homo sapiens
tggctctgccactcaccg

SEQ ID NO: 9074833 - DNA, 18 bp, Homo sapiens
tggctctgcagccagatg

SEQ ID NO: 9074834 - DNA, 18 bp, Homo sapiens
tggctctgcagccagatg

SEQ ID NO: 9074835 - DNA, 22 bp, Homo sapiens
tggctctgatcagatgtccagt

SEQ ID NO: 9074836 - DNA, 22 bp, Homo sapiens
tggctctgcacctcagtgtacc

SEQ ID NO: 9074837 - DNA, 22 bp, Homo sapiens
tggctctgctgaacctagtgca

SEQ ID NO: 9074838 - DNA, 22 bp, Homo sapiens
tggctctggagctcctgggccc

SEQ ID NO: 9074839 - DNA, 22 bp, Homo sapiens
tggctctgcgtctgttcgtggg

SEQ ID NO: 9074840 - DNA, 21 bp, Homo sapiens
tggctctgctcagagcagtcc

SEQ ID NO: 9074841 - DNA, 21 bp, Homo sapiens
tggctctgctcagagcagtcc

SEQ ID NO: 9074842 - DNA, 21 bp, Homo sapiens
tggctctgctcagagcagtcc

SEQ ID NO: 9074843 - DNA, 22 bp, Homo sapiens
tggctgcaagggcacggaccct

SEQ ID NO: 9074844 - DNA, 22 bp, Homo sapiens
tggctgagttctccaggagtag

SEQ ID NO: 9074845 - DNA, 22 bp, Homo sapiens
tggctgcagacacctatggcag

SEQ ID NO: 9074846 - DNA, 22 bp, Homo sapiens
tggctgcagatcaagggcaggc

SEQ ID NO: 9074847 - DNA, 20 bp, Homo sapiens
tggctgcacaccaggacagg

SEQ ID NO: 9074848 - DNA, 22 bp, Homo sapiens
tggctgcacttcaacacatcct

SEQ ID NO: 9074849 - DNA, 22 bp, Homo sapiens
tggctgagtgttccaaggagca

SEQ ID NO: 9074850 - DNA, 22 bp, Homo sapiens
tggctgagttcctggcacacgg

SEQ ID NO: 9074851 - DNA, 22 bp, Homo sapiens
tggctgagttacgaacagagca

SEQ ID NO: 9074852 - DNA, 22 bp, Homo sapiens
tggctgccaatggcttggaaag

SEQ ID NO: 9074853 - DNA, 22 bp, Homo sapiens
tggctgcagttgggccctcaga

SEQ ID NO: 9074854 - DNA, 22 bp, Homo sapiens
tggctgcagttgggccctcaga

SEQ ID NO: 9074855 - DNA, 22 bp, Homo sapiens
tggctgccatgacgcctgggga

SEQ ID NO: 9074856 - DNA, 22 bp, Homo sapiens
tggctgcttaaaattgctgcaa

SEQ ID NO: 9074857 - DNA, 22 bp, Homo sapiens
tggctgctgcttggtcttcttc

SEQ ID NO: 9074858 - DNA, 18 bp, Homo sapiens
tggctgctggagtagggt

SEQ ID NO: 9074859 - DNA, 21 bp, Homo sapiens
tggctgctggccctctctcca

SEQ ID NO: 9074860 - DNA, 22 bp, Homo sapiens
tggctgctgcagacagacagga

SEQ ID NO: 9074861 - DNA, 22 bp, Homo sapiens
tggctgctgagaaggcagctgt

SEQ ID NO: 9074862 - DNA, 22 bp, Homo sapiens
tggctgaggcacagctgccgcc

SEQ ID NO: 9074863 - DNA, 22 bp, Homo sapiens
tggctgaggagggtcttctggt

SEQ ID NO: 9074864 - DNA, 22 bp, Homo sapiens
tggctgaggagagggcggaagt

SEQ ID NO: 9074865 - DNA, 22 bp, Homo sapiens
tggctgagcctttggggctttc

SEQ ID NO: 9074866 - DNA, 22 bp, Homo sapiens
tggctgagctgcagcgtggctt

SEQ ID NO: 9074867 - DNA, 22 bp, Homo sapiens
tggctgagctgcagcgtggctt

SEQ ID NO: 9074868 - DNA, 22 bp, Homo sapiens
tggctgagctgcagcgtggctt

SEQ ID NO: 9074869 - DNA, 22 bp, Homo sapiens
tggctgaggttatgctggttgt

SEQ ID NO: 9074870 - DNA, 22 bp, Homo sapiens
tggctgaggtctggggcttctg

SEQ ID NO: 9074871 - DNA, 22 bp, Homo sapiens
tggctgagggcactatgaagcc

SEQ ID NO: 9074872 - DNA, 22 bp, Homo sapiens
tggctgaggctggagtgcagtg

SEQ ID NO: 9074873 - DNA, 22 bp, Homo sapiens
tggctgaggctggagtgcagtg

SEQ ID NO: 9074874 - DNA, 22 bp, Homo sapiens
tggctgagccacttgttcagat

SEQ ID NO: 9074875 - DNA, 22 bp, Homo sapiens
tggctgagagtcatcctgtgtg

SEQ ID NO: 9074876 - DNA, 22 bp, Homo sapiens
tggctgagccacttgttcagat

SEQ ID NO: 9074877 - DNA, 21 bp, Homo sapiens
tggctgagccaggtgtgtgga

SEQ ID NO: 9074878 - DNA, 23 bp, Homo sapiens
tggctgagcccactatcttggcc

SEQ ID NO: 9074879 - DNA, 22 bp, Homo sapiens
tggctgaattcatcaagaaaat

SEQ ID NO: 9074880 - DNA, 22 bp, Homo sapiens
tggctgaattcatcaagaaaat

SEQ ID NO: 9074881 - DNA, 22 bp, Homo sapiens
tggctgaaagcctggcctgcca

SEQ ID NO: 9074882 - DNA, 22 bp, Homo sapiens
tggctgaagtgggcaggaggga

SEQ ID NO: 9074883 - DNA, 22 bp, Homo sapiens
tggctgaactaatgtgctgttt

SEQ ID NO: 9074884 - DNA, 22 bp, Homo sapiens
tggctgagaaaaaagagctata

SEQ ID NO: 9074885 - DNA, 22 bp, Homo sapiens
tggctgagaagttctggtggga

SEQ ID NO: 9074886 - DNA, 22 bp, Homo sapiens
tgacatttgagcatacatgtaa

SEQ ID NO: 9074887 - DNA, 22 bp, Homo sapiens
tgacatttcttgttgatataaa

SEQ ID NO: 9074888 - DNA, 22 bp, Homo sapiens
tgacatttgagagagatataca

SEQ ID NO: 9074889 - DNA, 22 bp, Homo sapiens
tgacatttcctagtgctttgtg

SEQ ID NO: 9074890 - DNA, 22 bp, Homo sapiens
tgacatttcttgttgatataaa

SEQ ID NO: 9074891 - DNA, 22 bp, Homo sapiens
tgacctattagatttccttgcc

SEQ ID NO: 9074892 - DNA, 22 bp, Homo sapiens
tgaccgttttggcacccatgct

SEQ ID NO: 9074893 - DNA, 22 bp, Homo sapiens
tgacccttggtcagagtgccct

SEQ ID NO: 9074894 - DNA, 18 bp, Homo sapiens
tgaccctttctccctgtg

SEQ ID NO: 9074895 - DNA, 22 bp, Homo sapiens
tgacccttagaagctgcagcga

SEQ ID NO: 9074896 - DNA, 22 bp, Homo sapiens
tgacatttttaaaaccactagt

SEQ ID NO: 9074897 - DNA, 22 bp, Homo sapiens
tgacattctgttaagtctcata

SEQ ID NO: 9074898 - DNA, 22 bp, Homo sapiens
tgacatttaatccctaaatatt

SEQ ID NO: 9074899 - DNA, 22 bp, Homo sapiens
tgacatgtcctgagaagatggc

SEQ ID NO: 9074900 - DNA, 22 bp, Homo sapiens
tgacagtgcgggtacatcatag

SEQ ID NO: 9074901 - DNA, 22 bp, Homo sapiens
tgacatttatcttctacaatga

SEQ ID NO: 9074902 - DNA, 21 bp, Homo sapiens
tgacatttccaatataaagcc

SEQ ID NO: 9074903 - DNA, 21 bp, Homo sapiens
tgacatttccaatataaagcc

SEQ ID NO: 9074904 - DNA, 22 bp, Homo sapiens
tgacatttatcttctacaatga

SEQ ID NO: 9074905 - DNA, 22 bp, Homo sapiens
tgacatttatcaaagaaatggt

SEQ ID NO: 9074906 - DNA, 21 bp, Homo sapiens
tgactgaggcttcttcacaca

SEQ ID NO: 9074907 - DNA, 21 bp, Homo sapiens
tgactgaggcttcttcacaca

SEQ ID NO: 9074908 - DNA, 22 bp, Homo sapiens
tgactggattgtcattacgacg

SEQ ID NO: 9074909 - DNA, 22 bp, Homo sapiens
tgactgccccttccattcctgc

SEQ ID NO: 9074910 - DNA, 22 bp, Homo sapiens
tgactgtgcctgttgaatgaat

SEQ ID NO: 9074911 - DNA, 22 bp, Homo sapiens
tgactggattgtcattacgacg

SEQ ID NO: 9074912 - DNA, 22 bp, Homo sapiens
tgactggattgtcattacgacg

SEQ ID NO: 9074913 - DNA, 22 bp, Homo sapiens
tgactgtgcaagcagagagcat

SEQ ID NO: 9074914 - DNA, 22 bp, Homo sapiens
tgacttgtctctttgggagaca

SEQ ID NO: 9074915 - DNA, 22 bp, Homo sapiens
tgacttgtctctttgggagaca

SEQ ID NO: 9074916 - DNA, 22 bp, Homo sapiens
tgacttgtcaaagaaatgtgtg

SEQ ID NO: 9074917 - DNA, 22 bp, Homo sapiens
tgacttgtattttaaataattg

SEQ ID NO: 9074918 - DNA, 22 bp, Homo sapiens
tgacttcctgcactcaggtgat

SEQ ID NO: 9074919 - DNA, 22 bp, Homo sapiens
tgacttcctgcactcaggtgat

SEQ ID NO: 9074920 - DNA, 22 bp, Homo sapiens
tgacttcaaaggctctactcct

SEQ ID NO: 9074921 - DNA, 22 bp, Homo sapiens
tgacttaagctgttctttagat

SEQ ID NO: 9074922 - DNA, 18 bp, Homo sapiens
tgactcaccctgtcagtg

SEQ ID NO: 9074923 - DNA, 22 bp, Homo sapiens
tgactcccaggataggatctgg

SEQ ID NO: 9074924 - DNA, 20 bp, Homo sapiens
tgactctgcaaccgtctctc

SEQ ID NO: 9074925 - DNA, 22 bp, Homo sapiens
tgactctgattgccttagcttg

SEQ ID NO: 9074926 - DNA, 22 bp, Homo sapiens
tgactctgtacctgtctgcctt

SEQ ID NO: 9074927 - DNA, 22 bp, Homo sapiens
tgactctggggttgaccagatg

SEQ ID NO: 9074928 - DNA, 22 bp, Homo sapiens
tgactaaaataggacattaact

SEQ ID NO: 9074929 - DNA, 21 bp, Homo sapiens
tgactaattgtgataaagtgc

SEQ ID NO: 9074930 - DNA, 22 bp, Homo sapiens
tgacctcttgtcggagctccag

SEQ ID NO: 9074931 - DNA, 22 bp, Homo sapiens
tgaccttatttgaaaatagaga

SEQ ID NO: 9074932 - DNA, 22 bp, Homo sapiens
tgacctttctctgggtgcttgg

SEQ ID NO: 9074933 - DNA, 22 bp, Homo sapiens
tgacacatgcaccagtctttaa

SEQ ID NO: 9074934 - DNA, 22 bp, Homo sapiens
tgacacagttgtcgactctaca

SEQ ID NO: 9074935 - DNA, 22 bp, Homo sapiens
tgacacagttgtcgactctaca

SEQ ID NO: 9074936 - DNA, 22 bp, Homo sapiens
tgacacataccgaaaatatttg

SEQ ID NO: 9074937 - DNA, 22 bp, Homo sapiens
tgacacagtatcaaacatgatt

SEQ ID NO: 9074938 - DNA, 22 bp, Homo sapiens
tgacacagtatcaaacatgatt

SEQ ID NO: 9074939 - DNA, 22 bp, Homo sapiens
tgacacagtagaaagatgatga

SEQ ID NO: 9074940 - DNA, 22 bp, Homo sapiens
tgacacagtagaaagatgatga

SEQ ID NO: 9074941 - DNA, 22 bp, Homo sapiens
tgacacagtagaaagatgatga

SEQ ID NO: 9074942 - DNA, 22 bp, Homo sapiens
tgacacagattagagacatacc

SEQ ID NO: 9074943 - DNA, 22 bp, Homo sapiens
tgacacagattagagacatacc

SEQ ID NO: 9074944 - DNA, 19 bp, Homo sapiens
tgacacagctaggtttgct

SEQ ID NO: 9074945 - DNA, 19 bp, Homo sapiens
tgacacagctaggtttgct

SEQ ID NO: 9074946 - DNA, 22 bp, Homo sapiens
tgacacagattagagacatacc

SEQ ID NO: 9074947 - DNA, 22 bp, Homo sapiens
tgacacagaaattaagctgtca

SEQ ID NO: 9074948 - DNA, 22 bp, Homo sapiens
tgacacagaaattaagctgtca

SEQ ID NO: 9074949 - DNA, 22 bp, Homo sapiens
tgacacagaatttggctatcac

SEQ ID NO: 9074950 - DNA, 23 bp, Homo sapiens
tgacacaggtcaaaaataagatg

SEQ ID NO: 9074951 - DNA, 23 bp, Homo sapiens
tgacacaggtcaaaaataagatg

SEQ ID NO: 9074952 - DNA, 22 bp, Homo sapiens
tgacacagggcatgcagcagaa

SEQ ID NO: 9074953 - DNA, 22 bp, Homo sapiens
tgacacaggggaaggagtctgg

SEQ ID NO: 9074954 - DNA, 22 bp, Homo sapiens
tgacacaggcagctcccagcac

SEQ ID NO: 9074955 - DNA, 22 bp, Homo sapiens
tgacacagggaaagcggatcca

SEQ ID NO: 9074956 - DNA, 22 bp, Homo sapiens
tgacacagggcatgcagcagaa

SEQ ID NO: 9074957 - DNA, 22 bp, Homo sapiens
tgacacagggaaagcggatcca

SEQ ID NO: 9074958 - DNA, 22 bp, Homo sapiens
tgacagaaatagttcttaattt

SEQ ID NO: 9074959 - DNA, 22 bp, Homo sapiens
tgacagaaagaatatgtcaatc

SEQ ID NO: 9074960 - DNA, 22 bp, Homo sapiens
tgacagaaagaatatgtcaatc

SEQ ID NO: 9074961 - DNA, 22 bp, Homo sapiens
tgacagaccactgcaactctgt

SEQ ID NO: 9074962 - DNA, 22 bp, Homo sapiens
tgacagattttgatggctaata

SEQ ID NO: 9074963 - DNA, 22 bp, Homo sapiens
tgacagatgaagctggggacca

SEQ ID NO: 9074964 - DNA, 22 bp, Homo sapiens
tgacagcagcatagtgagcaat

SEQ ID NO: 9074965 - DNA, 18 bp, Homo sapiens
tgacagaacctggagcct

SEQ ID NO: 9074966 - DNA, 22 bp, Homo sapiens
tgacagaacaggttgggagcaa

SEQ ID NO: 9074967 - DNA, 22 bp, Homo sapiens
tgacagaatgtgactctcagat

SEQ ID NO: 9074968 - DNA, 22 bp, Homo sapiens
tgacagaatgtgactctcagat

SEQ ID NO: 9074969 - DNA, 21 bp, Homo sapiens
tgacaggcaccctggctgtga

SEQ ID NO: 9074970 - DNA, 21 bp, Homo sapiens
tgacaggcaccctggctgtga

SEQ ID NO: 9074971 - DNA, 22 bp, Homo sapiens
tgacaggcgtttttctctagta

SEQ ID NO: 9074972 - DNA, 22 bp, Homo sapiens
tgacaggcagtgctgggcatgt

SEQ ID NO: 9074973 - DNA, 23 bp, Homo sapiens
tgacaggccagaagagcagctgg

SEQ ID NO: 9074974 - DNA, 23 bp, Homo sapiens
tgacaggctttgctccttctgcc

SEQ ID NO: 9074975 - DNA, 19 bp, Homo sapiens
tgacaggctgttgccttga

SEQ ID NO: 9074976 - DNA, 23 bp, Homo sapiens
tgacaggctgcttctggctgagg

SEQ ID NO: 9074977 - DNA, 22 bp, Homo sapiens
tgacagggacagtggagatgga

SEQ ID NO: 9074978 - DNA, 22 bp, Homo sapiens
tgacagcataacactggtcttg

SEQ ID NO: 9074979 - DNA, 21 bp, Homo sapiens
tgacagcatagagcagggagg

SEQ ID NO: 9074980 - DNA, 22 bp, Homo sapiens
tgacagcataacactggtcttg

SEQ ID NO: 9074981 - DNA, 22 bp, Homo sapiens
tgacagcccacctcacaggatt

SEQ ID NO: 9074982 - DNA, 22 bp, Homo sapiens
tgacagctgagccccaggcaag

SEQ ID NO: 9074983 - DNA, 22 bp, Homo sapiens
tgacagctgccacaaaggccat

SEQ ID NO: 9074984 - DNA, 22 bp, Homo sapiens
tgacagtgacagccaaaggctt

SEQ ID NO: 9074985 - DNA, 22 bp, Homo sapiens
tgacagtgcatgtgacaaagga

SEQ ID NO: 9074986 - DNA, 22 bp, Homo sapiens
tgacagtgacagccaaaggctt

SEQ ID NO: 9074987 - DNA, 22 bp, Homo sapiens
tgacagtgaataagtctcttaa

SEQ ID NO: 9074988 - DNA, 22 bp, Homo sapiens
tgacagtctgcagttttaaaaa

SEQ ID NO: 9074989 - DNA, 22 bp, Homo sapiens
tgacagggccatgctgcactgc

SEQ ID NO: 9074990 - DNA, 21 bp, Homo sapiens
tgaaggagaggaccgagtgct

SEQ ID NO: 9074991 - DNA, 22 bp, Homo sapiens
tgaagcttgtatttaaataagt

SEQ ID NO: 9074992 - DNA, 22 bp, Homo sapiens
tgaaggagatttttagggaggc

SEQ ID NO: 9074993 - DNA, 22 bp, Homo sapiens
tgaaggagatttttagggaggc

SEQ ID NO: 9074994 - DNA, 22 bp, Homo sapiens
tgaaggagctcaatgatgatgc

SEQ ID NO: 9074995 - DNA, 22 bp, Homo sapiens
tgaaggagctcaggagatagtc

SEQ ID NO: 9074996 - DNA, 22 bp, Homo sapiens
tgaaggagctcaggagatagtc

SEQ ID NO: 9074997 - DNA, 22 bp, Homo sapiens
tgaaggagctcaatgatgatgc

SEQ ID NO: 9074998 - DNA, 22 bp, Homo sapiens
tgaagctgtaggcatgggcagc

SEQ ID NO: 9074999 - DNA, 22 bp, Homo sapiens
tgaagctgtccttgataggggc

SEQ ID NO: 9075000 - DNA, 22 bp, Homo sapiens
tgaagctggttgtatgactgga

SEQ ID NO: 9075001 - DNA, 22 bp, Homo sapiens
tgaagctgtaggcatgggcagc

SEQ ID NO: 9075002 - DNA, 22 bp, Homo sapiens
tgaagctgtgggcagtggagcc

SEQ ID NO: 9075003 - DNA, 22 bp, Homo sapiens
tgaagctgtgggcagtggagcc

SEQ ID NO: 9075004 - DNA, 22 bp, Homo sapiens
tgaagctgtgggcagtggagcc

SEQ ID NO: 9075005 - DNA, 22 bp, Homo sapiens
tgaagctggaagttaggtagac

SEQ ID NO: 9075006 - DNA, 22 bp, Homo sapiens
tgaagctggcttgacatggcct

SEQ ID NO: 9075007 - DNA, 22 bp, Homo sapiens
tgaagctatataagttacagca

SEQ ID NO: 9075008 - DNA, 22 bp, Homo sapiens
tgaagctggaagcatgcagact

SEQ ID NO: 9075009 - DNA, 22 bp, Homo sapiens
tgaagctggaagcatgcagact

SEQ ID NO: 9075010 - DNA, 19 bp, Homo sapiens
tgaaggagggggatggcca

SEQ ID NO: 9075011 - DNA, 22 bp, Homo sapiens
tgaaggcaaaacatgttacacc

SEQ ID NO: 9075012 - DNA, 22 bp, Homo sapiens
tgaaggcaactgagaaaaagca

SEQ ID NO: 9075013 - DNA, 22 bp, Homo sapiens
tgaaggcaacctctgtggtcct

SEQ ID NO: 9075014 - DNA, 22 bp, Homo sapiens
tgaaggagggaagaaggctctg

SEQ ID NO: 9075015 - DNA, 22 bp, Homo sapiens
tgaaggagggaagaaggctctg

SEQ ID NO: 9075016 - DNA, 19 bp, Homo sapiens
tgaaggagggggatggcca

SEQ ID NO: 9075017 - DNA, 19 bp, Homo sapiens
tgaaggagggggatggcca

SEQ ID NO: 9075018 - DNA, 22 bp, Homo sapiens
tgaaggagctgatgtaaggggt

SEQ ID NO: 9075019 - DNA, 22 bp, Homo sapiens
tgaaggaggaatgtggcctcca

SEQ ID NO: 9075020 - DNA, 22 bp, Homo sapiens
tgaagcagttctcagaagtggg

SEQ ID NO: 9075021 - DNA, 22 bp, Homo sapiens
tgaagcagttctcagaagtggg

SEQ ID NO: 9075022 - DNA, 22 bp, Homo sapiens
tgaagcatctggtctgagaatt

SEQ ID NO: 9075023 - DNA, 22 bp, Homo sapiens
tgaagccacagagcatctgcct

SEQ ID NO: 9075024 - DNA, 22 bp, Homo sapiens
tgaagccagtcaatgttaagtt

SEQ ID NO: 9075025 - DNA, 22 bp, Homo sapiens
tgaagccagctttggaagacac

SEQ ID NO: 9075026 - DNA, 22 bp, Homo sapiens
tgaagccactttccagaatcac

SEQ ID NO: 9075027 - DNA, 22 bp, Homo sapiens
tgaagccctgtcttatggaaga

SEQ ID NO: 9075028 - DNA, 22 bp, Homo sapiens
tgaagcccctaagtcccaggca

SEQ ID NO: 9075029 - DNA, 22 bp, Homo sapiens
tgaagcccctaagtcccaggca

SEQ ID NO: 9075030 - DNA, 23 bp, Homo sapiens
tgaagcccagtgattttgtttca

SEQ ID NO: 9075031 - DNA, 22 bp, Homo sapiens
tgaagcccaggaatctacattt

SEQ ID NO: 9075032 - DNA, 22 bp, Homo sapiens
tgaagcccaggtgttagtgggg

SEQ ID NO: 9075033 - DNA, 22 bp, Homo sapiens
tgaagccattactgtgttaggg

SEQ ID NO: 9075034 - DNA, 22 bp, Homo sapiens
tgaagcccaaggcactgtctga

SEQ ID NO: 9075035 - DNA, 22 bp, Homo sapiens
tgaagcccaatcctgtgttcct

SEQ ID NO: 9075036 - DNA, 22 bp, Homo sapiens
tgaagccatcaggaagccagca

SEQ ID NO: 9075037 - DNA, 22 bp, Homo sapiens
tgaagccatccctcagatggcc

SEQ ID NO: 9075038 - DNA, 22 bp, Homo sapiens
tgaagctaggttcatgaggtcg

SEQ ID NO: 9075039 - DNA, 22 bp, Homo sapiens
tgaagctagtattaactcagat

SEQ ID NO: 9075040 - DNA, 22 bp, Homo sapiens
tgaagctagcaggaagagcagg

SEQ ID NO: 9075041 - DNA, 22 bp, Homo sapiens
tgaagctattggtaaggaagtg

SEQ ID NO: 9075042 - DNA, 22 bp, Homo sapiens
tgaagctagtcaagcttagata

SEQ ID NO: 9075043 - DNA, 22 bp, Homo sapiens
tgaagctacagaccttcgcggt

SEQ ID NO: 9075044 - DNA, 22 bp, Homo sapiens
tgaagctacaaaagattattgc

SEQ ID NO: 9075045 - DNA, 22 bp, Homo sapiens
tgaagctagaatgtccatattt

SEQ ID NO: 9075046 - DNA, 22 bp, Homo sapiens
tgaagccctgtgtcagcttcca

SEQ ID NO: 9075047 - DNA, 22 bp, Homo sapiens
tgaagccctgtgataggtccag

SEQ ID NO: 9075048 - DNA, 22 bp, Homo sapiens
tgaagcccttcatgcacagtca

SEQ ID NO: 9075049 - DNA, 22 bp, Homo sapiens
tgaagccctgtgtcagcttcca

SEQ ID NO: 9075050 - DNA, 21 bp, Homo sapiens
tgaagcctgaggcatagcccc

SEQ ID NO: 9075051 - DNA, 22 bp, Homo sapiens
tgaagcctcacctgctcagtat

SEQ ID NO: 9075052 - DNA, 22 bp, Homo sapiens
tgaagcctgaaagctggacagg

SEQ ID NO: 9075053 - DNA, 22 bp, Homo sapiens
tgaaggctttctcccctctggt

SEQ ID NO: 9075054 - DNA, 22 bp, Homo sapiens
tgaaggctgtcacctgcacctt

SEQ ID NO: 9075055 - DNA, 23 bp, Homo sapiens
tgaaggcctggaggacgcgttgt

SEQ ID NO: 9075056 - DNA, 22 bp, Homo sapiens
tgaaggcctaacttccagtgct

SEQ ID NO: 9075057 - DNA, 22 bp, Homo sapiens
tgaaggcctctggtacatgcca

SEQ ID NO: 9075058 - DNA, 22 bp, Homo sapiens
tgaaggcctccccgagcattag

SEQ ID NO: 9075059 - DNA, 22 bp, Homo sapiens
tgaaggcctccccgagcattag

SEQ ID NO: 9075060 - DNA, 22 bp, Homo sapiens
tgaagggtggcatggcaggcag

SEQ ID NO: 9075061 - DNA, 22 bp, Homo sapiens
tgaaggggttcagcatgggggt

SEQ ID NO: 9075062 - DNA, 22 bp, Homo sapiens
tgaaggcagtgattttgtttgg

SEQ ID NO: 9075063 - DNA, 20 bp, Homo sapiens
tgaaggcaggtaagaaagat

SEQ ID NO: 9075064 - DNA, 22 bp, Homo sapiens
tgaaggcacttgcctaggggca

SEQ ID NO: 9075065 - DNA, 22 bp, Homo sapiens
tgaaggccagcagagtgaaggc

SEQ ID NO: 9075066 - DNA, 22 bp, Homo sapiens
tgaaggccacttcctgtgagct

SEQ ID NO: 9075067 - DNA, 22 bp, Homo sapiens
tgaaggccagcagagtgaaggc

SEQ ID NO: 9075068 - DNA, 22 bp, Homo sapiens
tgaaggccaaaagacgggcttc

SEQ ID NO: 9075069 - DNA, 22 bp, Homo sapiens
tgaaggccacttcctgtgagct

SEQ ID NO: 9075070 - DNA, 22 bp, Homo sapiens
tgaaggccacttcctgtgagct

SEQ ID NO: 9075071 - DNA, 22 bp, Homo sapiens
tgaaggccagcagagtgaaggc

SEQ ID NO: 9075072 - DNA, 20 bp, Homo sapiens
tgaaggccagcagcataggg

SEQ ID NO: 9075073 - DNA, 22 bp, Homo sapiens
tgaaggccagcagagtgaaggc

SEQ ID NO: 9075074 - DNA, 22 bp, Homo sapiens
tgaaggccagcagagtgaaggc

SEQ ID NO: 9075075 - DNA, 22 bp, Homo sapiens
tgaaggccaaaagacgggcttc

SEQ ID NO: 9075076 - DNA, 22 bp, Homo sapiens
tgaaggccagctctttatcagc

SEQ ID NO: 9075077 - DNA, 22 bp, Homo sapiens
tgaaggcccagccacagaatgg

SEQ ID NO: 9075078 - DNA, 20 bp, Homo sapiens
tgaaggccctataattcaat

SEQ ID NO: 9075079 - DNA, 23 bp, Homo sapiens
tgaaggccctggagccacgaggc

SEQ ID NO: 9075080 - DNA, 23 bp, Homo sapiens
tgaaggccctggagccacgaggc

SEQ ID NO: 9075081 - DNA, 23 bp, Homo sapiens
tgaaggccctggagccacgaggc

SEQ ID NO: 9075082 - DNA, 22 bp, Homo sapiens
tgaaggccctatctccatatac

SEQ ID NO: 9075083 - DNA, 22 bp, Homo sapiens
tgaaggcctaacttccagtgct

SEQ ID NO: 9075084 - DNA, 22 bp, Homo sapiens
tgaaggcccagccacagaatgg

SEQ ID NO: 9075085 - DNA, 17 bp, Homo sapiens
tgaaggccatgaccacg

SEQ ID NO: 9075086 - DNA, 22 bp, Homo sapiens
tgaaggccagggatttgcagcc

SEQ ID NO: 9075087 - DNA, 20 bp, Homo sapiens
tgaaggccatttgttccaga

SEQ ID NO: 9075088 - DNA, 20 bp, Homo sapiens
tgaaggccctataattcaat

SEQ ID NO: 9075089 - DNA, 22 bp, Homo sapiens
tgaaggcccagccacagaatgg

SEQ ID NO: 9075090 - DNA, 22 bp, Homo sapiens
tgaaggtaatggaatctcctga

SEQ ID NO: 9075091 - DNA, 22 bp, Homo sapiens
tgaaggtggcataggagagatg

SEQ ID NO: 9075092 - DNA, 22 bp, Homo sapiens
tgaagtttcttgaatcttggag

SEQ ID NO: 9075093 - DNA, 22 bp, Homo sapiens
tgaagtttaaggttagataagt

SEQ ID NO: 9075094 - DNA, 22 bp, Homo sapiens
tgaataagaattattataatga

SEQ ID NO: 9075095 - DNA, 21 bp, Homo sapiens
tgaataaagctgctgtcgata

SEQ ID NO: 9075096 - DNA, 21 bp, Homo sapiens
tgaataaagctgctgtcgata

SEQ ID NO: 9075097 - DNA, 22 bp, Homo sapiens
tgaataaagtatgtcctgggaa

SEQ ID NO: 9075098 - DNA, 22 bp, Homo sapiens
tgaataaatcaaagactgccct

SEQ ID NO: 9075099 - DNA, 22 bp, Homo sapiens
tgaataaattgagagcgaatgt

SEQ ID NO: 9075100 - DNA, 22 bp, Homo sapiens
tgaagttttacatcctctccaa

SEQ ID NO: 9075101 - DNA, 22 bp, Homo sapiens
tgaagttttctggttgattaag

SEQ ID NO: 9075102 - DNA, 22 bp, Homo sapiens
tgaataaactatgaggaggaat

SEQ ID NO: 9075103 - DNA, 22 bp, Homo sapiens
tgaataaactatgaggaggaat

SEQ ID NO: 9075104 - DNA, 22 bp, Homo sapiens
tgaataaactatgaggaggaat

SEQ ID NO: 9075105 - DNA, 22 bp, Homo sapiens
tgaatacaggaaaatatactga

SEQ ID NO: 9075106 - DNA, 22 bp, Homo sapiens
tgaatacactaaaaatcacttt

SEQ ID NO: 9075107 - DNA, 22 bp, Homo sapiens
tgaataattcctttttgtcaag

SEQ ID NO: 9075108 - DNA, 22 bp, Homo sapiens
tgaataattcctttttgtcaag

SEQ ID NO: 9075109 - DNA, 22 bp, Homo sapiens
tgaatactatttcataatgtgg

SEQ ID NO: 9075110 - DNA, 22 bp, Homo sapiens
tgaatacaggaaaatatactga

SEQ ID NO: 9075111 - DNA, 20 bp, Homo sapiens
tgaatagagagcacatatgc

SEQ ID NO: 9075112 - DNA, 22 bp, Homo sapiens
tgaatagatttttaacatataa

SEQ ID NO: 9075113 - DNA, 22 bp, Homo sapiens
tgaatagatggtgacagtatga

SEQ ID NO: 9075114 - DNA, 22 bp, Homo sapiens
tgaatcagtataaattctcaaa

SEQ ID NO: 9075115 - DNA, 23 bp, Homo sapiens
tgaatcaattatgggattcaatg

SEQ ID NO: 9075116 - DNA, 22 bp, Homo sapiens
tgaatcaattgtcttaagacat

SEQ ID NO: 9075117 - DNA, 22 bp, Homo sapiens
tgaatcaatagttgcaagtatt

SEQ ID NO: 9075118 - DNA, 22 bp, Homo sapiens
tgaatcaatgaattgcacttca

SEQ ID NO: 9075119 - DNA, 22 bp, Homo sapiens
tgaatatgattgcaaatttggc

SEQ ID NO: 9075120 - DNA, 22 bp, Homo sapiens
tgaatatgctttgcaatcctaa

SEQ ID NO: 9075121 - DNA, 20 bp, Homo sapiens
tgaatatgaccttatttgga

SEQ ID NO: 9075122 - DNA, 22 bp, Homo sapiens
tgaatatgtatttcttatttac

SEQ ID NO: 9075123 - DNA, 22 bp, Homo sapiens
tgaatatggcaactcttgtaac

SEQ ID NO: 9075124 - DNA, 22 bp, Homo sapiens
tgaatcaaagctgaagttttca

SEQ ID NO: 9075125 - DNA, 18 bp, Homo sapiens
tgaattagtttgtggttt

SEQ ID NO: 9075126 - DNA, 22 bp, Homo sapiens
tgaatgtgatgctaaacatatg

SEQ ID NO: 9075127 - DNA, 22 bp, Homo sapiens
tgaatgtaccttgaaggtgtaa

SEQ ID NO: 9075128 - DNA, 22 bp, Homo sapiens
tgaatggaagagaagtgtcctg

SEQ ID NO: 9075129 - DNA, 22 bp, Homo sapiens
tgaatgagtcaatcatttagct

SEQ ID NO: 9075130 - DNA, 22 bp, Homo sapiens
tgaatctgatttccctggaggc

SEQ ID NO: 9075131 - DNA, 22 bp, Homo sapiens
tgaatctggatctatgatcaat

SEQ ID NO: 9075132 - DNA, 20 bp, Homo sapiens
tgacaaagagtaagaggagg

SEQ ID NO: 9075133 - DNA, 23 bp, Homo sapiens
tgacaaagcgagactccagctca

SEQ ID NO: 9075134 - DNA, 22 bp, Homo sapiens
tgacaaaccagtagcaataaag

SEQ ID NO: 9075135 - DNA, 22 bp, Homo sapiens
tgacaaaccagtagcaataaag

SEQ ID NO: 9075136 - DNA, 22 bp, Homo sapiens
tgacaaaccctgcaaatagctc

SEQ ID NO: 9075137 - DNA, 22 bp, Homo sapiens
tgacaaagacaaagatatgtcc

SEQ ID NO: 9075138 - DNA, 23 bp, Homo sapiens
tgaattttggcatattctgaaat

SEQ ID NO: 9075139 - DNA, 22 bp, Homo sapiens
tgacaaatacaataagatctgt

SEQ ID NO: 9075140 - DNA, 20 bp, Homo sapiens
tgacaaatgatctgattttc

SEQ ID NO: 9075141 - DNA, 22 bp, Homo sapiens
tgacacaaaggaaagcataatc

SEQ ID NO: 9075142 - DNA, 22 bp, Homo sapiens
tgacaaattcatatttcagagg

SEQ ID NO: 9075143 - DNA, 22 bp, Homo sapiens
tgacaatttatagaatgtgact

SEQ ID NO: 9075144 - DNA, 22 bp, Homo sapiens
tgacaaatgttaattcagtgga

SEQ ID NO: 9075145 - DNA, 22 bp, Homo sapiens
tgaattcttaatgaaatctact

SEQ ID NO: 9075146 - DNA, 22 bp, Homo sapiens
tgaattctgggtcagcagcttg

SEQ ID NO: 9075147 - DNA, 22 bp, Homo sapiens
tgaattctgctgtagcaagtcc

SEQ ID NO: 9075148 - DNA, 20 bp, Homo sapiens
tgaattctagatgactggag

SEQ ID NO: 9075149 - DNA, 22 bp, Homo sapiens
tgaattccctgcaggcatcctc

SEQ ID NO: 9075150 - DNA, 22 bp, Homo sapiens
tgaatttaccttgcctatattt

SEQ ID NO: 9075151 - DNA, 22 bp, Homo sapiens
tgaattgagataggatcagtct

SEQ ID NO: 9075152 - DNA, 22 bp, Homo sapiens
tgaattcttatctgggctgtgc

SEQ ID NO: 9075153 - DNA, 22 bp, Homo sapiens
tgaattcttttagaattcagtg

SEQ ID NO: 9075154 - DNA, 22 bp, Homo sapiens
tgaatttatcaaagattcttaa

SEQ ID NO: 9075155 - DNA, 21 bp, Homo sapiens
tgaatttcggtatggctataa

SEQ ID NO: 9075156 - DNA, 21 bp, Homo sapiens
tgaatttcggtatggctataa

SEQ ID NO: 9075157 - DNA, 23 bp, Homo sapiens
tgaatttggaactcagagaatta

SEQ ID NO: 9075158 - DNA, 20 bp, Homo sapiens
tctttgttaattttatctcc

SEQ ID NO: 9075159 - DNA, 22 bp, Homo sapiens
tctttgttattgctttatctat

SEQ ID NO: 9075160 - DNA, 22 bp, Homo sapiens
tctttgtttgcctttatcaaga

SEQ ID NO: 9075161 - DNA, 22 bp, Homo sapiens
tctttgtttgtactgttagaat

SEQ ID NO: 9075162 - DNA, 22 bp, Homo sapiens
tcttttaaaagccctgctgtct

SEQ ID NO: 9075163 - DNA, 21 bp, Homo sapiens
tcttttaacaccaggaattcc

SEQ ID NO: 9075164 - DNA, 22 bp, Homo sapiens
tcttttaacctaactagcttgg

SEQ ID NO: 9075165 - DNA, 22 bp, Homo sapiens
tcttttagctctgcaaggaaag

SEQ ID NO: 9075166 - DNA, 21 bp, Homo sapiens
tcttttctctgcaggattcct

SEQ ID NO: 9075167 - DNA, 23 bp, Homo sapiens
tcttttcaatggttctttatgtg

SEQ ID NO: 9075168 - DNA, 22 bp, Homo sapiens
tcttttcatcatttaataggta

SEQ ID NO: 9075169 - DNA, 22 bp, Homo sapiens
tctttgcaaactatggagtgtg

SEQ ID NO: 9075170 - DNA, 22 bp, Homo sapiens
tctttgcaaactatggagtgtg

SEQ ID NO: 9075171 - DNA, 22 bp, Homo sapiens
tctttgcaaaatacaacaatgg

SEQ ID NO: 9075172 - DNA, 22 bp, Homo sapiens
tctttgcaaaatacaacaatgg

SEQ ID NO: 9075173 - DNA, 22 bp, Homo sapiens
tctttgcacacagcgattcttc

SEQ ID NO: 9075174 - DNA, 22 bp, Homo sapiens
tctttgcactgtgcaagcagaa

SEQ ID NO: 9075175 - DNA, 22 bp, Homo sapiens
tctttgcactgtgcaagcagaa

SEQ ID NO: 9075176 - DNA, 22 bp, Homo sapiens
tctttgcacacatcccttcccg

SEQ ID NO: 9075177 - DNA, 17 bp, Homo sapiens
tctttgcaatgagactg

SEQ ID NO: 9075178 - DNA, 17 bp, Homo sapiens
tctttgcaatgagactg

SEQ ID NO: 9075179 - DNA, 22 bp, Homo sapiens
tctttgcaaatgttattatctt

SEQ ID NO: 9075180 - DNA, 22 bp, Homo sapiens
tctttgcaactcccatttccat

SEQ ID NO: 9075181 - DNA, 22 bp, Homo sapiens
tctttgcagaacgatgaagatg

SEQ ID NO: 9075182 - DNA, 22 bp, Homo sapiens
tctttgcagaacgatgaagatg

SEQ ID NO: 9075183 - DNA, 22 bp, Homo sapiens
tctttgcactgtgcaagcagaa

SEQ ID NO: 9075184 - DNA, 22 bp, Homo sapiens
tctttgcagaatttaactttgc

SEQ ID NO: 9075185 - DNA, 22 bp, Homo sapiens
tctttgcagccccaggaagtgg

SEQ ID NO: 9075186 - DNA, 22 bp, Homo sapiens
tctttgcaggagccctttgaac

SEQ ID NO: 9075187 - DNA, 22 bp, Homo sapiens
tctttgcagtggtgaataaaga

SEQ ID NO: 9075188 - DNA, 21 bp, Homo sapiens
tctttgcatcagttgttttct

SEQ ID NO: 9075189 - DNA, 22 bp, Homo sapiens
tctttgcagttctgattaaata

SEQ ID NO: 9075190 - DNA, 22 bp, Homo sapiens
tctttgcagtctgggcttgttt

SEQ ID NO: 9075191 - DNA, 22 bp, Homo sapiens
tctttgcaggccaaattgttaa

SEQ ID NO: 9075192 - DNA, 22 bp, Homo sapiens
tctttgcagtctgggcttgttt

SEQ ID NO: 9075193 - DNA, 22 bp, Homo sapiens
tctttgctgagtacatctccaa

SEQ ID NO: 9075194 - DNA, 22 bp, Homo sapiens
tctttgctcttacacagttagt

SEQ ID NO: 9075195 - DNA, 22 bp, Homo sapiens
tctttggaaaaaatggacaatc

SEQ ID NO: 9075196 - DNA, 22 bp, Homo sapiens
tctttggaaatgctttgagaat

SEQ ID NO: 9075197 - DNA, 22 bp, Homo sapiens
tctttggaaggagcagtttttg

SEQ ID NO: 9075198 - DNA, 22 bp, Homo sapiens
tctttggaagtcaggggcatgg

SEQ ID NO: 9075199 - DNA, 22 bp, Homo sapiens
tctttggaagctttcagagaag

SEQ ID NO: 9075200 - DNA, 22 bp, Homo sapiens
tctttggaaggagcagtttttg

SEQ ID NO: 9075201 - DNA, 22 bp, Homo sapiens
tctttgcatgcattttccctta

SEQ ID NO: 9075202 - DNA, 22 bp, Homo sapiens
tctttgcatgagttccctctgt

SEQ ID NO: 9075203 - DNA, 22 bp, Homo sapiens
tctttgcatgcattttccctta

SEQ ID NO: 9075204 - DNA, 22 bp, Homo sapiens
tctttgcatcccttccatagtt

SEQ ID NO: 9075205 - DNA, 22 bp, Homo sapiens
tctttgcatcccttccatagtt

SEQ ID NO: 9075206 - DNA, 22 bp, Homo sapiens
tctttgcattttatgccgttat

SEQ ID NO: 9075207 - DNA, 22 bp, Homo sapiens
tctttgcatgtgcttcttggcc

SEQ ID NO: 9075208 - DNA, 22 bp, Homo sapiens
tctttgcatggacatgtgtttt

SEQ ID NO: 9075209 - DNA, 22 bp, Homo sapiens
tctttgcattcctgtgtgcttt

SEQ ID NO: 9075210 - DNA, 22 bp, Homo sapiens
tctttggatcccaactggctgg

SEQ ID NO: 9075211 - DNA, 22 bp, Homo sapiens
tctttggatctcaaggtggcag

SEQ ID NO: 9075212 - DNA, 22 bp, Homo sapiens
tctttggatggaaaatgtattc

SEQ ID NO: 9075213 - DNA, 22 bp, Homo sapiens
tctttggatgcgttacttttac

SEQ ID NO: 9075214 - DNA, 22 bp, Homo sapiens
tctttggatgcgttacttttac

SEQ ID NO: 9075215 - DNA, 22 bp, Homo sapiens
tctttggatatgtatggataga

SEQ ID NO: 9075216 - DNA, 22 bp, Homo sapiens
tctttggagtgttatcagtaat

SEQ ID NO: 9075217 - DNA, 22 bp, Homo sapiens
tctttggagtgttatcagtaat

SEQ ID NO: 9075218 - DNA, 22 bp, Homo sapiens
tctttggagtgttatcagtaat

SEQ ID NO: 9075219 - DNA, 22 bp, Homo sapiens
tctttggatatcgctagaccgt

SEQ ID NO: 9075220 - DNA, 22 bp, Homo sapiens
tctttggaatgctagcattcta

SEQ ID NO: 9075221 - DNA, 22 bp, Homo sapiens
tctttggaattctctgcagccc

SEQ ID NO: 9075222 - DNA, 22 bp, Homo sapiens
tctttggaatgctagcattcta

SEQ ID NO: 9075223 - DNA, 22 bp, Homo sapiens
tctttggaatttgctggaaata

SEQ ID NO: 9075224 - DNA, 18 bp, Homo sapiens
tctttggacaactactgg

SEQ ID NO: 9075225 - DNA, 23 bp, Homo sapiens
tctttggagtgctaggggttggg

SEQ ID NO: 9075226 - DNA, 22 bp, Homo sapiens
tctttggactttccaatttgtt

SEQ ID NO: 9075227 - DNA, 18 bp, Homo sapiens
tctttggacaactactgg

SEQ ID NO: 9075228 - DNA, 22 bp, Homo sapiens
tctttggacatgttgaggttgc

SEQ ID NO: 9075229 - DNA, 22 bp, Homo sapiens
tctttgtggcgggcttaaatac

SEQ ID NO: 9075230 - DNA, 22 bp, Homo sapiens
tctttgtaagacatgtaagtcc

SEQ ID NO: 9075231 - DNA, 22 bp, Homo sapiens
tctttgtaagttatatgtagta

SEQ ID NO: 9075232 - DNA, 19 bp, Homo sapiens
tctttgtacaagtctctgc

SEQ ID NO: 9075233 - DNA, 22 bp, Homo sapiens
tctttggcatcagggccagcta

SEQ ID NO: 9075234 - DNA, 22 bp, Homo sapiens
tctttggatggaaattggagtc

SEQ ID NO: 9075235 - DNA, 22 bp, Homo sapiens
tctttggattaaaatatttgta

SEQ ID NO: 9075236 - DNA, 22 bp, Homo sapiens
tctttggattaaaatatttgta

SEQ ID NO: 9075237 - DNA, 22 bp, Homo sapiens
tctttgtaactgtctattgaga

SEQ ID NO: 9075238 - DNA, 22 bp, Homo sapiens
tgaaaattcatctcatagcaga

SEQ ID NO: 9075239 - DNA, 22 bp, Homo sapiens
tgaaaattaagcagatgaatga

SEQ ID NO: 9075240 - DNA, 22 bp, Homo sapiens
tgaaaattaagcagatgaatga

SEQ ID NO: 9075241 - DNA, 22 bp, Homo sapiens
tgaaaatttccatcagttatat

SEQ ID NO: 9075242 - DNA, 22 bp, Homo sapiens
tgaaaattgttgtacttgataa

SEQ ID NO: 9075243 - DNA, 22 bp, Homo sapiens
tgaaaatttccatcagttatat

SEQ ID NO: 9075244 - DNA, 22 bp, Homo sapiens
tgaaaagtcttatattgtctga

SEQ ID NO: 9075245 - DNA, 22 bp, Homo sapiens
tgaaaactccaagtttcatcag

SEQ ID NO: 9075246 - DNA, 22 bp, Homo sapiens
tgaaaactccaagtttcatcag

SEQ ID NO: 9075247 - DNA, 22 bp, Homo sapiens
tgaaaacttgacaagtgaggta

SEQ ID NO: 9075248 - DNA, 22 bp, Homo sapiens
tgaaaacttgacaagtgaggta

SEQ ID NO: 9075249 - DNA, 22 bp, Homo sapiens
tgaaaagtgatcatggattagg

SEQ ID NO: 9075250 - DNA, 22 bp, Homo sapiens
tgaaaagtgatcatggattagg

SEQ ID NO: 9075251 - DNA, 22 bp, Homo sapiens
tgaaaatatagttttccagact

SEQ ID NO: 9075252 - DNA, 22 bp, Homo sapiens
tgaaaatatagttttccagact

SEQ ID NO: 9075253 - DNA, 22 bp, Homo sapiens
tgaaaaactgaatagttgagta

SEQ ID NO: 9075254 - DNA, 22 bp, Homo sapiens
tgaaaaacactaattggaaagc

SEQ ID NO: 9075255 - DNA, 22 bp, Homo sapiens
tgaaaaaacaagttggcccatt

SEQ ID NO: 9075256 - DNA, 22 bp, Homo sapiens
tgaaaaaacaagttggcccatt

SEQ ID NO: 9075257 - DNA, 22 bp, Homo sapiens
tgaaaaaacaagttggcccatt

SEQ ID NO: 9075258 - DNA, 22 bp, Homo sapiens
tgaaaaaacaagttggcccatt

SEQ ID NO: 9075259 - DNA, 22 bp, Homo sapiens
tctttttatattgacaaaaggt

SEQ ID NO: 9075260 - DNA, 22 bp, Homo sapiens
tctttttatattgacaaaaggt

SEQ ID NO: 9075261 - DNA, 22 bp, Homo sapiens
tctttttatattgacaaaaggt

SEQ ID NO: 9075262 - DNA, 22 bp, Homo sapiens
tctttttcttctgtggaaggtg

SEQ ID NO: 9075263 - DNA, 22 bp, Homo sapiens
tctttttttcctgtgcagagct

SEQ ID NO: 9075264 - DNA, 22 bp, Homo sapiens
tgaaagaactagcatcttcaag

SEQ ID NO: 9075265 - DNA, 22 bp, Homo sapiens
tgaaagaagtgtcacattgcca

SEQ ID NO: 9075266 - DNA, 22 bp, Homo sapiens
tgaaagaagtgtcacattgcca

SEQ ID NO: 9075267 - DNA, 22 bp, Homo sapiens
tgaaagacaaggttttttcaga

SEQ ID NO: 9075268 - DNA, 22 bp, Homo sapiens
tgaaagagtgcaagtcaaggag

SEQ ID NO: 9075269 - DNA, 21 bp, Homo sapiens
tgaaagaggatgtggtcattc

SEQ ID NO: 9075270 - DNA, 22 bp, Homo sapiens
tgaaacttataagaatatgaat

SEQ ID NO: 9075271 - DNA, 22 bp, Homo sapiens
tgaaaccttggctagagattga

SEQ ID NO: 9075272 - DNA, 22 bp, Homo sapiens
tgaaacctcaaccaaaggttac

SEQ ID NO: 9075273 - DNA, 22 bp, Homo sapiens
tgaaagaactagcatcttcaag

SEQ ID NO: 9075274 - DNA, 22 bp, Homo sapiens
tgaaacttattcagtttctacc

SEQ ID NO: 9075275 - DNA, 22 bp, Homo sapiens
tgaaacttttgaggttcttcca

SEQ ID NO: 9075276 - DNA, 22 bp, Homo sapiens
tgaaacaggaagtaaacagaca

SEQ ID NO: 9075277 - DNA, 19 bp, Homo sapiens
tgaaacaaacttaaaagga

SEQ ID NO: 9075278 - DNA, 22 bp, Homo sapiens
tgaaacagtctccagacttgga

SEQ ID NO: 9075279 - DNA, 22 bp, Homo sapiens
tgaaacaggcaaaactgcagat

SEQ ID NO: 9075280 - DNA, 22 bp, Homo sapiens
tgaaacagtctccagacttgga

SEQ ID NO: 9075281 - DNA, 22 bp, Homo sapiens
tgaaacagtctccagacttgga

SEQ ID NO: 9075282 - DNA, 19 bp, Homo sapiens
tgaaacaaacttaaaagga

SEQ ID NO: 9075283 - DNA, 22 bp, Homo sapiens
tgaacattagttgagtaaagtc

SEQ ID NO: 9075284 - DNA, 22 bp, Homo sapiens
tgaacattagttgagtaaagtc

SEQ ID NO: 9075285 - DNA, 22 bp, Homo sapiens
tgaacatattcacctctaaata

SEQ ID NO: 9075286 - DNA, 22 bp, Homo sapiens
tgaaccaggaggcagccagcac

SEQ ID NO: 9075287 - DNA, 22 bp, Homo sapiens
tgaaccagagtctccagtggtt

SEQ ID NO: 9075288 - DNA, 22 bp, Homo sapiens
tgaacttagagtatatgaaagg

SEQ ID NO: 9075289 - DNA, 22 bp, Homo sapiens
tgaacttagtgggaatatctct

SEQ ID NO: 9075290 - DNA, 22 bp, Homo sapiens
tgaactcctgacctcatgatcc

SEQ ID NO: 9075291 - DNA, 22 bp, Homo sapiens
tgaacgcaggtccacatggctc

SEQ ID NO: 9075292 - DNA, 22 bp, Homo sapiens
tgaacaaatggaaataaccagt

SEQ ID NO: 9075293 - DNA, 22 bp, Homo sapiens
tgaacaacagatgtccattgtt

SEQ ID NO: 9075294 - DNA, 22 bp, Homo sapiens
tgaacaaatgaatcagtgtagc

SEQ ID NO: 9075295 - DNA, 22 bp, Homo sapiens
tgaacaaatggaaataaccagt

SEQ ID NO: 9075296 - DNA, 22 bp, Homo sapiens
tgaacacacacatcttaataat

SEQ ID NO: 9075297 - DNA, 23 bp, Homo sapiens
tgaacaaaggcaggagaaggcgg

SEQ ID NO: 9075298 - DNA, 22 bp, Homo sapiens
tgaaattagtgaagttacagtt

SEQ ID NO: 9075299 - DNA, 22 bp, Homo sapiens
tgaaattatgcattgttgtacc

SEQ ID NO: 9075300 - DNA, 22 bp, Homo sapiens
tgaagactcagaagctaagata

SEQ ID NO: 9075301 - DNA, 22 bp, Homo sapiens
tgaagactcagaagctaagata

SEQ ID NO: 9075302 - DNA, 18 bp, Homo sapiens
tgaagacatgaggttagt

SEQ ID NO: 9075303 - DNA, 22 bp, Homo sapiens
tgaagacagaccaaggagaatg

SEQ ID NO: 9075304 - DNA, 22 bp, Homo sapiens
tgaagacagaccaaggagaatg

SEQ ID NO: 9075305 - DNA, 22 bp, Homo sapiens
tgaagacacatacaagggaatg

SEQ ID NO: 9075306 - DNA, 22 bp, Homo sapiens
tgaagacaagtgtgctggtgtt

SEQ ID NO: 9075307 - DNA, 22 bp, Homo sapiens
tgaagacaagtgtgctggtgtt

SEQ ID NO: 9075308 - DNA, 22 bp, Homo sapiens
tgaagaataaatggttgagact

SEQ ID NO: 9075309 - DNA, 22 bp, Homo sapiens
tgaagaataagatagatggagc

SEQ ID NO: 9075310 - DNA, 22 bp, Homo sapiens
tgaagaataagatagatggagc

SEQ ID NO: 9075311 - DNA, 22 bp, Homo sapiens
tgaagagaagaaaattatcttt

SEQ ID NO: 9075312 - DNA, 22 bp, Homo sapiens
tgaagcaatagagacaagacca

SEQ ID NO: 9075313 - DNA, 22 bp, Homo sapiens
tgaagcaatgatagcagaatga

SEQ ID NO: 9075314 - DNA, 22 bp, Homo sapiens
tgaagcagaggggtcttgagct

SEQ ID NO: 9075315 - DNA, 22 bp, Homo sapiens
tgaagcagagtgaaggtgaatt

SEQ ID NO: 9075316 - DNA, 22 bp, Homo sapiens
tgaagcagagtgaaggtgaatt

SEQ ID NO: 9075317 - DNA, 22 bp, Homo sapiens
tgaagcagagtgaaggtgaatt

SEQ ID NO: 9075318 - DNA, 22 bp, Homo sapiens
tgaagcagggtggccagattgt

SEQ ID NO: 9075319 - DNA, 22 bp, Homo sapiens
tgaagcaggtgaatggatgtcg

SEQ ID NO: 9075320 - DNA, 22 bp, Homo sapiens
tgaagcagttactgggtgttaa

SEQ ID NO: 9075321 - DNA, 19 bp, Homo sapiens
tgaagcaggcagagaagat

SEQ ID NO: 9075322 - DNA, 19 bp, Homo sapiens
tgaagcaggcagagaagat

SEQ ID NO: 9075323 - DNA, 22 bp, Homo sapiens
tgaagcaggaaccagcagcatt

SEQ ID NO: 9075324 - DNA, 20 bp, Homo sapiens
tgaagcagccttgattctgt

SEQ ID NO: 9075325 - DNA, 20 bp, Homo sapiens
tgaagcagccttgattctgt

SEQ ID NO: 9075326 - DNA, 22 bp, Homo sapiens
tgaagcagcttctttctgtcaa

SEQ ID NO: 9075327 - DNA, 22 bp, Homo sapiens
tgaagcaggaaacttcttgttt

SEQ ID NO: 9075328 - DNA, 19 bp, Homo sapiens
tgaagcagcaaactctcag

SEQ ID NO: 9075329 - DNA, 22 bp, Homo sapiens
tgaaatgttgccatgaggtctc

SEQ ID NO: 9075330 - DNA, 22 bp, Homo sapiens
tgaaatgttaaacaagtggctc

SEQ ID NO: 9075331 - DNA, 22 bp, Homo sapiens
tgaaatgttaaacaagtggctc

SEQ ID NO: 9075332 - DNA, 22 bp, Homo sapiens
tgaaatgtttgggtccagaagt

SEQ ID NO: 9075333 - DNA, 22 bp, Homo sapiens
tgaaatggattgaagtggctta

SEQ ID NO: 9075334 - DNA, 19 bp, Homo sapiens
tgaaatggcagttgctaaa

SEQ ID NO: 9075335 - DNA, 22 bp, Homo sapiens
tgaaatggcaaggcagagcttt

SEQ ID NO: 9075336 - DNA, 22 bp, Homo sapiens
tgaaatgaaacagaacatatca

SEQ ID NO: 9075337 - DNA, 22 bp, Homo sapiens
tgaaatgcctatgaagtcagga

SEQ ID NO: 9075338 - DNA, 22 bp, Homo sapiens
tgaaatcatctgccaataagtt

SEQ ID NO: 9075339 - DNA, 22 bp, Homo sapiens
tgaaatcatgaacaaggtaggt

SEQ ID NO: 9075340 - DNA, 22 bp, Homo sapiens
tgaaatcatgagatagtgtcac

SEQ ID NO: 9075341 - DNA, 22 bp, Homo sapiens
tgaaatcattgccaagtattga

SEQ ID NO: 9075342 - DNA, 22 bp, Homo sapiens
tgaaatcattgccaagtattga

SEQ ID NO: 9075343 - DNA, 21 bp, Homo sapiens
tgaaatctgatgggacaaatg

SEQ ID NO: 9075344 - DNA, 22 bp, Homo sapiens
tgaaatctgcatgcaaagtcct

SEQ ID NO: 9075345 - DNA, 22 bp, Homo sapiens
tgaaatctgtcccactttagct

SEQ ID NO: 9075346 - DNA, 22 bp, Homo sapiens
tgaaatcattggggttgaataa

SEQ ID NO: 9075347 - DNA, 22 bp, Homo sapiens
tgaaatacacaaatttagtaag

SEQ ID NO: 9075348 - DNA, 22 bp, Homo sapiens
tgaaatacacaaatttagtaag

SEQ ID NO: 9075349 - DNA, 22 bp, Homo sapiens
tgaaatactgagtgaaagaatt

SEQ ID NO: 9075350 - DNA, 22 bp, Homo sapiens
tgaaataggaaacagatgtttc

SEQ ID NO: 9075351 - DNA, 22 bp, Homo sapiens
tgaaatagtctaaaaaaccaga

SEQ ID NO: 9075352 - DNA, 22 bp, Homo sapiens
tgaaatatccagcccagcagga

SEQ ID NO: 9075353 - DNA, 22 bp, Homo sapiens
tgaaatatccagcccagcagga

SEQ ID NO: 9075354 - DNA, 22 bp, Homo sapiens
tgaaatcaataattggtgattg

SEQ ID NO: 9075355 - DNA, 22 bp, Homo sapiens
tgaaatatttagagagtaagtt

SEQ ID NO: 9075356 - DNA, 22 bp, Homo sapiens
tgaaatatttagagagtaagtt

SEQ ID NO: 9075357 - DNA, 23 bp, Homo sapiens
tgaaatattcttttgcatgagct

SEQ ID NO: 9075358 - DNA, 17 bp, Homo sapiens
tgaaatcagcacccagg

SEQ ID NO: 9075359 - DNA, 22 bp, Homo sapiens
tgaaatcaattgcaatgtttat

SEQ ID NO: 9075360 - DNA, 17 bp, Homo sapiens
tgaaatcagcacccagg

SEQ ID NO: 9075361 - DNA, 23 bp, Homo sapiens
tgaaagcaatgggtctatagtat

SEQ ID NO: 9075362 - DNA, 23 bp, Homo sapiens
tgaaagcaatgggtctatagtat

SEQ ID NO: 9075363 - DNA, 23 bp, Homo sapiens
tgaaagcaatgggtctatagtat

SEQ ID NO: 9075364 - DNA, 22 bp, Homo sapiens
tgaaagcactcacttctgctct

SEQ ID NO: 9075365 - DNA, 22 bp, Homo sapiens
tgaaagcactcacttctgctct

SEQ ID NO: 9075366 - DNA, 22 bp, Homo sapiens
tgaaagcactcacttctgctct

SEQ ID NO: 9075367 - DNA, 22 bp, Homo sapiens
tgaaagcacaagttctaacagg

SEQ ID NO: 9075368 - DNA, 21 bp, Homo sapiens
tgaaagaggatgtggtcattc

SEQ ID NO: 9075369 - DNA, 22 bp, Homo sapiens
tgaaagatgctcaatgaatggt

SEQ ID NO: 9075370 - DNA, 22 bp, Homo sapiens
tgaaagatgctcaatgaatggt

SEQ ID NO: 9075371 - DNA, 22 bp, Homo sapiens
tgaaagatgctcaatgaatggt

SEQ ID NO: 9075372 - DNA, 22 bp, Homo sapiens
tgaaagcaacctgtaacagtga

SEQ ID NO: 9075373 - DNA, 22 bp, Homo sapiens
tgaaagtctctgttatagagaa

SEQ ID NO: 9075374 - DNA, 22 bp, Homo sapiens
tgaaaggtgtccaatatttctc

SEQ ID NO: 9075375 - DNA, 22 bp, Homo sapiens
tgaaagttattactgatgatgt

SEQ ID NO: 9075376 - DNA, 22 bp, Homo sapiens
tgaaagttcaataccaatttgg

SEQ ID NO: 9075377 - DNA, 21 bp, Homo sapiens
tgaggcctgccagtctcagaa

SEQ ID NO: 9075378 - DNA, 22 bp, Homo sapiens
tgaggcctgccctggggaagtt

SEQ ID NO: 9075379 - DNA, 22 bp, Homo sapiens
tgaggcctggactctgcatgga

SEQ ID NO: 9075380 - DNA, 22 bp, Homo sapiens
tgaggcctggagggaggagttt

SEQ ID NO: 9075381 - DNA, 22 bp, Homo sapiens
tgaggccttttctgtctggcta

SEQ ID NO: 9075382 - DNA, 19 bp, Homo sapiens
tgaggccttggatgaaagg

SEQ ID NO: 9075383 - DNA, 22 bp, Homo sapiens
tgaggccttagtaaccctgcac

SEQ ID NO: 9075384 - DNA, 22 bp, Homo sapiens
tgaggccttagtaaccctgcac

SEQ ID NO: 9075385 - DNA, 22 bp, Homo sapiens
tgaggctggcaaggctggtatt

SEQ ID NO: 9075386 - DNA, 22 bp, Homo sapiens
tgaggctggatgggatgcctcc

SEQ ID NO: 9075387 - DNA, 22 bp, Homo sapiens
tgaggctgttctaccagggcca

SEQ ID NO: 9075388 - DNA, 22 bp, Homo sapiens
tgaggctgttctaccagggcca

SEQ ID NO: 9075389 - DNA, 21 bp, Homo sapiens
tgaggctgttgtaccagggag

SEQ ID NO: 9075390 - DNA, 21 bp, Homo sapiens
tgaggctgttgtaccagggag

SEQ ID NO: 9075391 - DNA, 22 bp, Homo sapiens
tgagggagcacacactgaagtg

SEQ ID NO: 9075392 - DNA, 22 bp, Homo sapiens
tgagggagctgacctttctgtg

SEQ ID NO: 9075393 - DNA, 22 bp, Homo sapiens
tgagggaggccctttgagcaga

SEQ ID NO: 9075394 - DNA, 22 bp, Homo sapiens
tgagggaggccctttgagcaga

SEQ ID NO: 9075395 - DNA, 20 bp, Homo sapiens
tgagggagtattgatttccc

SEQ ID NO: 9075396 - DNA, 22 bp, Homo sapiens
tgagggagtcatgattaaggaa

SEQ ID NO: 9075397 - DNA, 20 bp, Homo sapiens
tgagggagtattgatttccc

SEQ ID NO: 9075398 - DNA, 22 bp, Homo sapiens
tgagggaggcctccatctgcca

SEQ ID NO: 9075399 - DNA, 22 bp, Homo sapiens
tgagggaggcctccatctgcca

SEQ ID NO: 9075400 - DNA, 22 bp, Homo sapiens
tgagggagagggcgaaaatgaa

SEQ ID NO: 9075401 - DNA, 22 bp, Homo sapiens
tgagggacttgctagttctctg

SEQ ID NO: 9075402 - DNA, 22 bp, Homo sapiens
tgagggagcacacactgaagtg

SEQ ID NO: 9075403 - DNA, 22 bp, Homo sapiens
tgagggagtgtggatacagtag

SEQ ID NO: 9075404 - DNA, 22 bp, Homo sapiens
tgagggagttgggtgtatagga

SEQ ID NO: 9075405 - DNA, 22 bp, Homo sapiens
tgagggagtcatgattaaggaa

SEQ ID NO: 9075406 - DNA, 22 bp, Homo sapiens
tgagggagtgtggatacagtag

SEQ ID NO: 9075407 - DNA, 22 bp, Homo sapiens
tgaggtggctagggaggcactc

SEQ ID NO: 9075408 - DNA, 22 bp, Homo sapiens
tgaggtggctagggaggcactc

SEQ ID NO: 9075409 - DNA, 22 bp, Homo sapiens
tgaggtgggtgtcaggtcagag

SEQ ID NO: 9075410 - DNA, 22 bp, Homo sapiens
tgaggtgggtgtcaggtcagag

SEQ ID NO: 9075411 - DNA, 22 bp, Homo sapiens
tgaggtggttactgtggtgctc

SEQ ID NO: 9075412 - DNA, 22 bp, Homo sapiens
tgaggttatttattatgcatga

SEQ ID NO: 9075413 - DNA, 22 bp, Homo sapiens
tgaggtgtgtccccagggaggt

SEQ ID NO: 9075414 - DNA, 22 bp, Homo sapiens
tgagtctgggcatgttcacttt

SEQ ID NO: 9075415 - DNA, 22 bp, Homo sapiens
tgagtctgtatgtccagattta

SEQ ID NO: 9075416 - DNA, 22 bp, Homo sapiens
tgagtatcaattacatagttgt

SEQ ID NO: 9075417 - DNA, 22 bp, Homo sapiens
tgagtaaaaattctacatttcc

SEQ ID NO: 9075418 - DNA, 22 bp, Homo sapiens
tgaggttcagttcttggccaca

SEQ ID NO: 9075419 - DNA, 22 bp, Homo sapiens
tgagtaaaagtgaatcttatgt

SEQ ID NO: 9075420 - DNA, 22 bp, Homo sapiens
tgaggtaggagggtgatcagca

SEQ ID NO: 9075421 - DNA, 22 bp, Homo sapiens
tgaggtctgtcctgtctttgga

SEQ ID NO: 9075422 - DNA, 22 bp, Homo sapiens
tgaggtagaaaaagcttgtagt

SEQ ID NO: 9075423 - DNA, 22 bp, Homo sapiens
tgaggtagaagcctgggttgag

SEQ ID NO: 9075424 - DNA, 22 bp, Homo sapiens
tgaggtagagattgtgactgta

SEQ ID NO: 9075425 - DNA, 22 bp, Homo sapiens
tgaggtagctgctatttgtagt

SEQ ID NO: 9075426 - DNA, 22 bp, Homo sapiens
tgaggtaggaatttgtattggg

SEQ ID NO: 9075427 - DNA, 22 bp, Homo sapiens
tgagggtgggccctgggcatct

SEQ ID NO: 9075428 - DNA, 22 bp, Homo sapiens
tgagggtggccttgtgtggact

SEQ ID NO: 9075429 - DNA, 22 bp, Homo sapiens
tgaggggcggcctgcagaggcc

SEQ ID NO: 9075430 - DNA, 22 bp, Homo sapiens
tgaggggcagagaggtgtccag

SEQ ID NO: 9075431 - DNA, 22 bp, Homo sapiens
tgaggggcgctggcaggttcct

SEQ ID NO: 9075432 - DNA, 22 bp, Homo sapiens
tgaggggttaccttggagttga

SEQ ID NO: 9075433 - DNA, 22 bp, Homo sapiens
tgagggtggcacaggcacaaag

SEQ ID NO: 9075434 - DNA, 22 bp, Homo sapiens
tgagggtgcatttagcatgtag

SEQ ID NO: 9075435 - DNA, 19 bp, Homo sapiens
tgagggtgagctttggaga

SEQ ID NO: 9075436 - DNA, 22 bp, Homo sapiens
tgagggtctggaatctgggctt

SEQ ID NO: 9075437 - DNA, 22 bp, Homo sapiens
tgagggtctggaatctgggctt

SEQ ID NO: 9075438 - DNA, 22 bp, Homo sapiens
tgaggcctcataatgagatttc

SEQ ID NO: 9075439 - DNA, 22 bp, Homo sapiens
tgaggcctcatttagggagagg

SEQ ID NO: 9075440 - DNA, 22 bp, Homo sapiens
tgaggccctagggcatgggaga

SEQ ID NO: 9075441 - DNA, 22 bp, Homo sapiens
tgaggcctacccccctgtgttt

SEQ ID NO: 9075442 - DNA, 22 bp, Homo sapiens
tgaggccaggatcccaggctct

SEQ ID NO: 9075443 - DNA, 22 bp, Homo sapiens
tgaggccaggatcccaggctct

SEQ ID NO: 9075444 - DNA, 22 bp, Homo sapiens
tgaggcccgggtggaggaatgc

SEQ ID NO: 9075445 - DNA, 18 bp, Homo sapiens
tgaggcccgcagaggtgg

SEQ ID NO: 9075446 - DNA, 17 bp, Homo sapiens
tgaggcctgcatcagtg

SEQ ID NO: 9075447 - DNA, 22 bp, Homo sapiens
tgaggcctgcattgaactagaa

SEQ ID NO: 9075448 - DNA, 21 bp, Homo sapiens
tgaggcctgccagtctcagaa

SEQ ID NO: 9075449 - DNA, 17 bp, Homo sapiens
tgaggcctgcatcagtg

SEQ ID NO: 9075450 - DNA, 17 bp, Homo sapiens
tgaggcctgcatcagtg

SEQ ID NO: 9075451 - DNA, 22 bp, Homo sapiens
tgaggcctgacagaccaagcct

SEQ ID NO: 9075452 - DNA, 22 bp, Homo sapiens
tgaggcctgaagcctggagcct

SEQ ID NO: 9075453 - DNA, 22 bp, Homo sapiens
tgaggcctctgaggcctaggct

SEQ ID NO: 9075454 - DNA, 22 bp, Homo sapiens
tgaggcctctgtgccatccagg

SEQ ID NO: 9075455 - DNA, 22 bp, Homo sapiens
tgaggccacaggaaagggcccg

SEQ ID NO: 9075456 - DNA, 22 bp, Homo sapiens
tgaggccacttccccacagccc

SEQ ID NO: 9075457 - DNA, 22 bp, Homo sapiens
tgaggccacttccccacagccc

SEQ ID NO: 9075458 - DNA, 22 bp, Homo sapiens
tgaggccaatgaccctgggcag

SEQ ID NO: 9075459 - DNA, 22 bp, Homo sapiens
tgaggccaatgaccctgggcag

SEQ ID NO: 9075460 - DNA, 22 bp, Homo sapiens
tgaggccacaggaaagggcccg

SEQ ID NO: 9075461 - DNA, 19 bp, Homo sapiens
tgaggccaaggtcacagat

SEQ ID NO: 9075462 - DNA, 19 bp, Homo sapiens
tgaggccagctggcatttt

SEQ ID NO: 9075463 - DNA, 19 bp, Homo sapiens
tgaggccagctggcatttt

SEQ ID NO: 9075464 - DNA, 22 bp, Homo sapiens
tgaggccaggacccccagcagg

SEQ ID NO: 9075465 - DNA, 22 bp, Homo sapiens
tgaggccagcttcagcagtgga

SEQ ID NO: 9075466 - DNA, 22 bp, Homo sapiens
tgaggccagcttcagcagtgga

SEQ ID NO: 9075467 - DNA, 18 bp, Homo sapiens
tgaggccagagtgggcat

SEQ ID NO: 9075468 - DNA, 22 bp, Homo sapiens
tgaggccagccacagccaccct

SEQ ID NO: 9075469 - DNA, 18 bp, Homo sapiens
tgaggccagagtgggcat

SEQ ID NO: 9075470 - DNA, 22 bp, Homo sapiens
tgaggcaggaggttgagaactg

SEQ ID NO: 9075471 - DNA, 22 bp, Homo sapiens
tgaggcaggagttaatgtgctc

SEQ ID NO: 9075472 - DNA, 22 bp, Homo sapiens
tgaggcaggagttaatgtgctc

SEQ ID NO: 9075473 - DNA, 22 bp, Homo sapiens
tgaggcaggaggattgcaggat

SEQ ID NO: 9075474 - DNA, 22 bp, Homo sapiens
tgaggcaggagaatggcgggaa

SEQ ID NO: 9075475 - DNA, 20 bp, Homo sapiens
tgaggcaggagaatggcatg

SEQ ID NO: 9075476 - DNA, 20 bp, Homo sapiens
tgaggcaggagaatggcatg

SEQ ID NO: 9075477 - DNA, 20 bp, Homo sapiens
tgaggcaggagaatggcatg

SEQ ID NO: 9075478 - DNA, 20 bp, Homo sapiens
tgaggcaggagaatggcatg

SEQ ID NO: 9075479 - DNA, 22 bp, Homo sapiens
tgaggcaggagttcaggctgcg

SEQ ID NO: 9075480 - DNA, 22 bp, Homo sapiens
tgaggcaggatgcttgcacagg

SEQ ID NO: 9075481 - DNA, 22 bp, Homo sapiens
tgaggcaggatgcttgcacagg

SEQ ID NO: 9075482 - DNA, 22 bp, Homo sapiens
tgaggcaggagttcaggctgcg

SEQ ID NO: 9075483 - DNA, 22 bp, Homo sapiens
tgaggcaggagttaatgtgctc

SEQ ID NO: 9075484 - DNA, 22 bp, Homo sapiens
tgaggcaggagttaatgtgctc

SEQ ID NO: 9075485 - DNA, 22 bp, Homo sapiens
tgaggcaggagttaatgtgctc

SEQ ID NO: 9075486 - DNA, 22 bp, Homo sapiens
tgaggcagttcttacttgtatt

SEQ ID NO: 9075487 - DNA, 22 bp, Homo sapiens
tgaggcagtgtgagataataaa

SEQ ID NO: 9075488 - DNA, 22 bp, Homo sapiens
tgaggcagggagagtggatatg

SEQ ID NO: 9075489 - DNA, 22 bp, Homo sapiens
tgaggcagggagagtggatatg

SEQ ID NO: 9075490 - DNA, 23 bp, Homo sapiens
tgaggcaggcggatcacgaggtc

SEQ ID NO: 9075491 - DNA, 23 bp, Homo sapiens
tgaggcaggcggatcacgaggtc

SEQ ID NO: 9075492 - DNA, 22 bp, Homo sapiens
tgaggcagttgagcttcctgag

SEQ ID NO: 9075493 - DNA, 22 bp, Homo sapiens
tgaggcagttgagcttcctgag

SEQ ID NO: 9075494 - DNA, 19 bp, Homo sapiens
tgaggccaaggtcacagat

SEQ ID NO: 9075495 - DNA, 19 bp, Homo sapiens
tgaggccaaggtcacagat

SEQ ID NO: 9075496 - DNA, 22 bp, Homo sapiens
tgaggccaagcctcctctgcca

SEQ ID NO: 9075497 - DNA, 22 bp, Homo sapiens
tgaggccaactagggagatgga

SEQ ID NO: 9075498 - DNA, 22 bp, Homo sapiens
tgaggccaagaaaagctgggtg

SEQ ID NO: 9075499 - DNA, 22 bp, Homo sapiens
tgaggcaggactgagcgggatg

SEQ ID NO: 9075500 - DNA, 22 bp, Homo sapiens
tgaggcaggactgagcgggatg

SEQ ID NO: 9075501 - DNA, 22 bp, Homo sapiens
tgaggcaggactgagcgggatg

SEQ ID NO: 9075502 - DNA, 22 bp, Homo sapiens
tgaggcaggacatggacaactg

SEQ ID NO: 9075503 - DNA, 22 bp, Homo sapiens
tgaggcaggactgagcgggatg

SEQ ID NO: 9075504 - DNA, 22 bp, Homo sapiens
tgaggcaggacttgcataaagt

SEQ ID NO: 9075505 - DNA, 22 bp, Homo sapiens
tgaggcaggagaatcacatgaa

SEQ ID NO: 9075506 - DNA, 22 bp, Homo sapiens
tgaggcaggacttgcataaagt

SEQ ID NO: 9075507 - DNA, 22 bp, Homo sapiens
tgaggcaggagaatcacatgaa

SEQ ID NO: 9075508 - DNA, 22 bp, Homo sapiens
tgaggcaggagaatcacatgaa

SEQ ID NO: 9075509 - DNA, 22 bp, Homo sapiens
tgaggcaggagaatcaccggaa

SEQ ID NO: 9075510 - DNA, 20 bp, Homo sapiens
tgaggcaggagaatggcatg

SEQ ID NO: 9075511 - DNA, 20 bp, Homo sapiens
tgaggcaggagaatggcatg

SEQ ID NO: 9075512 - DNA, 22 bp, Homo sapiens
tgaggcagctttttctgtgtgt

SEQ ID NO: 9075513 - DNA, 22 bp, Homo sapiens
tgaggcagctttttctgtgtgt

SEQ ID NO: 9075514 - DNA, 22 bp, Homo sapiens
tgaggcactgggagagcacact

SEQ ID NO: 9075515 - DNA, 22 bp, Homo sapiens
tgaggcagaaaatagcagttca

SEQ ID NO: 9075516 - DNA, 22 bp, Homo sapiens
tgaggcagcctgcattaaagag

SEQ ID NO: 9075517 - DNA, 22 bp, Homo sapiens
tgaggcagctttttctgtgtgt

SEQ ID NO: 9075518 - DNA, 22 bp, Homo sapiens
tgaggcagcctgcattaaagag

SEQ ID NO: 9075519 - DNA, 22 bp, Homo sapiens
tgaggcaggacatggacaactg

SEQ ID NO: 9075520 - DNA, 22 bp, Homo sapiens
tgaggcaggaatggggaaaagt

SEQ ID NO: 9075521 - DNA, 21 bp, Homo sapiens
tgaggatgtgcagcagcagga

SEQ ID NO: 9075522 - DNA, 21 bp, Homo sapiens
tgaggatgtgcagcagcagga

SEQ ID NO: 9075523 - DNA, 22 bp, Homo sapiens
tgaggatggttaaagaacattg

SEQ ID NO: 9075524 - DNA, 22 bp, Homo sapiens
tgaggatggttaaagaacattg

SEQ ID NO: 9075525 - DNA, 22 bp, Homo sapiens
tgaggattaaatgagctaataa

SEQ ID NO: 9075526 - DNA, 22 bp, Homo sapiens
tgaggatttaatgggactcatt

SEQ ID NO: 9075527 - DNA, 22 bp, Homo sapiens
tgaggcaacagaaagggccaat

SEQ ID NO: 9075528 - DNA, 22 bp, Homo sapiens
tgaggcaaagacaaagcagcat

SEQ ID NO: 9075529 - DNA, 22 bp, Homo sapiens
tgaggcaaagacaaagcagcat

SEQ ID NO: 9075530 - DNA, 22 bp, Homo sapiens
tgaggcaaagttcaagctgaaa

SEQ ID NO: 9075531 - DNA, 22 bp, Homo sapiens
tgaggcaaaagttatgtggtag

SEQ ID NO: 9075532 - DNA, 22 bp, Homo sapiens
tgaggcacatccaggccagctc

SEQ ID NO: 9075533 - DNA, 19 bp, Homo sapiens
tgaggcacatgataagaac

SEQ ID NO: 9075534 - DNA, 22 bp, Homo sapiens
tgaggcacatccaggccagctc

SEQ ID NO: 9075535 - DNA, 22 bp, Homo sapiens
tgaggatggggagatggtgtct

SEQ ID NO: 9075536 - DNA, 22 bp, Homo sapiens
tgaggatggggagatggtgtct

SEQ ID NO: 9075537 - DNA, 22 bp, Homo sapiens
tgaggatggggagatggtgtct

SEQ ID NO: 9075538 - DNA, 22 bp, Homo sapiens
tgaggatggtcccgaggacact

SEQ ID NO: 9075539 - DNA, 22 bp, Homo sapiens
tgaggatggtcccgaggacact

SEQ ID NO: 9075540 - DNA, 22 bp, Homo sapiens
tgaggagcttctggaaagtgca

SEQ ID NO: 9075541 - DNA, 22 bp, Homo sapiens
tgaggagcgggcagggatgcag

SEQ ID NO: 9075542 - DNA, 23 bp, Homo sapiens
tgaggagcatagctgactgacag

SEQ ID NO: 9075543 - DNA, 19 bp, Homo sapiens
tgaggagcagctggttgat

SEQ ID NO: 9075544 - DNA, 22 bp, Homo sapiens
tgaggagcagggtggcttactc

SEQ ID NO: 9075545 - DNA, 22 bp, Homo sapiens
tgaggaggcccaggttggggct

SEQ ID NO: 9075546 - DNA, 22 bp, Homo sapiens
tgaggaagtggttgtatggttt

SEQ ID NO: 9075547 - DNA, 22 bp, Homo sapiens
tgaggaagtggttgtatggttt

SEQ ID NO: 9075548 - DNA, 22 bp, Homo sapiens
tgaggaagttgatctcatcagt

SEQ ID NO: 9075549 - DNA, 22 bp, Homo sapiens
tgaggagaaatgctcagagcca

SEQ ID NO: 9075550 - DNA, 22 bp, Homo sapiens
tgaggaagggtgtgacggcacc

SEQ ID NO: 9075551 - DNA, 22 bp, Homo sapiens
tgaggaagggtgtgacggcacc

SEQ ID NO: 9075552 - DNA, 18 bp, Homo sapiens
tgaggaaggggaagtatt

SEQ ID NO: 9075553 - DNA, 22 bp, Homo sapiens
tgaggaagggcacacggaccct

SEQ ID NO: 9075554 - DNA, 22 bp, Homo sapiens
tgaggaaagaaaggcatgcatg

SEQ ID NO: 9075555 - DNA, 22 bp, Homo sapiens
tgaggaaggaattgaggtttta

SEQ ID NO: 9075556 - DNA, 22 bp, Homo sapiens
tgaggaaggaattgaggtttta

SEQ ID NO: 9075557 - DNA, 22 bp, Homo sapiens
tgaggaagcaaaggcttgtgtg

SEQ ID NO: 9075558 - DNA, 22 bp, Homo sapiens
tgaggaagcaaaggcttgtgtg

SEQ ID NO: 9075559 - DNA, 22 bp, Homo sapiens
tgagctacacactaggcatggg

SEQ ID NO: 9075560 - DNA, 22 bp, Homo sapiens
tgagccttccttgtcatatcat

SEQ ID NO: 9075561 - DNA, 22 bp, Homo sapiens
tgagccttcctcagaagctcct

SEQ ID NO: 9075562 - DNA, 22 bp, Homo sapiens
tgagcctgtggggtgacaacca

SEQ ID NO: 9075563 - DNA, 22 bp, Homo sapiens
tgagcctgtggggtgacaacca

SEQ ID NO: 9075564 - DNA, 22 bp, Homo sapiens
tgagcctgggtggtcgaggctg

SEQ ID NO: 9075565 - DNA, 22 bp, Homo sapiens
tgagcctggggcctgggcagcg

SEQ ID NO: 9075566 - DNA, 22 bp, Homo sapiens
tgagcctgggagatggaggctg

SEQ ID NO: 9075567 - DNA, 22 bp, Homo sapiens
tgagcctgggagatggaggctg

SEQ ID NO: 9075568 - DNA, 22 bp, Homo sapiens
tgagcctgcaataagcacagcc

SEQ ID NO: 9075569 - DNA, 22 bp, Homo sapiens
tgagcctgcaataagcacagcc

SEQ ID NO: 9075570 - DNA, 22 bp, Homo sapiens
tgagcctgagttcaaggctgca

SEQ ID NO: 9075571 - DNA, 22 bp, Homo sapiens
tgagcctgagttcaaggctgca

SEQ ID NO: 9075572 - DNA, 22 bp, Homo sapiens
tgagcctgcctgcaggtgtgct

SEQ ID NO: 9075573 - DNA, 22 bp, Homo sapiens
tgagcctggcggaagcagcgtg

SEQ ID NO: 9075574 - DNA, 22 bp, Homo sapiens
tgagcctggcggaagcagcgtg

SEQ ID NO: 9075575 - DNA, 22 bp, Homo sapiens
tgagcctggcctgcagagacca

SEQ ID NO: 9075576 - DNA, 22 bp, Homo sapiens
tgagcctggagtcgtggagggg

SEQ ID NO: 9075577 - DNA, 22 bp, Homo sapiens
tgagcctgctgtcgctggaccc

SEQ ID NO: 9075578 - DNA, 22 bp, Homo sapiens
tgagcctgctgtcgctggaccc

SEQ ID NO: 9075579 - DNA, 21 bp, Homo sapiens
tgagcccttgcctcagagccc

SEQ ID NO: 9075580 - DNA, 21 bp, Homo sapiens
tgagcccttgcctcagagccc

SEQ ID NO: 9075581 - DNA, 22 bp, Homo sapiens
tgagcccttgacatcgcccact

SEQ ID NO: 9075582 - DNA, 22 bp, Homo sapiens
tgagccgtggtctctgagggtg

SEQ ID NO: 9075583 - DNA, 22 bp, Homo sapiens
tgagccgtggtctctgagggtg

SEQ ID NO: 9075584 - DNA, 22 bp, Homo sapiens
tgagccctcggctggggcagag

SEQ ID NO: 9075585 - DNA, 22 bp, Homo sapiens
tgagccctaagggtcaagcagg

SEQ ID NO: 9075586 - DNA, 22 bp, Homo sapiens
tgagccccggagtttcaggctg

SEQ ID NO: 9075587 - DNA, 22 bp, Homo sapiens
tgagcccatgtagcacttccat

SEQ ID NO: 9075588 - DNA, 22 bp, Homo sapiens
tgagccccaggaaattgaggag

SEQ ID NO: 9075589 - DNA, 22 bp, Homo sapiens
tgagccccggagtttcaggctg

SEQ ID NO: 9075590 - DNA, 22 bp, Homo sapiens
tgagccaggtctcactcacctt

SEQ ID NO: 9075591 - DNA, 20 bp, Homo sapiens
tgagccagtcaagctacatt

SEQ ID NO: 9075592 - DNA, 22 bp, Homo sapiens
tgagccaggttaagacaggagc

SEQ ID NO: 9075593 - DNA, 22 bp, Homo sapiens
tgagcccagtctgtctgacatg

SEQ ID NO: 9075594 - DNA, 22 bp, Homo sapiens
tgagccagtctgtctgggtgaa

SEQ ID NO: 9075595 - DNA, 22 bp, Homo sapiens
tgagccagtctctcagaaccct

SEQ ID NO: 9075596 - DNA, 22 bp, Homo sapiens
tgagccagtctctcagaaccct

SEQ ID NO: 9075597 - DNA, 22 bp, Homo sapiens
tgaggaaacttacaaggcagaa

SEQ ID NO: 9075598 - DNA, 22 bp, Homo sapiens
tgagcttcctccctgcatccat

SEQ ID NO: 9075599 - DNA, 22 bp, Homo sapiens
tgagcttcctccctgcatccat

SEQ ID NO: 9075600 - DNA, 22 bp, Homo sapiens
tgagcttctttatttggccaga

SEQ ID NO: 9075601 - DNA, 22 bp, Homo sapiens
tgagcttccctcctgcactaca

SEQ ID NO: 9075602 - DNA, 22 bp, Homo sapiens
tgagcttgctacatagatcaga

SEQ ID NO: 9075603 - DNA, 22 bp, Homo sapiens
tgagctgtgtcctgggggcagt

SEQ ID NO: 9075604 - DNA, 22 bp, Homo sapiens
tgagctgtgtgacattgagcca

SEQ ID NO: 9075605 - DNA, 22 bp, Homo sapiens
tgagcttcaaagttggatctga

SEQ ID NO: 9075606 - DNA, 17 bp, Homo sapiens
tgagcttcaatcaggtg

SEQ ID NO: 9075607 - DNA, 17 bp, Homo sapiens
tgagcttcaatcaggtg

SEQ ID NO: 9075608 - DNA, 20 bp, Homo sapiens
tgagcttcagatatcgtgca

SEQ ID NO: 9075609 - DNA, 22 bp, Homo sapiens
tgagcttcaaagttggatctga

SEQ ID NO: 9075610 - DNA, 22 bp, Homo sapiens
tgagcttcaaaatatgtgaatc

SEQ ID NO: 9075611 - DNA, 22 bp, Homo sapiens
tgagctgtggtggggtagagga

SEQ ID NO: 9075612 - DNA, 22 bp, Homo sapiens
tgagctgtgattaactctgaga

SEQ ID NO: 9075613 - DNA, 22 bp, Homo sapiens
tgagctgtgagggtacagatat

SEQ ID NO: 9075614 - DNA, 22 bp, Homo sapiens
tgagctgtctgaatggtgagga

SEQ ID NO: 9075615 - DNA, 22 bp, Homo sapiens
tgagctgtagcagatgctgttg

SEQ ID NO: 9075616 - DNA, 22 bp, Homo sapiens
tgagctgtcaaggtacagtgaa

SEQ ID NO: 9075617 - DNA, 22 bp, Homo sapiens
tgagctgtagcagatgctgttg

SEQ ID NO: 9075618 - DNA, 22 bp, Homo sapiens
tgagctgtagcagatgctgttg

SEQ ID NO: 9075619 - DNA, 22 bp, Homo sapiens
tgagctgagaacacttgggcta

SEQ ID NO: 9075620 - DNA, 22 bp, Homo sapiens
tgagctgagtggcaggtctcag

SEQ ID NO: 9075621 - DNA, 22 bp, Homo sapiens
tgagctctcagggacagactat

SEQ ID NO: 9075622 - DNA, 22 bp, Homo sapiens
tgagctccggcatatggaatta

SEQ ID NO: 9075623 - DNA, 22 bp, Homo sapiens
tgagctgagtttaaaagctgct

SEQ ID NO: 9075624 - DNA, 22 bp, Homo sapiens
tgagctgcagtgagctgagatg

SEQ ID NO: 9075625 - DNA, 22 bp, Homo sapiens
tgagctggaggacaggagggta

SEQ ID NO: 9075626 - DNA, 22 bp, Homo sapiens
tgagctggagtcgtgagcaaag

SEQ ID NO: 9075627 - DNA, 22 bp, Homo sapiens
tgagctggaggacaggagggta

SEQ ID NO: 9075628 - DNA, 22 bp, Homo sapiens
tgagctggaggacaggagggta

SEQ ID NO: 9075629 - DNA, 22 bp, Homo sapiens
tgagctggagtctgtggctcct

SEQ ID NO: 9075630 - DNA, 22 bp, Homo sapiens
tgagctggatccaactccgttt

SEQ ID NO: 9075631 - DNA, 22 bp, Homo sapiens
tgagctggtcactccttctgaa

SEQ ID NO: 9075632 - DNA, 22 bp, Homo sapiens
tgagctggtcactccttctgaa

SEQ ID NO: 9075633 - DNA, 22 bp, Homo sapiens
tgagctggtcttgagtgtagct

SEQ ID NO: 9075634 - DNA, 22 bp, Homo sapiens
tgagctggttcttgaggcatga

SEQ ID NO: 9075635 - DNA, 22 bp, Homo sapiens
tgagctgtaaggctgtcactga

SEQ ID NO: 9075636 - DNA, 22 bp, Homo sapiens
tgagctggttcttgaggcatga

SEQ ID NO: 9075637 - DNA, 22 bp, Homo sapiens
tgagctggttcttgaggcatga

SEQ ID NO: 9075638 - DNA, 22 bp, Homo sapiens
tgagcattggatcaaatgactt

SEQ ID NO: 9075639 - DNA, 22 bp, Homo sapiens
tgagccaaggcctcaagaattt

SEQ ID NO: 9075640 - DNA, 22 bp, Homo sapiens
tgagccacagtgagagctcctg

SEQ ID NO: 9075641 - DNA, 22 bp, Homo sapiens
tgagccagataagggctcacgc

SEQ ID NO: 9075642 - DNA, 22 bp, Homo sapiens
tgagccagagtggagtgtgcct

SEQ ID NO: 9075643 - DNA, 22 bp, Homo sapiens
tgagccagagtggagtgtgcct

SEQ ID NO: 9075644 - DNA, 22 bp, Homo sapiens
tgagccagaggaggctgtgtgg

SEQ ID NO: 9075645 - DNA, 22 bp, Homo sapiens
tgagccagagaggttgaggcta

SEQ ID NO: 9075646 - DNA, 22 bp, Homo sapiens
tgagcagtggcaccaggtcacc

SEQ ID NO: 9075647 - DNA, 22 bp, Homo sapiens
tgagcatagtgatttttctaga

SEQ ID NO: 9075648 - DNA, 22 bp, Homo sapiens
tgagcagggactttggagtctg

SEQ ID NO: 9075649 - DNA, 22 bp, Homo sapiens
tgagccagccttgcagctgtgc

SEQ ID NO: 9075650 - DNA, 22 bp, Homo sapiens
tgagccagcctcagaagtcacg

SEQ ID NO: 9075651 - DNA, 22 bp, Homo sapiens
tgagccagcctcagaagtcacg

SEQ ID NO: 9075652 - DNA, 22 bp, Homo sapiens
tgagccagcaggcctccagtgg

SEQ ID NO: 9075653 - DNA, 22 bp, Homo sapiens
tgagccaggcactgctcctgga

SEQ ID NO: 9075654 - DNA, 22 bp, Homo sapiens
tgagccaggctcaagtgatcct

SEQ ID NO: 9075655 - DNA, 22 bp, Homo sapiens
tgagccaggcccagtggggtca

SEQ ID NO: 9075656 - DNA, 19 bp, Homo sapiens
tgagccagggaggccatgc

SEQ ID NO: 9075657 - DNA, 21 bp, Homo sapiens
tgagccaggctgacggctgtg

SEQ ID NO: 9075658 - DNA, 21 bp, Homo sapiens
tgagccaggctgacggctgtg

SEQ ID NO: 9075659 - DNA, 22 bp, Homo sapiens
tgagcagagttgtttctcctga

SEQ ID NO: 9075660 - DNA, 22 bp, Homo sapiens
tgagcagatggaggcttctgca

SEQ ID NO: 9075661 - DNA, 22 bp, Homo sapiens
tgagcagaggagtgacgtaggt

SEQ ID NO: 9075662 - DNA, 22 bp, Homo sapiens
tgagcagagcaataggactctc

SEQ ID NO: 9075663 - DNA, 20 bp, Homo sapiens
tgagcaccaagaatcaagaa

SEQ ID NO: 9075664 - DNA, 22 bp, Homo sapiens
tgagcacatttcacatgacagg

SEQ ID NO: 9075665 - DNA, 22 bp, Homo sapiens
tgagcacagctttcactagaaa

SEQ ID NO: 9075666 - DNA, 22 bp, Homo sapiens
tgagcaattaacagagtctaaa

SEQ ID NO: 9075667 - DNA, 22 bp, Homo sapiens
tgagcaatatgtgaattttctt

SEQ ID NO: 9075668 - DNA, 22 bp, Homo sapiens
tgagcaggcgcagcaggaggtc

SEQ ID NO: 9075669 - DNA, 22 bp, Homo sapiens
tgagcaggactcactgcagcct

SEQ ID NO: 9075670 - DNA, 22 bp, Homo sapiens
tgagcagcaactgtccatggca

SEQ ID NO: 9075671 - DNA, 22 bp, Homo sapiens
tgagcagcaggatcttctggta

SEQ ID NO: 9075672 - DNA, 22 bp, Homo sapiens
tgagcagcccttcctccggcca

SEQ ID NO: 9075673 - DNA, 22 bp, Homo sapiens
tgagatggaaggtgaggcagta

SEQ ID NO: 9075674 - DNA, 22 bp, Homo sapiens
tgagatggagtcttgctctgtt

SEQ ID NO: 9075675 - DNA, 22 bp, Homo sapiens
tgagatggagtctcactctgtt

SEQ ID NO: 9075676 - DNA, 22 bp, Homo sapiens
tgagatggagttctgctcttgt

SEQ ID NO: 9075677 - DNA, 22 bp, Homo sapiens
tgagatggagttctgctcttgt

SEQ ID NO: 9075678 - DNA, 22 bp, Homo sapiens
tgagatgaataactcctgctaa

SEQ ID NO: 9075679 - DNA, 22 bp, Homo sapiens
tgagatgaataactcctgctaa

SEQ ID NO: 9075680 - DNA, 22 bp, Homo sapiens
tgagatgatgggataagagggc

SEQ ID NO: 9075681 - DNA, 22 bp, Homo sapiens
tgagatgatgggataagagggc

SEQ ID NO: 9075682 - DNA, 22 bp, Homo sapiens
tgagatgagatttcactgtcct

SEQ ID NO: 9075683 - DNA, 22 bp, Homo sapiens
tgagatgaataactcctgctaa

SEQ ID NO: 9075684 - DNA, 22 bp, Homo sapiens
tgagatgcaggagatgggactg

SEQ ID NO: 9075685 - DNA, 22 bp, Homo sapiens
tgagatgcaggagatgggactg

SEQ ID NO: 9075686 - DNA, 22 bp, Homo sapiens
tgagatacagcttgtgacttgg

SEQ ID NO: 9075687 - DNA, 22 bp, Homo sapiens
tgagataattaaatcaaaacct

SEQ ID NO: 9075688 - DNA, 22 bp, Homo sapiens
tgagatactgaaaatagctaac

SEQ ID NO: 9075689 - DNA, 22 bp, Homo sapiens
tgagataatcatgtgatttcat

SEQ ID NO: 9075690 - DNA, 22 bp, Homo sapiens
tgagaggtcaaagggcatggag

SEQ ID NO: 9075691 - DNA, 22 bp, Homo sapiens
tgagataatacttcttagctgg

SEQ ID NO: 9075692 - DNA, 22 bp, Homo sapiens
tgagatagtatatggaaagagt

SEQ ID NO: 9075693 - DNA, 22 bp, Homo sapiens
tgagatgaaagcagaaagactt

SEQ ID NO: 9075694 - DNA, 22 bp, Homo sapiens
tgagatgtaaggtatgcttact

SEQ ID NO: 9075695 - DNA, 22 bp, Homo sapiens
tgagatggttgaccagagagca

SEQ ID NO: 9075696 - DNA, 22 bp, Homo sapiens
tgagatggttcacagagaaggc

SEQ ID NO: 9075697 - DNA, 22 bp, Homo sapiens
tgagatgggtgtccagggagga

SEQ ID NO: 9075698 - DNA, 22 bp, Homo sapiens
tgagatgggtgggtagccaagg

SEQ ID NO: 9075699 - DNA, 22 bp, Homo sapiens
tgagatggggagggctgcagaa

SEQ ID NO: 9075700 - DNA, 22 bp, Homo sapiens
tgagatggattgggttggttcc

SEQ ID NO: 9075701 - DNA, 22 bp, Homo sapiens
tgagatggagttttggggatat

SEQ ID NO: 9075702 - DNA, 22 bp, Homo sapiens
tgagatggcaacaccagctttg

SEQ ID NO: 9075703 - DNA, 22 bp, Homo sapiens
tgagatggggtcatgctttgtc

SEQ ID NO: 9075704 - DNA, 22 bp, Homo sapiens
tgagatggggagggctgcagaa

SEQ ID NO: 9075705 - DNA, 22 bp, Homo sapiens
tgagatgggtcatcaggtttgg

SEQ ID NO: 9075706 - DNA, 22 bp, Homo sapiens
tgagatgggtggggagctcagg

SEQ ID NO: 9075707 - DNA, 22 bp, Homo sapiens
tgagatgggtggggagctcagg

SEQ ID NO: 9075708 - DNA, 20 bp, Homo sapiens
tgagatttgtattataagtc

SEQ ID NO: 9075709 - DNA, 19 bp, Homo sapiens
tgagatttcttaggtgatt

SEQ ID NO: 9075710 - DNA, 22 bp, Homo sapiens
tgagattctgttcagaaaaatg

SEQ ID NO: 9075711 - DNA, 22 bp, Homo sapiens
tgagagcttgagtatcactggc

SEQ ID NO: 9075712 - DNA, 22 bp, Homo sapiens
tgagaggaacaggcagtaggtt

SEQ ID NO: 9075713 - DNA, 22 bp, Homo sapiens
tgagaggagtgattgtaaaatt

SEQ ID NO: 9075714 - DNA, 22 bp, Homo sapiens
tgagaggatattttgggaggat

SEQ ID NO: 9075715 - DNA, 22 bp, Homo sapiens
tgagagggcccagagcacacca

SEQ ID NO: 9075716 - DNA, 22 bp, Homo sapiens
tgagaggtaggaaatgaacaag

SEQ ID NO: 9075717 - DNA, 22 bp, Homo sapiens
tgagaggtaggaaatgaacaag

SEQ ID NO: 9075718 - DNA, 22 bp, Homo sapiens
tgagagggcccagagcacacca

SEQ ID NO: 9075719 - DNA, 22 bp, Homo sapiens
tgagaggctagatcagctctgt

SEQ ID NO: 9075720 - DNA, 22 bp, Homo sapiens
tgagaggcgctcactctcaggt

SEQ ID NO: 9075721 - DNA, 22 bp, Homo sapiens
tgagaggcgctcactctcaggt

SEQ ID NO: 9075722 - DNA, 22 bp, Homo sapiens
tgagaggcagaatggtgcctgc

SEQ ID NO: 9075723 - DNA, 22 bp, Homo sapiens
tgagagacacactgtgcatgta

SEQ ID NO: 9075724 - DNA, 22 bp, Homo sapiens
tgagagagcctgaatctcttac

SEQ ID NO: 9075725 - DNA, 22 bp, Homo sapiens
tgagagaggggactgcctgctt

SEQ ID NO: 9075726 - DNA, 22 bp, Homo sapiens
tgagagaggggactgcctgctt

SEQ ID NO: 9075727 - DNA, 22 bp, Homo sapiens
tgagagcagaggtgggcagcct

SEQ ID NO: 9075728 - DNA, 22 bp, Homo sapiens
tgagagcacacagaaatatttt

SEQ ID NO: 9075729 - DNA, 18 bp, Homo sapiens
tgagagcattcgaggcaa

SEQ ID NO: 9075730 - DNA, 22 bp, Homo sapiens
tgagagattgctgtatgttttg

SEQ ID NO: 9075731 - DNA, 22 bp, Homo sapiens
tgagagattttcatgagtgctt

SEQ ID NO: 9075732 - DNA, 22 bp, Homo sapiens
tgagaaaattactataattgtc

SEQ ID NO: 9075733 - DNA, 22 bp, Homo sapiens
tgagaaagacagacattcctaa

SEQ ID NO: 9075734 - DNA, 22 bp, Homo sapiens
tgagaaagacagacattcctaa

SEQ ID NO: 9075735 - DNA, 22 bp, Homo sapiens
tgagaaaggtatttcatgcact

SEQ ID NO: 9075736 - DNA, 22 bp, Homo sapiens
tgagaaaattactataattgtc

SEQ ID NO: 9075737 - DNA, 22 bp, Homo sapiens
tgagaaaggtatttcatgcact

SEQ ID NO: 9075738 - DNA, 20 bp, Homo sapiens
tgagaaagtagagactcagg

SEQ ID NO: 9075739 - DNA, 20 bp, Homo sapiens
tgagaaagtagagactcagg

SEQ ID NO: 9075740 - DNA, 22 bp, Homo sapiens
tgagaaagtgggtgcctagcaa

SEQ ID NO: 9075741 - DNA, 22 bp, Homo sapiens
tgagaaatattgcacagtgagg

SEQ ID NO: 9075742 - DNA, 22 bp, Homo sapiens
tgagaaattcgacatatattta

SEQ ID NO: 9075743 - DNA, 19 bp, Homo sapiens
tgagaaattccacaggatg

SEQ ID NO: 9075744 - DNA, 22 bp, Homo sapiens
tgagaaccatgaaaagctgtca

SEQ ID NO: 9075745 - DNA, 22 bp, Homo sapiens
tgagaactggtagcacttgtga

SEQ ID NO: 9075746 - DNA, 22 bp, Homo sapiens
tgagaactggtttctattcatg

SEQ ID NO: 9075747 - DNA, 19 bp, Homo sapiens
tgagaacttttacttatgc

SEQ ID NO: 9075748 - DNA, 23 bp, Homo sapiens
tgagaaattttgattcagtagga

SEQ ID NO: 9075749 - DNA, 22 bp, Homo sapiens
tgagaacattgggaaagctatg

SEQ ID NO: 9075750 - DNA, 22 bp, Homo sapiens
tgagaacatacaaacagagaaa

SEQ ID NO: 9075751 - DNA, 22 bp, Homo sapiens
tgagaagcccacactctttcct

SEQ ID NO: 9075752 - DNA, 23 bp, Homo sapiens
tgagaagccattagagcaggtgg

SEQ ID NO: 9075753 - DNA, 23 bp, Homo sapiens
tgagaagccaggggagcgtgagg

SEQ ID NO: 9075754 - DNA, 22 bp, Homo sapiens
tgagaagattgggcagagtgga

SEQ ID NO: 9075755 - DNA, 22 bp, Homo sapiens
tgagaagagcaaggaactggtt

SEQ ID NO: 9075756 - DNA, 22 bp, Homo sapiens
tgagaagagcaaggaactggtt

SEQ ID NO: 9075757 - DNA, 22 bp, Homo sapiens
tgagaagcagcttacaggtgtc

SEQ ID NO: 9075758 - DNA, 22 bp, Homo sapiens
tgagaattttttgtcatgcatt

SEQ ID NO: 9075759 - DNA, 20 bp, Homo sapiens
tgagaagctcctgtctcctc

SEQ ID NO: 9075760 - DNA, 22 bp, Homo sapiens
tgagaagctctgaaacagtatc

SEQ ID NO: 9075761 - DNA, 22 bp, Homo sapiens
tgagaatgccataagagctatt

SEQ ID NO: 9075762 - DNA, 22 bp, Homo sapiens
tgagaatgccataagagctatt

SEQ ID NO: 9075763 - DNA, 22 bp, Homo sapiens
tgagaatgtgcaatatccttcc

SEQ ID NO: 9075764 - DNA, 19 bp, Homo sapiens
tgagacagaagatgagcct

SEQ ID NO: 9075765 - DNA, 19 bp, Homo sapiens
tgagacagaagatgagcct

SEQ ID NO: 9075766 - DNA, 19 bp, Homo sapiens
tgagacagaagatgagcct

SEQ ID NO: 9075767 - DNA, 19 bp, Homo sapiens
tgagacagagaccagttct

SEQ ID NO: 9075768 - DNA, 22 bp, Homo sapiens
tgagacagcagattagcaatga

SEQ ID NO: 9075769 - DNA, 22 bp, Homo sapiens
tgagacagcagtcagggaaata

SEQ ID NO: 9075770 - DNA, 22 bp, Homo sapiens
tgagacagcagattagcaatga

SEQ ID NO: 9075771 - DNA, 23 bp, Homo sapiens
tgagacactcattcatggagtat

SEQ ID NO: 9075772 - DNA, 22 bp, Homo sapiens
tgagacagcccttctgcacagg

SEQ ID NO: 9075773 - DNA, 22 bp, Homo sapiens
tgagacagcccttctgcacagg

SEQ ID NO: 9075774 - DNA, 22 bp, Homo sapiens
tgagacagcagtcagggaaata

SEQ ID NO: 9075775 - DNA, 22 bp, Homo sapiens
tgagacagcagtcagggaaata

SEQ ID NO: 9075776 - DNA, 22 bp, Homo sapiens
tgagacagcccttctgcacagg

SEQ ID NO: 9075777 - DNA, 22 bp, Homo sapiens
tgagacagcctctgcactcatg

SEQ ID NO: 9075778 - DNA, 22 bp, Homo sapiens
tgagacagcctctgcactcatg

SEQ ID NO: 9075779 - DNA, 22 bp, Homo sapiens
tgagacaggagaggcccctcct

SEQ ID NO: 9075780 - DNA, 18 bp, Homo sapiens
tgagacagctaccacttg

SEQ ID NO: 9075781 - DNA, 17 bp, Homo sapiens
tgagacagggcaggccc

SEQ ID NO: 9075782 - DNA, 19 bp, Homo sapiens
tgagacagggattcaggtg

SEQ ID NO: 9075783 - DNA, 22 bp, Homo sapiens
tgagacaggcttccttcttggg

SEQ ID NO: 9075784 - DNA, 22 bp, Homo sapiens
tgagacagggtcttgctctgtt

SEQ ID NO: 9075785 - DNA, 22 bp, Homo sapiens
tgagacagtaattgtatagttt

SEQ ID NO: 9075786 - DNA, 17 bp, Homo sapiens
tgagacagggcaggccc

SEQ ID NO: 9075787 - DNA, 22 bp, Homo sapiens
tgagacagggtcttgctctgtt

SEQ ID NO: 9075788 - DNA, 17 bp, Homo sapiens
tgagacagggcaggccc

SEQ ID NO: 9075789 - DNA, 22 bp, Homo sapiens
tgagacagtcccatgatctgca

SEQ ID NO: 9075790 - DNA, 22 bp, Homo sapiens
tgagacagttctgcagctgggt

SEQ ID NO: 9075791 - DNA, 22 bp, Homo sapiens
tgagacagttctgcagctgggt

SEQ ID NO: 9075792 - DNA, 22 bp, Homo sapiens
tgagacagtcaccaggcaggcc

SEQ ID NO: 9075793 - DNA, 22 bp, Homo sapiens
tgagacagtaattgtatagttt

SEQ ID NO: 9075794 - DNA, 22 bp, Homo sapiens
tgagacagtaattgtatagttt

SEQ ID NO: 9075795 - DNA, 22 bp, Homo sapiens
tgagacagtatcgccccaaggc

SEQ ID NO: 9075796 - DNA, 22 bp, Homo sapiens
tgagacagtcaccaggcaggcc

SEQ ID NO: 9075797 - DNA, 22 bp, Homo sapiens
tgcacaaaggctccctgctgag

SEQ ID NO: 9075798 - DNA, 17 bp, Homo sapiens
tgcacaagagacaatag

SEQ ID NO: 9075799 - DNA, 22 bp, Homo sapiens
tgcacacaagttggagaatgaa

SEQ ID NO: 9075800 - DNA, 22 bp, Homo sapiens
tgcacacaaatgtgaacgtgcc

SEQ ID NO: 9075801 - DNA, 22 bp, Homo sapiens
tgcacaaagcattctagacgca

SEQ ID NO: 9075802 - DNA, 22 bp, Homo sapiens
tgcaattttaatacattagagg

SEQ ID NO: 9075803 - DNA, 22 bp, Homo sapiens
tgcaattttaatacattagagg

SEQ ID NO: 9075804 - DNA, 22 bp, Homo sapiens
tgcaatttttatcaattcagca

SEQ ID NO: 9075805 - DNA, 22 bp, Homo sapiens
tgcaatttttatcaattcagca

SEQ ID NO: 9075806 - DNA, 22 bp, Homo sapiens
tgcaattttcagaaattccaaa

SEQ ID NO: 9075807 - DNA, 22 bp, Homo sapiens
tgcaattttcagaaattccaaa

SEQ ID NO: 9075808 - DNA, 22 bp, Homo sapiens
tgcaatgtgttagatggtttta

SEQ ID NO: 9075809 - DNA, 20 bp, Homo sapiens
tgcaatgtccatgttccagg

SEQ ID NO: 9075810 - DNA, 22 bp, Homo sapiens
tgcaatttcaggcatatattgt

SEQ ID NO: 9075811 - DNA, 22 bp, Homo sapiens
tgcaatttgacgtcagcacagt

SEQ ID NO: 9075812 - DNA, 22 bp, Homo sapiens
tgcaatttcaaatatcagaaag

SEQ ID NO: 9075813 - DNA, 22 bp, Homo sapiens
tgcaatttcaaatatcagaaag

SEQ ID NO: 9075814 - DNA, 21 bp, Homo sapiens
tgcaatttagacttgaacatt

SEQ ID NO: 9075815 - DNA, 21 bp, Homo sapiens
tgcaatttagacttgaacatt

SEQ ID NO: 9075816 - DNA, 22 bp, Homo sapiens
tgcacacactcgtgtatatgag

SEQ ID NO: 9075817 - DNA, 22 bp, Homo sapiens
tgcacacactctgcatatactt

SEQ ID NO: 9075818 - DNA, 19 bp, Homo sapiens
tgcacacagataagtatct

SEQ ID NO: 9075819 - DNA, 22 bp, Homo sapiens
tgcacacagccagtgagtggca

SEQ ID NO: 9075820 - DNA, 22 bp, Homo sapiens
tgcacacagctgggcctggctg

SEQ ID NO: 9075821 - DNA, 22 bp, Homo sapiens
tgcacacagatggtacatgcat

SEQ ID NO: 9075822 - DNA, 22 bp, Homo sapiens
tgcacacagatggtacatgcat

SEQ ID NO: 9075823 - DNA, 22 bp, Homo sapiens
tgcacacagctgggcctggctg

SEQ ID NO: 9075824 - DNA, 22 bp, Homo sapiens
tgcacacaggtctaggacatgg

SEQ ID NO: 9075825 - DNA, 22 bp, Homo sapiens
tgcacacacatgaagtagcatg

SEQ ID NO: 9075826 - DNA, 22 bp, Homo sapiens
tgcacacacatgaagtagcatg

SEQ ID NO: 9075827 - DNA, 22 bp, Homo sapiens
tgcacacacatgaagtagcatg

SEQ ID NO: 9075828 - DNA, 22 bp, Homo sapiens
tgcacacacatgcagagggaga

SEQ ID NO: 9075829 - DNA, 22 bp, Homo sapiens
tgcacacacaggagtctcctcc

SEQ ID NO: 9075830 - DNA, 22 bp, Homo sapiens
tgcacacacatgaagtagcatg

SEQ ID NO: 9075831 - DNA, 22 bp, Homo sapiens
tgcacacacaggagtctcctcc

SEQ ID NO: 9075832 - DNA, 20 bp, Homo sapiens
tgcacacaccctgtcctcca

SEQ ID NO: 9075833 - DNA, 22 bp, Homo sapiens
tgcacacaccgtgcttcactga

SEQ ID NO: 9075834 - DNA, 22 bp, Homo sapiens
tgcacacacgcggcacatctgt

SEQ ID NO: 9075835 - DNA, 22 bp, Homo sapiens
tgcacacacggagataggcttt

SEQ ID NO: 9075836 - DNA, 22 bp, Homo sapiens
tgcaagcaagtttttgaagtgg

SEQ ID NO: 9075837 - DNA, 22 bp, Homo sapiens
tgcaagcactcaatgcaaacag

SEQ ID NO: 9075838 - DNA, 21 bp, Homo sapiens
tgcaagcctctgtgagattct

SEQ ID NO: 9075839 - DNA, 22 bp, Homo sapiens
tgcaaggctgcctctgaggacc

SEQ ID NO: 9075840 - DNA, 22 bp, Homo sapiens
tgcaagggtagaagtgatggca

SEQ ID NO: 9075841 - DNA, 21 bp, Homo sapiens
tgcaatccagcctgggcgaca

SEQ ID NO: 9075842 - DNA, 21 bp, Homo sapiens
tgcaatccagcctgggcgaca

SEQ ID NO: 9075843 - DNA, 21 bp, Homo sapiens
tgcaatccagcctgggcgaca

SEQ ID NO: 9075844 - DNA, 21 bp, Homo sapiens
tgcaatccagcctgggcgaca
